United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 242

SEQ ID NO: 10000137 - DNA, 22 bp, Homo sapiens
cctgagacatgaaccaggctcc

SEQ ID NO: 10000138 - DNA, 21 bp, Homo sapiens
cctgacctaatttgccatcag

SEQ ID NO: 10000139 - DNA, 22 bp, Homo sapiens
cctgaccagagtgagggcttag

SEQ ID NO: 10000140 - DNA, 22 bp, Homo sapiens
cctgaccacccttggacaaggt

SEQ ID NO: 10000141 - DNA, 19 bp, Homo sapiens
cctgaccacacaggccttg

SEQ ID NO: 10000142 - DNA, 22 bp, Homo sapiens
cctgaccatttgccacatgggt

SEQ ID NO: 10000143 - DNA, 22 bp, Homo sapiens
cctgacagtccttttctagtgt

SEQ ID NO: 10000144 - DNA, 22 bp, Homo sapiens
cctgagggcgccgagctcccag

SEQ ID NO: 10000145 - DNA, 22 bp, Homo sapiens
cctgaggcttaatctgtcccaa

SEQ ID NO: 10000146 - DNA, 22 bp, Homo sapiens
cctgaggcttaatctgtcccaa

SEQ ID NO: 10000147 - DNA, 22 bp, Homo sapiens
cctgaggcttaatctgtcccaa

SEQ ID NO: 10000148 - DNA, 22 bp, Homo sapiens
cctgaggctctcctgaataatg

SEQ ID NO: 10000149 - DNA, 22 bp, Homo sapiens
cctgaggctggcccttccatcc

SEQ ID NO: 10000150 - DNA, 22 bp, Homo sapiens
cctgaggctccacctccagaga

SEQ ID NO: 10000151 - DNA, 22 bp, Homo sapiens
cctgaggctcgcgcgcccctgg

SEQ ID NO: 10000152 - DNA, 22 bp, Homo sapiens
cctgaggccctggctgtgctga

SEQ ID NO: 10000153 - DNA, 22 bp, Homo sapiens
cctgagcttgatccttctgtct

SEQ ID NO: 10000154 - DNA, 22 bp, Homo sapiens
cctgaggccctggctgtgctga

SEQ ID NO: 10000155 - DNA, 22 bp, Homo sapiens
cctgaggccctggctgtgctga

SEQ ID NO: 10000156 - DNA, 22 bp, Homo sapiens
cctgaggctccacctccagaga

SEQ ID NO: 10000157 - DNA, 22 bp, Homo sapiens
cctgaggctccacctccagaga

SEQ ID NO: 10000158 - DNA, 22 bp, Homo sapiens
cctgccaggagctggtgctgca

SEQ ID NO: 10000159 - DNA, 22 bp, Homo sapiens
cctgcactacctggggctgctg

SEQ ID NO: 10000160 - DNA, 22 bp, Homo sapiens
cctgcacaggccaggcatctga

SEQ ID NO: 10000161 - DNA, 22 bp, Homo sapiens
tgggggagagaggcattctttc

SEQ ID NO: 10000162 - DNA, 21 bp, Homo sapiens
tgggggagaattggttgcttt

SEQ ID NO: 10000163 - DNA, 22 bp, Homo sapiens
tgggggtggttcttgcctccag

SEQ ID NO: 10000164 - DNA, 21 bp, Homo sapiens
cctgagggtggttgtgaagat

SEQ ID NO: 10000165 - DNA, 22 bp, Homo sapiens
tggggtacttgtatcaaagcac

SEQ ID NO: 10000166 - DNA, 22 bp, Homo sapiens
tgggggtgtcctggtgcacaca

SEQ ID NO: 10000167 - DNA, 22 bp, Homo sapiens
tggggtccagtgccaccccaag

SEQ ID NO: 10000168 - DNA, 22 bp, Homo sapiens
tggggtcccactcagctcccct

SEQ ID NO: 10000169 - DNA, 22 bp, Homo sapiens
tggggtccagtgcctggcaagg

SEQ ID NO: 10000170 - DNA, 22 bp, Homo sapiens
tggggtaggagtcagcgagaga

SEQ ID NO: 10000171 - DNA, 22 bp, Homo sapiens
tggggtagggaaaagaagtcga

SEQ ID NO: 10000172 - DNA, 22 bp, Homo sapiens
tggggtagggaaaagaagtcga

SEQ ID NO: 10000173 - DNA, 22 bp, Homo sapiens
tgggagcaggtgtgctagggaa

SEQ ID NO: 10000174 - DNA, 22 bp, Homo sapiens
tgggagcagttcaggtgtggct

SEQ ID NO: 10000175 - DNA, 23 bp, Homo sapiens
tgggagctcaagggaggctgccc

SEQ ID NO: 10000176 - DNA, 16 bp, Homo sapiens
cctctggcaattagat

SEQ ID NO: 10000177 - DNA, 22 bp, Homo sapiens
cctctggcaacttcacagccca

SEQ ID NO: 10000178 - DNA, 22 bp, Homo sapiens
cctctggccacatgggacatag

SEQ ID NO: 10000179 - DNA, 22 bp, Homo sapiens
cctctggcatagcaagtggcct

SEQ ID NO: 10000180 - DNA, 22 bp, Homo sapiens
cctctggcagccagccagttgt

SEQ ID NO: 10000181 - DNA, 22 bp, Homo sapiens
tgggagctcagaaagggaggtc

SEQ ID NO: 10000182 - DNA, 22 bp, Homo sapiens
cctctggcaacttcacagccca

SEQ ID NO: 10000183 - DNA, 22 bp, Homo sapiens
cctctggatctttctccacact

SEQ ID NO: 10000184 - DNA, 22 bp, Homo sapiens
cctccctgcgctcctgcggcgg

SEQ ID NO: 10000185 - DNA, 22 bp, Homo sapiens
cctccctgcgctcctgcggcgg

SEQ ID NO: 10000186 - DNA, 22 bp, Homo sapiens
tggctctcagctcccagcagcc

SEQ ID NO: 10000187 - DNA, 20 bp, Homo sapiens
tggctctcaccctgtgcgat

SEQ ID NO: 10000188 - DNA, 22 bp, Homo sapiens
tggctctcaggcctgctgcgtt

SEQ ID NO: 10000189 - DNA, 22 bp, Homo sapiens
tggctctccagagcctatggta

SEQ ID NO: 10000190 - DNA, 21 bp, Homo sapiens
tggctctgaaagagtgctgca

SEQ ID NO: 10000191 - DNA, 22 bp, Homo sapiens
tggctctctgggaggtcctggc

SEQ ID NO: 10000192 - DNA, 22 bp, Homo sapiens
tggctctctgggaggtcctggc

SEQ ID NO: 10000193 - DNA, 22 bp, Homo sapiens
tgggagcaggaagcaggaagta

SEQ ID NO: 10000194 - DNA, 21 bp, Homo sapiens
tgggagagcgttgctgtcctc

SEQ ID NO: 10000195 - DNA, 22 bp, Homo sapiens
tggctctgaccaggtagaggag

SEQ ID NO: 10000196 - DNA, 22 bp, Homo sapiens
tgggccagaggcatggagctat

SEQ ID NO: 10000197 - DNA, 21 bp, Homo sapiens
tgggccagatctgagtttcta

SEQ ID NO: 10000198 - DNA, 22 bp, Homo sapiens
tgggccagaagtatgcatgttt

SEQ ID NO: 10000199 - DNA, 22 bp, Homo sapiens
tgggccacttgaaagtggatgt

SEQ ID NO: 10000200 - DNA, 22 bp, Homo sapiens
tgggccagagagtaagaaaggt

SEQ ID NO: 10000201 - DNA, 22 bp, Homo sapiens
tgggccagagagtaagaaaggt

SEQ ID NO: 10000202 - DNA, 22 bp, Homo sapiens
cctctggcctaggccgggagag

SEQ ID NO: 10000203 - DNA, 22 bp, Homo sapiens
cctctggccatcccccattaag

SEQ ID NO: 10000204 - DNA, 22 bp, Homo sapiens
cctctggccattctttgatgga

SEQ ID NO: 10000205 - DNA, 22 bp, Homo sapiens
cctctggccacatgggacatag

SEQ ID NO: 10000206 - DNA, 22 bp, Homo sapiens
cctctggccacatgggacatag

SEQ ID NO: 10000207 - DNA, 22 bp, Homo sapiens
cctctggccagagaaaggccag

SEQ ID NO: 10000208 - DNA, 22 bp, Homo sapiens
tgggccacgtgacccttaccct

SEQ ID NO: 10000209 - DNA, 18 bp, Homo sapiens
cctgaagcctgtgtcttt

SEQ ID NO: 10000210 - DNA, 22 bp, Homo sapiens
cctgaagcaagggtaggcaggt

SEQ ID NO: 10000211 - DNA, 22 bp, Homo sapiens
cctctttgtgcctgcaggctgc

SEQ ID NO: 10000212 - DNA, 22 bp, Homo sapiens
cctcttctgagtgagactccct

SEQ ID NO: 10000213 - DNA, 22 bp, Homo sapiens
cctcttctgagtgagactccct

SEQ ID NO: 10000214 - DNA, 22 bp, Homo sapiens
cctcttctgagtgagactccct

SEQ ID NO: 10000215 - DNA, 22 bp, Homo sapiens
cctcttgccaatcagctacaga

SEQ ID NO: 10000216 - DNA, 22 bp, Homo sapiens
cctctttaatcccatccatgtg

SEQ ID NO: 10000217 - DNA, 22 bp, Homo sapiens
cctcttgattggttggaagcgg

SEQ ID NO: 10000218 - DNA, 22 bp, Homo sapiens
cctgctggacctcaacacattt

SEQ ID NO: 10000219 - DNA, 22 bp, Homo sapiens
cctgctggacctcaacacattt

SEQ ID NO: 10000220 - DNA, 22 bp, Homo sapiens
cctgctggacgtggaggagggg

SEQ ID NO: 10000221 - DNA, 22 bp, Homo sapiens
cctgctggacgtggaggagggg

SEQ ID NO: 10000222 - DNA, 22 bp, Homo sapiens
tggtctgttcaaggtggctgat

SEQ ID NO: 10000223 - DNA, 22 bp, Homo sapiens
cctgctcggggtgcagtgggct

SEQ ID NO: 10000224 - DNA, 17 bp, Homo sapiens
tggtctggaagaactga

SEQ ID NO: 10000225 - DNA, 22 bp, Homo sapiens
tggtctcttcttccaagatggc

SEQ ID NO: 10000226 - DNA, 22 bp, Homo sapiens
tggtctcttcttccaagatggc

SEQ ID NO: 10000227 - DNA, 23 bp, Homo sapiens
tggtctgaagcctcaggttcctc

SEQ ID NO: 10000228 - DNA, 22 bp, Homo sapiens
tggtctgcctggatcacagccc

SEQ ID NO: 10000229 - DNA, 22 bp, Homo sapiens
tggtctgattcttgctccccaa

SEQ ID NO: 10000230 - DNA, 22 bp, Homo sapiens
tggtctgataccggattccagt

SEQ ID NO: 10000231 - DNA, 22 bp, Homo sapiens
cctgctggcagagggggttact

SEQ ID NO: 10000232 - DNA, 22 bp, Homo sapiens
cctgctggccagtggagggctg

SEQ ID NO: 10000233 - DNA, 22 bp, Homo sapiens
cctgctggccagtggagggctg

SEQ ID NO: 10000234 - DNA, 22 bp, Homo sapiens
cctgctggcgcttgtctgggag

SEQ ID NO: 10000235 - DNA, 22 bp, Homo sapiens
cctgctggcggggacccagtga

SEQ ID NO: 10000236 - DNA, 22 bp, Homo sapiens
cctgctggctggtagagttccg

SEQ ID NO: 10000237 - DNA, 22 bp, Homo sapiens
cctgctggctggtagagttccg

SEQ ID NO: 10000238 - DNA, 22 bp, Homo sapiens
cctgctgggacgtgtggttgcc

SEQ ID NO: 10000239 - DNA, 22 bp, Homo sapiens
cctgctgggcctgagcaatgag

SEQ ID NO: 10000240 - DNA, 22 bp, Homo sapiens
cctgctgggcctgagcaatgag

SEQ ID NO: 10000241 - DNA, 22 bp, Homo sapiens
cctgctgtctctgggcaggcag

SEQ ID NO: 10000242 - DNA, 22 bp, Homo sapiens
cctgctgtgaaactggcatatg

SEQ ID NO: 10000243 - DNA, 22 bp, Homo sapiens
cctgctgtctctgggcaggcag

SEQ ID NO: 10000244 - DNA, 22 bp, Homo sapiens
cctgctgtgaagccaggcctgt

SEQ ID NO: 10000245 - DNA, 22 bp, Homo sapiens
cctgctgtgaccggggagcagg

SEQ ID NO: 10000246 - DNA, 22 bp, Homo sapiens
cctgctgtcagtggggcaggca

SEQ ID NO: 10000247 - DNA, 22 bp, Homo sapiens
cctgctgtcagcatcctcgcga

SEQ ID NO: 10000248 - DNA, 22 bp, Homo sapiens
cctgctgtcagtggggcaggca

SEQ ID NO: 10000249 - DNA, 22 bp, Homo sapiens
cctgctggtttttacaaagatg

SEQ ID NO: 10000250 - DNA, 22 bp, Homo sapiens
cctgctgtaatgtgtctttatt

SEQ ID NO: 10000251 - DNA, 22 bp, Homo sapiens
cctgctgtaatgtgtctttatt

SEQ ID NO: 10000252 - DNA, 22 bp, Homo sapiens
cctgcctgtaagatgggtacaa

SEQ ID NO: 10000253 - DNA, 22 bp, Homo sapiens
cctgcctgtactagagacccag

SEQ ID NO: 10000254 - DNA, 22 bp, Homo sapiens
cctgcctgtactagagacccag

SEQ ID NO: 10000255 - DNA, 22 bp, Homo sapiens
cctgcctgtcatcgcctgcgcc

SEQ ID NO: 10000256 - DNA, 22 bp, Homo sapiens
cctgcctgtctttatcccctgt

SEQ ID NO: 10000257 - DNA, 22 bp, Homo sapiens
cctgcctgtccctcagtccaca

SEQ ID NO: 10000258 - DNA, 22 bp, Homo sapiens
cctgcctgtccctcagtccaca

SEQ ID NO: 10000259 - DNA, 20 bp, Homo sapiens
cctgcctgtgtttgtgatga

SEQ ID NO: 10000260 - DNA, 23 bp, Homo sapiens
cctgcctgttctaactccatttc

SEQ ID NO: 10000261 - DNA, 22 bp, Homo sapiens
cctgcctggcttccagaagaga

SEQ ID NO: 10000262 - DNA, 20 bp, Homo sapiens
cctgcctgcctcggctcatt

SEQ ID NO: 10000263 - DNA, 22 bp, Homo sapiens
cctgcctgggctcacttgccag

SEQ ID NO: 10000264 - DNA, 22 bp, Homo sapiens
cctgcctgggctcacttgccag

SEQ ID NO: 10000265 - DNA, 22 bp, Homo sapiens
cctgcctggtgtaagtctaagg

SEQ ID NO: 10000266 - DNA, 22 bp, Homo sapiens
cctgcctggggacaaaggaggg

SEQ ID NO: 10000267 - DNA, 22 bp, Homo sapiens
tgggtcaggctgggagtcctga

SEQ ID NO: 10000268 - DNA, 22 bp, Homo sapiens
tgggtcagattgagcccctggt

SEQ ID NO: 10000269 - DNA, 22 bp, Homo sapiens
tgggtcaggctgggagtcctga

SEQ ID NO: 10000270 - DNA, 22 bp, Homo sapiens
cctgccagggccttggaagaaa

SEQ ID NO: 10000271 - DNA, 22 bp, Homo sapiens
cctgccagggccagaggccagc

SEQ ID NO: 10000272 - DNA, 22 bp, Homo sapiens
tgggtaggtgtggcctgaatgt

SEQ ID NO: 10000273 - DNA, 22 bp, Homo sapiens
tgggtaggggacgtggaagaaa

SEQ ID NO: 10000274 - DNA, 22 bp, Homo sapiens
tgggtaggggacgtggaagaaa

SEQ ID NO: 10000275 - DNA, 22 bp, Homo sapiens
tgggtaggggacgtggaagaaa

SEQ ID NO: 10000276 - DNA, 22 bp, Homo sapiens
tgggtcagagcagacctctgga

SEQ ID NO: 10000277 - DNA, 22 bp, Homo sapiens
tgggtcagagctgtgctgccca

SEQ ID NO: 10000278 - DNA, 22 bp, Homo sapiens
tgggtcagaggacctcgtggcc

SEQ ID NO: 10000279 - DNA, 22 bp, Homo sapiens
tgggtcagaatcagagagttgc

SEQ ID NO: 10000280 - DNA, 22 bp, Homo sapiens
tgggtcagacagccagtgggcc

SEQ ID NO: 10000281 - DNA, 22 bp, Homo sapiens
tgtaatgttagaaacaattgct

SEQ ID NO: 10000282 - DNA, 22 bp, Homo sapiens
tgtaatgttagaaacaattgct

SEQ ID NO: 10000283 - DNA, 22 bp, Homo sapiens
tgtaattatgttgttagagtat

SEQ ID NO: 10000284 - DNA, 22 bp, Homo sapiens
tgtacagttttaactctgaggg

SEQ ID NO: 10000285 - DNA, 23 bp, Homo sapiens
tgtacagttgtttgactcagctc

SEQ ID NO: 10000286 - DNA, 22 bp, Homo sapiens
tgtacagtgtagtcatgaggtt

SEQ ID NO: 10000287 - DNA, 22 bp, Homo sapiens
tgtaccaaaaatgtgtcagact

SEQ ID NO: 10000288 - DNA, 22 bp, Homo sapiens
tgtacattgtcactcatcaagt

SEQ ID NO: 10000289 - DNA, 22 bp, Homo sapiens
tgtacatgacagagagagccaa

SEQ ID NO: 10000290 - DNA, 22 bp, Homo sapiens
tgtacatttagagctcaataga

SEQ ID NO: 10000291 - DNA, 22 bp, Homo sapiens
tgtacatttagagctcaataga

SEQ ID NO: 10000292 - DNA, 22 bp, Homo sapiens
tgtacatttagagctcaataga

SEQ ID NO: 10000293 - DNA, 22 bp, Homo sapiens
tgtacattttctcagagtttat

SEQ ID NO: 10000294 - DNA, 22 bp, Homo sapiens
tgtacatacatagatatacaca

SEQ ID NO: 10000295 - DNA, 22 bp, Homo sapiens
tgtacatacatagatatacaca

SEQ ID NO: 10000296 - DNA, 22 bp, Homo sapiens
tgtacatacatagatatacaca

SEQ ID NO: 10000297 - DNA, 22 bp, Homo sapiens
tgtacatacatagatatacaca

SEQ ID NO: 10000298 - DNA, 19 bp, Homo sapiens
tgtacatatagagctcagt

SEQ ID NO: 10000299 - DNA, 22 bp, Homo sapiens
tgtacatattcaagcacttcta

SEQ ID NO: 10000300 - DNA, 22 bp, Homo sapiens
tgtacatagaaaggatacagct

SEQ ID NO: 10000301 - DNA, 19 bp, Homo sapiens
tgtacatatagagctcagt

SEQ ID NO: 10000302 - DNA, 22 bp, Homo sapiens
tgtaagtctggcttatagcttt

SEQ ID NO: 10000303 - DNA, 21 bp, Homo sapiens
tgtaagtttcatctgaattgg

SEQ ID NO: 10000304 - DNA, 21 bp, Homo sapiens
tgtaatctaaagaagctcttt

SEQ ID NO: 10000305 - DNA, 22 bp, Homo sapiens
tgtaatattgtagtgacagtac

SEQ ID NO: 10000306 - DNA, 22 bp, Homo sapiens
tgtaatatatataactgtgtgc

SEQ ID NO: 10000307 - DNA, 22 bp, Homo sapiens
cctgctgttttcttcacttcag

SEQ ID NO: 10000308 - DNA, 20 bp, Homo sapiens
cctgctgtttccatggggcc

SEQ ID NO: 10000309 - DNA, 20 bp, Homo sapiens
cctgctgtttccatggggcc

SEQ ID NO: 10000310 - DNA, 22 bp, Homo sapiens
cctgcttaacattgccatgaca

SEQ ID NO: 10000311 - DNA, 20 bp, Homo sapiens
cctgctgtgctttccatgga

SEQ ID NO: 10000312 - DNA, 20 bp, Homo sapiens
cctgctgtgctttccatgga

SEQ ID NO: 10000313 - DNA, 22 bp, Homo sapiens
cctgctgtgtccctggctttct

SEQ ID NO: 10000314 - DNA, 22 bp, Homo sapiens
cctgctgtgtccctggctttct

SEQ ID NO: 10000315 - DNA, 22 bp, Homo sapiens
cctgctgtgtgacgggatgtta

SEQ ID NO: 10000316 - DNA, 22 bp, Homo sapiens
cctgctgtgtgacgggatgtta

SEQ ID NO: 10000317 - DNA, 22 bp, Homo sapiens
cctgctgttagatttcagtcac

SEQ ID NO: 10000318 - DNA, 22 bp, Homo sapiens
tgtaaagagaagaaacgtgagc

SEQ ID NO: 10000319 - DNA, 22 bp, Homo sapiens
cctggaggcggaggttgcagtg

SEQ ID NO: 10000320 - DNA, 22 bp, Homo sapiens
cctggagggcgccgcacagtcc

SEQ ID NO: 10000321 - DNA, 22 bp, Homo sapiens
cctggagggaccctggccctgt

SEQ ID NO: 10000322 - DNA, 22 bp, Homo sapiens
cctggagggaccctggccctgt

SEQ ID NO: 10000323 - DNA, 22 bp, Homo sapiens
cctggagcttttccatcctgga

SEQ ID NO: 10000324 - DNA, 22 bp, Homo sapiens
cctggagcttggtcacgctgcg

SEQ ID NO: 10000325 - DNA, 23 bp, Homo sapiens
tgtcaagtatagcaggccctccc

SEQ ID NO: 10000326 - DNA, 22 bp, Homo sapiens
tgtcaataacatttacttctat

SEQ ID NO: 10000327 - DNA, 22 bp, Homo sapiens
tgtcaataactggagtcattat

SEQ ID NO: 10000328 - DNA, 22 bp, Homo sapiens
tgtcaacagatctcaaagctgg

SEQ ID NO: 10000329 - DNA, 22 bp, Homo sapiens
tgtcaaatagtagaaagatggc

SEQ ID NO: 10000330 - DNA, 22 bp, Homo sapiens
tgtcaacaaaacggttcaaatg

SEQ ID NO: 10000331 - DNA, 22 bp, Homo sapiens
cccgtgtggatgcgctggtgct

SEQ ID NO: 10000332 - DNA, 23 bp, Homo sapiens
ccctaactaattctagggcctaa

SEQ ID NO: 10000333 - DNA, 21 bp, Homo sapiens
ccctaactctaaaggatccat

SEQ ID NO: 10000334 - DNA, 20 bp, Homo sapiens
tggaagaagaactcaggctt

SEQ ID NO: 10000335 - DNA, 22 bp, Homo sapiens
ccctagaacacgcagacactga

SEQ ID NO: 10000336 - DNA, 22 bp, Homo sapiens
ccctagaaatgaaagcatacgt

SEQ ID NO: 10000337 - DNA, 22 bp, Homo sapiens
ccctagaacacgcagacactga

SEQ ID NO: 10000338 - DNA, 22 bp, Homo sapiens
tggaagaataggatagaagaac

SEQ ID NO: 10000339 - DNA, 22 bp, Homo sapiens
tggaagaataggatagaagaac

SEQ ID NO: 10000340 - DNA, 22 bp, Homo sapiens
tggaagaataggatagaagaac

SEQ ID NO: 10000341 - DNA, 22 bp, Homo sapiens
tggaagaataggatagaagaac

SEQ ID NO: 10000342 - DNA, 22 bp, Homo sapiens
tggaagaaggcagagaggcatt

SEQ ID NO: 10000343 - DNA, 22 bp, Homo sapiens
tggaagaagctacaagcggtga

SEQ ID NO: 10000344 - DNA, 22 bp, Homo sapiens
tggaagaaggcagagaggcatt

SEQ ID NO: 10000345 - DNA, 22 bp, Homo sapiens
tggaagaatgctccacagggaa

SEQ ID NO: 10000346 - DNA, 22 bp, Homo sapiens
tggaagacaatgtacatgcagt

SEQ ID NO: 10000347 - DNA, 22 bp, Homo sapiens
tggaagacactatttaccaggt

SEQ ID NO: 10000348 - DNA, 20 bp, Homo sapiens
tggaaggcatctgcattatt

SEQ ID NO: 10000349 - DNA, 21 bp, Homo sapiens
tggaaggctgctctgccaggg

SEQ ID NO: 10000350 - DNA, 22 bp, Homo sapiens
tggaagggaaagtttggggtcc

SEQ ID NO: 10000351 - DNA, 17 bp, Homo sapiens
tggaaggcttcaatatt

SEQ ID NO: 10000352 - DNA, 22 bp, Homo sapiens
tggaaggcttggaatacttcca

SEQ ID NO: 10000353 - DNA, 22 bp, Homo sapiens
tgctttattgcatcagtgtggg

SEQ ID NO: 10000354 - DNA, 22 bp, Homo sapiens
tgctttattgcatcagtgtggg

SEQ ID NO: 10000355 - DNA, 22 bp, Homo sapiens
tgctttattggaacctcatcct

SEQ ID NO: 10000356 - DNA, 22 bp, Homo sapiens
tgctttatttataaaatagcaa

SEQ ID NO: 10000357 - DNA, 22 bp, Homo sapiens
tgctttattttaaatatgccat

SEQ ID NO: 10000358 - DNA, 22 bp, Homo sapiens
tgctttatttataaaatagcaa

SEQ ID NO: 10000359 - DNA, 22 bp, Homo sapiens
tgctttcacttctctgcagcca

SEQ ID NO: 10000360 - DNA, 22 bp, Homo sapiens
tgcctgcctaggaagctgtgaa

SEQ ID NO: 10000361 - DNA, 22 bp, Homo sapiens
tgcctgcctcaggccgagtgct

SEQ ID NO: 10000362 - DNA, 18 bp, Homo sapiens
tgcctgccccgtaagggt

SEQ ID NO: 10000363 - DNA, 21 bp, Homo sapiens
tgcctgcctcctttggctagg

SEQ ID NO: 10000364 - DNA, 22 bp, Homo sapiens
tgcctgcgaggcatgggtgaga

SEQ ID NO: 10000365 - DNA, 22 bp, Homo sapiens
ccctgctgaatcccatggagtc

SEQ ID NO: 10000366 - DNA, 22 bp, Homo sapiens
ccctgctgaatcccatggagtc

SEQ ID NO: 10000367 - DNA, 22 bp, Homo sapiens
tggaggggcaatggagcgcgga

SEQ ID NO: 10000368 - DNA, 22 bp, Homo sapiens
ccctgctcttagtgcctgtgtg

SEQ ID NO: 10000369 - DNA, 22 bp, Homo sapiens
ccctgctcttctgactcaagct

SEQ ID NO: 10000370 - DNA, 23 bp, Homo sapiens
ccctgctcaggggtctgattctc

SEQ ID NO: 10000371 - DNA, 22 bp, Homo sapiens
ccctgccttcttggcctttaaa

SEQ ID NO: 10000372 - DNA, 22 bp, Homo sapiens
ccctgccttggggtccacaccg

SEQ ID NO: 10000373 - DNA, 22 bp, Homo sapiens
ccctgccttggggtccacaccg

SEQ ID NO: 10000374 - DNA, 22 bp, Homo sapiens
ccctgccttgtctgggctaggt

SEQ ID NO: 10000375 - DNA, 22 bp, Homo sapiens
ccctgccttgttggagcctatg

SEQ ID NO: 10000376 - DNA, 22 bp, Homo sapiens
ccctgctagaacctccaacatg

SEQ ID NO: 10000377 - DNA, 22 bp, Homo sapiens
tggaggtcgcgcgggtgctgca

SEQ ID NO: 10000378 - DNA, 19 bp, Homo sapiens
tggaggggtttgaatgtgg

SEQ ID NO: 10000379 - DNA, 22 bp, Homo sapiens
tggaggggcaatggagcgcgga

SEQ ID NO: 10000380 - DNA, 23 bp, Homo sapiens
ccctggagctagtctgagcgggg

SEQ ID NO: 10000381 - DNA, 22 bp, Homo sapiens
tggaggtgaaatgagattttgt

SEQ ID NO: 10000382 - DNA, 22 bp, Homo sapiens
tggaggtgagtgtggtacagca

SEQ ID NO: 10000383 - DNA, 22 bp, Homo sapiens
tggaggtgagtgtggtacagca

SEQ ID NO: 10000384 - DNA, 22 bp, Homo sapiens
tggaggtgagtgtggtacagca

SEQ ID NO: 10000385 - DNA, 20 bp, Homo sapiens
ccctgcagccatgggagtgg

SEQ ID NO: 10000386 - DNA, 20 bp, Homo sapiens
ccctgcagccatgggagtgg

SEQ ID NO: 10000387 - DNA, 22 bp, Homo sapiens
ccctgcagatctagggtccttc

SEQ ID NO: 10000388 - DNA, 22 bp, Homo sapiens
ccctgcagatctagggtccttc

SEQ ID NO: 10000389 - DNA, 22 bp, Homo sapiens
ccctgcagagggatgggggcag

SEQ ID NO: 10000390 - DNA, 22 bp, Homo sapiens
ccctgaggaccaggaaggaggg

SEQ ID NO: 10000391 - DNA, 22 bp, Homo sapiens
tggaagggaacaggtgggtgtt

SEQ ID NO: 10000392 - DNA, 22 bp, Homo sapiens
tggaagggaacaggtgggtgtt

SEQ ID NO: 10000393 - DNA, 22 bp, Homo sapiens
tggaagggaacaggtgggtgtt

SEQ ID NO: 10000394 - DNA, 22 bp, Homo sapiens
ccctgcagacgtcttgatgcct

SEQ ID NO: 10000395 - DNA, 23 bp, Homo sapiens
ccctgcactaagaggagaaggtg

SEQ ID NO: 10000396 - DNA, 23 bp, Homo sapiens
ccctgcagtcagggtgagatggt

SEQ ID NO: 10000397 - DNA, 22 bp, Homo sapiens
ccctgcctacagggttttcttt

SEQ ID NO: 10000398 - DNA, 22 bp, Homo sapiens
ccctgcctgtgggcatcaacat

SEQ ID NO: 10000399 - DNA, 22 bp, Homo sapiens
ccctgcctctgaagctgctcag

SEQ ID NO: 10000400 - DNA, 22 bp, Homo sapiens
ccctgcctctgaagctgctcag

SEQ ID NO: 10000401 - DNA, 22 bp, Homo sapiens
tggacagttactgagcttgagt

SEQ ID NO: 10000402 - DNA, 22 bp, Homo sapiens
tggcctcccctaacagcctctt

SEQ ID NO: 10000403 - DNA, 22 bp, Homo sapiens
tggcctcctcgggctgaccctg

SEQ ID NO: 10000404 - DNA, 22 bp, Homo sapiens
cctcagccttggccccaggcag

SEQ ID NO: 10000405 - DNA, 22 bp, Homo sapiens
cctcagccttggccccaggcag

SEQ ID NO: 10000406 - DNA, 22 bp, Homo sapiens
cctcagctcttccctgtgcaca

SEQ ID NO: 10000407 - DNA, 22 bp, Homo sapiens
cctcagctgcttccctggagcc

SEQ ID NO: 10000408 - DNA, 22 bp, Homo sapiens
cctcagctgctgcacagctttt

SEQ ID NO: 10000409 - DNA, 22 bp, Homo sapiens
tggctaacaaggtgaaaccccg

SEQ ID NO: 10000410 - DNA, 22 bp, Homo sapiens
tggctaacaaggtgaaaccccg

SEQ ID NO: 10000411 - DNA, 22 bp, Homo sapiens
tggcctggggacctgtgagacc

SEQ ID NO: 10000412 - DNA, 22 bp, Homo sapiens
cctcagctgcttccctggagcc

SEQ ID NO: 10000413 - DNA, 19 bp, Homo sapiens
cctcaccctgcagaggagg

SEQ ID NO: 10000414 - DNA, 22 bp, Homo sapiens
cctcactgaagaggtgacattt

SEQ ID NO: 10000415 - DNA, 22 bp, Homo sapiens
cctcactctgcaccctgcagca

SEQ ID NO: 10000416 - DNA, 22 bp, Homo sapiens
cctcagaagaagtggaattgat

SEQ ID NO: 10000417 - DNA, 22 bp, Homo sapiens
cctcactggccagccaggggtg

SEQ ID NO: 10000418 - DNA, 22 bp, Homo sapiens
cctcactgtcatcagtagttat

SEQ ID NO: 10000419 - DNA, 22 bp, Homo sapiens
cctcactgtcacttatagtggt

SEQ ID NO: 10000420 - DNA, 22 bp, Homo sapiens
cctcactggccagccaggggtg

SEQ ID NO: 10000421 - DNA, 22 bp, Homo sapiens
cctcactgctatgtgtttgctc

SEQ ID NO: 10000422 - DNA, 22 bp, Homo sapiens
tggccctgcttatgtctctctt

SEQ ID NO: 10000423 - DNA, 22 bp, Homo sapiens
cctcagaagctcaaggacattg

SEQ ID NO: 10000424 - DNA, 21 bp, Homo sapiens
tggccctggccacggctgcca

SEQ ID NO: 10000425 - DNA, 22 bp, Homo sapiens
tggcctcaatctgtcctccagc

SEQ ID NO: 10000426 - DNA, 22 bp, Homo sapiens
cctccctccattgccatcgtct

SEQ ID NO: 10000427 - DNA, 22 bp, Homo sapiens
cctcccagatgtgcccaatgga

SEQ ID NO: 10000428 - DNA, 22 bp, Homo sapiens
cctcccagatgtgcccaatgga

SEQ ID NO: 10000429 - DNA, 22 bp, Homo sapiens
tggctcagcggtggcagcagac

SEQ ID NO: 10000430 - DNA, 22 bp, Homo sapiens
tggctacagtggcatatcaaat

SEQ ID NO: 10000431 - DNA, 22 bp, Homo sapiens
tggctacatcacagagaattcc

SEQ ID NO: 10000432 - DNA, 22 bp, Homo sapiens
tggctaacagttaagatttcat

SEQ ID NO: 10000433 - DNA, 22 bp, Homo sapiens
tggctaacaaggtgaaaccccg

SEQ ID NO: 10000434 - DNA, 22 bp, Homo sapiens
tggctaagctggggaggcctgg

SEQ ID NO: 10000435 - DNA, 22 bp, Homo sapiens
tggctaatcttaaggcttttgc

SEQ ID NO: 10000436 - DNA, 22 bp, Homo sapiens
tggctagcaactcaactgttaa

SEQ ID NO: 10000437 - DNA, 22 bp, Homo sapiens
tggctcagcgcggcctggtctt

SEQ ID NO: 10000438 - DNA, 22 bp, Homo sapiens
tggctcagcgcggcctggtctt

SEQ ID NO: 10000439 - DNA, 22 bp, Homo sapiens
ccctttcattggcagagctctc

SEQ ID NO: 10000440 - DNA, 22 bp, Homo sapiens
ccctttccatggctctcctagg

SEQ ID NO: 10000441 - DNA, 22 bp, Homo sapiens
ccggctactcgggaggctgacg

SEQ ID NO: 10000442 - DNA, 22 bp, Homo sapiens
ccctgtgacgagcacggccagt

SEQ ID NO: 10000443 - DNA, 22 bp, Homo sapiens
ccctgtgacgagcacggccagt

SEQ ID NO: 10000444 - DNA, 20 bp, Homo sapiens
ccctgtgattggcaagtgtc

SEQ ID NO: 10000445 - DNA, 22 bp, Homo sapiens
ccctgtgatgtagctagagtag

SEQ ID NO: 10000446 - DNA, 22 bp, Homo sapiens
ccctgtgcattggagggtgttt

SEQ ID NO: 10000447 - DNA, 22 bp, Homo sapiens
ccctgtgcacacacttcactct

SEQ ID NO: 10000448 - DNA, 22 bp, Homo sapiens
ccctgtgcctcagtttcctcat

SEQ ID NO: 10000449 - DNA, 22 bp, Homo sapiens
ccctgggttctggctgggctgc

SEQ ID NO: 10000450 - DNA, 22 bp, Homo sapiens
ccctggtggggccagacttgct

SEQ ID NO: 10000451 - DNA, 22 bp, Homo sapiens
ccctggtgccctgggtcagcct

SEQ ID NO: 10000452 - DNA, 22 bp, Homo sapiens
ccctggaggaaaatctgaggct

SEQ ID NO: 10000453 - DNA, 22 bp, Homo sapiens
ccctggagctgcttgcatgttg

SEQ ID NO: 10000454 - DNA, 22 bp, Homo sapiens
ccctggagctgcttgcatgttg

SEQ ID NO: 10000455 - DNA, 22 bp, Homo sapiens
ccctggtggtacggcactggca

SEQ ID NO: 10000456 - DNA, 22 bp, Homo sapiens
ccctgtcacaatggatgacatt

SEQ ID NO: 10000457 - DNA, 23 bp, Homo sapiens
ccctgtagcccaggacaggcttt

SEQ ID NO: 10000458 - DNA, 23 bp, Homo sapiens
ccctgtagcccaggacaggcttt

SEQ ID NO: 10000459 - DNA, 22 bp, Homo sapiens
ccctgtccttggctgtgaggct

SEQ ID NO: 10000460 - DNA, 22 bp, Homo sapiens
cctatttgtaggctgggccagt

SEQ ID NO: 10000461 - DNA, 22 bp, Homo sapiens
cctcacagagcccagatgtcta

SEQ ID NO: 10000462 - DNA, 22 bp, Homo sapiens
cctcacagagcccagatgtcta

SEQ ID NO: 10000463 - DNA, 22 bp, Homo sapiens
ccgtgtacataaagccctggta

SEQ ID NO: 10000464 - DNA, 23 bp, Homo sapiens
ccgtgtgtatactctgtaataga

SEQ ID NO: 10000465 - DNA, 22 bp, Homo sapiens
ccgtgtgtatggtggaactgct

SEQ ID NO: 10000466 - DNA, 22 bp, Homo sapiens
cctaaacagaacaaagaggcag

SEQ ID NO: 10000467 - DNA, 22 bp, Homo sapiens
cctcacagcccttggcccagga

SEQ ID NO: 10000468 - DNA, 22 bp, Homo sapiens
cctcacagcccttggcccagga

SEQ ID NO: 10000469 - DNA, 22 bp, Homo sapiens
cctcacagccctcctctagcac

SEQ ID NO: 10000470 - DNA, 22 bp, Homo sapiens
cctcacagaggggcagccatct

SEQ ID NO: 10000471 - DNA, 22 bp, Homo sapiens
cctcacagaggggcagccatct

SEQ ID NO: 10000472 - DNA, 22 bp, Homo sapiens
cctcacagcaaggatttcagtg

SEQ ID NO: 10000473 - DNA, 22 bp, Homo sapiens
cctcacagcctcatgcccagcc

SEQ ID NO: 10000474 - DNA, 22 bp, Homo sapiens
cctcacagcttgggcaaacggc

SEQ ID NO: 10000475 - DNA, 22 bp, Homo sapiens
cctcacagcttttcaaagtgga

SEQ ID NO: 10000476 - DNA, 22 bp, Homo sapiens
cctcacagggccaggcccctca

SEQ ID NO: 10000477 - DNA, 20 bp, Homo sapiens
cctcacagggcagagagggg

SEQ ID NO: 10000478 - DNA, 17 bp, Homo sapiens
cctcacagggaccagac

SEQ ID NO: 10000479 - DNA, 22 bp, Homo sapiens
cctcacatgaatgtaagctcca

SEQ ID NO: 10000480 - DNA, 22 bp, Homo sapiens
cctcacagtgttcgtgtcagat

SEQ ID NO: 10000481 - DNA, 22 bp, Homo sapiens
cctcacagtcagttcttagtct

SEQ ID NO: 10000482 - DNA, 22 bp, Homo sapiens
cctcacagtttggctaactgtg

SEQ ID NO: 10000483 - DNA, 22 bp, Homo sapiens
ccgtgcttcttcagatgtgaat

SEQ ID NO: 10000484 - DNA, 22 bp, Homo sapiens
ccgtggagttgtgctgagtatg

SEQ ID NO: 10000485 - DNA, 22 bp, Homo sapiens
ccgtatgtctgggtttcttaat

SEQ ID NO: 10000486 - DNA, 22 bp, Homo sapiens
ccgtatgttcagatttgtcaat

SEQ ID NO: 10000487 - DNA, 22 bp, Homo sapiens
ccggtcccaggtgccccggtga

SEQ ID NO: 10000488 - DNA, 22 bp, Homo sapiens
ccgggggcgggacgagcttgac

SEQ ID NO: 10000489 - DNA, 22 bp, Homo sapiens
ccggctactcgggaggctgacg

SEQ ID NO: 10000490 - DNA, 22 bp, Homo sapiens
ccggctactcgggaggctgacg

SEQ ID NO: 10000491 - DNA, 22 bp, Homo sapiens
ccggctactcgggaggctgacg

SEQ ID NO: 10000492 - DNA, 22 bp, Homo sapiens
ccgggagcaggcgccaccgcca

SEQ ID NO: 10000493 - DNA, 22 bp, Homo sapiens
ccgggagcaggcgccaccgcca

SEQ ID NO: 10000494 - DNA, 22 bp, Homo sapiens
ccgggcctcgggacaccgggta

SEQ ID NO: 10000495 - DNA, 22 bp, Homo sapiens
ccgggcctcgggacaccgggta

SEQ ID NO: 10000496 - DNA, 22 bp, Homo sapiens
tttgaataatcactgggcatta

SEQ ID NO: 10000497 - DNA, 21 bp, Homo sapiens
tttgaatagaaatagtgctta

SEQ ID NO: 10000498 - DNA, 22 bp, Homo sapiens
tttgactcattgattttctctg

SEQ ID NO: 10000499 - DNA, 22 bp, Homo sapiens
tttgactcaagcctttctttag

SEQ ID NO: 10000500 - DNA, 22 bp, Homo sapiens
ctctgcagaggcccaaggctga

SEQ ID NO: 10000501 - DNA, 22 bp, Homo sapiens
ctctgcagaatttgagctgctc

SEQ ID NO: 10000502 - DNA, 22 bp, Homo sapiens
ctctgaggtttcctcacaagct

SEQ ID NO: 10000503 - DNA, 22 bp, Homo sapiens
ctctgatttccttattctgtca

SEQ ID NO: 10000504 - DNA, 22 bp, Homo sapiens
ctctgaggtctaggaccatggc

SEQ ID NO: 10000505 - DNA, 22 bp, Homo sapiens
ctctgaggtctaggaccatggc

SEQ ID NO: 10000506 - DNA, 22 bp, Homo sapiens
ctctgaggttcctttgccctcg

SEQ ID NO: 10000507 - DNA, 22 bp, Homo sapiens
tttgaaagagctgatacatgaa

SEQ ID NO: 10000508 - DNA, 19 bp, Homo sapiens
tttgaaagagttttattgg

SEQ ID NO: 10000509 - DNA, 22 bp, Homo sapiens
tttgaaaaaggcctttggtatg

SEQ ID NO: 10000510 - DNA, 22 bp, Homo sapiens
tttgaaaaaggcctttggtatg

SEQ ID NO: 10000511 - DNA, 22 bp, Homo sapiens
tttgaaaacttaatttggtcgt

SEQ ID NO: 10000512 - DNA, 22 bp, Homo sapiens
tttgaaaacttaatttggtcgt

SEQ ID NO: 10000513 - DNA, 22 bp, Homo sapiens
ctctgaagggagggccaagccc

SEQ ID NO: 10000514 - DNA, 22 bp, Homo sapiens
tttcttgccagagaaaaagagt

SEQ ID NO: 10000515 - DNA, 22 bp, Homo sapiens
ctctgaaggtttctgttactgt

SEQ ID NO: 10000516 - DNA, 22 bp, Homo sapiens
tttgaaacctagttatatgact

SEQ ID NO: 10000517 - DNA, 22 bp, Homo sapiens
tttgaaacccgtcactttgagt

SEQ ID NO: 10000518 - DNA, 22 bp, Homo sapiens
tttgaaacccgtcactttgagt

SEQ ID NO: 10000519 - DNA, 22 bp, Homo sapiens
tttgaaaattagacacaggcta

SEQ ID NO: 10000520 - DNA, 22 bp, Homo sapiens
tttgaaaagaaccatcgcctta

SEQ ID NO: 10000521 - DNA, 22 bp, Homo sapiens
tttgaaaatttaagtgctacac

SEQ ID NO: 10000522 - DNA, 22 bp, Homo sapiens
tttgaaactctgaacatgtttc

SEQ ID NO: 10000523 - DNA, 22 bp, Homo sapiens
tttgaaactcatgatcatcact

SEQ ID NO: 10000524 - DNA, 22 bp, Homo sapiens
tttgaaagacagaatatttttg

SEQ ID NO: 10000525 - DNA, 22 bp, Homo sapiens
tttgaaagaatttatgtacttt

SEQ ID NO: 10000526 - DNA, 22 bp, Homo sapiens
tttgcaaacacttaagaagaga

SEQ ID NO: 10000527 - DNA, 22 bp, Homo sapiens
tttgagaagagtttgaggtatt

SEQ ID NO: 10000528 - DNA, 22 bp, Homo sapiens
tttgagaaccctgtattttaag

SEQ ID NO: 10000529 - DNA, 22 bp, Homo sapiens
tttgagaactttggtattttcc

SEQ ID NO: 10000530 - DNA, 22 bp, Homo sapiens
tttgagaagatgtaatgttaag

SEQ ID NO: 10000531 - DNA, 22 bp, Homo sapiens
tttgagaagatgtaatgttaag

SEQ ID NO: 10000532 - DNA, 22 bp, Homo sapiens
tttgactcttgtctcttgttag

SEQ ID NO: 10000533 - DNA, 22 bp, Homo sapiens
tttgacttctgggcattttggt

SEQ ID NO: 10000534 - DNA, 22 bp, Homo sapiens
tttgactcctgtgtttctggaa

SEQ ID NO: 10000535 - DNA, 22 bp, Homo sapiens
tttgactcctgccttctcctgt

SEQ ID NO: 10000536 - DNA, 22 bp, Homo sapiens
tttgagaaacagacgaaagaca

SEQ ID NO: 10000537 - DNA, 22 bp, Homo sapiens
tttgagaaaaccagaaagatct

SEQ ID NO: 10000538 - DNA, 22 bp, Homo sapiens
tttgagaaactgattattatgg

SEQ ID NO: 10000539 - DNA, 22 bp, Homo sapiens
tttgagaaactgattattatgg

SEQ ID NO: 10000540 - DNA, 22 bp, Homo sapiens
tttgagaaaggggatttaattc

SEQ ID NO: 10000541 - DNA, 20 bp, Homo sapiens
ctctggcaaaggatgcctat

SEQ ID NO: 10000542 - DNA, 22 bp, Homo sapiens
ctctggcaatggatttttgagg

SEQ ID NO: 10000543 - DNA, 22 bp, Homo sapiens
ctctggcaattgctgctgactc

SEQ ID NO: 10000544 - DNA, 22 bp, Homo sapiens
ctctggcctggggcctgctccc

SEQ ID NO: 10000545 - DNA, 22 bp, Homo sapiens
ctctggcctgcttcctcaggta

SEQ ID NO: 10000546 - DNA, 22 bp, Homo sapiens
ctctggcctggggcctgctccc

SEQ ID NO: 10000547 - DNA, 22 bp, Homo sapiens
ctctggcctggggcctgctccc

SEQ ID NO: 10000548 - DNA, 19 bp, Homo sapiens
ctctggcctctggatgctg

SEQ ID NO: 10000549 - DNA, 22 bp, Homo sapiens
ctctggcctgcttcctcaggta

SEQ ID NO: 10000550 - DNA, 22 bp, Homo sapiens
ctctggcctgcagatccatgct

SEQ ID NO: 10000551 - DNA, 22 bp, Homo sapiens
ctctggcagagctgtagacttc

SEQ ID NO: 10000552 - DNA, 22 bp, Homo sapiens
ctctggcacactccttccaggt

SEQ ID NO: 10000553 - DNA, 22 bp, Homo sapiens
ctctggccgcagctcagctctg

SEQ ID NO: 10000554 - DNA, 22 bp, Homo sapiens
ctctggccgcagctcagctctg

SEQ ID NO: 10000555 - DNA, 22 bp, Homo sapiens
tttggaatgacagatatcaata

SEQ ID NO: 10000556 - DNA, 22 bp, Homo sapiens
tttggaatgcccatggactggt

SEQ ID NO: 10000557 - DNA, 22 bp, Homo sapiens
tttggaatggaatagagattgc

SEQ ID NO: 10000558 - DNA, 22 bp, Homo sapiens
tttggaatgaaacagcagagcc

SEQ ID NO: 10000559 - DNA, 22 bp, Homo sapiens
tttggaatcctcagtatgatca

SEQ ID NO: 10000560 - DNA, 22 bp, Homo sapiens
tttggaatagcatagaagctca

SEQ ID NO: 10000561 - DNA, 22 bp, Homo sapiens
tttggaatagcatagaagctca

SEQ ID NO: 10000562 - DNA, 22 bp, Homo sapiens
tttggaataatcagatcctagt

SEQ ID NO: 10000563 - DNA, 22 bp, Homo sapiens
ctctggctccatttccctatgt

SEQ ID NO: 10000564 - DNA, 22 bp, Homo sapiens
ctctggctccatttccctatgt

SEQ ID NO: 10000565 - DNA, 22 bp, Homo sapiens
ctctggctatctgtttctatgt

SEQ ID NO: 10000566 - DNA, 22 bp, Homo sapiens
tttggaagtaaatgagtgtttt

SEQ ID NO: 10000567 - DNA, 22 bp, Homo sapiens
ctctggctcccgcagcccccat

SEQ ID NO: 10000568 - DNA, 22 bp, Homo sapiens
tttggaagtaaatgagtgtttt

SEQ ID NO: 10000569 - DNA, 22 bp, Homo sapiens
tttggaatgttaggtgtctcat

SEQ ID NO: 10000570 - DNA, 22 bp, Homo sapiens
tttggaattacttactcaagcc

SEQ ID NO: 10000571 - DNA, 22 bp, Homo sapiens
tttggaattatgcttaaagttt

SEQ ID NO: 10000572 - DNA, 22 bp, Homo sapiens
tttggaatgtagtttaatcatc

SEQ ID NO: 10000573 - DNA, 22 bp, Homo sapiens
tttggaatggtaccttcagttg

SEQ ID NO: 10000574 - DNA, 22 bp, Homo sapiens
tttggaatggtaccttcagttg

SEQ ID NO: 10000575 - DNA, 22 bp, Homo sapiens
tttggaatggaatagagattgc

SEQ ID NO: 10000576 - DNA, 23 bp, Homo sapiens
ctctgggtccgatgtcctgacag

SEQ ID NO: 10000577 - DNA, 23 bp, Homo sapiens
ctctgggtccgatgtcctgacag

SEQ ID NO: 10000578 - DNA, 22 bp, Homo sapiens
ctctgggctgaatggctgaacc

SEQ ID NO: 10000579 - DNA, 22 bp, Homo sapiens
tttggaattctgcagctcatgt

SEQ ID NO: 10000580 - DNA, 22 bp, Homo sapiens
tttggaattctgcagctcatgt

SEQ ID NO: 10000581 - DNA, 22 bp, Homo sapiens
tttggaattccatttctgcatt

SEQ ID NO: 10000582 - DNA, 22 bp, Homo sapiens
tttggaattcagatggcttagg

SEQ ID NO: 10000583 - DNA, 22 bp, Homo sapiens
tttgttcagctctcattgatta

SEQ ID NO: 10000584 - DNA, 21 bp, Homo sapiens
tttgttcaggcaagttacagt

SEQ ID NO: 10000585 - DNA, 22 bp, Homo sapiens
tttgttcagctctcattgatta

SEQ ID NO: 10000586 - DNA, 22 bp, Homo sapiens
ctctgggtgttaatgtcagtgt

SEQ ID NO: 10000587 - DNA, 22 bp, Homo sapiens
ctctgggtgtgacagcacctgg

SEQ ID NO: 10000588 - DNA, 22 bp, Homo sapiens
tttgttcattaaaagtgctgta

SEQ ID NO: 10000589 - DNA, 22 bp, Homo sapiens
tttgttcattaaaagtgctgta

SEQ ID NO: 10000590 - DNA, 22 bp, Homo sapiens
tttgttcattagtacagttgta

SEQ ID NO: 10000591 - DNA, 23 bp, Homo sapiens
tttgttcatcattagagtctagc

SEQ ID NO: 10000592 - DNA, 17 bp, Homo sapiens
ctctgggtctcctgctt

SEQ ID NO: 10000593 - DNA, 22 bp, Homo sapiens
ctctgggtgagacagacctggt

SEQ ID NO: 10000594 - DNA, 22 bp, Homo sapiens
ctctgggtctccctgaggctaa

SEQ ID NO: 10000595 - DNA, 23 bp, Homo sapiens
ctctgggtccgatgtcctgacag

SEQ ID NO: 10000596 - DNA, 22 bp, Homo sapiens
ctctgggtgtcttaggagctca

SEQ ID NO: 10000597 - DNA, 22 bp, Homo sapiens
ctctgggtggtctcactgagtg

SEQ ID NO: 10000598 - DNA, 22 bp, Homo sapiens
ctctgggtgggcagcagatgga

SEQ ID NO: 10000599 - DNA, 22 bp, Homo sapiens
ctctgtgcttatgctccatggg

SEQ ID NO: 10000600 - DNA, 22 bp, Homo sapiens
ctctgtgcgggccatggtcagg

SEQ ID NO: 10000601 - DNA, 22 bp, Homo sapiens
ctctgtgctcccatgctagtaa

SEQ ID NO: 10000602 - DNA, 22 bp, Homo sapiens
ctctgtgcctcagttttcttct

SEQ ID NO: 10000603 - DNA, 22 bp, Homo sapiens
ctctgtgccctactgctcagct

SEQ ID NO: 10000604 - DNA, 22 bp, Homo sapiens
ctctgtgccagtctgcactcgg

SEQ ID NO: 10000605 - DNA, 17 bp, Homo sapiens
tttgttcgttagtccgg

SEQ ID NO: 10000606 - DNA, 22 bp, Homo sapiens
tttgttcgttcatgcacggtag

SEQ ID NO: 10000607 - DNA, 22 bp, Homo sapiens
tttgttctaacttctgcagaca

SEQ ID NO: 10000608 - DNA, 22 bp, Homo sapiens
tttgttctagatcgtgtttgtg

SEQ ID NO: 10000609 - DNA, 22 bp, Homo sapiens
tttgttctaacttctgcagaca

SEQ ID NO: 10000610 - DNA, 17 bp, Homo sapiens
tttgttcattgaagaga

SEQ ID NO: 10000611 - DNA, 22 bp, Homo sapiens
tttgttcattttgagctcatca

SEQ ID NO: 10000612 - DNA, 22 bp, Homo sapiens
tttgttcattttgagctcatca

SEQ ID NO: 10000613 - DNA, 22 bp, Homo sapiens
ttttgctgttatatgctattat

SEQ ID NO: 10000614 - DNA, 22 bp, Homo sapiens
ttttgctgtgtccttgagccgg

SEQ ID NO: 10000615 - DNA, 22 bp, Homo sapiens
ttttgctggtttatctctatta

SEQ ID NO: 10000616 - DNA, 22 bp, Homo sapiens
ttttgcttaatctagattttgc

SEQ ID NO: 10000617 - DNA, 22 bp, Homo sapiens
ttttgctggggtggctagctta

SEQ ID NO: 10000618 - DNA, 22 bp, Homo sapiens
ttttgctggggtggctagctta

SEQ ID NO: 10000619 - DNA, 22 bp, Homo sapiens
ttttgcctgagatccgagtctg

SEQ ID NO: 10000620 - DNA, 22 bp, Homo sapiens
ttttgcctgtgaatactatctt

SEQ ID NO: 10000621 - DNA, 22 bp, Homo sapiens
ttttgcctgcactgtatatata

SEQ ID NO: 10000622 - DNA, 21 bp, Homo sapiens
ctctgtgttgagggtgttgag

SEQ ID NO: 10000623 - DNA, 17 bp, Homo sapiens
ttttctctcttggattc

SEQ ID NO: 10000624 - DNA, 22 bp, Homo sapiens
ttttgcctagggttgacccgtt

SEQ ID NO: 10000625 - DNA, 22 bp, Homo sapiens
ttttgcctgagagtgaaaataa

SEQ ID NO: 10000626 - DNA, 22 bp, Homo sapiens
ttttctcttccctctggacctg

SEQ ID NO: 10000627 - DNA, 22 bp, Homo sapiens
ctctgtgttcagcctagcagaa

SEQ ID NO: 10000628 - DNA, 22 bp, Homo sapiens
ctctgtgtggtcctctgtattg

SEQ ID NO: 10000629 - DNA, 22 bp, Homo sapiens
ctctgtgtggtatgattgtcat

SEQ ID NO: 10000630 - DNA, 22 bp, Homo sapiens
ctctgtgtgctggtggggtcct

SEQ ID NO: 10000631 - DNA, 22 bp, Homo sapiens
ctctgtgttccgggttgctgct

SEQ ID NO: 10000632 - DNA, 22 bp, Homo sapiens
ctctgtgttaaattgggttttt

SEQ ID NO: 10000633 - DNA, 22 bp, Homo sapiens
ctctgtgttcagcctagcagaa

SEQ ID NO: 10000634 - DNA, 22 bp, Homo sapiens
ctctgtgtcagctgggtgtgca

SEQ ID NO: 10000635 - DNA, 22 bp, Homo sapiens
ctctgtggttagactatggctg

SEQ ID NO: 10000636 - DNA, 22 bp, Homo sapiens
ctctgtgtggtagattccatta

SEQ ID NO: 10000637 - DNA, 22 bp, Homo sapiens
ctctgtgtgctggtggggtcct

SEQ ID NO: 10000638 - DNA, 22 bp, Homo sapiens
ctctgtgtctgagttatggtct

SEQ ID NO: 10000639 - DNA, 22 bp, Homo sapiens
tttccacactgcagccagcaaa

SEQ ID NO: 10000640 - DNA, 22 bp, Homo sapiens
tttccacatcaccatgaggtga

SEQ ID NO: 10000641 - DNA, 22 bp, Homo sapiens
tttccacacaggctctactact

SEQ ID NO: 10000642 - DNA, 22 bp, Homo sapiens
tttccacactcactgcactcat

SEQ ID NO: 10000643 - DNA, 22 bp, Homo sapiens
tttccacaatttgagcagcaga

SEQ ID NO: 10000644 - DNA, 22 bp, Homo sapiens
tttccacaatttgagcagcaga

SEQ ID NO: 10000645 - DNA, 22 bp, Homo sapiens
tttccaatgtagatgtctctgg

SEQ ID NO: 10000646 - DNA, 22 bp, Homo sapiens
tttccaattcaagcttttacgt

SEQ ID NO: 10000647 - DNA, 22 bp, Homo sapiens
tttccaatttggtagtcatcgg

SEQ ID NO: 10000648 - DNA, 22 bp, Homo sapiens
tttccaatttggtagtcatcgg

SEQ ID NO: 10000649 - DNA, 22 bp, Homo sapiens
tttccacaatgtttttgcagga

SEQ ID NO: 10000650 - DNA, 22 bp, Homo sapiens
tttccacaatgtttttgcagga

SEQ ID NO: 10000651 - DNA, 22 bp, Homo sapiens
tttctacaacacttctgaatct

SEQ ID NO: 10000652 - DNA, 22 bp, Homo sapiens
tttctacaacacttctgaatct

SEQ ID NO: 10000653 - DNA, 22 bp, Homo sapiens
tttctacagctggtgcaacttt

SEQ ID NO: 10000654 - DNA, 22 bp, Homo sapiens
tttctacagctggtgcaacttt

SEQ ID NO: 10000655 - DNA, 22 bp, Homo sapiens
tttctacagaagatacactgct

SEQ ID NO: 10000656 - DNA, 22 bp, Homo sapiens
tttctacagaagatacactgct

SEQ ID NO: 10000657 - DNA, 22 bp, Homo sapiens
tttcatgttacatttaaaatgt

SEQ ID NO: 10000658 - DNA, 22 bp, Homo sapiens
tttcatgttagttggttcttgg

SEQ ID NO: 10000659 - DNA, 23 bp, Homo sapiens
tttcatgttggcatgactgactt

SEQ ID NO: 10000660 - DNA, 22 bp, Homo sapiens
tttcatgtttatggaaaatgag

SEQ ID NO: 10000661 - DNA, 22 bp, Homo sapiens
tttcatgttttcttaaatggca

SEQ ID NO: 10000662 - DNA, 22 bp, Homo sapiens
tttcattaaagtcaaatctggt

SEQ ID NO: 10000663 - DNA, 22 bp, Homo sapiens
tttcattacgtgtttgacttgt

SEQ ID NO: 10000664 - DNA, 22 bp, Homo sapiens
tttcattaaagtcaaatctggt

SEQ ID NO: 10000665 - DNA, 18 bp, Homo sapiens
tttcattataaagcaggc

SEQ ID NO: 10000666 - DNA, 18 bp, Homo sapiens
tttcattataaagcaggc

SEQ ID NO: 10000667 - DNA, 22 bp, Homo sapiens
tttcattataaaaagttggctt

SEQ ID NO: 10000668 - DNA, 22 bp, Homo sapiens
tttccaactgtaccccagtgtt

SEQ ID NO: 10000669 - DNA, 22 bp, Homo sapiens
tttccaagctgtcttggcccac

SEQ ID NO: 10000670 - DNA, 22 bp, Homo sapiens
tttccaataaggtcaccttcct

SEQ ID NO: 10000671 - DNA, 22 bp, Homo sapiens
ctctctttctgaatgaggacta

SEQ ID NO: 10000672 - DNA, 22 bp, Homo sapiens
ctctctttgatgtataaataat

SEQ ID NO: 10000673 - DNA, 22 bp, Homo sapiens
ctctctttctgaatgaggacta

SEQ ID NO: 10000674 - DNA, 22 bp, Homo sapiens
ctctctttctgaatgaggacta

SEQ ID NO: 10000675 - DNA, 18 bp, Homo sapiens
ctctctttccactctttg

SEQ ID NO: 10000676 - DNA, 18 bp, Homo sapiens
ctctctttccactctttg

SEQ ID NO: 10000677 - DNA, 22 bp, Homo sapiens
ctctctttgatgtataaataat

SEQ ID NO: 10000678 - DNA, 22 bp, Homo sapiens
ctctctttttcgtgtgccgaag

SEQ ID NO: 10000679 - DNA, 22 bp, Homo sapiens
ctctctttttcgtgtgccgaag

SEQ ID NO: 10000680 - DNA, 22 bp, Homo sapiens
ctctctttgatgtataaataat

SEQ ID NO: 10000681 - DNA, 22 bp, Homo sapiens
ctctgaaagagtttagtattat

SEQ ID NO: 10000682 - DNA, 22 bp, Homo sapiens
ctctgaaagttagagaaaatag

SEQ ID NO: 10000683 - DNA, 22 bp, Homo sapiens
ctctgaaagcaaaactagagaa

SEQ ID NO: 10000684 - DNA, 18 bp, Homo sapiens
ctctctttccactctttg

SEQ ID NO: 10000685 - DNA, 22 bp, Homo sapiens
ctctctttcattggtcgccttg

SEQ ID NO: 10000686 - DNA, 22 bp, Homo sapiens
ctctctttcattggtcgccttg

SEQ ID NO: 10000687 - DNA, 22 bp, Homo sapiens
ctctctttcattggtcgccttg

SEQ ID NO: 10000688 - DNA, 22 bp, Homo sapiens
ctctctgttatgctttcatgaa

SEQ ID NO: 10000689 - DNA, 22 bp, Homo sapiens
ctctctgtggtggctgtcccat

SEQ ID NO: 10000690 - DNA, 22 bp, Homo sapiens
ctctctgtggtggctgtcccat

SEQ ID NO: 10000691 - DNA, 22 bp, Homo sapiens
tttctcaaattgcatgagtagc

SEQ ID NO: 10000692 - DNA, 17 bp, Homo sapiens
tttctacagttggcagc

SEQ ID NO: 10000693 - DNA, 22 bp, Homo sapiens
tttctacatgtcaatccaaacc

SEQ ID NO: 10000694 - DNA, 22 bp, Homo sapiens
tttctacagtactgatttcata

SEQ ID NO: 10000695 - DNA, 22 bp, Homo sapiens
tttctacatgtcaatccaaacc

SEQ ID NO: 10000696 - DNA, 22 bp, Homo sapiens
tttctattttaaaggcatatgg

SEQ ID NO: 10000697 - DNA, 22 bp, Homo sapiens
tttctcaaggtgtcatgtattt

SEQ ID NO: 10000698 - DNA, 18 bp, Homo sapiens
ctctctggtctggatccc

SEQ ID NO: 10000699 - DNA, 18 bp, Homo sapiens
ctctctggtctggatccc

SEQ ID NO: 10000700 - DNA, 22 bp, Homo sapiens
tttattcactcattcagccagt

SEQ ID NO: 10000701 - DNA, 22 bp, Homo sapiens
tttattcactcattcagccagt

SEQ ID NO: 10000702 - DNA, 22 bp, Homo sapiens
tttatgtaagtggaatgatgcc

SEQ ID NO: 10000703 - DNA, 22 bp, Homo sapiens
tttatgtaagtggaatgatgcc

SEQ ID NO: 10000704 - DNA, 19 bp, Homo sapiens
tttattcacctttaccttg

SEQ ID NO: 10000705 - DNA, 22 bp, Homo sapiens
tttattcacttcagtgccaaag

SEQ ID NO: 10000706 - DNA, 22 bp, Homo sapiens
tttattcacttcagtgccaaag

SEQ ID NO: 10000707 - DNA, 22 bp, Homo sapiens
tttattcactggggtctgcccg

SEQ ID NO: 10000708 - DNA, 22 bp, Homo sapiens
tttatgctactcaatagtcagt

SEQ ID NO: 10000709 - DNA, 22 bp, Homo sapiens
tttatgctcatccaaggaaggt

SEQ ID NO: 10000710 - DNA, 22 bp, Homo sapiens
tttatgctcatccaaggaaggt

SEQ ID NO: 10000711 - DNA, 23 bp, Homo sapiens
tttatgcagcatgtagaacatgg

SEQ ID NO: 10000712 - DNA, 22 bp, Homo sapiens
tttatgcacacttagacatggc

SEQ ID NO: 10000713 - DNA, 22 bp, Homo sapiens
ctccaggactgaggacagagct

SEQ ID NO: 10000714 - DNA, 22 bp, Homo sapiens
ctccaggagggcttcctgtgat

SEQ ID NO: 10000715 - DNA, 22 bp, Homo sapiens
ctccaggagggggatggctgta

SEQ ID NO: 10000716 - DNA, 22 bp, Homo sapiens
ctccaggatacctgttcctata

SEQ ID NO: 10000717 - DNA, 22 bp, Homo sapiens
ctccaggagtggcctggacacc

SEQ ID NO: 10000718 - DNA, 22 bp, Homo sapiens
ctccaggatgttagacgtccag

SEQ ID NO: 10000719 - DNA, 22 bp, Homo sapiens
ctccaggatgttagacgtccag

SEQ ID NO: 10000720 - DNA, 19 bp, Homo sapiens
ctccaggatggctgggcga

SEQ ID NO: 10000721 - DNA, 19 bp, Homo sapiens
ctccaggatggctgggcga

SEQ ID NO: 10000722 - DNA, 22 bp, Homo sapiens
ctccaggcccctggccttctgc

SEQ ID NO: 10000723 - DNA, 22 bp, Homo sapiens
ctccaggcccacgtcgaggagg

SEQ ID NO: 10000724 - DNA, 22 bp, Homo sapiens
tttatgattaatccaattctgt

SEQ ID NO: 10000725 - DNA, 22 bp, Homo sapiens
ctccttcctgcagatctgagat

SEQ ID NO: 10000726 - DNA, 22 bp, Homo sapiens
ctccttcccctactcagcatcc

SEQ ID NO: 10000727 - DNA, 22 bp, Homo sapiens
ctccttcccatgagtgtgggca

SEQ ID NO: 10000728 - DNA, 23 bp, Homo sapiens
tttcagaagtggtcctaggaagc

SEQ ID NO: 10000729 - DNA, 22 bp, Homo sapiens
ctcctgttgcactagttcctga

SEQ ID NO: 10000730 - DNA, 22 bp, Homo sapiens
tttattcatcatctgttcatat

SEQ ID NO: 10000731 - DNA, 22 bp, Homo sapiens
tttattcatcatctgttcatat

SEQ ID NO: 10000732 - DNA, 22 bp, Homo sapiens
tttattcagcagcagcagtggt

SEQ ID NO: 10000733 - DNA, 20 bp, Homo sapiens
tttattcagcctaccctctt

SEQ ID NO: 10000734 - DNA, 22 bp, Homo sapiens
tttattcagcagcagcagtggt

SEQ ID NO: 10000735 - DNA, 22 bp, Homo sapiens
tttattcagcagcagcagtggt

SEQ ID NO: 10000736 - DNA, 22 bp, Homo sapiens
tttcacatataggggaagctac

SEQ ID NO: 10000737 - DNA, 22 bp, Homo sapiens
tttcacatataggggaagctac

SEQ ID NO: 10000738 - DNA, 22 bp, Homo sapiens
tttattccaaagcttgcacttt

SEQ ID NO: 10000739 - DNA, 22 bp, Homo sapiens
tttattcattgtttcgtcgcag

SEQ ID NO: 10000740 - DNA, 22 bp, Homo sapiens
tttattcattgtttcgtcgcag

SEQ ID NO: 10000741 - DNA, 22 bp, Homo sapiens
tttcagaaattatattagatgc

SEQ ID NO: 10000742 - DNA, 22 bp, Homo sapiens
tttcagaaatggcactgaaatc

SEQ ID NO: 10000743 - DNA, 22 bp, Homo sapiens
tttcagaagtcaactaggtaaa

SEQ ID NO: 10000744 - DNA, 22 bp, Homo sapiens
tttcagaaccaagagagacatc

SEQ ID NO: 10000745 - DNA, 22 bp, Homo sapiens
ctcttctgtacctcggcctcca

SEQ ID NO: 10000746 - DNA, 22 bp, Homo sapiens
ctgagcactgggcacatagctg

SEQ ID NO: 10000747 - DNA, 22 bp, Homo sapiens
ctcttcttatggccgtggctga

SEQ ID NO: 10000748 - DNA, 22 bp, Homo sapiens
ctcttctctgcagcctttgaag

SEQ ID NO: 10000749 - DNA, 22 bp, Homo sapiens
ctcttcctagtgtgcagcgtgg

SEQ ID NO: 10000750 - DNA, 22 bp, Homo sapiens
ctcttcctacagtctgctatgc

SEQ ID NO: 10000751 - DNA, 22 bp, Homo sapiens
ttttggaaccaacagtgcacct

SEQ ID NO: 10000752 - DNA, 22 bp, Homo sapiens
ttttgcttgagtgcacaaaatg

SEQ ID NO: 10000753 - DNA, 22 bp, Homo sapiens
ttttgcttgagtgcacaaaatg

SEQ ID NO: 10000754 - DNA, 22 bp, Homo sapiens
ttttgcttatctgagtgcagcc

SEQ ID NO: 10000755 - DNA, 19 bp, Homo sapiens
ttttggaaatgtgaacagc

SEQ ID NO: 10000756 - DNA, 19 bp, Homo sapiens
ttttggaaatgtgaacagc

SEQ ID NO: 10000757 - DNA, 22 bp, Homo sapiens
ttttgcttttgtaacacagtgt

SEQ ID NO: 10000758 - DNA, 22 bp, Homo sapiens
ttttgcttttgtaacacagtgt

SEQ ID NO: 10000759 - DNA, 22 bp, Homo sapiens
ctgagcagtgctttgcagtggg

SEQ ID NO: 10000760 - DNA, 22 bp, Homo sapiens
ctgagcagtgctttgcagtggg

SEQ ID NO: 10000761 - DNA, 22 bp, Homo sapiens
ctgagcagtctagccaggtgtt

SEQ ID NO: 10000762 - DNA, 22 bp, Homo sapiens
ctgagcagtctgactcaagcta

SEQ ID NO: 10000763 - DNA, 22 bp, Homo sapiens
ctgagcagtttcttagggctca

SEQ ID NO: 10000764 - DNA, 22 bp, Homo sapiens
ctgagcaggcggtggagcggct

SEQ ID NO: 10000765 - DNA, 22 bp, Homo sapiens
ctgagcagggaccaaaagcatt

SEQ ID NO: 10000766 - DNA, 22 bp, Homo sapiens
ctgagcaggatattcacagcag

SEQ ID NO: 10000767 - DNA, 22 bp, Homo sapiens
ctgagcagtctagccaggtgtt

SEQ ID NO: 10000768 - DNA, 22 bp, Homo sapiens
ctgagcagtctagccaggtgtt

SEQ ID NO: 10000769 - DNA, 22 bp, Homo sapiens
ctgagcagcgtggggagctggc

SEQ ID NO: 10000770 - DNA, 22 bp, Homo sapiens
ctgagcagcgtggggagctggc

SEQ ID NO: 10000771 - DNA, 22 bp, Homo sapiens
ctgagcaggacagtgggagacc

SEQ ID NO: 10000772 - DNA, 22 bp, Homo sapiens
ctgagcaggacagtgggagacc

SEQ ID NO: 10000773 - DNA, 22 bp, Homo sapiens
ctgagcaggatattcacagcag

SEQ ID NO: 10000774 - DNA, 22 bp, Homo sapiens
ctgagcagctgttacagagtgt

SEQ ID NO: 10000775 - DNA, 22 bp, Homo sapiens
ctgagcagctccctgagtggtc

SEQ ID NO: 10000776 - DNA, 22 bp, Homo sapiens
ctgagcagctgttacagagtgt

SEQ ID NO: 10000777 - DNA, 22 bp, Homo sapiens
ctgagcagaagggtgcacgtgc

SEQ ID NO: 10000778 - DNA, 22 bp, Homo sapiens
ctgagcagaagggtgcacgtgc

SEQ ID NO: 10000779 - DNA, 22 bp, Homo sapiens
ctgagcagaccatggcagaggt

SEQ ID NO: 10000780 - DNA, 19 bp, Homo sapiens
ctgagcagcggcagcactt

SEQ ID NO: 10000781 - DNA, 19 bp, Homo sapiens
ctgagcagcggcagcactt

SEQ ID NO: 10000782 - DNA, 22 bp, Homo sapiens
ctgagcagaccatggcagaggt

SEQ ID NO: 10000783 - DNA, 19 bp, Homo sapiens
ctgagcagcggcagcactt

SEQ ID NO: 10000784 - DNA, 17 bp, Homo sapiens
ctgaggggagtgctgtg

SEQ ID NO: 10000785 - DNA, 17 bp, Homo sapiens
ctgaggggagtgctgtg

SEQ ID NO: 10000786 - DNA, 22 bp, Homo sapiens
ctgaggctggagtgcagtggtg

SEQ ID NO: 10000787 - DNA, 22 bp, Homo sapiens
ctgaggctggagtgcagtggtg

SEQ ID NO: 10000788 - DNA, 22 bp, Homo sapiens
ctgaggggaaaagtcaggatga

SEQ ID NO: 10000789 - DNA, 18 bp, Homo sapiens
ctgaggctggcaggagcc

SEQ ID NO: 10000790 - DNA, 22 bp, Homo sapiens
ctgaggctgcccagggccaggt

SEQ ID NO: 10000791 - DNA, 22 bp, Homo sapiens
ctgaggctgcccagggccaggt

SEQ ID NO: 10000792 - DNA, 22 bp, Homo sapiens
ctgaggctgagacaggtgaaat

SEQ ID NO: 10000793 - DNA, 22 bp, Homo sapiens
ctgaggctgagacaggtgaaat

SEQ ID NO: 10000794 - DNA, 22 bp, Homo sapiens
ctgaggctgcccagggccaggt

SEQ ID NO: 10000795 - DNA, 22 bp, Homo sapiens
ctgaggctctgggtgtcactgt

SEQ ID NO: 10000796 - DNA, 22 bp, Homo sapiens
ctgaggctgaagagggcctacg

SEQ ID NO: 10000797 - DNA, 22 bp, Homo sapiens
ctgaggctctgggtgtcactgt

SEQ ID NO: 10000798 - DNA, 22 bp, Homo sapiens
ctgaggctctgagaaagccaaa

SEQ ID NO: 10000799 - DNA, 22 bp, Homo sapiens
ctgaggctccctcgggtctgct

SEQ ID NO: 10000800 - DNA, 22 bp, Homo sapiens
ctgaggctccctcgggtctgct

SEQ ID NO: 10000801 - DNA, 22 bp, Homo sapiens
ctgaggctcagcgtgaggaaag

SEQ ID NO: 10000802 - DNA, 22 bp, Homo sapiens
ctgaggctagtataaagagcat

SEQ ID NO: 10000803 - DNA, 22 bp, Homo sapiens
ctgaggctaacctcgagagaca

SEQ ID NO: 10000804 - DNA, 22 bp, Homo sapiens
ctgaggctcaagggcaggtggg

SEQ ID NO: 10000805 - DNA, 22 bp, Homo sapiens
ctgaggctcaagggcaggtggg

SEQ ID NO: 10000806 - DNA, 22 bp, Homo sapiens
ctgaggcctgggggcgtggacg

SEQ ID NO: 10000807 - DNA, 22 bp, Homo sapiens
ctgaggcctggccccaccacag

SEQ ID NO: 10000808 - DNA, 22 bp, Homo sapiens
ctgaggcctggtgaggtggtga

SEQ ID NO: 10000809 - DNA, 22 bp, Homo sapiens
ctgaggcctgtgttggggcagt

SEQ ID NO: 10000810 - DNA, 22 bp, Homo sapiens
ctgaggccgtctgggtctgcag

SEQ ID NO: 10000811 - DNA, 22 bp, Homo sapiens
ctgaggccgtctgggtctgcag

SEQ ID NO: 10000812 - DNA, 22 bp, Homo sapiens
ctgagccaaaaagcagagcttg

SEQ ID NO: 10000813 - DNA, 22 bp, Homo sapiens
ctgaggccgttggtgggcctta

SEQ ID NO: 10000814 - DNA, 22 bp, Homo sapiens
ctgaggcctggccccaccacag

SEQ ID NO: 10000815 - DNA, 23 bp, Homo sapiens
ctgaggcctgctgcgttcaggtt

SEQ ID NO: 10000816 - DNA, 22 bp, Homo sapiens
ctgaggccgttggtgggcctta

SEQ ID NO: 10000817 - DNA, 22 bp, Homo sapiens
ctgagccaaaaagcagagcttg

SEQ ID NO: 10000818 - DNA, 22 bp, Homo sapiens
ctgagccaaaaagcagagcttg

SEQ ID NO: 10000819 - DNA, 22 bp, Homo sapiens
ctgcagctttggaaacctgttt

SEQ ID NO: 10000820 - DNA, 22 bp, Homo sapiens
ctgcagctttcgctccatcagc

SEQ ID NO: 10000821 - DNA, 22 bp, Homo sapiens
ctgcagcttatttgctgtgtga

SEQ ID NO: 10000822 - DNA, 22 bp, Homo sapiens
ctgcagcttatttgctgtgtga

SEQ ID NO: 10000823 - DNA, 22 bp, Homo sapiens
ctgcagctttcgctccatcagc

SEQ ID NO: 10000824 - DNA, 22 bp, Homo sapiens
ctgcagctttttgtgcttgtaa

SEQ ID NO: 10000825 - DNA, 22 bp, Homo sapiens
ctgcagctttttgtgcttgtaa

SEQ ID NO: 10000826 - DNA, 22 bp, Homo sapiens
ctgcagctttttgtgcttgtaa

SEQ ID NO: 10000827 - DNA, 22 bp, Homo sapiens
ctgcaggactgaaagatgaggt

SEQ ID NO: 10000828 - DNA, 22 bp, Homo sapiens
ctgcagctgggccagggccacc

SEQ ID NO: 10000829 - DNA, 22 bp, Homo sapiens
ctgcagcctcaacctcctgagc

SEQ ID NO: 10000830 - DNA, 22 bp, Homo sapiens
ctgcagcctaggtgcagctggg

SEQ ID NO: 10000831 - DNA, 22 bp, Homo sapiens
ctgcagctgggccagggccacc

SEQ ID NO: 10000832 - DNA, 22 bp, Homo sapiens
ctgcagctgtagaggacagtgg

SEQ ID NO: 10000833 - DNA, 22 bp, Homo sapiens
ctgcagctgtagaggacagtgg

SEQ ID NO: 10000834 - DNA, 22 bp, Homo sapiens
ctgcagctgtctctactgggca

SEQ ID NO: 10000835 - DNA, 22 bp, Homo sapiens
ctgcagctgtgagtgctggatg

SEQ ID NO: 10000836 - DNA, 22 bp, Homo sapiens
ctgcagctgtgagtgctggatg

SEQ ID NO: 10000837 - DNA, 22 bp, Homo sapiens
ctgcagcttaagggaggggttg

SEQ ID NO: 10000838 - DNA, 22 bp, Homo sapiens
ctgcagcttatttgctgtgtga

SEQ ID NO: 10000839 - DNA, 22 bp, Homo sapiens
ctgcagcttaaaggagttcaat

SEQ ID NO: 10000840 - DNA, 22 bp, Homo sapiens
ctgcagcttaaaggagttcaat

SEQ ID NO: 10000841 - DNA, 19 bp, Homo sapiens
ctgaggtgaggggcatcat

SEQ ID NO: 10000842 - DNA, 22 bp, Homo sapiens
ctgaggtgagcttccctgggct

SEQ ID NO: 10000843 - DNA, 22 bp, Homo sapiens
ctgaggtgagaggaggccatgt

SEQ ID NO: 10000844 - DNA, 22 bp, Homo sapiens
ctgaggtgctagggtccctgct

SEQ ID NO: 10000845 - DNA, 22 bp, Homo sapiens
ctgaggtgctatggaggatacg

SEQ ID NO: 10000846 - DNA, 22 bp, Homo sapiens
ctgaggtggaacagaggtgaag

SEQ ID NO: 10000847 - DNA, 22 bp, Homo sapiens
ctgaggtgctatggaggatacg

SEQ ID NO: 10000848 - DNA, 19 bp, Homo sapiens
ctgaggtgcagtaagaggc

SEQ ID NO: 10000849 - DNA, 19 bp, Homo sapiens
ctgaggtgcagtaagaggc

SEQ ID NO: 10000850 - DNA, 22 bp, Homo sapiens
ctgaggtgtttagtaggggcgg

SEQ ID NO: 10000851 - DNA, 22 bp, Homo sapiens
ctgaggtgtggtctgggagtat

SEQ ID NO: 10000852 - DNA, 22 bp, Homo sapiens
ctgaggtgttgatgacctatgc

SEQ ID NO: 10000853 - DNA, 22 bp, Homo sapiens
ctgaggtgtgaaatggtggcaa

SEQ ID NO: 10000854 - DNA, 22 bp, Homo sapiens
ctgaggtggcctctgccgggga

SEQ ID NO: 10000855 - DNA, 22 bp, Homo sapiens
ctgaggtggggcctgggcatca

SEQ ID NO: 10000856 - DNA, 22 bp, Homo sapiens
ctgaggtggaacagaggtgaag

SEQ ID NO: 10000857 - DNA, 20 bp, Homo sapiens
ctgcccagccactgagggat

SEQ ID NO: 10000858 - DNA, 20 bp, Homo sapiens
ctgcccagccactgagggat

SEQ ID NO: 10000859 - DNA, 22 bp, Homo sapiens
ctgcccacacctgagctgggcc

SEQ ID NO: 10000860 - DNA, 22 bp, Homo sapiens
ctgcccacactcatggggaagg

SEQ ID NO: 10000861 - DNA, 22 bp, Homo sapiens
ctgccatgttacctgcacaggt

SEQ ID NO: 10000862 - DNA, 22 bp, Homo sapiens
ctgcaggaggatcctgagagtg

SEQ ID NO: 10000863 - DNA, 22 bp, Homo sapiens
ctgcaggatttcatgggctgac

SEQ ID NO: 10000864 - DNA, 22 bp, Homo sapiens
ctgcccaggggagtgctgtcgg

SEQ ID NO: 10000865 - DNA, 22 bp, Homo sapiens
ctgcccccaggctgcatggctg

SEQ ID NO: 10000866 - DNA, 22 bp, Homo sapiens
ctgccccaggacctcttctgga

SEQ ID NO: 10000867 - DNA, 22 bp, Homo sapiens
ctgctgtctcactggtgtggtt

SEQ ID NO: 10000868 - DNA, 22 bp, Homo sapiens
ctgctgtcgccgagctgcatgc

SEQ ID NO: 10000869 - DNA, 22 bp, Homo sapiens
ctgctgtctttatttcactgct

SEQ ID NO: 10000870 - DNA, 23 bp, Homo sapiens
ctgctgtgaaacatggttttggt

SEQ ID NO: 10000871 - DNA, 22 bp, Homo sapiens
ctgctgtgagcactccagcctg

SEQ ID NO: 10000872 - DNA, 22 bp, Homo sapiens
ctgctgtgacagctgccgtgtt

SEQ ID NO: 10000873 - DNA, 22 bp, Homo sapiens
ctggaaagtgcttttctgagag

SEQ ID NO: 10000874 - DNA, 22 bp, Homo sapiens
ctggaaagtgcttttctgagag

SEQ ID NO: 10000875 - DNA, 22 bp, Homo sapiens
ctgctgtgagtggttcttgcct

SEQ ID NO: 10000876 - DNA, 22 bp, Homo sapiens
ctgctgtgagtttggaggtcta

SEQ ID NO: 10000877 - DNA, 22 bp, Homo sapiens
ctggaagagtcctaaacagata

SEQ ID NO: 10000878 - DNA, 22 bp, Homo sapiens
ctggaagaggggaaatgccatg

SEQ ID NO: 10000879 - DNA, 22 bp, Homo sapiens
ctggaagagtaatataaattag

SEQ ID NO: 10000880 - DNA, 22 bp, Homo sapiens
ctggaagaggacacacgaatca

SEQ ID NO: 10000881 - DNA, 22 bp, Homo sapiens
ctggaagagtgactttgcattt

SEQ ID NO: 10000882 - DNA, 20 bp, Homo sapiens
ctggaagcctttccagagca

SEQ ID NO: 10000883 - DNA, 22 bp, Homo sapiens
ctggaagcttgtttgccagtct

SEQ ID NO: 10000884 - DNA, 22 bp, Homo sapiens
ctggaaggagaaggaggctgtg

SEQ ID NO: 10000885 - DNA, 22 bp, Homo sapiens
ctggaaggagaaggaggctgtg

SEQ ID NO: 10000886 - DNA, 22 bp, Homo sapiens
ctggagaacagagctgtttaga

SEQ ID NO: 10000887 - DNA, 22 bp, Homo sapiens
ctggagagaccgaaagaggctg

SEQ ID NO: 10000888 - DNA, 22 bp, Homo sapiens
ctggagaactagttaaacacgt

SEQ ID NO: 10000889 - DNA, 22 bp, Homo sapiens
ctggagaaaatccatgtgtatg

SEQ ID NO: 10000890 - DNA, 22 bp, Homo sapiens
ctggaaggttcctcccagctcc

SEQ ID NO: 10000891 - DNA, 22 bp, Homo sapiens
ctggaaggttcctcccagctcc

SEQ ID NO: 10000892 - DNA, 22 bp, Homo sapiens
ctggaagggtcagagtgatgag

SEQ ID NO: 10000893 - DNA, 22 bp, Homo sapiens
ctggaaggctctgctgcctgtc

SEQ ID NO: 10000894 - DNA, 22 bp, Homo sapiens
ctggaaggcggaggttgtagtg

SEQ ID NO: 10000895 - DNA, 19 bp, Homo sapiens
ctggaaggagggactgttc

SEQ ID NO: 10000896 - DNA, 22 bp, Homo sapiens
ctggaaggcagaggttgcagtg

SEQ ID NO: 10000897 - DNA, 19 bp, Homo sapiens
ctggaaggagggactgttc

SEQ ID NO: 10000898 - DNA, 22 bp, Homo sapiens
ctggagagggagccctggcagt

SEQ ID NO: 10000899 - DNA, 22 bp, Homo sapiens
ctggagaggctgggaacaggtt

SEQ ID NO: 10000900 - DNA, 22 bp, Homo sapiens
ctggagaggctgggaacaggtt

SEQ ID NO: 10000901 - DNA, 22 bp, Homo sapiens
ctggagagttggaagatggact

SEQ ID NO: 10000902 - DNA, 22 bp, Homo sapiens
ctggagatactgctctccatat

SEQ ID NO: 10000903 - DNA, 22 bp, Homo sapiens
ctggagcaaaagtgactcctct

SEQ ID NO: 10000904 - DNA, 22 bp, Homo sapiens
ctggagattaagttctcagcca

SEQ ID NO: 10000905 - DNA, 22 bp, Homo sapiens
ctggagagtaatctctgtgtta

SEQ ID NO: 10000906 - DNA, 22 bp, Homo sapiens
ctggagagttggaagatggact

SEQ ID NO: 10000907 - DNA, 22 bp, Homo sapiens
ctggagccccaggctgtgcaga

SEQ ID NO: 10000908 - DNA, 22 bp, Homo sapiens
ctggagccctgaatgggcagga

SEQ ID NO: 10000909 - DNA, 22 bp, Homo sapiens
ctggagccccaggctgtgcaga

SEQ ID NO: 10000910 - DNA, 22 bp, Homo sapiens
ctggagcaggcttgtcccagct

SEQ ID NO: 10000911 - DNA, 22 bp, Homo sapiens
ctggagcagcaggtggccaggg

SEQ ID NO: 10000912 - DNA, 22 bp, Homo sapiens
ctggagcagcaggtggccaggg

SEQ ID NO: 10000913 - DNA, 22 bp, Homo sapiens
ctggagcaggtttaggagtccc

SEQ ID NO: 10000914 - DNA, 22 bp, Homo sapiens
ctggagcaggtttaggagtccc

SEQ ID NO: 10000915 - DNA, 22 bp, Homo sapiens
ctggagcctaggttgacctggg

SEQ ID NO: 10000916 - DNA, 22 bp, Homo sapiens
ctggagccggaccagggacggt

SEQ ID NO: 10000917 - DNA, 22 bp, Homo sapiens
ctggagccggaccagggacggt

SEQ ID NO: 10000918 - DNA, 22 bp, Homo sapiens
ctgccttctttcaagggtaagc

SEQ ID NO: 10000919 - DNA, 22 bp, Homo sapiens
ctgccttccaaccccagactcc

SEQ ID NO: 10000920 - DNA, 22 bp, Homo sapiens
ctgccttccaaccccagactcc

SEQ ID NO: 10000921 - DNA, 22 bp, Homo sapiens
ctgcctgttcctgatcattcta

SEQ ID NO: 10000922 - DNA, 18 bp, Homo sapiens
ctgcctgttgctgagagg

SEQ ID NO: 10000923 - DNA, 18 bp, Homo sapiens
ctgcctgttgctgagagg

SEQ ID NO: 10000924 - DNA, 22 bp, Homo sapiens
ctgcctgttttctgatagattt

SEQ ID NO: 10000925 - DNA, 22 bp, Homo sapiens
ctgcctgtttcctcttgctccc

SEQ ID NO: 10000926 - DNA, 22 bp, Homo sapiens
ctgcctgtttcctcttgctccc

SEQ ID NO: 10000927 - DNA, 22 bp, Homo sapiens
ctgccttcatctctgagctggg

SEQ ID NO: 10000928 - DNA, 22 bp, Homo sapiens
ctgcctggggaatgtgaggatt

SEQ ID NO: 10000929 - DNA, 22 bp, Homo sapiens
ctgcctgtgccaccgcctcatt

SEQ ID NO: 10000930 - DNA, 22 bp, Homo sapiens
ctgcctggggcatcagtcaagg

SEQ ID NO: 10000931 - DNA, 22 bp, Homo sapiens
ctgcctgttagtctagcagtta

SEQ ID NO: 10000932 - DNA, 19 bp, Homo sapiens
ctgcctgttatggagagaa

SEQ ID NO: 10000933 - DNA, 22 bp, Homo sapiens
ctgcctgtgtgtgcctgcagaa

SEQ ID NO: 10000934 - DNA, 22 bp, Homo sapiens
ctgcctgtgtgtgcctgcagaa

SEQ ID NO: 10000935 - DNA, 22 bp, Homo sapiens
ctgccttgtcttgttttcaggg

SEQ ID NO: 10000936 - DNA, 22 bp, Homo sapiens
ctgcctttgcccttgacactgt

SEQ ID NO: 10000937 - DNA, 22 bp, Homo sapiens
ctgctctgtgcacttgttcagg

SEQ ID NO: 10000938 - DNA, 21 bp, Homo sapiens
ctgctctgacagtgaggccag

SEQ ID NO: 10000939 - DNA, 22 bp, Homo sapiens
ctgctctgaccctttcaccttc

SEQ ID NO: 10000940 - DNA, 22 bp, Homo sapiens
ctgctctgtttcttagctgggt

SEQ ID NO: 10000941 - DNA, 22 bp, Homo sapiens
ctgctctgtttcttagctgggt

SEQ ID NO: 10000942 - DNA, 22 bp, Homo sapiens
ctgctctgttcccccatcatct

SEQ ID NO: 10000943 - DNA, 22 bp, Homo sapiens
ctgctctgttcccccatcatct

SEQ ID NO: 10000944 - DNA, 22 bp, Homo sapiens
ctgctctgttcccccatcatct

SEQ ID NO: 10000945 - DNA, 22 bp, Homo sapiens
ctgctctgttcccccatcatct

SEQ ID NO: 10000946 - DNA, 22 bp, Homo sapiens
ctgctctgttcccccatcatct

SEQ ID NO: 10000947 - DNA, 22 bp, Homo sapiens
ctgctgtcccagcctcctcaca

SEQ ID NO: 10000948 - DNA, 22 bp, Homo sapiens
ctgctgtccaacctgcactcgc

SEQ ID NO: 10000949 - DNA, 22 bp, Homo sapiens
ctgctgtcatctggcgctgtgc

SEQ ID NO: 10000950 - DNA, 22 bp, Homo sapiens
ctgctgtcaaaggaaatatttg

SEQ ID NO: 10000951 - DNA, 22 bp, Homo sapiens
ctgctgtagagaagggttgtca

SEQ ID NO: 10000952 - DNA, 22 bp, Homo sapiens
ctgctgtagccactgggctcag

SEQ ID NO: 10000953 - DNA, 22 bp, Homo sapiens
ctgctgtaatgagtcagcatct

SEQ ID NO: 10000954 - DNA, 22 bp, Homo sapiens
ctgctggtgcagagtggggctg

SEQ ID NO: 10000955 - DNA, 22 bp, Homo sapiens
ctgctgggtctatgcaagtgga

SEQ ID NO: 10000956 - DNA, 19 bp, Homo sapiens
ctgctgggtgctgagggag

SEQ ID NO: 10000957 - DNA, 19 bp, Homo sapiens
ctgctgggtgctgagggag

SEQ ID NO: 10000958 - DNA, 19 bp, Homo sapiens
ctgctgggtgctgagggag

SEQ ID NO: 10000959 - DNA, 19 bp, Homo sapiens
ctgctgggtgctgagggag

SEQ ID NO: 10000960 - DNA, 22 bp, Homo sapiens
ctgctgggtctatgcaagtgga

SEQ ID NO: 10000961 - DNA, 22 bp, Homo sapiens
ctgctgggtctatgcaagtgga

SEQ ID NO: 10000962 - DNA, 22 bp, Homo sapiens
ctgctgagagctgaaggctgta

SEQ ID NO: 10000963 - DNA, 22 bp, Homo sapiens
ctgctgggaaggtctgctcagt

SEQ ID NO: 10000964 - DNA, 22 bp, Homo sapiens
ctgctgagcatcagggctgccc

SEQ ID NO: 10000965 - DNA, 22 bp, Homo sapiens
ctgctgggcagaggctgcatga

SEQ ID NO: 10000966 - DNA, 22 bp, Homo sapiens
ctgctgagaaaagactgaggga

SEQ ID NO: 10000967 - DNA, 22 bp, Homo sapiens
ctgctgagactggctttgtgtc

SEQ ID NO: 10000968 - DNA, 22 bp, Homo sapiens
ctgctgagactggctttgtgtc

SEQ ID NO: 10000969 - DNA, 22 bp, Homo sapiens
ctgctgactcttcctggagtga

SEQ ID NO: 10000970 - DNA, 22 bp, Homo sapiens
ctgctcttcccactcactccca

SEQ ID NO: 10000971 - DNA, 22 bp, Homo sapiens
ttgcagaaaacagttttcttgt

SEQ ID NO: 10000972 - DNA, 22 bp, Homo sapiens
ttgcagttgtctttcctaattt

SEQ ID NO: 10000973 - DNA, 22 bp, Homo sapiens
ttgcagttttctgcctcatttc

SEQ ID NO: 10000974 - DNA, 22 bp, Homo sapiens
ctcaggagtagttcagcagctg

SEQ ID NO: 10000975 - DNA, 22 bp, Homo sapiens
ctcaggagatgacagaaggtat

SEQ ID NO: 10000976 - DNA, 22 bp, Homo sapiens
ctcaggaggaggaagttcattg

SEQ ID NO: 10000977 - DNA, 22 bp, Homo sapiens
ctcaggaaccgcggcagcagcc

SEQ ID NO: 10000978 - DNA, 22 bp, Homo sapiens
ctcagcttctacctcctgagtg

SEQ ID NO: 10000979 - DNA, 22 bp, Homo sapiens
ctcagcttctacctcctgagtg

SEQ ID NO: 10000980 - DNA, 22 bp, Homo sapiens
ctcagccccaatttgccctctt

SEQ ID NO: 10000981 - DNA, 22 bp, Homo sapiens
ctcagccccaatttgccctctt

SEQ ID NO: 10000982 - DNA, 23 bp, Homo sapiens
ctcagaggcctgtccagggtggt

SEQ ID NO: 10000983 - DNA, 23 bp, Homo sapiens
ctcagaggcctgtccagggtggt

SEQ ID NO: 10000984 - DNA, 22 bp, Homo sapiens
ctcaggagacagtgtccacatg

SEQ ID NO: 10000985 - DNA, 22 bp, Homo sapiens
ctcaggagacagtgtccacatg

SEQ ID NO: 10000986 - DNA, 22 bp, Homo sapiens
ctcaggagagtcttatatctcc

SEQ ID NO: 10000987 - DNA, 22 bp, Homo sapiens
ctcaggagacagtgtccacatg

SEQ ID NO: 10000988 - DNA, 22 bp, Homo sapiens
ctcaggaaggaagcagggagcc

SEQ ID NO: 10000989 - DNA, 22 bp, Homo sapiens
ctcaggtcttagttctgtcatc

SEQ ID NO: 10000990 - DNA, 22 bp, Homo sapiens
ctcaggtcacaggatggccagg

SEQ ID NO: 10000991 - DNA, 22 bp, Homo sapiens
ctcagggcttgagtgtccagga

SEQ ID NO: 10000992 - DNA, 18 bp, Homo sapiens
ctcagggtgaccaatgca

SEQ ID NO: 10000993 - DNA, 18 bp, Homo sapiens
ctcagggtgaccaatgca

SEQ ID NO: 10000994 - DNA, 22 bp, Homo sapiens
ctcagggctggaaagccaggaa

SEQ ID NO: 10000995 - DNA, 22 bp, Homo sapiens
ctcagggcggcgggcagcccag

SEQ ID NO: 10000996 - DNA, 18 bp, Homo sapiens
ctcagggcatcagtctgg

SEQ ID NO: 10000997 - DNA, 22 bp, Homo sapiens
ctcagggatgggcagatgttaa

SEQ ID NO: 10000998 - DNA, 22 bp, Homo sapiens
ctcagggatgggcagatgttaa

SEQ ID NO: 10000999 - DNA, 23 bp, Homo sapiens
ctcagggatagaaaggaagacag

SEQ ID NO: 10001000 - DNA, 22 bp, Homo sapiens
ctcagggagtagcacatgtgga

SEQ ID NO: 10001001 - DNA, 22 bp, Homo sapiens
ttgcatcagaaaatatgggaag

SEQ ID NO: 10001002 - DNA, 22 bp, Homo sapiens
ttgcatcagcaggcataattgg

SEQ ID NO: 10001003 - DNA, 22 bp, Homo sapiens
ttgcatcaaatatgtaccacag

SEQ ID NO: 10001004 - DNA, 22 bp, Homo sapiens
ttgcatatgaagctgacttaaa

SEQ ID NO: 10001005 - DNA, 22 bp, Homo sapiens
ttgcatatcctccaacacatgg

SEQ ID NO: 10001006 - DNA, 22 bp, Homo sapiens
ttgcatatatttctaaggaggt

SEQ ID NO: 10001007 - DNA, 22 bp, Homo sapiens
ttgcatcaggtagacaactata

SEQ ID NO: 10001008 - DNA, 22 bp, Homo sapiens
ttgcatcagtcctcaataaaat

SEQ ID NO: 10001009 - DNA, 22 bp, Homo sapiens
ttgccctgcctccctgaggtga

SEQ ID NO: 10001010 - DNA, 22 bp, Homo sapiens
ttgccctgcagcggtgagtggt

SEQ ID NO: 10001011 - DNA, 22 bp, Homo sapiens
ttgccctgtcagtagaagtgca

SEQ ID NO: 10001012 - DNA, 22 bp, Homo sapiens
ctccaggaccagggctcctgga

SEQ ID NO: 10001013 - DNA, 22 bp, Homo sapiens
ctccaggacactaacccaggct

SEQ ID NO: 10001014 - DNA, 22 bp, Homo sapiens
ctccaggacagattcagggcca

SEQ ID NO: 10001015 - DNA, 22 bp, Homo sapiens
ctccagcctcatctcctggctg

SEQ ID NO: 10001016 - DNA, 22 bp, Homo sapiens
ttggctgacaaatggaatctct

SEQ ID NO: 10001017 - DNA, 22 bp, Homo sapiens
ctccagaggttctcatctggga

SEQ ID NO: 10001018 - DNA, 17 bp, Homo sapiens
ttggctctattgcctct

SEQ ID NO: 10001019 - DNA, 20 bp, Homo sapiens
ttggctctgatcagtggagc

SEQ ID NO: 10001020 - DNA, 22 bp, Homo sapiens
ctccagaggatgcaggtgaggg

SEQ ID NO: 10001021 - DNA, 22 bp, Homo sapiens
ctccagaggccctatcccacta

SEQ ID NO: 10001022 - DNA, 22 bp, Homo sapiens
ttggatcaaatttcatgctgtc

SEQ ID NO: 10001023 - DNA, 22 bp, Homo sapiens
ttggatacagatgaaaggaagg

SEQ ID NO: 10001024 - DNA, 22 bp, Homo sapiens
ttggagtcagatgactgtagga

SEQ ID NO: 10001025 - DNA, 22 bp, Homo sapiens
ttggatccatctcaggcatagg

SEQ ID NO: 10001026 - DNA, 22 bp, Homo sapiens
ttggatccatctcaggcatagg

SEQ ID NO: 10001027 - DNA, 22 bp, Homo sapiens
ttggatcatggaatgtctgctt

SEQ ID NO: 10001028 - DNA, 22 bp, Homo sapiens
ttggagggactgagcttcagtc

SEQ ID NO: 10001029 - DNA, 22 bp, Homo sapiens
ttggaggggccactgcagagct

SEQ ID NO: 10001030 - DNA, 22 bp, Homo sapiens
ttggagggtcttccacagccat

SEQ ID NO: 10001031 - DNA, 23 bp, Homo sapiens
ttggaagggaagagcatttgaga

SEQ ID NO: 10001032 - DNA, 22 bp, Homo sapiens
ttggaaggagcctaaaagagac

SEQ ID NO: 10001033 - DNA, 22 bp, Homo sapiens
ttggaaggatttagagatgtct

SEQ ID NO: 10001034 - DNA, 22 bp, Homo sapiens
ttggaaggccagcaccttgagt

SEQ ID NO: 10001035 - DNA, 22 bp, Homo sapiens
ttggaaggagtctttggggatg

SEQ ID NO: 10001036 - DNA, 22 bp, Homo sapiens
ttggaagcctagttaagatgaa

SEQ ID NO: 10001037 - DNA, 23 bp, Homo sapiens
ttggaagccagacagctgtgcag

SEQ ID NO: 10001038 - DNA, 22 bp, Homo sapiens
ttggaagccctctgcaagatcc

SEQ ID NO: 10001039 - DNA, 22 bp, Homo sapiens
ttggaagcagtgtacactgtac

SEQ ID NO: 10001040 - DNA, 22 bp, Homo sapiens
ttggaagattctgtgtctggtg

SEQ ID NO: 10001041 - DNA, 22 bp, Homo sapiens
ttggaagatctaacagaggcat

SEQ ID NO: 10001042 - DNA, 21 bp, Homo sapiens
ttggaagataatgcttatgat

SEQ ID NO: 10001043 - DNA, 22 bp, Homo sapiens
ttggaagattacttagttttct

SEQ ID NO: 10001044 - DNA, 22 bp, Homo sapiens
ttggaagattacttagttttct

SEQ ID NO: 10001045 - DNA, 22 bp, Homo sapiens
ctcagtgcttagtgtgttttgg

SEQ ID NO: 10001046 - DNA, 22 bp, Homo sapiens
ctcagtgcttctagcttgatga

SEQ ID NO: 10001047 - DNA, 22 bp, Homo sapiens
ctcagtgcaaccaaagtgatct

SEQ ID NO: 10001048 - DNA, 22 bp, Homo sapiens
ctcagtgctagaagtagattgc

SEQ ID NO: 10001049 - DNA, 22 bp, Homo sapiens
ctcagtgctgaggaaagttgaa

SEQ ID NO: 10001050 - DNA, 22 bp, Homo sapiens
ctcagtgctacggttaccatat

SEQ ID NO: 10001051 - DNA, 22 bp, Homo sapiens
ctcagtgcagctaggcatgaga

SEQ ID NO: 10001052 - DNA, 22 bp, Homo sapiens
ctataattatgctcaaaatgta

SEQ ID NO: 10001053 - DNA, 22 bp, Homo sapiens
ctatacactttttgaaaataga

SEQ ID NO: 10001054 - DNA, 22 bp, Homo sapiens
ctataactgggtattagactac

SEQ ID NO: 10001055 - DNA, 22 bp, Homo sapiens
ttctggctttaggcttttcaag

SEQ ID NO: 10001056 - DNA, 22 bp, Homo sapiens
ttctggcatgagagatgggggt

SEQ ID NO: 10001057 - DNA, 22 bp, Homo sapiens
ttctggcagattgcgtaataaa

SEQ ID NO: 10001058 - DNA, 22 bp, Homo sapiens
ctcacaggttctgcagctcaca

SEQ ID NO: 10001059 - DNA, 22 bp, Homo sapiens
ctcacaggttctgcagctcaca

SEQ ID NO: 10001060 - DNA, 22 bp, Homo sapiens
ctcacaggttctgcagctcaca

SEQ ID NO: 10001061 - DNA, 22 bp, Homo sapiens
ctatagaaacaacctctctttc

SEQ ID NO: 10001062 - DNA, 22 bp, Homo sapiens
ctatagaaaattgtatcacacg

SEQ ID NO: 10001063 - DNA, 22 bp, Homo sapiens
ctatacagtaaccacagtgatt

SEQ ID NO: 10001064 - DNA, 22 bp, Homo sapiens
ctatacagcagcttactagtta

SEQ ID NO: 10001065 - DNA, 22 bp, Homo sapiens
ctatacagcagcttactagtta

SEQ ID NO: 10001066 - DNA, 22 bp, Homo sapiens
ctatagaaaattgtatcacacg

SEQ ID NO: 10001067 - DNA, 22 bp, Homo sapiens
ctcacccctgtaattccagcac

SEQ ID NO: 10001068 - DNA, 22 bp, Homo sapiens
ctcactgcaacctccgcctcct

SEQ ID NO: 10001069 - DNA, 22 bp, Homo sapiens
ctcactgactgcaagtcaagtt

SEQ ID NO: 10001070 - DNA, 22 bp, Homo sapiens
ctcactgcaacctctgcctccc

SEQ ID NO: 10001071 - DNA, 22 bp, Homo sapiens
ctcactgcaagctcagcctccc

SEQ ID NO: 10001072 - DNA, 22 bp, Homo sapiens
ctcactgcaagctcagcctccc

SEQ ID NO: 10001073 - DNA, 22 bp, Homo sapiens
ctcagagagacaatgtgggaca

SEQ ID NO: 10001074 - DNA, 22 bp, Homo sapiens
ctcagagcaatgaacatgcaaa

SEQ ID NO: 10001075 - DNA, 22 bp, Homo sapiens
ctcagagcaatgaacatgcaaa

SEQ ID NO: 10001076 - DNA, 22 bp, Homo sapiens
ctcagagcacagtttatgacag

SEQ ID NO: 10001077 - DNA, 22 bp, Homo sapiens
ctcagagcacttttgaaagctc

SEQ ID NO: 10001078 - DNA, 22 bp, Homo sapiens
ctcagagcccagggtacacccg

SEQ ID NO: 10001079 - DNA, 22 bp, Homo sapiens
ctcagagctcagctttgttagt

SEQ ID NO: 10001080 - DNA, 22 bp, Homo sapiens
ctcagaggaggcagggtgtgcc

SEQ ID NO: 10001081 - DNA, 22 bp, Homo sapiens
ctcagaggcaagcaaggagctg

SEQ ID NO: 10001082 - DNA, 22 bp, Homo sapiens
ctcagagcccagggtacacccg

SEQ ID NO: 10001083 - DNA, 22 bp, Homo sapiens
ctcagagccagttagcaggtgc

SEQ ID NO: 10001084 - DNA, 17 bp, Homo sapiens
ctcagagcaggacagaa

SEQ ID NO: 10001085 - DNA, 21 bp, Homo sapiens
ctcagagcagttcagagggat

SEQ ID NO: 10001086 - DNA, 22 bp, Homo sapiens
ttctttctgtccataatgagac

SEQ ID NO: 10001087 - DNA, 22 bp, Homo sapiens
ttctttctgtcatggtgtactg

SEQ ID NO: 10001088 - DNA, 22 bp, Homo sapiens
ctcagaaagggttgctgagggc

SEQ ID NO: 10001089 - DNA, 22 bp, Homo sapiens
ttctttctgggaagagttcaga

SEQ ID NO: 10001090 - DNA, 22 bp, Homo sapiens
ctcactgcaagctcagcctccc

SEQ ID NO: 10001091 - DNA, 22 bp, Homo sapiens
ctagaaatattttacagtcaag

SEQ ID NO: 10001092 - DNA, 22 bp, Homo sapiens
ctaaaaatccacactaggtgaa

SEQ ID NO: 10001093 - DNA, 22 bp, Homo sapiens
ctaaaaatccacactaggtgaa

SEQ ID NO: 10001094 - DNA, 22 bp, Homo sapiens
ctagaaatacaggcacgtgcca

SEQ ID NO: 10001095 - DNA, 22 bp, Homo sapiens
ctagagaaacgccgtgggagga

SEQ ID NO: 10001096 - DNA, 22 bp, Homo sapiens
ctagagaagaggctcagccagc

SEQ ID NO: 10001097 - DNA, 22 bp, Homo sapiens
ctagagaagaggttaagcatga

SEQ ID NO: 10001098 - DNA, 22 bp, Homo sapiens
ctagagcagattgcagagtagg

SEQ ID NO: 10001099 - DNA, 22 bp, Homo sapiens
ctagagctgttctgtgcactca

SEQ ID NO: 10001100 - DNA, 22 bp, Homo sapiens
ctagaggggaaaaaggtcttgt

SEQ ID NO: 10001101 - DNA, 22 bp, Homo sapiens
ttctatgccatgttcagctact

SEQ ID NO: 10001102 - DNA, 17 bp, Homo sapiens
cgtgtgcttgtgtgcac

SEQ ID NO: 10001103 - DNA, 22 bp, Homo sapiens
cgtgtgcgtgcatatgcacaag

SEQ ID NO: 10001104 - DNA, 22 bp, Homo sapiens
cgtgtgcgcacacctgtttcca

SEQ ID NO: 10001105 - DNA, 22 bp, Homo sapiens
cgtgtggtcccggcaaggcaag

SEQ ID NO: 10001106 - DNA, 20 bp, Homo sapiens
cgtgtgtggctattttgggt

SEQ ID NO: 10001107 - DNA, 20 bp, Homo sapiens
cgtgtgtggctattttgggt

SEQ ID NO: 10001108 - DNA, 22 bp, Homo sapiens
cgtgtgtgtacctgcgcattta

SEQ ID NO: 10001109 - DNA, 22 bp, Homo sapiens
cgtgtgtgtacctgcgcattta

SEQ ID NO: 10001110 - DNA, 22 bp, Homo sapiens
cgtgtctgggctcccatggcag

SEQ ID NO: 10001111 - DNA, 22 bp, Homo sapiens
cgtgtctgggatagcagaagta

SEQ ID NO: 10001112 - DNA, 23 bp, Homo sapiens
cgtgtctgtgggcgatccggcct

SEQ ID NO: 10001113 - DNA, 22 bp, Homo sapiens
cgtgtctgtatgtcaatcagct

SEQ ID NO: 10001114 - DNA, 22 bp, Homo sapiens
cgtgtctgtgtatgcaggccgt

SEQ ID NO: 10001115 - DNA, 22 bp, Homo sapiens
cgtgtacacgcacacgtgtcct

SEQ ID NO: 10001116 - DNA, 22 bp, Homo sapiens
cgttgtttgagattttcagaat

SEQ ID NO: 10001117 - DNA, 22 bp, Homo sapiens
cgttcctctactccagctaccc

SEQ ID NO: 10001118 - DNA, 22 bp, Homo sapiens
cgttctctcatgatcttcccga

SEQ ID NO: 10001119 - DNA, 22 bp, Homo sapiens
cgtgtgtgtacctgcgcattta

SEQ ID NO: 10001120 - DNA, 22 bp, Homo sapiens
cgttaataggtgcaaggtaagg

SEQ ID NO: 10001121 - DNA, 23 bp, Homo sapiens
cgttttttcctcagatgttctgg

SEQ ID NO: 10001122 - DNA, 22 bp, Homo sapiens
cgtttattttgaagattccact

SEQ ID NO: 10001123 - DNA, 22 bp, Homo sapiens
ttctgcatgtgtttcaaatact

SEQ ID NO: 10001124 - DNA, 22 bp, Homo sapiens
ttctgcatgtgtttcaaatact

SEQ ID NO: 10001125 - DNA, 22 bp, Homo sapiens
ttctggaaccagcctgcctggg

SEQ ID NO: 10001126 - DNA, 22 bp, Homo sapiens
ttctgcatctcacagccagtgc

SEQ ID NO: 10001127 - DNA, 22 bp, Homo sapiens
ttctgcatgaaaagaactgaac

SEQ ID NO: 10001128 - DNA, 22 bp, Homo sapiens
ttctgcatgaacagtttattcc

SEQ ID NO: 10001129 - DNA, 22 bp, Homo sapiens
ttctgcatgatattaaatgtaa

SEQ ID NO: 10001130 - DNA, 22 bp, Homo sapiens
ttctgcatggagaaactgagtc

SEQ ID NO: 10001131 - DNA, 22 bp, Homo sapiens
ttctgcatggttggggagaagc

SEQ ID NO: 10001132 - DNA, 22 bp, Homo sapiens
ttctgcatggttggggagaagc

SEQ ID NO: 10001133 - DNA, 17 bp, Homo sapiens
ttctgcatgtgaagatg

SEQ ID NO: 10001134 - DNA, 17 bp, Homo sapiens
ttctgcatgtgaagatg

SEQ ID NO: 10001135 - DNA, 22 bp, Homo sapiens
ttctgcatgtgtttcaaatact

SEQ ID NO: 10001136 - DNA, 23 bp, Homo sapiens
ttctggaagatttacttgagaca

SEQ ID NO: 10001137 - DNA, 23 bp, Homo sapiens
ttctggaagatttacttgagaca

SEQ ID NO: 10001138 - DNA, 22 bp, Homo sapiens
ttctggaagctgcaggtggccg

SEQ ID NO: 10001139 - DNA, 22 bp, Homo sapiens
ttctggaagccccagagtcaga

SEQ ID NO: 10001140 - DNA, 22 bp, Homo sapiens
ttctggaagccccagagtcaga

SEQ ID NO: 10001141 - DNA, 22 bp, Homo sapiens
ttctggaagctgggcagcaccc

SEQ ID NO: 10001142 - DNA, 22 bp, Homo sapiens
ttctatgctagtggaaagcttc

SEQ ID NO: 10001143 - DNA, 22 bp, Homo sapiens
ttctatgcctgagaagaagccg

SEQ ID NO: 10001144 - DNA, 22 bp, Homo sapiens
ttctatgtagataaggctgctc

SEQ ID NO: 10001145 - DNA, 22 bp, Homo sapiens
ttctatgtcagtgtgctctgtg

SEQ ID NO: 10001146 - DNA, 22 bp, Homo sapiens
ttctatgtgaacgttatagttt

SEQ ID NO: 10001147 - DNA, 22 bp, Homo sapiens
ttctatgtgaacgttatagttt

SEQ ID NO: 10001148 - DNA, 22 bp, Homo sapiens
ttctatgtgttgacaagcctga

SEQ ID NO: 10001149 - DNA, 22 bp, Homo sapiens
ttctatgtggcatcaagctcag

SEQ ID NO: 10001150 - DNA, 22 bp, Homo sapiens
ttctatgttagtatgggtctcc

SEQ ID NO: 10001151 - DNA, 22 bp, Homo sapiens
ttctatgtgctggagaatattt

SEQ ID NO: 10001152 - DNA, 22 bp, Homo sapiens
ttctatgtggatatagaactgc

SEQ ID NO: 10001153 - DNA, 22 bp, Homo sapiens
ttctattgcacacaaataatta

SEQ ID NO: 10001154 - DNA, 22 bp, Homo sapiens
ttctattgcacacaaataatta

SEQ ID NO: 10001155 - DNA, 22 bp, Homo sapiens
ttctatttcttaatcttggctg

SEQ ID NO: 10001156 - DNA, 22 bp, Homo sapiens
ttctatttcttaatcttggctg

SEQ ID NO: 10001157 - DNA, 22 bp, Homo sapiens
ttctgaagctcccttttgtagt

SEQ ID NO: 10001158 - DNA, 22 bp, Homo sapiens
ttctgaagctcccttttgtagt

SEQ ID NO: 10001159 - DNA, 22 bp, Homo sapiens
ttctgcagcccaacagtagttt

SEQ ID NO: 10001160 - DNA, 22 bp, Homo sapiens
ttctgcagcccaacagtagttt

SEQ ID NO: 10001161 - DNA, 22 bp, Homo sapiens
ttctgcatcccagaagaggaca

SEQ ID NO: 10001162 - DNA, 22 bp, Homo sapiens
ttctgcataggctatatttgtt

SEQ ID NO: 10001163 - DNA, 22 bp, Homo sapiens
ttctgcatacactgaatgtagt

SEQ ID NO: 10001164 - DNA, 22 bp, Homo sapiens
ttctgcagtgttaacaatgtca

SEQ ID NO: 10001165 - DNA, 22 bp, Homo sapiens
ttctgcatacactgaatgtagt

SEQ ID NO: 10001166 - DNA, 22 bp, Homo sapiens
ttctgcagtgaatgactcaata

SEQ ID NO: 10001167 - DNA, 22 bp, Homo sapiens
ttctgcaggagccctagtgtat

SEQ ID NO: 10001168 - DNA, 22 bp, Homo sapiens
ttctgcaggctgtacaagaagc

SEQ ID NO: 10001169 - DNA, 20 bp, Homo sapiens
ttcaaagtgtatgatatgca

SEQ ID NO: 10001170 - DNA, 22 bp, Homo sapiens
ttcaaagtgtgacctgacaagc

SEQ ID NO: 10001171 - DNA, 22 bp, Homo sapiens
ttcaaatacattctttgccact

SEQ ID NO: 10001172 - DNA, 21 bp, Homo sapiens
ttcaaagtttgcctaaagatt

SEQ ID NO: 10001173 - DNA, 22 bp, Homo sapiens
ttcaaatcctagccctgtggcc

SEQ ID NO: 10001174 - DNA, 22 bp, Homo sapiens
ttcaaatcactttggagcttaa

SEQ ID NO: 10001175 - DNA, 22 bp, Homo sapiens
ttcaaatgatggcagtcctggc

SEQ ID NO: 10001176 - DNA, 22 bp, Homo sapiens
ttcaaatcctgcttatgctacc

SEQ ID NO: 10001177 - DNA, 22 bp, Homo sapiens
ttcaaatcctgcttatgctacc

SEQ ID NO: 10001178 - DNA, 22 bp, Homo sapiens
ttcaaatggttagactgttagc

SEQ ID NO: 10001179 - DNA, 22 bp, Homo sapiens
ttcaaatgcaagttactacttt

SEQ ID NO: 10001180 - DNA, 22 bp, Homo sapiens
cggaggttgaggctgcagtgag

SEQ ID NO: 10001181 - DNA, 22 bp, Homo sapiens
cggaggttgaggctgcagtgag

SEQ ID NO: 10001182 - DNA, 22 bp, Homo sapiens
cggcagcatcgaaactacattc

SEQ ID NO: 10001183 - DNA, 22 bp, Homo sapiens
cggcagagtgtgtgcgtgcatg

SEQ ID NO: 10001184 - DNA, 22 bp, Homo sapiens
cggcagagtgtgtgcgtgcatg

SEQ ID NO: 10001185 - DNA, 22 bp, Homo sapiens
cggcagcaaaggaagccaggtc

SEQ ID NO: 10001186 - DNA, 22 bp, Homo sapiens
cggcagagcttcctgctcagcg

SEQ ID NO: 10001187 - DNA, 22 bp, Homo sapiens
cggcagagcttcctgctcagcg

SEQ ID NO: 10001188 - DNA, 22 bp, Homo sapiens
cggcagagcttcctgctcagcg

SEQ ID NO: 10001189 - DNA, 18 bp, Homo sapiens
cggcagagtgcttctagc

SEQ ID NO: 10001190 - DNA, 18 bp, Homo sapiens
cggcagagtgcttctagc

SEQ ID NO: 10001191 - DNA, 22 bp, Homo sapiens
cggcagagacggcgctttgaac

SEQ ID NO: 10001192 - DNA, 22 bp, Homo sapiens
cggcagagcggcgagcccctcc

SEQ ID NO: 10001193 - DNA, 22 bp, Homo sapiens
cggcagagcggcgagcccctcc

SEQ ID NO: 10001194 - DNA, 22 bp, Homo sapiens
cggcagagccctgagtcagcct

SEQ ID NO: 10001195 - DNA, 22 bp, Homo sapiens
cggcagagccctgagtcagcct

SEQ ID NO: 10001196 - DNA, 22 bp, Homo sapiens
cggcagagacggcgctttgaac

SEQ ID NO: 10001197 - DNA, 22 bp, Homo sapiens
cggggaagcggttctggcggta

SEQ ID NO: 10001198 - DNA, 22 bp, Homo sapiens
cggggaggcttcggattaaagc

SEQ ID NO: 10001199 - DNA, 22 bp, Homo sapiens
cggggcagagggtcttctccag

SEQ ID NO: 10001200 - DNA, 22 bp, Homo sapiens
cggggagggcagaggctccctc

SEQ ID NO: 10001201 - DNA, 22 bp, Homo sapiens
cggggagggcagaggctccctc

SEQ ID NO: 10001202 - DNA, 22 bp, Homo sapiens
cggggcctcagtttccccacct

SEQ ID NO: 10001203 - DNA, 22 bp, Homo sapiens
cggggccctggggctgaaggtc

SEQ ID NO: 10001204 - DNA, 22 bp, Homo sapiens
cggggctgacagcaggtgtgct

SEQ ID NO: 10001205 - DNA, 22 bp, Homo sapiens
cggggctgcgctcttcctgccg

SEQ ID NO: 10001206 - DNA, 21 bp, Homo sapiens
cgtgactgggtccgtctggct

SEQ ID NO: 10001207 - DNA, 22 bp, Homo sapiens
cgtgggagtggtgggtgctcag

SEQ ID NO: 10001208 - DNA, 22 bp, Homo sapiens
cgctggcttcctcctggggcca

SEQ ID NO: 10001209 - DNA, 22 bp, Homo sapiens
cgctgcagatgggagctggttg

SEQ ID NO: 10001210 - DNA, 22 bp, Homo sapiens
cgctgcagctggctgcagggaa

SEQ ID NO: 10001211 - DNA, 22 bp, Homo sapiens
cgctgccaggtcaccaggggta

SEQ ID NO: 10001212 - DNA, 22 bp, Homo sapiens
cgctgccaggatcccctgccgg

SEQ ID NO: 10001213 - DNA, 22 bp, Homo sapiens
ttatttcatgtaaaatttatgt

SEQ ID NO: 10001214 - DNA, 22 bp, Homo sapiens
cgccggcttgaggcaggcggca

SEQ ID NO: 10001215 - DNA, 16 bp, Homo sapiens
cgcctccctccctcgc

SEQ ID NO: 10001216 - DNA, 22 bp, Homo sapiens
cgctctggagaatagtagcttt

SEQ ID NO: 10001217 - DNA, 19 bp, Homo sapiens
cgctctgggtttcgtgtca

SEQ ID NO: 10001218 - DNA, 22 bp, Homo sapiens
ttatttattgtgtacctactgt

SEQ ID NO: 10001219 - DNA, 22 bp, Homo sapiens
ttatttattcattctgtctgtc

SEQ ID NO: 10001220 - DNA, 22 bp, Homo sapiens
ttatttatgttaacagtcgaga

SEQ ID NO: 10001221 - DNA, 17 bp, Homo sapiens
ttattgcagtgctgaag

SEQ ID NO: 10001222 - DNA, 22 bp, Homo sapiens
ccttttctggccaccaagcgct

SEQ ID NO: 10001223 - DNA, 22 bp, Homo sapiens
ccttttgtacacttactatata

SEQ ID NO: 10001224 - DNA, 22 bp, Homo sapiens
ccttttgtcctgcttggtttcg

SEQ ID NO: 10001225 - DNA, 22 bp, Homo sapiens
ccttttgctctcccatccagaa

SEQ ID NO: 10001226 - DNA, 22 bp, Homo sapiens
ccttttgctctcccatccagaa

SEQ ID NO: 10001227 - DNA, 22 bp, Homo sapiens
ccttttctatgtaccagcagtg

SEQ ID NO: 10001228 - DNA, 22 bp, Homo sapiens
ccttttctacaagcaaatgtgc

SEQ ID NO: 10001229 - DNA, 22 bp, Homo sapiens
cctttgggtgaattcctctctt

SEQ ID NO: 10001230 - DNA, 22 bp, Homo sapiens
ccttttcccatgtttctggagc

SEQ ID NO: 10001231 - DNA, 19 bp, Homo sapiens
ccttttttaacttcagcaa

SEQ ID NO: 10001232 - DNA, 22 bp, Homo sapiens
ccttttttctatgccaactctg

SEQ ID NO: 10001233 - DNA, 22 bp, Homo sapiens
cgaaaatagatctgtttcccag

SEQ ID NO: 10001234 - DNA, 22 bp, Homo sapiens
cgaaacatctatgatcattaat

SEQ ID NO: 10001235 - DNA, 22 bp, Homo sapiens
cgaaatcagcatcttgaggcaa

SEQ ID NO: 10001236 - DNA, 21 bp, Homo sapiens
cgacagtgtatagattagagc

SEQ ID NO: 10001237 - DNA, 22 bp, Homo sapiens
cgacagcagaagaagcaagcca

SEQ ID NO: 10001238 - DNA, 22 bp, Homo sapiens
ttattcagcagggacttccttt

SEQ ID NO: 10001239 - DNA, 22 bp, Homo sapiens
cgagagttagctaggagtcaca

SEQ ID NO: 10001240 - DNA, 22 bp, Homo sapiens
ccttgcagacatcagtagtggc

SEQ ID NO: 10001241 - DNA, 20 bp, Homo sapiens
ccttgccagtagggctggga

SEQ ID NO: 10001242 - DNA, 22 bp, Homo sapiens
ccttgcatttaaaggcgtaggg

SEQ ID NO: 10001243 - DNA, 22 bp, Homo sapiens
ccttgatggtgagagctgcaga

SEQ ID NO: 10001244 - DNA, 22 bp, Homo sapiens
ccttgagatgagctaatttttt

SEQ ID NO: 10001245 - DNA, 22 bp, Homo sapiens
ccttgaaatgttctcactgggg

SEQ ID NO: 10001246 - DNA, 22 bp, Homo sapiens
ccttgagacacagccaaagatg

SEQ ID NO: 10001247 - DNA, 22 bp, Homo sapiens
ccttgagaggaagtttgtagaa

SEQ ID NO: 10001248 - DNA, 22 bp, Homo sapiens
ttataaagatccttccagagtt

SEQ ID NO: 10001249 - DNA, 22 bp, Homo sapiens
ttataaagattgttatgtatct

SEQ ID NO: 10001250 - DNA, 22 bp, Homo sapiens
ttataaagattgttatgtatct

SEQ ID NO: 10001251 - DNA, 22 bp, Homo sapiens
ttagttttctcatctatctcac

SEQ ID NO: 10001252 - DNA, 22 bp, Homo sapiens
ttagttttctcatctatctcac

SEQ ID NO: 10001253 - DNA, 22 bp, Homo sapiens
ttagttttcccatctttatggt

SEQ ID NO: 10001254 - DNA, 22 bp, Homo sapiens
ttagtttataattcatttctgt

SEQ ID NO: 10001255 - DNA, 22 bp, Homo sapiens
ttagtttcctgtggtgtgaagt

SEQ ID NO: 10001256 - DNA, 22 bp, Homo sapiens
ttagttttcccatctttatggt

SEQ ID NO: 10001257 - DNA, 22 bp, Homo sapiens
ttagtttataattcatttctgt

SEQ ID NO: 10001258 - DNA, 22 bp, Homo sapiens
ttatatttctggtagccttcag

SEQ ID NO: 10001259 - DNA, 22 bp, Homo sapiens
ttatatttctggtagccttcag

SEQ ID NO: 10001260 - DNA, 22 bp, Homo sapiens
ttatatttctggtagccttcag

SEQ ID NO: 10001261 - DNA, 22 bp, Homo sapiens
ttatatttctggtagccttcag

SEQ ID NO: 10001262 - DNA, 22 bp, Homo sapiens
ttatcattgtcgcagtctaatt

SEQ ID NO: 10001263 - DNA, 22 bp, Homo sapiens
ttatcataagtaattgaaataa

SEQ ID NO: 10001264 - DNA, 22 bp, Homo sapiens
ttatcagagtccccaaaagaaa

SEQ ID NO: 10001265 - DNA, 22 bp, Homo sapiens
ttataacactgccttgtcacca

SEQ ID NO: 10001266 - DNA, 22 bp, Homo sapiens
ttataacactgccttgtcacca

SEQ ID NO: 10001267 - DNA, 22 bp, Homo sapiens
ttataacactgccttgtcacca

SEQ ID NO: 10001268 - DNA, 22 bp, Homo sapiens
ttatattagttagacttgctgt

SEQ ID NO: 10001269 - DNA, 22 bp, Homo sapiens
ttatattagttagacttgctgt

SEQ ID NO: 10001270 - DNA, 22 bp, Homo sapiens
ttataaagtgagaagtgctatg

SEQ ID NO: 10001271 - DNA, 23 bp, Homo sapiens
ttataaatattttcaggtgtgtt

SEQ ID NO: 10001272 - DNA, 22 bp, Homo sapiens
ttataaagtgagaagtgctatg

SEQ ID NO: 10001273 - DNA, 23 bp, Homo sapiens
ttataaatattttcaggtgtgtt

SEQ ID NO: 10001274 - DNA, 22 bp, Homo sapiens
ttataaaggtttgtgcatattt

SEQ ID NO: 10001275 - DNA, 22 bp, Homo sapiens
ttataaaggtttgtgcatattt

SEQ ID NO: 10001276 - DNA, 22 bp, Homo sapiens
ttataaaggtttgtgcatattt

SEQ ID NO: 10001277 - DNA, 22 bp, Homo sapiens
ttagacaggatgtatgaaagct

SEQ ID NO: 10001278 - DNA, 21 bp, Homo sapiens
ttagcaaagcaaacacatgct

SEQ ID NO: 10001279 - DNA, 22 bp, Homo sapiens
ttagcaaagtttgccatctagt

SEQ ID NO: 10001280 - DNA, 22 bp, Homo sapiens
ttagcaaatatcttgaaacagg

SEQ ID NO: 10001281 - DNA, 22 bp, Homo sapiens
ccttgaaaccacatcttagaaa

SEQ ID NO: 10001282 - DNA, 22 bp, Homo sapiens
ccttgaaaccctgacactctgt

SEQ ID NO: 10001283 - DNA, 22 bp, Homo sapiens
ccttgaaaccacatcttagaaa

SEQ ID NO: 10001284 - DNA, 22 bp, Homo sapiens
ccttgaaagccaggcagaggaa

SEQ ID NO: 10001285 - DNA, 22 bp, Homo sapiens
ccttgaaatgagaaaaagttgg

SEQ ID NO: 10001286 - DNA, 22 bp, Homo sapiens
ttagcaattgattctcataagc

SEQ ID NO: 10001287 - DNA, 22 bp, Homo sapiens
ttagcacaggcaactccacata

SEQ ID NO: 10001288 - DNA, 22 bp, Homo sapiens
ttagcaattgattctcataagc

SEQ ID NO: 10001289 - DNA, 22 bp, Homo sapiens
ttagcaatgtatgattaaaata

SEQ ID NO: 10001290 - DNA, 22 bp, Homo sapiens
ttagcaaatatcttgaaacagg

SEQ ID NO: 10001291 - DNA, 22 bp, Homo sapiens
ttagcaaatatcttgaaacagg

SEQ ID NO: 10001292 - DNA, 20 bp, Homo sapiens
ccttcagaacttacatagta

SEQ ID NO: 10001293 - DNA, 22 bp, Homo sapiens
ccttcacaccatctttaccagg

SEQ ID NO: 10001294 - DNA, 22 bp, Homo sapiens
ccttcaaattctcttagctgaa

SEQ ID NO: 10001295 - DNA, 22 bp, Homo sapiens
ccttcaaatttagaacaagtga

SEQ ID NO: 10001296 - DNA, 22 bp, Homo sapiens
ccttcagaatgaaattctaatg

SEQ ID NO: 10001297 - DNA, 22 bp, Homo sapiens
ccttcaaactttcattaaccag

SEQ ID NO: 10001298 - DNA, 22 bp, Homo sapiens
ccttcaaagagtatttcctgag

SEQ ID NO: 10001299 - DNA, 22 bp, Homo sapiens
ccttcaaagtacacatctttat

SEQ ID NO: 10001300 - DNA, 22 bp, Homo sapiens
ccttcaaactttcattaaccag

SEQ ID NO: 10001301 - DNA, 22 bp, Homo sapiens
ccttcaaaacactagtttttga

SEQ ID NO: 10001302 - DNA, 22 bp, Homo sapiens
ttacatacctcatagactcagg

SEQ ID NO: 10001303 - DNA, 22 bp, Homo sapiens
ttacataacggtatgaaaaatg

SEQ ID NO: 10001304 - DNA, 22 bp, Homo sapiens
ttacataactttaaaatgccgt

SEQ ID NO: 10001305 - DNA, 22 bp, Homo sapiens
ttacataaaagttcacgtaggc

SEQ ID NO: 10001306 - DNA, 22 bp, Homo sapiens
ttacagtttatccaggaagagc

SEQ ID NO: 10001307 - DNA, 22 bp, Homo sapiens
ttacataacggtatgaaaaatg

SEQ ID NO: 10001308 - DNA, 22 bp, Homo sapiens
ttacataacggtatgaaaaatg

SEQ ID NO: 10001309 - DNA, 23 bp, Homo sapiens
ccttaaatatctaccctgtggca

SEQ ID NO: 10001310 - DNA, 22 bp, Homo sapiens
ccttaaaagaactatctcttct

SEQ ID NO: 10001311 - DNA, 22 bp, Homo sapiens
ccttaaaagaactatctcttct

SEQ ID NO: 10001312 - DNA, 22 bp, Homo sapiens
ccttaaactctgatatgatatt

SEQ ID NO: 10001313 - DNA, 22 bp, Homo sapiens
ccttaaactttatcttgtgaga

SEQ ID NO: 10001314 - DNA, 22 bp, Homo sapiens
ccttaaattctccatttgaaag

SEQ ID NO: 10001315 - DNA, 22 bp, Homo sapiens
ttaagcatggaagtgaaataat

SEQ ID NO: 10001316 - DNA, 22 bp, Homo sapiens
ttaagcaacacacattaattat

SEQ ID NO: 10001317 - DNA, 23 bp, Homo sapiens
ttaagcactgttagtagaaaagg

SEQ ID NO: 10001318 - DNA, 18 bp, Homo sapiens
cctgtgtgtgttgcaggc

SEQ ID NO: 10001319 - DNA, 22 bp, Homo sapiens
cctgtgtgtctgtcactgcaca

SEQ ID NO: 10001320 - DNA, 17 bp, Homo sapiens
ttaagcatgtaatctgc

SEQ ID NO: 10001321 - DNA, 22 bp, Homo sapiens
ccttagatcaggctgtctaggg

SEQ ID NO: 10001322 - DNA, 22 bp, Homo sapiens
ccttagaaggctgaataattct

SEQ ID NO: 10001323 - DNA, 22 bp, Homo sapiens
ccttagaaggctgaataattct

SEQ ID NO: 10001324 - DNA, 22 bp, Homo sapiens
ccttagaggcaggaagaattgc

SEQ ID NO: 10001325 - DNA, 22 bp, Homo sapiens
ccttagaagaaagttacttttt

SEQ ID NO: 10001326 - DNA, 22 bp, Homo sapiens
ccttagaagaaagttacttttt

SEQ ID NO: 10001327 - DNA, 22 bp, Homo sapiens
ccttagaaggctgaataattct

SEQ ID NO: 10001328 - DNA, 22 bp, Homo sapiens
ccttagaaaatcatggaatatt

SEQ ID NO: 10001329 - DNA, 22 bp, Homo sapiens
ccttagaaaatcatggaatatt

SEQ ID NO: 10001330 - DNA, 22 bp, Homo sapiens
ccttagaaaatcatggaatatt

SEQ ID NO: 10001331 - DNA, 22 bp, Homo sapiens
ccttagaaatgtaccaaaggaa

SEQ ID NO: 10001332 - DNA, 22 bp, Homo sapiens
ccttagaaatgtaccaaaggaa

SEQ ID NO: 10001333 - DNA, 22 bp, Homo sapiens
ccttacaatgcagtttacttag

SEQ ID NO: 10001334 - DNA, 21 bp, Homo sapiens
ccttagtcttccacatagtcc

SEQ ID NO: 10001335 - DNA, 22 bp, Homo sapiens
ccttatcacaatggagtgtcac

SEQ ID NO: 10001336 - DNA, 22 bp, Homo sapiens
ttacaaagagtgccagagtgtg

SEQ ID NO: 10001337 - DNA, 22 bp, Homo sapiens
ttacaaagcgctttacctctga

SEQ ID NO: 10001338 - DNA, 22 bp, Homo sapiens
ttacaaagcgctttacctctga

SEQ ID NO: 10001339 - DNA, 22 bp, Homo sapiens
ttacaaagcgttgagacaagta

SEQ ID NO: 10001340 - DNA, 22 bp, Homo sapiens
ttacagaagtgaaggcctttaa

SEQ ID NO: 10001341 - DNA, 22 bp, Homo sapiens
ttacagaagtattgagagatcc

SEQ ID NO: 10001342 - DNA, 22 bp, Homo sapiens
ttacaaagagtgttcttttcca

SEQ ID NO: 10001343 - DNA, 22 bp, Homo sapiens
ttacaaagattatattcagtta

SEQ ID NO: 10001344 - DNA, 22 bp, Homo sapiens
ttacaaagattatattcagtta

SEQ ID NO: 10001345 - DNA, 21 bp, Homo sapiens
ttacaaagcaagtgctgtgtc

SEQ ID NO: 10001346 - DNA, 21 bp, Homo sapiens
ttacaaagcaagtgctgtgtc

SEQ ID NO: 10001347 - DNA, 22 bp, Homo sapiens
ttacagttgttctatcagcatg

SEQ ID NO: 10001348 - DNA, 22 bp, Homo sapiens
ttaaattatttctagtgaggtg

SEQ ID NO: 10001349 - DNA, 22 bp, Homo sapiens
ttaaattatttctagtgaggtg

SEQ ID NO: 10001350 - DNA, 22 bp, Homo sapiens
ttaaattcattccaacttttga

SEQ ID NO: 10001351 - DNA, 22 bp, Homo sapiens
ttaaattcattccaacttttga

SEQ ID NO: 10001352 - DNA, 22 bp, Homo sapiens
ttaaattccagcctcataatag

SEQ ID NO: 10001353 - DNA, 22 bp, Homo sapiens
ttaaattgtcatttgagcaatg

SEQ ID NO: 10001354 - DNA, 22 bp, Homo sapiens
ttaaattccagcctcataatag

SEQ ID NO: 10001355 - DNA, 22 bp, Homo sapiens
ttaaattccagcctcataatag

SEQ ID NO: 10001356 - DNA, 22 bp, Homo sapiens
ttaaattccagcctcataatag

SEQ ID NO: 10001357 - DNA, 22 bp, Homo sapiens
ttaagatttgtagagaaaaagc

SEQ ID NO: 10001358 - DNA, 22 bp, Homo sapiens
ttaagatgttcagataatttgg

SEQ ID NO: 10001359 - DNA, 22 bp, Homo sapiens
ttaagaggagatcatactggag

SEQ ID NO: 10001360 - DNA, 22 bp, Homo sapiens
ttaagagggtgatgctagcatt

SEQ ID NO: 10001361 - DNA, 22 bp, Homo sapiens
ttaagaggtgaggcctttaaga

SEQ ID NO: 10001362 - DNA, 22 bp, Homo sapiens
ttaagaggtggtcgtgtctgtg

SEQ ID NO: 10001363 - DNA, 22 bp, Homo sapiens
ttaagaggtgaggcctttaaga

SEQ ID NO: 10001364 - DNA, 22 bp, Homo sapiens
tgtcagcaacccatcactccca

SEQ ID NO: 10001365 - DNA, 22 bp, Homo sapiens
tgtcagcaagacatcagagtga

SEQ ID NO: 10001366 - DNA, 21 bp, Homo sapiens
tgtcagcaacaatactttctc

SEQ ID NO: 10001367 - DNA, 20 bp, Homo sapiens
tgtcagataactagctgtta

SEQ ID NO: 10001368 - DNA, 22 bp, Homo sapiens
tgtcagaggctcagggtctcag

SEQ ID NO: 10001369 - DNA, 22 bp, Homo sapiens
tgtcagatgcgataaactagtg

SEQ ID NO: 10001370 - DNA, 20 bp, Homo sapiens
tgtcagcaattaggagaaaa

SEQ ID NO: 10001371 - DNA, 22 bp, Homo sapiens
tgtcagcaattctggcttactc

SEQ ID NO: 10001372 - DNA, 22 bp, Homo sapiens
tgtcagcaccatgggtagtgat

SEQ ID NO: 10001373 - DNA, 21 bp, Homo sapiens
tgtcagagcttgtaggacatt

SEQ ID NO: 10001374 - DNA, 22 bp, Homo sapiens
tgtcaatatcaggcagacctaa

SEQ ID NO: 10001375 - DNA, 22 bp, Homo sapiens
tgtcagaactctattgatgtcc

SEQ ID NO: 10001376 - DNA, 22 bp, Homo sapiens
tgtcaatatgtaataactgaat

SEQ ID NO: 10001377 - DNA, 22 bp, Homo sapiens
tgtcagcagaagtggtgcactc

SEQ ID NO: 10001378 - DNA, 22 bp, Homo sapiens
tgtcagcagctggtttgctgtt

SEQ ID NO: 10001379 - DNA, 22 bp, Homo sapiens
tgtcagcaggacattaaaagct

SEQ ID NO: 10001380 - DNA, 22 bp, Homo sapiens
tgtcagcattgcgtcactgagc

SEQ ID NO: 10001381 - DNA, 22 bp, Homo sapiens
tgtcagcatcatttgttgaagg

SEQ ID NO: 10001382 - DNA, 22 bp, Homo sapiens
ttaaatagtaggtctattttgg

SEQ ID NO: 10001383 - DNA, 22 bp, Homo sapiens
ttaaatagtaggtctattttgg

SEQ ID NO: 10001384 - DNA, 22 bp, Homo sapiens
ttaaattattgagggattgtca

SEQ ID NO: 10001385 - DNA, 22 bp, Homo sapiens
ttaaattagtcaagcttctctg

SEQ ID NO: 10001386 - DNA, 21 bp, Homo sapiens
gagtaacatttcctctccaca

SEQ ID NO: 10001387 - DNA, 22 bp, Homo sapiens
gagtaagagctggctttggtgt

SEQ ID NO: 10001388 - DNA, 22 bp, Homo sapiens
gagtaacatgtattggaaggcc

SEQ ID NO: 10001389 - DNA, 22 bp, Homo sapiens
gagtaacatgtattggaaggcc

SEQ ID NO: 10001390 - DNA, 22 bp, Homo sapiens
gagtaacatctggaaccgacac

SEQ ID NO: 10001391 - DNA, 22 bp, Homo sapiens
gagtaacagcataaatttgtga

SEQ ID NO: 10001392 - DNA, 22 bp, Homo sapiens
gagtaacataccaaaattcaca

SEQ ID NO: 10001393 - DNA, 22 bp, Homo sapiens
gagtaacaaatacttcagtagt

SEQ ID NO: 10001394 - DNA, 22 bp, Homo sapiens
gagtaaaagttggattacaaag

SEQ ID NO: 10001395 - DNA, 22 bp, Homo sapiens
gagtacatcttaatttgactaa

SEQ ID NO: 10001396 - DNA, 22 bp, Homo sapiens
gagtacatgtatagagattaac

SEQ ID NO: 10001397 - DNA, 22 bp, Homo sapiens
gaggttttaagttgaaggggga

SEQ ID NO: 10001398 - DNA, 22 bp, Homo sapiens
gaggttttaggctgccattatt

SEQ ID NO: 10001399 - DNA, 19 bp, Homo sapiens
gaggtttctgaagtgggct

SEQ ID NO: 10001400 - DNA, 23 bp, Homo sapiens
gaggtgtgaattctgggtgctgc

SEQ ID NO: 10001401 - DNA, 23 bp, Homo sapiens
gaggtgtgaattctgggtgctgc

SEQ ID NO: 10001402 - DNA, 22 bp, Homo sapiens
gaggtgggagggcagtccctaa

SEQ ID NO: 10001403 - DNA, 22 bp, Homo sapiens
gaggtgagaagggggtcagatg

SEQ ID NO: 10001404 - DNA, 22 bp, Homo sapiens
gaggtgagaagggggtcagatg

SEQ ID NO: 10001405 - DNA, 22 bp, Homo sapiens
gaggtgagaagggggtcagatg

SEQ ID NO: 10001406 - DNA, 22 bp, Homo sapiens
gaggtgctgctgtacttcttgc

SEQ ID NO: 10001407 - DNA, 22 bp, Homo sapiens
gaggtgagtggatcacgaggtc

SEQ ID NO: 10001408 - DNA, 22 bp, Homo sapiens
gaggtgagtggatcacgaggtc

SEQ ID NO: 10001409 - DNA, 22 bp, Homo sapiens
gaggtggctgggagtagggaat

SEQ ID NO: 10001410 - DNA, 22 bp, Homo sapiens
gaggtggctggctcagagccag

SEQ ID NO: 10001411 - DNA, 18 bp, Homo sapiens
gaggtggctgggccatct

SEQ ID NO: 10001412 - DNA, 22 bp, Homo sapiens
gaggtggctgtcagcttcactt

SEQ ID NO: 10001413 - DNA, 22 bp, Homo sapiens
gaggtggctccttcagggaata

SEQ ID NO: 10001414 - DNA, 22 bp, Homo sapiens
gaggtctgccttcaggagagtt

SEQ ID NO: 10001415 - DNA, 22 bp, Homo sapiens
gagggtgtctcacgtgaaagta

SEQ ID NO: 10001416 - DNA, 22 bp, Homo sapiens
gagggtggtggcttaaggtgct

SEQ ID NO: 10001417 - DNA, 22 bp, Homo sapiens
gaggtcctgtctgagaatggag

SEQ ID NO: 10001418 - DNA, 22 bp, Homo sapiens
gagggtgggtttcttgcacgtc

SEQ ID NO: 10001419 - DNA, 22 bp, Homo sapiens
gagggtggtggcttaaggtgct

SEQ ID NO: 10001420 - DNA, 22 bp, Homo sapiens
gagggtggtggcttaaggtgct

SEQ ID NO: 10001421 - DNA, 22 bp, Homo sapiens
gagggtgggctttgttcctcca

SEQ ID NO: 10001422 - DNA, 22 bp, Homo sapiens
gagggtgggccagatatgaggg

SEQ ID NO: 10001423 - DNA, 22 bp, Homo sapiens
gagggtgggccagatatgaggg

SEQ ID NO: 10001424 - DNA, 22 bp, Homo sapiens
gagggtgggccagatatgaggg

SEQ ID NO: 10001425 - DNA, 22 bp, Homo sapiens
gagggtggggaatagactgcta

SEQ ID NO: 10001426 - DNA, 22 bp, Homo sapiens
gagggtggaagagctgctgaga

SEQ ID NO: 10001427 - DNA, 22 bp, Homo sapiens
gagggtggaagagctgctgaga

SEQ ID NO: 10001428 - DNA, 22 bp, Homo sapiens
gagggtggagctccagaatctg

SEQ ID NO: 10001429 - DNA, 22 bp, Homo sapiens
gagggtggctcctccctgggcc

SEQ ID NO: 10001430 - DNA, 22 bp, Homo sapiens
gagggtggcctttagagcccat

SEQ ID NO: 10001431 - DNA, 20 bp, Homo sapiens
gagggtgggacttcctaggc

SEQ ID NO: 10001432 - DNA, 20 bp, Homo sapiens
gagggtgggacttcctaggc

SEQ ID NO: 10001433 - DNA, 22 bp, Homo sapiens
gagggtgcaggaggatggtagt

SEQ ID NO: 10001434 - DNA, 22 bp, Homo sapiens
gaggccttgggatgtgccacgg

SEQ ID NO: 10001435 - DNA, 22 bp, Homo sapiens
gaggcctgtcgctaggcctctg

SEQ ID NO: 10001436 - DNA, 22 bp, Homo sapiens
gaggcctgtagtcatggatgta

SEQ ID NO: 10001437 - DNA, 22 bp, Homo sapiens
gaggcctggtttccagcatcct

SEQ ID NO: 10001438 - DNA, 22 bp, Homo sapiens
gaggcctggtttgcatgagaat

SEQ ID NO: 10001439 - DNA, 22 bp, Homo sapiens
gaggcctggtttccagcatcct

SEQ ID NO: 10001440 - DNA, 22 bp, Homo sapiens
gaggcctggtttccagcatcct

SEQ ID NO: 10001441 - DNA, 22 bp, Homo sapiens
gaggcctggtttgcatgagaat

SEQ ID NO: 10001442 - DNA, 22 bp, Homo sapiens
gaggcctggtttgcatgagaat

SEQ ID NO: 10001443 - DNA, 22 bp, Homo sapiens
gaggcctggtgctgtgtccaca

SEQ ID NO: 10001444 - DNA, 22 bp, Homo sapiens
gaggcctggtgtgtctcccgct

SEQ ID NO: 10001445 - DNA, 22 bp, Homo sapiens
gaggcctggtagccgagcccca

SEQ ID NO: 10001446 - DNA, 22 bp, Homo sapiens
gaggcctggtctatgagatgtt

SEQ ID NO: 10001447 - DNA, 22 bp, Homo sapiens
gaggcctggtctatgagatgtt

SEQ ID NO: 10001448 - DNA, 22 bp, Homo sapiens
gaggcctggtctatgagatgtt

SEQ ID NO: 10001449 - DNA, 22 bp, Homo sapiens
gaggcggcggccgagcctggct

SEQ ID NO: 10001450 - DNA, 22 bp, Homo sapiens
gaggctggtaggaaaggaaaca

SEQ ID NO: 10001451 - DNA, 22 bp, Homo sapiens
gaggctggggtctgcctttctg

SEQ ID NO: 10001452 - DNA, 22 bp, Homo sapiens
gaggctggtttgccttttggca

SEQ ID NO: 10001453 - DNA, 22 bp, Homo sapiens
gaggctggttctgaagtactgt

SEQ ID NO: 10001454 - DNA, 22 bp, Homo sapiens
gaggctggttctgaagtactgt

SEQ ID NO: 10001455 - DNA, 22 bp, Homo sapiens
gaggctggttctgaagtactgt

SEQ ID NO: 10001456 - DNA, 22 bp, Homo sapiens
gaggctggttcccttgatcttt

SEQ ID NO: 10001457 - DNA, 22 bp, Homo sapiens
gaggctggttctgaagtactgt

SEQ ID NO: 10001458 - DNA, 22 bp, Homo sapiens
gaggctggttcccttgatcttt

SEQ ID NO: 10001459 - DNA, 22 bp, Homo sapiens
gaggctggttcccttgatcttt

SEQ ID NO: 10001460 - DNA, 22 bp, Homo sapiens
gaggctggtaggaaaggaaaca

SEQ ID NO: 10001461 - DNA, 22 bp, Homo sapiens
gaggctggtaggaaaggaaaca

SEQ ID NO: 10001462 - DNA, 22 bp, Homo sapiens
gaggctggtcagccctaagatc

SEQ ID NO: 10001463 - DNA, 22 bp, Homo sapiens
gaggctggtggttagttccatt

SEQ ID NO: 10001464 - DNA, 22 bp, Homo sapiens
gaggctggtcagccctaagatc

SEQ ID NO: 10001465 - DNA, 22 bp, Homo sapiens
gaggctggtggttagttccatt

SEQ ID NO: 10001466 - DNA, 22 bp, Homo sapiens
gaggctgtaagtgtggagccta

SEQ ID NO: 10001467 - DNA, 22 bp, Homo sapiens
gaggctggtttgccttttggca

SEQ ID NO: 10001468 - DNA, 22 bp, Homo sapiens
gaggctgtctgttagcctggga

SEQ ID NO: 10001469 - DNA, 21 bp, Homo sapiens
gaggctgtctgctgctggcct

SEQ ID NO: 10001470 - DNA, 21 bp, Homo sapiens
gaggctgtctgctgctggcct

SEQ ID NO: 10001471 - DNA, 22 bp, Homo sapiens
gagggacagctaaagagaaatt

SEQ ID NO: 10001472 - DNA, 22 bp, Homo sapiens
gagggagaaggactatcaggct

SEQ ID NO: 10001473 - DNA, 22 bp, Homo sapiens
gagggccattctgagggggtga

SEQ ID NO: 10001474 - DNA, 22 bp, Homo sapiens
gagggcctctgtgggtgctcac

SEQ ID NO: 10001475 - DNA, 22 bp, Homo sapiens
gagggctgataacaggaataca

SEQ ID NO: 10001476 - DNA, 22 bp, Homo sapiens
gagggctgataaatgcgcatgg

SEQ ID NO: 10001477 - DNA, 22 bp, Homo sapiens
gagggccagagtcctggggtca

SEQ ID NO: 10001478 - DNA, 22 bp, Homo sapiens
gagggccagatcccaggaggaa

SEQ ID NO: 10001479 - DNA, 22 bp, Homo sapiens
gagggccagcagcctcagcatg

SEQ ID NO: 10001480 - DNA, 22 bp, Homo sapiens
gaggacgggcttcatggggcct

SEQ ID NO: 10001481 - DNA, 22 bp, Homo sapiens
gaggacgtgccaggcgatctcc

SEQ ID NO: 10001482 - DNA, 22 bp, Homo sapiens
gaggactctgcaggctgctcct

SEQ ID NO: 10001483 - DNA, 22 bp, Homo sapiens
gaggacatagtccagatggcaa

SEQ ID NO: 10001484 - DNA, 22 bp, Homo sapiens
gaggacatagtggactagggtt

SEQ ID NO: 10001485 - DNA, 22 bp, Homo sapiens
gaggaccacagatgagcctgca

SEQ ID NO: 10001486 - DNA, 22 bp, Homo sapiens
gaggaccacagatgagcctgca

SEQ ID NO: 10001487 - DNA, 17 bp, Homo sapiens
gaggacagggaagtagg

SEQ ID NO: 10001488 - DNA, 22 bp, Homo sapiens
gaggacagtgtgatctgccagc

SEQ ID NO: 10001489 - DNA, 22 bp, Homo sapiens
gaggactgaaacttacaggaaa

SEQ ID NO: 10001490 - DNA, 22 bp, Homo sapiens
gaggagaaagcagtgatttgtg

SEQ ID NO: 10001491 - DNA, 22 bp, Homo sapiens
gaggagacatatttttgaagca

SEQ ID NO: 10001492 - DNA, 22 bp, Homo sapiens
gaggagagaagctaacggtgct

SEQ ID NO: 10001493 - DNA, 22 bp, Homo sapiens
gaggagacggggtgcctggagc

SEQ ID NO: 10001494 - DNA, 18 bp, Homo sapiens
gaggatggaaggagatgc

SEQ ID NO: 10001495 - DNA, 18 bp, Homo sapiens
gaggatggaaggagatgc

SEQ ID NO: 10001496 - DNA, 22 bp, Homo sapiens
gaggatgctgcagtgcaggaca

SEQ ID NO: 10001497 - DNA, 22 bp, Homo sapiens
gaggagtggagttgctgggttg

SEQ ID NO: 10001498 - DNA, 22 bp, Homo sapiens
gaggagagaagctaacggtgct

SEQ ID NO: 10001499 - DNA, 22 bp, Homo sapiens
gaggagagagggactgtctgca

SEQ ID NO: 10001500 - DNA, 22 bp, Homo sapiens
gaggaggtggagtcatgcagag

SEQ ID NO: 10001501 - DNA, 22 bp, Homo sapiens
gaggaggtggagtcatgcagag

SEQ ID NO: 10001502 - DNA, 22 bp, Homo sapiens
gaggagtctagtttatggcttc

SEQ ID NO: 10001503 - DNA, 22 bp, Homo sapiens
gaggaggttccgggtggagaag

SEQ ID NO: 10001504 - DNA, 22 bp, Homo sapiens
gaggagtgccagccgtggagtc

SEQ ID NO: 10001505 - DNA, 22 bp, Homo sapiens
gaggatggtgagcaggacccag

SEQ ID NO: 10001506 - DNA, 22 bp, Homo sapiens
gaggatggtatgaggcaagcaa

SEQ ID NO: 10001507 - DNA, 22 bp, Homo sapiens
gaggatggatccgaccccttcc

SEQ ID NO: 10001508 - DNA, 22 bp, Homo sapiens
gaggatgtaaaatagacaaaat

SEQ ID NO: 10001509 - DNA, 22 bp, Homo sapiens
gaggcatggcctgaggctagga

SEQ ID NO: 10001510 - DNA, 22 bp, Homo sapiens
gaggcatggcctgaggctagga

SEQ ID NO: 10001511 - DNA, 22 bp, Homo sapiens
gaggccactgtccctgccttcc

SEQ ID NO: 10001512 - DNA, 22 bp, Homo sapiens
gaggccactgtccctgccttcc

SEQ ID NO: 10001513 - DNA, 21 bp, Homo sapiens
gaggccactaataggggcaga

SEQ ID NO: 10001514 - DNA, 21 bp, Homo sapiens
gaggccactaataggggcaga

SEQ ID NO: 10001515 - DNA, 21 bp, Homo sapiens
gaggccactaataggggcaga

SEQ ID NO: 10001516 - DNA, 22 bp, Homo sapiens
gaggccacggaagggagctgtg

SEQ ID NO: 10001517 - DNA, 22 bp, Homo sapiens
gaggccacggttttccttgggg

SEQ ID NO: 10001518 - DNA, 22 bp, Homo sapiens
gaggccacggttttccttgggg

SEQ ID NO: 10001519 - DNA, 22 bp, Homo sapiens
gaggccacgtgcttatgtttct

SEQ ID NO: 10001520 - DNA, 22 bp, Homo sapiens
gaggccagaatgagtctctggg

SEQ ID NO: 10001521 - DNA, 22 bp, Homo sapiens
gaggccagaatgagtctctggg

SEQ ID NO: 10001522 - DNA, 22 bp, Homo sapiens
gaggccagagttccccgagtca

SEQ ID NO: 10001523 - DNA, 22 bp, Homo sapiens
gaggccagactgccttttatga

SEQ ID NO: 10001524 - DNA, 22 bp, Homo sapiens
gaggcctggaattccagcctgg

SEQ ID NO: 10001525 - DNA, 22 bp, Homo sapiens
gaggccagatactctcttctgc

SEQ ID NO: 10001526 - DNA, 22 bp, Homo sapiens
gaggcctggaccagccacagag

SEQ ID NO: 10001527 - DNA, 22 bp, Homo sapiens
gaggccagaagtgcctcgggct

SEQ ID NO: 10001528 - DNA, 22 bp, Homo sapiens
gaggccagaagtgcctcgggct

SEQ ID NO: 10001529 - DNA, 22 bp, Homo sapiens
gaggccagaagtgcctcgggct

SEQ ID NO: 10001530 - DNA, 22 bp, Homo sapiens
gaggccagaagtgcctcgggct

SEQ ID NO: 10001531 - DNA, 22 bp, Homo sapiens
gaggccagaatgagctgaatgc

SEQ ID NO: 10001532 - DNA, 22 bp, Homo sapiens
gaggccagaatgagctgaatgc

SEQ ID NO: 10001533 - DNA, 22 bp, Homo sapiens
gaggccagaagtctgagatcag

SEQ ID NO: 10001534 - DNA, 22 bp, Homo sapiens
gaggccagaagtctgagatcag

SEQ ID NO: 10001535 - DNA, 22 bp, Homo sapiens
gaggccacttcctactggagga

SEQ ID NO: 10001536 - DNA, 22 bp, Homo sapiens
gagctggtgtgtgcccaagcac

SEQ ID NO: 10001537 - DNA, 22 bp, Homo sapiens
gagctggtgtgtgcccgagcac

SEQ ID NO: 10001538 - DNA, 22 bp, Homo sapiens
gagctggtgatcagctggagga

SEQ ID NO: 10001539 - DNA, 22 bp, Homo sapiens
gagctccctggaggttcagata

SEQ ID NO: 10001540 - DNA, 22 bp, Homo sapiens
gagctcccaggccccagcaagg

SEQ ID NO: 10001541 - DNA, 22 bp, Homo sapiens
gagctcccaggccccagcaagg

SEQ ID NO: 10001542 - DNA, 22 bp, Homo sapiens
gagctcctcccagggtagcact

SEQ ID NO: 10001543 - DNA, 22 bp, Homo sapiens
gagctcctgaaacgttcctgcc

SEQ ID NO: 10001544 - DNA, 22 bp, Homo sapiens
gagctcctgctgcatcctgcct

SEQ ID NO: 10001545 - DNA, 22 bp, Homo sapiens
gagctcctggattgctcctagg

SEQ ID NO: 10001546 - DNA, 22 bp, Homo sapiens
gagctgggatttgaacctggga

SEQ ID NO: 10001547 - DNA, 22 bp, Homo sapiens
gagctggtgtgtgcccgagcac

SEQ ID NO: 10001548 - DNA, 22 bp, Homo sapiens
gagctgtcctaccaggagtcct

SEQ ID NO: 10001549 - DNA, 22 bp, Homo sapiens
gagctgtccgcccctgggccga

SEQ ID NO: 10001550 - DNA, 22 bp, Homo sapiens
gagctgtgattggtgtctcact

SEQ ID NO: 10001551 - DNA, 22 bp, Homo sapiens
gagctgtgagggacacattgct

SEQ ID NO: 10001552 - DNA, 22 bp, Homo sapiens
gagctgtgagggacacattgct

SEQ ID NO: 10001553 - DNA, 22 bp, Homo sapiens
gagctgtgacacgcagcccagg

SEQ ID NO: 10001554 - DNA, 22 bp, Homo sapiens
gagctgtgaaaagtgcctgggg

SEQ ID NO: 10001555 - DNA, 22 bp, Homo sapiens
gagctgtgccaatctgtctggg

SEQ ID NO: 10001556 - DNA, 20 bp, Homo sapiens
gagctgtgctctcaggagcc

SEQ ID NO: 10001557 - DNA, 20 bp, Homo sapiens
gagctgtgctctcaggagcc

SEQ ID NO: 10001558 - DNA, 22 bp, Homo sapiens
gagctgtgcttataccaattca

SEQ ID NO: 10001559 - DNA, 22 bp, Homo sapiens
gagctgtggaaggcagggacca

SEQ ID NO: 10001560 - DNA, 22 bp, Homo sapiens
gagctgtggtcaacaggaaatt

SEQ ID NO: 10001561 - DNA, 22 bp, Homo sapiens
gagctgtgtatgcatcattctg

SEQ ID NO: 10001562 - DNA, 22 bp, Homo sapiens
gagctgtgtgcctggatggtct

SEQ ID NO: 10001563 - DNA, 22 bp, Homo sapiens
gaggacaggagactcactgttt

SEQ ID NO: 10001564 - DNA, 17 bp, Homo sapiens
gaggacagggaagtagg

SEQ ID NO: 10001565 - DNA, 22 bp, Homo sapiens
gagctccaccaccttcaggcag

SEQ ID NO: 10001566 - DNA, 22 bp, Homo sapiens
gagctcatccccatggtccgtc

SEQ ID NO: 10001567 - DNA, 22 bp, Homo sapiens
gagctccacttagcaaggccac

SEQ ID NO: 10001568 - DNA, 22 bp, Homo sapiens
gagctccacttagcaaggccac

SEQ ID NO: 10001569 - DNA, 22 bp, Homo sapiens
gagctccagcatctctgccaaa

SEQ ID NO: 10001570 - DNA, 22 bp, Homo sapiens
gagctcagtgtagtcatggctt

SEQ ID NO: 10001571 - DNA, 22 bp, Homo sapiens
gagctcagcaaaggtctgtgtg

SEQ ID NO: 10001572 - DNA, 22 bp, Homo sapiens
gagcaggccagcaatggaaggg

SEQ ID NO: 10001573 - DNA, 22 bp, Homo sapiens
gagcaggcctggggtgaggcct

SEQ ID NO: 10001574 - DNA, 22 bp, Homo sapiens
gagcaggcctggggtgaggcct

SEQ ID NO: 10001575 - DNA, 22 bp, Homo sapiens
gagctcagaggcgtctttgtcc

SEQ ID NO: 10001576 - DNA, 22 bp, Homo sapiens
gagctcagagcctatagttggt

SEQ ID NO: 10001577 - DNA, 22 bp, Homo sapiens
gagcaggatgggagctggggcc

SEQ ID NO: 10001578 - DNA, 22 bp, Homo sapiens
gagcaggatgggagctggggcc

SEQ ID NO: 10001579 - DNA, 22 bp, Homo sapiens
gagcaggacgtgggaatgggaa

SEQ ID NO: 10001580 - DNA, 19 bp, Homo sapiens
gagcaggccacacatgtgt

SEQ ID NO: 10001581 - DNA, 22 bp, Homo sapiens
gagcaggcattctagtggctga

SEQ ID NO: 10001582 - DNA, 22 bp, Homo sapiens
gacagtgattagttactataaa

SEQ ID NO: 10001583 - DNA, 22 bp, Homo sapiens
gacagctgggaggatgacataa

SEQ ID NO: 10001584 - DNA, 17 bp, Homo sapiens
gacagctgggcgcacgc

SEQ ID NO: 10001585 - DNA, 17 bp, Homo sapiens
gacagctggttcctggc

SEQ ID NO: 10001586 - DNA, 22 bp, Homo sapiens
gacagctgtacactcctggtta

SEQ ID NO: 10001587 - DNA, 22 bp, Homo sapiens
gacagctgtacactcctggtta

SEQ ID NO: 10001588 - DNA, 22 bp, Homo sapiens
gacatcatggagaggataaata

SEQ ID NO: 10001589 - DNA, 22 bp, Homo sapiens
gacatcatgttctgctaatagt

SEQ ID NO: 10001590 - DNA, 22 bp, Homo sapiens
gacagctgaacaggtgggataa

SEQ ID NO: 10001591 - DNA, 22 bp, Homo sapiens
gacagctgaaaaatgtaaggta

SEQ ID NO: 10001592 - DNA, 22 bp, Homo sapiens
gacagctgctcccgtttctgct

SEQ ID NO: 10001593 - DNA, 22 bp, Homo sapiens
gacagctgcctctgtgtagatc

SEQ ID NO: 10001594 - DNA, 22 bp, Homo sapiens
gacagctgaaggatgattcagg

SEQ ID NO: 10001595 - DNA, 22 bp, Homo sapiens
gacagctgcatcctcagacaca

SEQ ID NO: 10001596 - DNA, 22 bp, Homo sapiens
gacagctggcagtggaaaggtg

SEQ ID NO: 10001597 - DNA, 22 bp, Homo sapiens
gacagctggacagacactgatg

SEQ ID NO: 10001598 - DNA, 22 bp, Homo sapiens
gacagctgcttatgaaccaacg

SEQ ID NO: 10001599 - DNA, 22 bp, Homo sapiens
gacagccagtgcgatggattca

SEQ ID NO: 10001600 - DNA, 22 bp, Homo sapiens
gacagccaactggggagggcat

SEQ ID NO: 10001601 - DNA, 22 bp, Homo sapiens
gacagccaggcatagggagtat

SEQ ID NO: 10001602 - DNA, 22 bp, Homo sapiens
gacagcatgatcaaggagccca

SEQ ID NO: 10001603 - DNA, 22 bp, Homo sapiens
gacagcatctgtgtggcaggag

SEQ ID NO: 10001604 - DNA, 22 bp, Homo sapiens
gacagcagtcctggagttccca

SEQ ID NO: 10001605 - DNA, 22 bp, Homo sapiens
gacagcaggtgcttgggaaagg

SEQ ID NO: 10001606 - DNA, 22 bp, Homo sapiens
gacagcagggacatgtaggaag

SEQ ID NO: 10001607 - DNA, 22 bp, Homo sapiens
gacagcagggacatgtaggaag

SEQ ID NO: 10001608 - DNA, 22 bp, Homo sapiens
gacagcagggacatgtaggaag

SEQ ID NO: 10001609 - DNA, 22 bp, Homo sapiens
gacctggggtaagcttggcaac

SEQ ID NO: 10001610 - DNA, 22 bp, Homo sapiens
gaccttcaagcaccatatttat

SEQ ID NO: 10001611 - DNA, 22 bp, Homo sapiens
gaccttagaacgtgacacaaga

SEQ ID NO: 10001612 - DNA, 22 bp, Homo sapiens
gaccttctgttggaggcattta

SEQ ID NO: 10001613 - DNA, 19 bp, Homo sapiens
gactatctctggagaccat

SEQ ID NO: 10001614 - DNA, 22 bp, Homo sapiens
gactaggggcagcgtgggagct

SEQ ID NO: 10001615 - DNA, 22 bp, Homo sapiens
gactagggaatcattcttggat

SEQ ID NO: 10001616 - DNA, 22 bp, Homo sapiens
gactaggctctcatagaggtag

SEQ ID NO: 10001617 - DNA, 22 bp, Homo sapiens
gactatttatttacagaaagct

SEQ ID NO: 10001618 - DNA, 22 bp, Homo sapiens
gaccttggttgagcttcctaat

SEQ ID NO: 10001619 - DNA, 22 bp, Homo sapiens
gaccttcttgctgtgtcctaac

SEQ ID NO: 10001620 - DNA, 19 bp, Homo sapiens
gactacagggggaagaagt

SEQ ID NO: 10001621 - DNA, 22 bp, Homo sapiens
gactacaggtgtgtgccaccat

SEQ ID NO: 10001622 - DNA, 22 bp, Homo sapiens
gacatgcattaagacacactga

SEQ ID NO: 10001623 - DNA, 22 bp, Homo sapiens
gacatgtattagtacatatggt

SEQ ID NO: 10001624 - DNA, 22 bp, Homo sapiens
gacatgggatgagatgaagcat

SEQ ID NO: 10001625 - DNA, 22 bp, Homo sapiens
gacatgaatgttatactttatt

SEQ ID NO: 10001626 - DNA, 22 bp, Homo sapiens
gacatgaacctaccataatgat

SEQ ID NO: 10001627 - DNA, 22 bp, Homo sapiens
gacatgaacctaccataatgat

SEQ ID NO: 10001628 - DNA, 22 bp, Homo sapiens
gacatgcatgaatgcaggtctc

SEQ ID NO: 10001629 - DNA, 22 bp, Homo sapiens
gacattaatggcaaattaatta

SEQ ID NO: 10001630 - DNA, 22 bp, Homo sapiens
gacctgaaatttgtggtagaac

SEQ ID NO: 10001631 - DNA, 22 bp, Homo sapiens
gacattaatttctttggtaatt

SEQ ID NO: 10001632 - DNA, 22 bp, Homo sapiens
gacctgagattttgaggctcat

SEQ ID NO: 10001633 - DNA, 22 bp, Homo sapiens
gacctgcctgagctgcctctgc

SEQ ID NO: 10001634 - DNA, 22 bp, Homo sapiens
gacctggaagaactgaggcctt

SEQ ID NO: 10001635 - DNA, 22 bp, Homo sapiens
gacctgctccacgacaagtggt

SEQ ID NO: 10001636 - DNA, 22 bp, Homo sapiens
gaatgctaagcatgtgggagtt

SEQ ID NO: 10001637 - DNA, 21 bp, Homo sapiens
gaagacaaatgggaatagctg

SEQ ID NO: 10001638 - DNA, 22 bp, Homo sapiens
gaatgcagatggctggtgtatg

SEQ ID NO: 10001639 - DNA, 22 bp, Homo sapiens
gaagaagtcattctgtctttca

SEQ ID NO: 10001640 - DNA, 22 bp, Homo sapiens
gaagaaggtgctacacagggca

SEQ ID NO: 10001641 - DNA, 22 bp, Homo sapiens
gaagaaggtggcccaggggtag

SEQ ID NO: 10001642 - DNA, 22 bp, Homo sapiens
gaagaagggagtgacaaatgca

SEQ ID NO: 10001643 - DNA, 22 bp, Homo sapiens
gaagaaggtgccagaggcttac

SEQ ID NO: 10001644 - DNA, 22 bp, Homo sapiens
gaagaaggtgccagaggcttac

SEQ ID NO: 10001645 - DNA, 22 bp, Homo sapiens
gaagaaggtgccagaggcttac

SEQ ID NO: 10001646 - DNA, 22 bp, Homo sapiens
gaagaaggtgctacacagggca

SEQ ID NO: 10001647 - DNA, 22 bp, Homo sapiens
gaagaattgcccatttctgtct

SEQ ID NO: 10001648 - DNA, 22 bp, Homo sapiens
gaagaatctgaggacagtcatt

SEQ ID NO: 10001649 - DNA, 22 bp, Homo sapiens
gaagaatattcttgatcttaga

SEQ ID NO: 10001650 - DNA, 22 bp, Homo sapiens
gaagaagtgtaagtctgtttca

SEQ ID NO: 10001651 - DNA, 19 bp, Homo sapiens
gaagaagttggaggatctc

SEQ ID NO: 10001652 - DNA, 22 bp, Homo sapiens
gaagaatatataatgattttgt

SEQ ID NO: 10001653 - DNA, 22 bp, Homo sapiens
gaagaatatggctctcagcaat

SEQ ID NO: 10001654 - DNA, 22 bp, Homo sapiens
gaatgtaaaattgcctacaaga

SEQ ID NO: 10001655 - DNA, 22 bp, Homo sapiens
gaatgtaaaattgcctacaaga

SEQ ID NO: 10001656 - DNA, 19 bp, Homo sapiens
gaatgggaatgggaaagct

SEQ ID NO: 10001657 - DNA, 19 bp, Homo sapiens
gaatgggaatgggaaagct

SEQ ID NO: 10001658 - DNA, 22 bp, Homo sapiens
gaatggctgaatgtcttaaatt

SEQ ID NO: 10001659 - DNA, 22 bp, Homo sapiens
gaatggctatcggattattagg

SEQ ID NO: 10001660 - DNA, 23 bp, Homo sapiens
gaatggctaagcacatagacttg

SEQ ID NO: 10001661 - DNA, 22 bp, Homo sapiens
gaatgctgtagacagactctat

SEQ ID NO: 10001662 - DNA, 22 bp, Homo sapiens
gaatgctgagtcttatctctta

SEQ ID NO: 10001663 - DNA, 22 bp, Homo sapiens
gaatgctggtgttcagaatttt

SEQ ID NO: 10001664 - DNA, 22 bp, Homo sapiens
gaatgctggcttacaggcagtt

SEQ ID NO: 10001665 - DNA, 22 bp, Homo sapiens
gaatttaaggaccaagcatttt

SEQ ID NO: 10001666 - DNA, 22 bp, Homo sapiens
gaattaaaatagttttggtcga

SEQ ID NO: 10001667 - DNA, 22 bp, Homo sapiens
gaatttatctacgttaagtatg

SEQ ID NO: 10001668 - DNA, 22 bp, Homo sapiens
gaatttacaagttgaataacaa

SEQ ID NO: 10001669 - DNA, 22 bp, Homo sapiens
gaatttttctggaagcaattat

SEQ ID NO: 10001670 - DNA, 22 bp, Homo sapiens
gaatttttctggaagcaattat

SEQ ID NO: 10001671 - DNA, 22 bp, Homo sapiens
gacaaaacacattagtttaaaa

SEQ ID NO: 10001672 - DNA, 22 bp, Homo sapiens
gacaaactgaagtatatttaga

SEQ ID NO: 10001673 - DNA, 21 bp, Homo sapiens
gacaaacatttcatagcttta

SEQ ID NO: 10001674 - DNA, 22 bp, Homo sapiens
gacaaagagaagtaacagtacc

SEQ ID NO: 10001675 - DNA, 22 bp, Homo sapiens
gacaaagagaagtaacagtacc

SEQ ID NO: 10001676 - DNA, 22 bp, Homo sapiens
gacaaagagaagtaacagtacc

SEQ ID NO: 10001677 - DNA, 21 bp, Homo sapiens
gacaaacatttcatagcttta

SEQ ID NO: 10001678 - DNA, 22 bp, Homo sapiens
gacaaaagtgttttgaacaagg

SEQ ID NO: 10001679 - DNA, 22 bp, Homo sapiens
gacaaaagtgttttgaacaagg

SEQ ID NO: 10001680 - DNA, 22 bp, Homo sapiens
gacaaaacacattagtttaaaa

SEQ ID NO: 10001681 - DNA, 22 bp, Homo sapiens
gacaaaactgagatcacactgt

SEQ ID NO: 10001682 - DNA, 22 bp, Homo sapiens
gacaaaactgagatcacactgt

SEQ ID NO: 10001683 - DNA, 22 bp, Homo sapiens
gacaaaactgagatcacactgt

SEQ ID NO: 10001684 - DNA, 18 bp, Homo sapiens
gacaaaagtacagacaga

SEQ ID NO: 10001685 - DNA, 18 bp, Homo sapiens
gacaaaagtacagacaga

SEQ ID NO: 10001686 - DNA, 22 bp, Homo sapiens
gacaaatgaagtcactgacctt

SEQ ID NO: 10001687 - DNA, 22 bp, Homo sapiens
gacaaataggtcaacaggaggg

SEQ ID NO: 10001688 - DNA, 22 bp, Homo sapiens
gacaaataggtcaacaggaggg

SEQ ID NO: 10001689 - DNA, 23 bp, Homo sapiens
gacaaagcacttgaaatgtgtac

SEQ ID NO: 10001690 - DNA, 22 bp, Homo sapiens
gacaaagcagacaagataattc

SEQ ID NO: 10001691 - DNA, 22 bp, Homo sapiens
gacaaagcgcctgctcgcgggc

SEQ ID NO: 10001692 - DNA, 22 bp, Homo sapiens
gacaaagctttggcatccttac

SEQ ID NO: 10001693 - DNA, 22 bp, Homo sapiens
gacaaagcctaagaagtattta

SEQ ID NO: 10001694 - DNA, 22 bp, Homo sapiens
gacaaatgaatgatgaacacca

SEQ ID NO: 10001695 - DNA, 22 bp, Homo sapiens
gacaacaataatgtggagctga

SEQ ID NO: 10001696 - DNA, 22 bp, Homo sapiens
gacaaatgtacccctagagtct

SEQ ID NO: 10001697 - DNA, 22 bp, Homo sapiens
gacagcagccacagggagaggg

SEQ ID NO: 10001698 - DNA, 22 bp, Homo sapiens
gacagcagccacagggagaggg

SEQ ID NO: 10001699 - DNA, 22 bp, Homo sapiens
gacaacacatgtatgccactct

SEQ ID NO: 10001700 - DNA, 22 bp, Homo sapiens
gacagcagggaaagtccagacc

SEQ ID NO: 10001701 - DNA, 22 bp, Homo sapiens
gacagcaggagatcatgataga

SEQ ID NO: 10001702 - DNA, 22 bp, Homo sapiens
gacagcaggatgtgaggggatg

SEQ ID NO: 10001703 - DNA, 22 bp, Homo sapiens
gagcagaacaggccgggtggga

SEQ ID NO: 10001704 - DNA, 22 bp, Homo sapiens
gagcagaacaggccgggtggga

SEQ ID NO: 10001705 - DNA, 22 bp, Homo sapiens
gagcagaactactcacatatcg

SEQ ID NO: 10001706 - DNA, 22 bp, Homo sapiens
gagcacccgtcggtggtaggaa

SEQ ID NO: 10001707 - DNA, 22 bp, Homo sapiens
gagcacagtccttttgttaaaa

SEQ ID NO: 10001708 - DNA, 22 bp, Homo sapiens
gagcacagtccttttgttaaaa

SEQ ID NO: 10001709 - DNA, 22 bp, Homo sapiens
gagcacagtaaagcagtgtcac

SEQ ID NO: 10001710 - DNA, 22 bp, Homo sapiens
gagcaggaaggccagaagggtc

SEQ ID NO: 10001711 - DNA, 22 bp, Homo sapiens
gagcaggaaggccagaagggtc

SEQ ID NO: 10001712 - DNA, 22 bp, Homo sapiens
gagcaggaaggccagaagggtc

SEQ ID NO: 10001713 - DNA, 22 bp, Homo sapiens
gagcaggacgtgggaatgggaa

SEQ ID NO: 10001714 - DNA, 22 bp, Homo sapiens
gagcagcttgcgctgtcttcac

SEQ ID NO: 10001715 - DNA, 22 bp, Homo sapiens
gagcagcttgcgctgtcttcac

SEQ ID NO: 10001716 - DNA, 22 bp, Homo sapiens
gagcaggaactgaaaatgagac

SEQ ID NO: 10001717 - DNA, 22 bp, Homo sapiens
gagcaggaactgaaaatgagac

SEQ ID NO: 10001718 - DNA, 22 bp, Homo sapiens
gagcagagaatccagctaagtg

SEQ ID NO: 10001719 - DNA, 22 bp, Homo sapiens
gagcagagacagtacaactggc

SEQ ID NO: 10001720 - DNA, 22 bp, Homo sapiens
gagcagagacagtacaactggc

SEQ ID NO: 10001721 - DNA, 22 bp, Homo sapiens
gagcagagacagtacaactggc

SEQ ID NO: 10001722 - DNA, 22 bp, Homo sapiens
gagcagagacagtacaactggc

SEQ ID NO: 10001723 - DNA, 22 bp, Homo sapiens
gagcagcttgcgctgtcttcac

SEQ ID NO: 10001724 - DNA, 19 bp, Homo sapiens
gagcagcttcctatctggt

SEQ ID NO: 10001725 - DNA, 19 bp, Homo sapiens
gagcagcttcctatctggt

SEQ ID NO: 10001726 - DNA, 22 bp, Homo sapiens
gagcagcttatgtcaagccaga

SEQ ID NO: 10001727 - DNA, 22 bp, Homo sapiens
gagcagagcttctcaaagtaaa

SEQ ID NO: 10001728 - DNA, 22 bp, Homo sapiens
gagcagagcttctcaaagtaaa

SEQ ID NO: 10001729 - DNA, 22 bp, Homo sapiens
gagcaaagcttttagggccttt

SEQ ID NO: 10001730 - DNA, 22 bp, Homo sapiens
gagcaacagggcgaggagaact

SEQ ID NO: 10001731 - DNA, 22 bp, Homo sapiens
gagcaacttcaatagtactatt

SEQ ID NO: 10001732 - DNA, 22 bp, Homo sapiens
gagcaagaccctgggttctctc

SEQ ID NO: 10001733 - DNA, 22 bp, Homo sapiens
gagcaagaccctgggttctctc

SEQ ID NO: 10001734 - DNA, 22 bp, Homo sapiens
gagaggcaggcgctgcaatggt

SEQ ID NO: 10001735 - DNA, 22 bp, Homo sapiens
gagatttagctgcttaactcct

SEQ ID NO: 10001736 - DNA, 22 bp, Homo sapiens
gagatttcttttgatgcctgtc

SEQ ID NO: 10001737 - DNA, 22 bp, Homo sapiens
gagatttcacccctcttaacct

SEQ ID NO: 10001738 - DNA, 22 bp, Homo sapiens
gagaggagtccctatcacagtt

SEQ ID NO: 10001739 - DNA, 22 bp, Homo sapiens
gagaggagtccctatcacagtt

SEQ ID NO: 10001740 - DNA, 22 bp, Homo sapiens
gagaggcagaggcctgaaaccg

SEQ ID NO: 10001741 - DNA, 22 bp, Homo sapiens
gagaggcaggaatcctgggtga

SEQ ID NO: 10001742 - DNA, 22 bp, Homo sapiens
gagcacagatcctggagccaca

SEQ ID NO: 10001743 - DNA, 22 bp, Homo sapiens
gagcaatagcaccaattaactc

SEQ ID NO: 10001744 - DNA, 22 bp, Homo sapiens
gagcaaggtagctctctggggc

SEQ ID NO: 10001745 - DNA, 22 bp, Homo sapiens
gagcaatacatggcatgaaatt

SEQ ID NO: 10001746 - DNA, 22 bp, Homo sapiens
gagcaatagaaagaatactgct

SEQ ID NO: 10001747 - DNA, 22 bp, Homo sapiens
gagcaaggcggcatctctctga

SEQ ID NO: 10001748 - DNA, 22 bp, Homo sapiens
gagcaaggtagctctctggggc

SEQ ID NO: 10001749 - DNA, 22 bp, Homo sapiens
gagcaaggatgggtctatagta

SEQ ID NO: 10001750 - DNA, 22 bp, Homo sapiens
gagcaaggatggccggggccgt

SEQ ID NO: 10001751 - DNA, 22 bp, Homo sapiens
gagcaagattttataagttgtg

SEQ ID NO: 10001752 - DNA, 22 bp, Homo sapiens
gagcaaggagggtggggccttt

SEQ ID NO: 10001753 - DNA, 22 bp, Homo sapiens
gagcaagattaaaaggctgggt

SEQ ID NO: 10001754 - DNA, 22 bp, Homo sapiens
gagcaagattaaaaggctgggt

SEQ ID NO: 10001755 - DNA, 22 bp, Homo sapiens
gagcaagatcctgtttttctat

SEQ ID NO: 10001756 - DNA, 22 bp, Homo sapiens
gagcaagatcctgtttttctat

SEQ ID NO: 10001757 - DNA, 22 bp, Homo sapiens
gagcaagactcactgcatcttg

SEQ ID NO: 10001758 - DNA, 22 bp, Homo sapiens
gagcaagactacaggcagatga

SEQ ID NO: 10001759 - DNA, 22 bp, Homo sapiens
gagcaagagtgttggactttga

SEQ ID NO: 10001760 - DNA, 22 bp, Homo sapiens
gagcaagactcactgcatcttg

SEQ ID NO: 10001761 - DNA, 22 bp, Homo sapiens
gagagccctcactccttccctg

SEQ ID NO: 10001762 - DNA, 22 bp, Homo sapiens
gagagctgtaatagtcatgtct

SEQ ID NO: 10001763 - DNA, 22 bp, Homo sapiens
gagagctgtaatagtcatgtct

SEQ ID NO: 10001764 - DNA, 22 bp, Homo sapiens
gagagctgtcagcgtagcaccg

SEQ ID NO: 10001765 - DNA, 22 bp, Homo sapiens
gagagctgtccggctgagcagc

SEQ ID NO: 10001766 - DNA, 22 bp, Homo sapiens
gagaggagacttatccagattg

SEQ ID NO: 10001767 - DNA, 18 bp, Homo sapiens
gagaggagccagaatttt

SEQ ID NO: 10001768 - DNA, 22 bp, Homo sapiens
gagaggagaagcctgcgcttca

SEQ ID NO: 10001769 - DNA, 22 bp, Homo sapiens
gagaggagtagacactttggtt

SEQ ID NO: 10001770 - DNA, 22 bp, Homo sapiens
gagaggagtagacactttggtt

SEQ ID NO: 10001771 - DNA, 22 bp, Homo sapiens
gagaggaggtggctatgacagc

SEQ ID NO: 10001772 - DNA, 22 bp, Homo sapiens
gagaggaggtggctatgacagc

SEQ ID NO: 10001773 - DNA, 18 bp, Homo sapiens
gagaggagccagaatttt

SEQ ID NO: 10001774 - DNA, 22 bp, Homo sapiens
gagaggaggtggctatgacagc

SEQ ID NO: 10001775 - DNA, 22 bp, Homo sapiens
gagaggaggtggctatgacagc

SEQ ID NO: 10001776 - DNA, 22 bp, Homo sapiens
gagaggagtaggctgatggtgc

SEQ ID NO: 10001777 - DNA, 22 bp, Homo sapiens
gagagacagcagaacgtgcagc

SEQ ID NO: 10001778 - DNA, 22 bp, Homo sapiens
gagagacagcacacagtgtggg

SEQ ID NO: 10001779 - DNA, 22 bp, Homo sapiens
gagagagaaaatgactccggac

SEQ ID NO: 10001780 - DNA, 22 bp, Homo sapiens
gagagagaaccccgtgcccttc

SEQ ID NO: 10001781 - DNA, 22 bp, Homo sapiens
gagagcatgtggtctagtttta

SEQ ID NO: 10001782 - DNA, 22 bp, Homo sapiens
gagagcaggaggcagcgggacg

SEQ ID NO: 10001783 - DNA, 22 bp, Homo sapiens
gagagcaggaggcagcgggacg

SEQ ID NO: 10001784 - DNA, 22 bp, Homo sapiens
gagaagcaggtttagcagacaa

SEQ ID NO: 10001785 - DNA, 22 bp, Homo sapiens
gagaagcaggtttagcagacaa

SEQ ID NO: 10001786 - DNA, 22 bp, Homo sapiens
gagaagcaatttccaactgtgc

SEQ ID NO: 10001787 - DNA, 22 bp, Homo sapiens
gagaagcaatcgtgacatctcc

SEQ ID NO: 10001788 - DNA, 22 bp, Homo sapiens
gagaagcaatcagcagccaccc

SEQ ID NO: 10001789 - DNA, 22 bp, Homo sapiens
gagaagcaatcagtggccaccc

SEQ ID NO: 10001790 - DNA, 22 bp, Homo sapiens
gagaagctggactttccaaact

SEQ ID NO: 10001791 - DNA, 22 bp, Homo sapiens
gagagaagaaagccatggtcct

SEQ ID NO: 10001792 - DNA, 22 bp, Homo sapiens
gagagaagggggatatgagcct

SEQ ID NO: 10001793 - DNA, 22 bp, Homo sapiens
gagagaagggacttctacactt

SEQ ID NO: 10001794 - DNA, 22 bp, Homo sapiens
gagagaagaatgttccgaggcc

SEQ ID NO: 10001795 - DNA, 22 bp, Homo sapiens
gactccagaatctggacggtcc

SEQ ID NO: 10001796 - DNA, 22 bp, Homo sapiens
gactccagagtgactatttgtc

SEQ ID NO: 10001797 - DNA, 22 bp, Homo sapiens
gactcagatttagagggtaaga

SEQ ID NO: 10001798 - DNA, 19 bp, Homo sapiens
gactccaactttaagcatg

SEQ ID NO: 10001799 - DNA, 19 bp, Homo sapiens
gactcacaccttccgctgt

SEQ ID NO: 10001800 - DNA, 22 bp, Homo sapiens
gactcagagatccctggaggtc

SEQ ID NO: 10001801 - DNA, 22 bp, Homo sapiens
gagaaagggaacttacagagtg

SEQ ID NO: 10001802 - DNA, 22 bp, Homo sapiens
gagaaagggaacttacagagtg

SEQ ID NO: 10001803 - DNA, 22 bp, Homo sapiens
gagaacagtgtcatcctataat

SEQ ID NO: 10001804 - DNA, 22 bp, Homo sapiens
gagaacaggctctggagtcaga

SEQ ID NO: 10001805 - DNA, 22 bp, Homo sapiens
gagaacaggctctggagtcaga

SEQ ID NO: 10001806 - DNA, 22 bp, Homo sapiens
gagaacaggctctggagtcaga

SEQ ID NO: 10001807 - DNA, 22 bp, Homo sapiens
gagaacttcaggattattcaag

SEQ ID NO: 10001808 - DNA, 22 bp, Homo sapiens
gagaacttgaacttttcctctg

SEQ ID NO: 10001809 - DNA, 22 bp, Homo sapiens
gagaactcagacgcaggtcatg

SEQ ID NO: 10001810 - DNA, 22 bp, Homo sapiens
gagaacagtgttgtattttttc

SEQ ID NO: 10001811 - DNA, 22 bp, Homo sapiens
gagaacagtgtcatcctataat

SEQ ID NO: 10001812 - DNA, 22 bp, Homo sapiens
gagaacctactgtatactatat

SEQ ID NO: 10001813 - DNA, 22 bp, Homo sapiens
gagaacctctccacaagtctgg

SEQ ID NO: 10001814 - DNA, 22 bp, Homo sapiens
gagaagaaatagaatcacattt

SEQ ID NO: 10001815 - DNA, 22 bp, Homo sapiens
gagaagaaaattccgtgaacac

SEQ ID NO: 10001816 - DNA, 22 bp, Homo sapiens
gagaagacgtgatggccaagaa

SEQ ID NO: 10001817 - DNA, 16 bp, Homo sapiens
gagaagagcccggcag

SEQ ID NO: 10001818 - DNA, 22 bp, Homo sapiens
gagaagaacttgggcaaagtca

SEQ ID NO: 10001819 - DNA, 22 bp, Homo sapiens
cttcttctggacaggcagctcc

SEQ ID NO: 10001820 - DNA, 22 bp, Homo sapiens
cttcttctggtttatgtggcaa

SEQ ID NO: 10001821 - DNA, 22 bp, Homo sapiens
cttcttcttcccccttcagggg

SEQ ID NO: 10001822 - DNA, 22 bp, Homo sapiens
cttgcctccctcagctcacagc

SEQ ID NO: 10001823 - DNA, 22 bp, Homo sapiens
cttgctgtcttgcatttagagc

SEQ ID NO: 10001824 - DNA, 19 bp, Homo sapiens
cttgctgggtggtttctgc

SEQ ID NO: 10001825 - DNA, 22 bp, Homo sapiens
cttcttctctacatcctttgat

SEQ ID NO: 10001826 - DNA, 22 bp, Homo sapiens
cttcttctcaaggggcaggtgg

SEQ ID NO: 10001827 - DNA, 22 bp, Homo sapiens
cttcttcctgaaagctggctct

SEQ ID NO: 10001828 - DNA, 22 bp, Homo sapiens
cttcttccaagcttatgctcaa

SEQ ID NO: 10001829 - DNA, 22 bp, Homo sapiens
cttgctttccaaatgactcact

SEQ ID NO: 10001830 - DNA, 22 bp, Homo sapiens
cttggaaagttatcattttcct

SEQ ID NO: 10001831 - DNA, 22 bp, Homo sapiens
cttgctgtgtggtgttctcaga

SEQ ID NO: 10001832 - DNA, 22 bp, Homo sapiens
cttgctgttgtgggagactggg

SEQ ID NO: 10001833 - DNA, 22 bp, Homo sapiens
cttgcttacctagttagctcca

SEQ ID NO: 10001834 - DNA, 22 bp, Homo sapiens
cttgctgttttctaccctcaag

SEQ ID NO: 10001835 - DNA, 22 bp, Homo sapiens
cttgcttgttttgaagaaagat

SEQ ID NO: 10001836 - DNA, 22 bp, Homo sapiens
cttggacttccaggaagtattt

SEQ ID NO: 10001837 - DNA, 22 bp, Homo sapiens
cttggactggacccgaggaatg

SEQ ID NO: 10001838 - DNA, 22 bp, Homo sapiens
cttggaattgatgattttcata

SEQ ID NO: 10001839 - DNA, 22 bp, Homo sapiens
cttggaatcaagtttttggaga

SEQ ID NO: 10001840 - DNA, 22 bp, Homo sapiens
cttggaatggggcagaaaatgg

SEQ ID NO: 10001841 - DNA, 22 bp, Homo sapiens
cttggaatggggcagaaaatgg

SEQ ID NO: 10001842 - DNA, 21 bp, Homo sapiens
cttggaacgggtagaactcac

SEQ ID NO: 10001843 - DNA, 22 bp, Homo sapiens
cttggaacaaattaaacaatac

SEQ ID NO: 10001844 - DNA, 22 bp, Homo sapiens
cttggaaggacgggctgtatct

SEQ ID NO: 10001845 - DNA, 22 bp, Homo sapiens
cttggagagggagaaaaataac

SEQ ID NO: 10001846 - DNA, 22 bp, Homo sapiens
ctttcctccactccctaggctt

SEQ ID NO: 10001847 - DNA, 22 bp, Homo sapiens
ctttcctgagaaaggagaagga

SEQ ID NO: 10001848 - DNA, 22 bp, Homo sapiens
ctttcctggctggcagttgtgg

SEQ ID NO: 10001849 - DNA, 23 bp, Homo sapiens
ctttcctttctttgacacccagc

SEQ ID NO: 10001850 - DNA, 22 bp, Homo sapiens
ctttccttaataagcaggtata

SEQ ID NO: 10001851 - DNA, 22 bp, Homo sapiens
ctttccttctcgtggttctcac

SEQ ID NO: 10001852 - DNA, 22 bp, Homo sapiens
cttggaggatgtgcggctgccc

SEQ ID NO: 10001853 - DNA, 22 bp, Homo sapiens
cttggaggaaaggcagggagac

SEQ ID NO: 10001854 - DNA, 22 bp, Homo sapiens
cttggaggaaaggcagggagac

SEQ ID NO: 10001855 - DNA, 22 bp, Homo sapiens
cttggagcaacacatgacatct

SEQ ID NO: 10001856 - DNA, 22 bp, Homo sapiens
cttggagcaacacatgacatct

SEQ ID NO: 10001857 - DNA, 22 bp, Homo sapiens
cttggagtcaataagatctaga

SEQ ID NO: 10001858 - DNA, 22 bp, Homo sapiens
cttggaggtggaagttgcagtg

SEQ ID NO: 10001859 - DNA, 22 bp, Homo sapiens
ctttccaactgggtgggcagct

SEQ ID NO: 10001860 - DNA, 22 bp, Homo sapiens
ctttccaccaactcacttccct

SEQ ID NO: 10001861 - DNA, 22 bp, Homo sapiens
ctttccaatgcatttccaatgt

SEQ ID NO: 10001862 - DNA, 22 bp, Homo sapiens
ctttccaagaatgcagatacct

SEQ ID NO: 10001863 - DNA, 22 bp, Homo sapiens
ctttcctagttggtcccagcac

SEQ ID NO: 10001864 - DNA, 22 bp, Homo sapiens
ctttcctagtagttacagaatg

SEQ ID NO: 10001865 - DNA, 20 bp, Homo sapiens
ctttctctaatttataagta

SEQ ID NO: 10001866 - DNA, 20 bp, Homo sapiens
ctttctctaatttataagta

SEQ ID NO: 10001867 - DNA, 20 bp, Homo sapiens
ctttctctaatttataagta

SEQ ID NO: 10001868 - DNA, 22 bp, Homo sapiens
ctttctaattctcccatagtct

SEQ ID NO: 10001869 - DNA, 22 bp, Homo sapiens
ctttctcagtgttaattacttt

SEQ ID NO: 10001870 - DNA, 22 bp, Homo sapiens
ctttctctgtgtttcacatgct

SEQ ID NO: 10001871 - DNA, 22 bp, Homo sapiens
ctttctctgtgtttcacatgct

SEQ ID NO: 10001872 - DNA, 22 bp, Homo sapiens
ctttctctgtgtttcacatgct

SEQ ID NO: 10001873 - DNA, 22 bp, Homo sapiens
ctttctcttacccaaggatctg

SEQ ID NO: 10001874 - DNA, 22 bp, Homo sapiens
ctttctcttcactgtcatgatc

SEQ ID NO: 10001875 - DNA, 22 bp, Homo sapiens
cttcttcatctgtaaaacttgg

SEQ ID NO: 10001876 - DNA, 20 bp, Homo sapiens
cttcttcagtagtttgttct

SEQ ID NO: 10001877 - DNA, 20 bp, Homo sapiens
cttcttcagcctatgcttca

SEQ ID NO: 10001878 - DNA, 22 bp, Homo sapiens
cttcttcagaggccagcctctg

SEQ ID NO: 10001879 - DNA, 22 bp, Homo sapiens
cttcttcaatagcaagcgcata

SEQ ID NO: 10001880 - DNA, 22 bp, Homo sapiens
cttcttcaatagcaagcgcata

SEQ ID NO: 10001881 - DNA, 22 bp, Homo sapiens
cttcccttggtgaacagagcat

SEQ ID NO: 10001882 - DNA, 22 bp, Homo sapiens
cttccctttagcatatagtagt

SEQ ID NO: 10001883 - DNA, 22 bp, Homo sapiens
cttccctttctggtgacttctc

SEQ ID NO: 10001884 - DNA, 22 bp, Homo sapiens
cttccctttagcatatagtagt

SEQ ID NO: 10001885 - DNA, 22 bp, Homo sapiens
cttccctttctggtgacttctc

SEQ ID NO: 10001886 - DNA, 22 bp, Homo sapiens
cttcccttggtgaacagagcat

SEQ ID NO: 10001887 - DNA, 22 bp, Homo sapiens
cttcccttggtgaacagagcat

SEQ ID NO: 10001888 - DNA, 22 bp, Homo sapiens
cttcccttctgtgcagggcaga

SEQ ID NO: 10001889 - DNA, 22 bp, Homo sapiens
cttcccttctgcagatctttgg

SEQ ID NO: 10001890 - DNA, 22 bp, Homo sapiens
cttcccttctgcagatctttgg

SEQ ID NO: 10001891 - DNA, 22 bp, Homo sapiens
cttcccagacggggtggcagcc

SEQ ID NO: 10001892 - DNA, 22 bp, Homo sapiens
cttcccagaacaatgtaggctt

SEQ ID NO: 10001893 - DNA, 22 bp, Homo sapiens
cttccccaggacctctgctaaa

SEQ ID NO: 10001894 - DNA, 22 bp, Homo sapiens
cttccctgataagagcctcaga

SEQ ID NO: 10001895 - DNA, 22 bp, Homo sapiens
cttcccttcccctcacggagac

SEQ ID NO: 10001896 - DNA, 22 bp, Homo sapiens
cttcccttcctggggcaattta

SEQ ID NO: 10001897 - DNA, 22 bp, Homo sapiens
cttcccttcctggggcaattta

SEQ ID NO: 10001898 - DNA, 21 bp, Homo sapiens
cttccccaggctggtctgtat

SEQ ID NO: 10001899 - DNA, 22 bp, Homo sapiens
cttcccccaaatcaagagacct

SEQ ID NO: 10001900 - DNA, 22 bp, Homo sapiens
cttccctctgctccttggtcca

SEQ ID NO: 10001901 - DNA, 19 bp, Homo sapiens
cttcccctgttacctcact

SEQ ID NO: 10001902 - DNA, 20 bp, Homo sapiens
ctgttaaaaggtatgaattc

SEQ ID NO: 10001903 - DNA, 20 bp, Homo sapiens
ctgttaaaaggtatgaattc

SEQ ID NO: 10001904 - DNA, 22 bp, Homo sapiens
ctgttaaaatgtggtcttaaaa

SEQ ID NO: 10001905 - DNA, 22 bp, Homo sapiens
ctgttaaagatagttaagcttc

SEQ ID NO: 10001906 - DNA, 22 bp, Homo sapiens
cttcaaagattattgaaaacaa

SEQ ID NO: 10001907 - DNA, 22 bp, Homo sapiens
cttcaaatacaagtagattatg

SEQ ID NO: 10001908 - DNA, 22 bp, Homo sapiens
cttcaaatccccctgagtttga

SEQ ID NO: 10001909 - DNA, 22 bp, Homo sapiens
cttcaaagggtcactatttatc

SEQ ID NO: 10001910 - DNA, 22 bp, Homo sapiens
cttcacagtcaccctgctgtgt

SEQ ID NO: 10001911 - DNA, 23 bp, Homo sapiens
cttcacaggttcaggggattaag

SEQ ID NO: 10001912 - DNA, 22 bp, Homo sapiens
cttcacagtaaatccagaagaa

SEQ ID NO: 10001913 - DNA, 22 bp, Homo sapiens
cttcacagccaacatgggcaca

SEQ ID NO: 10001914 - DNA, 22 bp, Homo sapiens
cttcacagatgctgagagggct

SEQ ID NO: 10001915 - DNA, 22 bp, Homo sapiens
cttcagaaactagtaacagcta

SEQ ID NO: 10001916 - DNA, 22 bp, Homo sapiens
cttcactttaagccaatcatga

SEQ ID NO: 10001917 - DNA, 22 bp, Homo sapiens
cttcacttgctcatcatgctat

SEQ ID NO: 10001918 - DNA, 22 bp, Homo sapiens
cttcagaaataacaacaattac

SEQ ID NO: 10001919 - DNA, 22 bp, Homo sapiens
cttcagaaataacaacaattac

SEQ ID NO: 10001920 - DNA, 22 bp, Homo sapiens
cttccaggacaccagggtagta

SEQ ID NO: 10001921 - DNA, 22 bp, Homo sapiens
cttcacattgggcttgatatga

SEQ ID NO: 10001922 - DNA, 22 bp, Homo sapiens
cttcactggaatctgtaatagt

SEQ ID NO: 10001923 - DNA, 22 bp, Homo sapiens
cttcactgagtagtctagactc

SEQ ID NO: 10001924 - DNA, 22 bp, Homo sapiens
ctttttctaatcataattgtct

SEQ ID NO: 10001925 - DNA, 22 bp, Homo sapiens
ctttttctaatcataattgtct

SEQ ID NO: 10001926 - DNA, 20 bp, Homo sapiens
ctttttctccagctctgagc

SEQ ID NO: 10001927 - DNA, 20 bp, Homo sapiens
ctttttctccagctctgagc

SEQ ID NO: 10001928 - DNA, 16 bp, Homo sapiens
ctttttctcccctctt

SEQ ID NO: 10001929 - DNA, 20 bp, Homo sapiens
ctttttctccagctctgagc

SEQ ID NO: 10001930 - DNA, 16 bp, Homo sapiens
ctttttctcccctctt

SEQ ID NO: 10001931 - DNA, 22 bp, Homo sapiens
ctttttctgatgttccatgatt

SEQ ID NO: 10001932 - DNA, 22 bp, Homo sapiens
ctttttctgatgttccatgatt

SEQ ID NO: 10001933 - DNA, 22 bp, Homo sapiens
ctttttcttctaggtgtgcctg

SEQ ID NO: 10001934 - DNA, 22 bp, Homo sapiens
ctttttcttctaggtgtgcctg

SEQ ID NO: 10001935 - DNA, 22 bp, Homo sapiens
ctttttgtctctgtcctgatga

SEQ ID NO: 10001936 - DNA, 22 bp, Homo sapiens
cttttgttctacagctggggaa

SEQ ID NO: 10001937 - DNA, 22 bp, Homo sapiens
cttttgttgcccttgtcgcagg

SEQ ID NO: 10001938 - DNA, 22 bp, Homo sapiens
cttttgttaggagaaaacatca

SEQ ID NO: 10001939 - DNA, 22 bp, Homo sapiens
cttttgttaggagaaaacatca

SEQ ID NO: 10001940 - DNA, 22 bp, Homo sapiens
ctttggaggtcatagccaagag

SEQ ID NO: 10001941 - DNA, 22 bp, Homo sapiens
ctttggaggtcatagccaagag

SEQ ID NO: 10001942 - DNA, 22 bp, Homo sapiens
ctttggcaacacatgtgggaca

SEQ ID NO: 10001943 - DNA, 22 bp, Homo sapiens
ctttggcaacacatgtgggaca

SEQ ID NO: 10001944 - DNA, 22 bp, Homo sapiens
ctttggaggacctatgtgcaat

SEQ ID NO: 10001945 - DNA, 22 bp, Homo sapiens
ctttggaatattttattgagaa

SEQ ID NO: 10001946 - DNA, 22 bp, Homo sapiens
ctttggaatattttattgagaa

SEQ ID NO: 10001947 - DNA, 22 bp, Homo sapiens
ctttggaataatttcctggagt

SEQ ID NO: 10001948 - DNA, 22 bp, Homo sapiens
ctttggaataatcaagctctga

SEQ ID NO: 10001949 - DNA, 22 bp, Homo sapiens
ctttggaacatactgctgagct

SEQ ID NO: 10001950 - DNA, 22 bp, Homo sapiens
ctttggaacacccagctctgtg

SEQ ID NO: 10001951 - DNA, 22 bp, Homo sapiens
ctttggaaggcagagctctgtg

SEQ ID NO: 10001952 - DNA, 22 bp, Homo sapiens
ctttggaaggaagacctttcag

SEQ ID NO: 10001953 - DNA, 22 bp, Homo sapiens
gaaaaatgagctgatgtcaggg

SEQ ID NO: 10001954 - DNA, 22 bp, Homo sapiens
gaaaccagctagaggcagaggg

SEQ ID NO: 10001955 - DNA, 22 bp, Homo sapiens
cttttttcctaaggcaacatga

SEQ ID NO: 10001956 - DNA, 22 bp, Homo sapiens
cttttttaaggtagctcctcct

SEQ ID NO: 10001957 - DNA, 22 bp, Homo sapiens
ctttttgtgtatgctacagttg

SEQ ID NO: 10001958 - DNA, 22 bp, Homo sapiens
gaaaaagtgaccttggtagcta

SEQ ID NO: 10001959 - DNA, 22 bp, Homo sapiens
gaaaaagtgaccttggtagcta

SEQ ID NO: 10001960 - DNA, 22 bp, Homo sapiens
cttttttcctaaggcaacatga

SEQ ID NO: 10001961 - DNA, 22 bp, Homo sapiens
gaaagaagctttagatggctat

SEQ ID NO: 10001962 - DNA, 22 bp, Homo sapiens
gaaacttttaaacctcatgagt

SEQ ID NO: 10001963 - DNA, 22 bp, Homo sapiens
gaaacttgataattgaaacaga

SEQ ID NO: 10001964 - DNA, 22 bp, Homo sapiens
gaaacttgcctgaagtcaacca

SEQ ID NO: 10001965 - DNA, 22 bp, Homo sapiens
gaaactttcatgaatataagat

SEQ ID NO: 10001966 - DNA, 22 bp, Homo sapiens
gaaactttcatgaatataagat

SEQ ID NO: 10001967 - DNA, 22 bp, Homo sapiens
gaaactttggctaaaagccaga

SEQ ID NO: 10001968 - DNA, 22 bp, Homo sapiens
gaaactgtttctggctttggtg

SEQ ID NO: 10001969 - DNA, 22 bp, Homo sapiens
gaaactgtgaggatcttaactt

SEQ ID NO: 10001970 - DNA, 22 bp, Homo sapiens
gaaactgtttctggctttggtg

SEQ ID NO: 10001971 - DNA, 22 bp, Homo sapiens
gaaacttacttactcacatttc

SEQ ID NO: 10001972 - DNA, 22 bp, Homo sapiens
gaaacttcttgtctcacagttc

SEQ ID NO: 10001973 - DNA, 22 bp, Homo sapiens
gaaacctatttataacttctag

SEQ ID NO: 10001974 - DNA, 22 bp, Homo sapiens
gaaacgttaaaccatatgtaat

SEQ ID NO: 10001975 - DNA, 22 bp, Homo sapiens
gaaacgttggcataagtttatg

SEQ ID NO: 10001976 - DNA, 22 bp, Homo sapiens
gaaacgttgtggaaaatcctct

SEQ ID NO: 10001977 - DNA, 22 bp, Homo sapiens
gaaactctcgcatcctgggaac

SEQ ID NO: 10001978 - DNA, 22 bp, Homo sapiens
gaaactctcgcatcctgggaac

SEQ ID NO: 10001979 - DNA, 22 bp, Homo sapiens
gaaatattcttgtcttgttttc

SEQ ID NO: 10001980 - DNA, 22 bp, Homo sapiens
gaaatattcttgtcttgttttc

SEQ ID NO: 10001981 - DNA, 22 bp, Homo sapiens
gaaatattcttgtcttgttttc

SEQ ID NO: 10001982 - DNA, 22 bp, Homo sapiens
gaaatatacattgcaggaagag

SEQ ID NO: 10001983 - DNA, 22 bp, Homo sapiens
gaaatattacagtggaggggat

SEQ ID NO: 10001984 - DNA, 22 bp, Homo sapiens
gaaatattacagtggaggggat

SEQ ID NO: 10001985 - DNA, 22 bp, Homo sapiens
gaaatatacattgcaggaagag

SEQ ID NO: 10001986 - DNA, 22 bp, Homo sapiens
gaaagagaacctgggcctagat

SEQ ID NO: 10001987 - DNA, 22 bp, Homo sapiens
gaaatacagaaagggctgaatg

SEQ ID NO: 10001988 - DNA, 22 bp, Homo sapiens
gaaagacatagttgcaagatgg

SEQ ID NO: 10001989 - DNA, 22 bp, Homo sapiens
gaaagactaactagaaagtgca

SEQ ID NO: 10001990 - DNA, 22 bp, Homo sapiens
gaaagactaactagaaagtgca

SEQ ID NO: 10001991 - DNA, 22 bp, Homo sapiens
gaaagacatagttgcaagatgg

SEQ ID NO: 10001992 - DNA, 22 bp, Homo sapiens
gaaatattgggactcagagctt

SEQ ID NO: 10001993 - DNA, 22 bp, Homo sapiens
gaaatattgtactggagatgtt

SEQ ID NO: 10001994 - DNA, 22 bp, Homo sapiens
gaaatattgggactcagagctt

SEQ ID NO: 10001995 - DNA, 22 bp, Homo sapiens
gaaatattgtactggagatgtt

SEQ ID NO: 10001996 - DNA, 22 bp, Homo sapiens
gaaatattgtactggagatgtt

SEQ ID NO: 10001997 - DNA, 22 bp, Homo sapiens
gaaatgtagaattgcttaactg

SEQ ID NO: 10001998 - DNA, 22 bp, Homo sapiens
gaaatgtagagtatctgaggat

SEQ ID NO: 10001999 - DNA, 22 bp, Homo sapiens
gaaatgtagaattgcttaactg

SEQ ID NO: 10002000 - DNA, 22 bp, Homo sapiens
gaaatgtagagtatctgaggat

SEQ ID NO: 10002001 - DNA, 22 bp, Homo sapiens
gaaatgtcattgccttcagccc

SEQ ID NO: 10002002 - DNA, 20 bp, Homo sapiens
gaaatgtatctcttgattct

SEQ ID NO: 10002003 - DNA, 22 bp, Homo sapiens
gaaatgtaggcataattatttt

SEQ ID NO: 10002004 - DNA, 22 bp, Homo sapiens
gaaatgtaggcataattatttt

SEQ ID NO: 10002005 - DNA, 22 bp, Homo sapiens
gaaatgtataagctggtctttt

SEQ ID NO: 10002006 - DNA, 20 bp, Homo sapiens
gaaatgtatctcttgattct

SEQ ID NO: 10002007 - DNA, 22 bp, Homo sapiens
gaaatgtatgtcttcccccatt

SEQ ID NO: 10002008 - DNA, 22 bp, Homo sapiens
gaaatgtatttgacagtccttg

SEQ ID NO: 10002009 - DNA, 22 bp, Homo sapiens
gaaattgccagatctagtagat

SEQ ID NO: 10002010 - DNA, 22 bp, Homo sapiens
gaaattcaggacaaagactctt

SEQ ID NO: 10002011 - DNA, 22 bp, Homo sapiens
gaaattcaggacaaagactctt

SEQ ID NO: 10002012 - DNA, 22 bp, Homo sapiens
gaaattcactgtatttcttggg

SEQ ID NO: 10002013 - DNA, 22 bp, Homo sapiens
gaaattaagcaggggtctgtgg

SEQ ID NO: 10002014 - DNA, 22 bp, Homo sapiens
gaaattaagcaggggtctgtgg

SEQ ID NO: 10002015 - DNA, 22 bp, Homo sapiens
gaaattattgctagagactgca

SEQ ID NO: 10002016 - DNA, 22 bp, Homo sapiens
gaaattcaaaatgtcagtatag

SEQ ID NO: 10002017 - DNA, 22 bp, Homo sapiens
gaaattaagcaggggtctgtgg

SEQ ID NO: 10002018 - DNA, 22 bp, Homo sapiens
gaaattcaaataagatatgtag

SEQ ID NO: 10002019 - DNA, 22 bp, Homo sapiens
gaaatgttatgagatatgtact

SEQ ID NO: 10002020 - DNA, 22 bp, Homo sapiens
gaaatgttcctgatccctgatt

SEQ ID NO: 10002021 - DNA, 22 bp, Homo sapiens
gaaatgttgtctctgcagcaat

SEQ ID NO: 10002022 - DNA, 22 bp, Homo sapiens
gaaatgttgtcctgtctcttga

SEQ ID NO: 10002023 - DNA, 22 bp, Homo sapiens
gaaatgttggacacttgaaatt

SEQ ID NO: 10002024 - DNA, 23 bp, Homo sapiens
gaaatgtttcttgattaatccta

SEQ ID NO: 10002025 - DNA, 22 bp, Homo sapiens
gaaatgtttccttttgtatgct

SEQ ID NO: 10002026 - DNA, 22 bp, Homo sapiens
gaaatgttttacaaggcatact

SEQ ID NO: 10002027 - DNA, 22 bp, Homo sapiens
gaaatgtttgggaggagtcaac

SEQ ID NO: 10002028 - DNA, 22 bp, Homo sapiens
gaaattaaccacctttggcttt

SEQ ID NO: 10002029 - DNA, 22 bp, Homo sapiens
gaagaagacatggaacaatagt

SEQ ID NO: 10002030 - DNA, 22 bp, Homo sapiens
gaagaagcaggagtgtgtagca

SEQ ID NO: 10002031 - DNA, 19 bp, Homo sapiens
gaagaagcttgagaagtag

SEQ ID NO: 10002032 - DNA, 16 bp, Homo sapiens
gaagaaggaaaactac

SEQ ID NO: 10002033 - DNA, 17 bp, Homo sapiens
gaagaaggaatctagaa

SEQ ID NO: 10002034 - DNA, 22 bp, Homo sapiens
gaagaagggagtgacaaatgca

SEQ ID NO: 10002035 - DNA, 17 bp, Homo sapiens
gaagaaggaatctagaa

SEQ ID NO: 10002036 - DNA, 17 bp, Homo sapiens
gaagaaggaatctagaa

SEQ ID NO: 10002037 - DNA, 22 bp, Homo sapiens
gaagaagggagtgacaaatgca

SEQ ID NO: 10002038 - DNA, 22 bp, Homo sapiens
gaacttcacgatagccaaagct

SEQ ID NO: 10002039 - DNA, 22 bp, Homo sapiens
gaacttcagaatcagcatatct

SEQ ID NO: 10002040 - DNA, 17 bp, Homo sapiens
gaacttgttcactgtga

SEQ ID NO: 10002041 - DNA, 22 bp, Homo sapiens
gaactttaaaacaaagtacagt

SEQ ID NO: 10002042 - DNA, 22 bp, Homo sapiens
gaacttgggagaagggagtgtg

SEQ ID NO: 10002043 - DNA, 22 bp, Homo sapiens
gaagaacacttcatgattcatt

SEQ ID NO: 10002044 - DNA, 22 bp, Homo sapiens
gaagaacacttcatgattcatt

SEQ ID NO: 10002045 - DNA, 22 bp, Homo sapiens
gaagaacacctgctgcccagtg

SEQ ID NO: 10002046 - DNA, 22 bp, Homo sapiens
gaagaacaagcagtgctttcct

SEQ ID NO: 10002047 - DNA, 22 bp, Homo sapiens
gaagaaatgtgttcaaggtagg

SEQ ID NO: 10002048 - DNA, 22 bp, Homo sapiens
ctgtggggaaagggtcctgctc

SEQ ID NO: 10002049 - DNA, 22 bp, Homo sapiens
ctgtgggctcctgcagctcagg

SEQ ID NO: 10002050 - DNA, 22 bp, Homo sapiens
ctgtgggctgaaagtgctcccg

SEQ ID NO: 10002051 - DNA, 22 bp, Homo sapiens
ctgtgggctgaaagtgctcccg

SEQ ID NO: 10002052 - DNA, 18 bp, Homo sapiens
ctgtgggctggtgcatga

SEQ ID NO: 10002053 - DNA, 22 bp, Homo sapiens
ctgtggtcaccaggctggggcc

SEQ ID NO: 10002054 - DNA, 22 bp, Homo sapiens
ctgtgtcttctgttttgaagtt

SEQ ID NO: 10002055 - DNA, 22 bp, Homo sapiens
ctgtggtggcacagcgggctgg

SEQ ID NO: 10002056 - DNA, 22 bp, Homo sapiens
ctgtgtctttcctactttgtgg

SEQ ID NO: 10002057 - DNA, 22 bp, Homo sapiens
ctgtgtcttgagtaattcggtg

SEQ ID NO: 10002058 - DNA, 22 bp, Homo sapiens
ctgtgtctttcctactttgtgg

SEQ ID NO: 10002059 - DNA, 22 bp, Homo sapiens
ctgtgtgaatagtgaggtctat

SEQ ID NO: 10002060 - DNA, 22 bp, Homo sapiens
ctgtgtgtgaacacagcccagc

SEQ ID NO: 10002061 - DNA, 22 bp, Homo sapiens
ctgtggtgagcaactgactgaa

SEQ ID NO: 10002062 - DNA, 22 bp, Homo sapiens
ctgtggtggcacagcgggctgg

SEQ ID NO: 10002063 - DNA, 20 bp, Homo sapiens
ctgtggtgagcaggagagta

SEQ ID NO: 10002064 - DNA, 22 bp, Homo sapiens
ctgtgtgtgagaagcaggttga

SEQ ID NO: 10002065 - DNA, 22 bp, Homo sapiens
ctgtgtgtgagaagcaggttga

SEQ ID NO: 10002066 - DNA, 22 bp, Homo sapiens
ctgtgtgtgaacacagcccagc

SEQ ID NO: 10002067 - DNA, 22 bp, Homo sapiens
ctgtgtgtgagaagcaggttga

SEQ ID NO: 10002068 - DNA, 22 bp, Homo sapiens
ctgtgtgtgagaagcaggttga

SEQ ID NO: 10002069 - DNA, 23 bp, Homo sapiens
ctgtgtgtgccgagggtggccac

SEQ ID NO: 10002070 - DNA, 23 bp, Homo sapiens
ctgtgtgtgccgagggtggccac

SEQ ID NO: 10002071 - DNA, 23 bp, Homo sapiens
ctgtgtgtgccgagggtggccac

SEQ ID NO: 10002072 - DNA, 22 bp, Homo sapiens
ctgtgtgtgctacaggcttcca

SEQ ID NO: 10002073 - DNA, 22 bp, Homo sapiens
ctgtgtgtgctacaggcttcca

SEQ ID NO: 10002074 - DNA, 22 bp, Homo sapiens
ctgtgtgtgctacaggcttcca

SEQ ID NO: 10002075 - DNA, 22 bp, Homo sapiens
ctgtgtgtgtctgcagcatact

SEQ ID NO: 10002076 - DNA, 22 bp, Homo sapiens
ctgtgtgtgtctgcagcatact

SEQ ID NO: 10002077 - DNA, 22 bp, Homo sapiens
ctgtgtgtgtctgcagcatact

SEQ ID NO: 10002078 - DNA, 22 bp, Homo sapiens
ctgtgtgtgtctgcagcatact

SEQ ID NO: 10002079 - DNA, 22 bp, Homo sapiens
ctgtgtgtgtctgcagcatact

SEQ ID NO: 10002080 - DNA, 22 bp, Homo sapiens
ctgtgtttttggtctgatctat

SEQ ID NO: 10002081 - DNA, 22 bp, Homo sapiens
ctgtgtgtttatatcatttcct

SEQ ID NO: 10002082 - DNA, 22 bp, Homo sapiens
ctgtgtgtttatatcatttcct

SEQ ID NO: 10002083 - DNA, 22 bp, Homo sapiens
ctgtgtgtttatatcatttcct

SEQ ID NO: 10002084 - DNA, 22 bp, Homo sapiens
ctgtgtttctaagtaaaggagc

SEQ ID NO: 10002085 - DNA, 22 bp, Homo sapiens
ctgtggatttaggcagagctga

SEQ ID NO: 10002086 - DNA, 22 bp, Homo sapiens
ctgtggcaggaagggactagca

SEQ ID NO: 10002087 - DNA, 22 bp, Homo sapiens
ctgtggcaggaagggactagca

SEQ ID NO: 10002088 - DNA, 22 bp, Homo sapiens
ctgtggcacatgtggcaaggcc

SEQ ID NO: 10002089 - DNA, 20 bp, Homo sapiens
ctgtggcatctgtcatggtg

SEQ ID NO: 10002090 - DNA, 22 bp, Homo sapiens
ctgtggcattgccgaggctggc

SEQ ID NO: 10002091 - DNA, 22 bp, Homo sapiens
ctgtggcattgccgaggctggc

SEQ ID NO: 10002092 - DNA, 22 bp, Homo sapiens
ctgtggcattgccgaggctggc

SEQ ID NO: 10002093 - DNA, 22 bp, Homo sapiens
ctgtggcattgtgaggactgca

SEQ ID NO: 10002094 - DNA, 22 bp, Homo sapiens
ctgtggcaggaagggactagca

SEQ ID NO: 10002095 - DNA, 22 bp, Homo sapiens
ctgtggcagggaagaggccatg

SEQ ID NO: 10002096 - DNA, 22 bp, Homo sapiens
ctgtggcaggtgtctggggcag

SEQ ID NO: 10002097 - DNA, 22 bp, Homo sapiens
ctgtggcaggtgtctggggcag

SEQ ID NO: 10002098 - DNA, 22 bp, Homo sapiens
ctgtggcaggtgtctggggcag

SEQ ID NO: 10002099 - DNA, 20 bp, Homo sapiens
ctgtggcatctgtcatggtg

SEQ ID NO: 10002100 - DNA, 20 bp, Homo sapiens
ctgtggcatctgtcatggtg

SEQ ID NO: 10002101 - DNA, 22 bp, Homo sapiens
ctgtgggcatttgagtgtgggt

SEQ ID NO: 10002102 - DNA, 22 bp, Homo sapiens
ctgtgggcctagtctggcctag

SEQ ID NO: 10002103 - DNA, 22 bp, Homo sapiens
ctgtgggctcccagcttctctc

SEQ ID NO: 10002104 - DNA, 22 bp, Homo sapiens
ctgtgggcgcctgtcagcctca

SEQ ID NO: 10002105 - DNA, 22 bp, Homo sapiens
ctgtgggcctagtctggcctag

SEQ ID NO: 10002106 - DNA, 20 bp, Homo sapiens
ctgtgggcctcacttggggt

SEQ ID NO: 10002107 - DNA, 22 bp, Homo sapiens
ctgtgggcctgatgttcttctc

SEQ ID NO: 10002108 - DNA, 20 bp, Homo sapiens
ctgtgggcctcacttggggt

SEQ ID NO: 10002109 - DNA, 23 bp, Homo sapiens
ctgtggccacccctagctggagg

SEQ ID NO: 10002110 - DNA, 22 bp, Homo sapiens
ctgtggcttcagcattcagagc

SEQ ID NO: 10002111 - DNA, 22 bp, Homo sapiens
ctgtggctttctctgcctcctt

SEQ ID NO: 10002112 - DNA, 22 bp, Homo sapiens
ctgtgggagggtgagagaacca

SEQ ID NO: 10002113 - DNA, 22 bp, Homo sapiens
ctgtgggagggaaggcgcggcc

SEQ ID NO: 10002114 - DNA, 22 bp, Homo sapiens
ctgtctgttgaccatagtttgc

SEQ ID NO: 10002115 - DNA, 22 bp, Homo sapiens
ctgtctgttcagattcattact

SEQ ID NO: 10002116 - DNA, 22 bp, Homo sapiens
ctgtctgttatctcaccagtcc

SEQ ID NO: 10002117 - DNA, 22 bp, Homo sapiens
ctgtctgttatctcaccagtcc

SEQ ID NO: 10002118 - DNA, 22 bp, Homo sapiens
ctgtctgtggtctcagtaggcc

SEQ ID NO: 10002119 - DNA, 22 bp, Homo sapiens
ctgtctgtgtggacacggctgc

SEQ ID NO: 10002120 - DNA, 22 bp, Homo sapiens
ctgtccctcatcacctctgggt

SEQ ID NO: 10002121 - DNA, 22 bp, Homo sapiens
ctgtgacagtttctcagacttt

SEQ ID NO: 10002122 - DNA, 22 bp, Homo sapiens
ctgtgaatgctagtaagagtgc

SEQ ID NO: 10002123 - DNA, 22 bp, Homo sapiens
ctgtgaaatgctttgcgatggt

SEQ ID NO: 10002124 - DNA, 22 bp, Homo sapiens
ctgtgaattgaatatgactatg

SEQ ID NO: 10002125 - DNA, 22 bp, Homo sapiens
ctgtgagacctgatttcttcat

SEQ ID NO: 10002126 - DNA, 22 bp, Homo sapiens
ctgtgagagtggtggcctaggc

SEQ ID NO: 10002127 - DNA, 22 bp, Homo sapiens
ctgtgagggcagggaccagagg

SEQ ID NO: 10002128 - DNA, 22 bp, Homo sapiens
ctgtgaggcgggtggagtggag

SEQ ID NO: 10002129 - DNA, 22 bp, Homo sapiens
ctgtgaggcgggtggagtggag

SEQ ID NO: 10002130 - DNA, 22 bp, Homo sapiens
ctgtgagggcagggaccagagg

SEQ ID NO: 10002131 - DNA, 22 bp, Homo sapiens
ctgtgaggcctttggccagata

SEQ ID NO: 10002132 - DNA, 22 bp, Homo sapiens
ctgtgaggcggaaaggactctc

SEQ ID NO: 10002133 - DNA, 22 bp, Homo sapiens
ctgtgaggcctttggccagata

SEQ ID NO: 10002134 - DNA, 22 bp, Homo sapiens
ctgtgagctgggtggccaggac

SEQ ID NO: 10002135 - DNA, 22 bp, Homo sapiens
ctgtcatcacagttgagcagcc

SEQ ID NO: 10002136 - DNA, 22 bp, Homo sapiens
ctgtcagttcttccagatagag

SEQ ID NO: 10002137 - DNA, 22 bp, Homo sapiens
ctgtcagtaggctcccatcatt

SEQ ID NO: 10002138 - DNA, 22 bp, Homo sapiens
ctgtccagtgactttgggccat

SEQ ID NO: 10002139 - DNA, 22 bp, Homo sapiens
ctggttttgcccagtcttgcac

SEQ ID NO: 10002140 - DNA, 22 bp, Homo sapiens
ctggttttgaatatgtctgctt

SEQ ID NO: 10002141 - DNA, 22 bp, Homo sapiens
ctggtttgcccacaccagccac

SEQ ID NO: 10002142 - DNA, 22 bp, Homo sapiens
ctggttctgatgttcttggctt

SEQ ID NO: 10002143 - DNA, 22 bp, Homo sapiens
ctggttctgattttgctgcatt

SEQ ID NO: 10002144 - DNA, 22 bp, Homo sapiens
ctggttctgatgttcttggctt

SEQ ID NO: 10002145 - DNA, 18 bp, Homo sapiens
ctgtcccatcctcaggtt

SEQ ID NO: 10002146 - DNA, 22 bp, Homo sapiens
ctgtccccacccaaatctcatc

SEQ ID NO: 10002147 - DNA, 20 bp, Homo sapiens
ctgtccccgaggtcaccagg

SEQ ID NO: 10002148 - DNA, 20 bp, Homo sapiens
ctgtccccgaggtcaccagg

SEQ ID NO: 10002149 - DNA, 22 bp, Homo sapiens
ctgtccccgcgagtccagagct

SEQ ID NO: 10002150 - DNA, 22 bp, Homo sapiens
ctgtcccacaagcagtgtgcac

SEQ ID NO: 10002151 - DNA, 22 bp, Homo sapiens
ctgtccattttgaattttcagt

SEQ ID NO: 10002152 - DNA, 22 bp, Homo sapiens
ctgtccattggtatattagggt

SEQ ID NO: 10002153 - DNA, 22 bp, Homo sapiens
ctgtccattttcgtgcctcctt

SEQ ID NO: 10002154 - DNA, 22 bp, Homo sapiens
ctgtccatgttaagccccttgc

SEQ ID NO: 10002155 - DNA, 22 bp, Homo sapiens
ctgtccatggtgctggacggtc

SEQ ID NO: 10002156 - DNA, 22 bp, Homo sapiens
ctgtccagtgcagagaacagag

SEQ ID NO: 10002157 - DNA, 20 bp, Homo sapiens
ctgtccatatttgaaaatgc

SEQ ID NO: 10002158 - DNA, 22 bp, Homo sapiens
ctgtccatattcaaggggtagg

SEQ ID NO: 10002159 - DNA, 22 bp, Homo sapiens
ctgtccatggtccttattacca

SEQ ID NO: 10002160 - DNA, 22 bp, Homo sapiens
ctgtccatggcaatgatgcaga

SEQ ID NO: 10002161 - DNA, 22 bp, Homo sapiens
ctgtccatgcatgttgtctgct

SEQ ID NO: 10002162 - DNA, 22 bp, Homo sapiens
ctgtccatcagaaaggggctta

SEQ ID NO: 10002163 - DNA, 22 bp, Homo sapiens
ctgtccatgacttgcactataa

SEQ ID NO: 10002164 - DNA, 22 bp, Homo sapiens
ctgtcccaggagctgtaagaca

SEQ ID NO: 10002165 - DNA, 22 bp, Homo sapiens
ctgtcccagatgttctcagcac

SEQ ID NO: 10002166 - DNA, 22 bp, Homo sapiens
ctgggctcagtgtctcactcct

SEQ ID NO: 10002167 - DNA, 22 bp, Homo sapiens
ctgggctcagtggctcatggct

SEQ ID NO: 10002168 - DNA, 22 bp, Homo sapiens
ctgggctcagtggctcatggct

SEQ ID NO: 10002169 - DNA, 22 bp, Homo sapiens
ctgggctcaaatcctggccctg

SEQ ID NO: 10002170 - DNA, 22 bp, Homo sapiens
ctgggcctcatgcacagagatg

SEQ ID NO: 10002171 - DNA, 22 bp, Homo sapiens
ctgggcctccagctctgccagc

SEQ ID NO: 10002172 - DNA, 22 bp, Homo sapiens
ctgggcctcaatctcagagttt

SEQ ID NO: 10002173 - DNA, 22 bp, Homo sapiens
ctgggcctcaccctagaccaat

SEQ ID NO: 10002174 - DNA, 22 bp, Homo sapiens
ctgggcctcatccccagagttt

SEQ ID NO: 10002175 - DNA, 22 bp, Homo sapiens
ctgggcctcatcctcagagttt

SEQ ID NO: 10002176 - DNA, 22 bp, Homo sapiens
ctgggcctaggatggaagggcc

SEQ ID NO: 10002177 - DNA, 22 bp, Homo sapiens
ctgggcctaggatggaagggcc

SEQ ID NO: 10002178 - DNA, 22 bp, Homo sapiens
ctgggcctagcaacagaggagt

SEQ ID NO: 10002179 - DNA, 22 bp, Homo sapiens
ctgggcctagaggaagctgaca

SEQ ID NO: 10002180 - DNA, 22 bp, Homo sapiens
ctgggcctagcaacagaggagt

SEQ ID NO: 10002181 - DNA, 22 bp, Homo sapiens
ctgggcctagcaacagaggagt

SEQ ID NO: 10002182 - DNA, 22 bp, Homo sapiens
ctgggccctatggaagaaaggg

SEQ ID NO: 10002183 - DNA, 22 bp, Homo sapiens
ctgggcctagaggaagctgaca

SEQ ID NO: 10002184 - DNA, 22 bp, Homo sapiens
ctggagctccagggtctcctct

SEQ ID NO: 10002185 - DNA, 22 bp, Homo sapiens
ctggagctccagggtctcctct

SEQ ID NO: 10002186 - DNA, 22 bp, Homo sapiens
ctgggaggcggaggttgcagtg

SEQ ID NO: 10002187 - DNA, 22 bp, Homo sapiens
ctggagctccagggtctcctct

SEQ ID NO: 10002188 - DNA, 22 bp, Homo sapiens
ctggagctccagggtctcctct

SEQ ID NO: 10002189 - DNA, 22 bp, Homo sapiens
ctgggaggcggaggttgcagtg

SEQ ID NO: 10002190 - DNA, 22 bp, Homo sapiens
ctggagctcagcccaggttcca

SEQ ID NO: 10002191 - DNA, 22 bp, Homo sapiens
ctggagctaggaagtccaagat

SEQ ID NO: 10002192 - DNA, 22 bp, Homo sapiens
ctggagctcagcccaggttcca

SEQ ID NO: 10002193 - DNA, 22 bp, Homo sapiens
ctggagctaggaagtccaagat

SEQ ID NO: 10002194 - DNA, 22 bp, Homo sapiens
ctggagccttcaccaggggaaa

SEQ ID NO: 10002195 - DNA, 22 bp, Homo sapiens
ctggagccttcaccaggggaaa

SEQ ID NO: 10002196 - DNA, 22 bp, Homo sapiens
ctgggagtcaccaggagcaagg

SEQ ID NO: 10002197 - DNA, 22 bp, Homo sapiens
ctgggaggcggaggttgcagtg

SEQ ID NO: 10002198 - DNA, 22 bp, Homo sapiens
ctgggagtgaaaggagggctgc

SEQ ID NO: 10002199 - DNA, 22 bp, Homo sapiens
ctgggagtgaaaggagggctgc

SEQ ID NO: 10002200 - DNA, 22 bp, Homo sapiens
ctgggagttgacgaggcttgta

SEQ ID NO: 10002201 - DNA, 22 bp, Homo sapiens
ctgggagtgtccctctggtaat

SEQ ID NO: 10002202 - DNA, 22 bp, Homo sapiens
ctgggatgatagtgctagtatt

SEQ ID NO: 10002203 - DNA, 22 bp, Homo sapiens
ctgggatgcggaggttgcggtg

SEQ ID NO: 10002204 - DNA, 22 bp, Homo sapiens
ctgggatccacgggctcccaag

SEQ ID NO: 10002205 - DNA, 22 bp, Homo sapiens
ctgggccaggaccagggttgaa

SEQ ID NO: 10002206 - DNA, 22 bp, Homo sapiens
ctgggcccacgagggctctggg

SEQ ID NO: 10002207 - DNA, 22 bp, Homo sapiens
ctgggatggctccgctgctgct

SEQ ID NO: 10002208 - DNA, 22 bp, Homo sapiens
ctgggggtcgcgcctctgggca

SEQ ID NO: 10002209 - DNA, 22 bp, Homo sapiens
ctggggggctactgacagagga

SEQ ID NO: 10002210 - DNA, 22 bp, Homo sapiens
ctggggtctcaattctagcggg

SEQ ID NO: 10002211 - DNA, 22 bp, Homo sapiens
ctggggtggagattggcaatct

SEQ ID NO: 10002212 - DNA, 22 bp, Homo sapiens
ctggggtgagcagaaacagggg

SEQ ID NO: 10002213 - DNA, 22 bp, Homo sapiens
ctggggtggagattggcaatct

SEQ ID NO: 10002214 - DNA, 22 bp, Homo sapiens
ctggggtggatgggtccaagtt

SEQ ID NO: 10002215 - DNA, 22 bp, Homo sapiens
ctggggtggatgggtccaagtt

SEQ ID NO: 10002216 - DNA, 22 bp, Homo sapiens
ctggggtggatgggtccaagtt

SEQ ID NO: 10002217 - DNA, 22 bp, Homo sapiens
ctggggtgtctcgtctgccatt

SEQ ID NO: 10002218 - DNA, 20 bp, Homo sapiens
ctgggctcggtggccctggc

SEQ ID NO: 10002219 - DNA, 18 bp, Homo sapiens
ctgggctcgagagatcct

SEQ ID NO: 10002220 - DNA, 18 bp, Homo sapiens
ctgggctcgagagatcct

SEQ ID NO: 10002221 - DNA, 22 bp, Homo sapiens
ctgggctcctaaccatccaggt

SEQ ID NO: 10002222 - DNA, 22 bp, Homo sapiens
ctgggctccctcatgtgtctgc

SEQ ID NO: 10002223 - DNA, 22 bp, Homo sapiens
ctgggggcagcaagaagccatg

SEQ ID NO: 10002224 - DNA, 22 bp, Homo sapiens
ctgggggcagcaagaagccatg

SEQ ID NO: 10002225 - DNA, 22 bp, Homo sapiens
ctgggggccttacggaactcca

SEQ ID NO: 10002226 - DNA, 22 bp, Homo sapiens
ctgggggccttacggaactcca

SEQ ID NO: 10002227 - DNA, 22 bp, Homo sapiens
ctggggctggtgaggcaggctc

SEQ ID NO: 10002228 - DNA, 22 bp, Homo sapiens
ctggggctgtaggaggacttat

SEQ ID NO: 10002229 - DNA, 22 bp, Homo sapiens
ctgggctctagaaaggaaagaa

SEQ ID NO: 10002230 - DNA, 22 bp, Homo sapiens
ctggggctggtgaggcaggctc

SEQ ID NO: 10002231 - DNA, 22 bp, Homo sapiens
ctgggtggaaagtgctgagaat

SEQ ID NO: 10002232 - DNA, 22 bp, Homo sapiens
ctgggtggaaagtgctgagaat

SEQ ID NO: 10002233 - DNA, 22 bp, Homo sapiens
ctgggtggaaagtgctgagaat

SEQ ID NO: 10002234 - DNA, 22 bp, Homo sapiens
ctgggtggttttgatgtgaatt

SEQ ID NO: 10002235 - DNA, 22 bp, Homo sapiens
ctgggtggttttgatgtgaatt

SEQ ID NO: 10002236 - DNA, 22 bp, Homo sapiens
ctgggtggttctaactgttgat

SEQ ID NO: 10002237 - DNA, 22 bp, Homo sapiens
ctgggtggctgtccagccagcc

SEQ ID NO: 10002238 - DNA, 22 bp, Homo sapiens
ctgggtgtcaggagacatgatg

SEQ ID NO: 10002239 - DNA, 22 bp, Homo sapiens
ctgggtgttcacccgaggcgct

SEQ ID NO: 10002240 - DNA, 22 bp, Homo sapiens
ctgggtgttcaggagctgggct

SEQ ID NO: 10002241 - DNA, 22 bp, Homo sapiens
ctgggttttattacagtgagct

SEQ ID NO: 10002242 - DNA, 22 bp, Homo sapiens
ctgggttcttggcacagcagga

SEQ ID NO: 10002243 - DNA, 22 bp, Homo sapiens
ctgggttccatgtagccaagag

SEQ ID NO: 10002244 - DNA, 22 bp, Homo sapiens
ctggtcacctccttcccagcta

SEQ ID NO: 10002245 - DNA, 22 bp, Homo sapiens
ctggtcaccaggtagcattgta

SEQ ID NO: 10002246 - DNA, 22 bp, Homo sapiens
ctggtattgagttgttgcttcc

SEQ ID NO: 10002247 - DNA, 22 bp, Homo sapiens
ctggtaggggtgactgttatcg

SEQ ID NO: 10002248 - DNA, 22 bp, Homo sapiens
ctggtagcagtgaagctgttga

SEQ ID NO: 10002249 - DNA, 22 bp, Homo sapiens
ctggtcacctccttcccagcta

SEQ ID NO: 10002250 - DNA, 22 bp, Homo sapiens
ctggtgccctgtgtggcaggag

SEQ ID NO: 10002251 - DNA, 22 bp, Homo sapiens
ctggtgcctcctccctgtgctt

SEQ ID NO: 10002252 - DNA, 22 bp, Homo sapiens
ctggtggggagtcctggtctcc

SEQ ID NO: 10002253 - DNA, 22 bp, Homo sapiens
ctggtggggagtcctggtctcc

SEQ ID NO: 10002254 - DNA, 22 bp, Homo sapiens
ctggttattattcttggaatgc

SEQ ID NO: 10002255 - DNA, 22 bp, Homo sapiens
ctggtgtggcggcgccctgtag

SEQ ID NO: 10002256 - DNA, 22 bp, Homo sapiens
ctggtggttcaggagaatggct

SEQ ID NO: 10002257 - DNA, 22 bp, Homo sapiens
ctggtgtctgctccctcacagc

SEQ ID NO: 10002258 - DNA, 22 bp, Homo sapiens
ctggtgtgattgagcccaggtg

SEQ ID NO: 10002259 - DNA, 22 bp, Homo sapiens
tcctgagaaggcacagcttgca

SEQ ID NO: 10002260 - DNA, 22 bp, Homo sapiens
tcctgagacatctctgctggtc

SEQ ID NO: 10002261 - DNA, 22 bp, Homo sapiens
tcctgagagccttggcttcaga

SEQ ID NO: 10002262 - DNA, 22 bp, Homo sapiens
tcctgagagcagagtccaggtg

SEQ ID NO: 10002263 - DNA, 20 bp, Homo sapiens
tcctgagacctgggaaggtt

SEQ ID NO: 10002264 - DNA, 22 bp, Homo sapiens
tcctgaacattatgcaagcttc

SEQ ID NO: 10002265 - DNA, 22 bp, Homo sapiens
tcctgaaatgtgcacatgacat

SEQ ID NO: 10002266 - DNA, 19 bp, Homo sapiens
tcctgaaaacttctggaat

SEQ ID NO: 10002267 - DNA, 22 bp, Homo sapiens
tcctctggttatacttgcaccc

SEQ ID NO: 10002268 - DNA, 22 bp, Homo sapiens
tcctctggttatacttgcaccc

SEQ ID NO: 10002269 - DNA, 22 bp, Homo sapiens
tcctctttctcaacattagtta

SEQ ID NO: 10002270 - DNA, 22 bp, Homo sapiens
tcctctggtcttcggtgtggac

SEQ ID NO: 10002271 - DNA, 22 bp, Homo sapiens
tcctctggtcctgcagcagatc

SEQ ID NO: 10002272 - DNA, 22 bp, Homo sapiens
tcctctggtcctgcagcagatc

SEQ ID NO: 10002273 - DNA, 22 bp, Homo sapiens
tcctctgggctccctgcaacag

SEQ ID NO: 10002274 - DNA, 22 bp, Homo sapiens
tcctcaggtcaaagcaggagaa

SEQ ID NO: 10002275 - DNA, 22 bp, Homo sapiens
tcctcaggtgactaggtatctt

SEQ ID NO: 10002276 - DNA, 22 bp, Homo sapiens
tcctctgggcctatttgttcac

SEQ ID NO: 10002277 - DNA, 22 bp, Homo sapiens
tcctctgggctccctgcaacag

SEQ ID NO: 10002278 - DNA, 22 bp, Homo sapiens
tcctcaggtgactaggtatctt

SEQ ID NO: 10002279 - DNA, 22 bp, Homo sapiens
tcctgagataggagttgaaggc

SEQ ID NO: 10002280 - DNA, 22 bp, Homo sapiens
tcctgagagtcaagaatgcagg

SEQ ID NO: 10002281 - DNA, 22 bp, Homo sapiens
tcctgagagtcaagaatgcagg

SEQ ID NO: 10002282 - DNA, 20 bp, Homo sapiens
tcctgagcctccaccatgtc

SEQ ID NO: 10002283 - DNA, 22 bp, Homo sapiens
tcctgagccctggggtcagtgt

SEQ ID NO: 10002284 - DNA, 22 bp, Homo sapiens
tcctgagcacctatgccatggc

SEQ ID NO: 10002285 - DNA, 22 bp, Homo sapiens
tcctgagccccagggaggttgg

SEQ ID NO: 10002286 - DNA, 20 bp, Homo sapiens
tcctgagatttaaggggttc

SEQ ID NO: 10002287 - DNA, 22 bp, Homo sapiens
tcctgagcaacacagctaagtg

SEQ ID NO: 10002288 - DNA, 22 bp, Homo sapiens
tcctgagcacagagacaaggaa

SEQ ID NO: 10002289 - DNA, 22 bp, Homo sapiens
tcctgagctttacagtaaggac

SEQ ID NO: 10002290 - DNA, 22 bp, Homo sapiens
tcctgagctgacacttggggag

SEQ ID NO: 10002291 - DNA, 22 bp, Homo sapiens
tcctgagctcccatgaacaggc

SEQ ID NO: 10002292 - DNA, 22 bp, Homo sapiens
tcctgagctacagtagtatgat

SEQ ID NO: 10002293 - DNA, 22 bp, Homo sapiens
tcctgaggaatgtgaagagaac

SEQ ID NO: 10002294 - DNA, 22 bp, Homo sapiens
tcctgaggactaacaggaagga

SEQ ID NO: 10002295 - DNA, 22 bp, Homo sapiens
tcctgaggactaacaggaagga

SEQ ID NO: 10002296 - DNA, 22 bp, Homo sapiens
tcctgaggaccctgtcaggggc

SEQ ID NO: 10002297 - DNA, 22 bp, Homo sapiens
tcctgatggcctctggctccag

SEQ ID NO: 10002298 - DNA, 22 bp, Homo sapiens
tcctgaggatggttgaagtgca

SEQ ID NO: 10002299 - DNA, 22 bp, Homo sapiens
tcctgaggccctgttagggtct

SEQ ID NO: 10002300 - DNA, 21 bp, Homo sapiens
tcctgcagggcagcagagtgg

SEQ ID NO: 10002301 - DNA, 21 bp, Homo sapiens
tcctgcagggcagcagagtgg

SEQ ID NO: 10002302 - DNA, 19 bp, Homo sapiens
tcctgcaggtggcttgcag

SEQ ID NO: 10002303 - DNA, 22 bp, Homo sapiens
tcctgcccagagctctccactc

SEQ ID NO: 10002304 - DNA, 22 bp, Homo sapiens
tcctgcagctgaagctcatgtg

SEQ ID NO: 10002305 - DNA, 22 bp, Homo sapiens
tcctgcagctgaagctcatgtg

SEQ ID NO: 10002306 - DNA, 22 bp, Homo sapiens
tcctgcagccttgggctggagc

SEQ ID NO: 10002307 - DNA, 22 bp, Homo sapiens
tcctgcagctctgagaagcatc

SEQ ID NO: 10002308 - DNA, 22 bp, Homo sapiens
tcctgcaggcctgttcccagta

SEQ ID NO: 10002309 - DNA, 22 bp, Homo sapiens
tcctgcaggccagaggggtgag

SEQ ID NO: 10002310 - DNA, 21 bp, Homo sapiens
tcctgcaggaggcctgagagg

SEQ ID NO: 10002311 - DNA, 22 bp, Homo sapiens
tcctgcagagacagaggcctca

SEQ ID NO: 10002312 - DNA, 22 bp, Homo sapiens
tcctgcagacctcagtcaggtc

SEQ ID NO: 10002313 - DNA, 22 bp, Homo sapiens
tcctgcagacctcagtcaggtc

SEQ ID NO: 10002314 - DNA, 22 bp, Homo sapiens
tcctgcagacctcagtcaggtc

SEQ ID NO: 10002315 - DNA, 22 bp, Homo sapiens
tcctgcagacctcagtcaggtc

SEQ ID NO: 10002316 - DNA, 22 bp, Homo sapiens
tcctgcagagccgccctcaggt

SEQ ID NO: 10002317 - DNA, 23 bp, Homo sapiens
tcctgcagataagctggttgaca

SEQ ID NO: 10002318 - DNA, 22 bp, Homo sapiens
tcctgcagatcaaagcctttga

SEQ ID NO: 10002319 - DNA, 22 bp, Homo sapiens
tcctgcagccactgcaggcaga

SEQ ID NO: 10002320 - DNA, 22 bp, Homo sapiens
tcctgcagccactgcaggcaga

SEQ ID NO: 10002321 - DNA, 22 bp, Homo sapiens
tcctgcctcaggctctggagta

SEQ ID NO: 10002322 - DNA, 22 bp, Homo sapiens
tcctgcctcacagttgaagttt

SEQ ID NO: 10002323 - DNA, 22 bp, Homo sapiens
tcctgcctagcaggtgacctat

SEQ ID NO: 10002324 - DNA, 22 bp, Homo sapiens
tcctgcctagcaggtgacctat

SEQ ID NO: 10002325 - DNA, 22 bp, Homo sapiens
tcctgcctaccttgcggaggtg

SEQ ID NO: 10002326 - DNA, 22 bp, Homo sapiens
tcctgcctcttttcttattcca

SEQ ID NO: 10002327 - DNA, 22 bp, Homo sapiens
tcctgcctcttgccttcttcac

SEQ ID NO: 10002328 - DNA, 22 bp, Homo sapiens
tcctgcctctccatgctaacta

SEQ ID NO: 10002329 - DNA, 22 bp, Homo sapiens
tcctgcctgagcgtggaggagg

SEQ ID NO: 10002330 - DNA, 22 bp, Homo sapiens
tcctgcctgcaatcccagcact

SEQ ID NO: 10002331 - DNA, 22 bp, Homo sapiens
tcctgcctgcaatcccagcact

SEQ ID NO: 10002332 - DNA, 22 bp, Homo sapiens
tcctcagaaacccctgtgaggt

SEQ ID NO: 10002333 - DNA, 20 bp, Homo sapiens
tcctcagaagacatttgggg

SEQ ID NO: 10002334 - DNA, 22 bp, Homo sapiens
tcctcacaagcatcctgtctca

SEQ ID NO: 10002335 - DNA, 22 bp, Homo sapiens
tcctcagatgctcttggacgcc

SEQ ID NO: 10002336 - DNA, 22 bp, Homo sapiens
tcctcagacttccctttgtgta

SEQ ID NO: 10002337 - DNA, 22 bp, Homo sapiens
tcctcagacaccctgctggctt

SEQ ID NO: 10002338 - DNA, 22 bp, Homo sapiens
tcctcagggcggcctccgtctt

SEQ ID NO: 10002339 - DNA, 19 bp, Homo sapiens
tcctcaggggctcacagac

SEQ ID NO: 10002340 - DNA, 19 bp, Homo sapiens
tcctcaggggctcacagac

SEQ ID NO: 10002341 - DNA, 21 bp, Homo sapiens
tcctcagggccccagagcact

SEQ ID NO: 10002342 - DNA, 21 bp, Homo sapiens
tcctcagggccccagagcact

SEQ ID NO: 10002343 - DNA, 21 bp, Homo sapiens
tcctcagggccccagagcact

SEQ ID NO: 10002344 - DNA, 22 bp, Homo sapiens
tcctcagggaagatgagcctca

SEQ ID NO: 10002345 - DNA, 22 bp, Homo sapiens
tcctcaggtcaaagcaggagaa

SEQ ID NO: 10002346 - DNA, 22 bp, Homo sapiens
tcctcaggggtttcaggtgtac

SEQ ID NO: 10002347 - DNA, 22 bp, Homo sapiens
tcctcaggtcaaagcaggagaa

SEQ ID NO: 10002348 - DNA, 19 bp, Homo sapiens
tcctcaggggctcacagac

SEQ ID NO: 10002349 - DNA, 22 bp, Homo sapiens
tccctggaacagagagacaacg

SEQ ID NO: 10002350 - DNA, 22 bp, Homo sapiens
tccctggacaacagacttcact

SEQ ID NO: 10002351 - DNA, 22 bp, Homo sapiens
tccctggaacagagagacaacg

SEQ ID NO: 10002352 - DNA, 22 bp, Homo sapiens
tccctggacagccttgcctggg

SEQ ID NO: 10002353 - DNA, 22 bp, Homo sapiens
tccctggacagccttgcctggg

SEQ ID NO: 10002354 - DNA, 22 bp, Homo sapiens
tccctggacaacagacttcact

SEQ ID NO: 10002355 - DNA, 22 bp, Homo sapiens
tccctggagataacttctggga

SEQ ID NO: 10002356 - DNA, 22 bp, Homo sapiens
tccctggcagctaagggtggtc

SEQ ID NO: 10002357 - DNA, 23 bp, Homo sapiens
tccctggaggcaggtccagggcc

SEQ ID NO: 10002358 - DNA, 20 bp, Homo sapiens
tccctggaggtggtggcatc

SEQ ID NO: 10002359 - DNA, 22 bp, Homo sapiens
tccctggaggtgtttgctcagg

SEQ ID NO: 10002360 - DNA, 20 bp, Homo sapiens
tccctggaggtggtggcatc

SEQ ID NO: 10002361 - DNA, 22 bp, Homo sapiens
tccctggcctggaaggatatca

SEQ ID NO: 10002362 - DNA, 22 bp, Homo sapiens
tccctgggaacaaaggatgaga

SEQ ID NO: 10002363 - DNA, 22 bp, Homo sapiens
tcctagaggatggtaggaagct

SEQ ID NO: 10002364 - DNA, 22 bp, Homo sapiens
tcctaggaatactgcctgaaat

SEQ ID NO: 10002365 - DNA, 22 bp, Homo sapiens
tcctaggcctggcctggtggat

SEQ ID NO: 10002366 - DNA, 22 bp, Homo sapiens
tcctagggattcaacactgaac

SEQ ID NO: 10002367 - DNA, 22 bp, Homo sapiens
tcctagggtaatcagcatacat

SEQ ID NO: 10002368 - DNA, 22 bp, Homo sapiens
tcctagggttggagacagtgac

SEQ ID NO: 10002369 - DNA, 22 bp, Homo sapiens
tcctagaatctttgtaagattg

SEQ ID NO: 10002370 - DNA, 22 bp, Homo sapiens
tcctagaataagtaacaggaca

SEQ ID NO: 10002371 - DNA, 22 bp, Homo sapiens
tcctagaataatctttgactgc

SEQ ID NO: 10002372 - DNA, 22 bp, Homo sapiens
tccccttggcttggtcaagagg

SEQ ID NO: 10002373 - DNA, 22 bp, Homo sapiens
tccctcagacagatgtgttcct

SEQ ID NO: 10002374 - DNA, 18 bp, Homo sapiens
tccctcagaattatagaa

SEQ ID NO: 10002375 - DNA, 22 bp, Homo sapiens
tcccgcttcttccgaatcgcga

SEQ ID NO: 10002376 - DNA, 22 bp, Homo sapiens
tccctcagatgagctcctagca

SEQ ID NO: 10002377 - DNA, 22 bp, Homo sapiens
tccctcagatgagctcctagca

SEQ ID NO: 10002378 - DNA, 21 bp, Homo sapiens
tccctcagacagggtgcctat

SEQ ID NO: 10002379 - DNA, 21 bp, Homo sapiens
tccctcagacagggtgcctat

SEQ ID NO: 10002380 - DNA, 22 bp, Homo sapiens
tccctcagattggcaattagat

SEQ ID NO: 10002381 - DNA, 22 bp, Homo sapiens
tccctcagcaggaactggcctg

SEQ ID NO: 10002382 - DNA, 22 bp, Homo sapiens
tccctcagcaggaatgtggcag

SEQ ID NO: 10002383 - DNA, 22 bp, Homo sapiens
tcccaggctggcaggcagcagt

SEQ ID NO: 10002384 - DNA, 22 bp, Homo sapiens
tcccaggctggcaggcagcagt

SEQ ID NO: 10002385 - DNA, 22 bp, Homo sapiens
tcccaggctggcaggcagcagt

SEQ ID NO: 10002386 - DNA, 20 bp, Homo sapiens
tcccaggctccaccctagac

SEQ ID NO: 10002387 - DNA, 20 bp, Homo sapiens
tcccaggctccaccctagac

SEQ ID NO: 10002388 - DNA, 20 bp, Homo sapiens
tcccaggctccaccctagac

SEQ ID NO: 10002389 - DNA, 22 bp, Homo sapiens
tcccaggctcttcaaggaagac

SEQ ID NO: 10002390 - DNA, 22 bp, Homo sapiens
tcccaggctaggcctctgcgtt

SEQ ID NO: 10002391 - DNA, 22 bp, Homo sapiens
tcccaggctaccagtgaggtca

SEQ ID NO: 10002392 - DNA, 20 bp, Homo sapiens
tcccaggctccaccctagac

SEQ ID NO: 10002393 - DNA, 22 bp, Homo sapiens
tcccaggctaggcctctgcgtt

SEQ ID NO: 10002394 - DNA, 22 bp, Homo sapiens
tcccaggctaggcctctgcgtt

SEQ ID NO: 10002395 - DNA, 20 bp, Homo sapiens
tcccaggctgggctccagct

SEQ ID NO: 10002396 - DNA, 20 bp, Homo sapiens
tcccaggctgggctccagct

SEQ ID NO: 10002397 - DNA, 20 bp, Homo sapiens
tcccaggctgggctccagct

SEQ ID NO: 10002398 - DNA, 20 bp, Homo sapiens
tcccaggctgggctccagct

SEQ ID NO: 10002399 - DNA, 22 bp, Homo sapiens
tcccaggctggggccaggtgac

SEQ ID NO: 10002400 - DNA, 22 bp, Homo sapiens
tcccaggctggggccaggtgac

SEQ ID NO: 10002401 - DNA, 22 bp, Homo sapiens
tcccaggctgggggcctgaagt

SEQ ID NO: 10002402 - DNA, 22 bp, Homo sapiens
tcccaggctgggggcctgaagt

SEQ ID NO: 10002403 - DNA, 22 bp, Homo sapiens
tcccaggctgggggcctgaagt

SEQ ID NO: 10002404 - DNA, 20 bp, Homo sapiens
tccctcagtttccagccctg

SEQ ID NO: 10002405 - DNA, 19 bp, Homo sapiens
tccctcagtctgccaggcc

SEQ ID NO: 10002406 - DNA, 20 bp, Homo sapiens
tccctcagtcctggctttgt

SEQ ID NO: 10002407 - DNA, 22 bp, Homo sapiens
tccctcagcttgtctccatgca

SEQ ID NO: 10002408 - DNA, 23 bp, Homo sapiens
tccctcaggccttatctccatct

SEQ ID NO: 10002409 - DNA, 22 bp, Homo sapiens
tccctcagcttgtctccatgca

SEQ ID NO: 10002410 - DNA, 22 bp, Homo sapiens
tccctcagctcatatttatgcc

SEQ ID NO: 10002411 - DNA, 22 bp, Homo sapiens
tccctcagtccctggacaggca

SEQ ID NO: 10002412 - DNA, 22 bp, Homo sapiens
tccctcaggtggttcttgtttc

SEQ ID NO: 10002413 - DNA, 23 bp, Homo sapiens
tccctcaggccttatctccatct

SEQ ID NO: 10002414 - DNA, 22 bp, Homo sapiens
tccctcagggtgcagttgcttt

SEQ ID NO: 10002415 - DNA, 20 bp, Homo sapiens
tccctcaggtcattgggctg

SEQ ID NO: 10002416 - DNA, 22 bp, Homo sapiens
tccctgcctcctggcagtgcca

SEQ ID NO: 10002417 - DNA, 22 bp, Homo sapiens
tccctctgttctgttccaagtg

SEQ ID NO: 10002418 - DNA, 22 bp, Homo sapiens
tccctgaaccactagtgatgag

SEQ ID NO: 10002419 - DNA, 22 bp, Homo sapiens
tccctctggtcctcggtggaga

SEQ ID NO: 10002420 - DNA, 22 bp, Homo sapiens
tccctctcttgggcgtggctca

SEQ ID NO: 10002421 - DNA, 22 bp, Homo sapiens
tccctctgctagtgcttgagct

SEQ ID NO: 10002422 - DNA, 22 bp, Homo sapiens
tcccagccttccagtctggttt

SEQ ID NO: 10002423 - DNA, 22 bp, Homo sapiens
tcccagccttccagtctggttt

SEQ ID NO: 10002424 - DNA, 22 bp, Homo sapiens
tcccagccttatctcccctggc

SEQ ID NO: 10002425 - DNA, 22 bp, Homo sapiens
tcccagcctggaccctgccagt

SEQ ID NO: 10002426 - DNA, 22 bp, Homo sapiens
tcccagcctggaccctgccagt

SEQ ID NO: 10002427 - DNA, 22 bp, Homo sapiens
tcccagcctgacagtgcatcaa

SEQ ID NO: 10002428 - DNA, 22 bp, Homo sapiens
tcccagcctgacagtgcatcaa

SEQ ID NO: 10002429 - DNA, 22 bp, Homo sapiens
tcccaggccataaaactcagag

SEQ ID NO: 10002430 - DNA, 22 bp, Homo sapiens
tcccaggcgcctggtggggagc

SEQ ID NO: 10002431 - DNA, 22 bp, Homo sapiens
tcccaggcgcctggtggggagc

SEQ ID NO: 10002432 - DNA, 22 bp, Homo sapiens
tcccaggccacacttggggaac

SEQ ID NO: 10002433 - DNA, 22 bp, Homo sapiens
tcccaggcaggtgacaggggga

SEQ ID NO: 10002434 - DNA, 16 bp, Homo sapiens
tcccaggccaggtgga

SEQ ID NO: 10002435 - DNA, 22 bp, Homo sapiens
tcccaggcagcttctttcatca

SEQ ID NO: 10002436 - DNA, 22 bp, Homo sapiens
tcccagcctttctttctccagc

SEQ ID NO: 10002437 - DNA, 22 bp, Homo sapiens
tcccagccttccttgtggtgaa

SEQ ID NO: 10002438 - DNA, 22 bp, Homo sapiens
tcccagccttccttgtggtgaa

SEQ ID NO: 10002439 - DNA, 22 bp, Homo sapiens
tcccagaggctccagtctctat

SEQ ID NO: 10002440 - DNA, 22 bp, Homo sapiens
tcccagaggctccagtctctat

SEQ ID NO: 10002441 - DNA, 22 bp, Homo sapiens
tcccagcctcctgacagttttg

SEQ ID NO: 10002442 - DNA, 22 bp, Homo sapiens
tcccagccggtgcctgggtccc

SEQ ID NO: 10002443 - DNA, 22 bp, Homo sapiens
tcccagccggtgcctgggtccc

SEQ ID NO: 10002444 - DNA, 23 bp, Homo sapiens
tcccagcctcttctcttgcatac

SEQ ID NO: 10002445 - DNA, 22 bp, Homo sapiens
tcccagccggtgcctgggtccc

SEQ ID NO: 10002446 - DNA, 22 bp, Homo sapiens
tcccagcccaggtatgatgata

SEQ ID NO: 10002447 - DNA, 22 bp, Homo sapiens
tcccagcattaatgcctgtcag

SEQ ID NO: 10002448 - DNA, 22 bp, Homo sapiens
tcccaaagaactgaatagtaat

SEQ ID NO: 10002449 - DNA, 22 bp, Homo sapiens
tcccaaaggtccgagcgggaat

SEQ ID NO: 10002450 - DNA, 22 bp, Homo sapiens
tcccaaagctactcttctgact

SEQ ID NO: 10002451 - DNA, 22 bp, Homo sapiens
tccattgctcaatatagagttt

SEQ ID NO: 10002452 - DNA, 22 bp, Homo sapiens
tccattgtgttacagagcattc

SEQ ID NO: 10002453 - DNA, 22 bp, Homo sapiens
tccattgtgttacagagcattc

SEQ ID NO: 10002454 - DNA, 22 bp, Homo sapiens
tccattctatgcttacatttat

SEQ ID NO: 10002455 - DNA, 22 bp, Homo sapiens
tccattatacttctgattcaaa

SEQ ID NO: 10002456 - DNA, 22 bp, Homo sapiens
tccattatacttctgattcaaa

SEQ ID NO: 10002457 - DNA, 22 bp, Homo sapiens
tccattaatgattatttctgtg

SEQ ID NO: 10002458 - DNA, 22 bp, Homo sapiens
tccattaatgattatttctgtg

SEQ ID NO: 10002459 - DNA, 22 bp, Homo sapiens
tccatgttaggtaaaggcactg

SEQ ID NO: 10002460 - DNA, 22 bp, Homo sapiens
tccatgttgagaatgctataat

SEQ ID NO: 10002461 - DNA, 22 bp, Homo sapiens
tccatgtgttttcctgtccaca

SEQ ID NO: 10002462 - DNA, 22 bp, Homo sapiens
tccatgtgacggtggcagtttt

SEQ ID NO: 10002463 - DNA, 22 bp, Homo sapiens
tccatgtggcaataggagacag

SEQ ID NO: 10002464 - DNA, 22 bp, Homo sapiens
tccatgtgcttcctcaggggaa

SEQ ID NO: 10002465 - DNA, 22 bp, Homo sapiens
tccatggtttcagtctggctgg

SEQ ID NO: 10002466 - DNA, 22 bp, Homo sapiens
tccatggtaggtttcttaaaga

SEQ ID NO: 10002467 - DNA, 22 bp, Homo sapiens
tccatggtaggtttcttaaaga

SEQ ID NO: 10002468 - DNA, 22 bp, Homo sapiens
tccatggggcccaggatgagag

SEQ ID NO: 10002469 - DNA, 22 bp, Homo sapiens
tccatggggcccaggatgagag

SEQ ID NO: 10002470 - DNA, 22 bp, Homo sapiens
tccatgggaagattttgagtgg

SEQ ID NO: 10002471 - DNA, 22 bp, Homo sapiens
tcccagagccaagctatggatg

SEQ ID NO: 10002472 - DNA, 22 bp, Homo sapiens
tcccaaatataatgcaagagac

SEQ ID NO: 10002473 - DNA, 22 bp, Homo sapiens
tcccaaagtcaagctgtgtctt

SEQ ID NO: 10002474 - DNA, 22 bp, Homo sapiens
tcccaaagctactcttctgact

SEQ ID NO: 10002475 - DNA, 22 bp, Homo sapiens
tcccaaagtattagcatttcaa

SEQ ID NO: 10002476 - DNA, 22 bp, Homo sapiens
tcccaaagtattagcatttcaa

SEQ ID NO: 10002477 - DNA, 22 bp, Homo sapiens
tcccaagattaggttggaaagg

SEQ ID NO: 10002478 - DNA, 22 bp, Homo sapiens
tcccaagatgacacagtggacg

SEQ ID NO: 10002479 - DNA, 22 bp, Homo sapiens
tcccagagaagagctggatgga

SEQ ID NO: 10002480 - DNA, 22 bp, Homo sapiens
tccaggctggctcttcaaaatt

SEQ ID NO: 10002481 - DNA, 22 bp, Homo sapiens
tccaggctggctcttcaaaatt

SEQ ID NO: 10002482 - DNA, 22 bp, Homo sapiens
tccaggctggcctcgcgtgaca

SEQ ID NO: 10002483 - DNA, 22 bp, Homo sapiens
tccaggctagaagtcacaggcc

SEQ ID NO: 10002484 - DNA, 22 bp, Homo sapiens
tccaggccttgacaggtcagtt

SEQ ID NO: 10002485 - DNA, 22 bp, Homo sapiens
tccaggcctggctccattcagt

SEQ ID NO: 10002486 - DNA, 22 bp, Homo sapiens
tccaggcctggctccattcagt

SEQ ID NO: 10002487 - DNA, 22 bp, Homo sapiens
tccaggcctgcctggtgtttgc

SEQ ID NO: 10002488 - DNA, 20 bp, Homo sapiens
tccaggccttgttctcagat

SEQ ID NO: 10002489 - DNA, 22 bp, Homo sapiens
tccaggcctttgcacatgttgt

SEQ ID NO: 10002490 - DNA, 22 bp, Homo sapiens
tccaggctaattttgcattgtt

SEQ ID NO: 10002491 - DNA, 22 bp, Homo sapiens
tccaggcctctagcccctatct

SEQ ID NO: 10002492 - DNA, 21 bp, Homo sapiens
tccaggcctcaggaagggatg

SEQ ID NO: 10002493 - DNA, 22 bp, Homo sapiens
tccaggcctgcaatgacaaagc

SEQ ID NO: 10002494 - DNA, 22 bp, Homo sapiens
tccaggcctgactataaatgta

SEQ ID NO: 10002495 - DNA, 22 bp, Homo sapiens
tccaggcctctagccctctctt

SEQ ID NO: 10002496 - DNA, 18 bp, Homo sapiens
tccaggcctgaagtgtcc

SEQ ID NO: 10002497 - DNA, 22 bp, Homo sapiens
tccagggaagagcagaggctac

SEQ ID NO: 10002498 - DNA, 22 bp, Homo sapiens
tccaggctgggctgaagggtgc

SEQ ID NO: 10002499 - DNA, 22 bp, Homo sapiens
tccagggctgggttggctcagc

SEQ ID NO: 10002500 - DNA, 22 bp, Homo sapiens
tccagggctgttactttacata

SEQ ID NO: 10002501 - DNA, 22 bp, Homo sapiens
tccagggctgttactttacata

SEQ ID NO: 10002502 - DNA, 23 bp, Homo sapiens
tccagggctggccagacctcggt

SEQ ID NO: 10002503 - DNA, 23 bp, Homo sapiens
tccagggctggccagacctcggt

SEQ ID NO: 10002504 - DNA, 22 bp, Homo sapiens
tccagggctgacttgggagagg

SEQ ID NO: 10002505 - DNA, 22 bp, Homo sapiens
tccagggctgacttgggagagg

SEQ ID NO: 10002506 - DNA, 22 bp, Homo sapiens
tccagggctccccaacatccag

SEQ ID NO: 10002507 - DNA, 22 bp, Homo sapiens
tccaggtcttcctattccaggt

SEQ ID NO: 10002508 - DNA, 18 bp, Homo sapiens
tccagggcttcctcctct

SEQ ID NO: 10002509 - DNA, 18 bp, Homo sapiens
tccagggcttcctcctct

SEQ ID NO: 10002510 - DNA, 18 bp, Homo sapiens
tccagggcttcctcctct

SEQ ID NO: 10002511 - DNA, 22 bp, Homo sapiens
tccagggcttgacagggtgcct

SEQ ID NO: 10002512 - DNA, 22 bp, Homo sapiens
tccagggcttgacagggtgcct

SEQ ID NO: 10002513 - DNA, 22 bp, Homo sapiens
tccagggcttgacagggtgcct

SEQ ID NO: 10002514 - DNA, 19 bp, Homo sapiens
tccagggctttatggcttt

SEQ ID NO: 10002515 - DNA, 22 bp, Homo sapiens
tccagggcttggctgggacggt

SEQ ID NO: 10002516 - DNA, 21 bp, Homo sapiens
tccagggctttgattctctca

SEQ ID NO: 10002517 - DNA, 19 bp, Homo sapiens
tccagggctttatggcttt

SEQ ID NO: 10002518 - DNA, 21 bp, Homo sapiens
tccagggctttgattctctca

SEQ ID NO: 10002519 - DNA, 22 bp, Homo sapiens
tcaactgatttagtctgtgcca

SEQ ID NO: 10002520 - DNA, 22 bp, Homo sapiens
tcaacttggagcacatttggct

SEQ ID NO: 10002521 - DNA, 22 bp, Homo sapiens
tcaacgcatgctccaagaaaga

SEQ ID NO: 10002522 - DNA, 22 bp, Homo sapiens
tcaagaaactgtgctacagagt

SEQ ID NO: 10002523 - DNA, 22 bp, Homo sapiens
tcaagaaactgtagcaatgggt

SEQ ID NO: 10002524 - DNA, 22 bp, Homo sapiens
tcacagtgacagccaatgtttt

SEQ ID NO: 10002525 - DNA, 22 bp, Homo sapiens
tcacagtattgggggtggagga

SEQ ID NO: 10002526 - DNA, 22 bp, Homo sapiens
tcacagtattcatgaacatgga

SEQ ID NO: 10002527 - DNA, 22 bp, Homo sapiens
tcacagtgacttacagagattg

SEQ ID NO: 10002528 - DNA, 22 bp, Homo sapiens
tcacagtgacagccaatgtttt

SEQ ID NO: 10002529 - DNA, 22 bp, Homo sapiens
tcacagtgacagccaatgtttt

SEQ ID NO: 10002530 - DNA, 22 bp, Homo sapiens
tcaagaacttaggagcaagcca

SEQ ID NO: 10002531 - DNA, 22 bp, Homo sapiens
tcaagaactgtgaagagtctga

SEQ ID NO: 10002532 - DNA, 22 bp, Homo sapiens
tcaagaaatgtgcttggatata

SEQ ID NO: 10002533 - DNA, 22 bp, Homo sapiens
tcaagaactggaaattgatatg

SEQ ID NO: 10002534 - DNA, 22 bp, Homo sapiens
tcacagtatcaggtggagtgga

SEQ ID NO: 10002535 - DNA, 22 bp, Homo sapiens
tcaacacaacagagaaatgctg

SEQ ID NO: 10002536 - DNA, 22 bp, Homo sapiens
tcaacaattttgagatgagaca

SEQ ID NO: 10002537 - DNA, 22 bp, Homo sapiens
tcaacaattttgagatgagaca

SEQ ID NO: 10002538 - DNA, 22 bp, Homo sapiens
tcaacaattttgagatgagaca

SEQ ID NO: 10002539 - DNA, 22 bp, Homo sapiens
tcaacaataggatatagcaggt

SEQ ID NO: 10002540 - DNA, 22 bp, Homo sapiens
tcaacaataggatatagcaggt

SEQ ID NO: 10002541 - DNA, 22 bp, Homo sapiens
tcaacaattgcatgttgatgtt

SEQ ID NO: 10002542 - DNA, 22 bp, Homo sapiens
tcaacaatgggtctgtaatgga

SEQ ID NO: 10002543 - DNA, 22 bp, Homo sapiens
tcaacaataggatatagcaggt

SEQ ID NO: 10002544 - DNA, 22 bp, Homo sapiens
tcaacaagagcccatgcttttt

SEQ ID NO: 10002545 - DNA, 22 bp, Homo sapiens
tcaacaagagcccatgcttttt

SEQ ID NO: 10002546 - DNA, 22 bp, Homo sapiens
tcaaatgcaggtctggtcttgg

SEQ ID NO: 10002547 - DNA, 22 bp, Homo sapiens
tcaaatgcacctctcatttgtt

SEQ ID NO: 10002548 - DNA, 22 bp, Homo sapiens
tcaaatgaggctgatgaatgtg

SEQ ID NO: 10002549 - DNA, 22 bp, Homo sapiens
tcaaatgagtgactcacacagg

SEQ ID NO: 10002550 - DNA, 22 bp, Homo sapiens
tcaacagacatttttaagcact

SEQ ID NO: 10002551 - DNA, 22 bp, Homo sapiens
tcaacagaagtgatagctatta

SEQ ID NO: 10002552 - DNA, 22 bp, Homo sapiens
tcaacacttttgtctttgtccc

SEQ ID NO: 10002553 - DNA, 22 bp, Homo sapiens
tcaacactggctacagttatgc

SEQ ID NO: 10002554 - DNA, 22 bp, Homo sapiens
tcaacatacatacatggtcagg

SEQ ID NO: 10002555 - DNA, 22 bp, Homo sapiens
tcaacagttgcactggagaggt

SEQ ID NO: 10002556 - DNA, 22 bp, Homo sapiens
tcaacagttctgtccaattaat

SEQ ID NO: 10002557 - DNA, 22 bp, Homo sapiens
tcaacatataggcaacctgtaa

SEQ ID NO: 10002558 - DNA, 22 bp, Homo sapiens
tcacattgtaggtcatttgcaa

SEQ ID NO: 10002559 - DNA, 22 bp, Homo sapiens
tcacattgttcttagtttacct

SEQ ID NO: 10002560 - DNA, 22 bp, Homo sapiens
tcacatgccttttactctgcac

SEQ ID NO: 10002561 - DNA, 22 bp, Homo sapiens
tcacatactgaaagtccagtga

SEQ ID NO: 10002562 - DNA, 21 bp, Homo sapiens
tcacatgcttattcctggaat

SEQ ID NO: 10002563 - DNA, 22 bp, Homo sapiens
tcacatttcaagtgctcaaaag

SEQ ID NO: 10002564 - DNA, 22 bp, Homo sapiens
tcacatttatttcaaagttact

SEQ ID NO: 10002565 - DNA, 22 bp, Homo sapiens
tcacatttctcagcactgatga

SEQ ID NO: 10002566 - DNA, 22 bp, Homo sapiens
tcacatttctcagcactgatga

SEQ ID NO: 10002567 - DNA, 22 bp, Homo sapiens
tcacatttcaagtgctcaaaag

SEQ ID NO: 10002568 - DNA, 21 bp, Homo sapiens
tcacatttctcatgggtaaat

SEQ ID NO: 10002569 - DNA, 22 bp, Homo sapiens
tcacatttctcagcactgatga

SEQ ID NO: 10002570 - DNA, 22 bp, Homo sapiens
tcacatttctttatgtagtctt

SEQ ID NO: 10002571 - DNA, 22 bp, Homo sapiens
tcacatttctgattataccaaa

SEQ ID NO: 10002572 - DNA, 22 bp, Homo sapiens
tcacatttctgattataccaaa

SEQ ID NO: 10002573 - DNA, 22 bp, Homo sapiens
tcacagtgaggagttacagttt

SEQ ID NO: 10002574 - DNA, 22 bp, Homo sapiens
tcacagtgagccatgtcagaga

SEQ ID NO: 10002575 - DNA, 22 bp, Homo sapiens
tcacagtgcacagcaggcgtgg

SEQ ID NO: 10002576 - DNA, 22 bp, Homo sapiens
tcacagtgcaccagtgtgaagc

SEQ ID NO: 10002577 - DNA, 22 bp, Homo sapiens
tcacagtgcacccctcacaggg

SEQ ID NO: 10002578 - DNA, 22 bp, Homo sapiens
tcacagtgcaggatcagttaat

SEQ ID NO: 10002579 - DNA, 22 bp, Homo sapiens
tcacagtgggacttttatcgct

SEQ ID NO: 10002580 - DNA, 22 bp, Homo sapiens
tcacagttttagaaaatagata

SEQ ID NO: 10002581 - DNA, 22 bp, Homo sapiens
tcacagttttaagtgtgatcca

SEQ ID NO: 10002582 - DNA, 22 bp, Homo sapiens
tcacagtttccataggtcagca

SEQ ID NO: 10002583 - DNA, 22 bp, Homo sapiens
tcacagtttcttttctgataaa

SEQ ID NO: 10002584 - DNA, 23 bp, Homo sapiens
tcacataatccttcatccacagg

SEQ ID NO: 10002585 - DNA, 23 bp, Homo sapiens
tcacataatccttcatccacagg

SEQ ID NO: 10002586 - DNA, 22 bp, Homo sapiens
tcacagttttagaaaatagata

SEQ ID NO: 10002587 - DNA, 22 bp, Homo sapiens
tcacagttttagctgttaaata

SEQ ID NO: 10002588 - DNA, 22 bp, Homo sapiens
tcacataaattatacaatttca

SEQ ID NO: 10002589 - DNA, 22 bp, Homo sapiens
tcacataaattatacaatttca

SEQ ID NO: 10002590 - DNA, 22 bp, Homo sapiens
tcacataaatttaccagatgat

SEQ ID NO: 10002591 - DNA, 23 bp, Homo sapiens
tcactgctactcagcctgagatt

SEQ ID NO: 10002592 - DNA, 23 bp, Homo sapiens
tcactgctactcagcctgagatt

SEQ ID NO: 10002593 - DNA, 22 bp, Homo sapiens
tcactgctatattggatactga

SEQ ID NO: 10002594 - DNA, 22 bp, Homo sapiens
tcactgctctctaagcatcgcc

SEQ ID NO: 10002595 - DNA, 22 bp, Homo sapiens
tcactgctcagtctgtactaca

SEQ ID NO: 10002596 - DNA, 22 bp, Homo sapiens
tcactgcttaactcaagatctc

SEQ ID NO: 10002597 - DNA, 22 bp, Homo sapiens
tcagaaaatgaaatggactctc

SEQ ID NO: 10002598 - DNA, 22 bp, Homo sapiens
tcagaaaataactgttagtttg

SEQ ID NO: 10002599 - DNA, 22 bp, Homo sapiens
tcactgctgctgccatgatgga

SEQ ID NO: 10002600 - DNA, 22 bp, Homo sapiens
tcactgctctccaatgtggagt

SEQ ID NO: 10002601 - DNA, 22 bp, Homo sapiens
tcactgctctctaagcatcgcc

SEQ ID NO: 10002602 - DNA, 22 bp, Homo sapiens
tcactgctctgaaagtacaggg

SEQ ID NO: 10002603 - DNA, 22 bp, Homo sapiens
tcactgcaacctccacctcctg

SEQ ID NO: 10002604 - DNA, 22 bp, Homo sapiens
tcactgcaacctccacctcccg

SEQ ID NO: 10002605 - DNA, 22 bp, Homo sapiens
tcactgcaacctccacctcctg

SEQ ID NO: 10002606 - DNA, 22 bp, Homo sapiens
tcacattttatatctctggttt

SEQ ID NO: 10002607 - DNA, 22 bp, Homo sapiens
tcactgcaacctccacctcccg

SEQ ID NO: 10002608 - DNA, 22 bp, Homo sapiens
tcactgcaacctccacctcccg

SEQ ID NO: 10002609 - DNA, 22 bp, Homo sapiens
tcacattttagtaccatgattt

SEQ ID NO: 10002610 - DNA, 22 bp, Homo sapiens
tcacattttatatctctggttt

SEQ ID NO: 10002611 - DNA, 22 bp, Homo sapiens
tcacattttagtaccatgattt

SEQ ID NO: 10002612 - DNA, 22 bp, Homo sapiens
tcacatttgttcctctgcactt

SEQ ID NO: 10002613 - DNA, 22 bp, Homo sapiens
tcacatttgttcctctgcactt

SEQ ID NO: 10002614 - DNA, 22 bp, Homo sapiens
tcacatttggagaaagcctgcc

SEQ ID NO: 10002615 - DNA, 22 bp, Homo sapiens
tcacatttgcaattgcattgtt

SEQ ID NO: 10002616 - DNA, 20 bp, Homo sapiens
tcagaagtttcctggagcat

SEQ ID NO: 10002617 - DNA, 22 bp, Homo sapiens
tcagaagtttcaatcccagctg

SEQ ID NO: 10002618 - DNA, 23 bp, Homo sapiens
tcagaagtttggttgtaacatgg

SEQ ID NO: 10002619 - DNA, 22 bp, Homo sapiens
tcagaataagttatgaaatgaa

SEQ ID NO: 10002620 - DNA, 22 bp, Homo sapiens
tcagaatatattcatgttgtca

SEQ ID NO: 10002621 - DNA, 22 bp, Homo sapiens
tcagaatatattcatgttgtca

SEQ ID NO: 10002622 - DNA, 21 bp, Homo sapiens
tcagaatctgtgagctatctc

SEQ ID NO: 10002623 - DNA, 22 bp, Homo sapiens
tcagaatctgcatttaacaaaa

SEQ ID NO: 10002624 - DNA, 22 bp, Homo sapiens
tcagaatctctggaggcttggc

SEQ ID NO: 10002625 - DNA, 22 bp, Homo sapiens
tcagaatctgaaaagcgcttgg

SEQ ID NO: 10002626 - DNA, 22 bp, Homo sapiens
tcagaatctttctagagtctag

SEQ ID NO: 10002627 - DNA, 22 bp, Homo sapiens
tcagaatggcccataaatagtc

SEQ ID NO: 10002628 - DNA, 22 bp, Homo sapiens
tcagaagttaatatataaattt

SEQ ID NO: 10002629 - DNA, 22 bp, Homo sapiens
tcagaagttaatacgaggagaa

SEQ ID NO: 10002630 - DNA, 22 bp, Homo sapiens
tcagaagttgaaggctcttttt

SEQ ID NO: 10002631 - DNA, 22 bp, Homo sapiens
tcagaagttgagatattcaggg

SEQ ID NO: 10002632 - DNA, 23 bp, Homo sapiens
tcagaagtgggatacaaagctga

SEQ ID NO: 10002633 - DNA, 22 bp, Homo sapiens
tcagaagccggaagtgctcctc

SEQ ID NO: 10002634 - DNA, 22 bp, Homo sapiens
tcagaacagcgagaatattcac

SEQ ID NO: 10002635 - DNA, 22 bp, Homo sapiens
tcagaacagctctcagatatcc

SEQ ID NO: 10002636 - DNA, 22 bp, Homo sapiens
tcagaacaggttgtactatgtc

SEQ ID NO: 10002637 - DNA, 22 bp, Homo sapiens
tcagaacaggactggctgccat

SEQ ID NO: 10002638 - DNA, 22 bp, Homo sapiens
tcagaaagaacacaggcagtag

SEQ ID NO: 10002639 - DNA, 22 bp, Homo sapiens
tcagaaagaacacaggcagtag

SEQ ID NO: 10002640 - DNA, 22 bp, Homo sapiens
tcagaaagaacacaggcagtag

SEQ ID NO: 10002641 - DNA, 22 bp, Homo sapiens
tcagaaaatgaaatggactctc

SEQ ID NO: 10002642 - DNA, 22 bp, Homo sapiens
tcagaaaccccaacaatggaga

SEQ ID NO: 10002643 - DNA, 22 bp, Homo sapiens
tcagaaacagaaactaagaacc

SEQ ID NO: 10002644 - DNA, 22 bp, Homo sapiens
tcagaaagctgattcttgatac

SEQ ID NO: 10002645 - DNA, 22 bp, Homo sapiens
tcagaaagcttagtgtcttgca

SEQ ID NO: 10002646 - DNA, 22 bp, Homo sapiens
tcagaaagctatatggtgtgtc

SEQ ID NO: 10002647 - DNA, 22 bp, Homo sapiens
tcagaaagctatatggtgtgtc

SEQ ID NO: 10002648 - DNA, 22 bp, Homo sapiens
tcagaaagctgattcttgatac

SEQ ID NO: 10002649 - DNA, 22 bp, Homo sapiens
tcagaaagcttagtgtcttgca

SEQ ID NO: 10002650 - DNA, 22 bp, Homo sapiens
tcagaaagcttagtgtcttgca

SEQ ID NO: 10002651 - DNA, 22 bp, Homo sapiens
tcagaaagcttttacttaaaca

SEQ ID NO: 10002652 - DNA, 22 bp, Homo sapiens
tcagaaagacgaaacagatggg

SEQ ID NO: 10002653 - DNA, 22 bp, Homo sapiens
tcagaaagctatatggtgtgtc

SEQ ID NO: 10002654 - DNA, 22 bp, Homo sapiens
tcagaacagaagaaggaacacg

SEQ ID NO: 10002655 - DNA, 22 bp, Homo sapiens
tcagaaaggttctatgttttac

SEQ ID NO: 10002656 - DNA, 22 bp, Homo sapiens
tcagaaaggccacatggtgcag

SEQ ID NO: 10002657 - DNA, 22 bp, Homo sapiens
tcagaaaggccacatggtgcag

SEQ ID NO: 10002658 - DNA, 22 bp, Homo sapiens
tcagaaaggttctatgttttac

SEQ ID NO: 10002659 - DNA, 22 bp, Homo sapiens
tcagaaaggagttagaggtctc

SEQ ID NO: 10002660 - DNA, 22 bp, Homo sapiens
tcagaaaggagttagaggtctc

SEQ ID NO: 10002661 - DNA, 22 bp, Homo sapiens
tcagaaaggccacatggtgcag

SEQ ID NO: 10002662 - DNA, 22 bp, Homo sapiens
tcagctgcctttcccatgctag

SEQ ID NO: 10002663 - DNA, 22 bp, Homo sapiens
tcagctgccccgggcactgccc

SEQ ID NO: 10002664 - DNA, 22 bp, Homo sapiens
tcagctgccccgggcactgccc

SEQ ID NO: 10002665 - DNA, 22 bp, Homo sapiens
tcagctgcctctccctggaaga

SEQ ID NO: 10002666 - DNA, 22 bp, Homo sapiens
tcagctgcctctccctggaaga

SEQ ID NO: 10002667 - DNA, 19 bp, Homo sapiens
tcagctctggggtcagtgg

SEQ ID NO: 10002668 - DNA, 22 bp, Homo sapiens
tcagctgctctgttgagctgaa

SEQ ID NO: 10002669 - DNA, 23 bp, Homo sapiens
tcagctgcttcctcctgcctgcc

SEQ ID NO: 10002670 - DNA, 22 bp, Homo sapiens
tcagctgctgtggtatgtacat

SEQ ID NO: 10002671 - DNA, 22 bp, Homo sapiens
tcagctgcttcatgttctgaat

SEQ ID NO: 10002672 - DNA, 22 bp, Homo sapiens
tcagctgctctgttgagctgaa

SEQ ID NO: 10002673 - DNA, 22 bp, Homo sapiens
tcagctgctctgttgagctgaa

SEQ ID NO: 10002674 - DNA, 22 bp, Homo sapiens
tcagctgcgacaggggcctgag

SEQ ID NO: 10002675 - DNA, 22 bp, Homo sapiens
tcagccaggcacaatggcagct

SEQ ID NO: 10002676 - DNA, 22 bp, Homo sapiens
tcagcattctttacaaggatga

SEQ ID NO: 10002677 - DNA, 22 bp, Homo sapiens
tcagcattcctgaagacaagca

SEQ ID NO: 10002678 - DNA, 22 bp, Homo sapiens
tcagcagtgtcagttcccagag

SEQ ID NO: 10002679 - DNA, 22 bp, Homo sapiens
tcagcagttttatatgcagctt

SEQ ID NO: 10002680 - DNA, 19 bp, Homo sapiens
tcagcatcaatttggtcct

SEQ ID NO: 10002681 - DNA, 22 bp, Homo sapiens
tcagccagccagctacaggctt

SEQ ID NO: 10002682 - DNA, 22 bp, Homo sapiens
tcagcatttcagaagtggcata

SEQ ID NO: 10002683 - DNA, 22 bp, Homo sapiens
tcagcattgtggcagagaatgg

SEQ ID NO: 10002684 - DNA, 22 bp, Homo sapiens
tcaggaagtataatcagattca

SEQ ID NO: 10002685 - DNA, 22 bp, Homo sapiens
tcaggaagggtggtccacaggg

SEQ ID NO: 10002686 - DNA, 22 bp, Homo sapiens
tcaggaagggctcagtctgtgc

SEQ ID NO: 10002687 - DNA, 22 bp, Homo sapiens
tcagctggtgagtggatagaca

SEQ ID NO: 10002688 - DNA, 22 bp, Homo sapiens
tcagctgtactgtgccatagct

SEQ ID NO: 10002689 - DNA, 21 bp, Homo sapiens
tcagctgtagagattacattc

SEQ ID NO: 10002690 - DNA, 22 bp, Homo sapiens
tcagctggtgaatggactcatc

SEQ ID NO: 10002691 - DNA, 23 bp, Homo sapiens
tcagctgcttcctcctgcctgcc

SEQ ID NO: 10002692 - DNA, 23 bp, Homo sapiens
tcagctgcttcctcctgcctgcc

SEQ ID NO: 10002693 - DNA, 22 bp, Homo sapiens
tcagctggagatgagaaccgaa

SEQ ID NO: 10002694 - DNA, 19 bp, Homo sapiens
tcagctggcaggcctcctc

SEQ ID NO: 10002695 - DNA, 19 bp, Homo sapiens
tcagctggcaggcctcctc

SEQ ID NO: 10002696 - DNA, 22 bp, Homo sapiens
tcagctggcaggttctgggaag

SEQ ID NO: 10002697 - DNA, 22 bp, Homo sapiens
tcagctggcagttcagaggctg

SEQ ID NO: 10002698 - DNA, 18 bp, Homo sapiens
tcagctggggctgcagcc

SEQ ID NO: 10002699 - DNA, 22 bp, Homo sapiens
tcagctggcatcggctcaccca

SEQ ID NO: 10002700 - DNA, 22 bp, Homo sapiens
tcaggacatttgtcagcaggag

SEQ ID NO: 10002701 - DNA, 22 bp, Homo sapiens
tcaggacagggatcacatcatc

SEQ ID NO: 10002702 - DNA, 22 bp, Homo sapiens
tcaggacagccagggtgcagac

SEQ ID NO: 10002703 - DNA, 22 bp, Homo sapiens
tcaggacaatagtgatttttac

SEQ ID NO: 10002704 - DNA, 22 bp, Homo sapiens
tcaggacacttggcacaaggtc

SEQ ID NO: 10002705 - DNA, 22 bp, Homo sapiens
tcaggagaaagccaattagagt

SEQ ID NO: 10002706 - DNA, 22 bp, Homo sapiens
tcaggagaacttccttctaccc

SEQ ID NO: 10002707 - DNA, 22 bp, Homo sapiens
tcaggagaaaatatcaggaagt

SEQ ID NO: 10002708 - DNA, 22 bp, Homo sapiens
tcaggagaatcagggctgtcct

SEQ ID NO: 10002709 - DNA, 18 bp, Homo sapiens
tcaggagacacagacgca

SEQ ID NO: 10002710 - DNA, 22 bp, Homo sapiens
tcaggagactggcagtgcccac

SEQ ID NO: 10002711 - DNA, 22 bp, Homo sapiens
tcagcaagaagctgtgggcttc

SEQ ID NO: 10002712 - DNA, 22 bp, Homo sapiens
tcagcaagaagctgtgggcttc

SEQ ID NO: 10002713 - DNA, 22 bp, Homo sapiens
tcagcaagaagtcatttgtagc

SEQ ID NO: 10002714 - DNA, 22 bp, Homo sapiens
tcagcaagaagtcatttgtagc

SEQ ID NO: 10002715 - DNA, 22 bp, Homo sapiens
tcagcaggctgtcagcaggggc

SEQ ID NO: 10002716 - DNA, 22 bp, Homo sapiens
tcagcaggctgtcagcaggggc

SEQ ID NO: 10002717 - DNA, 22 bp, Homo sapiens
tcagcagggagaggagaatgca

SEQ ID NO: 10002718 - DNA, 17 bp, Homo sapiens
tcagcaggggccaagct

SEQ ID NO: 10002719 - DNA, 22 bp, Homo sapiens
tcagcagggctgtggtgtggct

SEQ ID NO: 10002720 - DNA, 22 bp, Homo sapiens
tcagaatttaaaatgtgtagat

SEQ ID NO: 10002721 - DNA, 22 bp, Homo sapiens
tcagaatttaaaatgtgtagat

SEQ ID NO: 10002722 - DNA, 19 bp, Homo sapiens
tcagaattctgtctcttga

SEQ ID NO: 10002723 - DNA, 22 bp, Homo sapiens
tcagaattgattttcaaaacag

SEQ ID NO: 10002724 - DNA, 22 bp, Homo sapiens
tcagaattggaacgtgaagatt

SEQ ID NO: 10002725 - DNA, 22 bp, Homo sapiens
tcagaattggacaatagaagca

SEQ ID NO: 10002726 - DNA, 22 bp, Homo sapiens
tcagaattagagctcttcttga

SEQ ID NO: 10002727 - DNA, 21 bp, Homo sapiens
tcagaattacccctggatctg

SEQ ID NO: 10002728 - DNA, 22 bp, Homo sapiens
tcagaattctacaatagatcag

SEQ ID NO: 10002729 - DNA, 22 bp, Homo sapiens
tcagaattctagctcttccctt

SEQ ID NO: 10002730 - DNA, 22 bp, Homo sapiens
tcagatgctaaagatggaatta

SEQ ID NO: 10002731 - DNA, 22 bp, Homo sapiens
tcagatggattcattacatgac

SEQ ID NO: 10002732 - DNA, 21 bp, Homo sapiens
tcagattctctcattttgatg

SEQ ID NO: 10002733 - DNA, 22 bp, Homo sapiens
tcagatttctagcgtttggcca

SEQ ID NO: 10002734 - DNA, 22 bp, Homo sapiens
tcagatttatgaatatactatg

SEQ ID NO: 10002735 - DNA, 22 bp, Homo sapiens
tcagatttatgtggctaggctc

SEQ ID NO: 10002736 - DNA, 22 bp, Homo sapiens
tcagattttccagcctttctct

SEQ ID NO: 10002737 - DNA, 22 bp, Homo sapiens
tcagattttgcacgaggttttg

SEQ ID NO: 10002738 - DNA, 22 bp, Homo sapiens
tcagtagtctaggatttcacct

SEQ ID NO: 10002739 - DNA, 22 bp, Homo sapiens
tcagtaatattctttaaaatac

SEQ ID NO: 10002740 - DNA, 22 bp, Homo sapiens
tcagtacagcttagtcttctca

SEQ ID NO: 10002741 - DNA, 22 bp, Homo sapiens
tcagtagttttaagtctgttaa

SEQ ID NO: 10002742 - DNA, 22 bp, Homo sapiens
tcagtagttttgatctgagcag

SEQ ID NO: 10002743 - DNA, 22 bp, Homo sapiens
tcagtaaacaggtttaagtcct

SEQ ID NO: 10002744 - DNA, 22 bp, Homo sapiens
tcagtaaccctgctgttcagag

SEQ ID NO: 10002745 - DNA, 22 bp, Homo sapiens
tcagtaacttacttattcacct

SEQ ID NO: 10002746 - DNA, 22 bp, Homo sapiens
tcagtaacctttagcacagttg

SEQ ID NO: 10002747 - DNA, 22 bp, Homo sapiens
tcagtaactgggttgaagctag

SEQ ID NO: 10002748 - DNA, 19 bp, Homo sapiens
tcagtaacttttaagagga

SEQ ID NO: 10002749 - DNA, 22 bp, Homo sapiens
tcagtaacttcatgaccaagca

SEQ ID NO: 10002750 - DNA, 22 bp, Homo sapiens
tcagtaacttggccgaggtcat

SEQ ID NO: 10002751 - DNA, 22 bp, Homo sapiens
tcagtaaatgagcaaaaatttc

SEQ ID NO: 10002752 - DNA, 22 bp, Homo sapiens
tcagggcatcatcatgaatata

SEQ ID NO: 10002753 - DNA, 22 bp, Homo sapiens
tcagggcatactcttcaaggtc

SEQ ID NO: 10002754 - DNA, 21 bp, Homo sapiens
tcagggcagtgggaggttcct

SEQ ID NO: 10002755 - DNA, 22 bp, Homo sapiens
tcagggccggggctgtggcgag

SEQ ID NO: 10002756 - DNA, 22 bp, Homo sapiens
tcagggcctgagcttttaatta

SEQ ID NO: 10002757 - DNA, 19 bp, Homo sapiens
tcagggccgcagagggtac

SEQ ID NO: 10002758 - DNA, 22 bp, Homo sapiens
tcagggccgccggggatctcgc

SEQ ID NO: 10002759 - DNA, 22 bp, Homo sapiens
tcagggccctggcaggaaacag

SEQ ID NO: 10002760 - DNA, 22 bp, Homo sapiens
tcagggccctggacaaccctcc

SEQ ID NO: 10002761 - DNA, 22 bp, Homo sapiens
tcagggcatctcttaagtggtg

SEQ ID NO: 10002762 - DNA, 22 bp, Homo sapiens
tcagggctgcatacaggagata

SEQ ID NO: 10002763 - DNA, 22 bp, Homo sapiens
tcagggctgcatacaggagata

SEQ ID NO: 10002764 - DNA, 22 bp, Homo sapiens
tcagggctgactgctactctcc

SEQ ID NO: 10002765 - DNA, 22 bp, Homo sapiens
tcagggcctttgcagttgtttt

SEQ ID NO: 10002766 - DNA, 22 bp, Homo sapiens
tcaggcttccaacaatgatgtt

SEQ ID NO: 10002767 - DNA, 22 bp, Homo sapiens
tcaggctgtatatcttgcactc

SEQ ID NO: 10002768 - DNA, 22 bp, Homo sapiens
tcaggctgtagggcccctggag

SEQ ID NO: 10002769 - DNA, 22 bp, Homo sapiens
tcaggctgttcctgtccaaaat

SEQ ID NO: 10002770 - DNA, 22 bp, Homo sapiens
tcaggcttataggtagtggtta

SEQ ID NO: 10002771 - DNA, 22 bp, Homo sapiens
tcagggcaggcgagcagctgct

SEQ ID NO: 10002772 - DNA, 22 bp, Homo sapiens
tcagggcaggacagtgtaggcc

SEQ ID NO: 10002773 - DNA, 21 bp, Homo sapiens
tcagggcagctgctcttcaga

SEQ ID NO: 10002774 - DNA, 22 bp, Homo sapiens
tcaggctggtccccacagtgga

SEQ ID NO: 10002775 - DNA, 22 bp, Homo sapiens
tcaggctggtccccacagtgga

SEQ ID NO: 10002776 - DNA, 22 bp, Homo sapiens
tcaggctgtagggcccctggag

SEQ ID NO: 10002777 - DNA, 22 bp, Homo sapiens
tcaggctggtggtcagatggct

SEQ ID NO: 10002778 - DNA, 22 bp, Homo sapiens
tcaggctggtggtcagatggct

SEQ ID NO: 10002779 - DNA, 22 bp, Homo sapiens
tcaggctggtggtcagatggct

SEQ ID NO: 10002780 - DNA, 22 bp, Homo sapiens
tcaggagacttatgtcacagtg

SEQ ID NO: 10002781 - DNA, 22 bp, Homo sapiens
tcaggagagaaagaatacaatt

SEQ ID NO: 10002782 - DNA, 17 bp, Homo sapiens
tcaggctgggtgcagtg

SEQ ID NO: 10002783 - DNA, 21 bp, Homo sapiens
tcaggagagcccatctacaaa

SEQ ID NO: 10002784 - DNA, 17 bp, Homo sapiens
tcaggctgggtgcagtg

SEQ ID NO: 10002785 - DNA, 17 bp, Homo sapiens
tcaggctgggtgcagtg

SEQ ID NO: 10002786 - DNA, 17 bp, Homo sapiens
tcaggctgggtgcagtg

SEQ ID NO: 10002787 - DNA, 22 bp, Homo sapiens
tcagtgttgaattttttgcaaa

SEQ ID NO: 10002788 - DNA, 22 bp, Homo sapiens
tcagtctcctttcctctagaca

SEQ ID NO: 10002789 - DNA, 22 bp, Homo sapiens
tcagtctcctttcctctagaca

SEQ ID NO: 10002790 - DNA, 22 bp, Homo sapiens
tcagtgtttaccgtatgttgtt

SEQ ID NO: 10002791 - DNA, 22 bp, Homo sapiens
tcagtcctcctctcatagagag

SEQ ID NO: 10002792 - DNA, 18 bp, Homo sapiens
tcagtcctccatagagct

SEQ ID NO: 10002793 - DNA, 22 bp, Homo sapiens
tcagtcctccacacaggcaccc

SEQ ID NO: 10002794 - DNA, 22 bp, Homo sapiens
tcagtattcctggaaatacaag

SEQ ID NO: 10002795 - DNA, 22 bp, Homo sapiens
tcagtcccttctccaggtcagc

SEQ ID NO: 10002796 - DNA, 22 bp, Homo sapiens
tcagttaacaactatttattga

SEQ ID NO: 10002797 - DNA, 22 bp, Homo sapiens
tcagtgtttgaacccagggtta

SEQ ID NO: 10002798 - DNA, 22 bp, Homo sapiens
tcagtgtttcctgtggtacagc

SEQ ID NO: 10002799 - DNA, 22 bp, Homo sapiens
tcagtgttttaactgtctttta

SEQ ID NO: 10002800 - DNA, 22 bp, Homo sapiens
tcataaagcttgcctgcagtgt

SEQ ID NO: 10002801 - DNA, 22 bp, Homo sapiens
tcataaagtgaaggatgatggg

SEQ ID NO: 10002802 - DNA, 22 bp, Homo sapiens
tcataaagttctaagaattgta

SEQ ID NO: 10002803 - DNA, 22 bp, Homo sapiens
tcataaagttctaagaattgta

SEQ ID NO: 10002804 - DNA, 22 bp, Homo sapiens
tcataaagttgttttaatggga

SEQ ID NO: 10002805 - DNA, 22 bp, Homo sapiens
tcataaagttgttttaatggga

SEQ ID NO: 10002806 - DNA, 22 bp, Homo sapiens
tcataaatagttgtgcctgaat

SEQ ID NO: 10002807 - DNA, 23 bp, Homo sapiens
tcataaatattagcacagtagga

SEQ ID NO: 10002808 - DNA, 22 bp, Homo sapiens
tcataaatcatactccatttgc

SEQ ID NO: 10002809 - DNA, 22 bp, Homo sapiens
tcataaatcatactccatttgc

SEQ ID NO: 10002810 - DNA, 22 bp, Homo sapiens
tcataaatcatactccatttgc

SEQ ID NO: 10002811 - DNA, 22 bp, Homo sapiens
tcataaatcatactccatttgc

SEQ ID NO: 10002812 - DNA, 22 bp, Homo sapiens
tcataaatatttgtgggggctt

SEQ ID NO: 10002813 - DNA, 22 bp, Homo sapiens
tcataaatcatactccatttgc

SEQ ID NO: 10002814 - DNA, 23 bp, Homo sapiens
tcataaatattagcacagtagga

SEQ ID NO: 10002815 - DNA, 23 bp, Homo sapiens
tcataaatattagcacagtagga

SEQ ID NO: 10002816 - DNA, 23 bp, Homo sapiens
tcataaatattagcacagtagga

SEQ ID NO: 10002817 - DNA, 23 bp, Homo sapiens
tcatctgtaacagcctatgaaat

SEQ ID NO: 10002818 - DNA, 21 bp, Homo sapiens
tcatcttacagtcctttcttt

SEQ ID NO: 10002819 - DNA, 22 bp, Homo sapiens
tcatctttaccccttgcttcaa

SEQ ID NO: 10002820 - DNA, 22 bp, Homo sapiens
tcatgaaaatagatcagaaatt

SEQ ID NO: 10002821 - DNA, 22 bp, Homo sapiens
tcatgaaaaattttccatgtca

SEQ ID NO: 10002822 - DNA, 22 bp, Homo sapiens
tcatagaaatatcacgtctttt

SEQ ID NO: 10002823 - DNA, 22 bp, Homo sapiens
tcatagaaatatcacgtctttt

SEQ ID NO: 10002824 - DNA, 22 bp, Homo sapiens
tcatacattcagcagatatttg

SEQ ID NO: 10002825 - DNA, 22 bp, Homo sapiens
tcatacattcagcagatatttg

SEQ ID NO: 10002826 - DNA, 22 bp, Homo sapiens
tcatagaaatggaaagtatatt

SEQ ID NO: 10002827 - DNA, 22 bp, Homo sapiens
tcatagaagcaccagaagatat

SEQ ID NO: 10002828 - DNA, 22 bp, Homo sapiens
tcatagaaatgtggccagaaac

SEQ ID NO: 10002829 - DNA, 22 bp, Homo sapiens
tcatagaaatggaaagtatatt

SEQ ID NO: 10002830 - DNA, 22 bp, Homo sapiens
tcatctgaacatgcagcctgtg

SEQ ID NO: 10002831 - DNA, 22 bp, Homo sapiens
tcatagaagcaccagaagatat

SEQ ID NO: 10002832 - DNA, 22 bp, Homo sapiens
tcatagaagtagtatccacatt

SEQ ID NO: 10002833 - DNA, 22 bp, Homo sapiens
tcatagaatgagttaatgaact

SEQ ID NO: 10002834 - DNA, 22 bp, Homo sapiens
tcataaattagctgtctttgaa

SEQ ID NO: 10002835 - DNA, 22 bp, Homo sapiens
tcataaattatctatttggcta

SEQ ID NO: 10002836 - DNA, 22 bp, Homo sapiens
tcataaattatctatttggcta

SEQ ID NO: 10002837 - DNA, 22 bp, Homo sapiens
tcataaattctggtgctgtgag

SEQ ID NO: 10002838 - DNA, 22 bp, Homo sapiens
tcataaattgattatgtgcttt

SEQ ID NO: 10002839 - DNA, 22 bp, Homo sapiens
tcataaatcatactccatttgc

SEQ ID NO: 10002840 - DNA, 22 bp, Homo sapiens
tcataaatgcagtgtcataaat

SEQ ID NO: 10002841 - DNA, 22 bp, Homo sapiens
tcataaattatctatttggcta

SEQ ID NO: 10002842 - DNA, 22 bp, Homo sapiens
tcatacatcttgtatatctatc

SEQ ID NO: 10002843 - DNA, 22 bp, Homo sapiens
tcatacatgttgtgttcaaatg

SEQ ID NO: 10002844 - DNA, 22 bp, Homo sapiens
tcatacatcttgtatatctatc

SEQ ID NO: 10002845 - DNA, 22 bp, Homo sapiens
tcatacatcttgtatatctatc

SEQ ID NO: 10002846 - DNA, 22 bp, Homo sapiens
tcataaattgattatgtgcttt

SEQ ID NO: 10002847 - DNA, 22 bp, Homo sapiens
tcataaattgattatgtgcttt

SEQ ID NO: 10002848 - DNA, 22 bp, Homo sapiens
tcataaattgattatgtgcttt

SEQ ID NO: 10002849 - DNA, 22 bp, Homo sapiens
tcataaattgattatgtgcttt

SEQ ID NO: 10002850 - DNA, 22 bp, Homo sapiens
tcatttctgttgtgcatcactg

SEQ ID NO: 10002851 - DNA, 22 bp, Homo sapiens
tcatttctgttgtgcatcactg

SEQ ID NO: 10002852 - DNA, 22 bp, Homo sapiens
tcatttctgttgtgcatcactg

SEQ ID NO: 10002853 - DNA, 22 bp, Homo sapiens
tcatttctgagccttccatgat

SEQ ID NO: 10002854 - DNA, 22 bp, Homo sapiens
tcatttctgagccttccatgat

SEQ ID NO: 10002855 - DNA, 22 bp, Homo sapiens
tcatttctgagccttccatgat

SEQ ID NO: 10002856 - DNA, 22 bp, Homo sapiens
tcatttctctgagtctgataat

SEQ ID NO: 10002857 - DNA, 22 bp, Homo sapiens
tcatttctctgagtctgataat

SEQ ID NO: 10002858 - DNA, 22 bp, Homo sapiens
tcatttctctgagtctgataat

SEQ ID NO: 10002859 - DNA, 22 bp, Homo sapiens
tcatttctctgagtctgataat

SEQ ID NO: 10002860 - DNA, 20 bp, Homo sapiens
tcatttcttggggttccaag

SEQ ID NO: 10002861 - DNA, 22 bp, Homo sapiens
tcatttctgttgtgcatcactg

SEQ ID NO: 10002862 - DNA, 22 bp, Homo sapiens
tcatttcttaactagagtgaac

SEQ ID NO: 10002863 - DNA, 22 bp, Homo sapiens
tcatttcttaactagagtgaac

SEQ ID NO: 10002864 - DNA, 22 bp, Homo sapiens
tcatttcttaactagagtgaac

SEQ ID NO: 10002865 - DNA, 22 bp, Homo sapiens
tcatttctcctaagtgaaatat

SEQ ID NO: 10002866 - DNA, 22 bp, Homo sapiens
tcatttctcctaagtgaaatat

SEQ ID NO: 10002867 - DNA, 22 bp, Homo sapiens
tcatttctctgagtctgataat

SEQ ID NO: 10002868 - DNA, 21 bp, Homo sapiens
tcatttctctatgtatttcac

SEQ ID NO: 10002869 - DNA, 21 bp, Homo sapiens
tcatttctctatgtatttcac

SEQ ID NO: 10002870 - DNA, 22 bp, Homo sapiens
tcatttctccgacctgctgtcc

SEQ ID NO: 10002871 - DNA, 22 bp, Homo sapiens
tcatttctccgacctgctgtcc

SEQ ID NO: 10002872 - DNA, 22 bp, Homo sapiens
tcatttctccgacctgctgtcc

SEQ ID NO: 10002873 - DNA, 22 bp, Homo sapiens
tcatttctattgctactgtctg

SEQ ID NO: 10002874 - DNA, 22 bp, Homo sapiens
tcatttctattgctactgtctg

SEQ ID NO: 10002875 - DNA, 22 bp, Homo sapiens
tcatttctcccggccaaaaact

SEQ ID NO: 10002876 - DNA, 22 bp, Homo sapiens
tcatttctcccggccaaaaact

SEQ ID NO: 10002877 - DNA, 22 bp, Homo sapiens
tcatttctcccggccaaaaact

SEQ ID NO: 10002878 - DNA, 22 bp, Homo sapiens
tcatttctcccggccaaaaact

SEQ ID NO: 10002879 - DNA, 22 bp, Homo sapiens
tcatttctcccggccaaaaact

SEQ ID NO: 10002880 - DNA, 22 bp, Homo sapiens
tcatttcagccatttttaaatg

SEQ ID NO: 10002881 - DNA, 21 bp, Homo sapiens
tcatttcagggccttggcttc

SEQ ID NO: 10002882 - DNA, 22 bp, Homo sapiens
tcatttcagatgcatttagaat

SEQ ID NO: 10002883 - DNA, 22 bp, Homo sapiens
tcatttcagccatttttaaatg

SEQ ID NO: 10002884 - DNA, 22 bp, Homo sapiens
tcatttcacttctctagggaga

SEQ ID NO: 10002885 - DNA, 23 bp, Homo sapiens
tcatttcacagtgagcttcctag

SEQ ID NO: 10002886 - DNA, 22 bp, Homo sapiens
tcatttcaatgatactactaag

SEQ ID NO: 10002887 - DNA, 22 bp, Homo sapiens
tcatttcagtcctctgtgtgag

SEQ ID NO: 10002888 - DNA, 17 bp, Homo sapiens
tcatttcagtaaatcca

SEQ ID NO: 10002889 - DNA, 23 bp, Homo sapiens
tcatttcaggttgcatggtacca

SEQ ID NO: 10002890 - DNA, 22 bp, Homo sapiens
tcatttcagttcagaggccttt

SEQ ID NO: 10002891 - DNA, 22 bp, Homo sapiens
tcatttcagttgttccctggtt

SEQ ID NO: 10002892 - DNA, 22 bp, Homo sapiens
tcatttcagtggcacagaagat

SEQ ID NO: 10002893 - DNA, 22 bp, Homo sapiens
tcatttcagtggcacagaagat

SEQ ID NO: 10002894 - DNA, 17 bp, Homo sapiens
tcatttctaggcactcc

SEQ ID NO: 10002895 - DNA, 17 bp, Homo sapiens
tcatttctaggcactcc

SEQ ID NO: 10002896 - DNA, 22 bp, Homo sapiens
tcatttctatctatgcagcttc

SEQ ID NO: 10002897 - DNA, 22 bp, Homo sapiens
tcatttctatctatgcagcttc

SEQ ID NO: 10002898 - DNA, 22 bp, Homo sapiens
tcatttccctcctacaaagagg

SEQ ID NO: 10002899 - DNA, 22 bp, Homo sapiens
tcatttcatgtctcaggcactg

SEQ ID NO: 10002900 - DNA, 23 bp, Homo sapiens
tcatttcatccagccttgagagt

SEQ ID NO: 10002901 - DNA, 22 bp, Homo sapiens
tcatgcaggtttccagccagat

SEQ ID NO: 10002902 - DNA, 22 bp, Homo sapiens
tcatgcagtttcttatctgcca

SEQ ID NO: 10002903 - DNA, 22 bp, Homo sapiens
tcatgcatatttgtagtagttc

SEQ ID NO: 10002904 - DNA, 22 bp, Homo sapiens
tcattgccatggcatttgcaga

SEQ ID NO: 10002905 - DNA, 22 bp, Homo sapiens
tcattgtatactttatttatga

SEQ ID NO: 10002906 - DNA, 22 bp, Homo sapiens
tcatttatagctaaccttgaat

SEQ ID NO: 10002907 - DNA, 22 bp, Homo sapiens
tcatttatagctaaccttgaat

SEQ ID NO: 10002908 - DNA, 22 bp, Homo sapiens
tcatttataaggatgcaattaa

SEQ ID NO: 10002909 - DNA, 22 bp, Homo sapiens
tcatttacatagaaacaatata

SEQ ID NO: 10002910 - DNA, 22 bp, Homo sapiens
tcatttacatagaaacaatata

SEQ ID NO: 10002911 - DNA, 22 bp, Homo sapiens
tcatttagttctttcatgtcca

SEQ ID NO: 10002912 - DNA, 22 bp, Homo sapiens
tcatttacacttcacaaatgga

SEQ ID NO: 10002913 - DNA, 22 bp, Homo sapiens
tcatttacacttcacaaatgga

SEQ ID NO: 10002914 - DNA, 22 bp, Homo sapiens
tcatttacaggtgaagcaacta

SEQ ID NO: 10002915 - DNA, 22 bp, Homo sapiens
tcatttaataatttttgagtag

SEQ ID NO: 10002916 - DNA, 22 bp, Homo sapiens
tccaaatattcatctacttctg

SEQ ID NO: 10002917 - DNA, 22 bp, Homo sapiens
tccaaatattcggtctttctga

SEQ ID NO: 10002918 - DNA, 22 bp, Homo sapiens
tccaaatattatgattatagga

SEQ ID NO: 10002919 - DNA, 22 bp, Homo sapiens
tccaaatatcttggtggttagg

SEQ ID NO: 10002920 - DNA, 22 bp, Homo sapiens
tccaaatatattcacgtcctag

SEQ ID NO: 10002921 - DNA, 22 bp, Homo sapiens
tccaaatataggatgtgatata

SEQ ID NO: 10002922 - DNA, 22 bp, Homo sapiens
tccaagaacccaagcgaatgcc

SEQ ID NO: 10002923 - DNA, 22 bp, Homo sapiens
tccaactttctcctccggcttg

SEQ ID NO: 10002924 - DNA, 22 bp, Homo sapiens
tccaactccacctttgtctccc

SEQ ID NO: 10002925 - DNA, 22 bp, Homo sapiens
tccaaatttaccttacagatat

SEQ ID NO: 10002926 - DNA, 22 bp, Homo sapiens
tccaaatttaccttacagatat

SEQ ID NO: 10002927 - DNA, 22 bp, Homo sapiens
tccaaggacgctggacccctgc

SEQ ID NO: 10002928 - DNA, 22 bp, Homo sapiens
tccaaggacattgttctagttg

SEQ ID NO: 10002929 - DNA, 22 bp, Homo sapiens
tccaagaagctcagcaaacatc

SEQ ID NO: 10002930 - DNA, 22 bp, Homo sapiens
tccaaggaggctttgacgtcca

SEQ ID NO: 10002931 - DNA, 19 bp, Homo sapiens
tccaaggcatggcccagtg

SEQ ID NO: 10002932 - DNA, 22 bp, Homo sapiens
tccaaggactcttgtcagctgt

SEQ ID NO: 10002933 - DNA, 22 bp, Homo sapiens
tccaaggagcagatccagagga

SEQ ID NO: 10002934 - DNA, 22 bp, Homo sapiens
tccaaggagcagtcttcaacct

SEQ ID NO: 10002935 - DNA, 22 bp, Homo sapiens
tccaaggtcagcgagagtcact

SEQ ID NO: 10002936 - DNA, 22 bp, Homo sapiens
tccaagtcttccttcccaaacc

SEQ ID NO: 10002937 - DNA, 22 bp, Homo sapiens
tccaatgtgactatcagggagc

SEQ ID NO: 10002938 - DNA, 22 bp, Homo sapiens
tccaatgtgtttgtggcatgga

SEQ ID NO: 10002939 - DNA, 20 bp, Homo sapiens
tccaatgtaggataaatgtg

SEQ ID NO: 10002940 - DNA, 22 bp, Homo sapiens
tccaatgttattatctagaggc

SEQ ID NO: 10002941 - DNA, 22 bp, Homo sapiens
tccaatgttcctgctttcagct

SEQ ID NO: 10002942 - DNA, 22 bp, Homo sapiens
tccaatgttccagggtaaatgt

SEQ ID NO: 10002943 - DNA, 23 bp, Homo sapiens
tccaattcaattgggtcaggaag

SEQ ID NO: 10002944 - DNA, 19 bp, Homo sapiens
tccaatttctattcatgtt

SEQ ID NO: 10002945 - DNA, 22 bp, Homo sapiens
tccaattttacgtctgtataaa

SEQ ID NO: 10002946 - DNA, 22 bp, Homo sapiens
tccaattttacgtctgtataaa

SEQ ID NO: 10002947 - DNA, 22 bp, Homo sapiens
tccaatatttctcatatatgga

SEQ ID NO: 10002948 - DNA, 18 bp, Homo sapiens
tccaaaatcatgtatttt

SEQ ID NO: 10002949 - DNA, 21 bp, Homo sapiens
tccaaacctgtctctggctct

SEQ ID NO: 10002950 - DNA, 22 bp, Homo sapiens
tccaaacaccctccatgctgca

SEQ ID NO: 10002951 - DNA, 22 bp, Homo sapiens
tccaaagaacattgctgagacc

SEQ ID NO: 10002952 - DNA, 22 bp, Homo sapiens
tccaaagaacctggctactgtc

SEQ ID NO: 10002953 - DNA, 22 bp, Homo sapiens
tccaaatacatttactgtattt

SEQ ID NO: 10002954 - DNA, 22 bp, Homo sapiens
tccaaatacatttactgtattt

SEQ ID NO: 10002955 - DNA, 22 bp, Homo sapiens
tccaaataccagatgggctaat

SEQ ID NO: 10002956 - DNA, 23 bp, Homo sapiens
tccaaatacctgtcaccttgtct

SEQ ID NO: 10002957 - DNA, 22 bp, Homo sapiens
tccaaatagttctggaagactg

SEQ ID NO: 10002958 - DNA, 22 bp, Homo sapiens
tccaaatagctggatgatggtg

SEQ ID NO: 10002959 - DNA, 22 bp, Homo sapiens
tccaaatatacagaatctcctc

SEQ ID NO: 10002960 - DNA, 22 bp, Homo sapiens
tccaaatatagatgagttgtaa

SEQ ID NO: 10002961 - DNA, 22 bp, Homo sapiens
tccaaaggaagaggctgtcagt

SEQ ID NO: 10002962 - DNA, 22 bp, Homo sapiens
tccaaagtgttgggattatagg

SEQ ID NO: 10002963 - DNA, 22 bp, Homo sapiens
tccaaagtaatttcacttctgt

SEQ ID NO: 10002964 - DNA, 22 bp, Homo sapiens
tcatttttctcttacacgtaga

SEQ ID NO: 10002965 - DNA, 21 bp, Homo sapiens
tcatttttattgctaccttgc

SEQ ID NO: 10002966 - DNA, 22 bp, Homo sapiens
tcatttgtaccattttttaaga

SEQ ID NO: 10002967 - DNA, 22 bp, Homo sapiens
tcatttgtgcaatgtagatgaa

SEQ ID NO: 10002968 - DNA, 22 bp, Homo sapiens
tcatttgtgtgagtgatttgac

SEQ ID NO: 10002969 - DNA, 22 bp, Homo sapiens
tatgtcaaaaaagattatgttt

SEQ ID NO: 10002970 - DNA, 22 bp, Homo sapiens
tatgtcaaaaaagattatgttt

SEQ ID NO: 10002971 - DNA, 22 bp, Homo sapiens
tatgtattctgagtacaagttc

SEQ ID NO: 10002972 - DNA, 22 bp, Homo sapiens
tatgtatatatgttgggtagaa

SEQ ID NO: 10002973 - DNA, 22 bp, Homo sapiens
tatgtatatggtagaagtatgt

SEQ ID NO: 10002974 - DNA, 22 bp, Homo sapiens
tatgtatatgtatacacacaca

SEQ ID NO: 10002975 - DNA, 22 bp, Homo sapiens
tatgtatatgtgtgttgacaac

SEQ ID NO: 10002976 - DNA, 22 bp, Homo sapiens
tatgtatatgtgtgttgacaac

SEQ ID NO: 10002977 - DNA, 22 bp, Homo sapiens
tatgtatctgttcatcagttaa

SEQ ID NO: 10002978 - DNA, 22 bp, Homo sapiens
tatgtatcttttgttttccctg

SEQ ID NO: 10002979 - DNA, 22 bp, Homo sapiens
tatgtatccgtgtgtgtacaga

SEQ ID NO: 10002980 - DNA, 22 bp, Homo sapiens
tatgtatctgttcatcagttaa

SEQ ID NO: 10002981 - DNA, 22 bp, Homo sapiens
tatgtatctgttcatcagttaa

SEQ ID NO: 10002982 - DNA, 22 bp, Homo sapiens
tatgtatagagtcttttaaatt

SEQ ID NO: 10002983 - DNA, 22 bp, Homo sapiens
tatgtatataggtgtgtgtctc

SEQ ID NO: 10002984 - DNA, 22 bp, Homo sapiens
tatgtatataggtgtgtgtctc

SEQ ID NO: 10002985 - DNA, 22 bp, Homo sapiens
tatgtatataggtgtgtgtctc

SEQ ID NO: 10002986 - DNA, 22 bp, Homo sapiens
tatgtatagagtcttttaaatt

SEQ ID NO: 10002987 - DNA, 22 bp, Homo sapiens
tatgtatagagtcttttaaatt

SEQ ID NO: 10002988 - DNA, 22 bp, Homo sapiens
tatgtataaatgcatgtgtgga

SEQ ID NO: 10002989 - DNA, 22 bp, Homo sapiens
tatgtataaatgcatgtgtgga

SEQ ID NO: 10002990 - DNA, 22 bp, Homo sapiens
tatgtataatcacagagtgtca

SEQ ID NO: 10002991 - DNA, 18 bp, Homo sapiens
tatgtataacatagttca

SEQ ID NO: 10002992 - DNA, 18 bp, Homo sapiens
tatgtataacatagttca

SEQ ID NO: 10002993 - DNA, 22 bp, Homo sapiens
tatgtagtcaagtggatatatg

SEQ ID NO: 10002994 - DNA, 22 bp, Homo sapiens
tatgtagatttctctgtttttc

SEQ ID NO: 10002995 - DNA, 22 bp, Homo sapiens
tatgtcaactgtgctggttaat

SEQ ID NO: 10002996 - DNA, 22 bp, Homo sapiens
tatgtcaaagttaagaaatagg

SEQ ID NO: 10002997 - DNA, 23 bp, Homo sapiens
tatgtcatgagcatattgaatgt

SEQ ID NO: 10002998 - DNA, 22 bp, Homo sapiens
tatgtcatgggtcaaaatgaag

SEQ ID NO: 10002999 - DNA, 22 bp, Homo sapiens
tatgtcatgggtcaaaatgaag

SEQ ID NO: 10003000 - DNA, 22 bp, Homo sapiens
tatgtttctgggcttgatattt

SEQ ID NO: 10003001 - DNA, 22 bp, Homo sapiens
tatgtttctgggcttgatattt

SEQ ID NO: 10003002 - DNA, 22 bp, Homo sapiens
tatgtttcattcttttctggta

SEQ ID NO: 10003003 - DNA, 22 bp, Homo sapiens
tatgtttcatcaggcatggagt

SEQ ID NO: 10003004 - DNA, 22 bp, Homo sapiens
tatgtttatactttgatgtact

SEQ ID NO: 10003005 - DNA, 22 bp, Homo sapiens
tatgtcatgtcttagagaatga

SEQ ID NO: 10003006 - DNA, 22 bp, Homo sapiens
tattaaattatggatttaggag

SEQ ID NO: 10003007 - DNA, 22 bp, Homo sapiens
tattaaattatggatttaggag

SEQ ID NO: 10003008 - DNA, 22 bp, Homo sapiens
tattaaattatggatttaggag

SEQ ID NO: 10003009 - DNA, 22 bp, Homo sapiens
tattaaattatggatttaggag

SEQ ID NO: 10003010 - DNA, 22 bp, Homo sapiens
tatgtttggcctggcaatttca

SEQ ID NO: 10003011 - DNA, 22 bp, Homo sapiens
tatgtttggcctggcaatttca

SEQ ID NO: 10003012 - DNA, 22 bp, Homo sapiens
tattaaattatggatttaggag

SEQ ID NO: 10003013 - DNA, 22 bp, Homo sapiens
tattaaattatggatttaggag

SEQ ID NO: 10003014 - DNA, 22 bp, Homo sapiens
tattaaattatggatttaggag

SEQ ID NO: 10003015 - DNA, 22 bp, Homo sapiens
tattaaattatggatttaggag

SEQ ID NO: 10003016 - DNA, 22 bp, Homo sapiens
tattaacacgtataaagtgttt

SEQ ID NO: 10003017 - DNA, 22 bp, Homo sapiens
tattaatatgtgtgtgcatgta

SEQ ID NO: 10003018 - DNA, 21 bp, Homo sapiens
tattaatatgtctaagctgat

SEQ ID NO: 10003019 - DNA, 22 bp, Homo sapiens
tattaataagtgactactagct

SEQ ID NO: 10003020 - DNA, 22 bp, Homo sapiens
tattaacacgtataaagtgttt

SEQ ID NO: 10003021 - DNA, 22 bp, Homo sapiens
tattaacatgaactgacttttc

SEQ ID NO: 10003022 - DNA, 22 bp, Homo sapiens
tattaataaatatgtaggggcc

SEQ ID NO: 10003023 - DNA, 22 bp, Homo sapiens
tatgctttgcaattggaaaagg

SEQ ID NO: 10003024 - DNA, 22 bp, Homo sapiens
tatgctttaacattaaacaaca

SEQ ID NO: 10003025 - DNA, 22 bp, Homo sapiens
tatgctttaacattaaacaaca

SEQ ID NO: 10003026 - DNA, 22 bp, Homo sapiens
tatgctttaaccctcttatatt

SEQ ID NO: 10003027 - DNA, 22 bp, Homo sapiens
tatgctttacttttcattgtga

SEQ ID NO: 10003028 - DNA, 22 bp, Homo sapiens
tatggaaataattagacaagtg

SEQ ID NO: 10003029 - DNA, 22 bp, Homo sapiens
tatggaatggctattttctagg

SEQ ID NO: 10003030 - DNA, 22 bp, Homo sapiens
tatggaaactaattcatttttc

SEQ ID NO: 10003031 - DNA, 22 bp, Homo sapiens
tatggaaagctctttttgattg

SEQ ID NO: 10003032 - DNA, 22 bp, Homo sapiens
tatgtaagttgcaaatgaagga

SEQ ID NO: 10003033 - DNA, 22 bp, Homo sapiens
tatgtaaagtagatggcaggta

SEQ ID NO: 10003034 - DNA, 22 bp, Homo sapiens
tatgtacatacatgtgcatacg

SEQ ID NO: 10003035 - DNA, 22 bp, Homo sapiens
tatgtacatacatgtgcatacg

SEQ ID NO: 10003036 - DNA, 22 bp, Homo sapiens
tatgtacatacatgtgcatacg

SEQ ID NO: 10003037 - DNA, 22 bp, Homo sapiens
tatgtaaagtagatggcaggta

SEQ ID NO: 10003038 - DNA, 22 bp, Homo sapiens
tatgtaaaaattcatcaggctg

SEQ ID NO: 10003039 - DNA, 22 bp, Homo sapiens
tatgtaaaggattgagatgaat

SEQ ID NO: 10003040 - DNA, 22 bp, Homo sapiens
tatgtaaaaattcatcaggctg

SEQ ID NO: 10003041 - DNA, 22 bp, Homo sapiens
tatgtaaaaattcatcaggctg

SEQ ID NO: 10003042 - DNA, 22 bp, Homo sapiens
tatggttatgtaatcagttgtt

SEQ ID NO: 10003043 - DNA, 22 bp, Homo sapiens
tatgtactttcctgggaatgtt

SEQ ID NO: 10003044 - DNA, 22 bp, Homo sapiens
tatgtagacaggctgcttttcc

SEQ ID NO: 10003045 - DNA, 22 bp, Homo sapiens
tatgtactcatcaactattgaa

SEQ ID NO: 10003046 - DNA, 22 bp, Homo sapiens
tatgtactctaatttgtctcat

SEQ ID NO: 10003047 - DNA, 22 bp, Homo sapiens
tatgtactacactagaacattt

SEQ ID NO: 10003048 - DNA, 22 bp, Homo sapiens
tatgtacatatacacgtgtgtg

SEQ ID NO: 10003049 - DNA, 22 bp, Homo sapiens
tatgtacatacatgtgcatacg

SEQ ID NO: 10003050 - DNA, 22 bp, Homo sapiens
tatgtacatacatgtgcatacg

SEQ ID NO: 10003051 - DNA, 22 bp, Homo sapiens
tatgtacatacatgtgcatacg

SEQ ID NO: 10003052 - DNA, 22 bp, Homo sapiens
tatgaaaatttagctgaagcat

SEQ ID NO: 10003053 - DNA, 22 bp, Homo sapiens
tatcttttgagttctcaagatg

SEQ ID NO: 10003054 - DNA, 23 bp, Homo sapiens
tatctttttcaatgttggaaata

SEQ ID NO: 10003055 - DNA, 22 bp, Homo sapiens
tatccaaacatatagtctctct

SEQ ID NO: 10003056 - DNA, 22 bp, Homo sapiens
tatccaaaggaacaatcacagc

SEQ ID NO: 10003057 - DNA, 22 bp, Homo sapiens
tatcatttagagtatttcttca

SEQ ID NO: 10003058 - DNA, 22 bp, Homo sapiens
tatcatttgttattattagtgg

SEQ ID NO: 10003059 - DNA, 22 bp, Homo sapiens
tatcatttagagtatttcttca

SEQ ID NO: 10003060 - DNA, 22 bp, Homo sapiens
tatcatttaacagaatcattgc

SEQ ID NO: 10003061 - DNA, 22 bp, Homo sapiens
tatcatttaacagaatcattgc

SEQ ID NO: 10003062 - DNA, 22 bp, Homo sapiens
tatgaaatttaaacacagatca

SEQ ID NO: 10003063 - DNA, 22 bp, Homo sapiens
tatgaaatttaaacacagatca

SEQ ID NO: 10003064 - DNA, 22 bp, Homo sapiens
tatgaaatttaaacacagatca

SEQ ID NO: 10003065 - DNA, 22 bp, Homo sapiens
tatgaaattgccatttttatgg

SEQ ID NO: 10003066 - DNA, 22 bp, Homo sapiens
tatgaaattgccatttttatgg

SEQ ID NO: 10003067 - DNA, 22 bp, Homo sapiens
tatgaatataccacaatttagg

SEQ ID NO: 10003068 - DNA, 22 bp, Homo sapiens
tatgaagtgatgttgaattttg

SEQ ID NO: 10003069 - DNA, 22 bp, Homo sapiens
tatgaagtgagttatggttgct

SEQ ID NO: 10003070 - DNA, 22 bp, Homo sapiens
tatgaagtctctgatgttgagt

SEQ ID NO: 10003071 - DNA, 22 bp, Homo sapiens
tatgaagtagagcagagatgcc

SEQ ID NO: 10003072 - DNA, 20 bp, Homo sapiens
tatgacaacgcagcaaggca

SEQ ID NO: 10003073 - DNA, 22 bp, Homo sapiens
tatgacaagaaatacagaggta

SEQ ID NO: 10003074 - DNA, 22 bp, Homo sapiens
tatgacaaggtggagtatgagt

SEQ ID NO: 10003075 - DNA, 22 bp, Homo sapiens
tatgacaaagagaggcccatgc

SEQ ID NO: 10003076 - DNA, 22 bp, Homo sapiens
tatgaattctgttcattgatga

SEQ ID NO: 10003077 - DNA, 18 bp, Homo sapiens
tataaacacacttaggtt

SEQ ID NO: 10003078 - DNA, 22 bp, Homo sapiens
tataaagaaggcacagcaagac

SEQ ID NO: 10003079 - DNA, 22 bp, Homo sapiens
tagttttttcaacaaatggtgc

SEQ ID NO: 10003080 - DNA, 22 bp, Homo sapiens
tataaagtgtgaactgtgagta

SEQ ID NO: 10003081 - DNA, 22 bp, Homo sapiens
tataaagtgtgaactgtgagta

SEQ ID NO: 10003082 - DNA, 22 bp, Homo sapiens
tatcacaggtgtgatttacatt

SEQ ID NO: 10003083 - DNA, 22 bp, Homo sapiens
tataaagttggggctgaagtaa

SEQ ID NO: 10003084 - DNA, 22 bp, Homo sapiens
tataaagttggggctgaagtaa

SEQ ID NO: 10003085 - DNA, 22 bp, Homo sapiens
tataaagagtctcaaagaagtt

SEQ ID NO: 10003086 - DNA, 22 bp, Homo sapiens
tataaagagtctcaaagaagtt

SEQ ID NO: 10003087 - DNA, 22 bp, Homo sapiens
tataaagtgtgaactgtgagta

SEQ ID NO: 10003088 - DNA, 22 bp, Homo sapiens
tataaagaatccagaagagaca

SEQ ID NO: 10003089 - DNA, 22 bp, Homo sapiens
tataaagagtctcaaagaagtt

SEQ ID NO: 10003090 - DNA, 22 bp, Homo sapiens
tatcagcaactcagagcagtct

SEQ ID NO: 10003091 - DNA, 22 bp, Homo sapiens
tatcagcaagatggcagtatag

SEQ ID NO: 10003092 - DNA, 22 bp, Homo sapiens
tatcagcaccgcggacagcatc

SEQ ID NO: 10003093 - DNA, 22 bp, Homo sapiens
tatcagcatctcctcaaagata

SEQ ID NO: 10003094 - DNA, 21 bp, Homo sapiens
tatcagaagagaaagaatgat

SEQ ID NO: 10003095 - DNA, 22 bp, Homo sapiens
tatcagataatcttttacaagc

SEQ ID NO: 10003096 - DNA, 21 bp, Homo sapiens
tatcagagacattgagaggca

SEQ ID NO: 10003097 - DNA, 22 bp, Homo sapiens
tatcagatatagcattcactgg

SEQ ID NO: 10003098 - DNA, 18 bp, Homo sapiens
tatcactgctgaacaaga

SEQ ID NO: 10003099 - DNA, 22 bp, Homo sapiens
tatcagaaatgccttaaattgg

SEQ ID NO: 10003100 - DNA, 22 bp, Homo sapiens
tatcagaaatgccttaaattgg

SEQ ID NO: 10003101 - DNA, 22 bp, Homo sapiens
tatcagaagacttacagtatcg

SEQ ID NO: 10003102 - DNA, 22 bp, Homo sapiens
tatcacatagtgtttagtaaat

SEQ ID NO: 10003103 - DNA, 21 bp, Homo sapiens
tatcacagtagaataggatct

SEQ ID NO: 10003104 - DNA, 21 bp, Homo sapiens
tatcacagtagaataggatct

SEQ ID NO: 10003105 - DNA, 22 bp, Homo sapiens
tatcactacacctggctaatta

SEQ ID NO: 10003106 - DNA, 22 bp, Homo sapiens
tatcacatttggagatttatga

SEQ ID NO: 10003107 - DNA, 22 bp, Homo sapiens
tatcacatcaatgttttaaaat

SEQ ID NO: 10003108 - DNA, 22 bp, Homo sapiens
tatcacatcaatgttttaaaat

SEQ ID NO: 10003109 - DNA, 22 bp, Homo sapiens
tatttgatggttctaaaacagc

SEQ ID NO: 10003110 - DNA, 22 bp, Homo sapiens
tatttgatggttctaaaacagc

SEQ ID NO: 10003111 - DNA, 22 bp, Homo sapiens
tatttgatgaaggtaaagtctt

SEQ ID NO: 10003112 - DNA, 22 bp, Homo sapiens
tatttgatagagataaatgata

SEQ ID NO: 10003113 - DNA, 22 bp, Homo sapiens
tatttgctcaaccctgcctcca

SEQ ID NO: 10003114 - DNA, 22 bp, Homo sapiens
tatttgcaggcttttgtcatgg

SEQ ID NO: 10003115 - DNA, 22 bp, Homo sapiens
tatttgcaggacatagatatgg

SEQ ID NO: 10003116 - DNA, 22 bp, Homo sapiens
tatttgaagggagaaagtgcca

SEQ ID NO: 10003117 - DNA, 22 bp, Homo sapiens
tatttgaatcctggttcttcag

SEQ ID NO: 10003118 - DNA, 22 bp, Homo sapiens
tatttgaaggcatacattttga

SEQ ID NO: 10003119 - DNA, 22 bp, Homo sapiens
tatttgaaggcatacattttga

SEQ ID NO: 10003120 - DNA, 22 bp, Homo sapiens
tatttgaagggagaaagtgcca

SEQ ID NO: 10003121 - DNA, 22 bp, Homo sapiens
tatttgaatcctggttcttcag

SEQ ID NO: 10003122 - DNA, 22 bp, Homo sapiens
tatttcttgttattctcgttga

SEQ ID NO: 10003123 - DNA, 22 bp, Homo sapiens
tatttcttgttattctcgttga

SEQ ID NO: 10003124 - DNA, 22 bp, Homo sapiens
tatttcttgagtggtcagtttc

SEQ ID NO: 10003125 - DNA, 22 bp, Homo sapiens
tatttcttgttattctcgttga

SEQ ID NO: 10003126 - DNA, 22 bp, Homo sapiens
tattttgaaagtctgttttgaa

SEQ ID NO: 10003127 - DNA, 22 bp, Homo sapiens
tattttctggggagagtgaacc

SEQ ID NO: 10003128 - DNA, 22 bp, Homo sapiens
tattttctggacagtcttgctt

SEQ ID NO: 10003129 - DNA, 22 bp, Homo sapiens
tattttctggacagtcttgctt

SEQ ID NO: 10003130 - DNA, 23 bp, Homo sapiens
tattttcctggcaacaggggaac

SEQ ID NO: 10003131 - DNA, 23 bp, Homo sapiens
tattttccaaatgatgactacat

SEQ ID NO: 10003132 - DNA, 22 bp, Homo sapiens
tattttcattctgtgtgactgt

SEQ ID NO: 10003133 - DNA, 22 bp, Homo sapiens
tatttggacaccaagtagaagt

SEQ ID NO: 10003134 - DNA, 22 bp, Homo sapiens
tattttcattctgtgtgactgt

SEQ ID NO: 10003135 - DNA, 23 bp, Homo sapiens
tattttccaaatgatgactacat

SEQ ID NO: 10003136 - DNA, 23 bp, Homo sapiens
tatttggaaagagggaagaagac

SEQ ID NO: 10003137 - DNA, 22 bp, Homo sapiens
tatttggaaatagggctttgta

SEQ ID NO: 10003138 - DNA, 22 bp, Homo sapiens
tatttgctgacagtgctggagc

SEQ ID NO: 10003139 - DNA, 22 bp, Homo sapiens
tatttgctgaatctgattcaga

SEQ ID NO: 10003140 - DNA, 22 bp, Homo sapiens
tatttgctgtgcttattccatt

SEQ ID NO: 10003141 - DNA, 22 bp, Homo sapiens
tatttgctgtgcttattccatt

SEQ ID NO: 10003142 - DNA, 21 bp, Homo sapiens
tatttgctgccatctttgagg

SEQ ID NO: 10003143 - DNA, 22 bp, Homo sapiens
tatttggaaaagggaagggaca

SEQ ID NO: 10003144 - DNA, 22 bp, Homo sapiens
tatttgcttttgtgccacagat

SEQ ID NO: 10003145 - DNA, 22 bp, Homo sapiens
tatttgctttgctttatagaga

SEQ ID NO: 10003146 - DNA, 22 bp, Homo sapiens
tatttgcttggaaacctaatcc

SEQ ID NO: 10003147 - DNA, 22 bp, Homo sapiens
tattgtatcttaccacatgtat

SEQ ID NO: 10003148 - DNA, 22 bp, Homo sapiens
tattgtctgtccgggtcaaagc

SEQ ID NO: 10003149 - DNA, 22 bp, Homo sapiens
tattgtctctgcgttgttctat

SEQ ID NO: 10003150 - DNA, 22 bp, Homo sapiens
tattgtctaggaattgtttaaa

SEQ ID NO: 10003151 - DNA, 22 bp, Homo sapiens
tattgtccatgtgtctgttagc

SEQ ID NO: 10003152 - DNA, 22 bp, Homo sapiens
tattgtccatggctgctttggt

SEQ ID NO: 10003153 - DNA, 22 bp, Homo sapiens
tattgtccaataggatgttcct

SEQ ID NO: 10003154 - DNA, 22 bp, Homo sapiens
tattaatttaatctccatggta

SEQ ID NO: 10003155 - DNA, 21 bp, Homo sapiens
tattaatttttcttcccacta

SEQ ID NO: 10003156 - DNA, 22 bp, Homo sapiens
tattacaaattataatgggaga

SEQ ID NO: 10003157 - DNA, 23 bp, Homo sapiens
tattacaattggtcttattaaga

SEQ ID NO: 10003158 - DNA, 23 bp, Homo sapiens
tattacaattggtcttattaaga

SEQ ID NO: 10003159 - DNA, 23 bp, Homo sapiens
tattacaattggtcttattaaga

SEQ ID NO: 10003160 - DNA, 22 bp, Homo sapiens
tattacaatttacattgcactt

SEQ ID NO: 10003161 - DNA, 23 bp, Homo sapiens
tattacaattggtcttattaaga

SEQ ID NO: 10003162 - DNA, 22 bp, Homo sapiens
tattacaatttacattgcactt

SEQ ID NO: 10003163 - DNA, 22 bp, Homo sapiens
tatttaaaaagaggccagctgg

SEQ ID NO: 10003164 - DNA, 22 bp, Homo sapiens
tatttaaaaagaggccagctgg

SEQ ID NO: 10003165 - DNA, 22 bp, Homo sapiens
tatttaaaataagccccagtgg

SEQ ID NO: 10003166 - DNA, 22 bp, Homo sapiens
tatttaaaataagccccagtgg

SEQ ID NO: 10003167 - DNA, 22 bp, Homo sapiens
tatttaaaataagccccagtgg

SEQ ID NO: 10003168 - DNA, 22 bp, Homo sapiens
tatttaaaataagccccagtgg

SEQ ID NO: 10003169 - DNA, 22 bp, Homo sapiens
tatttaaaatagtgctccagca

SEQ ID NO: 10003170 - DNA, 22 bp, Homo sapiens
tatttaaaatagtgctccagca

SEQ ID NO: 10003171 - DNA, 22 bp, Homo sapiens
tatttaaaatagtgctccagca

SEQ ID NO: 10003172 - DNA, 22 bp, Homo sapiens
tatttaaaatagtgctccagca

SEQ ID NO: 10003173 - DNA, 22 bp, Homo sapiens
tatttaataaaactatggcatg

SEQ ID NO: 10003174 - DNA, 22 bp, Homo sapiens
tatttaataaaactatggcatg

SEQ ID NO: 10003175 - DNA, 22 bp, Homo sapiens
tatttaagatgtgtcataaaga

SEQ ID NO: 10003176 - DNA, 22 bp, Homo sapiens
tatttaagatgtgtcataaaga

SEQ ID NO: 10003177 - DNA, 22 bp, Homo sapiens
tatttaaccagttaaatttcca

SEQ ID NO: 10003178 - DNA, 22 bp, Homo sapiens
tattgtttctggctgtggcagc

SEQ ID NO: 10003179 - DNA, 22 bp, Homo sapiens
tatttaaaaagaggccagctgg

SEQ ID NO: 10003180 - DNA, 22 bp, Homo sapiens
tatttaaaaagaggccagctgg

SEQ ID NO: 10003181 - DNA, 22 bp, Homo sapiens
tattgtgaatttggaagcaatg

SEQ ID NO: 10003182 - DNA, 22 bp, Homo sapiens
tcaaatacatggtcaatcaact

SEQ ID NO: 10003183 - DNA, 22 bp, Homo sapiens
tcaaataatgccattcatcatc

SEQ ID NO: 10003184 - DNA, 22 bp, Homo sapiens
tcaaatacatggtcaatcaact

SEQ ID NO: 10003185 - DNA, 22 bp, Homo sapiens
tcaaatatgtgatagaagctaa

SEQ ID NO: 10003186 - DNA, 22 bp, Homo sapiens
tcaaatatgtgatagaagctaa

SEQ ID NO: 10003187 - DNA, 22 bp, Homo sapiens
tcaaatatgtgatagaagctaa

SEQ ID NO: 10003188 - DNA, 22 bp, Homo sapiens
tcaaatatgtgatagaagctaa

SEQ ID NO: 10003189 - DNA, 22 bp, Homo sapiens
tcaaataccagcaatttcatgt

SEQ ID NO: 10003190 - DNA, 22 bp, Homo sapiens
tcaaatagttgacattaacttg

SEQ ID NO: 10003191 - DNA, 22 bp, Homo sapiens
tcaaataggtatgagtagaaat

SEQ ID NO: 10003192 - DNA, 22 bp, Homo sapiens
tcaaatctttgaccacttatgt

SEQ ID NO: 10003193 - DNA, 22 bp, Homo sapiens
tcaaatgagaggcagggcagct

SEQ ID NO: 10003194 - DNA, 22 bp, Homo sapiens
tcaaatcccagctcagcctctc

SEQ ID NO: 10003195 - DNA, 21 bp, Homo sapiens
tcaaatcatgtactgaccaca

SEQ ID NO: 10003196 - DNA, 22 bp, Homo sapiens
tcaaatcagcaagcagcttccc

SEQ ID NO: 10003197 - DNA, 22 bp, Homo sapiens
tcaaatattggctatttcacat

SEQ ID NO: 10003198 - DNA, 22 bp, Homo sapiens
tcaaatattggctatttcacat

SEQ ID NO: 10003199 - DNA, 22 bp, Homo sapiens
tcaaatcaccaaactcactggc

SEQ ID NO: 10003200 - DNA, 22 bp, Homo sapiens
tcaaagtaccattatcagtgga

SEQ ID NO: 10003201 - DNA, 22 bp, Homo sapiens
tcaaagtaagaatttattacaa

SEQ ID NO: 10003202 - DNA, 22 bp, Homo sapiens
tcaaagtagccggatggaattt

SEQ ID NO: 10003203 - DNA, 22 bp, Homo sapiens
tcaaagtagccggatggaattt

SEQ ID NO: 10003204 - DNA, 22 bp, Homo sapiens
tcaaagtagccggatggaattt

SEQ ID NO: 10003205 - DNA, 22 bp, Homo sapiens
tcaaagtactactcagttcagc

SEQ ID NO: 10003206 - DNA, 22 bp, Homo sapiens
tcaaataatgccattcatcatc

SEQ ID NO: 10003207 - DNA, 22 bp, Homo sapiens
tcaaataaggagtcatgaccat

SEQ ID NO: 10003208 - DNA, 22 bp, Homo sapiens
tcaaagtattttaactgtatcc

SEQ ID NO: 10003209 - DNA, 22 bp, Homo sapiens
tcaaagtcatggcaggctcaga

SEQ ID NO: 10003210 - DNA, 17 bp, Homo sapiens
tcaaagtattctgatgc

SEQ ID NO: 10003211 - DNA, 23 bp, Homo sapiens
tcaaagtagttttatccaataaa

SEQ ID NO: 10003212 - DNA, 22 bp, Homo sapiens
tcaaagtataattgcttttttg

SEQ ID NO: 10003213 - DNA, 22 bp, Homo sapiens
tattttgtaattggtcatagct

SEQ ID NO: 10003214 - DNA, 22 bp, Homo sapiens
tattttgtaattggtcatagct

SEQ ID NO: 10003215 - DNA, 22 bp, Homo sapiens
tattttgctttagctgactgtt

SEQ ID NO: 10003216 - DNA, 22 bp, Homo sapiens
tattttgcgttgagtcagattt

SEQ ID NO: 10003217 - DNA, 20 bp, Homo sapiens
tattttgcaattatggttca

SEQ ID NO: 10003218 - DNA, 22 bp, Homo sapiens
tattttgactattaaaccaaca

SEQ ID NO: 10003219 - DNA, 22 bp, Homo sapiens
tattttgcaaacctgagtttga

SEQ ID NO: 10003220 - DNA, 22 bp, Homo sapiens
tattttgtgccatgcactgcct

SEQ ID NO: 10003221 - DNA, 22 bp, Homo sapiens
tatttttgcctctcagataaaa

SEQ ID NO: 10003222 - DNA, 22 bp, Homo sapiens
tattttgttttgtatccactgt

SEQ ID NO: 10003223 - DNA, 22 bp, Homo sapiens
tatttttgcctctcagataaaa

SEQ ID NO: 10003224 - DNA, 22 bp, Homo sapiens
tcaaagagctctatcttcaaaa

SEQ ID NO: 10003225 - DNA, 22 bp, Homo sapiens
tcaaagagctctatcttcaaaa

SEQ ID NO: 10003226 - DNA, 22 bp, Homo sapiens
tcaaagacatggggaagctgag

SEQ ID NO: 10003227 - DNA, 22 bp, Homo sapiens
tcaaagacatggggaagctgag

SEQ ID NO: 10003228 - DNA, 22 bp, Homo sapiens
tcaaagacagacatcagtcaaa

SEQ ID NO: 10003229 - DNA, 22 bp, Homo sapiens
tcaaagactatatattttattt

SEQ ID NO: 10003230 - DNA, 22 bp, Homo sapiens
tcaaagactatatattttattt

SEQ ID NO: 10003231 - DNA, 21 bp, Homo sapiens
tcaaagactggggctgtgtgc

SEQ ID NO: 10003232 - DNA, 22 bp, Homo sapiens
tcaaagatgataggaaatcata

SEQ ID NO: 10003233 - DNA, 22 bp, Homo sapiens
tcaaagatgataggaaatcata

SEQ ID NO: 10003234 - DNA, 22 bp, Homo sapiens
tcaaagatgataggaaatcata

SEQ ID NO: 10003235 - DNA, 22 bp, Homo sapiens
tcaaagatagatgttgagaaat

SEQ ID NO: 10003236 - DNA, 22 bp, Homo sapiens
tcaaagatagatgttgagaaat

SEQ ID NO: 10003237 - DNA, 19 bp, Homo sapiens
tcaaagcaagcatgttctg

SEQ ID NO: 10003238 - DNA, 22 bp, Homo sapiens
tcaaagatgatgctgaagttat

SEQ ID NO: 10003239 - DNA, 22 bp, Homo sapiens
tcaaagaagtgcaaacctcatc

SEQ ID NO: 10003240 - DNA, 20 bp, Homo sapiens
tcaaagaagattcagctcaa

SEQ ID NO: 10003241 - DNA, 20 bp, Homo sapiens
tcaaagacaagctctcatcc

SEQ ID NO: 10003242 - DNA, 17 bp, Homo sapiens
tcaaagaatgcatgcag

SEQ ID NO: 10003243 - DNA, 22 bp, Homo sapiens
tcaaacttggtaagagaaatac

SEQ ID NO: 10003244 - DNA, 22 bp, Homo sapiens
tcaaactgttcagaactccttt

SEQ ID NO: 10003245 - DNA, 22 bp, Homo sapiens
tcaaactgtttacagtgagata

SEQ ID NO: 10003246 - DNA, 23 bp, Homo sapiens
tcaaactgttatattgccagagt

SEQ ID NO: 10003247 - DNA, 22 bp, Homo sapiens
tcaaactgttcagaactccttt

SEQ ID NO: 10003248 - DNA, 22 bp, Homo sapiens
tcaaactgaactaagatccaac

SEQ ID NO: 10003249 - DNA, 22 bp, Homo sapiens
tcaaactgaattaaacacttgt

SEQ ID NO: 10003250 - DNA, 22 bp, Homo sapiens
tcaaactgctaccttttatgtg

SEQ ID NO: 10003251 - DNA, 22 bp, Homo sapiens
tcaaactgttagatttcagctc

SEQ ID NO: 10003252 - DNA, 18 bp, Homo sapiens
tcaaactgtcattggtga

SEQ ID NO: 10003253 - DNA, 22 bp, Homo sapiens
tcaaactggggaacttatttat

SEQ ID NO: 10003254 - DNA, 18 bp, Homo sapiens
tcaaactgtcattggtga

SEQ ID NO: 10003255 - DNA, 22 bp, Homo sapiens
tcaaactggcagacttctactt

SEQ ID NO: 10003256 - DNA, 22 bp, Homo sapiens
tagctgttaagttgtttggaaa

SEQ ID NO: 10003257 - DNA, 22 bp, Homo sapiens
tagctgttacccataaaagcca

SEQ ID NO: 10003258 - DNA, 22 bp, Homo sapiens
tagctgtgtgtccttgggcaaa

SEQ ID NO: 10003259 - DNA, 17 bp, Homo sapiens
tagctgtgtttcagcta

SEQ ID NO: 10003260 - DNA, 22 bp, Homo sapiens
tagctgtgtagacactcagagc

SEQ ID NO: 10003261 - DNA, 22 bp, Homo sapiens
tagctgtgtatggtttacaaat

SEQ ID NO: 10003262 - DNA, 22 bp, Homo sapiens
tagctgtgtgatgggaaacctt

SEQ ID NO: 10003263 - DNA, 22 bp, Homo sapiens
tagctgtgtaacatgagaatgt

SEQ ID NO: 10003264 - DNA, 22 bp, Homo sapiens
tagctgtgtaagcttggtaaga

SEQ ID NO: 10003265 - DNA, 23 bp, Homo sapiens
tagctgtggcgtaaggctcagct

SEQ ID NO: 10003266 - DNA, 22 bp, Homo sapiens
tagctgtgtaacatgagaatgt

SEQ ID NO: 10003267 - DNA, 20 bp, Homo sapiens
taggcagagctgtgcagcct

SEQ ID NO: 10003268 - DNA, 20 bp, Homo sapiens
taggcagagctgtgcagcct

SEQ ID NO: 10003269 - DNA, 22 bp, Homo sapiens
taggcagaaaggaaggcaagtt

SEQ ID NO: 10003270 - DNA, 22 bp, Homo sapiens
taggcagaaaggaaggcaagtt

SEQ ID NO: 10003271 - DNA, 22 bp, Homo sapiens
tagctgtgagcacccaggctgt

SEQ ID NO: 10003272 - DNA, 21 bp, Homo sapiens
tagctgtgcaactttgggcaa

SEQ ID NO: 10003273 - DNA, 22 bp, Homo sapiens
tagctgtgaagagctaaaaaat

SEQ ID NO: 10003274 - DNA, 22 bp, Homo sapiens
tagctgtgacgtatctctatgg

SEQ ID NO: 10003275 - DNA, 22 bp, Homo sapiens
tagctgtgcccagggaagttgt

SEQ ID NO: 10003276 - DNA, 22 bp, Homo sapiens
tagctgtgcccgccacccaacg

SEQ ID NO: 10003277 - DNA, 22 bp, Homo sapiens
tagctgtggccttgctggtctg

SEQ ID NO: 10003278 - DNA, 22 bp, Homo sapiens
tagctgtggagcagaggtctcc

SEQ ID NO: 10003279 - DNA, 22 bp, Homo sapiens
tagctgtggagcagaggtctcc

SEQ ID NO: 10003280 - DNA, 22 bp, Homo sapiens
tagctgtcagctgcaggcaggc

SEQ ID NO: 10003281 - DNA, 22 bp, Homo sapiens
tagctgtgaaacagcagaagag

SEQ ID NO: 10003282 - DNA, 22 bp, Homo sapiens
tagctgtcaccagaaatggcca

SEQ ID NO: 10003283 - DNA, 22 bp, Homo sapiens
tagctgtcagcaatcaagtggt

SEQ ID NO: 10003284 - DNA, 23 bp, Homo sapiens
taggcaggactcagatatgacag

SEQ ID NO: 10003285 - DNA, 22 bp, Homo sapiens
taggcagcttaggttagaagtg

SEQ ID NO: 10003286 - DNA, 22 bp, Homo sapiens
taggcagatgttaacaggaaaa

SEQ ID NO: 10003287 - DNA, 22 bp, Homo sapiens
taggcagaggtatggtaaggac

SEQ ID NO: 10003288 - DNA, 20 bp, Homo sapiens
taggcagagctgtgcagcct

SEQ ID NO: 10003289 - DNA, 22 bp, Homo sapiens
taggccagtggcaggttgtgtg

SEQ ID NO: 10003290 - DNA, 22 bp, Homo sapiens
taggccagttggtggccctgga

SEQ ID NO: 10003291 - DNA, 23 bp, Homo sapiens
taggccagggtgacctggggaga

SEQ ID NO: 10003292 - DNA, 22 bp, Homo sapiens
taggccaggacagagcttccag

SEQ ID NO: 10003293 - DNA, 22 bp, Homo sapiens
taggccaggacagagcttccag

SEQ ID NO: 10003294 - DNA, 22 bp, Homo sapiens
taggcaggctgaatgtagattt

SEQ ID NO: 10003295 - DNA, 22 bp, Homo sapiens
taggccagattactagagtagg

SEQ ID NO: 10003296 - DNA, 22 bp, Homo sapiens
taggccagcccttagtcctgtc

SEQ ID NO: 10003297 - DNA, 22 bp, Homo sapiens
tagggcagagtccaggatgggc

SEQ ID NO: 10003298 - DNA, 22 bp, Homo sapiens
tagggcagccacccaggctgct

SEQ ID NO: 10003299 - DNA, 22 bp, Homo sapiens
tagggcagattcggtggagttt

SEQ ID NO: 10003300 - DNA, 23 bp, Homo sapiens
tagggcagctgggagggacatgc

SEQ ID NO: 10003301 - DNA, 18 bp, Homo sapiens
tagggctctagggagtga

SEQ ID NO: 10003302 - DNA, 22 bp, Homo sapiens
tagggcagctgcatcaggcact

SEQ ID NO: 10003303 - DNA, 22 bp, Homo sapiens
tagggcttagaaaagaatttac

SEQ ID NO: 10003304 - DNA, 22 bp, Homo sapiens
tagggctgtttaaaagtgaggt

SEQ ID NO: 10003305 - DNA, 22 bp, Homo sapiens
tagggctgtttaaaagtgaggt

SEQ ID NO: 10003306 - DNA, 16 bp, Homo sapiens
tagggctgggaaggag

SEQ ID NO: 10003307 - DNA, 22 bp, Homo sapiens
tagggctgtggtcagtcctcta

SEQ ID NO: 10003308 - DNA, 22 bp, Homo sapiens
tagggctgtgtctccaggacca

SEQ ID NO: 10003309 - DNA, 22 bp, Homo sapiens
tagggctgggtacactcttgcc

SEQ ID NO: 10003310 - DNA, 19 bp, Homo sapiens
tagggctggccgggcggtg

SEQ ID NO: 10003311 - DNA, 22 bp, Homo sapiens
tagggctggcgtgctcagggaa

SEQ ID NO: 10003312 - DNA, 22 bp, Homo sapiens
tagggctgcctatggctagata

SEQ ID NO: 10003313 - DNA, 22 bp, Homo sapiens
tagggctgctgcagatgacagg

SEQ ID NO: 10003314 - DNA, 22 bp, Homo sapiens
tagggctgcctatggctagata

SEQ ID NO: 10003315 - DNA, 22 bp, Homo sapiens
tagggctgccatttgcttttct

SEQ ID NO: 10003316 - DNA, 22 bp, Homo sapiens
tagggctgcagaacaatggcct

SEQ ID NO: 10003317 - DNA, 22 bp, Homo sapiens
tagtggagaagtggagtctgtg

SEQ ID NO: 10003318 - DNA, 22 bp, Homo sapiens
tagtgccatcttgagctgcttt

SEQ ID NO: 10003319 - DNA, 22 bp, Homo sapiens
tagtgccatgcgaggggtggga

SEQ ID NO: 10003320 - DNA, 22 bp, Homo sapiens
tagtgccattcaagaggtagtt

SEQ ID NO: 10003321 - DNA, 22 bp, Homo sapiens
tagttacaatgggttctgtgac

SEQ ID NO: 10003322 - DNA, 22 bp, Homo sapiens
tagttacagagaaatgatttga

SEQ ID NO: 10003323 - DNA, 22 bp, Homo sapiens
tagttacagatctaggactgtt

SEQ ID NO: 10003324 - DNA, 22 bp, Homo sapiens
tagtggagaggatgtggagaaa

SEQ ID NO: 10003325 - DNA, 22 bp, Homo sapiens
tagtggaggcctgttgtgtgca

SEQ ID NO: 10003326 - DNA, 22 bp, Homo sapiens
tagtggagagttgttttgtgca

SEQ ID NO: 10003327 - DNA, 22 bp, Homo sapiens
tagtggaggggatgcaaagctt

SEQ ID NO: 10003328 - DNA, 22 bp, Homo sapiens
tagtggaggtggtctgtgaact

SEQ ID NO: 10003329 - DNA, 22 bp, Homo sapiens
tagtggagtagaaaccaaagaa

SEQ ID NO: 10003330 - DNA, 22 bp, Homo sapiens
tagtggaggtggtctgtgaact

SEQ ID NO: 10003331 - DNA, 22 bp, Homo sapiens
tagtggagggtgtagctgctgg

SEQ ID NO: 10003332 - DNA, 22 bp, Homo sapiens
taggggctcagaacatgtcctt

SEQ ID NO: 10003333 - DNA, 21 bp, Homo sapiens
taggggctggggctccagctg

SEQ ID NO: 10003334 - DNA, 23 bp, Homo sapiens
taggggctggcgtggagcctgcg

SEQ ID NO: 10003335 - DNA, 21 bp, Homo sapiens
tagggggcagtgggatgctta

SEQ ID NO: 10003336 - DNA, 22 bp, Homo sapiens
taggggcttgtaatttaataga

SEQ ID NO: 10003337 - DNA, 21 bp, Homo sapiens
tagggggcagtgggatgctta

SEQ ID NO: 10003338 - DNA, 22 bp, Homo sapiens
tagggggctgtcctgtgcatta

SEQ ID NO: 10003339 - DNA, 22 bp, Homo sapiens
tagggggctgtcctgtgcatta

SEQ ID NO: 10003340 - DNA, 22 bp, Homo sapiens
tagggggctttgctgcttgaca

SEQ ID NO: 10003341 - DNA, 22 bp, Homo sapiens
taggggaggggatcatgtgctg

SEQ ID NO: 10003342 - DNA, 22 bp, Homo sapiens
taggggagctcgggtgcaatcg

SEQ ID NO: 10003343 - DNA, 23 bp, Homo sapiens
taggggaaaaatcttctgcaatt

SEQ ID NO: 10003344 - DNA, 22 bp, Homo sapiens
taggggaactggcacagggcag

SEQ ID NO: 10003345 - DNA, 22 bp, Homo sapiens
tagtctctgctttgcccttggc

SEQ ID NO: 10003346 - DNA, 22 bp, Homo sapiens
tagtctctggagactctagggg

SEQ ID NO: 10003347 - DNA, 22 bp, Homo sapiens
tagtgccaccttccaagtatca

SEQ ID NO: 10003348 - DNA, 22 bp, Homo sapiens
tagtgccaccactgtctttggc

SEQ ID NO: 10003349 - DNA, 22 bp, Homo sapiens
tagtgccaaagcctggtgtcat

SEQ ID NO: 10003350 - DNA, 22 bp, Homo sapiens
tagttctacagatggtttgtaa

SEQ ID NO: 10003351 - DNA, 22 bp, Homo sapiens
tagttctactcaaagtgtgatc

SEQ ID NO: 10003352 - DNA, 22 bp, Homo sapiens
tagttctagaccagttaatagt

SEQ ID NO: 10003353 - DNA, 22 bp, Homo sapiens
tagttctactcaaagtgtgatc

SEQ ID NO: 10003354 - DNA, 21 bp, Homo sapiens
tagttctacttcagtctcatg

SEQ ID NO: 10003355 - DNA, 22 bp, Homo sapiens
tagttctataagcagatagagt

SEQ ID NO: 10003356 - DNA, 22 bp, Homo sapiens
tagttctataagcagatagagt

SEQ ID NO: 10003357 - DNA, 22 bp, Homo sapiens
tagttctataagcagatagagt

SEQ ID NO: 10003358 - DNA, 22 bp, Homo sapiens
tagttctagccagtgaaatgta

SEQ ID NO: 10003359 - DNA, 22 bp, Homo sapiens
tagttctagggcatcatcccag

SEQ ID NO: 10003360 - DNA, 22 bp, Homo sapiens
tagttcaaagtctgtcaaagga

SEQ ID NO: 10003361 - DNA, 22 bp, Homo sapiens
tagttacagtgcatagcaagat

SEQ ID NO: 10003362 - DNA, 22 bp, Homo sapiens
tagttatatccagtctttaaaa

SEQ ID NO: 10003363 - DNA, 22 bp, Homo sapiens
tagttgaagagatgaatgacca

SEQ ID NO: 10003364 - DNA, 22 bp, Homo sapiens
tagtttaatggtcaactaatga

SEQ ID NO: 10003365 - DNA, 22 bp, Homo sapiens
tagtttactgttcactttgccc

SEQ ID NO: 10003366 - DNA, 22 bp, Homo sapiens
tagtttaatggtcaactaatga

SEQ ID NO: 10003367 - DNA, 22 bp, Homo sapiens
tagtttactcatctataaaatg

SEQ ID NO: 10003368 - DNA, 22 bp, Homo sapiens
tagtttaccaaattgatcttcc

SEQ ID NO: 10003369 - DNA, 18 bp, Homo sapiens
tagtttctaatggccttt

SEQ ID NO: 10003370 - DNA, 22 bp, Homo sapiens
tagtttctaaagcttcctaggt

SEQ ID NO: 10003371 - DNA, 22 bp, Homo sapiens
tagttttataatgttaacatct

SEQ ID NO: 10003372 - DNA, 22 bp, Homo sapiens
tagtttttaagtgtacaatttc

SEQ ID NO: 10003373 - DNA, 22 bp, Homo sapiens
tagttttttcaacaaatggtgc

SEQ ID NO: 10003374 - DNA, 22 bp, Homo sapiens
tagttttgattagtattgtctt

SEQ ID NO: 10003375 - DNA, 22 bp, Homo sapiens
tagtttcctaggctgtattgtt

SEQ ID NO: 10003376 - DNA, 22 bp, Homo sapiens
tagtttcatctccaccctgccc

SEQ ID NO: 10003377 - DNA, 22 bp, Homo sapiens
tagtttcatatgcaaaatagta

SEQ ID NO: 10003378 - DNA, 22 bp, Homo sapiens
tagtttatgctgctgcagtgag

SEQ ID NO: 10003379 - DNA, 22 bp, Homo sapiens
tagtttatgctgctgcagtgag

SEQ ID NO: 10003380 - DNA, 22 bp, Homo sapiens
tagtttatgattttttggaagg

SEQ ID NO: 10003381 - DNA, 22 bp, Homo sapiens
tagtttatagttagcgagcacg

SEQ ID NO: 10003382 - DNA, 22 bp, Homo sapiens
tagctggcttatataaaagggc

SEQ ID NO: 10003383 - DNA, 22 bp, Homo sapiens
tagctgcttagaaatcactgag

SEQ ID NO: 10003384 - DNA, 22 bp, Homo sapiens
tagctgcctttgggctcctgct

SEQ ID NO: 10003385 - DNA, 22 bp, Homo sapiens
tagctgcctatgtgataagaga

SEQ ID NO: 10003386 - DNA, 19 bp, Homo sapiens
tagctgcctgttacctcca

SEQ ID NO: 10003387 - DNA, 22 bp, Homo sapiens
tagctgcccatctttcctttag

SEQ ID NO: 10003388 - DNA, 17 bp, Homo sapiens
tagctgccccgaatgct

SEQ ID NO: 10003389 - DNA, 22 bp, Homo sapiens
tagctgcctagacagctatagc

SEQ ID NO: 10003390 - DNA, 22 bp, Homo sapiens
tagctgccagaccattcttact

SEQ ID NO: 10003391 - DNA, 22 bp, Homo sapiens
tagctgccattgctccaggaag

SEQ ID NO: 10003392 - DNA, 22 bp, Homo sapiens
tagcagggtctcaggagtcagg

SEQ ID NO: 10003393 - DNA, 22 bp, Homo sapiens
tagcagggtctcaggagtcagg

SEQ ID NO: 10003394 - DNA, 22 bp, Homo sapiens
tagcagggtccaatgtgaggca

SEQ ID NO: 10003395 - DNA, 22 bp, Homo sapiens
tagcagggtctcaggagtcagg

SEQ ID NO: 10003396 - DNA, 22 bp, Homo sapiens
tagctgatgaataattattctt

SEQ ID NO: 10003397 - DNA, 19 bp, Homo sapiens
tagctgatagctactttat

SEQ ID NO: 10003398 - DNA, 22 bp, Homo sapiens
tagctgccaaaagggtgggcta

SEQ ID NO: 10003399 - DNA, 20 bp, Homo sapiens
tagctgcacagccctaggag

SEQ ID NO: 10003400 - DNA, 22 bp, Homo sapiens
tagctgcacaggaagtaagatt

SEQ ID NO: 10003401 - DNA, 22 bp, Homo sapiens
tagctgcacaggaagtaagatt

SEQ ID NO: 10003402 - DNA, 18 bp, Homo sapiens
tagcagggcttgtccttt

SEQ ID NO: 10003403 - DNA, 22 bp, Homo sapiens
tagcaggggtagatagagtgtg

SEQ ID NO: 10003404 - DNA, 22 bp, Homo sapiens
tagcaggggtagatagagtgtg

SEQ ID NO: 10003405 - DNA, 22 bp, Homo sapiens
tagcagggtaaatgtagatgga

SEQ ID NO: 10003406 - DNA, 22 bp, Homo sapiens
tagcagggtaaatgtagatgga

SEQ ID NO: 10003407 - DNA, 22 bp, Homo sapiens
tagcagggtccaatgtgaggca

SEQ ID NO: 10003408 - DNA, 22 bp, Homo sapiens
tagcagggtccaatgtgaggca

SEQ ID NO: 10003409 - DNA, 22 bp, Homo sapiens
tagcagggtccaatgtgaggca

SEQ ID NO: 10003410 - DNA, 22 bp, Homo sapiens
tagcagggtctcaggagtcagg

SEQ ID NO: 10003411 - DNA, 22 bp, Homo sapiens
tagcagcttaagtaattagaat

SEQ ID NO: 10003412 - DNA, 22 bp, Homo sapiens
tagcagcttccagagagggcag

SEQ ID NO: 10003413 - DNA, 22 bp, Homo sapiens
tagcaggaatatgaggttaata

SEQ ID NO: 10003414 - DNA, 22 bp, Homo sapiens
tagcaggaccatgacaagaaaa

SEQ ID NO: 10003415 - DNA, 22 bp, Homo sapiens
tagcagctgtcagtttcacata

SEQ ID NO: 10003416 - DNA, 22 bp, Homo sapiens
tagcagctgtgagtaaaagcca

SEQ ID NO: 10003417 - DNA, 22 bp, Homo sapiens
tagcagctgtggaggggctgtg

SEQ ID NO: 10003418 - DNA, 22 bp, Homo sapiens
tagcagctggggctattcatca

SEQ ID NO: 10003419 - DNA, 19 bp, Homo sapiens
tagcagctgccaaaggaga

SEQ ID NO: 10003420 - DNA, 19 bp, Homo sapiens
tagcagctgccaaaggaga

SEQ ID NO: 10003421 - DNA, 22 bp, Homo sapiens
tagcagctctttactaaccagt

SEQ ID NO: 10003422 - DNA, 22 bp, Homo sapiens
tagcagctctttactaaccagt

SEQ ID NO: 10003423 - DNA, 22 bp, Homo sapiens
tagcagctgcatcattttacag

SEQ ID NO: 10003424 - DNA, 19 bp, Homo sapiens
tagcagctgccaaaggaga

SEQ ID NO: 10003425 - DNA, 22 bp, Homo sapiens
tagcaggatttgaagaagatct

SEQ ID NO: 10003426 - DNA, 22 bp, Homo sapiens
tagcaggcatctcagagataat

SEQ ID NO: 10003427 - DNA, 22 bp, Homo sapiens
tagcagggaaggtgtgctgagc

SEQ ID NO: 10003428 - DNA, 22 bp, Homo sapiens
tagcagggagggccagtgtcaa

SEQ ID NO: 10003429 - DNA, 22 bp, Homo sapiens
tagcagggagggccagtgtcaa

SEQ ID NO: 10003430 - DNA, 22 bp, Homo sapiens
tagcagggaagatgatcagaat

SEQ ID NO: 10003431 - DNA, 22 bp, Homo sapiens
tagcagggccaggctgggaacc

SEQ ID NO: 10003432 - DNA, 22 bp, Homo sapiens
tagcagggccaggctgggaacc

SEQ ID NO: 10003433 - DNA, 22 bp, Homo sapiens
tagcagggatacaaggtcgcct

SEQ ID NO: 10003434 - DNA, 22 bp, Homo sapiens
tagcagggatacaaggtcgcct

SEQ ID NO: 10003435 - DNA, 22 bp, Homo sapiens
tagatctgatacaattcatctg

SEQ ID NO: 10003436 - DNA, 22 bp, Homo sapiens
tagatctgatacaattcatctg

SEQ ID NO: 10003437 - DNA, 22 bp, Homo sapiens
tagcaaaatgtggatgtagttg

SEQ ID NO: 10003438 - DNA, 22 bp, Homo sapiens
tagcaaaatgtggatgtagttg

SEQ ID NO: 10003439 - DNA, 22 bp, Homo sapiens
tagcaaagaacctgatacccca

SEQ ID NO: 10003440 - DNA, 22 bp, Homo sapiens
tagcaaagaagatattattgca

SEQ ID NO: 10003441 - DNA, 22 bp, Homo sapiens
tagcaaaagctcaacaggaagg

SEQ ID NO: 10003442 - DNA, 22 bp, Homo sapiens
tagcaaaagctcaacaggaagg

SEQ ID NO: 10003443 - DNA, 18 bp, Homo sapiens
tagcaaagatgtggattg

SEQ ID NO: 10003444 - DNA, 22 bp, Homo sapiens
tagcaaataaaacagtattgaa

SEQ ID NO: 10003445 - DNA, 22 bp, Homo sapiens
tagcaaataaaacagtattgaa

SEQ ID NO: 10003446 - DNA, 23 bp, Homo sapiens
tagcaaagttgtttgggaaattt

SEQ ID NO: 10003447 - DNA, 22 bp, Homo sapiens
tagcaaagttttgtggtgatta

SEQ ID NO: 10003448 - DNA, 22 bp, Homo sapiens
tagcaaaggatgactatgtacc

SEQ ID NO: 10003449 - DNA, 22 bp, Homo sapiens
tagcaaaggccttggacacgct

SEQ ID NO: 10003450 - DNA, 21 bp, Homo sapiens
tagcaaatggagagtaagaga

SEQ ID NO: 10003451 - DNA, 22 bp, Homo sapiens
tagcaaatgcctggttaattag

SEQ ID NO: 10003452 - DNA, 22 bp, Homo sapiens
tagcaaatacatgatgtaattt

SEQ ID NO: 10003453 - DNA, 22 bp, Homo sapiens
tagcaaatgtaaaatgcctaca

SEQ ID NO: 10003454 - DNA, 22 bp, Homo sapiens
tagcaaatgtaaaatgcctaca

SEQ ID NO: 10003455 - DNA, 22 bp, Homo sapiens
tagcaaatgtctgaaggaatag

SEQ ID NO: 10003456 - DNA, 22 bp, Homo sapiens
tagcaaatgtgttatgctatgc

SEQ ID NO: 10003457 - DNA, 22 bp, Homo sapiens
tagcaaatgtgttatgctatgc

SEQ ID NO: 10003458 - DNA, 22 bp, Homo sapiens
tagcaaatgtgttatgctatgc

SEQ ID NO: 10003459 - DNA, 21 bp, Homo sapiens
tagcaaattgctattaaggca

SEQ ID NO: 10003460 - DNA, 22 bp, Homo sapiens
tagcaacaatggaagtaacttc

SEQ ID NO: 10003461 - DNA, 22 bp, Homo sapiens
tagcaacataagaaacattttg

SEQ ID NO: 10003462 - DNA, 22 bp, Homo sapiens
tagcagctctgattctgggccc

SEQ ID NO: 10003463 - DNA, 22 bp, Homo sapiens
tagcagctcctaaacagtggtg

SEQ ID NO: 10003464 - DNA, 22 bp, Homo sapiens
tagcagctcctaaacagtggtg

SEQ ID NO: 10003465 - DNA, 22 bp, Homo sapiens
tagcaagaagctgtcacaggtg

SEQ ID NO: 10003466 - DNA, 22 bp, Homo sapiens
tagcaagaagctgtcacaggtg

SEQ ID NO: 10003467 - DNA, 22 bp, Homo sapiens
tagcaacctatggatagagaag

SEQ ID NO: 10003468 - DNA, 22 bp, Homo sapiens
tagcaactgctctattctagga

SEQ ID NO: 10003469 - DNA, 22 bp, Homo sapiens
tagcaagaaaacacaagaatta

SEQ ID NO: 10003470 - DNA, 22 bp, Homo sapiens
tagagaaacagaaccaacaggg

SEQ ID NO: 10003471 - DNA, 22 bp, Homo sapiens
tagagaaacagaaccaacaggg

SEQ ID NO: 10003472 - DNA, 22 bp, Homo sapiens
tagagaaataagctttgccttg

SEQ ID NO: 10003473 - DNA, 23 bp, Homo sapiens
tagagaaagccaccgagtctctc

SEQ ID NO: 10003474 - DNA, 22 bp, Homo sapiens
tagagaaaagcagggatcagga

SEQ ID NO: 10003475 - DNA, 22 bp, Homo sapiens
tagagaaaagcagggatcagga

SEQ ID NO: 10003476 - DNA, 22 bp, Homo sapiens
tagactttgatattgtacaccc

SEQ ID NO: 10003477 - DNA, 22 bp, Homo sapiens
tagacttttcaaaatctagacc

SEQ ID NO: 10003478 - DNA, 20 bp, Homo sapiens
tagacttttcatcaacctta

SEQ ID NO: 10003479 - DNA, 21 bp, Homo sapiens
tagagaaaagaagctgttcct

SEQ ID NO: 10003480 - DNA, 21 bp, Homo sapiens
tagagaaaagaagctgttcct

SEQ ID NO: 10003481 - DNA, 22 bp, Homo sapiens
tagagaaaaccactggtgagct

SEQ ID NO: 10003482 - DNA, 22 bp, Homo sapiens
tagagaggtttgaattggctgc

SEQ ID NO: 10003483 - DNA, 22 bp, Homo sapiens
tagagacaccagtaccattctg

SEQ ID NO: 10003484 - DNA, 22 bp, Homo sapiens
tagatacctgctggacctcatt

SEQ ID NO: 10003485 - DNA, 19 bp, Homo sapiens
tagatactgatgaactcca

SEQ ID NO: 10003486 - DNA, 22 bp, Homo sapiens
tagatactcagaaatgctttca

SEQ ID NO: 10003487 - DNA, 23 bp, Homo sapiens
tagatagcacactgacatctgac

SEQ ID NO: 10003488 - DNA, 22 bp, Homo sapiens
tagataggtgattaggaaaagc

SEQ ID NO: 10003489 - DNA, 22 bp, Homo sapiens
tagatacatgaaatggcagata

SEQ ID NO: 10003490 - DNA, 22 bp, Homo sapiens
tagatacatacattttaaaatg

SEQ ID NO: 10003491 - DNA, 22 bp, Homo sapiens
tagatacatacattttaaaatg

SEQ ID NO: 10003492 - DNA, 22 bp, Homo sapiens
tagatacagtgttaagtgtgga

SEQ ID NO: 10003493 - DNA, 22 bp, Homo sapiens
tagagtctagtgtatacaaagt

SEQ ID NO: 10003494 - DNA, 22 bp, Homo sapiens
tagagtccttcattctgtgcag

SEQ ID NO: 10003495 - DNA, 22 bp, Homo sapiens
tagatatcagaaatagaattta

SEQ ID NO: 10003496 - DNA, 22 bp, Homo sapiens
tagatataaggtccttagaaca

SEQ ID NO: 10003497 - DNA, 21 bp, Homo sapiens
tagatcatggtattctttggc

SEQ ID NO: 10003498 - DNA, 22 bp, Homo sapiens
tagaaatggagaacagattaat

SEQ ID NO: 10003499 - DNA, 22 bp, Homo sapiens
tagaaatggagaacagattaat

SEQ ID NO: 10003500 - DNA, 22 bp, Homo sapiens
tagaaatggagaacagattaat

SEQ ID NO: 10003501 - DNA, 22 bp, Homo sapiens
tacttacatgaattcaagagca

SEQ ID NO: 10003502 - DNA, 22 bp, Homo sapiens
tacttacattagcaaacaaggt

SEQ ID NO: 10003503 - DNA, 22 bp, Homo sapiens
tagaaatggggaagtagttagg

SEQ ID NO: 10003504 - DNA, 22 bp, Homo sapiens
tagaaatgggttacatttagag

SEQ ID NO: 10003505 - DNA, 22 bp, Homo sapiens
tagaacatgtgaaaatatagcc

SEQ ID NO: 10003506 - DNA, 22 bp, Homo sapiens
tagaaccaccttctcctttacc

SEQ ID NO: 10003507 - DNA, 22 bp, Homo sapiens
tagaacatgctcatgtataaat

SEQ ID NO: 10003508 - DNA, 22 bp, Homo sapiens
tagaacatgggatagagttttt

SEQ ID NO: 10003509 - DNA, 22 bp, Homo sapiens
tagaacatgtgaaaatatagcc

SEQ ID NO: 10003510 - DNA, 22 bp, Homo sapiens
tagaacatgacttatttttgga

SEQ ID NO: 10003511 - DNA, 22 bp, Homo sapiens
tagaacatgacttatttttgga

SEQ ID NO: 10003512 - DNA, 23 bp, Homo sapiens
tagaacatcggtgtcttggagca

SEQ ID NO: 10003513 - DNA, 22 bp, Homo sapiens
tagaacatcaggttgaatttgg

SEQ ID NO: 10003514 - DNA, 22 bp, Homo sapiens
tagaacttagcactagacttgt

SEQ ID NO: 10003515 - DNA, 22 bp, Homo sapiens
tagaacttgaatgtgaaatcag

SEQ ID NO: 10003516 - DNA, 22 bp, Homo sapiens
tagaacttgagatcaggtcttc

SEQ ID NO: 10003517 - DNA, 22 bp, Homo sapiens
tagaacttgagatcaggtcttc

SEQ ID NO: 10003518 - DNA, 22 bp, Homo sapiens
tagaacttgatagacagtacaa

SEQ ID NO: 10003519 - DNA, 22 bp, Homo sapiens
tagaacttgatagacagtacaa

SEQ ID NO: 10003520 - DNA, 22 bp, Homo sapiens
tagaacttgtgaaatatcaatg

SEQ ID NO: 10003521 - DNA, 22 bp, Homo sapiens
tagaacttattagaaaggctca

SEQ ID NO: 10003522 - DNA, 22 bp, Homo sapiens
tagaacttatttggcattattt

SEQ ID NO: 10003523 - DNA, 22 bp, Homo sapiens
tagaacttatttggcattattt

SEQ ID NO: 10003524 - DNA, 22 bp, Homo sapiens
tagaacttccaattcagggctg

SEQ ID NO: 10003525 - DNA, 22 bp, Homo sapiens
tagaacttcttacagctaagtt

SEQ ID NO: 10003526 - DNA, 22 bp, Homo sapiens
tagaacctccagagtggccccc

SEQ ID NO: 10003527 - DNA, 22 bp, Homo sapiens
tagaacctcataagaatcgaaa

SEQ ID NO: 10003528 - DNA, 22 bp, Homo sapiens
tagaacctccacaggacctcca

SEQ ID NO: 10003529 - DNA, 22 bp, Homo sapiens
tagaacctattagaaatgtatt

SEQ ID NO: 10003530 - DNA, 22 bp, Homo sapiens
tagaaccagtccacagaatttg

SEQ ID NO: 10003531 - DNA, 22 bp, Homo sapiens
tagaacctctgattatgttact

SEQ ID NO: 10003532 - DNA, 19 bp, Homo sapiens
tagaacctggatttcagga

SEQ ID NO: 10003533 - DNA, 22 bp, Homo sapiens
tagaactaagagttatcattta

SEQ ID NO: 10003534 - DNA, 22 bp, Homo sapiens
tagaactctggtcttctcatcc

SEQ ID NO: 10003535 - DNA, 22 bp, Homo sapiens
tagactgtgagctccttgaggg

SEQ ID NO: 10003536 - DNA, 22 bp, Homo sapiens
tagactggtgaattagggggaa

SEQ ID NO: 10003537 - DNA, 22 bp, Homo sapiens
tagactagaggatcagcaaggg

SEQ ID NO: 10003538 - DNA, 22 bp, Homo sapiens
tagactatagctcacagtgctt

SEQ ID NO: 10003539 - DNA, 22 bp, Homo sapiens
tagactagaggatcagcaaggg

SEQ ID NO: 10003540 - DNA, 19 bp, Homo sapiens
tagactctaatgttaagct

SEQ ID NO: 10003541 - DNA, 22 bp, Homo sapiens
tagactcagacagaaaatgtgt

SEQ ID NO: 10003542 - DNA, 19 bp, Homo sapiens
tagactctaatgttaagct

SEQ ID NO: 10003543 - DNA, 22 bp, Homo sapiens
tagactcttggggaaatctgca

SEQ ID NO: 10003544 - DNA, 22 bp, Homo sapiens
tagactctgcatttacctccca

SEQ ID NO: 10003545 - DNA, 23 bp, Homo sapiens
tagactgcaggctccttgagggc

SEQ ID NO: 10003546 - DNA, 23 bp, Homo sapiens
tagactgcaggctccttgagggc

SEQ ID NO: 10003547 - DNA, 22 bp, Homo sapiens
tagacaggaaacattaggatgg

SEQ ID NO: 10003548 - DNA, 22 bp, Homo sapiens
tagacaggagtcaggctagaat

SEQ ID NO: 10003549 - DNA, 22 bp, Homo sapiens
tagacctgaaatatggacctgg

SEQ ID NO: 10003550 - DNA, 22 bp, Homo sapiens
tagaagataagacaagtgctgc

SEQ ID NO: 10003551 - DNA, 22 bp, Homo sapiens
tagaagagacatagcctgtggt

SEQ ID NO: 10003552 - DNA, 22 bp, Homo sapiens
tagaagaacatgtcaaactata

SEQ ID NO: 10003553 - DNA, 22 bp, Homo sapiens
tagaagaaagtgaagctgggga

SEQ ID NO: 10003554 - DNA, 22 bp, Homo sapiens
tagaactttcagaaattccaaa

SEQ ID NO: 10003555 - DNA, 20 bp, Homo sapiens
tagaacttttcagtatggat

SEQ ID NO: 10003556 - DNA, 22 bp, Homo sapiens
tagaagattctaaagtggagag

SEQ ID NO: 10003557 - DNA, 22 bp, Homo sapiens
tagaagattcatttcctctgaa

SEQ ID NO: 10003558 - DNA, 22 bp, Homo sapiens
tagaagataagacaagtgctgc

SEQ ID NO: 10003559 - DNA, 22 bp, Homo sapiens
gtgttgatgacattttagaaac

SEQ ID NO: 10003560 - DNA, 22 bp, Homo sapiens
gtgtttaacatctggtttatac

SEQ ID NO: 10003561 - DNA, 22 bp, Homo sapiens
gtgttgtggagcttgtcagggg

SEQ ID NO: 10003562 - DNA, 22 bp, Homo sapiens
gtgttgtggagcttgtcagggg

SEQ ID NO: 10003563 - DNA, 22 bp, Homo sapiens
gtgttctctctacaggaattta

SEQ ID NO: 10003564 - DNA, 22 bp, Homo sapiens
gtgttctgcagaccagcatcat

SEQ ID NO: 10003565 - DNA, 22 bp, Homo sapiens
gtgttccatgtttgaggtagtt

SEQ ID NO: 10003566 - DNA, 22 bp, Homo sapiens
gtgttatttgagtgggagcgtg

SEQ ID NO: 10003567 - DNA, 17 bp, Homo sapiens
gtgttcacaatgactgt

SEQ ID NO: 10003568 - DNA, 22 bp, Homo sapiens
gtgttcatggatgtcaatttga

SEQ ID NO: 10003569 - DNA, 22 bp, Homo sapiens
gtgttattagagcattaatttt

SEQ ID NO: 10003570 - DNA, 22 bp, Homo sapiens
gtgtttctggggcattcatagt

SEQ ID NO: 10003571 - DNA, 21 bp, Homo sapiens
gtgtttcctgtttatggcttg

SEQ ID NO: 10003572 - DNA, 22 bp, Homo sapiens
gtgtttccctggcacaagaacc

SEQ ID NO: 10003573 - DNA, 22 bp, Homo sapiens
gtgtttcccctcctggagaagg

SEQ ID NO: 10003574 - DNA, 22 bp, Homo sapiens
gttaaataacctcatgtccgtt

SEQ ID NO: 10003575 - DNA, 22 bp, Homo sapiens
gttaaataacctcatgtccgtt

SEQ ID NO: 10003576 - DNA, 22 bp, Homo sapiens
gtgtttcttgcactccccggac

SEQ ID NO: 10003577 - DNA, 22 bp, Homo sapiens
gtgtttatacagcaaagagcat

SEQ ID NO: 10003578 - DNA, 22 bp, Homo sapiens
gtgtttaatgcagatgtgggtg

SEQ ID NO: 10003579 - DNA, 22 bp, Homo sapiens
gtgtttaataggtagctgaatc

SEQ ID NO: 10003580 - DNA, 22 bp, Homo sapiens
gtgtttccagttcagaaagcaa

SEQ ID NO: 10003581 - DNA, 22 bp, Homo sapiens
gttaacaaatgtaaagcaatta

SEQ ID NO: 10003582 - DNA, 22 bp, Homo sapiens
gttaaataacctcatgtccgtt

SEQ ID NO: 10003583 - DNA, 22 bp, Homo sapiens
gttaaatgcactattgaaagct

SEQ ID NO: 10003584 - DNA, 22 bp, Homo sapiens
gttaaatgcagattctgactca

SEQ ID NO: 10003585 - DNA, 22 bp, Homo sapiens
gttaacaaccaaacagaagttc

SEQ ID NO: 10003586 - DNA, 22 bp, Homo sapiens
gttaacaaccaaacagaagttc

SEQ ID NO: 10003587 - DNA, 22 bp, Homo sapiens
gttaacaaccaaacagaagttc

SEQ ID NO: 10003588 - DNA, 22 bp, Homo sapiens
gttaacaaggtgtagaggtttt

SEQ ID NO: 10003589 - DNA, 22 bp, Homo sapiens
gttaacacaggactctctgcct

SEQ ID NO: 10003590 - DNA, 23 bp, Homo sapiens
gttaacatggtccatggaagagc

SEQ ID NO: 10003591 - DNA, 22 bp, Homo sapiens
gttaacataggagtttgttgta

SEQ ID NO: 10003592 - DNA, 22 bp, Homo sapiens
gttaacataggcttaggggttt

SEQ ID NO: 10003593 - DNA, 22 bp, Homo sapiens
gttctggaaagcaagaaagagt

SEQ ID NO: 10003594 - DNA, 22 bp, Homo sapiens
gttcttcatcattttagatagg

SEQ ID NO: 10003595 - DNA, 22 bp, Homo sapiens
gttcttcagtaaaattaaatgt

SEQ ID NO: 10003596 - DNA, 22 bp, Homo sapiens
gttcttcagtaaaattaaatgt

SEQ ID NO: 10003597 - DNA, 22 bp, Homo sapiens
gttatttataaggtgtaactcc

SEQ ID NO: 10003598 - DNA, 22 bp, Homo sapiens
gttatttcagccacagagtgca

SEQ ID NO: 10003599 - DNA, 22 bp, Homo sapiens
gttatttaactttgtagcatgg

SEQ ID NO: 10003600 - DNA, 22 bp, Homo sapiens
gttattgtttatcctgcacccc

SEQ ID NO: 10003601 - DNA, 22 bp, Homo sapiens
gttatctagaccaaaagcctaa

SEQ ID NO: 10003602 - DNA, 22 bp, Homo sapiens
gttatattgccaagtatattgt

SEQ ID NO: 10003603 - DNA, 22 bp, Homo sapiens
gttatattggcagaagagaaga

SEQ ID NO: 10003604 - DNA, 22 bp, Homo sapiens
gttatattggcagaagagaaga

SEQ ID NO: 10003605 - DNA, 22 bp, Homo sapiens
gttatgtatcttgattgggtgg

SEQ ID NO: 10003606 - DNA, 22 bp, Homo sapiens
gttatgtatgagggaatgatta

SEQ ID NO: 10003607 - DNA, 22 bp, Homo sapiens
gttatgtaatctaacactcagt

SEQ ID NO: 10003608 - DNA, 22 bp, Homo sapiens
gttatgtactttttaaatcttg

SEQ ID NO: 10003609 - DNA, 22 bp, Homo sapiens
gttatgtactttttaaatcttg

SEQ ID NO: 10003610 - DNA, 22 bp, Homo sapiens
gttatgaagtcattcacaaata

SEQ ID NO: 10003611 - DNA, 22 bp, Homo sapiens
gttatacatatgtgttaacaaa

SEQ ID NO: 10003612 - DNA, 22 bp, Homo sapiens
gttataaatgactgcaaaagtt

SEQ ID NO: 10003613 - DNA, 22 bp, Homo sapiens
gttatataagacaaatcagagt

SEQ ID NO: 10003614 - DNA, 22 bp, Homo sapiens
gttatataattcctgtggtagt

SEQ ID NO: 10003615 - DNA, 22 bp, Homo sapiens
gttatataattcctgtggtagt

SEQ ID NO: 10003616 - DNA, 22 bp, Homo sapiens
gttataggagcccgaactaaga

SEQ ID NO: 10003617 - DNA, 20 bp, Homo sapiens
gttataggagagggaattat

SEQ ID NO: 10003618 - DNA, 22 bp, Homo sapiens
gttataggtcatgctatgtcaa

SEQ ID NO: 10003619 - DNA, 22 bp, Homo sapiens
gttatattcaaaatgaggctgt

SEQ ID NO: 10003620 - DNA, 22 bp, Homo sapiens
gttatatatagtatttctctga

SEQ ID NO: 10003621 - DNA, 21 bp, Homo sapiens
gtttgcagttgagtccttccc

SEQ ID NO: 10003622 - DNA, 22 bp, Homo sapiens
gtttgattcaagaacaaagagt

SEQ ID NO: 10003623 - DNA, 22 bp, Homo sapiens
gtttgaaacatgcacctggagg

SEQ ID NO: 10003624 - DNA, 22 bp, Homo sapiens
gtttgaaagaccaattagattt

SEQ ID NO: 10003625 - DNA, 22 bp, Homo sapiens
gtttgaaagaccaattagattt

SEQ ID NO: 10003626 - DNA, 22 bp, Homo sapiens
gtttgaaagtggcaagtccttg

SEQ ID NO: 10003627 - DNA, 22 bp, Homo sapiens
gtttgaaagttcaacaggaaaa

SEQ ID NO: 10003628 - DNA, 22 bp, Homo sapiens
gtttgaaatgtctgcaagggaa

SEQ ID NO: 10003629 - DNA, 22 bp, Homo sapiens
gtttgaaatgtctgcaagggaa

SEQ ID NO: 10003630 - DNA, 22 bp, Homo sapiens
gtttgacacggtgcgtcttcag

SEQ ID NO: 10003631 - DNA, 22 bp, Homo sapiens
gtttgacacggtgcgtcttcag

SEQ ID NO: 10003632 - DNA, 22 bp, Homo sapiens
gtttgtgtaacatgatgatgat

SEQ ID NO: 10003633 - DNA, 22 bp, Homo sapiens
gtttgtgtaacatgatgatgat

SEQ ID NO: 10003634 - DNA, 22 bp, Homo sapiens
gtttgtgtaacatgatgatgat

SEQ ID NO: 10003635 - DNA, 22 bp, Homo sapiens
gtttgtatgaatgttttatgct

SEQ ID NO: 10003636 - DNA, 22 bp, Homo sapiens
gtttgtatgaatgttttatgct

SEQ ID NO: 10003637 - DNA, 22 bp, Homo sapiens
gtttgtttatacaaaagatcct

SEQ ID NO: 10003638 - DNA, 22 bp, Homo sapiens
gtttgtttatacaaaagatcct

SEQ ID NO: 10003639 - DNA, 22 bp, Homo sapiens
gtttgtttatacaaaagatcct

SEQ ID NO: 10003640 - DNA, 22 bp, Homo sapiens
gtttgtttatacaaaagatcct

SEQ ID NO: 10003641 - DNA, 22 bp, Homo sapiens
gtttgttcactatgactgtggt

SEQ ID NO: 10003642 - DNA, 22 bp, Homo sapiens
gtttgttcatggctgatgcttg

SEQ ID NO: 10003643 - DNA, 22 bp, Homo sapiens
gtttgttcactatgactgtggt

SEQ ID NO: 10003644 - DNA, 22 bp, Homo sapiens
gtttgttttaagataggatgga

SEQ ID NO: 10003645 - DNA, 22 bp, Homo sapiens
gtttgtttgtagggaagccgtg

SEQ ID NO: 10003646 - DNA, 22 bp, Homo sapiens
gtttgttttaagataggatgga

SEQ ID NO: 10003647 - DNA, 22 bp, Homo sapiens
gtttcttttaaaatatgtagac

SEQ ID NO: 10003648 - DNA, 22 bp, Homo sapiens
gtttcttttaaaatatgtagac

SEQ ID NO: 10003649 - DNA, 22 bp, Homo sapiens
gtttcttttaaaatatgtagac

SEQ ID NO: 10003650 - DNA, 22 bp, Homo sapiens
gtttcttttaaaatatgtagac

SEQ ID NO: 10003651 - DNA, 22 bp, Homo sapiens
gtttcttttgtgatcaccaacc

SEQ ID NO: 10003652 - DNA, 22 bp, Homo sapiens
gtttcttagacagacattatct

SEQ ID NO: 10003653 - DNA, 22 bp, Homo sapiens
gtttctttctattgactgaaca

SEQ ID NO: 10003654 - DNA, 22 bp, Homo sapiens
gtttcacagatggtgttcatat

SEQ ID NO: 10003655 - DNA, 22 bp, Homo sapiens
gtttcacagtctgcagaatttt

SEQ ID NO: 10003656 - DNA, 22 bp, Homo sapiens
gtttcaatttcactttccaggc

SEQ ID NO: 10003657 - DNA, 22 bp, Homo sapiens
gtttcaaagtcagaaaaggagg

SEQ ID NO: 10003658 - DNA, 22 bp, Homo sapiens
gtttcaaagtcagaaaaggagg

SEQ ID NO: 10003659 - DNA, 22 bp, Homo sapiens
gttcttctcttgtaatggaatc

SEQ ID NO: 10003660 - DNA, 21 bp, Homo sapiens
gttcttgcaggatttccttcc

SEQ ID NO: 10003661 - DNA, 22 bp, Homo sapiens
gttcttcctggaagtggatttc

SEQ ID NO: 10003662 - DNA, 22 bp, Homo sapiens
gttcttcctcattgctttgaag

SEQ ID NO: 10003663 - DNA, 22 bp, Homo sapiens
gttcttccctttggggattgtg

SEQ ID NO: 10003664 - DNA, 19 bp, Homo sapiens
gttcttttcacctctgtgc

SEQ ID NO: 10003665 - DNA, 19 bp, Homo sapiens
gttcttttcacctctgtgc

SEQ ID NO: 10003666 - DNA, 22 bp, Homo sapiens
gttcttttggtagagtgtgcat

SEQ ID NO: 10003667 - DNA, 22 bp, Homo sapiens
gttcttttggtagagtgtgcat

SEQ ID NO: 10003668 - DNA, 22 bp, Homo sapiens
gttgaaaatacagattcctagg

SEQ ID NO: 10003669 - DNA, 22 bp, Homo sapiens
gttgaatatcgtgttcttgttt

SEQ ID NO: 10003670 - DNA, 22 bp, Homo sapiens
gttgaatattttaagagttttg

SEQ ID NO: 10003671 - DNA, 22 bp, Homo sapiens
gttgaatacttgagaaatccat

SEQ ID NO: 10003672 - DNA, 22 bp, Homo sapiens
gttgaataattcatagaagcta

SEQ ID NO: 10003673 - DNA, 22 bp, Homo sapiens
gttgaatatacctgcatttgtg

SEQ ID NO: 10003674 - DNA, 21 bp, Homo sapiens
gttgaatatccatgtatgtgt

SEQ ID NO: 10003675 - DNA, 22 bp, Homo sapiens
gttgaatatcccgtatcttaaa

SEQ ID NO: 10003676 - DNA, 22 bp, Homo sapiens
gttgaaagtagatgctatttgg

SEQ ID NO: 10003677 - DNA, 22 bp, Homo sapiens
gttgaaagatgtcttggttccc

SEQ ID NO: 10003678 - DNA, 22 bp, Homo sapiens
gttgaaaatgactttataccat

SEQ ID NO: 10003679 - DNA, 22 bp, Homo sapiens
gtttattatacaacaaaagcta

SEQ ID NO: 10003680 - DNA, 22 bp, Homo sapiens
gtttcaaagcacagctcacatt

SEQ ID NO: 10003681 - DNA, 22 bp, Homo sapiens
gtttcaaagcacagctcacatt

SEQ ID NO: 10003682 - DNA, 22 bp, Homo sapiens
gtttcaaagggaagacgctgga

SEQ ID NO: 10003683 - DNA, 22 bp, Homo sapiens
gtttcaaagggaagacgctgga

SEQ ID NO: 10003684 - DNA, 22 bp, Homo sapiens
gtttcaaaggtgtcaggcagtt

SEQ ID NO: 10003685 - DNA, 22 bp, Homo sapiens
gtttattaactgtcaagtgatt

SEQ ID NO: 10003686 - DNA, 22 bp, Homo sapiens
gtttattagagttttctgtctg

SEQ ID NO: 10003687 - DNA, 22 bp, Homo sapiens
gtttattagagttttctgtctg

SEQ ID NO: 10003688 - DNA, 22 bp, Homo sapiens
gtttatgaatgttactatagag

SEQ ID NO: 10003689 - DNA, 22 bp, Homo sapiens
gtttatgaatgtgtcagacata

SEQ ID NO: 10003690 - DNA, 22 bp, Homo sapiens
gtttatcattattattagcaac

SEQ ID NO: 10003691 - DNA, 22 bp, Homo sapiens
gtttatcacaataaataattct

SEQ ID NO: 10003692 - DNA, 22 bp, Homo sapiens
gttgagcaaggccagagaagcc

SEQ ID NO: 10003693 - DNA, 22 bp, Homo sapiens
gttgagagttaagcgggctaat

SEQ ID NO: 10003694 - DNA, 22 bp, Homo sapiens
taacagtattgaagataaacta

SEQ ID NO: 10003695 - DNA, 22 bp, Homo sapiens
taacagtatccccatttgcaag

SEQ ID NO: 10003696 - DNA, 22 bp, Homo sapiens
taacagtatatttaccaaacct

SEQ ID NO: 10003697 - DNA, 22 bp, Homo sapiens
taacagtatagcctaacatttc

SEQ ID NO: 10003698 - DNA, 22 bp, Homo sapiens
taacagtatatttaccaaacct

SEQ ID NO: 10003699 - DNA, 22 bp, Homo sapiens
taacagtattgaagataaacta

SEQ ID NO: 10003700 - DNA, 22 bp, Homo sapiens
taacagtgacctgaatgtcaat

SEQ ID NO: 10003701 - DNA, 22 bp, Homo sapiens
taacagtgtgtccagtcagttt

SEQ ID NO: 10003702 - DNA, 22 bp, Homo sapiens
taacagtgtgtccagtcagttt

SEQ ID NO: 10003703 - DNA, 22 bp, Homo sapiens
taacaggtggtagtttgtgctc

SEQ ID NO: 10003704 - DNA, 22 bp, Homo sapiens
taacagtaaagtaagttagctt

SEQ ID NO: 10003705 - DNA, 20 bp, Homo sapiens
taacagtaagtgatgttaca

SEQ ID NO: 10003706 - DNA, 22 bp, Homo sapiens
taacagtacatccttttctctt

SEQ ID NO: 10003707 - DNA, 20 bp, Homo sapiens
taacagtaagtgatgttaca

SEQ ID NO: 10003708 - DNA, 22 bp, Homo sapiens
taacagtaccattaactttgat

SEQ ID NO: 10003709 - DNA, 22 bp, Homo sapiens
taacagtaccattaactttgat

SEQ ID NO: 10003710 - DNA, 22 bp, Homo sapiens
taacagtagccttatgtggtct

SEQ ID NO: 10003711 - DNA, 22 bp, Homo sapiens
taacagtatagcctaacatttc

SEQ ID NO: 10003712 - DNA, 22 bp, Homo sapiens
taacagtagccttatgtggtct

SEQ ID NO: 10003713 - DNA, 20 bp, Homo sapiens
taacagttgtagagggtttt

SEQ ID NO: 10003714 - DNA, 20 bp, Homo sapiens
taacagttgaagaacaagga

SEQ ID NO: 10003715 - DNA, 22 bp, Homo sapiens
taacatattgtgtggcactagg

SEQ ID NO: 10003716 - DNA, 22 bp, Homo sapiens
taacatgagagctaagacatta

SEQ ID NO: 10003717 - DNA, 22 bp, Homo sapiens
taacatgaaactccaaatggta

SEQ ID NO: 10003718 - DNA, 22 bp, Homo sapiens
taaatgttgtaagtacatctaa

SEQ ID NO: 10003719 - DNA, 22 bp, Homo sapiens
taaatgttggcattggaggccg

SEQ ID NO: 10003720 - DNA, 22 bp, Homo sapiens
taaatgtttagtcttatttggg

SEQ ID NO: 10003721 - DNA, 22 bp, Homo sapiens
taaatgttttgtgggttgagtt

SEQ ID NO: 10003722 - DNA, 22 bp, Homo sapiens
taaatgttgtaagtacatctaa

SEQ ID NO: 10003723 - DNA, 22 bp, Homo sapiens
taacagcatttgaatgagtaac

SEQ ID NO: 10003724 - DNA, 22 bp, Homo sapiens
taacagcatttgaatgagtaac

SEQ ID NO: 10003725 - DNA, 22 bp, Homo sapiens
taaatgttatgcccatcatcca

SEQ ID NO: 10003726 - DNA, 22 bp, Homo sapiens
taaatgttatgcccatcatcca

SEQ ID NO: 10003727 - DNA, 22 bp, Homo sapiens
taaatgttactttcctttcaca

SEQ ID NO: 10003728 - DNA, 18 bp, Homo sapiens
taaatgcatgttaataac

SEQ ID NO: 10003729 - DNA, 22 bp, Homo sapiens
taaatgctcaataaatgttgct

SEQ ID NO: 10003730 - DNA, 22 bp, Homo sapiens
taaatgctcaataaatgttgct

SEQ ID NO: 10003731 - DNA, 22 bp, Homo sapiens
taaatgctatcgcataaaacct

SEQ ID NO: 10003732 - DNA, 22 bp, Homo sapiens
taaatgctccatacatacacca

SEQ ID NO: 10003733 - DNA, 22 bp, Homo sapiens
taaatgctcaataaatgttgct

SEQ ID NO: 10003734 - DNA, 22 bp, Homo sapiens
taaatgctcagaccttattcca

SEQ ID NO: 10003735 - DNA, 22 bp, Homo sapiens
taaatgctcagaccttattcca

SEQ ID NO: 10003736 - DNA, 22 bp, Homo sapiens
taagacaaatactatttcaaga

SEQ ID NO: 10003737 - DNA, 18 bp, Homo sapiens
taacatgttttcattaag

SEQ ID NO: 10003738 - DNA, 22 bp, Homo sapiens
taagacaaatactatttcaaga

SEQ ID NO: 10003739 - DNA, 19 bp, Homo sapiens
taagacagattcctagagt

SEQ ID NO: 10003740 - DNA, 22 bp, Homo sapiens
taagacaattcttcagtcacaa

SEQ ID NO: 10003741 - DNA, 22 bp, Homo sapiens
taacatgatttgctatttagat

SEQ ID NO: 10003742 - DNA, 22 bp, Homo sapiens
taacatgtccctgattctttgt

SEQ ID NO: 10003743 - DNA, 22 bp, Homo sapiens
taacatgtttgtacactgaaac

SEQ ID NO: 10003744 - DNA, 22 bp, Homo sapiens
taacatgttcagactacctgtg

SEQ ID NO: 10003745 - DNA, 22 bp, Homo sapiens
taacatgttaagaaattagata

SEQ ID NO: 10003746 - DNA, 22 bp, Homo sapiens
taagaccatacatttccacaga

SEQ ID NO: 10003747 - DNA, 22 bp, Homo sapiens
taagactagttgaatggttttc

SEQ ID NO: 10003748 - DNA, 22 bp, Homo sapiens
taagactgtgagctcagagact

SEQ ID NO: 10003749 - DNA, 22 bp, Homo sapiens
taagacatccgttgcttataat

SEQ ID NO: 10003750 - DNA, 22 bp, Homo sapiens
taagacatcctggatgttcaaa

SEQ ID NO: 10003751 - DNA, 22 bp, Homo sapiens
taagacaggtagtaagaacatt

SEQ ID NO: 10003752 - DNA, 22 bp, Homo sapiens
taagagaaggatctgttccagg

SEQ ID NO: 10003753 - DNA, 22 bp, Homo sapiens
taagagaatgtcaggagtggat

SEQ ID NO: 10003754 - DNA, 22 bp, Homo sapiens
taagagaaggatctgttccagg

SEQ ID NO: 10003755 - DNA, 22 bp, Homo sapiens
taagagaaggatctgttccagg

SEQ ID NO: 10003756 - DNA, 22 bp, Homo sapiens
taagagaactggatagatagga

SEQ ID NO: 10003757 - DNA, 22 bp, Homo sapiens
taagacttcattagtaatatgg

SEQ ID NO: 10003758 - DNA, 22 bp, Homo sapiens
taagagacttaagaataattga

SEQ ID NO: 10003759 - DNA, 22 bp, Homo sapiens
taagagcataggcttgaaaata

SEQ ID NO: 10003760 - DNA, 22 bp, Homo sapiens
taagagcagaggttgaataaat

SEQ ID NO: 10003761 - DNA, 22 bp, Homo sapiens
taagagcattgtaaaataatct

SEQ ID NO: 10003762 - DNA, 22 bp, Homo sapiens
taagagctaggattttaaatca

SEQ ID NO: 10003763 - DNA, 22 bp, Homo sapiens
taagagctccaatatttgtggc

SEQ ID NO: 10003764 - DNA, 22 bp, Homo sapiens
taagagctcccttctccttgca

SEQ ID NO: 10003765 - DNA, 21 bp, Homo sapiens
taagcatatcagatagactct

SEQ ID NO: 10003766 - DNA, 22 bp, Homo sapiens
taagcatattccagtcatgtcc

SEQ ID NO: 10003767 - DNA, 22 bp, Homo sapiens
taagcatagtaccgtagcagct

SEQ ID NO: 10003768 - DNA, 20 bp, Homo sapiens
taagcatagttgtcagggtc

SEQ ID NO: 10003769 - DNA, 22 bp, Homo sapiens
taagaggatatttggccagaag

SEQ ID NO: 10003770 - DNA, 22 bp, Homo sapiens
taaaactgcttggtatggtcta

SEQ ID NO: 10003771 - DNA, 22 bp, Homo sapiens
taaaacttaactatccagatta

SEQ ID NO: 10003772 - DNA, 22 bp, Homo sapiens
taaaagatcactggctgcttta

SEQ ID NO: 10003773 - DNA, 22 bp, Homo sapiens
taaaagatcactggctgcttta

SEQ ID NO: 10003774 - DNA, 22 bp, Homo sapiens
taaaagatcactggctgcttta

SEQ ID NO: 10003775 - DNA, 22 bp, Homo sapiens
taaaagagaatggataacagag

SEQ ID NO: 10003776 - DNA, 22 bp, Homo sapiens
taaaagagaatggataacagag

SEQ ID NO: 10003777 - DNA, 22 bp, Homo sapiens
taaaagatatcttagggatttg

SEQ ID NO: 10003778 - DNA, 22 bp, Homo sapiens
taaaagagaatggataacagag

SEQ ID NO: 10003779 - DNA, 22 bp, Homo sapiens
taaaagagaatggataacagag

SEQ ID NO: 10003780 - DNA, 22 bp, Homo sapiens
taaaagagaatggataacagag

SEQ ID NO: 10003781 - DNA, 22 bp, Homo sapiens
taaaagaccctctagagtccca

SEQ ID NO: 10003782 - DNA, 22 bp, Homo sapiens
taaaagaccctctagagtccca

SEQ ID NO: 10003783 - DNA, 22 bp, Homo sapiens
taaaagacatataactgtagga

SEQ ID NO: 10003784 - DNA, 22 bp, Homo sapiens
taaaagaccacaaggtggtaat

SEQ ID NO: 10003785 - DNA, 22 bp, Homo sapiens
taaaagaccctctagagtccca

SEQ ID NO: 10003786 - DNA, 22 bp, Homo sapiens
taaaagaagcttcaaggccggc

SEQ ID NO: 10003787 - DNA, 22 bp, Homo sapiens
taaaagaagcttcaaggccggc

SEQ ID NO: 10003788 - DNA, 22 bp, Homo sapiens
taaaagacatataactgtagga

SEQ ID NO: 10003789 - DNA, 22 bp, Homo sapiens
taaaaggattagcaggatgggc

SEQ ID NO: 10003790 - DNA, 22 bp, Homo sapiens
taaaaggcaatactagatgagt

SEQ ID NO: 10003791 - DNA, 22 bp, Homo sapiens
taaaaggcaatactagatgagt

SEQ ID NO: 10003792 - DNA, 22 bp, Homo sapiens
taaaaggcacttggatgctgag

SEQ ID NO: 10003793 - DNA, 22 bp, Homo sapiens
taaaaggcacttggatgctgag

SEQ ID NO: 10003794 - DNA, 22 bp, Homo sapiens
taaaagtatactttcaaaggag

SEQ ID NO: 10003795 - DNA, 22 bp, Homo sapiens
taaaagtaggaatgaaacgcat

SEQ ID NO: 10003796 - DNA, 22 bp, Homo sapiens
taaaaggaggttgaagctgtca

SEQ ID NO: 10003797 - DNA, 22 bp, Homo sapiens
taaaaggaggttgaagctgtca

SEQ ID NO: 10003798 - DNA, 19 bp, Homo sapiens
taaaaggatgtggaaggat

SEQ ID NO: 10003799 - DNA, 22 bp, Homo sapiens
taaaagctgagatatcctgtac

SEQ ID NO: 10003800 - DNA, 22 bp, Homo sapiens
taaaagattttataggaacaag

SEQ ID NO: 10003801 - DNA, 20 bp, Homo sapiens
taaagacataagctactatc

SEQ ID NO: 10003802 - DNA, 22 bp, Homo sapiens
taaagacataggatcagggaga

SEQ ID NO: 10003803 - DNA, 22 bp, Homo sapiens
taaagacatgcaaagtctaatt

SEQ ID NO: 10003804 - DNA, 23 bp, Homo sapiens
taaagacagccttcaggattctg

SEQ ID NO: 10003805 - DNA, 23 bp, Homo sapiens
taaagacagccttcaggattctg

SEQ ID NO: 10003806 - DNA, 23 bp, Homo sapiens
taaagacagccttcaggattctg

SEQ ID NO: 10003807 - DNA, 22 bp, Homo sapiens
taaagacactggttttaatcat

SEQ ID NO: 10003808 - DNA, 22 bp, Homo sapiens
taaagacagatggaccagccat

SEQ ID NO: 10003809 - DNA, 22 bp, Homo sapiens
taaagacactggttttaatcat

SEQ ID NO: 10003810 - DNA, 22 bp, Homo sapiens
taaaagtatactttcaaaggag

SEQ ID NO: 10003811 - DNA, 22 bp, Homo sapiens
taaagcaatttgagcaagttct

SEQ ID NO: 10003812 - DNA, 19 bp, Homo sapiens
taaagagaataccggtggc

SEQ ID NO: 10003813 - DNA, 22 bp, Homo sapiens
taaagacatggtgtaggtgaac

SEQ ID NO: 10003814 - DNA, 22 bp, Homo sapiens
taaagatgttctcatttcatag

SEQ ID NO: 10003815 - DNA, 22 bp, Homo sapiens
taaagatgttctcatttcatag

SEQ ID NO: 10003816 - DNA, 22 bp, Homo sapiens
taaatgcagcagtttctgttct

SEQ ID NO: 10003817 - DNA, 22 bp, Homo sapiens
taaatgcagcagtttctgttct

SEQ ID NO: 10003818 - DNA, 22 bp, Homo sapiens
taaatgcagtacaaattgttct

SEQ ID NO: 10003819 - DNA, 22 bp, Homo sapiens
taaatgcaatgtgctttaccag

SEQ ID NO: 10003820 - DNA, 22 bp, Homo sapiens
taaatgcaatgtgctttaccag

SEQ ID NO: 10003821 - DNA, 22 bp, Homo sapiens
taaatgcagttagtacttgcca

SEQ ID NO: 10003822 - DNA, 22 bp, Homo sapiens
taaatgcagttagtacttgcca

SEQ ID NO: 10003823 - DNA, 22 bp, Homo sapiens
taaatgcagttagtacttgcca

SEQ ID NO: 10003824 - DNA, 20 bp, Homo sapiens
taaatgcatgaatgtaaggc

SEQ ID NO: 10003825 - DNA, 22 bp, Homo sapiens
taaatgatttatgtatgtgaaa

SEQ ID NO: 10003826 - DNA, 22 bp, Homo sapiens
taaatgcaagggaaaggcaaga

SEQ ID NO: 10003827 - DNA, 22 bp, Homo sapiens
taaatgcaagggaaaggcaaga

SEQ ID NO: 10003828 - DNA, 22 bp, Homo sapiens
taattccttaagctgaagactt

SEQ ID NO: 10003829 - DNA, 22 bp, Homo sapiens
taattcctagaaattattctca

SEQ ID NO: 10003830 - DNA, 22 bp, Homo sapiens
taattattgtctgaagagttat

SEQ ID NO: 10003831 - DNA, 22 bp, Homo sapiens
taattatttgaagacattagag

SEQ ID NO: 10003832 - DNA, 22 bp, Homo sapiens
taattatttgaagacattagag

SEQ ID NO: 10003833 - DNA, 22 bp, Homo sapiens
taatttatatggaattgttgct

SEQ ID NO: 10003834 - DNA, 22 bp, Homo sapiens
taatttatagaatttcttggat

SEQ ID NO: 10003835 - DNA, 22 bp, Homo sapiens
taatttacttgcaaataacaat

SEQ ID NO: 10003836 - DNA, 22 bp, Homo sapiens
taatttatatggaattgttgct

SEQ ID NO: 10003837 - DNA, 22 bp, Homo sapiens
taatttatatggaattgttgct

SEQ ID NO: 10003838 - DNA, 22 bp, Homo sapiens
taatttatgatgcaaagaaaag

SEQ ID NO: 10003839 - DNA, 22 bp, Homo sapiens
taattgctgaactactatccct

SEQ ID NO: 10003840 - DNA, 22 bp, Homo sapiens
taatttacttgcaaataacaat

SEQ ID NO: 10003841 - DNA, 22 bp, Homo sapiens
taattattatgacaacaattgc

SEQ ID NO: 10003842 - DNA, 22 bp, Homo sapiens
taattattatgacaacaattgc

SEQ ID NO: 10003843 - DNA, 22 bp, Homo sapiens
taattattgtctgaagagttat

SEQ ID NO: 10003844 - DNA, 22 bp, Homo sapiens
taattattctagtcacatagca

SEQ ID NO: 10003845 - DNA, 22 bp, Homo sapiens
taattattctagtcacatagca

SEQ ID NO: 10003846 - DNA, 22 bp, Homo sapiens
taatcttagcaacctccagtgt

SEQ ID NO: 10003847 - DNA, 22 bp, Homo sapiens
taatctgttgttaatattgact

SEQ ID NO: 10003848 - DNA, 22 bp, Homo sapiens
taatctgttaatatttgtatcc

SEQ ID NO: 10003849 - DNA, 22 bp, Homo sapiens
taatctgtattcctactttgca

SEQ ID NO: 10003850 - DNA, 22 bp, Homo sapiens
taatctgtaatttttgcaatag

SEQ ID NO: 10003851 - DNA, 22 bp, Homo sapiens
taatatatttctgctaagctca

SEQ ID NO: 10003852 - DNA, 22 bp, Homo sapiens
taatatatacctttgttaggaa

SEQ ID NO: 10003853 - DNA, 22 bp, Homo sapiens
taatatatttctgctaagctca

SEQ ID NO: 10003854 - DNA, 22 bp, Homo sapiens
taatcctgatcaattttagctt

SEQ ID NO: 10003855 - DNA, 22 bp, Homo sapiens
taatctagtcccacatggaatt

SEQ ID NO: 10003856 - DNA, 22 bp, Homo sapiens
taatctctttatgagaagaagg

SEQ ID NO: 10003857 - DNA, 22 bp, Homo sapiens
taatctaccactattgcaatat

SEQ ID NO: 10003858 - DNA, 22 bp, Homo sapiens
taatctagaacatatgagagca

SEQ ID NO: 10003859 - DNA, 22 bp, Homo sapiens
taatatatacctttgttaggaa

SEQ ID NO: 10003860 - DNA, 22 bp, Homo sapiens
taatatatacctttgttaggaa

SEQ ID NO: 10003861 - DNA, 22 bp, Homo sapiens
taatatacttcccatagtttga

SEQ ID NO: 10003862 - DNA, 21 bp, Homo sapiens
taatataggttcacaactagt

SEQ ID NO: 10003863 - DNA, 22 bp, Homo sapiens
taatagtttcataatgtgcttc

SEQ ID NO: 10003864 - DNA, 22 bp, Homo sapiens
taatagttgtgactttgtaaag

SEQ ID NO: 10003865 - DNA, 22 bp, Homo sapiens
taatagttgtgactttgtaaag

SEQ ID NO: 10003866 - DNA, 22 bp, Homo sapiens
taatagttgtgactttgtaaag

SEQ ID NO: 10003867 - DNA, 22 bp, Homo sapiens
taatagttatggttggttctca

SEQ ID NO: 10003868 - DNA, 22 bp, Homo sapiens
taatagttgtgactttgtaaag

SEQ ID NO: 10003869 - DNA, 22 bp, Homo sapiens
taaggagagaatttagaggttt

SEQ ID NO: 10003870 - DNA, 22 bp, Homo sapiens
taaggacattagaaatgatgct

SEQ ID NO: 10003871 - DNA, 22 bp, Homo sapiens
taaggaatagtgctatgaaaaa

SEQ ID NO: 10003872 - DNA, 22 bp, Homo sapiens
taaggaatatcataagaagtag

SEQ ID NO: 10003873 - DNA, 22 bp, Homo sapiens
taaggaatgcttgaatgttcct

SEQ ID NO: 10003874 - DNA, 22 bp, Homo sapiens
taaggacaatcaggttagtagc

SEQ ID NO: 10003875 - DNA, 22 bp, Homo sapiens
taaggacaatcaggttagtagc

SEQ ID NO: 10003876 - DNA, 22 bp, Homo sapiens
taaggaaagtgccatgatttct

SEQ ID NO: 10003877 - DNA, 22 bp, Homo sapiens
taaggaaggggaaagacatgtc

SEQ ID NO: 10003878 - DNA, 22 bp, Homo sapiens
taaggaaagtacatgttttgac

SEQ ID NO: 10003879 - DNA, 22 bp, Homo sapiens
taaggaaaatggacatcaaaca

SEQ ID NO: 10003880 - DNA, 22 bp, Homo sapiens
taaggaaaatggacatcaaaca

SEQ ID NO: 10003881 - DNA, 22 bp, Homo sapiens
taaggaaacaacttgtattttt

SEQ ID NO: 10003882 - DNA, 22 bp, Homo sapiens
taaggaaacaacttgtattttt

SEQ ID NO: 10003883 - DNA, 22 bp, Homo sapiens
taaggaaacaacttgtattttt

SEQ ID NO: 10003884 - DNA, 22 bp, Homo sapiens
taagccactagtctgttatgaa

SEQ ID NO: 10003885 - DNA, 21 bp, Homo sapiens
taagccaccatgtgaaaccag

SEQ ID NO: 10003886 - DNA, 22 bp, Homo sapiens
taagccaaaatcaggacacaga

SEQ ID NO: 10003887 - DNA, 22 bp, Homo sapiens
taagcattatggtaaagaagta

SEQ ID NO: 10003888 - DNA, 22 bp, Homo sapiens
taagcattatggtaaagaagta

SEQ ID NO: 10003889 - DNA, 21 bp, Homo sapiens
taagctaaacattcagttaac

SEQ ID NO: 10003890 - DNA, 22 bp, Homo sapiens
taagctaacgtccatggaaatg

SEQ ID NO: 10003891 - DNA, 22 bp, Homo sapiens
taaggaaaatggacatcaaaca

SEQ ID NO: 10003892 - DNA, 22 bp, Homo sapiens
tacaagagtgagattatcatgt

SEQ ID NO: 10003893 - DNA, 22 bp, Homo sapiens
tacaagatgtactaaaaattat

SEQ ID NO: 10003894 - DNA, 21 bp, Homo sapiens
tacaagatagaggtaatatat

SEQ ID NO: 10003895 - DNA, 22 bp, Homo sapiens
tacacaatctgtttttccattt

SEQ ID NO: 10003896 - DNA, 22 bp, Homo sapiens
tacacaatgacttaagatgtca

SEQ ID NO: 10003897 - DNA, 22 bp, Homo sapiens
tacacaactgacaaccattctg

SEQ ID NO: 10003898 - DNA, 22 bp, Homo sapiens
tacaagatgtactaaaaattat

SEQ ID NO: 10003899 - DNA, 22 bp, Homo sapiens
tacacaaaggcactctgttgtt

SEQ ID NO: 10003900 - DNA, 21 bp, Homo sapiens
tacaagaccggattcgggccc

SEQ ID NO: 10003901 - DNA, 22 bp, Homo sapiens
tacaagagacaccagggaggct

SEQ ID NO: 10003902 - DNA, 22 bp, Homo sapiens
tacaagacgagggaagttcttt

SEQ ID NO: 10003903 - DNA, 22 bp, Homo sapiens
tacaagaaggaaaactagcaat

SEQ ID NO: 10003904 - DNA, 22 bp, Homo sapiens
tacaagaaggaaaactagcaat

SEQ ID NO: 10003905 - DNA, 22 bp, Homo sapiens
tacaagaaggatggagcccact

SEQ ID NO: 10003906 - DNA, 22 bp, Homo sapiens
tacaagaaggatggagcccact

SEQ ID NO: 10003907 - DNA, 20 bp, Homo sapiens
tacaagaatccccagttgtc

SEQ ID NO: 10003908 - DNA, 22 bp, Homo sapiens
tacaagaatgtcttaaaagctc

SEQ ID NO: 10003909 - DNA, 22 bp, Homo sapiens
tacaagaaactacatgaatgca

SEQ ID NO: 10003910 - DNA, 22 bp, Homo sapiens
tacaacttccagctttcagccc

SEQ ID NO: 10003911 - DNA, 22 bp, Homo sapiens
tacaagaaactacatgaatgca

SEQ ID NO: 10003912 - DNA, 22 bp, Homo sapiens
tacaagaaatttctgcatatat

SEQ ID NO: 10003913 - DNA, 22 bp, Homo sapiens
tacaaccagatcctctaagtca

SEQ ID NO: 10003914 - DNA, 22 bp, Homo sapiens
tacaaccatagacatatactag

SEQ ID NO: 10003915 - DNA, 22 bp, Homo sapiens
tacaacttacttgaatggcttt

SEQ ID NO: 10003916 - DNA, 22 bp, Homo sapiens
tacaactgcacatctgaatcac

SEQ ID NO: 10003917 - DNA, 22 bp, Homo sapiens
tacaacatttacgttaggctgt

SEQ ID NO: 10003918 - DNA, 22 bp, Homo sapiens
tacaacatttacgttaggctgt

SEQ ID NO: 10003919 - DNA, 22 bp, Homo sapiens
tacaacatttacgttaggctgt

SEQ ID NO: 10003920 - DNA, 22 bp, Homo sapiens
tacaaccagatcctctaagtca

SEQ ID NO: 10003921 - DNA, 22 bp, Homo sapiens
tacaaccatagacatatactag

SEQ ID NO: 10003922 - DNA, 22 bp, Homo sapiens
tacaacattgtgttgcttcata

SEQ ID NO: 10003923 - DNA, 22 bp, Homo sapiens
tacaacattgtgttgcttcata

SEQ ID NO: 10003924 - DNA, 22 bp, Homo sapiens
tacaacataacgggcattcagt

SEQ ID NO: 10003925 - DNA, 22 bp, Homo sapiens
tacaacatgtggtcctttatga

SEQ ID NO: 10003926 - DNA, 22 bp, Homo sapiens
tacaacatgtggtcctttatga

SEQ ID NO: 10003927 - DNA, 21 bp, Homo sapiens
taatttattcagcacagtgtt

SEQ ID NO: 10003928 - DNA, 21 bp, Homo sapiens
taatttattcagcacagtgtt

SEQ ID NO: 10003929 - DNA, 22 bp, Homo sapiens
taatttatggtatgtgtgtaat

SEQ ID NO: 10003930 - DNA, 22 bp, Homo sapiens
taatttatggtatgtgtgtaat

SEQ ID NO: 10003931 - DNA, 22 bp, Homo sapiens
tacacaattagttgcaaagtga

SEQ ID NO: 10003932 - DNA, 22 bp, Homo sapiens
tacacaattagttgcaaagtga

SEQ ID NO: 10003933 - DNA, 22 bp, Homo sapiens
tacacacagaggccatgggatt

SEQ ID NO: 10003934 - DNA, 22 bp, Homo sapiens
tacacacagaggccatgggatt

SEQ ID NO: 10003935 - DNA, 22 bp, Homo sapiens
tacacacatgcatttgccttat

SEQ ID NO: 10003936 - DNA, 22 bp, Homo sapiens
tacacacatgcatttgccttat

SEQ ID NO: 10003937 - DNA, 22 bp, Homo sapiens
tacacacctgcctgcagactct

SEQ ID NO: 10003938 - DNA, 22 bp, Homo sapiens
tacacacatgcatttgccttat

SEQ ID NO: 10003939 - DNA, 22 bp, Homo sapiens
tacacacatgcatttgccttat

SEQ ID NO: 10003940 - DNA, 22 bp, Homo sapiens
tacacacatgcatttgccttat

SEQ ID NO: 10003941 - DNA, 22 bp, Homo sapiens
tacacacagaggccatgggatt

SEQ ID NO: 10003942 - DNA, 22 bp, Homo sapiens
tacacacagaggccatgggatt

SEQ ID NO: 10003943 - DNA, 22 bp, Homo sapiens
tacacagtaaatggtaaataca

SEQ ID NO: 10003944 - DNA, 22 bp, Homo sapiens
tacacagtagagtataatgcgt

SEQ ID NO: 10003945 - DNA, 22 bp, Homo sapiens
tacacagaacctggtgtacagt

SEQ ID NO: 10003946 - DNA, 22 bp, Homo sapiens
tacacagaacctggtgtacagt

SEQ ID NO: 10003947 - DNA, 22 bp, Homo sapiens
tacacagaacctggtgtacagt

SEQ ID NO: 10003948 - DNA, 22 bp, Homo sapiens
tacacagaaattgtgtagggat

SEQ ID NO: 10003949 - DNA, 22 bp, Homo sapiens
tacacacttactggagatgaag

SEQ ID NO: 10003950 - DNA, 22 bp, Homo sapiens
tacacagaaattgtgtagggat

SEQ ID NO: 10003951 - DNA, 22 bp, Homo sapiens
tacacagtgagtcctctctgcc

SEQ ID NO: 10003952 - DNA, 22 bp, Homo sapiens
tacacagttccatttaagccag

SEQ ID NO: 10003953 - DNA, 22 bp, Homo sapiens
tacacagttccatttaagccag

SEQ ID NO: 10003954 - DNA, 22 bp, Homo sapiens
tacacagttttgctcccatgat

SEQ ID NO: 10003955 - DNA, 22 bp, Homo sapiens
tacacataaaatgctcatggta

SEQ ID NO: 10003956 - DNA, 22 bp, Homo sapiens
tacacataaaatgctcatggta

SEQ ID NO: 10003957 - DNA, 22 bp, Homo sapiens
tacacatacaccaatgtggtca

SEQ ID NO: 10003958 - DNA, 22 bp, Homo sapiens
tacacatacaccaatgtggtca

SEQ ID NO: 10003959 - DNA, 22 bp, Homo sapiens
tacacatacattgcttacaagg

SEQ ID NO: 10003960 - DNA, 22 bp, Homo sapiens
tacagaatgttatgaagcatag

SEQ ID NO: 10003961 - DNA, 22 bp, Homo sapiens
tacagaattagattattagaga

SEQ ID NO: 10003962 - DNA, 22 bp, Homo sapiens
tacagaattagattattagaga

SEQ ID NO: 10003963 - DNA, 22 bp, Homo sapiens
tacagaattagattattagaga

SEQ ID NO: 10003964 - DNA, 21 bp, Homo sapiens
tacagaatgcgcttcagtctg

SEQ ID NO: 10003965 - DNA, 22 bp, Homo sapiens
tacagaatgtgtatcattacca

SEQ ID NO: 10003966 - DNA, 22 bp, Homo sapiens
tacagaatgtgtatcattacca

SEQ ID NO: 10003967 - DNA, 22 bp, Homo sapiens
tacagaattagattattagaga

SEQ ID NO: 10003968 - DNA, 22 bp, Homo sapiens
tacagacagacttcccaccctc

SEQ ID NO: 10003969 - DNA, 22 bp, Homo sapiens
tacagaatatagaagctggaag

SEQ ID NO: 10003970 - DNA, 22 bp, Homo sapiens
tacagaatatttctgccctgag

SEQ ID NO: 10003971 - DNA, 22 bp, Homo sapiens
tacagaatgatgtgtttaaata

SEQ ID NO: 10003972 - DNA, 22 bp, Homo sapiens
tacagaatctatgcttcacagt

SEQ ID NO: 10003973 - DNA, 22 bp, Homo sapiens
tacagaatgatgtgtttaaata

SEQ ID NO: 10003974 - DNA, 22 bp, Homo sapiens
tacagaatgatgtgtttaaata

SEQ ID NO: 10003975 - DNA, 20 bp, Homo sapiens
tacagaatgcaataaaatgg

SEQ ID NO: 10003976 - DNA, 20 bp, Homo sapiens
tacagaatgcaataaaatgg

SEQ ID NO: 10003977 - DNA, 20 bp, Homo sapiens
tacagaatgcaataaaatgg

SEQ ID NO: 10003978 - DNA, 20 bp, Homo sapiens
tacagaatgcaataaaatgg

SEQ ID NO: 10003979 - DNA, 22 bp, Homo sapiens
tacacatacattgcttacaagg

SEQ ID NO: 10003980 - DNA, 22 bp, Homo sapiens
tacacatacattgcttacaagg

SEQ ID NO: 10003981 - DNA, 22 bp, Homo sapiens
tacacataggagggtaataaaa

SEQ ID NO: 10003982 - DNA, 22 bp, Homo sapiens
tacacataggagggtaataaaa

SEQ ID NO: 10003983 - DNA, 22 bp, Homo sapiens
tacagaatagaatagggacagg

SEQ ID NO: 10003984 - DNA, 22 bp, Homo sapiens
tacagaataaagcgtgaagctt

SEQ ID NO: 10003985 - DNA, 22 bp, Homo sapiens
tacacataggtctgaataaaaa

SEQ ID NO: 10003986 - DNA, 22 bp, Homo sapiens
tacatgcatgtgtgtaaatata

SEQ ID NO: 10003987 - DNA, 22 bp, Homo sapiens
tacatgctcagtaactttcagt

SEQ ID NO: 10003988 - DNA, 22 bp, Homo sapiens
tacatgtaagacatgagactct

SEQ ID NO: 10003989 - DNA, 22 bp, Homo sapiens
taccaaagattaaatagcaaca

SEQ ID NO: 10003990 - DNA, 22 bp, Homo sapiens
taccaaatgtaatcattctaat

SEQ ID NO: 10003991 - DNA, 19 bp, Homo sapiens
taccaaattgcattatggc

SEQ ID NO: 10003992 - DNA, 19 bp, Homo sapiens
taccaaattgcattatggc

SEQ ID NO: 10003993 - DNA, 22 bp, Homo sapiens
tacatgtatgtgtacgtgcatg

SEQ ID NO: 10003994 - DNA, 22 bp, Homo sapiens
tacatgtatgtgtacgtgcatg

SEQ ID NO: 10003995 - DNA, 22 bp, Homo sapiens
tacatgtatgtgttaatatctg

SEQ ID NO: 10003996 - DNA, 22 bp, Homo sapiens
tacatgtatgtgttaatatctg

SEQ ID NO: 10003997 - DNA, 22 bp, Homo sapiens
tacatgtaattttcatagtaag

SEQ ID NO: 10003998 - DNA, 22 bp, Homo sapiens
tacatgtacatgcataggtaga

SEQ ID NO: 10003999 - DNA, 22 bp, Homo sapiens
tacatgcatgatacaaagttgc

SEQ ID NO: 10004000 - DNA, 22 bp, Homo sapiens
tacatgcacatgaacatgtgtg

SEQ ID NO: 10004001 - DNA, 22 bp, Homo sapiens
tacatgaatgtttcaatattgt

SEQ ID NO: 10004002 - DNA, 22 bp, Homo sapiens
tacagttaaaaagttcaatggt

SEQ ID NO: 10004003 - DNA, 22 bp, Homo sapiens
tacatgaacaaaatagcagaaa

SEQ ID NO: 10004004 - DNA, 22 bp, Homo sapiens
tacatgaagaaaattaagcagt

SEQ ID NO: 10004005 - DNA, 22 bp, Homo sapiens
tacagtgatagagagtagctat

SEQ ID NO: 10004006 - DNA, 22 bp, Homo sapiens
tacagtgactggactttgtcat

SEQ ID NO: 10004007 - DNA, 22 bp, Homo sapiens
tacagtgcaatgtgatgtagat

SEQ ID NO: 10004008 - DNA, 22 bp, Homo sapiens
tacagtgcaatgtgatgtagat

SEQ ID NO: 10004009 - DNA, 20 bp, Homo sapiens
tacagtgtatgtatttaggc

SEQ ID NO: 10004010 - DNA, 22 bp, Homo sapiens
tacagtattatgagtgattgaa

SEQ ID NO: 10004011 - DNA, 22 bp, Homo sapiens
tacagtatggaaaatgtatagt

SEQ ID NO: 10004012 - DNA, 22 bp, Homo sapiens
tacagtatggaaaatgtatagt

SEQ ID NO: 10004013 - DNA, 22 bp, Homo sapiens
tacagtatatactgtgtgtaga

SEQ ID NO: 10004014 - DNA, 22 bp, Homo sapiens
tacagtatatactgtgtgtaga

SEQ ID NO: 10004015 - DNA, 22 bp, Homo sapiens
tacagtatagaatgtgtattaa

SEQ ID NO: 10004016 - DNA, 22 bp, Homo sapiens
tacagtagtaagaatgccttat

SEQ ID NO: 10004017 - DNA, 22 bp, Homo sapiens
tacagaggggacatggaagaca

SEQ ID NO: 10004018 - DNA, 22 bp, Homo sapiens
tacagagatactctagatcaaa

SEQ ID NO: 10004019 - DNA, 22 bp, Homo sapiens
tacagagatgccgaagagtgaa

SEQ ID NO: 10004020 - DNA, 22 bp, Homo sapiens
tacagacagtttttcagatatt

SEQ ID NO: 10004021 - DNA, 22 bp, Homo sapiens
tacagagagtacagcatccaca

SEQ ID NO: 10004022 - DNA, 22 bp, Homo sapiens
tacagagatgtgaaaagctcta

SEQ ID NO: 10004023 - DNA, 22 bp, Homo sapiens
tacagagatttattgctaaggc

SEQ ID NO: 10004024 - DNA, 22 bp, Homo sapiens
tacttaaaaattatcaaagtgg

SEQ ID NO: 10004025 - DNA, 22 bp, Homo sapiens
tactgttttctttatagtacag

SEQ ID NO: 10004026 - DNA, 22 bp, Homo sapiens
tactgttttctttatagtacag

SEQ ID NO: 10004027 - DNA, 22 bp, Homo sapiens
tactgttttctttatagtacag

SEQ ID NO: 10004028 - DNA, 22 bp, Homo sapiens
tactgttttctataatggctgt

SEQ ID NO: 10004029 - DNA, 22 bp, Homo sapiens
tactgtttcaagccctcacaga

SEQ ID NO: 10004030 - DNA, 22 bp, Homo sapiens
tactgttcatgccttcataaag

SEQ ID NO: 10004031 - DNA, 22 bp, Homo sapiens
tacttaaaactgatagaatctc

SEQ ID NO: 10004032 - DNA, 22 bp, Homo sapiens
tacttaaataattgctgctatt

SEQ ID NO: 10004033 - DNA, 22 bp, Homo sapiens
tacttaaataattgctgctatt

SEQ ID NO: 10004034 - DNA, 22 bp, Homo sapiens
tacttaaaaattatcaaagtgg

SEQ ID NO: 10004035 - DNA, 22 bp, Homo sapiens
tacttaaaactgatagaatctc

SEQ ID NO: 10004036 - DNA, 22 bp, Homo sapiens
tacttaaaactgatagaatctc

SEQ ID NO: 10004037 - DNA, 22 bp, Homo sapiens
tacttacactgaagcaaagata

SEQ ID NO: 10004038 - DNA, 22 bp, Homo sapiens
tacttacactgaagcaaagata

SEQ ID NO: 10004039 - DNA, 22 bp, Homo sapiens
tacttacacagctgtagaaggt

SEQ ID NO: 10004040 - DNA, 22 bp, Homo sapiens
tacttacacagctgtagaaggt

SEQ ID NO: 10004041 - DNA, 22 bp, Homo sapiens
tacttacagaaggaagcaattg

SEQ ID NO: 10004042 - DNA, 22 bp, Homo sapiens
tacttacagaaggaagcaattg

SEQ ID NO: 10004043 - DNA, 22 bp, Homo sapiens
tacttacataaaaactgaatgt

SEQ ID NO: 10004044 - DNA, 22 bp, Homo sapiens
tacttacataaaaactgaatgt

SEQ ID NO: 10004045 - DNA, 22 bp, Homo sapiens
tacttacataaaaactgaatgt

SEQ ID NO: 10004046 - DNA, 22 bp, Homo sapiens
tacttacagttacggcaagtgg

SEQ ID NO: 10004047 - DNA, 22 bp, Homo sapiens
tacttacagagcttataagtta

SEQ ID NO: 10004048 - DNA, 22 bp, Homo sapiens
tactgaaactcttgtaaatatc

SEQ ID NO: 10004049 - DNA, 22 bp, Homo sapiens
tactgaaactcttgtaaatatc

SEQ ID NO: 10004050 - DNA, 22 bp, Homo sapiens
tactgaaaaagaatccagacct

SEQ ID NO: 10004051 - DNA, 22 bp, Homo sapiens
tactctcagggttagtacagga

SEQ ID NO: 10004052 - DNA, 22 bp, Homo sapiens
tactctaaaaagaagcagatct

SEQ ID NO: 10004053 - DNA, 22 bp, Homo sapiens
tactccaggactccatttgaaa

SEQ ID NO: 10004054 - DNA, 22 bp, Homo sapiens
tactccagacattctgtcctcg

SEQ ID NO: 10004055 - DNA, 22 bp, Homo sapiens
tactccaggactccatttgaaa

SEQ ID NO: 10004056 - DNA, 22 bp, Homo sapiens
tactgtgtgcccagccgagctg

SEQ ID NO: 10004057 - DNA, 22 bp, Homo sapiens
tactgaaagaatacataatttc

SEQ ID NO: 10004058 - DNA, 22 bp, Homo sapiens
taccatttcagtaaaaacttag

SEQ ID NO: 10004059 - DNA, 22 bp, Homo sapiens
taccatgtcttcaataagtcta

SEQ ID NO: 10004060 - DNA, 22 bp, Homo sapiens
taccagggaacagggatattaa

SEQ ID NO: 10004061 - DNA, 22 bp, Homo sapiens
taccagttgatgttttaaatag

SEQ ID NO: 10004062 - DNA, 22 bp, Homo sapiens
taccagcaactggaagtcagat

SEQ ID NO: 10004063 - DNA, 22 bp, Homo sapiens
taccactgctccctgcctgtga

SEQ ID NO: 10004064 - DNA, 22 bp, Homo sapiens
taccagcaatgctagtcaactc

SEQ ID NO: 10004065 - DNA, 22 bp, Homo sapiens
tactacaagggccctaaaaggt

SEQ ID NO: 10004066 - DNA, 23 bp, Homo sapiens
tactacagggtcttgctatgaat

SEQ ID NO: 10004067 - DNA, 22 bp, Homo sapiens
tactacaaggccgaagctctca

SEQ ID NO: 10004068 - DNA, 22 bp, Homo sapiens
taccatttgagagagaacataa

SEQ ID NO: 10004069 - DNA, 22 bp, Homo sapiens
taccatttgagagagaacataa

SEQ ID NO: 10004070 - DNA, 22 bp, Homo sapiens
taccatttctacatatcttgtc

SEQ ID NO: 10004071 - DNA, 22 bp, Homo sapiens
taccatttctacatatcttgtc

SEQ ID NO: 10004072 - DNA, 22 bp, Homo sapiens
tactacatacagaatttagaga

SEQ ID NO: 10004073 - DNA, 22 bp, Homo sapiens
tactacatacagaatttagaga

SEQ ID NO: 10004074 - DNA, 22 bp, Homo sapiens
tactacattaataaaacattca

SEQ ID NO: 10004075 - DNA, 21 bp, Homo sapiens
tactacagtctctttatcagt

SEQ ID NO: 10004076 - DNA, 22 bp, Homo sapiens
tactacagtatgtgtgttatac

SEQ ID NO: 10004077 - DNA, 21 bp, Homo sapiens
tactacagtctctttatcagt

SEQ ID NO: 10004078 - DNA, 23 bp, Homo sapiens
tactataacgctgtgtcagctcc

SEQ ID NO: 10004079 - DNA, 23 bp, Homo sapiens
tactataacgctgtgtcagctcc

SEQ ID NO: 10004080 - DNA, 22 bp, Homo sapiens
tactagttctcatatgaaataa

SEQ ID NO: 10004081 - DNA, 22 bp, Homo sapiens
tactataaagtcttaatgagtc

SEQ ID NO: 10004082 - DNA, 23 bp, Homo sapiens
tactatggttattatccctctcc

SEQ ID NO: 10004083 - DNA, 22 bp, Homo sapiens
tactagaatgccactgttagtg

SEQ ID NO: 10004084 - DNA, 22 bp, Homo sapiens
tactagaaattaccttctcact

SEQ ID NO: 10004085 - DNA, 22 bp, Homo sapiens
tactagaacctcacaacaatcc

SEQ ID NO: 10004086 - DNA, 17 bp, Homo sapiens
tactagaatagagacag

SEQ ID NO: 10004087 - DNA, 22 bp, Homo sapiens
gccacctcggctttctctgctc

SEQ ID NO: 10004088 - DNA, 22 bp, Homo sapiens
gccacctccttattccacctgt

SEQ ID NO: 10004089 - DNA, 22 bp, Homo sapiens
gccacctggacagctgtgccct

SEQ ID NO: 10004090 - DNA, 22 bp, Homo sapiens
gccacctggactcagagccagg

SEQ ID NO: 10004091 - DNA, 22 bp, Homo sapiens
gccactgttgctcctcaggaaa

SEQ ID NO: 10004092 - DNA, 21 bp, Homo sapiens
gccactgtgcacactaaccca

SEQ ID NO: 10004093 - DNA, 22 bp, Homo sapiens
gccacctgtttcgcttgcccag

SEQ ID NO: 10004094 - DNA, 22 bp, Homo sapiens
gcattgcaactgacagatcatt

SEQ ID NO: 10004095 - DNA, 22 bp, Homo sapiens
gcattgattctgaagtgaaatg

SEQ ID NO: 10004096 - DNA, 22 bp, Homo sapiens
gcatttaaatttgaacttcaga

SEQ ID NO: 10004097 - DNA, 22 bp, Homo sapiens
gcatttagctttaaaatatttc

SEQ ID NO: 10004098 - DNA, 22 bp, Homo sapiens
gcatttacatggagctatctaa

SEQ ID NO: 10004099 - DNA, 22 bp, Homo sapiens
gcatttcatgccgtggaagtcc

SEQ ID NO: 10004100 - DNA, 22 bp, Homo sapiens
gcatttcatgctccttggaacc

SEQ ID NO: 10004101 - DNA, 19 bp, Homo sapiens
gcatttcaggcatgtttgc

SEQ ID NO: 10004102 - DNA, 22 bp, Homo sapiens
gcatttcagaagcatgccctct

SEQ ID NO: 10004103 - DNA, 22 bp, Homo sapiens
gcatttcagagaaaatctgctt

SEQ ID NO: 10004104 - DNA, 22 bp, Homo sapiens
gcatttcagaaaggttaccaac

SEQ ID NO: 10004105 - DNA, 22 bp, Homo sapiens
gcatttcaaaattccaggcaag

SEQ ID NO: 10004106 - DNA, 22 bp, Homo sapiens
gcatttatttctttactgcatc

SEQ ID NO: 10004107 - DNA, 22 bp, Homo sapiens
gcatttatattctgttcggata

SEQ ID NO: 10004108 - DNA, 22 bp, Homo sapiens
gcagtgtttgtgttctcacatg

SEQ ID NO: 10004109 - DNA, 22 bp, Homo sapiens
gcagtgtttttcaatgcttcca

SEQ ID NO: 10004110 - DNA, 22 bp, Homo sapiens
gcagttctacttatccatagac

SEQ ID NO: 10004111 - DNA, 22 bp, Homo sapiens
gcagttctccagaataaagggt

SEQ ID NO: 10004112 - DNA, 22 bp, Homo sapiens
gcagtttagtagatgacattat

SEQ ID NO: 10004113 - DNA, 18 bp, Homo sapiens
gcaggtgccactgctgtt

SEQ ID NO: 10004114 - DNA, 22 bp, Homo sapiens
gcaggtgattcaccctgggcct

SEQ ID NO: 10004115 - DNA, 23 bp, Homo sapiens
gcagtgtttgcttcatcttatcc

SEQ ID NO: 10004116 - DNA, 23 bp, Homo sapiens
gcagtgtttgcttcatcttatcc

SEQ ID NO: 10004117 - DNA, 22 bp, Homo sapiens
gcagtgtttacatattagaaac

SEQ ID NO: 10004118 - DNA, 22 bp, Homo sapiens
gcattcttgtttttcctaccct

SEQ ID NO: 10004119 - DNA, 18 bp, Homo sapiens
gcattctgttaatgtgga

SEQ ID NO: 10004120 - DNA, 22 bp, Homo sapiens
gcattgaaatggcaaaaagaga

SEQ ID NO: 10004121 - DNA, 23 bp, Homo sapiens
gcattgaacaaaagaggggagta

SEQ ID NO: 10004122 - DNA, 22 bp, Homo sapiens
gcattgaagatcttagactagg

SEQ ID NO: 10004123 - DNA, 22 bp, Homo sapiens
gcattgaaccatctagatttct

SEQ ID NO: 10004124 - DNA, 20 bp, Homo sapiens
gcattgagtatagacagatg

SEQ ID NO: 10004125 - DNA, 22 bp, Homo sapiens
gcattgaaggacttccattata

SEQ ID NO: 10004126 - DNA, 22 bp, Homo sapiens
gcattgaaggcattttatctac

SEQ ID NO: 10004127 - DNA, 22 bp, Homo sapiens
gcattgaatcctatcaggcaaa

SEQ ID NO: 10004128 - DNA, 22 bp, Homo sapiens
gcagttttagtggatctggggc

SEQ ID NO: 10004129 - DNA, 22 bp, Homo sapiens
gcagttttagtggatctggggc

SEQ ID NO: 10004130 - DNA, 19 bp, Homo sapiens
gcataaaatgtcaatgtgt

SEQ ID NO: 10004131 - DNA, 22 bp, Homo sapiens
gcattagaagggacctctgggg

SEQ ID NO: 10004132 - DNA, 22 bp, Homo sapiens
gcattagaaactattgctgcaa

SEQ ID NO: 10004133 - DNA, 22 bp, Homo sapiens
gcattacttctttcataggtca

SEQ ID NO: 10004134 - DNA, 19 bp, Homo sapiens
gcataaaatgtcaatgtgt

SEQ ID NO: 10004135 - DNA, 21 bp, Homo sapiens
gcattaaaagcagttgttggt

SEQ ID NO: 10004136 - DNA, 21 bp, Homo sapiens
gcattaaaagcagttgttggt

SEQ ID NO: 10004137 - DNA, 21 bp, Homo sapiens
gcattaaaagcagttgttggt

SEQ ID NO: 10004138 - DNA, 22 bp, Homo sapiens
gcattaaatgctagggacctaa

SEQ ID NO: 10004139 - DNA, 22 bp, Homo sapiens
gcattaaatgctagggacctaa

SEQ ID NO: 10004140 - DNA, 19 bp, Homo sapiens
gcataaaatgtcaatgtgt

SEQ ID NO: 10004141 - DNA, 22 bp, Homo sapiens
gccagacactcccctgggcagg

SEQ ID NO: 10004142 - DNA, 22 bp, Homo sapiens
gccagctgaggccgtgcaggct

SEQ ID NO: 10004143 - DNA, 22 bp, Homo sapiens
gccagctgagaaatcattgata

SEQ ID NO: 10004144 - DNA, 22 bp, Homo sapiens
gccagaagactggagtcagctg

SEQ ID NO: 10004145 - DNA, 22 bp, Homo sapiens
gccagaaggggtggatccaggc

SEQ ID NO: 10004146 - DNA, 22 bp, Homo sapiens
gccagctgtaagctggggtgat

SEQ ID NO: 10004147 - DNA, 22 bp, Homo sapiens
gccagctgtatctttggccagc

SEQ ID NO: 10004148 - DNA, 22 bp, Homo sapiens
gccagctggtaggcacctagcc

SEQ ID NO: 10004149 - DNA, 22 bp, Homo sapiens
gccagctgtaagctggggtgat

SEQ ID NO: 10004150 - DNA, 22 bp, Homo sapiens
gccagctgaggccgtgcaggct

SEQ ID NO: 10004151 - DNA, 22 bp, Homo sapiens
gccagctgcaaagtatgttgaa

SEQ ID NO: 10004152 - DNA, 22 bp, Homo sapiens
gccagctggctgcaggtcccag

SEQ ID NO: 10004153 - DNA, 22 bp, Homo sapiens
gccagctgggccttagggctgg

SEQ ID NO: 10004154 - DNA, 22 bp, Homo sapiens
gccagctggtaggcacctagcc

SEQ ID NO: 10004155 - DNA, 22 bp, Homo sapiens
gccagctgtttcagagcccagt

SEQ ID NO: 10004156 - DNA, 22 bp, Homo sapiens
gccagctttggcacagggtggt

SEQ ID NO: 10004157 - DNA, 22 bp, Homo sapiens
gccagcttccatggccacgtca

SEQ ID NO: 10004158 - DNA, 22 bp, Homo sapiens
gccaggcatgtcctctgcagaa

SEQ ID NO: 10004159 - DNA, 21 bp, Homo sapiens
gccatttcacacagacatttg

SEQ ID NO: 10004160 - DNA, 22 bp, Homo sapiens
gccattttctgtcttgtttatt

SEQ ID NO: 10004161 - DNA, 22 bp, Homo sapiens
gccattttgaaaaccgttgcta

SEQ ID NO: 10004162 - DNA, 22 bp, Homo sapiens
gcccaaagagctttgatctcag

SEQ ID NO: 10004163 - DNA, 22 bp, Homo sapiens
gcccaaagagctttgatctcag

SEQ ID NO: 10004164 - DNA, 21 bp, Homo sapiens
gccatttcacacagacatttg

SEQ ID NO: 10004165 - DNA, 21 bp, Homo sapiens
gccatttcacacagacatttg

SEQ ID NO: 10004166 - DNA, 22 bp, Homo sapiens
gcccaaagtcactcagctagga

SEQ ID NO: 10004167 - DNA, 22 bp, Homo sapiens
gcccaaagccagtgtgctctcc

SEQ ID NO: 10004168 - DNA, 22 bp, Homo sapiens
gcccaaagtcactcagctagga

SEQ ID NO: 10004169 - DNA, 22 bp, Homo sapiens
gcccaagagttaagtctctgct

SEQ ID NO: 10004170 - DNA, 22 bp, Homo sapiens
gcccaagcagcttcccgagctt

SEQ ID NO: 10004171 - DNA, 22 bp, Homo sapiens
gcccaagcagcttcccgagctt

SEQ ID NO: 10004172 - DNA, 22 bp, Homo sapiens
gcccaaggtatatcagagacag

SEQ ID NO: 10004173 - DNA, 22 bp, Homo sapiens
gcccaaggtatatcagagacag

SEQ ID NO: 10004174 - DNA, 22 bp, Homo sapiens
gcccaagggcatcaagttctac

SEQ ID NO: 10004175 - DNA, 22 bp, Homo sapiens
gcccaaggtatatcagagacag

SEQ ID NO: 10004176 - DNA, 22 bp, Homo sapiens
gcccaaggtcacacacaggaag

SEQ ID NO: 10004177 - DNA, 20 bp, Homo sapiens
gcccaaggtccagaaggggg

SEQ ID NO: 10004178 - DNA, 22 bp, Homo sapiens
gcccaaggtcacacacaggaag

SEQ ID NO: 10004179 - DNA, 22 bp, Homo sapiens
gcccaaggtcacacacaggaag

SEQ ID NO: 10004180 - DNA, 22 bp, Homo sapiens
gcccaaggtcacacacaggaag

SEQ ID NO: 10004181 - DNA, 22 bp, Homo sapiens
gcccaagctggactgcagtggc

SEQ ID NO: 10004182 - DNA, 20 bp, Homo sapiens
gcccaagcgccggccgcaga

SEQ ID NO: 10004183 - DNA, 20 bp, Homo sapiens
gcccaagcgccggccgcaga

SEQ ID NO: 10004184 - DNA, 22 bp, Homo sapiens
gcccaagccgccttccagagac

SEQ ID NO: 10004185 - DNA, 22 bp, Homo sapiens
gcccaagccgccttccagagac

SEQ ID NO: 10004186 - DNA, 22 bp, Homo sapiens
gcccaagccggagctgggagag

SEQ ID NO: 10004187 - DNA, 22 bp, Homo sapiens
gcccaagccggagctgggagag

SEQ ID NO: 10004188 - DNA, 22 bp, Homo sapiens
gccaggcattattccgatccct

SEQ ID NO: 10004189 - DNA, 22 bp, Homo sapiens
gccaggcattattccgatccct

SEQ ID NO: 10004190 - DNA, 22 bp, Homo sapiens
gccaggcgggtctcaaactcct

SEQ ID NO: 10004191 - DNA, 22 bp, Homo sapiens
gccaggctaagaaaggtgtgat

SEQ ID NO: 10004192 - DNA, 22 bp, Homo sapiens
gccaggctaagaaaggtgtgat

SEQ ID NO: 10004193 - DNA, 19 bp, Homo sapiens
gccaggctccatagccggc

SEQ ID NO: 10004194 - DNA, 22 bp, Homo sapiens
gccaggctccaggccctcctga

SEQ ID NO: 10004195 - DNA, 22 bp, Homo sapiens
gccaggctccaggccctcctga

SEQ ID NO: 10004196 - DNA, 22 bp, Homo sapiens
gccaggctccaggccctcctga

SEQ ID NO: 10004197 - DNA, 22 bp, Homo sapiens
gccaggctccaggccctcctga

SEQ ID NO: 10004198 - DNA, 22 bp, Homo sapiens
gccaggctccccggatccctgg

SEQ ID NO: 10004199 - DNA, 23 bp, Homo sapiens
gccaggctccggtctgtggccac

SEQ ID NO: 10004200 - DNA, 22 bp, Homo sapiens
gccaggctccccggatccctgg

SEQ ID NO: 10004201 - DNA, 22 bp, Homo sapiens
gcctggagcccagtgtggggct

SEQ ID NO: 10004202 - DNA, 22 bp, Homo sapiens
gcctggagcccagtgtggggct

SEQ ID NO: 10004203 - DNA, 22 bp, Homo sapiens
gcctggagtagcatggcaagcc

SEQ ID NO: 10004204 - DNA, 16 bp, Homo sapiens
gcctggagtggcaggg

SEQ ID NO: 10004205 - DNA, 16 bp, Homo sapiens
gcctggagtggcaggg

SEQ ID NO: 10004206 - DNA, 22 bp, Homo sapiens
gcctggagtggacttggcccct

SEQ ID NO: 10004207 - DNA, 22 bp, Homo sapiens
gcctggagtgcagtggcgtgat

SEQ ID NO: 10004208 - DNA, 22 bp, Homo sapiens
gcctggagtgcagtggcgtgat

SEQ ID NO: 10004209 - DNA, 22 bp, Homo sapiens
gcctggagagcactgtgcgctt

SEQ ID NO: 10004210 - DNA, 22 bp, Homo sapiens
gcctggagaggaagccggtgga

SEQ ID NO: 10004211 - DNA, 22 bp, Homo sapiens
gcctggagcagacgtgtcccgg

SEQ ID NO: 10004212 - DNA, 22 bp, Homo sapiens
gcctggagcagacgtgtcccgg

SEQ ID NO: 10004213 - DNA, 22 bp, Homo sapiens
gcctggagagcactgtgcgctt

SEQ ID NO: 10004214 - DNA, 22 bp, Homo sapiens
gcctggagacagcagaggcggc

SEQ ID NO: 10004215 - DNA, 22 bp, Homo sapiens
gcctggagacaaggacaaaggg

SEQ ID NO: 10004216 - DNA, 22 bp, Homo sapiens
gcctggagaattaaaaggaagg

SEQ ID NO: 10004217 - DNA, 22 bp, Homo sapiens
gcctggagaagatggaactagc

SEQ ID NO: 10004218 - DNA, 22 bp, Homo sapiens
gcctggagaaaggaaggtggga

SEQ ID NO: 10004219 - DNA, 22 bp, Homo sapiens
gcctggagaaaggaaggtggga

SEQ ID NO: 10004220 - DNA, 23 bp, Homo sapiens
gcctggagaaaagctgcagttca

SEQ ID NO: 10004221 - DNA, 23 bp, Homo sapiens
gcctggagaaaagctgcagttca

SEQ ID NO: 10004222 - DNA, 23 bp, Homo sapiens
gcctggagaaaagctgcagttca

SEQ ID NO: 10004223 - DNA, 20 bp, Homo sapiens
gcctgcaggttggatgggat

SEQ ID NO: 10004224 - DNA, 22 bp, Homo sapiens
gcctgcagggtgatgggctgcc

SEQ ID NO: 10004225 - DNA, 20 bp, Homo sapiens
gcctgcaggttggatgggat

SEQ ID NO: 10004226 - DNA, 22 bp, Homo sapiens
gcctgcagggtgatgggctgcc

SEQ ID NO: 10004227 - DNA, 22 bp, Homo sapiens
gcctccctggcccacagcagcg

SEQ ID NO: 10004228 - DNA, 22 bp, Homo sapiens
gcctgaggaatgctcctgactt

SEQ ID NO: 10004229 - DNA, 18 bp, Homo sapiens
gcctgagggtcaagtgtg

SEQ ID NO: 10004230 - DNA, 22 bp, Homo sapiens
gcctgagggctcctagcaggct

SEQ ID NO: 10004231 - DNA, 22 bp, Homo sapiens
gcctccctccaccactgcaggt

SEQ ID NO: 10004232 - DNA, 22 bp, Homo sapiens
gcctccctggcccacagcagcg

SEQ ID NO: 10004233 - DNA, 22 bp, Homo sapiens
gcctccctggcccacagcagcg

SEQ ID NO: 10004234 - DNA, 22 bp, Homo sapiens
gcctgcaagatggctggtcact

SEQ ID NO: 10004235 - DNA, 20 bp, Homo sapiens
gcctgatggacatttcagtt

SEQ ID NO: 10004236 - DNA, 22 bp, Homo sapiens
gcctgagtgcatctgcagacat

SEQ ID NO: 10004237 - DNA, 22 bp, Homo sapiens
gcctgcagaggtgctgctagct

SEQ ID NO: 10004238 - DNA, 20 bp, Homo sapiens
gcctgcagagaaggtcagag

SEQ ID NO: 10004239 - DNA, 22 bp, Homo sapiens
gcctgcagcctcaagggctgag

SEQ ID NO: 10004240 - DNA, 18 bp, Homo sapiens
gcctgcaggcacgggggt

SEQ ID NO: 10004241 - DNA, 22 bp, Homo sapiens
gcccctgcctttgaacctggag

SEQ ID NO: 10004242 - DNA, 22 bp, Homo sapiens
gcccacagctcgttcctctcct

SEQ ID NO: 10004243 - DNA, 22 bp, Homo sapiens
gcccaaggtcccatggcagcac

SEQ ID NO: 10004244 - DNA, 22 bp, Homo sapiens
gcccaagtcagtgcttctggca

SEQ ID NO: 10004245 - DNA, 22 bp, Homo sapiens
gcccaaggtcccatggcagcac

SEQ ID NO: 10004246 - DNA, 22 bp, Homo sapiens
gcccacacaccagctcaggagg

SEQ ID NO: 10004247 - DNA, 22 bp, Homo sapiens
gcccaatagagaaatagtgaaa

SEQ ID NO: 10004248 - DNA, 22 bp, Homo sapiens
gcccaatagtggggatatacct

SEQ ID NO: 10004249 - DNA, 22 bp, Homo sapiens
gcccgcgccagcctctccatct

SEQ ID NO: 10004250 - DNA, 22 bp, Homo sapiens
gcccggcagtcacacacccagg

SEQ ID NO: 10004251 - DNA, 22 bp, Homo sapiens
gcccggccaggaacagagtata

SEQ ID NO: 10004252 - DNA, 22 bp, Homo sapiens
gccctagcgccagctcagcacc

SEQ ID NO: 10004253 - DNA, 22 bp, Homo sapiens
gcccctgttgtggctttgtcta

SEQ ID NO: 10004254 - DNA, 22 bp, Homo sapiens
gccccttcttctggagattcaa

SEQ ID NO: 10004255 - DNA, 21 bp, Homo sapiens
gccctaggctacctggagcgc

SEQ ID NO: 10004256 - DNA, 22 bp, Homo sapiens
gccctaggcttttgtgactgcc

SEQ ID NO: 10004257 - DNA, 22 bp, Homo sapiens
gccctagggggaaccgaggact

SEQ ID NO: 10004258 - DNA, 22 bp, Homo sapiens
gccctagggcttttgggcctgt

SEQ ID NO: 10004259 - DNA, 22 bp, Homo sapiens
gccctgagtgcctgtgtaagaa

SEQ ID NO: 10004260 - DNA, 22 bp, Homo sapiens
gccctgagtggtacctgtgggt

SEQ ID NO: 10004261 - DNA, 22 bp, Homo sapiens
gccctgagtggtacctgtgggt

SEQ ID NO: 10004262 - DNA, 22 bp, Homo sapiens
gccctgctgtcttcagagtata

SEQ ID NO: 10004263 - DNA, 22 bp, Homo sapiens
gccctgctgtcttcagagtata

SEQ ID NO: 10004264 - DNA, 22 bp, Homo sapiens
gccctgctcttttgcccaccca

SEQ ID NO: 10004265 - DNA, 22 bp, Homo sapiens
gccctgctcttttgcccaccca

SEQ ID NO: 10004266 - DNA, 22 bp, Homo sapiens
gccctgctctgttggtcacctg

SEQ ID NO: 10004267 - DNA, 22 bp, Homo sapiens
gccctgctgagtccggctcaga

SEQ ID NO: 10004268 - DNA, 23 bp, Homo sapiens
gccctgctgggacctcctgctac

SEQ ID NO: 10004269 - DNA, 22 bp, Homo sapiens
gccctgctcatttcacgtgttt

SEQ ID NO: 10004270 - DNA, 22 bp, Homo sapiens
gccctgctcctccgtcccacga

SEQ ID NO: 10004271 - DNA, 22 bp, Homo sapiens
gccctgctcctccgtcccacga

SEQ ID NO: 10004272 - DNA, 22 bp, Homo sapiens
gccctggacagtgacggtgacc

SEQ ID NO: 10004273 - DNA, 22 bp, Homo sapiens
gccctggaatctctccatggga

SEQ ID NO: 10004274 - DNA, 22 bp, Homo sapiens
gcctcagggggagaggccagct

SEQ ID NO: 10004275 - DNA, 22 bp, Homo sapiens
gcctcaggtaaaacttgagttt

SEQ ID NO: 10004276 - DNA, 22 bp, Homo sapiens
gcctcaggtaaaacttgagttt

SEQ ID NO: 10004277 - DNA, 22 bp, Homo sapiens
gcctcaggtgcatctctcattc

SEQ ID NO: 10004278 - DNA, 22 bp, Homo sapiens
gcctcagggggagaggccagct

SEQ ID NO: 10004279 - DNA, 20 bp, Homo sapiens
gcctccacactcacccctta

SEQ ID NO: 10004280 - DNA, 19 bp, Homo sapiens
gcctcatttccacctcccc

SEQ ID NO: 10004281 - DNA, 19 bp, Homo sapiens
gcctcatttccacctcccc

SEQ ID NO: 10004282 - DNA, 22 bp, Homo sapiens
gcctcagtgatatgtgggacaa

SEQ ID NO: 10004283 - DNA, 20 bp, Homo sapiens
gcctcagtcacatggcctac

SEQ ID NO: 10004284 - DNA, 22 bp, Homo sapiens
gcctcagtgtcctcctccatgt

SEQ ID NO: 10004285 - DNA, 22 bp, Homo sapiens
gcacagagtcactagctaagca

SEQ ID NO: 10004286 - DNA, 22 bp, Homo sapiens
gcacagagtgggtgagatgtgg

SEQ ID NO: 10004287 - DNA, 22 bp, Homo sapiens
gcacagaggtggaggacaaata

SEQ ID NO: 10004288 - DNA, 22 bp, Homo sapiens
gcacagaggtggaggacaaata

SEQ ID NO: 10004289 - DNA, 22 bp, Homo sapiens
gcacagaggtggaggacaaata

SEQ ID NO: 10004290 - DNA, 22 bp, Homo sapiens
gcacagagtcactagctaagca

SEQ ID NO: 10004291 - DNA, 22 bp, Homo sapiens
gcacagagtcactagctaagca

SEQ ID NO: 10004292 - DNA, 22 bp, Homo sapiens
gcacatggacaatggaggtgca

SEQ ID NO: 10004293 - DNA, 18 bp, Homo sapiens
gcacatgtaagagtaaag

SEQ ID NO: 10004294 - DNA, 22 bp, Homo sapiens
gcacatggtaggcatttgatgt

SEQ ID NO: 10004295 - DNA, 22 bp, Homo sapiens
gcacatgttgctagttacttgc

SEQ ID NO: 10004296 - DNA, 17 bp, Homo sapiens
gcacatgtgttctttta

SEQ ID NO: 10004297 - DNA, 22 bp, Homo sapiens
gcacatgtcttattcactgtta

SEQ ID NO: 10004298 - DNA, 22 bp, Homo sapiens
gcacatgtgagagtagaggcct

SEQ ID NO: 10004299 - DNA, 22 bp, Homo sapiens
gcacagagggcagtgagcctct

SEQ ID NO: 10004300 - DNA, 22 bp, Homo sapiens
gcacagagagggaaggtaactt

SEQ ID NO: 10004301 - DNA, 22 bp, Homo sapiens
gcacagagagggaaggtaactt

SEQ ID NO: 10004302 - DNA, 22 bp, Homo sapiens
gcacagagaggctgtgagcgcc

SEQ ID NO: 10004303 - DNA, 20 bp, Homo sapiens
gcacagagatgagcaaagta

SEQ ID NO: 10004304 - DNA, 22 bp, Homo sapiens
gcacagagacagtcctgagatc

SEQ ID NO: 10004305 - DNA, 22 bp, Homo sapiens
gcacagagagcagtgggggaca

SEQ ID NO: 10004306 - DNA, 22 bp, Homo sapiens
gcacagagagcagtgggggaca

SEQ ID NO: 10004307 - DNA, 22 bp, Homo sapiens
gcacagaaccagacatgaggca

SEQ ID NO: 10004308 - DNA, 22 bp, Homo sapiens
gcacagaacttctcttagtagg

SEQ ID NO: 10004309 - DNA, 22 bp, Homo sapiens
gcacagaagtaaaatacaagtc

SEQ ID NO: 10004310 - DNA, 22 bp, Homo sapiens
gcacagaataacactctgggct

SEQ ID NO: 10004311 - DNA, 22 bp, Homo sapiens
gcaataaagtagcagctcatca

SEQ ID NO: 10004312 - DNA, 22 bp, Homo sapiens
gcaataaataacatggaagaca

SEQ ID NO: 10004313 - DNA, 22 bp, Homo sapiens
gcaataaaatgtaatgattggg

SEQ ID NO: 10004314 - DNA, 22 bp, Homo sapiens
gcaataaaatgtaatgattggg

SEQ ID NO: 10004315 - DNA, 20 bp, Homo sapiens
gcaaggctccaaggggtgtg

SEQ ID NO: 10004316 - DNA, 22 bp, Homo sapiens
gcaataaactctctcaagccac

SEQ ID NO: 10004317 - DNA, 21 bp, Homo sapiens
gcaaggcctatcatggcagct

SEQ ID NO: 10004318 - DNA, 20 bp, Homo sapiens
gcaaggcaggttgaccaaga

SEQ ID NO: 10004319 - DNA, 18 bp, Homo sapiens
gcaaggcagctctctggg

SEQ ID NO: 10004320 - DNA, 22 bp, Homo sapiens
gcaaggcagtcctggggccctg

SEQ ID NO: 10004321 - DNA, 18 bp, Homo sapiens
gcaaggctcaggccaggc

SEQ ID NO: 10004322 - DNA, 18 bp, Homo sapiens
gcaaggctcaggccaggc

SEQ ID NO: 10004323 - DNA, 20 bp, Homo sapiens
gcaaggcacagtgaggaggg

SEQ ID NO: 10004324 - DNA, 22 bp, Homo sapiens
gcaaggcagcgcggagtagcta

SEQ ID NO: 10004325 - DNA, 22 bp, Homo sapiens
gcaaggcagcgcggagtagcta

SEQ ID NO: 10004326 - DNA, 22 bp, Homo sapiens
gcaaggcagcgcggagtagcta

SEQ ID NO: 10004327 - DNA, 22 bp, Homo sapiens
gcaaggagcctggaggtgagtg

SEQ ID NO: 10004328 - DNA, 22 bp, Homo sapiens
gcaaggagcctggaggtgagtg

SEQ ID NO: 10004329 - DNA, 21 bp, Homo sapiens
gcaaggcaatgccatgatttc

SEQ ID NO: 10004330 - DNA, 21 bp, Homo sapiens
gcaaggcaatgccatgatttc

SEQ ID NO: 10004331 - DNA, 22 bp, Homo sapiens
gcaaggagactgtagggccaag

SEQ ID NO: 10004332 - DNA, 22 bp, Homo sapiens
gcaaggagactgtagggccaag

SEQ ID NO: 10004333 - DNA, 19 bp, Homo sapiens
gagtattttccaacttggt

SEQ ID NO: 10004334 - DNA, 22 bp, Homo sapiens
gcaaggacctttgagcgtgcca

SEQ ID NO: 10004335 - DNA, 22 bp, Homo sapiens
gagtattcctcagtcattttgt

SEQ ID NO: 10004336 - DNA, 22 bp, Homo sapiens
gcacccagagggcagggtctcc

SEQ ID NO: 10004337 - DNA, 22 bp, Homo sapiens
gcacccagaggtcagcagtgct

SEQ ID NO: 10004338 - DNA, 22 bp, Homo sapiens
gcacccagaggtcagcagtgct

SEQ ID NO: 10004339 - DNA, 22 bp, Homo sapiens
gcagaaggatccgcaggtgcaa

SEQ ID NO: 10004340 - DNA, 20 bp, Homo sapiens
gcacccagcttcttgttcta

SEQ ID NO: 10004341 - DNA, 21 bp, Homo sapiens
gcacccagccggttctcccag

SEQ ID NO: 10004342 - DNA, 22 bp, Homo sapiens
gcacccagcccagggcgtgatg

SEQ ID NO: 10004343 - DNA, 22 bp, Homo sapiens
gcacccagaggtcagcagtgct

SEQ ID NO: 10004344 - DNA, 22 bp, Homo sapiens
gcacccagatagcaaggattag

SEQ ID NO: 10004345 - DNA, 22 bp, Homo sapiens
gcacccagatattgccttgacc

SEQ ID NO: 10004346 - DNA, 22 bp, Homo sapiens
gcacccagccagcatctcagag

SEQ ID NO: 10004347 - DNA, 22 bp, Homo sapiens
gcacccagccagcatctcagag

SEQ ID NO: 10004348 - DNA, 22 bp, Homo sapiens
gcagacaggcccagtggaggga

SEQ ID NO: 10004349 - DNA, 22 bp, Homo sapiens
gcagacaggcccagtggaggga

SEQ ID NO: 10004350 - DNA, 22 bp, Homo sapiens
gcagacagcatgttgggctatt

SEQ ID NO: 10004351 - DNA, 22 bp, Homo sapiens
gcagacagccagactgcactgg

SEQ ID NO: 10004352 - DNA, 22 bp, Homo sapiens
gcagacagccagactgcactgg

SEQ ID NO: 10004353 - DNA, 22 bp, Homo sapiens
gcagacagatgagggtgctggg

SEQ ID NO: 10004354 - DNA, 22 bp, Homo sapiens
gcagacagatgagggtgctggg

SEQ ID NO: 10004355 - DNA, 22 bp, Homo sapiens
gcagacagcatgttgggctatt

SEQ ID NO: 10004356 - DNA, 22 bp, Homo sapiens
gcagacagcatgttgggctatt

SEQ ID NO: 10004357 - DNA, 22 bp, Homo sapiens
gcagacagatgagggtgctggg

SEQ ID NO: 10004358 - DNA, 22 bp, Homo sapiens
gcagacagatgagggtgctggg

SEQ ID NO: 10004359 - DNA, 22 bp, Homo sapiens
gcagaagggaataaggagcttt

SEQ ID NO: 10004360 - DNA, 22 bp, Homo sapiens
gcagacaatttattagcagatt

SEQ ID NO: 10004361 - DNA, 22 bp, Homo sapiens
gcagacaatttattagcagatt

SEQ ID NO: 10004362 - DNA, 22 bp, Homo sapiens
gcagacaatttattagcagatt

SEQ ID NO: 10004363 - DNA, 22 bp, Homo sapiens
gcagacacttcccactgcagcg

SEQ ID NO: 10004364 - DNA, 22 bp, Homo sapiens
gcagacagactgcagtgatttt

SEQ ID NO: 10004365 - DNA, 22 bp, Homo sapiens
gcagacagactgcagtgatttt

SEQ ID NO: 10004366 - DNA, 22 bp, Homo sapiens
gcagacagaagctaagtagaca

SEQ ID NO: 10004367 - DNA, 23 bp, Homo sapiens
gcagacagagcagactaagacaa

SEQ ID NO: 10004368 - DNA, 22 bp, Homo sapiens
gcagagtcaggattccatccca

SEQ ID NO: 10004369 - DNA, 22 bp, Homo sapiens
gcagagtctgggcagcctccat

SEQ ID NO: 10004370 - DNA, 22 bp, Homo sapiens
gcagagtctgggctacctcttg

SEQ ID NO: 10004371 - DNA, 22 bp, Homo sapiens
gcagagtgaagcagtatggaaa

SEQ ID NO: 10004372 - DNA, 23 bp, Homo sapiens
gcagaggttatgttttttaggct

SEQ ID NO: 10004373 - DNA, 22 bp, Homo sapiens
gcagaggttggattggtgactt

SEQ ID NO: 10004374 - DNA, 23 bp, Homo sapiens
gcagaggtttttcagtatggttt

SEQ ID NO: 10004375 - DNA, 22 bp, Homo sapiens
gcagagtcagcctccgagacag

SEQ ID NO: 10004376 - DNA, 23 bp, Homo sapiens
gcagagtcaagtagtcatgagtg

SEQ ID NO: 10004377 - DNA, 19 bp, Homo sapiens
gcagagtcaagagctgctg

SEQ ID NO: 10004378 - DNA, 19 bp, Homo sapiens
gcagagtcaagagctgctg

SEQ ID NO: 10004379 - DNA, 22 bp, Homo sapiens
gcagacagggctacagaggtac

SEQ ID NO: 10004380 - DNA, 22 bp, Homo sapiens
gcagacaggcccagtggaggga

SEQ ID NO: 10004381 - DNA, 22 bp, Homo sapiens
gcagaggtgagtttctcagctg

SEQ ID NO: 10004382 - DNA, 22 bp, Homo sapiens
gcagaggtgtcaccttccagga

SEQ ID NO: 10004383 - DNA, 22 bp, Homo sapiens
gcagaggtgtgggaggggccac

SEQ ID NO: 10004384 - DNA, 22 bp, Homo sapiens
gcagaggtgtagccccctccat

SEQ ID NO: 10004385 - DNA, 22 bp, Homo sapiens
gcagaggtggcatctgggctct

SEQ ID NO: 10004386 - DNA, 22 bp, Homo sapiens
gcagaggtgctcagtggcagaa

SEQ ID NO: 10004387 - DNA, 22 bp, Homo sapiens
gcagaggtggcatctgggctct

SEQ ID NO: 10004388 - DNA, 22 bp, Homo sapiens
gcagaggtggatgcaattgggg

SEQ ID NO: 10004389 - DNA, 22 bp, Homo sapiens
gcagcaagaggtgccatcttga

SEQ ID NO: 10004390 - DNA, 22 bp, Homo sapiens
gcagcaagaataatttgggtag

SEQ ID NO: 10004391 - DNA, 22 bp, Homo sapiens
gcagcaagaataatttgggtag

SEQ ID NO: 10004392 - DNA, 21 bp, Homo sapiens
gcagcaaatgacaacagtgag

SEQ ID NO: 10004393 - DNA, 22 bp, Homo sapiens
gcagcaaacttccacaagtaga

SEQ ID NO: 10004394 - DNA, 19 bp, Homo sapiens
gcagcaaacaaaacaggta

SEQ ID NO: 10004395 - DNA, 22 bp, Homo sapiens
gcagatttcatttaaacctttc

SEQ ID NO: 10004396 - DNA, 22 bp, Homo sapiens
gcagatttctaataagcaatgt

SEQ ID NO: 10004397 - DNA, 22 bp, Homo sapiens
gcagagtgggagcccagggctg

SEQ ID NO: 10004398 - DNA, 22 bp, Homo sapiens
gcagagtgaagggagaggtgtg

SEQ ID NO: 10004399 - DNA, 22 bp, Homo sapiens
gcagagtgagatatgaacccag

SEQ ID NO: 10004400 - DNA, 22 bp, Homo sapiens
gcagagtgccgagatggaagcg

SEQ ID NO: 10004401 - DNA, 22 bp, Homo sapiens
gcagagtgccgagatggaagcg

SEQ ID NO: 10004402 - DNA, 18 bp, Homo sapiens
gcagagtgcgtctctgtg

SEQ ID NO: 10004403 - DNA, 22 bp, Homo sapiens
gcagcagccactattctggcat

SEQ ID NO: 10004404 - DNA, 22 bp, Homo sapiens
gcagcagcccagggctctcaga

SEQ ID NO: 10004405 - DNA, 21 bp, Homo sapiens
gcagccacagccaccaagcta

SEQ ID NO: 10004406 - DNA, 22 bp, Homo sapiens
gcagccaccctcaaggctgaat

SEQ ID NO: 10004407 - DNA, 22 bp, Homo sapiens
gcagccacagaggagggatgca

SEQ ID NO: 10004408 - DNA, 22 bp, Homo sapiens
gcagccactagttttcctgttt

SEQ ID NO: 10004409 - DNA, 22 bp, Homo sapiens
gcagccagaagactcagaacaa

SEQ ID NO: 10004410 - DNA, 22 bp, Homo sapiens
gcagccactttgcaaccaagag

SEQ ID NO: 10004411 - DNA, 22 bp, Homo sapiens
gcagccagccctagtcccactt

SEQ ID NO: 10004412 - DNA, 22 bp, Homo sapiens
gcagccagccctagtcccactt

SEQ ID NO: 10004413 - DNA, 22 bp, Homo sapiens
gcagccaggaaagctggaccct

SEQ ID NO: 10004414 - DNA, 21 bp, Homo sapiens
gcagccagccgagaccatgcc

SEQ ID NO: 10004415 - DNA, 21 bp, Homo sapiens
gcagccagacgggattcagtt

SEQ ID NO: 10004416 - DNA, 22 bp, Homo sapiens
gcagccagaagactcagaacaa

SEQ ID NO: 10004417 - DNA, 21 bp, Homo sapiens
gcagccagacgggattcagtt

SEQ ID NO: 10004418 - DNA, 22 bp, Homo sapiens
gcagccagcccctctgacctct

SEQ ID NO: 10004419 - DNA, 22 bp, Homo sapiens
gcagcagcaagaaggttggact

SEQ ID NO: 10004420 - DNA, 22 bp, Homo sapiens
gcagcagaagtagaagtacagg

SEQ ID NO: 10004421 - DNA, 22 bp, Homo sapiens
gcagcagaaggccaaggggagc

SEQ ID NO: 10004422 - DNA, 19 bp, Homo sapiens
gcagcagcatttggtaata

SEQ ID NO: 10004423 - DNA, 22 bp, Homo sapiens
gcagcagcagggagtctgactt

SEQ ID NO: 10004424 - DNA, 22 bp, Homo sapiens
gcagcagcagcaattttctgtc

SEQ ID NO: 10004425 - DNA, 22 bp, Homo sapiens
gcagcagcaggcgctcggccgt

SEQ ID NO: 10004426 - DNA, 22 bp, Homo sapiens
gcagcaaggatgaagcacttgg

SEQ ID NO: 10004427 - DNA, 22 bp, Homo sapiens
gcagcaagtctagtttgtaggc

SEQ ID NO: 10004428 - DNA, 22 bp, Homo sapiens
gcagcaagtctagtttgtaggc

SEQ ID NO: 10004429 - DNA, 22 bp, Homo sapiens
gcagcaagaggtttctgttgac

SEQ ID NO: 10004430 - DNA, 22 bp, Homo sapiens
gcagcaagaggtgccatcttga

SEQ ID NO: 10004431 - DNA, 22 bp, Homo sapiens
gcagcaaggatgaagcacttgg

SEQ ID NO: 10004432 - DNA, 22 bp, Homo sapiens
gcagcaagaggtgccatcttga

SEQ ID NO: 10004433 - DNA, 22 bp, Homo sapiens
gcagcaagaggtttctgttgac

SEQ ID NO: 10004434 - DNA, 22 bp, Homo sapiens
gcagcaatcttcacagtgtcat

SEQ ID NO: 10004435 - DNA, 19 bp, Homo sapiens
gcagcaatagaagacaaat

SEQ ID NO: 10004436 - DNA, 22 bp, Homo sapiens
gcagcaatcccaagtctgagtg

SEQ ID NO: 10004437 - DNA, 19 bp, Homo sapiens
gcagcaatagaagacaaat

SEQ ID NO: 10004438 - DNA, 22 bp, Homo sapiens
gcagcagaaggccaaggggagc

SEQ ID NO: 10004439 - DNA, 22 bp, Homo sapiens
gcagcactgtcttgtcttagga

SEQ ID NO: 10004440 - DNA, 22 bp, Homo sapiens
gcagcactaatgggccccagaa

SEQ ID NO: 10004441 - DNA, 22 bp, Homo sapiens
gcagcacatataaacaaagaga

SEQ ID NO: 10004442 - DNA, 22 bp, Homo sapiens
gcagcacatataaacaaagaga

SEQ ID NO: 10004443 - DNA, 22 bp, Homo sapiens
gcagcacatataaacaaagaga

SEQ ID NO: 10004444 - DNA, 22 bp, Homo sapiens
gcagctggccctgacacgcaga

SEQ ID NO: 10004445 - DNA, 22 bp, Homo sapiens
gcagcccaatggactgagacag

SEQ ID NO: 10004446 - DNA, 22 bp, Homo sapiens
gcagctggctcagagaggtggg

SEQ ID NO: 10004447 - DNA, 22 bp, Homo sapiens
gcagctggctctgggaaaaact

SEQ ID NO: 10004448 - DNA, 22 bp, Homo sapiens
gcagctgggacactgaggccag

SEQ ID NO: 10004449 - DNA, 22 bp, Homo sapiens
gcagctgggacactgaggccag

SEQ ID NO: 10004450 - DNA, 17 bp, Homo sapiens
gcagccagtgcagcagg

SEQ ID NO: 10004451 - DNA, 22 bp, Homo sapiens
gcagccaggtttgaggaccact

SEQ ID NO: 10004452 - DNA, 22 bp, Homo sapiens
gcagccagtgggatgagaaaga

SEQ ID NO: 10004453 - DNA, 17 bp, Homo sapiens
gcagccagtgcagcagg

SEQ ID NO: 10004454 - DNA, 22 bp, Homo sapiens
gcagctggggccacacttaggc

SEQ ID NO: 10004455 - DNA, 21 bp, Homo sapiens
gcagctggtctcagagcttgc

SEQ ID NO: 10004456 - DNA, 22 bp, Homo sapiens
gcagctgggtctgtgtgggctg

SEQ ID NO: 10004457 - DNA, 22 bp, Homo sapiens
gcagctgggccccagcctctcc

SEQ ID NO: 10004458 - DNA, 22 bp, Homo sapiens
gcagctggggaggtcgtgggga

SEQ ID NO: 10004459 - DNA, 22 bp, Homo sapiens
gcagctggggaggtcgtgggga

SEQ ID NO: 10004460 - DNA, 22 bp, Homo sapiens
gcagctggtgcaaatgtcactc

SEQ ID NO: 10004461 - DNA, 22 bp, Homo sapiens
gcagctggttaatgggagaatt

SEQ ID NO: 10004462 - DNA, 21 bp, Homo sapiens
gcagctggtctcagagcttgc

SEQ ID NO: 10004463 - DNA, 22 bp, Homo sapiens
gcaggccagctgtgcagatggg

SEQ ID NO: 10004464 - DNA, 22 bp, Homo sapiens
gcaggccactgtctcctctggg

SEQ ID NO: 10004465 - DNA, 22 bp, Homo sapiens
gcaggccagctgtgcagatggg

SEQ ID NO: 10004466 - DNA, 22 bp, Homo sapiens
gcaggccacagtggagtctctg

SEQ ID NO: 10004467 - DNA, 22 bp, Homo sapiens
gcaggccattcaggagatgtgc

SEQ ID NO: 10004468 - DNA, 22 bp, Homo sapiens
gcaggcccagagtcgctggcct

SEQ ID NO: 10004469 - DNA, 22 bp, Homo sapiens
gcaggcagtttgcttttccctc

SEQ ID NO: 10004470 - DNA, 22 bp, Homo sapiens
gcaggccaagccctcgcagaga

SEQ ID NO: 10004471 - DNA, 22 bp, Homo sapiens
gcagctgtactggcagcattgt

SEQ ID NO: 10004472 - DNA, 22 bp, Homo sapiens
gcagctgtaaagcagaaatagt

SEQ ID NO: 10004473 - DNA, 22 bp, Homo sapiens
gcagctgtagaggggagaaaga

SEQ ID NO: 10004474 - DNA, 22 bp, Homo sapiens
gcagctgtcactttcacaatgc

SEQ ID NO: 10004475 - DNA, 22 bp, Homo sapiens
gcagctgtatcacttttaaaca

SEQ ID NO: 10004476 - DNA, 22 bp, Homo sapiens
gcaggcagttgcagttttctag

SEQ ID NO: 10004477 - DNA, 22 bp, Homo sapiens
gcagctgtcagaagttggaatc

SEQ ID NO: 10004478 - DNA, 22 bp, Homo sapiens
gcaggcctcccctgctggagct

SEQ ID NO: 10004479 - DNA, 18 bp, Homo sapiens
gcaggccctgtttctggg

SEQ ID NO: 10004480 - DNA, 22 bp, Homo sapiens
gcaggcccttagccttggtggg

SEQ ID NO: 10004481 - DNA, 20 bp, Homo sapiens
gcaggccctctctctagtct

SEQ ID NO: 10004482 - DNA, 22 bp, Homo sapiens
gcaggccctcctctagcaaggc

SEQ ID NO: 10004483 - DNA, 19 bp, Homo sapiens
gcaggcccagtcgggctgg

SEQ ID NO: 10004484 - DNA, 22 bp, Homo sapiens
gcagggcagctgaagctaggtg

SEQ ID NO: 10004485 - DNA, 22 bp, Homo sapiens
gcagggcagcttagtccctgtc

SEQ ID NO: 10004486 - DNA, 22 bp, Homo sapiens
gcagggcagctcactgtggttc

SEQ ID NO: 10004487 - DNA, 19 bp, Homo sapiens
gcaggtgagccgtggctcc

SEQ ID NO: 10004488 - DNA, 22 bp, Homo sapiens
gcaggtgatgtgatgtgagcat

SEQ ID NO: 10004489 - DNA, 22 bp, Homo sapiens
gcaggtgatgtgatgtgagcat

SEQ ID NO: 10004490 - DNA, 22 bp, Homo sapiens
gcaggtgatgtgatgtgagcat

SEQ ID NO: 10004491 - DNA, 22 bp, Homo sapiens
gcaggtgaatgatggactagga

SEQ ID NO: 10004492 - DNA, 22 bp, Homo sapiens
gcaggtgaatgatggactagga

SEQ ID NO: 10004493 - DNA, 22 bp, Homo sapiens
gcaggtctcaatctgagcaggc

SEQ ID NO: 10004494 - DNA, 22 bp, Homo sapiens
gcaggtctagaagctgcctctg

SEQ ID NO: 10004495 - DNA, 22 bp, Homo sapiens
gcaggtccagtcaccagagaga

SEQ ID NO: 10004496 - DNA, 19 bp, Homo sapiens
gcaggtcattaggctaggt

SEQ ID NO: 10004497 - DNA, 19 bp, Homo sapiens
gcagggtgttgactgtccc

SEQ ID NO: 10004498 - DNA, 19 bp, Homo sapiens
gcagggtgttgactgtccc

SEQ ID NO: 10004499 - DNA, 19 bp, Homo sapiens
gcagggtgttgactgtccc

SEQ ID NO: 10004500 - DNA, 19 bp, Homo sapiens
gcaggtagagacagcagcc

SEQ ID NO: 10004501 - DNA, 22 bp, Homo sapiens
gcagggcagggcaagaactggg

SEQ ID NO: 10004502 - DNA, 22 bp, Homo sapiens
gcagggcagtaagagctagagt

SEQ ID NO: 10004503 - DNA, 22 bp, Homo sapiens
gcagggccagggctcaggctgt

SEQ ID NO: 10004504 - DNA, 22 bp, Homo sapiens
gcagggccagggctcaggctgt

SEQ ID NO: 10004505 - DNA, 22 bp, Homo sapiens
gcagggccaggtacaagaagca

SEQ ID NO: 10004506 - DNA, 22 bp, Homo sapiens
gcagggccaggtacaagaagca

SEQ ID NO: 10004507 - DNA, 22 bp, Homo sapiens
gcagggccagtgcagagaggaa

SEQ ID NO: 10004508 - DNA, 22 bp, Homo sapiens
gcagggccttagcagcggctgc

SEQ ID NO: 10004509 - DNA, 19 bp, Homo sapiens
gcagggtggcagagctctt

SEQ ID NO: 10004510 - DNA, 19 bp, Homo sapiens
gcagggtggcagagctctt

SEQ ID NO: 10004511 - DNA, 22 bp, Homo sapiens
gcagggtgtgtctcatacagtt

SEQ ID NO: 10004512 - DNA, 22 bp, Homo sapiens
gcagggtgtgtctcatacagtt

SEQ ID NO: 10004513 - DNA, 22 bp, Homo sapiens
gctggaggggtaataggatggg

SEQ ID NO: 10004514 - DNA, 22 bp, Homo sapiens
gctggaggggtaataggatggg

SEQ ID NO: 10004515 - DNA, 22 bp, Homo sapiens
gctggagcttgagaggacaggg

SEQ ID NO: 10004516 - DNA, 22 bp, Homo sapiens
gctgctgtccttcaagtctgcg

SEQ ID NO: 10004517 - DNA, 22 bp, Homo sapiens
gctgctgtcagtggtggcagtt

SEQ ID NO: 10004518 - DNA, 22 bp, Homo sapiens
gctgctgtcagtggtggcagtt

SEQ ID NO: 10004519 - DNA, 22 bp, Homo sapiens
gctgctggtcctcagagctcat

SEQ ID NO: 10004520 - DNA, 22 bp, Homo sapiens
gctgctgtcagcaggccttgtt

SEQ ID NO: 10004521 - DNA, 22 bp, Homo sapiens
gctgctgtcagcaggccttgtt

SEQ ID NO: 10004522 - DNA, 22 bp, Homo sapiens
gctgctgtcacggtgctaaggg

SEQ ID NO: 10004523 - DNA, 18 bp, Homo sapiens
gctgctggtggagggagc

SEQ ID NO: 10004524 - DNA, 22 bp, Homo sapiens
gctgcctctgtagctttggacc

SEQ ID NO: 10004525 - DNA, 22 bp, Homo sapiens
gctgcctctgtagctttggacc

SEQ ID NO: 10004526 - DNA, 22 bp, Homo sapiens
gctgcctgaaatgttgcctagc

SEQ ID NO: 10004527 - DNA, 23 bp, Homo sapiens
gctgcctctgttggtcttcagtt

SEQ ID NO: 10004528 - DNA, 22 bp, Homo sapiens
gctgctgcttgaaggctcggag

SEQ ID NO: 10004529 - DNA, 22 bp, Homo sapiens
gctgctggaacaaatcacccca

SEQ ID NO: 10004530 - DNA, 22 bp, Homo sapiens
gctgctggaagcatgcgatgaa

SEQ ID NO: 10004531 - DNA, 19 bp, Homo sapiens
gctgctggctctggctgga

SEQ ID NO: 10004532 - DNA, 22 bp, Homo sapiens
gctgctggggccttccctcggg

SEQ ID NO: 10004533 - DNA, 22 bp, Homo sapiens
gctgctggggtcacatggtaag

SEQ ID NO: 10004534 - DNA, 19 bp, Homo sapiens
gctgctggctctggctgga

SEQ ID NO: 10004535 - DNA, 22 bp, Homo sapiens
gctgctgggatcctgggtctca

SEQ ID NO: 10004536 - DNA, 22 bp, Homo sapiens
gctggagttggcaaggcatgta

SEQ ID NO: 10004537 - DNA, 22 bp, Homo sapiens
gctggatccctgtgggagtggt

SEQ ID NO: 10004538 - DNA, 22 bp, Homo sapiens
gctggcagggtggttgagagag

SEQ ID NO: 10004539 - DNA, 22 bp, Homo sapiens
gctggcagggttctcactgaaa

SEQ ID NO: 10004540 - DNA, 22 bp, Homo sapiens
gctggcagggttctcactgaaa

SEQ ID NO: 10004541 - DNA, 22 bp, Homo sapiens
gctggcaggtccaagatagagc

SEQ ID NO: 10004542 - DNA, 22 bp, Homo sapiens
gctggcaggtaaagccccgggg

SEQ ID NO: 10004543 - DNA, 22 bp, Homo sapiens
gctggcaggtaaagccccgggg

SEQ ID NO: 10004544 - DNA, 22 bp, Homo sapiens
gctggcattacaggagagaacc

SEQ ID NO: 10004545 - DNA, 22 bp, Homo sapiens
gctggcatggagactctgggtc

SEQ ID NO: 10004546 - DNA, 22 bp, Homo sapiens
gctggcagtttcctcaccgagg

SEQ ID NO: 10004547 - DNA, 22 bp, Homo sapiens
gctggcagtgtattgttagctg

SEQ ID NO: 10004548 - DNA, 22 bp, Homo sapiens
gctggcagtgtattgttagctg

SEQ ID NO: 10004549 - DNA, 22 bp, Homo sapiens
gctggcagtgtgaatgacaagc

SEQ ID NO: 10004550 - DNA, 22 bp, Homo sapiens
gctggcaggtccaagatagagc

SEQ ID NO: 10004551 - DNA, 22 bp, Homo sapiens
gctggcaggtccaagatagagc

SEQ ID NO: 10004552 - DNA, 22 bp, Homo sapiens
gctggcaggtccaagatagagc

SEQ ID NO: 10004553 - DNA, 22 bp, Homo sapiens
gctggcagtcccatcagctggg

SEQ ID NO: 10004554 - DNA, 22 bp, Homo sapiens
gctggaggtagggaggtcctgt

SEQ ID NO: 10004555 - DNA, 22 bp, Homo sapiens
gctggaggggtaataggatggg

SEQ ID NO: 10004556 - DNA, 22 bp, Homo sapiens
gctggagtccagtggcatgatc

SEQ ID NO: 10004557 - DNA, 22 bp, Homo sapiens
gctggagtatctggggaaggag

SEQ ID NO: 10004558 - DNA, 22 bp, Homo sapiens
gctggagttaggtgggcttgaa

SEQ ID NO: 10004559 - DNA, 22 bp, Homo sapiens
gctggagttagaactagcctgg

SEQ ID NO: 10004560 - DNA, 22 bp, Homo sapiens
gctggagtgctggagtgcagtg

SEQ ID NO: 10004561 - DNA, 22 bp, Homo sapiens
gctgagtcttgagcactgagca

SEQ ID NO: 10004562 - DNA, 22 bp, Homo sapiens
gctgaggtttcaggagtggcag

SEQ ID NO: 10004563 - DNA, 22 bp, Homo sapiens
gctgaggtttcaggagtggcag

SEQ ID NO: 10004564 - DNA, 18 bp, Homo sapiens
gctgaggtggtgtcagag

SEQ ID NO: 10004565 - DNA, 22 bp, Homo sapiens
gctgaggtggctgccttagtaa

SEQ ID NO: 10004566 - DNA, 22 bp, Homo sapiens
gctgagggctgtaacagcagag

SEQ ID NO: 10004567 - DNA, 22 bp, Homo sapiens
gctgagggggaaggaaagctga

SEQ ID NO: 10004568 - DNA, 22 bp, Homo sapiens
gctgagggtaacacttcgggat

SEQ ID NO: 10004569 - DNA, 22 bp, Homo sapiens
gctgagggtaacacttcgggat

SEQ ID NO: 10004570 - DNA, 20 bp, Homo sapiens
gctgaggggtctatggcata

SEQ ID NO: 10004571 - DNA, 23 bp, Homo sapiens
gctgaggtacatttacaggaaga

SEQ ID NO: 10004572 - DNA, 23 bp, Homo sapiens
gctgaggtacatttacaggaaga

SEQ ID NO: 10004573 - DNA, 20 bp, Homo sapiens
gctctgtggtttgagtctcc

SEQ ID NO: 10004574 - DNA, 22 bp, Homo sapiens
gctctgtggcattcatgggcag

SEQ ID NO: 10004575 - DNA, 22 bp, Homo sapiens
gctgagtgaggtccagagcttg

SEQ ID NO: 10004576 - DNA, 22 bp, Homo sapiens
gctgagtgattgatattttagt

SEQ ID NO: 10004577 - DNA, 17 bp, Homo sapiens
gctgagtgcagggagtc

SEQ ID NO: 10004578 - DNA, 22 bp, Homo sapiens
gctgagtgtaatgatggcagag

SEQ ID NO: 10004579 - DNA, 22 bp, Homo sapiens
gctgagttgaaagcagaggata

SEQ ID NO: 10004580 - DNA, 22 bp, Homo sapiens
gctgcaggcattttcctgggca

SEQ ID NO: 10004581 - DNA, 22 bp, Homo sapiens
gctgcaggcgcctgcggtctct

SEQ ID NO: 10004582 - DNA, 18 bp, Homo sapiens
gctgcaggcgcctgcggt

SEQ ID NO: 10004583 - DNA, 22 bp, Homo sapiens
gctgcaggcagaatctcccaat

SEQ ID NO: 10004584 - DNA, 22 bp, Homo sapiens
gctgcaggcattttcctgggca

SEQ ID NO: 10004585 - DNA, 23 bp, Homo sapiens
gctgataatgcattctgtttaat

SEQ ID NO: 10004586 - DNA, 22 bp, Homo sapiens
gctgcaggggggtctggacttg

SEQ ID NO: 10004587 - DNA, 22 bp, Homo sapiens
gctgcagggagctggaaggctc

SEQ ID NO: 10004588 - DNA, 22 bp, Homo sapiens
gctgcagggagctggaaggctc

SEQ ID NO: 10004589 - DNA, 22 bp, Homo sapiens
gctgcagggagctggaaggctc

SEQ ID NO: 10004590 - DNA, 21 bp, Homo sapiens
gctgcagggcccagggcaccc

SEQ ID NO: 10004591 - DNA, 22 bp, Homo sapiens
gctgcaggctctgcaggaattg

SEQ ID NO: 10004592 - DNA, 22 bp, Homo sapiens
gctgcaggctgtggcaggggag

SEQ ID NO: 10004593 - DNA, 22 bp, Homo sapiens
gctgcaggcggccgtggtggcg

SEQ ID NO: 10004594 - DNA, 22 bp, Homo sapiens
gctgcaggctgtggcaggggag

SEQ ID NO: 10004595 - DNA, 22 bp, Homo sapiens
gctgcaggctgtggcaggggag

SEQ ID NO: 10004596 - DNA, 22 bp, Homo sapiens
gctgcaggctgtggcaggggag

SEQ ID NO: 10004597 - DNA, 22 bp, Homo sapiens
gctgcaggctgtggcaggggag

SEQ ID NO: 10004598 - DNA, 22 bp, Homo sapiens
gctgcagggagctggaaggctc

SEQ ID NO: 10004599 - DNA, 22 bp, Homo sapiens
gctgcagggaatgtatggattt

SEQ ID NO: 10004600 - DNA, 22 bp, Homo sapiens
gctgcctccgccggctccacag

SEQ ID NO: 10004601 - DNA, 23 bp, Homo sapiens
gctgcctcctacaaaagcccagc

SEQ ID NO: 10004602 - DNA, 22 bp, Homo sapiens
gctgcctcccccatggctggaa

SEQ ID NO: 10004603 - DNA, 22 bp, Homo sapiens
gctgcctccactggctcccagt

SEQ ID NO: 10004604 - DNA, 22 bp, Homo sapiens
gctgcctccaatctgtgccccg

SEQ ID NO: 10004605 - DNA, 22 bp, Homo sapiens
gctgcctccaatctgtgccccg

SEQ ID NO: 10004606 - DNA, 22 bp, Homo sapiens
gctgcctctgcgactctgggcg

SEQ ID NO: 10004607 - DNA, 22 bp, Homo sapiens
gctgcctctgcacagctcactc

SEQ ID NO: 10004608 - DNA, 22 bp, Homo sapiens
gctgcctctcctgagttgacag

SEQ ID NO: 10004609 - DNA, 23 bp, Homo sapiens
gctgcctcctacaaaagcccagc

SEQ ID NO: 10004610 - DNA, 22 bp, Homo sapiens
gctgcctcctgagatttgggca

SEQ ID NO: 10004611 - DNA, 22 bp, Homo sapiens
gctgcctcctgaaagcgctctg

SEQ ID NO: 10004612 - DNA, 22 bp, Homo sapiens
gctgcctcctgagatttgggca

SEQ ID NO: 10004613 - DNA, 22 bp, Homo sapiens
gctcccaggaagagaagggcca

SEQ ID NO: 10004614 - DNA, 22 bp, Homo sapiens
gctcccaggaagagaagggcca

SEQ ID NO: 10004615 - DNA, 22 bp, Homo sapiens
gctcccagcattgctgctgaat

SEQ ID NO: 10004616 - DNA, 22 bp, Homo sapiens
gctcccagcattgctgctgaat

SEQ ID NO: 10004617 - DNA, 22 bp, Homo sapiens
gctcccagcattgcttcccagg

SEQ ID NO: 10004618 - DNA, 22 bp, Homo sapiens
gctcccaggatgaggagccagg

SEQ ID NO: 10004619 - DNA, 20 bp, Homo sapiens
gctccccttctctgggcctc

SEQ ID NO: 10004620 - DNA, 22 bp, Homo sapiens
gctccccattgatctgcaggct

SEQ ID NO: 10004621 - DNA, 22 bp, Homo sapiens
gctccctcccaccagcctgcag

SEQ ID NO: 10004622 - DNA, 22 bp, Homo sapiens
gctctccaggtctcatgcactg

SEQ ID NO: 10004623 - DNA, 22 bp, Homo sapiens
gctctccaggtctcatgcactg

SEQ ID NO: 10004624 - DNA, 22 bp, Homo sapiens
gctctccaggtctcatgcactg

SEQ ID NO: 10004625 - DNA, 19 bp, Homo sapiens
gctctccctctcagttgag

SEQ ID NO: 10004626 - DNA, 22 bp, Homo sapiens
gctctcctgtgcagatgctgct

SEQ ID NO: 10004627 - DNA, 22 bp, Homo sapiens
gctccctctgctcaggcacttg

SEQ ID NO: 10004628 - DNA, 22 bp, Homo sapiens
gctccctctgctcaggcacttg

SEQ ID NO: 10004629 - DNA, 21 bp, Homo sapiens
gctctccagggccagcccagg

SEQ ID NO: 10004630 - DNA, 21 bp, Homo sapiens
gctctccagggccagcccagg

SEQ ID NO: 10004631 - DNA, 22 bp, Homo sapiens
gctctccaggggctcccaggat

SEQ ID NO: 10004632 - DNA, 22 bp, Homo sapiens
gctctccaggggctcccaggat

SEQ ID NO: 10004633 - DNA, 22 bp, Homo sapiens
gctctccaggggctcccaggat

SEQ ID NO: 10004634 - DNA, 22 bp, Homo sapiens
gctctctgaggtgctggcagag

SEQ ID NO: 10004635 - DNA, 22 bp, Homo sapiens
gctctctcttggggattcagca

SEQ ID NO: 10004636 - DNA, 22 bp, Homo sapiens
gctctctcgtgaacaggtggtt

SEQ ID NO: 10004637 - DNA, 22 bp, Homo sapiens
gctctctccctaggcaagtgag

SEQ ID NO: 10004638 - DNA, 22 bp, Homo sapiens
gctctctccctaggcaagtgag

SEQ ID NO: 10004639 - DNA, 22 bp, Homo sapiens
gctctctccctaggcaagtgag

SEQ ID NO: 10004640 - DNA, 21 bp, Homo sapiens
gctctctgcatggtggctcag

SEQ ID NO: 10004641 - DNA, 21 bp, Homo sapiens
gctctctgcatggtggctcag

SEQ ID NO: 10004642 - DNA, 22 bp, Homo sapiens
gctctctgcaagtcagcagcct

SEQ ID NO: 10004643 - DNA, 22 bp, Homo sapiens
gctctctgaggtgctggcagag

SEQ ID NO: 10004644 - DNA, 22 bp, Homo sapiens
gctctgggtagccactgcctgg

SEQ ID NO: 10004645 - DNA, 18 bp, Homo sapiens
gctctggttccttcaacc

SEQ ID NO: 10004646 - DNA, 22 bp, Homo sapiens
gctctgggtagccactgcctgg

SEQ ID NO: 10004647 - DNA, 22 bp, Homo sapiens
gctctgtatgagggtgagagat

SEQ ID NO: 10004648 - DNA, 22 bp, Homo sapiens
gctctctgtcgttatgcttcat

SEQ ID NO: 10004649 - DNA, 22 bp, Homo sapiens
gctctctgtcgttatgcttcat

SEQ ID NO: 10004650 - DNA, 22 bp, Homo sapiens
gctctctgttattaagatcttt

SEQ ID NO: 10004651 - DNA, 22 bp, Homo sapiens
gctctcttgacagcttgctgtt

SEQ ID NO: 10004652 - DNA, 22 bp, Homo sapiens
gctctctgggtgtgtctagata

SEQ ID NO: 10004653 - DNA, 22 bp, Homo sapiens
gctctctgggtggtgggcaaca

SEQ ID NO: 10004654 - DNA, 22 bp, Homo sapiens
gctctctggttccagtcaggaa

SEQ ID NO: 10004655 - DNA, 22 bp, Homo sapiens
gctctctggttccagtcaggaa

SEQ ID NO: 10004656 - DNA, 22 bp, Homo sapiens
gctctctggaggccatggacag

SEQ ID NO: 10004657 - DNA, 22 bp, Homo sapiens
gctctctggctagtccatcggg

SEQ ID NO: 10004658 - DNA, 22 bp, Homo sapiens
gctctctgccatatgaggatac

SEQ ID NO: 10004659 - DNA, 22 bp, Homo sapiens
gctctctgcctttctcaatgac

SEQ ID NO: 10004660 - DNA, 22 bp, Homo sapiens
gctctctggaggccatggacag

SEQ ID NO: 10004661 - DNA, 22 bp, Homo sapiens
gctctctgcctttctcaatgac

SEQ ID NO: 10004662 - DNA, 22 bp, Homo sapiens
gctctctgcctttctcaatgac

SEQ ID NO: 10004663 - DNA, 21 bp, Homo sapiens
gctctgtccctgctgtgtgtc

SEQ ID NO: 10004664 - DNA, 22 bp, Homo sapiens
gctctgtccagcgtgcacagaa

SEQ ID NO: 10004665 - DNA, 20 bp, Homo sapiens
gctctgtctggcctactttt

SEQ ID NO: 10004666 - DNA, 22 bp, Homo sapiens
gctctgtcttcagcacacagta

SEQ ID NO: 10004667 - DNA, 20 bp, Homo sapiens
gctctgtctggcctactttt

SEQ ID NO: 10004668 - DNA, 22 bp, Homo sapiens
gctctgtcattttgcagacact

SEQ ID NO: 10004669 - DNA, 22 bp, Homo sapiens
gctctgtcaacagctagctgtg

SEQ ID NO: 10004670 - DNA, 22 bp, Homo sapiens
gctctgtgaagggtgttgctca

SEQ ID NO: 10004671 - DNA, 22 bp, Homo sapiens
gctctgtgagccacttgatgta

SEQ ID NO: 10004672 - DNA, 22 bp, Homo sapiens
gctctgtggcaggaggtcttgt

SEQ ID NO: 10004673 - DNA, 20 bp, Homo sapiens
gctctgtgctggcggaggct

SEQ ID NO: 10004674 - DNA, 22 bp, Homo sapiens
gctctgtgccagggctgggcca

SEQ ID NO: 10004675 - DNA, 22 bp, Homo sapiens
gctctgtgccacatgcagtgtt

SEQ ID NO: 10004676 - DNA, 22 bp, Homo sapiens
gctcccagatttcagccttgtg

SEQ ID NO: 10004677 - DNA, 22 bp, Homo sapiens
gctcccagatttcagccttgtg

SEQ ID NO: 10004678 - DNA, 22 bp, Homo sapiens
gctcccagcaattgaggcagcc

SEQ ID NO: 10004679 - DNA, 22 bp, Homo sapiens
gctcccagcaattgaggcagcc

SEQ ID NO: 10004680 - DNA, 22 bp, Homo sapiens
gctcccagcaattgaggcagcc

SEQ ID NO: 10004681 - DNA, 22 bp, Homo sapiens
gctcccagactgaccagaggtg

SEQ ID NO: 10004682 - DNA, 23 bp, Homo sapiens
gctcatcaggcttagagtcaagg

SEQ ID NO: 10004683 - DNA, 23 bp, Homo sapiens
gctcatcaggcttagagtcaagg

SEQ ID NO: 10004684 - DNA, 22 bp, Homo sapiens
gctatacacatttcttggtagt

SEQ ID NO: 10004685 - DNA, 22 bp, Homo sapiens
gctatacaagtgtagaatagag

SEQ ID NO: 10004686 - DNA, 19 bp, Homo sapiens
gctaggtgaccagctggat

SEQ ID NO: 10004687 - DNA, 22 bp, Homo sapiens
gctaggttggggaagttctcct

SEQ ID NO: 10004688 - DNA, 22 bp, Homo sapiens
gctaggtgcagcagacagctta

SEQ ID NO: 10004689 - DNA, 23 bp, Homo sapiens
gctaggtgcttccacacgtgctg

SEQ ID NO: 10004690 - DNA, 21 bp, Homo sapiens
gctatacagaatggccagagg

SEQ ID NO: 10004691 - DNA, 20 bp, Homo sapiens
gctcagggcctgggtctgga

SEQ ID NO: 10004692 - DNA, 22 bp, Homo sapiens
gctcagggcctggctgcggact

SEQ ID NO: 10004693 - DNA, 22 bp, Homo sapiens
gctcagggagcgatttaccatg

SEQ ID NO: 10004694 - DNA, 22 bp, Homo sapiens
gcctggagttcagccaagtccc

SEQ ID NO: 10004695 - DNA, 20 bp, Homo sapiens
gcctggcacccggggctggc

SEQ ID NO: 10004696 - DNA, 20 bp, Homo sapiens
gcctggcacccggggctggc

SEQ ID NO: 10004697 - DNA, 22 bp, Homo sapiens
gcctggagtggtcctgctgccc

SEQ ID NO: 10004698 - DNA, 22 bp, Homo sapiens
gctagaaactgtttaatctctt

SEQ ID NO: 10004699 - DNA, 22 bp, Homo sapiens
gcctggcaggcctcatgagggg

SEQ ID NO: 10004700 - DNA, 22 bp, Homo sapiens
gctactttgcagctagctagga

SEQ ID NO: 10004701 - DNA, 22 bp, Homo sapiens
gcctggcactcactgaagaggc

SEQ ID NO: 10004702 - DNA, 22 bp, Homo sapiens
gcctggcactcactgaagaggc

SEQ ID NO: 10004703 - DNA, 22 bp, Homo sapiens
gctagaatattgggtaggcaag

SEQ ID NO: 10004704 - DNA, 22 bp, Homo sapiens
gctagaaatcgacttcagaatt

SEQ ID NO: 10004705 - DNA, 22 bp, Homo sapiens
gctagaaatcgacttcagaatt

SEQ ID NO: 10004706 - DNA, 22 bp, Homo sapiens
gctagcagaaagcaggctgctc

SEQ ID NO: 10004707 - DNA, 22 bp, Homo sapiens
gctagcaaatgtcatttggaag

SEQ ID NO: 10004708 - DNA, 22 bp, Homo sapiens
gctagcaagtggcatagcaggg

SEQ ID NO: 10004709 - DNA, 22 bp, Homo sapiens
gctagcaggttgcatctgtctt

SEQ ID NO: 10004710 - DNA, 22 bp, Homo sapiens
gctagcagagtgcatccttcta

SEQ ID NO: 10004711 - DNA, 22 bp, Homo sapiens
gctagcctgcagtggctatggt

SEQ ID NO: 10004712 - DNA, 22 bp, Homo sapiens
gctagctgggtttcactgtgga

SEQ ID NO: 10004713 - DNA, 20 bp, Homo sapiens
gctaggaaggggaaaaagtg

SEQ ID NO: 10004714 - DNA, 22 bp, Homo sapiens
gctaggaagctggggagaagtc

SEQ ID NO: 10004715 - DNA, 22 bp, Homo sapiens
gctaggaacatttatatacaaa

SEQ ID NO: 10004716 - DNA, 22 bp, Homo sapiens
gctaggaggccctgcacgctta

SEQ ID NO: 10004717 - DNA, 22 bp, Homo sapiens
gctaggagtaaggagaccttca

SEQ ID NO: 10004718 - DNA, 22 bp, Homo sapiens
gctaggctcggaagcagcaggg

SEQ ID NO: 10004719 - DNA, 22 bp, Homo sapiens
gctagggagacttgtgtcatca

SEQ ID NO: 10004720 - DNA, 22 bp, Homo sapiens
gctagggaacctcttctgagga

SEQ ID NO: 10004721 - DNA, 22 bp, Homo sapiens
gctgtatgtgaggccacagtga

SEQ ID NO: 10004722 - DNA, 22 bp, Homo sapiens
gctgtaggtttttccaggagtt

SEQ ID NO: 10004723 - DNA, 22 bp, Homo sapiens
gctgtagtgaatggccgcgttc

SEQ ID NO: 10004724 - DNA, 22 bp, Homo sapiens
gctgtaggtaaggatggcaaag

SEQ ID NO: 10004725 - DNA, 22 bp, Homo sapiens
gctgtagggtgtcatatgaagc

SEQ ID NO: 10004726 - DNA, 22 bp, Homo sapiens
gctgtaggtcatttaatcacct

SEQ ID NO: 10004727 - DNA, 22 bp, Homo sapiens
gctgtaggaagacagaatgcag

SEQ ID NO: 10004728 - DNA, 22 bp, Homo sapiens
gctgtaggaatgacatgtacct

SEQ ID NO: 10004729 - DNA, 22 bp, Homo sapiens
gctgtagggctgagctggaccg

SEQ ID NO: 10004730 - DNA, 22 bp, Homo sapiens
gctgtcacaaatatttctcagc

SEQ ID NO: 10004731 - DNA, 22 bp, Homo sapiens
gctgtcaccaaagcaggcactg

SEQ ID NO: 10004732 - DNA, 22 bp, Homo sapiens
gctgtcacatttggagcactgg

SEQ ID NO: 10004733 - DNA, 22 bp, Homo sapiens
gctgtcaccaaagcaggcactg

SEQ ID NO: 10004734 - DNA, 22 bp, Homo sapiens
gctgtcacatcaaggcactaaa

SEQ ID NO: 10004735 - DNA, 22 bp, Homo sapiens
gctgtcacatttggagcactgg

SEQ ID NO: 10004736 - DNA, 22 bp, Homo sapiens
gctgtcacatcaaggcactaaa

SEQ ID NO: 10004737 - DNA, 22 bp, Homo sapiens
gctgtcacaaattgggttcttt

SEQ ID NO: 10004738 - DNA, 22 bp, Homo sapiens
gctgtcacaaatatttctcagc

SEQ ID NO: 10004739 - DNA, 22 bp, Homo sapiens
gctgtcacaagcatctggggca

SEQ ID NO: 10004740 - DNA, 22 bp, Homo sapiens
gctgtcacaagcatctggggca

SEQ ID NO: 10004741 - DNA, 22 bp, Homo sapiens
gctgtcacacatggccccagct

SEQ ID NO: 10004742 - DNA, 22 bp, Homo sapiens
gctgtcacacatggccccagct

SEQ ID NO: 10004743 - DNA, 22 bp, Homo sapiens
gctgtcacacatggccccagct

SEQ ID NO: 10004744 - DNA, 22 bp, Homo sapiens
gctgtcacacatgggatctcag

SEQ ID NO: 10004745 - DNA, 22 bp, Homo sapiens
gctgtcacacatgggatctcag

SEQ ID NO: 10004746 - DNA, 22 bp, Homo sapiens
gctgtcactctccggccttccc

SEQ ID NO: 10004747 - DNA, 22 bp, Homo sapiens
gctgtcactctccggccttccc

SEQ ID NO: 10004748 - DNA, 22 bp, Homo sapiens
gctgtcactcaccaggcctgca

SEQ ID NO: 10004749 - DNA, 22 bp, Homo sapiens
gctgtcactcaccaggcctgca

SEQ ID NO: 10004750 - DNA, 22 bp, Homo sapiens
gctgtcactggcatgttccggg

SEQ ID NO: 10004751 - DNA, 22 bp, Homo sapiens
gctgtcagaaggtgaagggtaa

SEQ ID NO: 10004752 - DNA, 22 bp, Homo sapiens
gctgtcagcgcccaaggagctc

SEQ ID NO: 10004753 - DNA, 22 bp, Homo sapiens
gctgtcaggaacatgccttggt

SEQ ID NO: 10004754 - DNA, 22 bp, Homo sapiens
gctgtcagcgcccaaggagctc

SEQ ID NO: 10004755 - DNA, 22 bp, Homo sapiens
gctgtcaggccatgtgggcctt

SEQ ID NO: 10004756 - DNA, 22 bp, Homo sapiens
gctgtcaggccatgtgggcctt

SEQ ID NO: 10004757 - DNA, 23 bp, Homo sapiens
gctgtcagttgtttttgtctcta

SEQ ID NO: 10004758 - DNA, 22 bp, Homo sapiens
gctgtcagtgaggtgagacatg

SEQ ID NO: 10004759 - DNA, 22 bp, Homo sapiens
gctgtcagtgaggtgagacatg

SEQ ID NO: 10004760 - DNA, 22 bp, Homo sapiens
gctgtcagtgaggtgagacatg

SEQ ID NO: 10004761 - DNA, 22 bp, Homo sapiens
gctggccacattgtgccgtcct

SEQ ID NO: 10004762 - DNA, 22 bp, Homo sapiens
gctggccacactgctgatggag

SEQ ID NO: 10004763 - DNA, 22 bp, Homo sapiens
gctgtacattctgcacaggccc

SEQ ID NO: 10004764 - DNA, 22 bp, Homo sapiens
gctgtacagtttactaggtggg

SEQ ID NO: 10004765 - DNA, 22 bp, Homo sapiens
gctgtctgtcttcacatctcgc

SEQ ID NO: 10004766 - DNA, 23 bp, Homo sapiens
gctgtctgtcatctctgcgggag

SEQ ID NO: 10004767 - DNA, 22 bp, Homo sapiens
gctgtctgggtgcccaaaagaa

SEQ ID NO: 10004768 - DNA, 22 bp, Homo sapiens
gctgtctggatatcttggaatt

SEQ ID NO: 10004769 - DNA, 22 bp, Homo sapiens
gctgtctgctgtgcactgagca

SEQ ID NO: 10004770 - DNA, 22 bp, Homo sapiens
gctgtctggaggctctgaggga

SEQ ID NO: 10004771 - DNA, 22 bp, Homo sapiens
gctgtgtgctcacgtagtggaa

SEQ ID NO: 10004772 - DNA, 22 bp, Homo sapiens
gctgtgtgctcacgtagtggaa

SEQ ID NO: 10004773 - DNA, 22 bp, Homo sapiens
gctgtgtgctcacgtagtggaa

SEQ ID NO: 10004774 - DNA, 22 bp, Homo sapiens
gctgtgtgctaggatatgtttt

SEQ ID NO: 10004775 - DNA, 22 bp, Homo sapiens
gctgtgtgccaggggaaggctg

SEQ ID NO: 10004776 - DNA, 19 bp, Homo sapiens
gctgtgtgaccttgggcaa

SEQ ID NO: 10004777 - DNA, 22 bp, Homo sapiens
gctgtctgtggtgtcagctgac

SEQ ID NO: 10004778 - DNA, 22 bp, Homo sapiens
gctgtgtgactgagagcctggc

SEQ ID NO: 10004779 - DNA, 22 bp, Homo sapiens
gctgtgtgactgagagcctggc

SEQ ID NO: 10004780 - DNA, 22 bp, Homo sapiens
gctgtgtgactgagagcctggc

SEQ ID NO: 10004781 - DNA, 22 bp, Homo sapiens
gctgtcagttttacccacagac

SEQ ID NO: 10004782 - DNA, 22 bp, Homo sapiens
gctgtccacctccagagcctta

SEQ ID NO: 10004783 - DNA, 22 bp, Homo sapiens
gctgtccagctccagccagcca

SEQ ID NO: 10004784 - DNA, 22 bp, Homo sapiens
gctgtccagagcatgggagcaa

SEQ ID NO: 10004785 - DNA, 22 bp, Homo sapiens
gctgtccaggagtgcagagatt

SEQ ID NO: 10004786 - DNA, 22 bp, Homo sapiens
gctgtccatccacttcccagcg

SEQ ID NO: 10004787 - DNA, 22 bp, Homo sapiens
gctgtccatgtctggcctcagt

SEQ ID NO: 10004788 - DNA, 22 bp, Homo sapiens
gctgtccatgtctggcctcagt

SEQ ID NO: 10004789 - DNA, 22 bp, Homo sapiens
gctgtcccatggttgcaagatg

SEQ ID NO: 10004790 - DNA, 22 bp, Homo sapiens
gctgtcccgaacccctggtaat

SEQ ID NO: 10004791 - DNA, 22 bp, Homo sapiens
gctgtcctggggagggagaatg

SEQ ID NO: 10004792 - DNA, 22 bp, Homo sapiens
gctgtctcatacaaggccctgc

SEQ ID NO: 10004793 - DNA, 22 bp, Homo sapiens
gctttatggattgtaaactgca

SEQ ID NO: 10004794 - DNA, 22 bp, Homo sapiens
gctttatgggccatgcggtgtc

SEQ ID NO: 10004795 - DNA, 22 bp, Homo sapiens
gctttggatgtgtgcctgaggt

SEQ ID NO: 10004796 - DNA, 22 bp, Homo sapiens
gctttatccgcttgacccttac

SEQ ID NO: 10004797 - DNA, 22 bp, Homo sapiens
gctttatgagtgaggcaggata

SEQ ID NO: 10004798 - DNA, 22 bp, Homo sapiens
gctttatgcaaacctggtactt

SEQ ID NO: 10004799 - DNA, 22 bp, Homo sapiens
gctttatgctacgatttctagt

SEQ ID NO: 10004800 - DNA, 22 bp, Homo sapiens
gctttggtcttctagctgtgag

SEQ ID NO: 10004801 - DNA, 22 bp, Homo sapiens
gctttagtttgtcactggcatt

SEQ ID NO: 10004802 - DNA, 22 bp, Homo sapiens
gctttaggaatgaataaaaatc

SEQ ID NO: 10004803 - DNA, 22 bp, Homo sapiens
gctttagagcccagcttggtgg

SEQ ID NO: 10004804 - DNA, 22 bp, Homo sapiens
gctttagatactcccaatgtcc

SEQ ID NO: 10004805 - DNA, 22 bp, Homo sapiens
gctttagatagatttagtcttt

SEQ ID NO: 10004806 - DNA, 22 bp, Homo sapiens
gctttagatctgactttctgtg

SEQ ID NO: 10004807 - DNA, 21 bp, Homo sapiens
gctttagatttagtgagccag

SEQ ID NO: 10004808 - DNA, 22 bp, Homo sapiens
gctttagaaatgagtaaattag

SEQ ID NO: 10004809 - DNA, 22 bp, Homo sapiens
gctttagaaatatcactgtgga

SEQ ID NO: 10004810 - DNA, 22 bp, Homo sapiens
gctttactgtctggaaagtttg

SEQ ID NO: 10004811 - DNA, 22 bp, Homo sapiens
gctttactgagatgacacaggg

SEQ ID NO: 10004812 - DNA, 22 bp, Homo sapiens
gctttagaagacactctgtttt

SEQ ID NO: 10004813 - DNA, 22 bp, Homo sapiens
gctttagacataaagttcttca

SEQ ID NO: 10004814 - DNA, 22 bp, Homo sapiens
gctttagaaatgtaggagatac

SEQ ID NO: 10004815 - DNA, 22 bp, Homo sapiens
gctttagagaagaaaggttgct

SEQ ID NO: 10004816 - DNA, 22 bp, Homo sapiens
gctttagacataaagttcttca

SEQ ID NO: 10004817 - DNA, 22 bp, Homo sapiens
gctttgtgtgaagtccatggcg

SEQ ID NO: 10004818 - DNA, 22 bp, Homo sapiens
gctttgtgtagaaggaggatgg

SEQ ID NO: 10004819 - DNA, 22 bp, Homo sapiens
gctttgtgaattattactcaca

SEQ ID NO: 10004820 - DNA, 22 bp, Homo sapiens
gcttttatgcacataagggtca

SEQ ID NO: 10004821 - DNA, 19 bp, Homo sapiens
gcttttattgctcaggtgc

SEQ ID NO: 10004822 - DNA, 22 bp, Homo sapiens
gcttttattgtctttacgacga

SEQ ID NO: 10004823 - DNA, 22 bp, Homo sapiens
gcttttatttcttcacaaaagt

SEQ ID NO: 10004824 - DNA, 22 bp, Homo sapiens
gcttttcatagataaaattcta

SEQ ID NO: 10004825 - DNA, 22 bp, Homo sapiens
gcttttcctgactttccattag

SEQ ID NO: 10004826 - DNA, 22 bp, Homo sapiens
gcttttcctgactttccattag

SEQ ID NO: 10004827 - DNA, 22 bp, Homo sapiens
gcttttctagctagaacatccg

SEQ ID NO: 10004828 - DNA, 22 bp, Homo sapiens
gcttttctccttagtgtccctg

SEQ ID NO: 10004829 - DNA, 22 bp, Homo sapiens
gcttttgtcatggtgactcagt

SEQ ID NO: 10004830 - DNA, 22 bp, Homo sapiens
gcttttgtcatggtgactcagt

SEQ ID NO: 10004831 - DNA, 22 bp, Homo sapiens
gcttttgtcatggtgactcagt

SEQ ID NO: 10004832 - DNA, 22 bp, Homo sapiens
gcttttgtgagctctcactttg

SEQ ID NO: 10004833 - DNA, 22 bp, Homo sapiens
gcttttgtgagctctcactttg

SEQ ID NO: 10004834 - DNA, 22 bp, Homo sapiens
gcttttgtgagattaagctact

SEQ ID NO: 10004835 - DNA, 22 bp, Homo sapiens
gcttttgttccacagttttgaa

SEQ ID NO: 10004836 - DNA, 22 bp, Homo sapiens
gcttttgttccacagttttgaa

SEQ ID NO: 10004837 - DNA, 22 bp, Homo sapiens
gcttttgtggtgatggagaggc

SEQ ID NO: 10004838 - DNA, 22 bp, Homo sapiens
gcttttgttccacagttttgaa

SEQ ID NO: 10004839 - DNA, 22 bp, Homo sapiens
gcttttgtggctgtcttcattg

SEQ ID NO: 10004840 - DNA, 20 bp, Homo sapiens
gctttttctaatagcagtcc

SEQ ID NO: 10004841 - DNA, 18 bp, Homo sapiens
gctttttagtgcatcttc

SEQ ID NO: 10004842 - DNA, 22 bp, Homo sapiens
gctgtgtgttcaataatgtgat

SEQ ID NO: 10004843 - DNA, 22 bp, Homo sapiens
gctgtgtgttcaataatgtgat

SEQ ID NO: 10004844 - DNA, 22 bp, Homo sapiens
gctgttggggccagcaggtcat

SEQ ID NO: 10004845 - DNA, 22 bp, Homo sapiens
gctgtgtgctgggcatggcact

SEQ ID NO: 10004846 - DNA, 22 bp, Homo sapiens
gctgtgtgctctggtctttctt

SEQ ID NO: 10004847 - DNA, 22 bp, Homo sapiens
gctgtgtgctgggcatggcact

SEQ ID NO: 10004848 - DNA, 22 bp, Homo sapiens
gctgtttctttggcaaactgat

SEQ ID NO: 10004849 - DNA, 22 bp, Homo sapiens
gctgtttctgagtagctaggct

SEQ ID NO: 10004850 - DNA, 22 bp, Homo sapiens
gctgtttccagacaatgtcttt

SEQ ID NO: 10004851 - DNA, 22 bp, Homo sapiens
gctgtttccccttcacagtggc

SEQ ID NO: 10004852 - DNA, 22 bp, Homo sapiens
gcttaaattgtttgtggatagt

SEQ ID NO: 10004853 - DNA, 22 bp, Homo sapiens
gcttaaattgtttgtggatagt

SEQ ID NO: 10004854 - DNA, 22 bp, Homo sapiens
gcttggagtagaatgcattctt

SEQ ID NO: 10004855 - DNA, 22 bp, Homo sapiens
gcttggaagtaggattgggaga

SEQ ID NO: 10004856 - DNA, 22 bp, Homo sapiens
gcttggcacacttggacctgag

SEQ ID NO: 10004857 - DNA, 22 bp, Homo sapiens
gcttggcagggcctgctggagc

SEQ ID NO: 10004858 - DNA, 22 bp, Homo sapiens
gcttggcaggtctgggattgtt

SEQ ID NO: 10004859 - DNA, 22 bp, Homo sapiens
gcttggggtcatgaggctgctg

SEQ ID NO: 10004860 - DNA, 22 bp, Homo sapiens
gcttggggtcatgaggctgctg

SEQ ID NO: 10004861 - DNA, 22 bp, Homo sapiens
gctttaaacctctactctgtcc

SEQ ID NO: 10004862 - DNA, 22 bp, Homo sapiens
gctttaaatggcttgcccaagt

SEQ ID NO: 10004863 - DNA, 22 bp, Homo sapiens
gcttgtttctatttatcaagta

SEQ ID NO: 10004864 - DNA, 22 bp, Homo sapiens
gcttgtttgtgcctctgcagaa

SEQ ID NO: 10004865 - DNA, 22 bp, Homo sapiens
gcttgtttgtgatttctccaga

SEQ ID NO: 10004866 - DNA, 22 bp, Homo sapiens
ggaggaggcggcagaagttcct

SEQ ID NO: 10004867 - DNA, 22 bp, Homo sapiens
ggaggaggggtgactgaatgct

SEQ ID NO: 10004868 - DNA, 22 bp, Homo sapiens
ggaggaggggtgactgaatgct

SEQ ID NO: 10004869 - DNA, 21 bp, Homo sapiens
ggaggaaaaaggaatgacttg

SEQ ID NO: 10004870 - DNA, 22 bp, Homo sapiens
ggagctgttgattgtttgagga

SEQ ID NO: 10004871 - DNA, 22 bp, Homo sapiens
ggagctgttgcgcatgcgctcg

SEQ ID NO: 10004872 - DNA, 22 bp, Homo sapiens
ggagctgtctgtagggcacagg

SEQ ID NO: 10004873 - DNA, 22 bp, Homo sapiens
ggagctgtgcagtgactacaga

SEQ ID NO: 10004874 - DNA, 22 bp, Homo sapiens
ggagctgtgggacgctgtccca

SEQ ID NO: 10004875 - DNA, 22 bp, Homo sapiens
ggagctgtaacgagccattgct

SEQ ID NO: 10004876 - DNA, 22 bp, Homo sapiens
ggagcctggcctggctctgtgt

SEQ ID NO: 10004877 - DNA, 22 bp, Homo sapiens
ggagcctgggcattagtaattt

SEQ ID NO: 10004878 - DNA, 22 bp, Homo sapiens
ggagcctggtatagtgttgcat

SEQ ID NO: 10004879 - DNA, 22 bp, Homo sapiens
ggagctggctacagagaactcc

SEQ ID NO: 10004880 - DNA, 22 bp, Homo sapiens
ggagctgcatttagggagcctt

SEQ ID NO: 10004881 - DNA, 22 bp, Homo sapiens
ggagctgggaccctgtcatctg

SEQ ID NO: 10004882 - DNA, 22 bp, Homo sapiens
ggagaagcagcttcttgatgaa

SEQ ID NO: 10004883 - DNA, 17 bp, Homo sapiens
ggagccaggagcccacc

SEQ ID NO: 10004884 - DNA, 17 bp, Homo sapiens
ggagccaggagcccacc

SEQ ID NO: 10004885 - DNA, 22 bp, Homo sapiens
ggagccagtatttagtggtctt

SEQ ID NO: 10004886 - DNA, 22 bp, Homo sapiens
ggagaagaggagctggaagcct

SEQ ID NO: 10004887 - DNA, 22 bp, Homo sapiens
ggagaagaggagctggaagcct

SEQ ID NO: 10004888 - DNA, 22 bp, Homo sapiens
ggagaaagtacagcaggcaaca

SEQ ID NO: 10004889 - DNA, 22 bp, Homo sapiens
ggagaaagggactgatctgctc

SEQ ID NO: 10004890 - DNA, 22 bp, Homo sapiens
ggagaaagtcagctccaagcag

SEQ ID NO: 10004891 - DNA, 22 bp, Homo sapiens
ggagaaagtacagcaggcaaca

SEQ ID NO: 10004892 - DNA, 22 bp, Homo sapiens
ggagaaaggcatagcagaacct

SEQ ID NO: 10004893 - DNA, 22 bp, Homo sapiens
ggagaaagggactgatctgctc

SEQ ID NO: 10004894 - DNA, 22 bp, Homo sapiens
ggagaaaggcatagcagaacct

SEQ ID NO: 10004895 - DNA, 19 bp, Homo sapiens
ggagcctggagcacgtgcc

SEQ ID NO: 10004896 - DNA, 22 bp, Homo sapiens
ggagcccaggttgtttgtgcag

SEQ ID NO: 10004897 - DNA, 22 bp, Homo sapiens
ggagcccaggttgtttgtgcag

SEQ ID NO: 10004898 - DNA, 22 bp, Homo sapiens
ggagcctggcccggcccttggc

SEQ ID NO: 10004899 - DNA, 23 bp, Homo sapiens
ggagcctggcatatgagacgcat

SEQ ID NO: 10004900 - DNA, 23 bp, Homo sapiens
ggagcctggcatatgagacgcat

SEQ ID NO: 10004901 - DNA, 19 bp, Homo sapiens
ggagcctggcaggggcgtg

SEQ ID NO: 10004902 - DNA, 22 bp, Homo sapiens
ggagcctggcaatgctgcgtcc

SEQ ID NO: 10004903 - DNA, 22 bp, Homo sapiens
ggagcctggcaatgctgcgtcc

SEQ ID NO: 10004904 - DNA, 22 bp, Homo sapiens
ggagcccaagtctgcactcggc

SEQ ID NO: 10004905 - DNA, 18 bp, Homo sapiens
ggagcccagaggacagga

SEQ ID NO: 10004906 - DNA, 18 bp, Homo sapiens
ggagcccacggcgtccca

SEQ ID NO: 10004907 - DNA, 22 bp, Homo sapiens
ggaaggctgtgcagtgtttgca

SEQ ID NO: 10004908 - DNA, 18 bp, Homo sapiens
ggacaggagacatgggtg

SEQ ID NO: 10004909 - DNA, 22 bp, Homo sapiens
ggaagggaaaattcattcggct

SEQ ID NO: 10004910 - DNA, 22 bp, Homo sapiens
ggaaggaggggcaaagcagttc

SEQ ID NO: 10004911 - DNA, 22 bp, Homo sapiens
ggaaggaggggcaaagcagttc

SEQ ID NO: 10004912 - DNA, 22 bp, Homo sapiens
ggaaggaggatgctctggcctt

SEQ ID NO: 10004913 - DNA, 22 bp, Homo sapiens
ggaaggaggatgctctggcctt

SEQ ID NO: 10004914 - DNA, 22 bp, Homo sapiens
ggaaggagcatttgccagttta

SEQ ID NO: 10004915 - DNA, 22 bp, Homo sapiens
ggaaggaggggcaaagcagttc

SEQ ID NO: 10004916 - DNA, 22 bp, Homo sapiens
ggaaaaacagtctttattattt

SEQ ID NO: 10004917 - DNA, 22 bp, Homo sapiens
ggaaaaacagtctttattattt

SEQ ID NO: 10004918 - DNA, 22 bp, Homo sapiens
ggaaaaacagtctttattattt

SEQ ID NO: 10004919 - DNA, 22 bp, Homo sapiens
ggaaggaagtgaccaggatatc

SEQ ID NO: 10004920 - DNA, 22 bp, Homo sapiens
ggaaggaagtgaccaggatatc

SEQ ID NO: 10004921 - DNA, 22 bp, Homo sapiens
ggaaaaatgacacatatctcaa

SEQ ID NO: 10004922 - DNA, 22 bp, Homo sapiens
ggaaaaatgacacatatctcaa

SEQ ID NO: 10004923 - DNA, 22 bp, Homo sapiens
ggaaggaattccaagactaaag

SEQ ID NO: 10004924 - DNA, 22 bp, Homo sapiens
ggaaggaagtgcagactttaaa

SEQ ID NO: 10004925 - DNA, 22 bp, Homo sapiens
ggaaggagcatttgccagttta

SEQ ID NO: 10004926 - DNA, 19 bp, Homo sapiens
ggaaggagagaaatgcatg

SEQ ID NO: 10004927 - DNA, 22 bp, Homo sapiens
ggacaggctgcatctgagcatg

SEQ ID NO: 10004928 - DNA, 22 bp, Homo sapiens
ggacaggccgcctcggtggggg

SEQ ID NO: 10004929 - DNA, 22 bp, Homo sapiens
ggacaggcccggggagcctgga

SEQ ID NO: 10004930 - DNA, 22 bp, Homo sapiens
ggacaggcccggggagcctgga

SEQ ID NO: 10004931 - DNA, 22 bp, Homo sapiens
ggacaggcccggggagcctgga

SEQ ID NO: 10004932 - DNA, 22 bp, Homo sapiens
ggacaggggcgtggggattgtt

SEQ ID NO: 10004933 - DNA, 22 bp, Homo sapiens
ggacaggggcgtggggattgtt

SEQ ID NO: 10004934 - DNA, 22 bp, Homo sapiens
ggacagggctcttggcactcct

SEQ ID NO: 10004935 - DNA, 23 bp, Homo sapiens
ggacagggccctgccctatggcc

SEQ ID NO: 10004936 - DNA, 23 bp, Homo sapiens
ggacagggccctgccctatggcc

SEQ ID NO: 10004937 - DNA, 22 bp, Homo sapiens
ggacagggctcttggcactcct

SEQ ID NO: 10004938 - DNA, 22 bp, Homo sapiens
ggactgggaatcagggagatgc

SEQ ID NO: 10004939 - DNA, 22 bp, Homo sapiens
ggacttgctaaggtggctgaac

SEQ ID NO: 10004940 - DNA, 22 bp, Homo sapiens
ggactggtggctccttgggcag

SEQ ID NO: 10004941 - DNA, 22 bp, Homo sapiens
ggactttagcagctggagagga

SEQ ID NO: 10004942 - DNA, 22 bp, Homo sapiens
ggactttaggtgagaaggcatt

SEQ ID NO: 10004943 - DNA, 22 bp, Homo sapiens
ggactttaggaagggccaagtg

SEQ ID NO: 10004944 - DNA, 22 bp, Homo sapiens
ggagaaagaagacgaacattgt

SEQ ID NO: 10004945 - DNA, 22 bp, Homo sapiens
ggagaaaggataggaatgtgct

SEQ ID NO: 10004946 - DNA, 22 bp, Homo sapiens
ggagaaaggcatagcagaacct

SEQ ID NO: 10004947 - DNA, 22 bp, Homo sapiens
ggagaaagctgtagtggaatgt

SEQ ID NO: 10004948 - DNA, 22 bp, Homo sapiens
ggagaaagctatgtgggggagt

SEQ ID NO: 10004949 - DNA, 22 bp, Homo sapiens
ggagaaagctgtagtggaatgt

SEQ ID NO: 10004950 - DNA, 22 bp, Homo sapiens
ggagaaagctgtagtggaatgt

SEQ ID NO: 10004951 - DNA, 22 bp, Homo sapiens
ggagaaagctatgtgggggagt

SEQ ID NO: 10004952 - DNA, 20 bp, Homo sapiens
gtgcagcacttgggggtagg

SEQ ID NO: 10004953 - DNA, 20 bp, Homo sapiens
gtgcagcacttgggggtagg

SEQ ID NO: 10004954 - DNA, 22 bp, Homo sapiens
gtgcaggaggtaacatagcaaa

SEQ ID NO: 10004955 - DNA, 22 bp, Homo sapiens
gtgcaggagtaggagagggctt

SEQ ID NO: 10004956 - DNA, 22 bp, Homo sapiens
gtgcaggagtaggagagggctt

SEQ ID NO: 10004957 - DNA, 22 bp, Homo sapiens
gtgcaggatgttgggaatcagg

SEQ ID NO: 10004958 - DNA, 22 bp, Homo sapiens
gtgcaggagtaggagagggctt

SEQ ID NO: 10004959 - DNA, 22 bp, Homo sapiens
gtgcagggagcccagaaggtcc

SEQ ID NO: 10004960 - DNA, 22 bp, Homo sapiens
gtgcagggagcccagaaggtcc

SEQ ID NO: 10004961 - DNA, 22 bp, Homo sapiens
gtgcagggagcccagaaggtcc

SEQ ID NO: 10004962 - DNA, 22 bp, Homo sapiens
gtgaggatgcagatgagggcct

SEQ ID NO: 10004963 - DNA, 22 bp, Homo sapiens
gtgaggatacttaagagaacac

SEQ ID NO: 10004964 - DNA, 19 bp, Homo sapiens
gtgaggatactgctcagag

SEQ ID NO: 10004965 - DNA, 22 bp, Homo sapiens
gtgaggagtctgaagcacataa

SEQ ID NO: 10004966 - DNA, 22 bp, Homo sapiens
gtgaggcagcaggagcctctgt

SEQ ID NO: 10004967 - DNA, 22 bp, Homo sapiens
gtgcagcaaagtttgagatata

SEQ ID NO: 10004968 - DNA, 22 bp, Homo sapiens
gtgcagcaaagtttgagatata

SEQ ID NO: 10004969 - DNA, 22 bp, Homo sapiens
gtgcagcaaactagtgcgaggg

SEQ ID NO: 10004970 - DNA, 22 bp, Homo sapiens
gtgcagcaaactagtgcgaggg

SEQ ID NO: 10004971 - DNA, 22 bp, Homo sapiens
gtgccagcagttatggtgattt

SEQ ID NO: 10004972 - DNA, 22 bp, Homo sapiens
gtgcaggggcctccccttgctg

SEQ ID NO: 10004973 - DNA, 22 bp, Homo sapiens
gtgcaggggatcaggttgcagc

SEQ ID NO: 10004974 - DNA, 22 bp, Homo sapiens
gtgcagggctggcaccggaggc

SEQ ID NO: 10004975 - DNA, 22 bp, Homo sapiens
gtgcagggctggcaccggaggc

SEQ ID NO: 10004976 - DNA, 22 bp, Homo sapiens
gtgcagggcagccgaatgggct

SEQ ID NO: 10004977 - DNA, 22 bp, Homo sapiens
gtgcagggcaggtgtccttcca

SEQ ID NO: 10004978 - DNA, 22 bp, Homo sapiens
gtgcagggccctcctaacatct

SEQ ID NO: 10004979 - DNA, 17 bp, Homo sapiens
gtgcagggatgaaggat

SEQ ID NO: 10004980 - DNA, 17 bp, Homo sapiens
gtgcagggatgaaggat

SEQ ID NO: 10004981 - DNA, 22 bp, Homo sapiens
gtgcagggcagccgaatgggct

SEQ ID NO: 10004982 - DNA, 22 bp, Homo sapiens
gtgcagggcagccgaatgggct

SEQ ID NO: 10004983 - DNA, 18 bp, Homo sapiens
gtgccaggaggcgcagcc

SEQ ID NO: 10004984 - DNA, 18 bp, Homo sapiens
gtgccaggaggcgcagcc

SEQ ID NO: 10004985 - DNA, 20 bp, Homo sapiens
gtgccaggcaagacaggtgg

SEQ ID NO: 10004986 - DNA, 22 bp, Homo sapiens
gtgccaggcccagggagcgggg

SEQ ID NO: 10004987 - DNA, 22 bp, Homo sapiens
gtgccaggcccagggagcgggg

SEQ ID NO: 10004988 - DNA, 22 bp, Homo sapiens
gtgccagggagtggaggagctt

SEQ ID NO: 10004989 - DNA, 22 bp, Homo sapiens
gtgccagggagtggaggagctt

SEQ ID NO: 10004990 - DNA, 22 bp, Homo sapiens
gtgccagggggcactgaacaga

SEQ ID NO: 10004991 - DNA, 22 bp, Homo sapiens
gtgccagggggcactgaacaga

SEQ ID NO: 10004992 - DNA, 22 bp, Homo sapiens
gtgccagggggcactgaacaga

SEQ ID NO: 10004993 - DNA, 22 bp, Homo sapiens
gtgccagggggcactgaacaga

SEQ ID NO: 10004994 - DNA, 22 bp, Homo sapiens
gtgccaggtgctaagctgtgct

SEQ ID NO: 10004995 - DNA, 22 bp, Homo sapiens
gtgccaggtgctaagctgtgct

SEQ ID NO: 10004996 - DNA, 22 bp, Homo sapiens
gtgcccagcagcagcgtccccg

SEQ ID NO: 10004997 - DNA, 22 bp, Homo sapiens
gtgcccagctccacctcacaga

SEQ ID NO: 10004998 - DNA, 20 bp, Homo sapiens
gtgctgagtgaaatgagatt

SEQ ID NO: 10004999 - DNA, 22 bp, Homo sapiens
gtgcccaggcccaaggcaccac

SEQ ID NO: 10005000 - DNA, 22 bp, Homo sapiens
gtgctgaataacagtagaaatt

SEQ ID NO: 10005001 - DNA, 22 bp, Homo sapiens
gtgctgaatccactcttaggaa

SEQ ID NO: 10005002 - DNA, 18 bp, Homo sapiens
gtgctgaataactacttt

SEQ ID NO: 10005003 - DNA, 22 bp, Homo sapiens
gtgctgacaggagcctggcggt

SEQ ID NO: 10005004 - DNA, 22 bp, Homo sapiens
gtgctgaattggagatgctcct

SEQ ID NO: 10005005 - DNA, 22 bp, Homo sapiens
gtgctgaattgtgctctttaca

SEQ ID NO: 10005006 - DNA, 22 bp, Homo sapiens
gtgctgaatttgagaaactctg

SEQ ID NO: 10005007 - DNA, 20 bp, Homo sapiens
gtgctggagttaggaaaggt

SEQ ID NO: 10005008 - DNA, 20 bp, Homo sapiens
gtgctggagttaggaaaggt

SEQ ID NO: 10005009 - DNA, 22 bp, Homo sapiens
gtgctggaactgtgctaagaga

SEQ ID NO: 10005010 - DNA, 22 bp, Homo sapiens
gtgctggaccctggaaggtggt

SEQ ID NO: 10005011 - DNA, 22 bp, Homo sapiens
gtgctggaactgtgctaagaga

SEQ ID NO: 10005012 - DNA, 22 bp, Homo sapiens
gtgctgctcaagggacaggaca

SEQ ID NO: 10005013 - DNA, 22 bp, Homo sapiens
gtctttagttgaaacatgtggt

SEQ ID NO: 10005014 - DNA, 20 bp, Homo sapiens
gtctttatgttttatgacct

SEQ ID NO: 10005015 - DNA, 20 bp, Homo sapiens
gtctttatgttttatgacct

SEQ ID NO: 10005016 - DNA, 22 bp, Homo sapiens
gtctttaagggactgaatttgg

SEQ ID NO: 10005017 - DNA, 22 bp, Homo sapiens
gtcttgtcagtgttggcagctt

SEQ ID NO: 10005018 - DNA, 22 bp, Homo sapiens
gtcttgtttgggatgtggatgg

SEQ ID NO: 10005019 - DNA, 22 bp, Homo sapiens
gtcttgttggagttcttgcagc

SEQ ID NO: 10005020 - DNA, 22 bp, Homo sapiens
gtcttgtcccagctctgccact

SEQ ID NO: 10005021 - DNA, 22 bp, Homo sapiens
gtcttgttaagattttggaata

SEQ ID NO: 10005022 - DNA, 22 bp, Homo sapiens
gtctcccaatccgggacagcct

SEQ ID NO: 10005023 - DNA, 21 bp, Homo sapiens
gtcttggcaccaggagagaga

SEQ ID NO: 10005024 - DNA, 22 bp, Homo sapiens
gtcttggccgtgcagatgaaga

SEQ ID NO: 10005025 - DNA, 19 bp, Homo sapiens
gtcttggctctcaaccatc

SEQ ID NO: 10005026 - DNA, 22 bp, Homo sapiens
gtctatgtaaacgtctacatta

SEQ ID NO: 10005027 - DNA, 22 bp, Homo sapiens
gtctatgatattttgttatagc

SEQ ID NO: 10005028 - DNA, 22 bp, Homo sapiens
gtctagagtgcttcctagtcat

SEQ ID NO: 10005029 - DNA, 22 bp, Homo sapiens
gtctagagcctgatgaggatga

SEQ ID NO: 10005030 - DNA, 22 bp, Homo sapiens
gtctagcacatcatctcactgc

SEQ ID NO: 10005031 - DNA, 22 bp, Homo sapiens
gtctagcaatgatgatgagcta

SEQ ID NO: 10005032 - DNA, 22 bp, Homo sapiens
gtctagggctcctcagtgacaa

SEQ ID NO: 10005033 - DNA, 22 bp, Homo sapiens
gtctatgtaaacgtctacatta

SEQ ID NO: 10005034 - DNA, 22 bp, Homo sapiens
gtctatgtgtaatagcatgtgt

SEQ ID NO: 10005035 - DNA, 22 bp, Homo sapiens
gtctccagcccactctagatat

SEQ ID NO: 10005036 - DNA, 19 bp, Homo sapiens
gtctagaccaggctcctta

SEQ ID NO: 10005037 - DNA, 22 bp, Homo sapiens
gtctagaattgcttggcagatg

SEQ ID NO: 10005038 - DNA, 22 bp, Homo sapiens
gtctagaattgcttggcagatg

SEQ ID NO: 10005039 - DNA, 19 bp, Homo sapiens
gtctagaccaggctcctta

SEQ ID NO: 10005040 - DNA, 22 bp, Homo sapiens
gtctagaattgcttggcagatg

SEQ ID NO: 10005041 - DNA, 19 bp, Homo sapiens
gtctagaacattgtaggtg

SEQ ID NO: 10005042 - DNA, 19 bp, Homo sapiens
gtctagaacattgtaggtg

SEQ ID NO: 10005043 - DNA, 22 bp, Homo sapiens
gtctagaatatctagaaagatc

SEQ ID NO: 10005044 - DNA, 22 bp, Homo sapiens
gtctagaatggatgagcatttt

SEQ ID NO: 10005045 - DNA, 22 bp, Homo sapiens
gtctagaaatgttctcaggggt

SEQ ID NO: 10005046 - DNA, 22 bp, Homo sapiens
gtctagaaataggtttcagaaa

SEQ ID NO: 10005047 - DNA, 22 bp, Homo sapiens
gtctagaaatcatgtactgtga

SEQ ID NO: 10005048 - DNA, 22 bp, Homo sapiens
gtctagaaatgccatacgtgcc

SEQ ID NO: 10005049 - DNA, 22 bp, Homo sapiens
gtctagaaatcatgtactgtga

SEQ ID NO: 10005050 - DNA, 22 bp, Homo sapiens
gtctagaaataggtttcagaaa

SEQ ID NO: 10005051 - DNA, 22 bp, Homo sapiens
gtctagaaaatgccgagggatg

SEQ ID NO: 10005052 - DNA, 22 bp, Homo sapiens
gtctaaggatctgttagctttt

SEQ ID NO: 10005053 - DNA, 22 bp, Homo sapiens
gtctaaagcccttagaatagta

SEQ ID NO: 10005054 - DNA, 22 bp, Homo sapiens
gtctacactgaatttccacaga

SEQ ID NO: 10005055 - DNA, 22 bp, Homo sapiens
gtctacactgaatttccacaga

SEQ ID NO: 10005056 - DNA, 20 bp, Homo sapiens
gtctacacgggcagtgtaga

SEQ ID NO: 10005057 - DNA, 20 bp, Homo sapiens
gtctacacgggcagtgtaga

SEQ ID NO: 10005058 - DNA, 22 bp, Homo sapiens
gtctacaaagcttcaagtctct

SEQ ID NO: 10005059 - DNA, 22 bp, Homo sapiens
gtctacaaagcatataaaagag

SEQ ID NO: 10005060 - DNA, 22 bp, Homo sapiens
gtgagcagtttgttccagaatc

SEQ ID NO: 10005061 - DNA, 22 bp, Homo sapiens
gtgagcagttgtataaagactt

SEQ ID NO: 10005062 - DNA, 22 bp, Homo sapiens
gtgagcagttgtataaagactt

SEQ ID NO: 10005063 - DNA, 22 bp, Homo sapiens
gtgagctggaatagtggagaaa

SEQ ID NO: 10005064 - DNA, 22 bp, Homo sapiens
gtgagctgggtgaatggtaggg

SEQ ID NO: 10005065 - DNA, 22 bp, Homo sapiens
gtgagcgtggtcttctgtgggt

SEQ ID NO: 10005066 - DNA, 22 bp, Homo sapiens
gtgagctgttttggacccatct

SEQ ID NO: 10005067 - DNA, 22 bp, Homo sapiens
gtgagctttgtggtaatgaagt

SEQ ID NO: 10005068 - DNA, 22 bp, Homo sapiens
gtgagcttctgcctctcagtcc

SEQ ID NO: 10005069 - DNA, 22 bp, Homo sapiens
gtgaggactggtaaggactgca

SEQ ID NO: 10005070 - DNA, 22 bp, Homo sapiens
gtgaggactagtgggtttgtgc

SEQ ID NO: 10005071 - DNA, 22 bp, Homo sapiens
gtgaggactggtaaggactgca

SEQ ID NO: 10005072 - DNA, 22 bp, Homo sapiens
gtgaggagggctggtcccaggc

SEQ ID NO: 10005073 - DNA, 22 bp, Homo sapiens
gtgaggagggctggtcccaggc

SEQ ID NO: 10005074 - DNA, 22 bp, Homo sapiens
gtgaggagctgacactggggtg

SEQ ID NO: 10005075 - DNA, 22 bp, Homo sapiens
gtgaggagctgacactggggtg

SEQ ID NO: 10005076 - DNA, 22 bp, Homo sapiens
gtgaggagctgacactggggtg

SEQ ID NO: 10005077 - DNA, 22 bp, Homo sapiens
gtgaggagctctttgactcacg

SEQ ID NO: 10005078 - DNA, 22 bp, Homo sapiens
gtgaggagctgacactggggtg

SEQ ID NO: 10005079 - DNA, 18 bp, Homo sapiens
gtcttttctcccttcctc

SEQ ID NO: 10005080 - DNA, 21 bp, Homo sapiens
gtctttttaattgcgatttcc

SEQ ID NO: 10005081 - DNA, 22 bp, Homo sapiens
gtcttttttacaccttacatca

SEQ ID NO: 10005082 - DNA, 22 bp, Homo sapiens
gtgaaaaatcatcatgacttga

SEQ ID NO: 10005083 - DNA, 22 bp, Homo sapiens
gtgaaaaatgatttgttaactg

SEQ ID NO: 10005084 - DNA, 22 bp, Homo sapiens
gtgaaaaatgatttgttaactg

SEQ ID NO: 10005085 - DNA, 22 bp, Homo sapiens
gtcttttttacaccttacatca

SEQ ID NO: 10005086 - DNA, 22 bp, Homo sapiens
gtctttttgtctggcagaggtc

SEQ ID NO: 10005087 - DNA, 22 bp, Homo sapiens
gtcttttttacaccttacatca

SEQ ID NO: 10005088 - DNA, 22 bp, Homo sapiens
gtctttttctacgatagcgcct

SEQ ID NO: 10005089 - DNA, 22 bp, Homo sapiens
gtctttttattatagagtggag

SEQ ID NO: 10005090 - DNA, 22 bp, Homo sapiens
gtccaggctgcccagggtcctg

SEQ ID NO: 10005091 - DNA, 22 bp, Homo sapiens
gtccaggcctgcctctgaggag

SEQ ID NO: 10005092 - DNA, 22 bp, Homo sapiens
gtccaggctaagtcccttctgc

SEQ ID NO: 10005093 - DNA, 22 bp, Homo sapiens
gtccaggccatggtggacacag

SEQ ID NO: 10005094 - DNA, 20 bp, Homo sapiens
gtccaggacccagcaggagg

SEQ ID NO: 10005095 - DNA, 22 bp, Homo sapiens
gtccaggaatcaaaagatggaa

SEQ ID NO: 10005096 - DNA, 22 bp, Homo sapiens
gtcctgcttgttaggcctagtc

SEQ ID NO: 10005097 - DNA, 22 bp, Homo sapiens
gtcctctggtgaaagcattccc

SEQ ID NO: 10005098 - DNA, 22 bp, Homo sapiens
gtcgtggagctcacagtgtgcc

SEQ ID NO: 10005099 - DNA, 22 bp, Homo sapiens
gtcagaagcatttgtggctgaa

SEQ ID NO: 10005100 - DNA, 22 bp, Homo sapiens
gtcacttttaagggccttttct

SEQ ID NO: 10005101 - DNA, 22 bp, Homo sapiens
gtcactttacactcctactaaa

SEQ ID NO: 10005102 - DNA, 22 bp, Homo sapiens
gtcactttacactcctactaaa

SEQ ID NO: 10005103 - DNA, 22 bp, Homo sapiens
gtcactttattaattttggtga

SEQ ID NO: 10005104 - DNA, 22 bp, Homo sapiens
gtcactttcacactttattgct

SEQ ID NO: 10005105 - DNA, 22 bp, Homo sapiens
gtcactttgaagctgtttttag

SEQ ID NO: 10005106 - DNA, 22 bp, Homo sapiens
gtcactgtttcctattatattt

SEQ ID NO: 10005107 - DNA, 22 bp, Homo sapiens
gtcactgtatccaggttccagc

SEQ ID NO: 10005108 - DNA, 17 bp, Homo sapiens
gtcactgtctaatgaag

SEQ ID NO: 10005109 - DNA, 22 bp, Homo sapiens
gtcactgtatccaggttccagc

SEQ ID NO: 10005110 - DNA, 18 bp, Homo sapiens
gtcacctggatcagatta

SEQ ID NO: 10005111 - DNA, 22 bp, Homo sapiens
gtcaccctgctggctgttcagc

SEQ ID NO: 10005112 - DNA, 22 bp, Homo sapiens
gtcagaggaggctgagtaggaa

SEQ ID NO: 10005113 - DNA, 22 bp, Homo sapiens
gtccagagaagggaggggactc

SEQ ID NO: 10005114 - DNA, 22 bp, Homo sapiens
gtcagaggaatggatgagtgat

SEQ ID NO: 10005115 - DNA, 20 bp, Homo sapiens
gtcagaggaccctagagcga

SEQ ID NO: 10005116 - DNA, 22 bp, Homo sapiens
gtcagagacaaacttcctctct

SEQ ID NO: 10005117 - DNA, 22 bp, Homo sapiens
gtccagcccgggctccgccagc

SEQ ID NO: 10005118 - DNA, 22 bp, Homo sapiens
gtccagccctctgcctccaggt

SEQ ID NO: 10005119 - DNA, 22 bp, Homo sapiens
gtccagcccctgactcccaggc

SEQ ID NO: 10005120 - DNA, 22 bp, Homo sapiens
gtaggaattttgtgagctttcc

SEQ ID NO: 10005121 - DNA, 22 bp, Homo sapiens
gtaggaagctctgaggctagtt

SEQ ID NO: 10005122 - DNA, 22 bp, Homo sapiens
gtaggagcattgagggtatgga

SEQ ID NO: 10005123 - DNA, 22 bp, Homo sapiens
gtacaattcctgtcaagctggc

SEQ ID NO: 10005124 - DNA, 22 bp, Homo sapiens
gtagggttggagagcacaacca

SEQ ID NO: 10005125 - DNA, 22 bp, Homo sapiens
gtagggctcagtaaatactttg

SEQ ID NO: 10005126 - DNA, 22 bp, Homo sapiens
gtaggtcagacataagaggaca

SEQ ID NO: 10005127 - DNA, 22 bp, Homo sapiens
gtaggtcagacataagaggaca

SEQ ID NO: 10005128 - DNA, 22 bp, Homo sapiens
gtagtaaagcaggttttgctgt

SEQ ID NO: 10005129 - DNA, 22 bp, Homo sapiens
gtagtacagtgagacaatgttt

SEQ ID NO: 10005130 - DNA, 22 bp, Homo sapiens
gtagtaatagtacattagaatg

SEQ ID NO: 10005131 - DNA, 22 bp, Homo sapiens
gtagtcccagctaccccggagg

SEQ ID NO: 10005132 - DNA, 22 bp, Homo sapiens
gtagtctgaacagtaattttgt

SEQ ID NO: 10005133 - DNA, 22 bp, Homo sapiens
gtagtcttggattttaaaaagt

SEQ ID NO: 10005134 - DNA, 22 bp, Homo sapiens
gtagtgcgcatggcctgtttgt

SEQ ID NO: 10005135 - DNA, 22 bp, Homo sapiens
gtagtggagtctcctgtcctgg

SEQ ID NO: 10005136 - DNA, 22 bp, Homo sapiens
gtacaaattgatacaggttttc

SEQ ID NO: 10005137 - DNA, 22 bp, Homo sapiens
gtacaaattttgacatctagga

SEQ ID NO: 10005138 - DNA, 19 bp, Homo sapiens
gtacaacaatgctgagcat

SEQ ID NO: 10005139 - DNA, 22 bp, Homo sapiens
gtacaacaggattgatgtacca

SEQ ID NO: 10005140 - DNA, 22 bp, Homo sapiens
gtacaacaggattgatgtacca

SEQ ID NO: 10005141 - DNA, 22 bp, Homo sapiens
gtacaaattgatacagatttga

SEQ ID NO: 10005142 - DNA, 22 bp, Homo sapiens
gtacaaattgatacagatttga

SEQ ID NO: 10005143 - DNA, 22 bp, Homo sapiens
gtacaagtgtatttggcttgat

SEQ ID NO: 10005144 - DNA, 22 bp, Homo sapiens
gtacaagttctactctataaat

SEQ ID NO: 10005145 - DNA, 22 bp, Homo sapiens
gtacaacatgattttactctct

SEQ ID NO: 10005146 - DNA, 22 bp, Homo sapiens
gtacaacatgattttactctct

SEQ ID NO: 10005147 - DNA, 19 bp, Homo sapiens
gtacaagaatgactgagca

SEQ ID NO: 10005148 - DNA, 22 bp, Homo sapiens
gtacaagaggagaaaatggagt

SEQ ID NO: 10005149 - DNA, 21 bp, Homo sapiens
gtacaagctcaccaagtggac

SEQ ID NO: 10005150 - DNA, 22 bp, Homo sapiens
gtacaaatgagagttctgtttt

SEQ ID NO: 10005151 - DNA, 22 bp, Homo sapiens
gtacaaatgcaggtttgttaca

SEQ ID NO: 10005152 - DNA, 22 bp, Homo sapiens
gtacaaatgagagttctgtttt

SEQ ID NO: 10005153 - DNA, 22 bp, Homo sapiens
gtacaaatgagagttctgtttt

SEQ ID NO: 10005154 - DNA, 22 bp, Homo sapiens
gtacaaatgcaggtttgttaca

SEQ ID NO: 10005155 - DNA, 22 bp, Homo sapiens
gtacaaatgtacacttgtataa

SEQ ID NO: 10005156 - DNA, 22 bp, Homo sapiens
gtacaaatgcaggtttgttaca

SEQ ID NO: 10005157 - DNA, 22 bp, Homo sapiens
gtacaaatgtacacttgtataa

SEQ ID NO: 10005158 - DNA, 22 bp, Homo sapiens
gtacaaattaggaagctttgtg

SEQ ID NO: 10005159 - DNA, 22 bp, Homo sapiens
gtacaaatgtacacttgtataa

SEQ ID NO: 10005160 - DNA, 22 bp, Homo sapiens
gtacaaaagttattgcggtttt

SEQ ID NO: 10005161 - DNA, 22 bp, Homo sapiens
gtacaaaagttattgcggtttt

SEQ ID NO: 10005162 - DNA, 22 bp, Homo sapiens
gtacaaaagttattgcggtttt

SEQ ID NO: 10005163 - DNA, 22 bp, Homo sapiens
gtagttttctgaaaattacttt

SEQ ID NO: 10005164 - DNA, 22 bp, Homo sapiens
gtagttttctgaaaattacttt

SEQ ID NO: 10005165 - DNA, 22 bp, Homo sapiens
gtagttttctgaaaattacttt

SEQ ID NO: 10005166 - DNA, 22 bp, Homo sapiens
gtagtgctttcatctggagtgt

SEQ ID NO: 10005167 - DNA, 22 bp, Homo sapiens
gtagtgtgtaggcactgtgctc

SEQ ID NO: 10005168 - DNA, 22 bp, Homo sapiens
gtataaaggcacaggttttctg

SEQ ID NO: 10005169 - DNA, 22 bp, Homo sapiens
gtatacactgtctcctctaggt

SEQ ID NO: 10005170 - DNA, 22 bp, Homo sapiens
gtatacaatacacaatgctctg

SEQ ID NO: 10005171 - DNA, 22 bp, Homo sapiens
gtatacaatacacaatgctctg

SEQ ID NO: 10005172 - DNA, 22 bp, Homo sapiens
gtatacaactattgttgggtaa

SEQ ID NO: 10005173 - DNA, 22 bp, Homo sapiens
gtatttttaggtaaggaaagta

SEQ ID NO: 10005174 - DNA, 22 bp, Homo sapiens
gtatttcctcgcttgtgggatt

SEQ ID NO: 10005175 - DNA, 22 bp, Homo sapiens
gtatttcctatagtgagggcct

SEQ ID NO: 10005176 - DNA, 22 bp, Homo sapiens
gtatttcctatagtgagggcct

SEQ ID NO: 10005177 - DNA, 22 bp, Homo sapiens
gtattttatggcatgcagtggc

SEQ ID NO: 10005178 - DNA, 22 bp, Homo sapiens
gtatttccctgagttctgtgag

SEQ ID NO: 10005179 - DNA, 22 bp, Homo sapiens
gtatttcccccagactccctgg

SEQ ID NO: 10005180 - DNA, 21 bp, Homo sapiens
gtcaaacttgcaccagtgccc

SEQ ID NO: 10005181 - DNA, 22 bp, Homo sapiens
gtcaaacaaattaacatatcca

SEQ ID NO: 10005182 - DNA, 22 bp, Homo sapiens
gtcacccactccctgctgctgt

SEQ ID NO: 10005183 - DNA, 22 bp, Homo sapiens
gtcaaatatactaagaggtaaa

SEQ ID NO: 10005184 - DNA, 22 bp, Homo sapiens
gtcaaataattttctcaatagt

SEQ ID NO: 10005185 - DNA, 22 bp, Homo sapiens
gtcaaatatatgcaaaactatt

SEQ ID NO: 10005186 - DNA, 22 bp, Homo sapiens
gtatttttcattccaagtgaga

SEQ ID NO: 10005187 - DNA, 22 bp, Homo sapiens
gtcaaaaagtagtcatttctgt

SEQ ID NO: 10005188 - DNA, 22 bp, Homo sapiens
gtcaaaacaaagttaagaattc

SEQ ID NO: 10005189 - DNA, 22 bp, Homo sapiens
gtaatttaattctctgacttga

SEQ ID NO: 10005190 - DNA, 22 bp, Homo sapiens
ggtttaaaagccatgcatgggg

SEQ ID NO: 10005191 - DNA, 21 bp, Homo sapiens
ggttggtgtgtccagtggcca

SEQ ID NO: 10005192 - DNA, 21 bp, Homo sapiens
ggttggtgtgtccagtggcca

SEQ ID NO: 10005193 - DNA, 22 bp, Homo sapiens
ggttcagggctaccagtgggtg

SEQ ID NO: 10005194 - DNA, 22 bp, Homo sapiens
ggttcagggatgtgggtgatgc

SEQ ID NO: 10005195 - DNA, 19 bp, Homo sapiens
ggttggagaagagcggccc

SEQ ID NO: 10005196 - DNA, 22 bp, Homo sapiens
ggttccacctggcgaggggtat

SEQ ID NO: 10005197 - DNA, 22 bp, Homo sapiens
ggttcattctgaagtcttcagc

SEQ ID NO: 10005198 - DNA, 22 bp, Homo sapiens
ggttggggcgagctggaggccc

SEQ ID NO: 10005199 - DNA, 22 bp, Homo sapiens
ggttggggcgagctggaggccc

SEQ ID NO: 10005200 - DNA, 22 bp, Homo sapiens
ggttggggcgagctggaggccc

SEQ ID NO: 10005201 - DNA, 22 bp, Homo sapiens
ggttcacaggtcctgggagcag

SEQ ID NO: 10005202 - DNA, 22 bp, Homo sapiens
ggttattttggttgtctaaggc

SEQ ID NO: 10005203 - DNA, 22 bp, Homo sapiens
ggttagagggcatgcgatcttt

SEQ ID NO: 10005204 - DNA, 22 bp, Homo sapiens
ggttacatggaagaaatataat

SEQ ID NO: 10005205 - DNA, 19 bp, Homo sapiens
ggttaccagtgtgtctggc

SEQ ID NO: 10005206 - DNA, 22 bp, Homo sapiens
ggtggtggagccagctgggagt

SEQ ID NO: 10005207 - DNA, 22 bp, Homo sapiens
ggtggtggagccagctgggagt

SEQ ID NO: 10005208 - DNA, 22 bp, Homo sapiens
ggttaaggctttacagtcaaac

SEQ ID NO: 10005209 - DNA, 22 bp, Homo sapiens
ggtgggtgagccctgggagctg

SEQ ID NO: 10005210 - DNA, 22 bp, Homo sapiens
ggtggggcctgctccagcggcc

SEQ ID NO: 10005211 - DNA, 22 bp, Homo sapiens
ggtggggattcctgatcactgt

SEQ ID NO: 10005212 - DNA, 22 bp, Homo sapiens
ggtggggagtcaggcattcttg

SEQ ID NO: 10005213 - DNA, 22 bp, Homo sapiens
ggtgggcaggtcactctgcctc

SEQ ID NO: 10005214 - DNA, 22 bp, Homo sapiens
ggtgggccaggaaggccgccag

SEQ ID NO: 10005215 - DNA, 22 bp, Homo sapiens
ggtggagagctggatgagaggt

SEQ ID NO: 10005216 - DNA, 22 bp, Homo sapiens
ggtggactgtgttggagttgac

SEQ ID NO: 10005217 - DNA, 22 bp, Homo sapiens
ggtggacagtgttagctctggg

SEQ ID NO: 10005218 - DNA, 22 bp, Homo sapiens
ggtggcacactggggagctcgg

SEQ ID NO: 10005219 - DNA, 22 bp, Homo sapiens
ggtggcagaataattgaaggtc

SEQ ID NO: 10005220 - DNA, 22 bp, Homo sapiens
ggtggcactcattatcaggtgc

SEQ ID NO: 10005221 - DNA, 19 bp, Homo sapiens
ggtggcagaacgtgggtcc

SEQ ID NO: 10005222 - DNA, 22 bp, Homo sapiens
ggtggcagagacataggacata

SEQ ID NO: 10005223 - DNA, 22 bp, Homo sapiens
ggtggcagagacataggacata

SEQ ID NO: 10005224 - DNA, 22 bp, Homo sapiens
ggtgggcaggcgaggcccaggt

SEQ ID NO: 10005225 - DNA, 22 bp, Homo sapiens
ggtcccagctggtcactgtcag

SEQ ID NO: 10005226 - DNA, 22 bp, Homo sapiens
ggtcccagctggtcactgtcag

SEQ ID NO: 10005227 - DNA, 22 bp, Homo sapiens
ggtcccaggagaataggtgcaa

SEQ ID NO: 10005228 - DNA, 22 bp, Homo sapiens
ggtcccaggctccctcttgtcc

SEQ ID NO: 10005229 - DNA, 22 bp, Homo sapiens
ggtcccaggattggttgcgcag

SEQ ID NO: 10005230 - DNA, 22 bp, Homo sapiens
ggtcccaggaagtgcggcggcg

SEQ ID NO: 10005231 - DNA, 22 bp, Homo sapiens
ggtcccaggaagtgcggcggcg

SEQ ID NO: 10005232 - DNA, 22 bp, Homo sapiens
ggtcccaggaatctgtgttcta

SEQ ID NO: 10005233 - DNA, 22 bp, Homo sapiens
ggtcccagctgctcaagaggct

SEQ ID NO: 10005234 - DNA, 22 bp, Homo sapiens
gggttggggcccagcagtctgc

SEQ ID NO: 10005235 - DNA, 22 bp, Homo sapiens
gggttggggcccagcagtctgc

SEQ ID NO: 10005236 - DNA, 22 bp, Homo sapiens
gggttttatggttcacttgcaa

SEQ ID NO: 10005237 - DNA, 22 bp, Homo sapiens
gggtgtcctgtgccaagctggg

SEQ ID NO: 10005238 - DNA, 22 bp, Homo sapiens
gggttggatcctggtggctgcc

SEQ ID NO: 10005239 - DNA, 22 bp, Homo sapiens
gggttggattacttagggagaa

SEQ ID NO: 10005240 - DNA, 22 bp, Homo sapiens
ggtccccccatggtgagcactg

SEQ ID NO: 10005241 - DNA, 23 bp, Homo sapiens
ggtcccagtggagaggcctcacc

SEQ ID NO: 10005242 - DNA, 23 bp, Homo sapiens
ggtcccagtggagaggcctcacc

SEQ ID NO: 10005243 - DNA, 22 bp, Homo sapiens
ggtcccagttgcccaggtcagg

SEQ ID NO: 10005244 - DNA, 22 bp, Homo sapiens
ggtcccaggctgcgggctggtg

SEQ ID NO: 10005245 - DNA, 22 bp, Homo sapiens
ggtcccaggctgcgggctggtg

SEQ ID NO: 10005246 - DNA, 22 bp, Homo sapiens
ggtcccaggttgacagggagac

SEQ ID NO: 10005247 - DNA, 22 bp, Homo sapiens
ggtcccaggttgacagggagac

SEQ ID NO: 10005248 - DNA, 22 bp, Homo sapiens
ggtcccagtcctctccctgcta

SEQ ID NO: 10005249 - DNA, 22 bp, Homo sapiens
ggtcccagtcctctccctgcta

SEQ ID NO: 10005250 - DNA, 22 bp, Homo sapiens
ggtccccgtggaggctggagcg

SEQ ID NO: 10005251 - DNA, 22 bp, Homo sapiens
ggtccccgtggaggctggagcg

SEQ ID NO: 10005252 - DNA, 22 bp, Homo sapiens
ggtgaggaattggggactgacc

SEQ ID NO: 10005253 - DNA, 22 bp, Homo sapiens
ggtgaggaattggggactgacc

SEQ ID NO: 10005254 - DNA, 22 bp, Homo sapiens
ggtgaggaattggggactgacc

SEQ ID NO: 10005255 - DNA, 22 bp, Homo sapiens
ggtgaggaattggggactgacc

SEQ ID NO: 10005256 - DNA, 22 bp, Homo sapiens
ggtgaggaaagatggtgacagt

SEQ ID NO: 10005257 - DNA, 22 bp, Homo sapiens
ggtgaggaaagatggtgacagt

SEQ ID NO: 10005258 - DNA, 22 bp, Homo sapiens
ggtgaggaaagatggtgacagt

SEQ ID NO: 10005259 - DNA, 22 bp, Homo sapiens
ggtgaggaattggggactgacc

SEQ ID NO: 10005260 - DNA, 22 bp, Homo sapiens
ggtgaggaattggggactgacc

SEQ ID NO: 10005261 - DNA, 22 bp, Homo sapiens
ggtgaggaaagatggtgacagt

SEQ ID NO: 10005262 - DNA, 22 bp, Homo sapiens
ggtgaggaaagatggtgacagt

SEQ ID NO: 10005263 - DNA, 22 bp, Homo sapiens
ggtgagcagctgtctgtatgga

SEQ ID NO: 10005264 - DNA, 22 bp, Homo sapiens
ggtgagcactgccctgggtctc

SEQ ID NO: 10005265 - DNA, 22 bp, Homo sapiens
ggtgagcactgccctgggtctc

SEQ ID NO: 10005266 - DNA, 22 bp, Homo sapiens
ggtccctggaaggcactagtga

SEQ ID NO: 10005267 - DNA, 22 bp, Homo sapiens
ggtgagaggcagtgctgtggaa

SEQ ID NO: 10005268 - DNA, 22 bp, Homo sapiens
ggtgagaggcagtgctgtggaa

SEQ ID NO: 10005269 - DNA, 22 bp, Homo sapiens
ggtgagcaaagcttcatctgta

SEQ ID NO: 10005270 - DNA, 18 bp, Homo sapiens
ggtgagggagctggaagc

SEQ ID NO: 10005271 - DNA, 18 bp, Homo sapiens
ggtgagggagctggaagc

SEQ ID NO: 10005272 - DNA, 18 bp, Homo sapiens
ggtgagggagctggaagc

SEQ ID NO: 10005273 - DNA, 22 bp, Homo sapiens
ggtgagggagtggaacgaggtg

SEQ ID NO: 10005274 - DNA, 18 bp, Homo sapiens
ggtgagggagctggaagc

SEQ ID NO: 10005275 - DNA, 18 bp, Homo sapiens
ggtgagggagctggaagc

SEQ ID NO: 10005276 - DNA, 22 bp, Homo sapiens
ggtggacagtgttagctctggg

SEQ ID NO: 10005277 - DNA, 22 bp, Homo sapiens
ggtggaagccttcagaacagca

SEQ ID NO: 10005278 - DNA, 22 bp, Homo sapiens
ggtggaaggcctggaaggaggc

SEQ ID NO: 10005279 - DNA, 22 bp, Homo sapiens
ggtggaaggcctggaaggaggc

SEQ ID NO: 10005280 - DNA, 22 bp, Homo sapiens
ggtgagggagtggaacgaggtg

SEQ ID NO: 10005281 - DNA, 22 bp, Homo sapiens
ggtgctgtggcagctcctcctc

SEQ ID NO: 10005282 - DNA, 16 bp, Homo sapiens
gggctgggggattctg

SEQ ID NO: 10005283 - DNA, 22 bp, Homo sapiens
gggctggtctggcttagtcagg

SEQ ID NO: 10005284 - DNA, 22 bp, Homo sapiens
gggctggtgaggctgccctgca

SEQ ID NO: 10005285 - DNA, 22 bp, Homo sapiens
gggctctgggattcagagcaag

SEQ ID NO: 10005286 - DNA, 22 bp, Homo sapiens
gggcttcaaaattggcactctt

SEQ ID NO: 10005287 - DNA, 22 bp, Homo sapiens
gggcttcaaaattggcactctt

SEQ ID NO: 10005288 - DNA, 22 bp, Homo sapiens
gggcttcaatagcagaggcgtg

SEQ ID NO: 10005289 - DNA, 22 bp, Homo sapiens
gggcttcaaaattggcactctt

SEQ ID NO: 10005290 - DNA, 22 bp, Homo sapiens
gggcttcaggagggtcagccca

SEQ ID NO: 10005291 - DNA, 22 bp, Homo sapiens
gggcttcagtaccaaagtttga

SEQ ID NO: 10005292 - DNA, 22 bp, Homo sapiens
gggcttcagggtacttcctcct

SEQ ID NO: 10005293 - DNA, 22 bp, Homo sapiens
gggcttcaggagggtcagccca

SEQ ID NO: 10005294 - DNA, 22 bp, Homo sapiens
gggcttcaatagcagaggcgtg

SEQ ID NO: 10005295 - DNA, 22 bp, Homo sapiens
gggcttcagatccagggacctc

SEQ ID NO: 10005296 - DNA, 22 bp, Homo sapiens
gggcttcagatccagggacctc

SEQ ID NO: 10005297 - DNA, 22 bp, Homo sapiens
gggcttcagctggggatggagc

SEQ ID NO: 10005298 - DNA, 22 bp, Homo sapiens
gggcttcagatccagggacctc

SEQ ID NO: 10005299 - DNA, 23 bp, Homo sapiens
gggcttcattttaattcagctgc

SEQ ID NO: 10005300 - DNA, 23 bp, Homo sapiens
gggcttcattttaattcagctgc

SEQ ID NO: 10005301 - DNA, 22 bp, Homo sapiens
gggcttcattcaggcagaattt

SEQ ID NO: 10005302 - DNA, 22 bp, Homo sapiens
gggcttcagttctgaccatctt

SEQ ID NO: 10005303 - DNA, 22 bp, Homo sapiens
gggcttcattcaggcagaattt

SEQ ID NO: 10005304 - DNA, 22 bp, Homo sapiens
gggcttctagaatttctgatat

SEQ ID NO: 10005305 - DNA, 22 bp, Homo sapiens
gggcttctattcaagtctgttt

SEQ ID NO: 10005306 - DNA, 22 bp, Homo sapiens
gggcttctccctaaggactctg

SEQ ID NO: 10005307 - DNA, 22 bp, Homo sapiens
gggcttctctcaggggcatgag

SEQ ID NO: 10005308 - DNA, 22 bp, Homo sapiens
gggcttctctgggagtcctggt

SEQ ID NO: 10005309 - DNA, 22 bp, Homo sapiens
gggcttctctgggagtcctggt

SEQ ID NO: 10005310 - DNA, 22 bp, Homo sapiens
gggcttctgctcttttggtgct

SEQ ID NO: 10005311 - DNA, 22 bp, Homo sapiens
gggcttctctttagtgagctga

SEQ ID NO: 10005312 - DNA, 22 bp, Homo sapiens
gggcttctggctactgtatgag

SEQ ID NO: 10005313 - DNA, 20 bp, Homo sapiens
ggggcaggtttttatggcta

SEQ ID NO: 10005314 - DNA, 22 bp, Homo sapiens
ggggccagatatcactaaggtt

SEQ ID NO: 10005315 - DNA, 22 bp, Homo sapiens
ggggccagagaggacccaggtg

SEQ ID NO: 10005316 - DNA, 22 bp, Homo sapiens
ggggagtgttttcatgggcttg

SEQ ID NO: 10005317 - DNA, 22 bp, Homo sapiens
ggggagtgacgcagggccatag

SEQ ID NO: 10005318 - DNA, 22 bp, Homo sapiens
ggggatgagactagagctaaag

SEQ ID NO: 10005319 - DNA, 22 bp, Homo sapiens
ggggcaggaggtgttctctttt

SEQ ID NO: 10005320 - DNA, 22 bp, Homo sapiens
ggggcagggaggttatcgccga

SEQ ID NO: 10005321 - DNA, 22 bp, Homo sapiens
ggggaggaagctggaacacggg

SEQ ID NO: 10005322 - DNA, 22 bp, Homo sapiens
ggggaggaagctggaacacggg

SEQ ID NO: 10005323 - DNA, 22 bp, Homo sapiens
ggggaggaagctggaacacggg

SEQ ID NO: 10005324 - DNA, 22 bp, Homo sapiens
ggggaggaagctggaacacggg

SEQ ID NO: 10005325 - DNA, 22 bp, Homo sapiens
ggggaggaagctggaacacggg

SEQ ID NO: 10005326 - DNA, 22 bp, Homo sapiens
ggggagaataaatcagatttta

SEQ ID NO: 10005327 - DNA, 19 bp, Homo sapiens
ggggagaactagagacagc

SEQ ID NO: 10005328 - DNA, 22 bp, Homo sapiens
ggggaggacctttccaaggctt

SEQ ID NO: 10005329 - DNA, 22 bp, Homo sapiens
ggggaggagtgtacaggtttat

SEQ ID NO: 10005330 - DNA, 22 bp, Homo sapiens
ggggtggatttcaggcggtgtc

SEQ ID NO: 10005331 - DNA, 22 bp, Homo sapiens
ggggtggatttcaggcggtgtc

SEQ ID NO: 10005332 - DNA, 22 bp, Homo sapiens
ggggtggattcctacaggtcca

SEQ ID NO: 10005333 - DNA, 19 bp, Homo sapiens
ggggtgctagggagggatc

SEQ ID NO: 10005334 - DNA, 22 bp, Homo sapiens
ggggtggcctgtaggcagcatg

SEQ ID NO: 10005335 - DNA, 22 bp, Homo sapiens
ggggtggcctgtaggcagcatg

SEQ ID NO: 10005336 - DNA, 19 bp, Homo sapiens
ggggtggctggggctccag

SEQ ID NO: 10005337 - DNA, 19 bp, Homo sapiens
ggggtggctggggctccag

SEQ ID NO: 10005338 - DNA, 22 bp, Homo sapiens
ggggtgggagtgccatccttga

SEQ ID NO: 10005339 - DNA, 19 bp, Homo sapiens
ggggtggctggggctccag

SEQ ID NO: 10005340 - DNA, 22 bp, Homo sapiens
ggggtgggagtgccatccttga

SEQ ID NO: 10005341 - DNA, 19 bp, Homo sapiens
ggggtggctggggctccag

SEQ ID NO: 10005342 - DNA, 22 bp, Homo sapiens
ggggtgggcgtgcagggacacc

SEQ ID NO: 10005343 - DNA, 22 bp, Homo sapiens
ggggtgggagtgccatccttga

SEQ ID NO: 10005344 - DNA, 22 bp, Homo sapiens
ggggccagtaggagtgatgtac

SEQ ID NO: 10005345 - DNA, 22 bp, Homo sapiens
ggggtagggcgattgctgcttt

SEQ ID NO: 10005346 - DNA, 22 bp, Homo sapiens
ggggtaggcaggtgatctgatc

SEQ ID NO: 10005347 - DNA, 22 bp, Homo sapiens
gggtgaggcccatttgaggcca

SEQ ID NO: 10005348 - DNA, 22 bp, Homo sapiens
gggtgaggcccatttgaggcca

SEQ ID NO: 10005349 - DNA, 22 bp, Homo sapiens
gggtgaggcccatttgaggcca

SEQ ID NO: 10005350 - DNA, 20 bp, Homo sapiens
gggtgaggatggagaatttg

SEQ ID NO: 10005351 - DNA, 20 bp, Homo sapiens
gggtgaggatggagaatttg

SEQ ID NO: 10005352 - DNA, 22 bp, Homo sapiens
gggtgaggccttgctgccatca

SEQ ID NO: 10005353 - DNA, 22 bp, Homo sapiens
gggtgagggatgagccttcttc

SEQ ID NO: 10005354 - DNA, 21 bp, Homo sapiens
gggtgctgtggtcatgcagga

SEQ ID NO: 10005355 - DNA, 22 bp, Homo sapiens
gggtgctttggctcacgcctgt

SEQ ID NO: 10005356 - DNA, 21 bp, Homo sapiens
gggtgctgtggtcatgcagga

SEQ ID NO: 10005357 - DNA, 21 bp, Homo sapiens
gggtgctgtggtcatgcagga

SEQ ID NO: 10005358 - DNA, 21 bp, Homo sapiens
gggtgctgtggtcatgcagga

SEQ ID NO: 10005359 - DNA, 22 bp, Homo sapiens
gggtgcaggcagcccaggcagg

SEQ ID NO: 10005360 - DNA, 22 bp, Homo sapiens
gggtggtggccagcagtgggca

SEQ ID NO: 10005361 - DNA, 22 bp, Homo sapiens
gggtggtgggcacagaatctgg

SEQ ID NO: 10005362 - DNA, 22 bp, Homo sapiens
gggtggtgtattagagctgcag

SEQ ID NO: 10005363 - DNA, 22 bp, Homo sapiens
gggtggtggccagcagtgggca

SEQ ID NO: 10005364 - DNA, 22 bp, Homo sapiens
gggtggtgagatgtagctgatg

SEQ ID NO: 10005365 - DNA, 22 bp, Homo sapiens
gggtggagagaaagaaacgtga

SEQ ID NO: 10005366 - DNA, 22 bp, Homo sapiens
gggtggagccagttgactctgt

SEQ ID NO: 10005367 - DNA, 22 bp, Homo sapiens
gggtggagaggctaagtccagt

SEQ ID NO: 10005368 - DNA, 21 bp, Homo sapiens
gggtggggttccagccttttc

SEQ ID NO: 10005369 - DNA, 22 bp, Homo sapiens
gggaagccatgctcagaggtac

SEQ ID NO: 10005370 - DNA, 22 bp, Homo sapiens
gggaaggcaccatggtgttcca

SEQ ID NO: 10005371 - DNA, 22 bp, Homo sapiens
gggaaggaggtggcttgaagtg

SEQ ID NO: 10005372 - DNA, 22 bp, Homo sapiens
gggaaggaggtggcttgaagtg

SEQ ID NO: 10005373 - DNA, 22 bp, Homo sapiens
gggaaggcaggcctctgttgga

SEQ ID NO: 10005374 - DNA, 22 bp, Homo sapiens
gggaaggcaggattctctggtg

SEQ ID NO: 10005375 - DNA, 22 bp, Homo sapiens
gggaaggcagtgtctggttgaa

SEQ ID NO: 10005376 - DNA, 22 bp, Homo sapiens
gggaaggcagtgggaggaactg

SEQ ID NO: 10005377 - DNA, 22 bp, Homo sapiens
gggaaggcagtgggaggaactg

SEQ ID NO: 10005378 - DNA, 22 bp, Homo sapiens
gggaaggcatacctgagggaga

SEQ ID NO: 10005379 - DNA, 22 bp, Homo sapiens
gggaagatagtgttgagggccc

SEQ ID NO: 10005380 - DNA, 22 bp, Homo sapiens
gggaagcagcattgtgctggct

SEQ ID NO: 10005381 - DNA, 22 bp, Homo sapiens
gggaagcagcattgtgctggct

SEQ ID NO: 10005382 - DNA, 22 bp, Homo sapiens
gggaagagtgtcggttgaagtg

SEQ ID NO: 10005383 - DNA, 22 bp, Homo sapiens
gggaagatagtgttgagggccc

SEQ ID NO: 10005384 - DNA, 22 bp, Homo sapiens
gggaagagggagctggaatgat

SEQ ID NO: 10005385 - DNA, 22 bp, Homo sapiens
gggaagagtaactagcccatgt

SEQ ID NO: 10005386 - DNA, 22 bp, Homo sapiens
gggaagagtaactagcccatgt

SEQ ID NO: 10005387 - DNA, 22 bp, Homo sapiens
gggaagagtaactagcccatgt

SEQ ID NO: 10005388 - DNA, 22 bp, Homo sapiens
gggaagagtgtcggttgaagtg

SEQ ID NO: 10005389 - DNA, 22 bp, Homo sapiens
gggagatgactcagtgacctcg

SEQ ID NO: 10005390 - DNA, 22 bp, Homo sapiens
gggagatgaatcagaagtgatc

SEQ ID NO: 10005391 - DNA, 23 bp, Homo sapiens
gggagatgggaaatgaaggctct

SEQ ID NO: 10005392 - DNA, 22 bp, Homo sapiens
gggagccacagtttatagtgat

SEQ ID NO: 10005393 - DNA, 22 bp, Homo sapiens
gggagccacagtgaggtgcatg

SEQ ID NO: 10005394 - DNA, 22 bp, Homo sapiens
gggagccagcagggcatggagc

SEQ ID NO: 10005395 - DNA, 22 bp, Homo sapiens
gggagccagcagggcatggagc

SEQ ID NO: 10005396 - DNA, 23 bp, Homo sapiens
gggagccatgggtggtcatggag

SEQ ID NO: 10005397 - DNA, 22 bp, Homo sapiens
gggagccatgctggtcttcttt

SEQ ID NO: 10005398 - DNA, 22 bp, Homo sapiens
ggctgtggggccgggtacagtg

SEQ ID NO: 10005399 - DNA, 22 bp, Homo sapiens
ggctgtggggccgggtacagtg

SEQ ID NO: 10005400 - DNA, 22 bp, Homo sapiens
ggctgtgggatgcataggagct

SEQ ID NO: 10005401 - DNA, 22 bp, Homo sapiens
ggctgtgggatgcataggagct

SEQ ID NO: 10005402 - DNA, 22 bp, Homo sapiens
ggctgtggccagcggggctgag

SEQ ID NO: 10005403 - DNA, 22 bp, Homo sapiens
ggctgtggccagcggggctgag

SEQ ID NO: 10005404 - DNA, 22 bp, Homo sapiens
ggctgtggtctcatctagcctt

SEQ ID NO: 10005405 - DNA, 22 bp, Homo sapiens
ggctgtggtctgggtgctcccc

SEQ ID NO: 10005406 - DNA, 22 bp, Homo sapiens
gggaagagggagctggaatgat

SEQ ID NO: 10005407 - DNA, 22 bp, Homo sapiens
gggaagagggagctggaatgat

SEQ ID NO: 10005408 - DNA, 18 bp, Homo sapiens
gggaagaggatctggccc

SEQ ID NO: 10005409 - DNA, 22 bp, Homo sapiens
gggaagagggagctggaatgat

SEQ ID NO: 10005410 - DNA, 22 bp, Homo sapiens
ggctgtggcagctggaagtggt

SEQ ID NO: 10005411 - DNA, 22 bp, Homo sapiens
ggctgtggcagctggaagtggt

SEQ ID NO: 10005412 - DNA, 22 bp, Homo sapiens
ggctgtggagctgcagagttgg

SEQ ID NO: 10005413 - DNA, 22 bp, Homo sapiens
ggctgtggcattaggtgaggcc

SEQ ID NO: 10005414 - DNA, 22 bp, Homo sapiens
ggctgtggcattaggtgaggcc

SEQ ID NO: 10005415 - DNA, 22 bp, Homo sapiens
ggctgtggcagctggaagtggt

SEQ ID NO: 10005416 - DNA, 22 bp, Homo sapiens
ggctgtggacactgagctcaga

SEQ ID NO: 10005417 - DNA, 18 bp, Homo sapiens
ggctgtgcgtggaggctg

SEQ ID NO: 10005418 - DNA, 22 bp, Homo sapiens
ggctgtgctgagggggaagccc

SEQ ID NO: 10005419 - DNA, 22 bp, Homo sapiens
ggctgtgcgggcagccgtggga

SEQ ID NO: 10005420 - DNA, 22 bp, Homo sapiens
ggctgtgcgggcagccgtggga

SEQ ID NO: 10005421 - DNA, 22 bp, Homo sapiens
ggctgtgcgtcatccggctgca

SEQ ID NO: 10005422 - DNA, 18 bp, Homo sapiens
ggctgtgcgtggaggctg

SEQ ID NO: 10005423 - DNA, 18 bp, Homo sapiens
ggctgtgcgtggaggctg

SEQ ID NO: 10005424 - DNA, 17 bp, Homo sapiens
ggctgcagtccaggagg

SEQ ID NO: 10005425 - DNA, 17 bp, Homo sapiens
ggctgcagtccaggagg

SEQ ID NO: 10005426 - DNA, 22 bp, Homo sapiens
ggctgcaggttggttggcagct

SEQ ID NO: 10005427 - DNA, 22 bp, Homo sapiens
ggctgcagggcagctggtgtgg

SEQ ID NO: 10005428 - DNA, 22 bp, Homo sapiens
ggctgcagggcagctggtgtgg

SEQ ID NO: 10005429 - DNA, 22 bp, Homo sapiens
ggctgcaggcttccctccagca

SEQ ID NO: 10005430 - DNA, 22 bp, Homo sapiens
ggctgcaggcagggtatccact

SEQ ID NO: 10005431 - DNA, 22 bp, Homo sapiens
ggctgcaggcagggtatccact

SEQ ID NO: 10005432 - DNA, 22 bp, Homo sapiens
ggctgcaggcagggtatccact

SEQ ID NO: 10005433 - DNA, 22 bp, Homo sapiens
ggctgcctctatttaggatcaa

SEQ ID NO: 10005434 - DNA, 19 bp, Homo sapiens
ggctgcctcctgggagatt

SEQ ID NO: 10005435 - DNA, 19 bp, Homo sapiens
ggctgcctcctgggagatt

SEQ ID NO: 10005436 - DNA, 19 bp, Homo sapiens
ggctgcctcctgggagatt

SEQ ID NO: 10005437 - DNA, 22 bp, Homo sapiens
ggctgcctcctcgagacaggat

SEQ ID NO: 10005438 - DNA, 22 bp, Homo sapiens
ggctgcctcctgctgggctgga

SEQ ID NO: 10005439 - DNA, 22 bp, Homo sapiens
ggctgcctccactgcttgtccc

SEQ ID NO: 10005440 - DNA, 22 bp, Homo sapiens
ggctgcctcccaggagaatctg

SEQ ID NO: 10005441 - DNA, 22 bp, Homo sapiens
ggctgcctcctcgagacaggat

SEQ ID NO: 10005442 - DNA, 22 bp, Homo sapiens
ggctgcctcagatttgctgact

SEQ ID NO: 10005443 - DNA, 22 bp, Homo sapiens
ggctgcctcagatttgctgact

SEQ ID NO: 10005444 - DNA, 22 bp, Homo sapiens
ggctgccaggagggaggccagt

SEQ ID NO: 10005445 - DNA, 22 bp, Homo sapiens
ggctgccagtgagtgcagaccg

SEQ ID NO: 10005446 - DNA, 22 bp, Homo sapiens
ggctgccaggagaagctcagtg

SEQ ID NO: 10005447 - DNA, 22 bp, Homo sapiens
ggctgccacgtcgagggtccaa

SEQ ID NO: 10005448 - DNA, 22 bp, Homo sapiens
ggctgcataggcagaagctgtg

SEQ ID NO: 10005449 - DNA, 22 bp, Homo sapiens
ggctgcatgcctcagtgtaaga

SEQ ID NO: 10005450 - DNA, 22 bp, Homo sapiens
ggctgcatgttcagatgacact

SEQ ID NO: 10005451 - DNA, 22 bp, Homo sapiens
ggctgcagttgtgtgaaggccg

SEQ ID NO: 10005452 - DNA, 17 bp, Homo sapiens
ggctggaggggacccgg

SEQ ID NO: 10005453 - DNA, 19 bp, Homo sapiens
ggctggagtggccatctgt

SEQ ID NO: 10005454 - DNA, 19 bp, Homo sapiens
ggctggagtggccatctgt

SEQ ID NO: 10005455 - DNA, 22 bp, Homo sapiens
ggctggaggtagaagaacactt

SEQ ID NO: 10005456 - DNA, 22 bp, Homo sapiens
ggctggaggtagaagaacactt

SEQ ID NO: 10005457 - DNA, 22 bp, Homo sapiens
ggctggataccaggagacaggg

SEQ ID NO: 10005458 - DNA, 22 bp, Homo sapiens
ggctggcaggcacagtatgcaa

SEQ ID NO: 10005459 - DNA, 22 bp, Homo sapiens
ggctggcagaagtgtgctggct

SEQ ID NO: 10005460 - DNA, 22 bp, Homo sapiens
ggctggcagaggggagtctgtg

SEQ ID NO: 10005461 - DNA, 22 bp, Homo sapiens
ggctggcagtgtgagagaggga

SEQ ID NO: 10005462 - DNA, 22 bp, Homo sapiens
ggctggcagtgtgagagaggga

SEQ ID NO: 10005463 - DNA, 22 bp, Homo sapiens
ggctggcaggggatgtcagatg

SEQ ID NO: 10005464 - DNA, 22 bp, Homo sapiens
ggctgcctgaggctgaggcccg

SEQ ID NO: 10005465 - DNA, 22 bp, Homo sapiens
ggctgcctgctcctcctgcacg

SEQ ID NO: 10005466 - DNA, 22 bp, Homo sapiens
ggctgcctctatttaggatcaa

SEQ ID NO: 10005467 - DNA, 22 bp, Homo sapiens
ggctgcctctgatgtgcagacg

SEQ ID NO: 10005468 - DNA, 22 bp, Homo sapiens
ggctgcctctggaagctggaga

SEQ ID NO: 10005469 - DNA, 22 bp, Homo sapiens
ggctgcctctgatgtgcagacg

SEQ ID NO: 10005470 - DNA, 22 bp, Homo sapiens
ggctgcctgaggcagtgagaga

SEQ ID NO: 10005471 - DNA, 22 bp, Homo sapiens
ggctgcctgaggcagtgagaga

SEQ ID NO: 10005472 - DNA, 22 bp, Homo sapiens
ggctgcctctttcttagtgtct

SEQ ID NO: 10005473 - DNA, 22 bp, Homo sapiens
ggctgcctgaactttggggaaa

SEQ ID NO: 10005474 - DNA, 17 bp, Homo sapiens
ggctggagcagctcccc

SEQ ID NO: 10005475 - DNA, 22 bp, Homo sapiens
ggctggaggagaatgggtgtga

SEQ ID NO: 10005476 - DNA, 22 bp, Homo sapiens
gggcaggtggagggcccagcca

SEQ ID NO: 10005477 - DNA, 22 bp, Homo sapiens
gggcaggtggcagggtctctgg

SEQ ID NO: 10005478 - DNA, 22 bp, Homo sapiens
gggcaggtggcaaagccagagg

SEQ ID NO: 10005479 - DNA, 22 bp, Homo sapiens
gggcaggtggcaaagccagagg

SEQ ID NO: 10005480 - DNA, 22 bp, Homo sapiens
gggcaggtgttgtcaatctaat

SEQ ID NO: 10005481 - DNA, 22 bp, Homo sapiens
gggcaggtgtttccaaggtgag

SEQ ID NO: 10005482 - DNA, 22 bp, Homo sapiens
gggcaggtgtttccaaggtgag

SEQ ID NO: 10005483 - DNA, 22 bp, Homo sapiens
gggcaggtggcctcttgtacta

SEQ ID NO: 10005484 - DNA, 22 bp, Homo sapiens
gggcaggtgtttccaaggtgag

SEQ ID NO: 10005485 - DNA, 22 bp, Homo sapiens
gggcccaggcctccttccttcc

SEQ ID NO: 10005486 - DNA, 22 bp, Homo sapiens
gggcccagtaccctctgccaag

SEQ ID NO: 10005487 - DNA, 22 bp, Homo sapiens
gggcccagtaccctctgccaag

SEQ ID NO: 10005488 - DNA, 22 bp, Homo sapiens
gggccccaagaacctcctcctg

SEQ ID NO: 10005489 - DNA, 22 bp, Homo sapiens
gggccccagtcctcccacgtgg

SEQ ID NO: 10005490 - DNA, 22 bp, Homo sapiens
gggccccactggggctgcctgc

SEQ ID NO: 10005491 - DNA, 22 bp, Homo sapiens
gggccctgatctgtgagcgcag

SEQ ID NO: 10005492 - DNA, 22 bp, Homo sapiens
gggccctgccccgtggctctga

SEQ ID NO: 10005493 - DNA, 22 bp, Homo sapiens
gggccctgccccgtggctctga

SEQ ID NO: 10005494 - DNA, 22 bp, Homo sapiens
gggccctggggatgtggacgcg

SEQ ID NO: 10005495 - DNA, 22 bp, Homo sapiens
gggccctgcctaaggaacacac

SEQ ID NO: 10005496 - DNA, 22 bp, Homo sapiens
gggccctgcgactcgcggcgga

SEQ ID NO: 10005497 - DNA, 20 bp, Homo sapiens
gggctaggtagccatttggc

SEQ ID NO: 10005498 - DNA, 22 bp, Homo sapiens
gggctaggtctgatcagagaag

SEQ ID NO: 10005499 - DNA, 22 bp, Homo sapiens
gggccggagctgggtcccgcgc

SEQ ID NO: 10005500 - DNA, 22 bp, Homo sapiens
gggccggagctgggtcccgcgc

SEQ ID NO: 10005501 - DNA, 22 bp, Homo sapiens
gggccctggggcctgatttgca

SEQ ID NO: 10005502 - DNA, 22 bp, Homo sapiens
gggccctggggcctgatttgca

SEQ ID NO: 10005503 - DNA, 22 bp, Homo sapiens
gggccctggggcctgatttgca

SEQ ID NO: 10005504 - DNA, 22 bp, Homo sapiens
gggccctgtgatttcttgagga

SEQ ID NO: 10005505 - DNA, 22 bp, Homo sapiens
gggccctgtgatttcttgagga

SEQ ID NO: 10005506 - DNA, 22 bp, Homo sapiens
gggctctgaatcccaggtctgc

SEQ ID NO: 10005507 - DNA, 18 bp, Homo sapiens
gggctctggcatctgggt

SEQ ID NO: 10005508 - DNA, 22 bp, Homo sapiens
gggctctggatggagcctgcag

SEQ ID NO: 10005509 - DNA, 22 bp, Homo sapiens
gggctctggaaatgggagctcc

SEQ ID NO: 10005510 - DNA, 22 bp, Homo sapiens
gggctctggacccaggcaagag

SEQ ID NO: 10005511 - DNA, 21 bp, Homo sapiens
gggctcagtggaaaagagtgt

SEQ ID NO: 10005512 - DNA, 21 bp, Homo sapiens
gggctcagtggaaaagagtgt

SEQ ID NO: 10005513 - DNA, 22 bp, Homo sapiens
gggctcagctgggcgtgctggt

SEQ ID NO: 10005514 - DNA, 21 bp, Homo sapiens
gggctcagcgctcggctcctc

SEQ ID NO: 10005515 - DNA, 22 bp, Homo sapiens
gggctcagctccttccttccta

SEQ ID NO: 10005516 - DNA, 22 bp, Homo sapiens
gggctcagctccttccttccta

SEQ ID NO: 10005517 - DNA, 22 bp, Homo sapiens
gggctcagaggagtggcctggg

SEQ ID NO: 10005518 - DNA, 22 bp, Homo sapiens
gggctcagaggagtggcctggg

SEQ ID NO: 10005519 - DNA, 22 bp, Homo sapiens
gggctcagcctcctcacttcga

SEQ ID NO: 10005520 - DNA, 22 bp, Homo sapiens
gggcagagactcagaaacagaa

SEQ ID NO: 10005521 - DNA, 22 bp, Homo sapiens
gggcagagactcagaaacagaa

SEQ ID NO: 10005522 - DNA, 22 bp, Homo sapiens
gggcagagactcagaaacagaa

SEQ ID NO: 10005523 - DNA, 22 bp, Homo sapiens
gggcagagactcagaaacagaa

SEQ ID NO: 10005524 - DNA, 22 bp, Homo sapiens
gggcactgtacactgtgcatgg

SEQ ID NO: 10005525 - DNA, 22 bp, Homo sapiens
gggcagaggctctggcccatcc

SEQ ID NO: 10005526 - DNA, 20 bp, Homo sapiens
gggcagagccagccagtccc

SEQ ID NO: 10005527 - DNA, 20 bp, Homo sapiens
gggcagagccagccagtccc

SEQ ID NO: 10005528 - DNA, 20 bp, Homo sapiens
gggcagagccagccagtccc

SEQ ID NO: 10005529 - DNA, 20 bp, Homo sapiens
gggcagagccagccagtccc

SEQ ID NO: 10005530 - DNA, 22 bp, Homo sapiens
gggcagagagctggaactcctt

SEQ ID NO: 10005531 - DNA, 22 bp, Homo sapiens
gggcagagagctggaactcctt

SEQ ID NO: 10005532 - DNA, 20 bp, Homo sapiens
gggcagagccagccagtccc

SEQ ID NO: 10005533 - DNA, 22 bp, Homo sapiens
gggcagagagctggaactcctt

SEQ ID NO: 10005534 - DNA, 22 bp, Homo sapiens
gggcagagagctggaactcctt

SEQ ID NO: 10005535 - DNA, 22 bp, Homo sapiens
gggcagaggctctggcccatcc

SEQ ID NO: 10005536 - DNA, 22 bp, Homo sapiens
gggcagaggctctggcccatcc

SEQ ID NO: 10005537 - DNA, 22 bp, Homo sapiens
gggcagaggctctggcccatcc

SEQ ID NO: 10005538 - DNA, 21 bp, Homo sapiens
gggcagaggggcctcctgggt

SEQ ID NO: 10005539 - DNA, 21 bp, Homo sapiens
gggcagaggggcctcctgggt

SEQ ID NO: 10005540 - DNA, 21 bp, Homo sapiens
gggcagaggggcctcctgggt

SEQ ID NO: 10005541 - DNA, 21 bp, Homo sapiens
gggcagaggggcctcctgggt

SEQ ID NO: 10005542 - DNA, 17 bp, Homo sapiens
gggcagggactcctggg

SEQ ID NO: 10005543 - DNA, 17 bp, Homo sapiens
gggcagggactcctggg

SEQ ID NO: 10005544 - DNA, 21 bp, Homo sapiens
gggcaggtctctgatgtcaac

SEQ ID NO: 10005545 - DNA, 22 bp, Homo sapiens
gggcaggtctgggtcagcctga

SEQ ID NO: 10005546 - DNA, 21 bp, Homo sapiens
gggcaggtctctgatgtcaac

SEQ ID NO: 10005547 - DNA, 21 bp, Homo sapiens
gggcaggtctctgatgtcaac

SEQ ID NO: 10005548 - DNA, 17 bp, Homo sapiens
gggcagggactcctggg

SEQ ID NO: 10005549 - DNA, 22 bp, Homo sapiens
gggcaggtgacctcttgtcctg

SEQ ID NO: 10005550 - DNA, 22 bp, Homo sapiens
gggcaggtgcccagggccagag

SEQ ID NO: 10005551 - DNA, 22 bp, Homo sapiens
gggagcgggactgcgcaggctt

SEQ ID NO: 10005552 - DNA, 22 bp, Homo sapiens
gggagctccactgcctctcatt

SEQ ID NO: 10005553 - DNA, 22 bp, Homo sapiens
gggagctgaactgctgaagttg

SEQ ID NO: 10005554 - DNA, 22 bp, Homo sapiens
gggagctgaagtaggggtaaat

SEQ ID NO: 10005555 - DNA, 22 bp, Homo sapiens
gggagtcaggctccctcagaga

SEQ ID NO: 10005556 - DNA, 22 bp, Homo sapiens
gggagtggagagcaatggatga

SEQ ID NO: 10005557 - DNA, 22 bp, Homo sapiens
gggagtggagagcaatggatga

SEQ ID NO: 10005558 - DNA, 22 bp, Homo sapiens
gggagtcagagaggtaatggga

SEQ ID NO: 10005559 - DNA, 22 bp, Homo sapiens
gggagctgaatggcaatggaga

SEQ ID NO: 10005560 - DNA, 22 bp, Homo sapiens
gggaggttgaggctgcagtgag

SEQ ID NO: 10005561 - DNA, 22 bp, Homo sapiens
gggaggttgaggctgcagtgag

SEQ ID NO: 10005562 - DNA, 22 bp, Homo sapiens
gggagtggattatgtggaccca

SEQ ID NO: 10005563 - DNA, 22 bp, Homo sapiens
gggagtggattatgtggaccca

SEQ ID NO: 10005564 - DNA, 22 bp, Homo sapiens
gggagtgggtttggcctaggcc

SEQ ID NO: 10005565 - DNA, 22 bp, Homo sapiens
gggagtgggtttggcctaggcc

SEQ ID NO: 10005566 - DNA, 20 bp, Homo sapiens
gggagtggtggtagcctgtg

SEQ ID NO: 10005567 - DNA, 22 bp, Homo sapiens
gggagtggttgatggtgaaaat

SEQ ID NO: 10005568 - DNA, 22 bp, Homo sapiens
gggagtggttgatggtgaaaat

SEQ ID NO: 10005569 - DNA, 22 bp, Homo sapiens
gggataggagattgggagtgtt

SEQ ID NO: 10005570 - DNA, 19 bp, Homo sapiens
gggatcagcccagggctct

SEQ ID NO: 10005571 - DNA, 22 bp, Homo sapiens
ggaggaggggtgactgaatgct

SEQ ID NO: 10005572 - DNA, 22 bp, Homo sapiens
ggaggaggggtgactgaatgct

SEQ ID NO: 10005573 - DNA, 22 bp, Homo sapiens
ggaggaggggtgactgaatgct

SEQ ID NO: 10005574 - DNA, 22 bp, Homo sapiens
ggaggaggggtgactgaatgct

SEQ ID NO: 10005575 - DNA, 22 bp, Homo sapiens
ggaggagtgtggggcactctgc

SEQ ID NO: 10005576 - DNA, 22 bp, Homo sapiens
ggaggatgagctacgaggagct

SEQ ID NO: 10005577 - DNA, 22 bp, Homo sapiens
ggaggaggggtttacattggaa

SEQ ID NO: 10005578 - DNA, 22 bp, Homo sapiens
ggaggagtcagttgggctgctt

SEQ ID NO: 10005579 - DNA, 22 bp, Homo sapiens
ggaggatgccaagctgtgcaca

SEQ ID NO: 10005580 - DNA, 17 bp, Homo sapiens
ggaggcaacagacaggg

SEQ ID NO: 10005581 - DNA, 22 bp, Homo sapiens
ggcacctgtctgctcacagtga

SEQ ID NO: 10005582 - DNA, 22 bp, Homo sapiens
ggcacctggaggtttactggat

SEQ ID NO: 10005583 - DNA, 22 bp, Homo sapiens
ggcacctggatgtagcagtgaa

SEQ ID NO: 10005584 - DNA, 22 bp, Homo sapiens
ggcacctggtaagtgctcagta

SEQ ID NO: 10005585 - DNA, 16 bp, Homo sapiens
ggcaccagtgaacaca

SEQ ID NO: 10005586 - DNA, 22 bp, Homo sapiens
ggaggcacttcccgtctcagcc

SEQ ID NO: 10005587 - DNA, 22 bp, Homo sapiens
ggcactcaataaatgttgccaa

SEQ ID NO: 10005588 - DNA, 22 bp, Homo sapiens
ggcactcaataaatgttgccaa

SEQ ID NO: 10005589 - DNA, 22 bp, Homo sapiens
ggcactgagaggctcttcctaa

SEQ ID NO: 10005590 - DNA, 21 bp, Homo sapiens
ggcactgagccagatggactc

SEQ ID NO: 10005591 - DNA, 22 bp, Homo sapiens
ggcactgagcgggctctgagcg

SEQ ID NO: 10005592 - DNA, 22 bp, Homo sapiens
ggcagatggaatgagctgtcta

SEQ ID NO: 10005593 - DNA, 22 bp, Homo sapiens
ggcagatgttatatgatctgag

SEQ ID NO: 10005594 - DNA, 22 bp, Homo sapiens
ggcagaggtgaagttcacaagg

SEQ ID NO: 10005595 - DNA, 22 bp, Homo sapiens
ggcactgatctgatttccctcc

SEQ ID NO: 10005596 - DNA, 22 bp, Homo sapiens
ggcactgattccattcatgaag

SEQ ID NO: 10005597 - DNA, 22 bp, Homo sapiens
ggcagcactgcagcttgttggg

SEQ ID NO: 10005598 - DNA, 21 bp, Homo sapiens
ggcagcactacctgaagcata

SEQ ID NO: 10005599 - DNA, 22 bp, Homo sapiens
ggcagcacgacaggagtggaag

SEQ ID NO: 10005600 - DNA, 22 bp, Homo sapiens
ggcagcaatgctgtgcaggcat

SEQ ID NO: 10005601 - DNA, 22 bp, Homo sapiens
ggcagcaatgctgtgcaggcat

SEQ ID NO: 10005602 - DNA, 22 bp, Homo sapiens
ggcagcaattcttcagaatcat

SEQ ID NO: 10005603 - DNA, 20 bp, Homo sapiens
ggcagcaattcaccctatcc

SEQ ID NO: 10005604 - DNA, 22 bp, Homo sapiens
ggcagcaatgctgtgcaggcat

SEQ ID NO: 10005605 - DNA, 22 bp, Homo sapiens
ggcagcaagtggtgggagactt

SEQ ID NO: 10005606 - DNA, 22 bp, Homo sapiens
ggcagcaagtaggattcttatt

SEQ ID NO: 10005607 - DNA, 22 bp, Homo sapiens
ggcagcactgcagcttgttggg

SEQ ID NO: 10005608 - DNA, 22 bp, Homo sapiens
ggcagcagaactggccctgtat

SEQ ID NO: 10005609 - DNA, 22 bp, Homo sapiens
ggcagcaaactggcttcaggct

SEQ ID NO: 10005610 - DNA, 22 bp, Homo sapiens
ggcagcaaaaagcctggttgaa

SEQ ID NO: 10005611 - DNA, 22 bp, Homo sapiens
ggcagcaacacgagtgagctaa

SEQ ID NO: 10005612 - DNA, 22 bp, Homo sapiens
ggcagcaacaggtgtgttgtga

SEQ ID NO: 10005613 - DNA, 22 bp, Homo sapiens
ggcagcaaccaaccaggcattt

SEQ ID NO: 10005614 - DNA, 22 bp, Homo sapiens
ggcagcaaagtcacatggaaaa

SEQ ID NO: 10005615 - DNA, 22 bp, Homo sapiens
ggcagcaaactggcttcaggct

SEQ ID NO: 10005616 - DNA, 22 bp, Homo sapiens
ggcagcaaatattgtcagctgt

SEQ ID NO: 10005617 - DNA, 22 bp, Homo sapiens
ggcagcaaatattgtcagctgt

SEQ ID NO: 10005618 - DNA, 19 bp, Homo sapiens
ggcagcaagctctgaaggc

SEQ ID NO: 10005619 - DNA, 19 bp, Homo sapiens
ggcagcaagctctgaaggc

SEQ ID NO: 10005620 - DNA, 22 bp, Homo sapiens
ggcagcaaggcctcgggtgagc

SEQ ID NO: 10005621 - DNA, 22 bp, Homo sapiens
ggcagcaaggtggcggaaatga

SEQ ID NO: 10005622 - DNA, 22 bp, Homo sapiens
ggcagcaagtggtgggagactt

SEQ ID NO: 10005623 - DNA, 22 bp, Homo sapiens
ggcagcaagcagaagttctatg

SEQ ID NO: 10005624 - DNA, 22 bp, Homo sapiens
ggcagcaagagaggttcagctt

SEQ ID NO: 10005625 - DNA, 22 bp, Homo sapiens
ggcagcaagagaggttcagctt

SEQ ID NO: 10005626 - DNA, 18 bp, Homo sapiens
ggcagcaagaagggaggg

SEQ ID NO: 10005627 - DNA, 22 bp, Homo sapiens
ggcagcaactcggagagaagag

SEQ ID NO: 10005628 - DNA, 18 bp, Homo sapiens
ggcagcaagaagggaggg

SEQ ID NO: 10005629 - DNA, 22 bp, Homo sapiens
ggcagcaactcggagagaagag

SEQ ID NO: 10005630 - DNA, 20 bp, Homo sapiens
ggcagcaaccatatgctaca

SEQ ID NO: 10005631 - DNA, 20 bp, Homo sapiens
ggcagcaaccatatgctaca

SEQ ID NO: 10005632 - DNA, 22 bp, Homo sapiens
ggcagcaactcattattcctgt

SEQ ID NO: 10005633 - DNA, 22 bp, Homo sapiens
ggcagcaacgaggcttgatacc

SEQ ID NO: 10005634 - DNA, 22 bp, Homo sapiens
ggcagcaactcggagagaagag

SEQ ID NO: 10005635 - DNA, 22 bp, Homo sapiens
ggcaggggtcctggtgttgact

SEQ ID NO: 10005636 - DNA, 22 bp, Homo sapiens
ggcaggggtcctggtgttgact

SEQ ID NO: 10005637 - DNA, 22 bp, Homo sapiens
ggcagggcttgtctctgtgatg

SEQ ID NO: 10005638 - DNA, 22 bp, Homo sapiens
ggcagggcaggaaagtcaggaa

SEQ ID NO: 10005639 - DNA, 20 bp, Homo sapiens
ggcagggcatcaacagctct

SEQ ID NO: 10005640 - DNA, 20 bp, Homo sapiens
ggcagggcatcaacagctct

SEQ ID NO: 10005641 - DNA, 22 bp, Homo sapiens
ggcagggacaggatagggtttt

SEQ ID NO: 10005642 - DNA, 22 bp, Homo sapiens
ggcagggaagctggcatcacgg

SEQ ID NO: 10005643 - DNA, 22 bp, Homo sapiens
ggcagggagagcatgctgataa

SEQ ID NO: 10005644 - DNA, 22 bp, Homo sapiens
ggcagggaaacagctgatccca

SEQ ID NO: 10005645 - DNA, 22 bp, Homo sapiens
ggcagggaaacagctgatccca

SEQ ID NO: 10005646 - DNA, 18 bp, Homo sapiens
ggcagggaaaagataggg

SEQ ID NO: 10005647 - DNA, 22 bp, Homo sapiens
ggcagggaaacagctgatccca

SEQ ID NO: 10005648 - DNA, 22 bp, Homo sapiens
ggcagggaaacagctgatccca

SEQ ID NO: 10005649 - DNA, 22 bp, Homo sapiens
ggcaggggtcctggtgttgact

SEQ ID NO: 10005650 - DNA, 22 bp, Homo sapiens
ggcagtgactgttcagacgtcc

SEQ ID NO: 10005651 - DNA, 22 bp, Homo sapiens
ggcagtgagctggagggaagga

SEQ ID NO: 10005652 - DNA, 22 bp, Homo sapiens
ggcagtgagaggtctcctggtc

SEQ ID NO: 10005653 - DNA, 22 bp, Homo sapiens
ggcagtgagctggagggaagga

SEQ ID NO: 10005654 - DNA, 22 bp, Homo sapiens
ggcagtgagctggagggaagga

SEQ ID NO: 10005655 - DNA, 22 bp, Homo sapiens
ggcagtgagtcccggagaggcc

SEQ ID NO: 10005656 - DNA, 22 bp, Homo sapiens
ggcagtgagtcccggagaggcc

SEQ ID NO: 10005657 - DNA, 22 bp, Homo sapiens
ggcagtgagtcccggagaggcc

SEQ ID NO: 10005658 - DNA, 22 bp, Homo sapiens
ggcagtgagtcccggagaggcc

SEQ ID NO: 10005659 - DNA, 22 bp, Homo sapiens
ggcagtgcaaggcagcctggat

SEQ ID NO: 10005660 - DNA, 22 bp, Homo sapiens
ggcagtgatgtcaaacagtgaa

SEQ ID NO: 10005661 - DNA, 21 bp, Homo sapiens
ggcagtgatgtgaagtgcatc

SEQ ID NO: 10005662 - DNA, 22 bp, Homo sapiens
ggcagtgatgtcaaacagtgaa

SEQ ID NO: 10005663 - DNA, 22 bp, Homo sapiens
ggcagtgccactaagctctgct

SEQ ID NO: 10005664 - DNA, 22 bp, Homo sapiens
ggcagtgcaaggctggcacagt

SEQ ID NO: 10005665 - DNA, 17 bp, Homo sapiens
ggcagtggaggaagaga

SEQ ID NO: 10005666 - DNA, 20 bp, Homo sapiens
ggcaggctttatatggaggg

SEQ ID NO: 10005667 - DNA, 22 bp, Homo sapiens
ggcaggctttcagcatcaagtc

SEQ ID NO: 10005668 - DNA, 22 bp, Homo sapiens
ggcaggcttgatatggggggac

SEQ ID NO: 10005669 - DNA, 20 bp, Homo sapiens
ggcaggctttatatggaggg

SEQ ID NO: 10005670 - DNA, 22 bp, Homo sapiens
ggcaggctgttcacctgctttt

SEQ ID NO: 10005671 - DNA, 22 bp, Homo sapiens
ggcaggctgttcacctgctttt

SEQ ID NO: 10005672 - DNA, 22 bp, Homo sapiens
ggcagctattccaagcagcact

SEQ ID NO: 10005673 - DNA, 22 bp, Homo sapiens
ggcagctcacctctggtccagg

SEQ ID NO: 10005674 - DNA, 22 bp, Homo sapiens
ggcagccttgagggaggcctgg

SEQ ID NO: 10005675 - DNA, 22 bp, Homo sapiens
ggcagccttgagggaggcctgg

SEQ ID NO: 10005676 - DNA, 22 bp, Homo sapiens
ggcagcgcccgagtccgcagct

SEQ ID NO: 10005677 - DNA, 22 bp, Homo sapiens
ggcagcgagtcgccaagtctcg

SEQ ID NO: 10005678 - DNA, 22 bp, Homo sapiens
ggcagctcctctcagcaaaaga

SEQ ID NO: 10005679 - DNA, 22 bp, Homo sapiens
ggcagctcgatgacttctgcat

SEQ ID NO: 10005680 - DNA, 22 bp, Homo sapiens
ggcagctcctcctagtctgccc

SEQ ID NO: 10005681 - DNA, 22 bp, Homo sapiens
ggcagctccaaaaggaaacact

SEQ ID NO: 10005682 - DNA, 22 bp, Homo sapiens
ggcagctcacgggcatggggtg

SEQ ID NO: 10005683 - DNA, 20 bp, Homo sapiens
ggcagctcactactttctgt

SEQ ID NO: 10005684 - DNA, 22 bp, Homo sapiens
ggcagccatgtcccagggcttc

SEQ ID NO: 10005685 - DNA, 22 bp, Homo sapiens
ggcagccatgtcccagggcttc

SEQ ID NO: 10005686 - DNA, 22 bp, Homo sapiens
ggcagccatgtcccagggcttc

SEQ ID NO: 10005687 - DNA, 22 bp, Homo sapiens
ggcagccctttctggccagctc

SEQ ID NO: 10005688 - DNA, 22 bp, Homo sapiens
ggcagcctcaggttttctttga

SEQ ID NO: 10005689 - DNA, 17 bp, Homo sapiens
ggcagcctcaggcgttt

SEQ ID NO: 10005690 - DNA, 17 bp, Homo sapiens
ggcagcctcaggcgttt

SEQ ID NO: 10005691 - DNA, 18 bp, Homo sapiens
ggcagcctacccacttgt

SEQ ID NO: 10005692 - DNA, 19 bp, Homo sapiens
ggcagcctgcacgggctgc

SEQ ID NO: 10005693 - DNA, 18 bp, Homo sapiens
ggcagcctggacatgctc

SEQ ID NO: 10005694 - DNA, 22 bp, Homo sapiens
ggcagccttctctcataggtga

SEQ ID NO: 10005695 - DNA, 22 bp, Homo sapiens
ggcagccttgactagtgactta

SEQ ID NO: 10005696 - DNA, 22 bp, Homo sapiens
ggcagccttgactagtgactta

SEQ ID NO: 10005697 - DNA, 22 bp, Homo sapiens
ggcagccttctctcataggtga

SEQ ID NO: 10005698 - DNA, 23 bp, Homo sapiens
ggcagcctctgactctgctttgc

SEQ ID NO: 10005699 - DNA, 21 bp, Homo sapiens
ggcagcctgacccccagagag

SEQ ID NO: 10005700 - DNA, 22 bp, Homo sapiens
ggcagcctccagggcactggtg

SEQ ID NO: 10005701 - DNA, 23 bp, Homo sapiens
ggcagcctctgactctgctttgc

SEQ ID NO: 10005702 - DNA, 22 bp, Homo sapiens
ggcagcctccagggcactggtg

SEQ ID NO: 10005703 - DNA, 19 bp, Homo sapiens
ggccacctctcttcccagg

SEQ ID NO: 10005704 - DNA, 22 bp, Homo sapiens
ggccagagtctatatgcagaca

SEQ ID NO: 10005705 - DNA, 22 bp, Homo sapiens
ggccagagtctatatgcagaca

SEQ ID NO: 10005706 - DNA, 22 bp, Homo sapiens
ggccagcagacctcagggactc

SEQ ID NO: 10005707 - DNA, 21 bp, Homo sapiens
ggccagcagcgtccactgtgg

SEQ ID NO: 10005708 - DNA, 22 bp, Homo sapiens
ggccagcagacctcagggactc

SEQ ID NO: 10005709 - DNA, 19 bp, Homo sapiens
ggccagcacagggctctgt

SEQ ID NO: 10005710 - DNA, 21 bp, Homo sapiens
ggccacagttagggctcagga

SEQ ID NO: 10005711 - DNA, 21 bp, Homo sapiens
ggccacagttagggctcagga

SEQ ID NO: 10005712 - DNA, 22 bp, Homo sapiens
ggccacagtgggaaatcctggg

SEQ ID NO: 10005713 - DNA, 22 bp, Homo sapiens
ggccacatgtggctgctcgtat

SEQ ID NO: 10005714 - DNA, 22 bp, Homo sapiens
ggccaccaaagtcctgtggctt

SEQ ID NO: 10005715 - DNA, 17 bp, Homo sapiens
ggccacagagcttgggg

SEQ ID NO: 10005716 - DNA, 22 bp, Homo sapiens
ggcagtgggaaataagtgagaa

SEQ ID NO: 10005717 - DNA, 22 bp, Homo sapiens
ggcagtgggtggatctcaggga

SEQ ID NO: 10005718 - DNA, 22 bp, Homo sapiens
ggcagtggctcctctctactcc

SEQ ID NO: 10005719 - DNA, 22 bp, Homo sapiens
ggccacagcaatgctgtgatgt

SEQ ID NO: 10005720 - DNA, 22 bp, Homo sapiens
ggccacagcagatgcttcagat

SEQ ID NO: 10005721 - DNA, 22 bp, Homo sapiens
ggccacagcagatgcttcagat

SEQ ID NO: 10005722 - DNA, 20 bp, Homo sapiens
ggccacagggtgctggtgga

SEQ ID NO: 10005723 - DNA, 22 bp, Homo sapiens
ggccacagtctctggaaggatg

SEQ ID NO: 10005724 - DNA, 22 bp, Homo sapiens
ggccacagtctctggaaggatg

SEQ ID NO: 10005725 - DNA, 22 bp, Homo sapiens
ggcccagtctggggccctgtga

SEQ ID NO: 10005726 - DNA, 22 bp, Homo sapiens
ggcccagtctggggccctgtga

SEQ ID NO: 10005727 - DNA, 20 bp, Homo sapiens
ggcccagtgaaccaggacgg

SEQ ID NO: 10005728 - DNA, 22 bp, Homo sapiens
ggcccagtgctgttcacccagt

SEQ ID NO: 10005729 - DNA, 20 bp, Homo sapiens
ggcccagtgaaccaggacgg

SEQ ID NO: 10005730 - DNA, 22 bp, Homo sapiens
ggcccagtgtgggtggatgttg

SEQ ID NO: 10005731 - DNA, 22 bp, Homo sapiens
ggcccagtgtcccggtcgtggc

SEQ ID NO: 10005732 - DNA, 22 bp, Homo sapiens
ggcccagtgtaccccaggcagt

SEQ ID NO: 10005733 - DNA, 22 bp, Homo sapiens
ggcccagtgtaccccaggcagt

SEQ ID NO: 10005734 - DNA, 22 bp, Homo sapiens
ggcccagtgtaccccaggcagt

SEQ ID NO: 10005735 - DNA, 22 bp, Homo sapiens
ggcccagctgggcggggacacg

SEQ ID NO: 10005736 - DNA, 22 bp, Homo sapiens
ggcccagctgtatattacagtt

SEQ ID NO: 10005737 - DNA, 22 bp, Homo sapiens
ggcccagctttcattccttgct

SEQ ID NO: 10005738 - DNA, 22 bp, Homo sapiens
ggcccagctgtgcttccagccc

SEQ ID NO: 10005739 - DNA, 20 bp, Homo sapiens
ggccagctggaggcgccggg

SEQ ID NO: 10005740 - DNA, 22 bp, Homo sapiens
ggccagctggatgtgggtgacg

SEQ ID NO: 10005741 - DNA, 22 bp, Homo sapiens
ggccagctggagttccgggtgg

SEQ ID NO: 10005742 - DNA, 22 bp, Homo sapiens
ggccagctgggccaccaggtgc

SEQ ID NO: 10005743 - DNA, 22 bp, Homo sapiens
ggccagctggatgtgggtgacg

SEQ ID NO: 10005744 - DNA, 22 bp, Homo sapiens
ggcccagctctattgaattaca

SEQ ID NO: 10005745 - DNA, 22 bp, Homo sapiens
ggccagctgccaccagccctat

SEQ ID NO: 10005746 - DNA, 22 bp, Homo sapiens
ggccagctgcctgaccttctgt

SEQ ID NO: 10005747 - DNA, 22 bp, Homo sapiens
ggccagctgctcagtgtctctg

SEQ ID NO: 10005748 - DNA, 22 bp, Homo sapiens
ggccagctgagctgctgcacag

SEQ ID NO: 10005749 - DNA, 21 bp, Homo sapiens
ggccagctgcatatgtcactg

SEQ ID NO: 10005750 - DNA, 21 bp, Homo sapiens
ggccagctgcatatgtcactg

SEQ ID NO: 10005751 - DNA, 20 bp, Homo sapiens
ggccagctgatgcacgatgc

SEQ ID NO: 10005752 - DNA, 22 bp, Homo sapiens
ggccagcagtcacagggtcaga

SEQ ID NO: 10005753 - DNA, 22 bp, Homo sapiens
ggccagcagtcacagggtcaga

SEQ ID NO: 10005754 - DNA, 22 bp, Homo sapiens
ggccagcagtcacagggtcaga

SEQ ID NO: 10005755 - DNA, 22 bp, Homo sapiens
ggccagcagtcacagggtcaga

SEQ ID NO: 10005756 - DNA, 22 bp, Homo sapiens
ggccagcagtatatagctaatt

SEQ ID NO: 10005757 - DNA, 22 bp, Homo sapiens
ggccagctctgcacagcagctg

SEQ ID NO: 10005758 - DNA, 22 bp, Homo sapiens
ggccagctcttgtccacggagg

SEQ ID NO: 10005759 - DNA, 22 bp, Homo sapiens
ggccagctcttgtccacggagg

SEQ ID NO: 10005760 - DNA, 22 bp, Homo sapiens
ggccagctgagctgctgcacag

SEQ ID NO: 10005761 - DNA, 22 bp, Homo sapiens
ggccagcatggcaagaccaact

SEQ ID NO: 10005762 - DNA, 22 bp, Homo sapiens
ggccagcatggcaagaccaact

SEQ ID NO: 10005763 - DNA, 22 bp, Homo sapiens
ggccagcatggcaagaccaact

SEQ ID NO: 10005764 - DNA, 22 bp, Homo sapiens
ggctctgccgtgtgctcacatg

SEQ ID NO: 10005765 - DNA, 22 bp, Homo sapiens
ggctctgcagagggcccagctt

SEQ ID NO: 10005766 - DNA, 22 bp, Homo sapiens
ggctctgagtttagaagggtgg

SEQ ID NO: 10005767 - DNA, 22 bp, Homo sapiens
ggctctgaggcagatcgatggg

SEQ ID NO: 10005768 - DNA, 23 bp, Homo sapiens
ggctctgaggatggagctggtgg

SEQ ID NO: 10005769 - DNA, 22 bp, Homo sapiens
ggctctgaagggtgacaggttt

SEQ ID NO: 10005770 - DNA, 22 bp, Homo sapiens
ggctctgaattattcctgagtc

SEQ ID NO: 10005771 - DNA, 22 bp, Homo sapiens
ggctcactgcaacttccgcctc

SEQ ID NO: 10005772 - DNA, 22 bp, Homo sapiens
ggctcagcaatgatgagcccct

SEQ ID NO: 10005773 - DNA, 22 bp, Homo sapiens
ggctcagattccgagtggccct

SEQ ID NO: 10005774 - DNA, 22 bp, Homo sapiens
ggctctgaaattctcactttta

SEQ ID NO: 10005775 - DNA, 22 bp, Homo sapiens
ggctctgaacatggggaggagt

SEQ ID NO: 10005776 - DNA, 22 bp, Homo sapiens
ggctctgaacatggggaggagt

SEQ ID NO: 10005777 - DNA, 22 bp, Homo sapiens
ggctctgaacatggggaggagt

SEQ ID NO: 10005778 - DNA, 21 bp, Homo sapiens
ggcctcccggaccgcagcgcc

SEQ ID NO: 10005779 - DNA, 22 bp, Homo sapiens
ggcccatgcatcctgtgcagcc

SEQ ID NO: 10005780 - DNA, 22 bp, Homo sapiens
ggcctctgcaactggctgtggc

SEQ ID NO: 10005781 - DNA, 22 bp, Homo sapiens
ggcctctgcaggcctcgacaag

SEQ ID NO: 10005782 - DNA, 22 bp, Homo sapiens
ggcctctgcaggcctcgacaag

SEQ ID NO: 10005783 - DNA, 22 bp, Homo sapiens
ggcctctgccccagccacacct

SEQ ID NO: 10005784 - DNA, 22 bp, Homo sapiens
ggcctctgcctcatctgggcac

SEQ ID NO: 10005785 - DNA, 22 bp, Homo sapiens
ggctcaccattttcactctctg

SEQ ID NO: 10005786 - DNA, 22 bp, Homo sapiens
ggctcaccatggcctccctgct

SEQ ID NO: 10005787 - DNA, 22 bp, Homo sapiens
ggctagggacacagctctgctc

SEQ ID NO: 10005788 - DNA, 22 bp, Homo sapiens
ggctagggaaatcctgatccaa

SEQ ID NO: 10005789 - DNA, 22 bp, Homo sapiens
ggctagggaaaatgattggata

SEQ ID NO: 10005790 - DNA, 22 bp, Homo sapiens
ggctcacgcaattatcccggcc

SEQ ID NO: 10005791 - DNA, 22 bp, Homo sapiens
ggctcacgcaattatcccggcc

SEQ ID NO: 10005792 - DNA, 22 bp, Homo sapiens
ggctcacgcaattatcccggcc

SEQ ID NO: 10005793 - DNA, 22 bp, Homo sapiens
ggctcactgcaacttccgcctc

SEQ ID NO: 10005794 - DNA, 22 bp, Homo sapiens
ggctcactgcaacttccgcctc

SEQ ID NO: 10005795 - DNA, 18 bp, Homo sapiens
ggcctctggactggcagc

SEQ ID NO: 10005796 - DNA, 22 bp, Homo sapiens
ggcctctgcttatgctgatgac

SEQ ID NO: 10005797 - DNA, 18 bp, Homo sapiens
ggcctctggactggcagc

SEQ ID NO: 10005798 - DNA, 22 bp, Homo sapiens
ggctaggctcacctggagagtt

SEQ ID NO: 10005799 - DNA, 22 bp, Homo sapiens
ggcctctggtgcctgaagcgcc

SEQ ID NO: 10005800 - DNA, 22 bp, Homo sapiens
ggcctctggtcaagacaagcat

SEQ ID NO: 10005801 - DNA, 22 bp, Homo sapiens
ttggcagtgtctgcaaaatgga

SEQ ID NO: 10005802 - DNA, 20 bp, Homo sapiens
ttggcagttaagaatcttac

SEQ ID NO: 10005803 - DNA, 22 bp, Homo sapiens
ttggcaggatgatagctttgtg

SEQ ID NO: 10005804 - DNA, 22 bp, Homo sapiens
ttggaggaggcattggaggatt

SEQ ID NO: 10005805 - DNA, 20 bp, Homo sapiens
ttggcagcagttccaagtga

SEQ ID NO: 10005806 - DNA, 22 bp, Homo sapiens
ttggcagcagggagttggccgc

SEQ ID NO: 10005807 - DNA, 22 bp, Homo sapiens
ttggcagcatacagttggattg

SEQ ID NO: 10005808 - DNA, 22 bp, Homo sapiens
ttggcagcatacagttggattg

SEQ ID NO: 10005809 - DNA, 22 bp, Homo sapiens
ttggcagcattccagccaagca

SEQ ID NO: 10005810 - DNA, 22 bp, Homo sapiens
ttggcagcatccaagtctcggg

SEQ ID NO: 10005811 - DNA, 22 bp, Homo sapiens
ttggcagctacttccccagtgc

SEQ ID NO: 10005812 - DNA, 23 bp, Homo sapiens
ttggcagcgggtcaggctgtggg

SEQ ID NO: 10005813 - DNA, 22 bp, Homo sapiens
ttggcagccaggacccgcctgg

SEQ ID NO: 10005814 - DNA, 22 bp, Homo sapiens
ttggcagcggggaccctggctg

SEQ ID NO: 10005815 - DNA, 22 bp, Homo sapiens
ttggcagccctgacccaatggg

SEQ ID NO: 10005816 - DNA, 22 bp, Homo sapiens
ttggcagcccagcttactagca

SEQ ID NO: 10005817 - DNA, 22 bp, Homo sapiens
ttggcagctcttgatggcaccc

SEQ ID NO: 10005818 - DNA, 19 bp, Homo sapiens
ttggcagctgagatcctgc

SEQ ID NO: 10005819 - DNA, 22 bp, Homo sapiens
ttggcagctgcacagactccat

SEQ ID NO: 10005820 - DNA, 22 bp, Homo sapiens
ttggcagctgttggaccttgac

SEQ ID NO: 10005821 - DNA, 20 bp, Homo sapiens
ttggcagcttcagggtacta

SEQ ID NO: 10005822 - DNA, 22 bp, Homo sapiens
ttggagatatgtgaaaaaaaca

SEQ ID NO: 10005823 - DNA, 22 bp, Homo sapiens
ttggagatgtaaaattcagaga

SEQ ID NO: 10005824 - DNA, 22 bp, Homo sapiens
ttggacctcagttattctatca

SEQ ID NO: 10005825 - DNA, 22 bp, Homo sapiens
ttggacagtaaattgtgcttaa

SEQ ID NO: 10005826 - DNA, 22 bp, Homo sapiens
ttggagaactggcatttttaat

SEQ ID NO: 10005827 - DNA, 22 bp, Homo sapiens
ttgggcagtgattagttcatga

SEQ ID NO: 10005828 - DNA, 22 bp, Homo sapiens
ttgggcagtgattagttcatga

SEQ ID NO: 10005829 - DNA, 22 bp, Homo sapiens
ttgggcagggaaaggacaggca

SEQ ID NO: 10005830 - DNA, 22 bp, Homo sapiens
ttgggaggtaatggagccaagt

SEQ ID NO: 10005831 - DNA, 22 bp, Homo sapiens
ttgggcagtagcctcttggtgt

SEQ ID NO: 10005832 - DNA, 22 bp, Homo sapiens
ttgggagatattgttctttaca

SEQ ID NO: 10005833 - DNA, 22 bp, Homo sapiens
ttgggagatggggagataatat

SEQ ID NO: 10005834 - DNA, 22 bp, Homo sapiens
ttgggagattcattgagccaag

SEQ ID NO: 10005835 - DNA, 22 bp, Homo sapiens
ttgggagattcattgagccaag

SEQ ID NO: 10005836 - DNA, 22 bp, Homo sapiens
ttgggacatctggcatacagtt

SEQ ID NO: 10005837 - DNA, 22 bp, Homo sapiens
ttgggagaaatagttgatccgc

SEQ ID NO: 10005838 - DNA, 22 bp, Homo sapiens
ttgggaagtaatatggtggtct

SEQ ID NO: 10005839 - DNA, 22 bp, Homo sapiens
ttgggaagaatggaggtggtta

SEQ ID NO: 10005840 - DNA, 22 bp, Homo sapiens
ttggcccacagtaccatgctgt

SEQ ID NO: 10005841 - DNA, 22 bp, Homo sapiens
ttgggacagaaaaggagaagat

SEQ ID NO: 10005842 - DNA, 22 bp, Homo sapiens
ttggccagtgaaccaggcctgg

SEQ ID NO: 10005843 - DNA, 22 bp, Homo sapiens
ttggccatctaagcccagccac

SEQ ID NO: 10005844 - DNA, 22 bp, Homo sapiens
ttggccaggtccatttctccat

SEQ ID NO: 10005845 - DNA, 22 bp, Homo sapiens
ttggccagcgacgaccttctta

SEQ ID NO: 10005846 - DNA, 22 bp, Homo sapiens
ttggccagcgacgaccttctta

SEQ ID NO: 10005847 - DNA, 22 bp, Homo sapiens
ttggcatccactttgcaagttt

SEQ ID NO: 10005848 - DNA, 22 bp, Homo sapiens
ttgtggcagaccatgagtctaa

SEQ ID NO: 10005849 - DNA, 22 bp, Homo sapiens
ttgtggctcgtgagatgttagg

SEQ ID NO: 10005850 - DNA, 22 bp, Homo sapiens
ttgtgtcaggggcccatactca

SEQ ID NO: 10005851 - DNA, 22 bp, Homo sapiens
ttgtgtactgttggttgatatt

SEQ ID NO: 10005852 - DNA, 22 bp, Homo sapiens
ttgtgtcatgttccattgaaaa

SEQ ID NO: 10005853 - DNA, 22 bp, Homo sapiens
ttgtgtccccctttgagagcca

SEQ ID NO: 10005854 - DNA, 22 bp, Homo sapiens
ttgtgtcttaaagattaaatgg

SEQ ID NO: 10005855 - DNA, 22 bp, Homo sapiens
ttgtgtctggaatgcgtggagc

SEQ ID NO: 10005856 - DNA, 22 bp, Homo sapiens
ttgtgtctgggggagtgacatc

SEQ ID NO: 10005857 - DNA, 22 bp, Homo sapiens
ttgtgtctggatttcagctttc

SEQ ID NO: 10005858 - DNA, 22 bp, Homo sapiens
ttgtgtctatggtttgagcatc

SEQ ID NO: 10005859 - DNA, 23 bp, Homo sapiens
ttgtgtctacttcctatctaggg

SEQ ID NO: 10005860 - DNA, 22 bp, Homo sapiens
ttgtgtctatggtttgagcatc

SEQ ID NO: 10005861 - DNA, 22 bp, Homo sapiens
ttgtgtctggaatgcgtggagc

SEQ ID NO: 10005862 - DNA, 22 bp, Homo sapiens
ttgtgtctaaataaggagacct

SEQ ID NO: 10005863 - DNA, 23 bp, Homo sapiens
ttgtgtctacttcctatctaggg

SEQ ID NO: 10005864 - DNA, 22 bp, Homo sapiens
ttgtgtcctgatttgacacaat

SEQ ID NO: 10005865 - DNA, 22 bp, Homo sapiens
ttgtgtctaaataaggagacct

SEQ ID NO: 10005866 - DNA, 22 bp, Homo sapiens
ttgtgtccccctttgagagcca

SEQ ID NO: 10005867 - DNA, 22 bp, Homo sapiens
ttgtgtccccctttgagagcca

SEQ ID NO: 10005868 - DNA, 22 bp, Homo sapiens
ttgtcatcaagatgcattggtc

SEQ ID NO: 10005869 - DNA, 22 bp, Homo sapiens
ttgtcatatttataaaatgtaa

SEQ ID NO: 10005870 - DNA, 22 bp, Homo sapiens
ttgtcatatttataaaatgtaa

SEQ ID NO: 10005871 - DNA, 22 bp, Homo sapiens
ttgtcctgcaacctcacatggc

SEQ ID NO: 10005872 - DNA, 22 bp, Homo sapiens
ttgtcctggaggttaatagagt

SEQ ID NO: 10005873 - DNA, 22 bp, Homo sapiens
ttgtccattttattggatggtg

SEQ ID NO: 10005874 - DNA, 22 bp, Homo sapiens
ttgtccattgtgacaagtgtgg

SEQ ID NO: 10005875 - DNA, 22 bp, Homo sapiens
ttgtccatggacagcaccacag

SEQ ID NO: 10005876 - DNA, 22 bp, Homo sapiens
ttgtccatctgtatttcccatg

SEQ ID NO: 10005877 - DNA, 22 bp, Homo sapiens
ttgtccattttattggatggtg

SEQ ID NO: 10005878 - DNA, 23 bp, Homo sapiens
ttgtccagctggtttgggccaca

SEQ ID NO: 10005879 - DNA, 23 bp, Homo sapiens
ttgtatttttagtagagacaggg

SEQ ID NO: 10005880 - DNA, 22 bp, Homo sapiens
ttgtatttctccactttctgtt

SEQ ID NO: 10005881 - DNA, 22 bp, Homo sapiens
ttgtatttcgatgcacgtgtag

SEQ ID NO: 10005882 - DNA, 22 bp, Homo sapiens
ttgtacagggaagtaatacaag

SEQ ID NO: 10005883 - DNA, 22 bp, Homo sapiens
ttgtactagaaaggatgtcaaa

SEQ ID NO: 10005884 - DNA, 22 bp, Homo sapiens
ttgtactatcaccatgtcatgt

SEQ ID NO: 10005885 - DNA, 22 bp, Homo sapiens
ttgtactatcaccatgtcatgt

SEQ ID NO: 10005886 - DNA, 22 bp, Homo sapiens
ttgtactagaaaattattcttt

SEQ ID NO: 10005887 - DNA, 22 bp, Homo sapiens
ttgtacaagtattatgtgaaca

SEQ ID NO: 10005888 - DNA, 22 bp, Homo sapiens
ttgtaagactgtagaatgcaaa

SEQ ID NO: 10005889 - DNA, 22 bp, Homo sapiens
ttgtaagatggataggaacagc

SEQ ID NO: 10005890 - DNA, 22 bp, Homo sapiens
ttgtacaagttttgagcttaag

SEQ ID NO: 10005891 - DNA, 22 bp, Homo sapiens
ttgtacaagtattatgtgaaca

SEQ ID NO: 10005892 - DNA, 22 bp, Homo sapiens
ttgtacaatggatgccagatga

SEQ ID NO: 10005893 - DNA, 22 bp, Homo sapiens
ttgtacaagttttgagcttaag

SEQ ID NO: 10005894 - DNA, 22 bp, Homo sapiens
ttgtacaatggatgccagatga

SEQ ID NO: 10005895 - DNA, 22 bp, Homo sapiens
ttgtacacaattcttaacatac

SEQ ID NO: 10005896 - DNA, 22 bp, Homo sapiens
ttgtaaagtacttagcacagca

SEQ ID NO: 10005897 - DNA, 22 bp, Homo sapiens
ttgtaaagtacttagcacagca

SEQ ID NO: 10005898 - DNA, 22 bp, Homo sapiens
ttgtaaatagtagtaagatgcc

SEQ ID NO: 10005899 - DNA, 22 bp, Homo sapiens
ttgtaaatgaccttttctaatt

SEQ ID NO: 10005900 - DNA, 22 bp, Homo sapiens
ttgggcctgatcggaataagga

SEQ ID NO: 10005901 - DNA, 23 bp, Homo sapiens
ttgtaaaacagtgtgacggttcc

SEQ ID NO: 10005902 - DNA, 22 bp, Homo sapiens
ttgtaaacatagagatttaggt

SEQ ID NO: 10005903 - DNA, 22 bp, Homo sapiens
ttgtaaacatctgttgcttaga

SEQ ID NO: 10005904 - DNA, 22 bp, Homo sapiens
ttgtaaactggatagacctatt

SEQ ID NO: 10005905 - DNA, 22 bp, Homo sapiens
ttgtaaacttgtttgaaggtat

SEQ ID NO: 10005906 - DNA, 22 bp, Homo sapiens
ttgtaaactgctgcaggagtgc

SEQ ID NO: 10005907 - DNA, 22 bp, Homo sapiens
ttgtaaactgttaaaagccaga

SEQ ID NO: 10005908 - DNA, 22 bp, Homo sapiens
ttgtaacaaagacactccaaaa

SEQ ID NO: 10005909 - DNA, 22 bp, Homo sapiens
ttgtaacagctgcttaatagag

SEQ ID NO: 10005910 - DNA, 22 bp, Homo sapiens
ttgtaagaatatgaatacaaat

SEQ ID NO: 10005911 - DNA, 22 bp, Homo sapiens
ttgtaacatcaccatcaaaatc

SEQ ID NO: 10005912 - DNA, 22 bp, Homo sapiens
ttgcagagccatgaggctggct

SEQ ID NO: 10005913 - DNA, 22 bp, Homo sapiens
ttgcagaggcaaaaatgaactc

SEQ ID NO: 10005914 - DNA, 22 bp, Homo sapiens
ttgcagagtggttgtgaggatt

SEQ ID NO: 10005915 - DNA, 22 bp, Homo sapiens
ttgcagagtggttgtgaggatt

SEQ ID NO: 10005916 - DNA, 22 bp, Homo sapiens
ttgcagagcagtaggaatatag

SEQ ID NO: 10005917 - DNA, 22 bp, Homo sapiens
ttgcagagccatgaggctggct

SEQ ID NO: 10005918 - DNA, 22 bp, Homo sapiens
ttgcagagatcagcaggtttga

SEQ ID NO: 10005919 - DNA, 22 bp, Homo sapiens
ttgcagaatctcaggaaggaga

SEQ ID NO: 10005920 - DNA, 22 bp, Homo sapiens
ttgcagagaggttaggaactca

SEQ ID NO: 10005921 - DNA, 22 bp, Homo sapiens
ttgcagaatacttattctgtat

SEQ ID NO: 10005922 - DNA, 22 bp, Homo sapiens
ttgcagaagcctgttgttcctg

SEQ ID NO: 10005923 - DNA, 22 bp, Homo sapiens
ttgcaattaacatatgtcaact

SEQ ID NO: 10005924 - DNA, 22 bp, Homo sapiens
ttgcacaaaaaattgttgaata

SEQ ID NO: 10005925 - DNA, 22 bp, Homo sapiens
ttgcaattgctatggagagcgt

SEQ ID NO: 10005926 - DNA, 22 bp, Homo sapiens
ttgacagaaatgtatttgcatg

SEQ ID NO: 10005927 - DNA, 22 bp, Homo sapiens
ttgacacattagagcttgtaaa

SEQ ID NO: 10005928 - DNA, 22 bp, Homo sapiens
ttgacacagtcaacttgatttt

SEQ ID NO: 10005929 - DNA, 22 bp, Homo sapiens
ttgacacagttttctcattaag

SEQ ID NO: 10005930 - DNA, 22 bp, Homo sapiens
ttgacagagctaggtcaactct

SEQ ID NO: 10005931 - DNA, 22 bp, Homo sapiens
ttgacagaatgttacatataga

SEQ ID NO: 10005932 - DNA, 22 bp, Homo sapiens
ttgacagagaaaagtgtgactt

SEQ ID NO: 10005933 - DNA, 22 bp, Homo sapiens
ttgacagatgtgaaagtgagca

SEQ ID NO: 10005934 - DNA, 22 bp, Homo sapiens
ttgacaaaaacctcatttcacc

SEQ ID NO: 10005935 - DNA, 22 bp, Homo sapiens
ttgacaaaacaacacagatttc

SEQ ID NO: 10005936 - DNA, 22 bp, Homo sapiens
ttgacaaaacaacacagatttc

SEQ ID NO: 10005937 - DNA, 22 bp, Homo sapiens
ttgacaaaggaccttgctattt

SEQ ID NO: 10005938 - DNA, 22 bp, Homo sapiens
ttgacaaaggaattgaatctct

SEQ ID NO: 10005939 - DNA, 22 bp, Homo sapiens
ttgacaaaggaattgaatctct

SEQ ID NO: 10005940 - DNA, 22 bp, Homo sapiens
ttgacaaagatatattcatgct

SEQ ID NO: 10005941 - DNA, 22 bp, Homo sapiens
ttgacacagatcaatattcaac

SEQ ID NO: 10005942 - DNA, 22 bp, Homo sapiens
ttgacacagatcaatattcaac

SEQ ID NO: 10005943 - DNA, 22 bp, Homo sapiens
ttgacacaatgtatattttcaa

SEQ ID NO: 10005944 - DNA, 22 bp, Homo sapiens
ttgacacaaacagtgatgtagt

SEQ ID NO: 10005945 - DNA, 22 bp, Homo sapiens
ttgacaatgcactgtgctaagt

SEQ ID NO: 10005946 - DNA, 22 bp, Homo sapiens
ttgacaatgtcctttgaatttc

SEQ ID NO: 10005947 - DNA, 22 bp, Homo sapiens
ttgacaagtggagatatttaag

SEQ ID NO: 10005948 - DNA, 22 bp, Homo sapiens
ttgacaagaatcgttgccttgg

SEQ ID NO: 10005949 - DNA, 22 bp, Homo sapiens
ttgacaaggagccattgcatct

SEQ ID NO: 10005950 - DNA, 22 bp, Homo sapiens
ttgacaagtaatacttaaatta

SEQ ID NO: 10005951 - DNA, 22 bp, Homo sapiens
ttgacaaagtttagtaataatc

SEQ ID NO: 10005952 - DNA, 22 bp, Homo sapiens
ttgacaaagtttagtaataatc

SEQ ID NO: 10005953 - DNA, 22 bp, Homo sapiens
ttgacaaatacccattagacca

SEQ ID NO: 10005954 - DNA, 22 bp, Homo sapiens
ttgcagattaaaacactgagct

SEQ ID NO: 10005955 - DNA, 20 bp, Homo sapiens
ttgcagcagtgaggtgaagg

SEQ ID NO: 10005956 - DNA, 19 bp, Homo sapiens
ttgcagcaaagttaggacc

SEQ ID NO: 10005957 - DNA, 22 bp, Homo sapiens
ttgcagcatgcatagacactgc

SEQ ID NO: 10005958 - DNA, 22 bp, Homo sapiens
ttgcagcatattgatctcctgt

SEQ ID NO: 10005959 - DNA, 22 bp, Homo sapiens
ttgcagctgttgcaaagtctct

SEQ ID NO: 10005960 - DNA, 22 bp, Homo sapiens
ttgcagggacctgcagaaagct

SEQ ID NO: 10005961 - DNA, 22 bp, Homo sapiens
ttgcagggacctgcagaaagct

SEQ ID NO: 10005962 - DNA, 22 bp, Homo sapiens
ttgcagggaaatcagtgaggat

SEQ ID NO: 10005963 - DNA, 22 bp, Homo sapiens
ttgcagggaaatagaaataaac

SEQ ID NO: 10005964 - DNA, 22 bp, Homo sapiens
ttgcagggattaccttattttt

SEQ ID NO: 10005965 - DNA, 23 bp, Homo sapiens
ttgcagggatggagttcaaaatg

SEQ ID NO: 10005966 - DNA, 22 bp, Homo sapiens
ttgcagggataaaacaagtgaa

SEQ ID NO: 10005967 - DNA, 22 bp, Homo sapiens
ttgcagggaaacagtttaggaa

SEQ ID NO: 10005968 - DNA, 22 bp, Homo sapiens
ttgcagggtcctgtggctctcc

SEQ ID NO: 10005969 - DNA, 22 bp, Homo sapiens
ttgcagggtcccagaggcctgg

SEQ ID NO: 10005970 - DNA, 22 bp, Homo sapiens
ttgcagggtacattcttagaat

SEQ ID NO: 10005971 - DNA, 22 bp, Homo sapiens
ttgcaggggagaggaacaaaca

SEQ ID NO: 10005972 - DNA, 22 bp, Homo sapiens
ttgcaggggaaggagcagagct

SEQ ID NO: 10005973 - DNA, 22 bp, Homo sapiens
ttgcaggggaaggagcagagct

SEQ ID NO: 10005974 - DNA, 22 bp, Homo sapiens
ttgcagggcaaatggtcagata

SEQ ID NO: 10005975 - DNA, 22 bp, Homo sapiens
ttgcagggcaggaccatggaca

SEQ ID NO: 10005976 - DNA, 22 bp, Homo sapiens
ttgcagggcatcgcgtacttct

SEQ ID NO: 10005977 - DNA, 22 bp, Homo sapiens
ttgcagggcaggaccatggaca

SEQ ID NO: 10005978 - DNA, 22 bp, Homo sapiens
ttgcagggcttggggattacag

SEQ ID NO: 10005979 - DNA, 22 bp, Homo sapiens
ttgcagggctggaacatggaat

SEQ ID NO: 10005980 - DNA, 22 bp, Homo sapiens
ttgcagggccttggcttcttcc

SEQ ID NO: 10005981 - DNA, 22 bp, Homo sapiens
ttgcagggctggaacatggaat

SEQ ID NO: 10005982 - DNA, 22 bp, Homo sapiens
ttgcagggcatctatgtctggt

SEQ ID NO: 10005983 - DNA, 22 bp, Homo sapiens
ttgcagggttgaccaataggct

SEQ ID NO: 10005984 - DNA, 22 bp, Homo sapiens
ttgcagggttgacactgcctgc

SEQ ID NO: 10005985 - DNA, 22 bp, Homo sapiens
ttgcagggttaaagtaaggtag

SEQ ID NO: 10005986 - DNA, 18 bp, Homo sapiens
ttgcaggtacctctatct

SEQ ID NO: 10005987 - DNA, 22 bp, Homo sapiens
ttgcagttgctgtatttaagga

SEQ ID NO: 10005988 - DNA, 22 bp, Homo sapiens
ttgcttagagccaatcttgatt

SEQ ID NO: 10005989 - DNA, 21 bp, Homo sapiens
ttgcttatggcactgctttgc

SEQ ID NO: 10005990 - DNA, 22 bp, Homo sapiens
ttgcttatagagagtttcatac

SEQ ID NO: 10005991 - DNA, 21 bp, Homo sapiens
ttgcttatggcactgctttgc

SEQ ID NO: 10005992 - DNA, 21 bp, Homo sapiens
ttgctgttttcccaatgcagt

SEQ ID NO: 10005993 - DNA, 21 bp, Homo sapiens
ttgctgttttcccaatgcagt

SEQ ID NO: 10005994 - DNA, 23 bp, Homo sapiens
ttgctgagataaagaatgcaggg

SEQ ID NO: 10005995 - DNA, 22 bp, Homo sapiens
ttgctgtgaaaccatgggaagt

SEQ ID NO: 10005996 - DNA, 22 bp, Homo sapiens
ttgctgtgtaactcctggcctg

SEQ ID NO: 10005997 - DNA, 22 bp, Homo sapiens
ttgctgtgtctgatggctgaga

SEQ ID NO: 10005998 - DNA, 22 bp, Homo sapiens
ttgctgtgtctgatggctgaga

SEQ ID NO: 10005999 - DNA, 22 bp, Homo sapiens
ttgctgtgtcatttgtttaatc

SEQ ID NO: 10006000 - DNA, 22 bp, Homo sapiens
ttgctgtgtaactcctggcctg

SEQ ID NO: 10006001 - DNA, 22 bp, Homo sapiens
ttgctgaaaacaggtcatcagg

SEQ ID NO: 10006002 - DNA, 22 bp, Homo sapiens
ttgctcttgaaaattgatgctg

SEQ ID NO: 10006003 - DNA, 22 bp, Homo sapiens
ttgctgaagaaaaaatatgtta

SEQ ID NO: 10006004 - DNA, 22 bp, Homo sapiens
ttgcatgtgtataaaagttgga

SEQ ID NO: 10006005 - DNA, 22 bp, Homo sapiens
ttgctctgtcagggcctcagtc

SEQ ID NO: 10006006 - DNA, 22 bp, Homo sapiens
ttgctctgtaataatctggggt

SEQ ID NO: 10006007 - DNA, 22 bp, Homo sapiens
ttgctctgtcagggcctcagtc

SEQ ID NO: 10006008 - DNA, 22 bp, Homo sapiens
ttgctctgtaataatctggggt

SEQ ID NO: 10006009 - DNA, 22 bp, Homo sapiens
ttgctctgattaggtggaaaca

SEQ ID NO: 10006010 - DNA, 22 bp, Homo sapiens
ttgctctgattaggtggaaaca

SEQ ID NO: 10006011 - DNA, 22 bp, Homo sapiens
ttgctctgactggagtgcagtg

SEQ ID NO: 10006012 - DNA, 22 bp, Homo sapiens
ttgctctgaacccagggcacca

SEQ ID NO: 10006013 - DNA, 22 bp, Homo sapiens
ttgctctccagaggctcacagc

SEQ ID NO: 10006014 - DNA, 22 bp, Homo sapiens
ttgctcattccgtgagaagatc

SEQ ID NO: 10006015 - DNA, 22 bp, Homo sapiens
ttgctcatatttgcatgtgttt

SEQ ID NO: 10006016 - DNA, 22 bp, Homo sapiens
ttgctcatttgcctttaggttt

SEQ ID NO: 10006017 - DNA, 22 bp, Homo sapiens
ttgcttatttgattaaatgtct

SEQ ID NO: 10006018 - DNA, 22 bp, Homo sapiens
ttgctttatttggcatgccact

SEQ ID NO: 10006019 - DNA, 22 bp, Homo sapiens
ttgctttattgggtttactgcc

SEQ ID NO: 10006020 - DNA, 22 bp, Homo sapiens
ttgctttattgggtttactgcc

SEQ ID NO: 10006021 - DNA, 22 bp, Homo sapiens
ttggaaaccaggctttgagacg

SEQ ID NO: 10006022 - DNA, 22 bp, Homo sapiens
ttggaaaatgtatttctagaag

SEQ ID NO: 10006023 - DNA, 23 bp, Homo sapiens
ttgctttcatcatgagatgctcc

SEQ ID NO: 10006024 - DNA, 22 bp, Homo sapiens
ttgctttccgtcatgtgctaat

SEQ ID NO: 10006025 - DNA, 22 bp, Homo sapiens
ttggaaacttggatggaaaacc

SEQ ID NO: 10006026 - DNA, 22 bp, Homo sapiens
ttggaaagattattattatgaa

SEQ ID NO: 10006027 - DNA, 22 bp, Homo sapiens
ttggaaagcaacttttgagagt

SEQ ID NO: 10006028 - DNA, 22 bp, Homo sapiens
ttggaaagggaggaatgtagac

SEQ ID NO: 10006029 - DNA, 22 bp, Homo sapiens
ttggaatttagtaaaataatgc

SEQ ID NO: 10006030 - DNA, 22 bp, Homo sapiens
ttggaattgtgaactaagtgat

SEQ ID NO: 10006031 - DNA, 22 bp, Homo sapiens
ttggaattcctgttgtttcgtc

SEQ ID NO: 10006032 - DNA, 22 bp, Homo sapiens
ttggaattgaggatttacatag

SEQ ID NO: 10006033 - DNA, 22 bp, Homo sapiens
ttggacagaattttgtgtgtgt

SEQ ID NO: 10006034 - DNA, 22 bp, Homo sapiens
ttggacagtaaattgtgcttaa

SEQ ID NO: 10006035 - DNA, 21 bp, Homo sapiens
ttggaatttgggagctatgtg

SEQ ID NO: 10006036 - DNA, 21 bp, Homo sapiens
ttggaatttgggagctatgtg

SEQ ID NO: 10006037 - DNA, 22 bp, Homo sapiens
ttggaaatgcaaatatattgaa

SEQ ID NO: 10006038 - DNA, 22 bp, Homo sapiens
ttggaaatgcaaatatattgaa

SEQ ID NO: 10006039 - DNA, 22 bp, Homo sapiens
ttggaaatgatttctattatta

SEQ ID NO: 10006040 - DNA, 22 bp, Homo sapiens
ttggaaatacagcagttacttt

SEQ ID NO: 10006041 - DNA, 22 bp, Homo sapiens
ttggaaatacagcagttacttt

SEQ ID NO: 10006042 - DNA, 22 bp, Homo sapiens
ttggaaatacagcagttacttt

SEQ ID NO: 10006043 - DNA, 22 bp, Homo sapiens
ttggaaattgcaagtgatttgc

SEQ ID NO: 10006044 - DNA, 22 bp, Homo sapiens
ttggaaattgcaagtgatttgc

SEQ ID NO: 10006045 - DNA, 22 bp, Homo sapiens
ttggaaatgtagaaaagcagat

SEQ ID NO: 10006046 - DNA, 22 bp, Homo sapiens
ttggaaatgcatttgttattat

SEQ ID NO: 10006047 - DNA, 22 bp, Homo sapiens
ttggaaatggctgtagttatga

SEQ ID NO: 10006048 - DNA, 22 bp, Homo sapiens
ttggaaatggctgtagttatga

SEQ ID NO: 10006049 - DNA, 22 bp, Homo sapiens
ttggaaatggctgtagttatga

SEQ ID NO: 10006050 - DNA, 23 bp, Homo sapiens
ttggaaatggggagaacagattc

SEQ ID NO: 10006051 - DNA, 17 bp, Homo sapiens
tttaaactactacaagg

SEQ ID NO: 10006052 - DNA, 17 bp, Homo sapiens
tttaaactactacaagg

SEQ ID NO: 10006053 - DNA, 22 bp, Homo sapiens
tttaaagaaattcctcatcttt

SEQ ID NO: 10006054 - DNA, 22 bp, Homo sapiens
tttaaactaacagtacacgttg

SEQ ID NO: 10006055 - DNA, 22 bp, Homo sapiens
tttaaagaaattcctcatcttt

SEQ ID NO: 10006056 - DNA, 21 bp, Homo sapiens
tttaaagaataggaagggagg

SEQ ID NO: 10006057 - DNA, 22 bp, Homo sapiens
tttaaagagaatgtgaaggagt

SEQ ID NO: 10006058 - DNA, 17 bp, Homo sapiens
ttgtgtgtagttctgat

SEQ ID NO: 10006059 - DNA, 22 bp, Homo sapiens
ttgtgtgtagactcagccattg

SEQ ID NO: 10006060 - DNA, 17 bp, Homo sapiens
ttgtgtgtagttctgat

SEQ ID NO: 10006061 - DNA, 17 bp, Homo sapiens
ttgtgtgtagttctgat

SEQ ID NO: 10006062 - DNA, 22 bp, Homo sapiens
tttaaacatcttgttgccttaa

SEQ ID NO: 10006063 - DNA, 22 bp, Homo sapiens
ttgtgtgtactggttatgggca

SEQ ID NO: 10006064 - DNA, 22 bp, Homo sapiens
ttgtgtgtactggttatgggca

SEQ ID NO: 10006065 - DNA, 22 bp, Homo sapiens
ttgtgtgtagactcagccattg

SEQ ID NO: 10006066 - DNA, 22 bp, Homo sapiens
ttgtgtgtagactcagccattg

SEQ ID NO: 10006067 - DNA, 22 bp, Homo sapiens
ttgtgtgtactggttatgggca

SEQ ID NO: 10006068 - DNA, 22 bp, Homo sapiens
ttgtgtgctgagggcctgctgt

SEQ ID NO: 10006069 - DNA, 22 bp, Homo sapiens
ttgtgtgcataaattctgatgt

SEQ ID NO: 10006070 - DNA, 22 bp, Homo sapiens
tttaaataggactcctgggggt

SEQ ID NO: 10006071 - DNA, 22 bp, Homo sapiens
tttaaatgctttaagcaagggt

SEQ ID NO: 10006072 - DNA, 22 bp, Homo sapiens
tttaaatgcagacgttgattca

SEQ ID NO: 10006073 - DNA, 22 bp, Homo sapiens
tttaaataggactcctgggggt

SEQ ID NO: 10006074 - DNA, 22 bp, Homo sapiens
tttaaataggactcctgggggt

SEQ ID NO: 10006075 - DNA, 22 bp, Homo sapiens
tttaagatggtattttataaag

SEQ ID NO: 10006076 - DNA, 22 bp, Homo sapiens
tttaagatggtattttataaag

SEQ ID NO: 10006077 - DNA, 22 bp, Homo sapiens
tttaaatgttcatgatactgaa

SEQ ID NO: 10006078 - DNA, 22 bp, Homo sapiens
tttaaatgttcatgatactgaa

SEQ ID NO: 10006079 - DNA, 22 bp, Homo sapiens
tttaaatgtttaaaactcgtga

SEQ ID NO: 10006080 - DNA, 22 bp, Homo sapiens
tttaaatgtttaaaactcgtga

SEQ ID NO: 10006081 - DNA, 22 bp, Homo sapiens
tttaaatgtgttcttagtagct

SEQ ID NO: 10006082 - DNA, 22 bp, Homo sapiens
tttaagctaatgtcataattag

SEQ ID NO: 10006083 - DNA, 22 bp, Homo sapiens
tttaagcacagggataaagtta

SEQ ID NO: 10006084 - DNA, 22 bp, Homo sapiens
tttaatctattccctaaacacc

SEQ ID NO: 10006085 - DNA, 22 bp, Homo sapiens
tttaagtgaaatgtaatacagt

SEQ ID NO: 10006086 - DNA, 22 bp, Homo sapiens
tttaaggcagtgaaactattct

SEQ ID NO: 10006087 - DNA, 22 bp, Homo sapiens
tttaatgtagcgtgaaatgatt

SEQ ID NO: 10006088 - DNA, 22 bp, Homo sapiens
tttacaggattaccctggctgc

SEQ ID NO: 10006089 - DNA, 22 bp, Homo sapiens
tttacagcttctatactatgtg

SEQ ID NO: 10006090 - DNA, 22 bp, Homo sapiens
tttacagtctctatagtcaaaa

SEQ ID NO: 10006091 - DNA, 22 bp, Homo sapiens
tttacagtctctatagtcaaaa

SEQ ID NO: 10006092 - DNA, 22 bp, Homo sapiens
tttacagtctatgttgaattaa

SEQ ID NO: 10006093 - DNA, 22 bp, Homo sapiens
tttacagtcaccaaactttgct

SEQ ID NO: 10006094 - DNA, 22 bp, Homo sapiens
tttacagtaaggtggatggtac

SEQ ID NO: 10006095 - DNA, 21 bp, Homo sapiens
tttatcatcacgagcttgagc

SEQ ID NO: 10006096 - DNA, 22 bp, Homo sapiens
tttatccacagtatccaaaatc

SEQ ID NO: 10006097 - DNA, 20 bp, Homo sapiens
tttatcaggcacttactatt

SEQ ID NO: 10006098 - DNA, 20 bp, Homo sapiens
tttatcaggcacttactatt

SEQ ID NO: 10006099 - DNA, 22 bp, Homo sapiens
tttatcagtagcaaagttttaa

SEQ ID NO: 10006100 - DNA, 22 bp, Homo sapiens
tttatcagaggctatgtttcat

SEQ ID NO: 10006101 - DNA, 22 bp, Homo sapiens
tttatcagaggctatgtttcat

SEQ ID NO: 10006102 - DNA, 22 bp, Homo sapiens
tttatcaaacaaattatccagc

SEQ ID NO: 10006103 - DNA, 22 bp, Homo sapiens
tttatcaaacaaattatccagc

SEQ ID NO: 10006104 - DNA, 22 bp, Homo sapiens
tttattcaagatgaggttcatg

SEQ ID NO: 10006105 - DNA, 22 bp, Homo sapiens
tttattcaagatgaggttcatg

SEQ ID NO: 10006106 - DNA, 22 bp, Homo sapiens
tttatctgagctgatagatagt

SEQ ID NO: 10006107 - DNA, 22 bp, Homo sapiens
tttatctgaggaaagcagacaa

SEQ ID NO: 10006108 - DNA, 22 bp, Homo sapiens
tttatccagcagctattcaaaa

SEQ ID NO: 10006109 - DNA, 22 bp, Homo sapiens
tttatccatatcattaaaatct

SEQ ID NO: 10006110 - DNA, 22 bp, Homo sapiens
tttatccatcatctgctgaagg

SEQ ID NO: 10006111 - DNA, 22 bp, Homo sapiens
tttatccattggttagaaaatc

SEQ ID NO: 10006112 - DNA, 22 bp, Homo sapiens
tttatatagagatttgtgcatg

SEQ ID NO: 10006113 - DNA, 22 bp, Homo sapiens
tttatatagagatttgtgcatg

SEQ ID NO: 10006114 - DNA, 22 bp, Homo sapiens
tttatatagagatttgtgcatg

SEQ ID NO: 10006115 - DNA, 22 bp, Homo sapiens
tttatatatggctggtctggat

SEQ ID NO: 10006116 - DNA, 22 bp, Homo sapiens
tttatatagagatttgtgcatg

SEQ ID NO: 10006117 - DNA, 22 bp, Homo sapiens
tttatattgtaaaaatggttct

SEQ ID NO: 10006118 - DNA, 22 bp, Homo sapiens
tttagcagaaactcattaaatt

SEQ ID NO: 10006119 - DNA, 22 bp, Homo sapiens
tttagcagctggtgttaccata

SEQ ID NO: 10006120 - DNA, 22 bp, Homo sapiens
tttagcagctggtgttaccata

SEQ ID NO: 10006121 - DNA, 22 bp, Homo sapiens
tttagcatatcctataaaacta

SEQ ID NO: 10006122 - DNA, 22 bp, Homo sapiens
tttagcagcaaataagtagtgc

SEQ ID NO: 10006123 - DNA, 22 bp, Homo sapiens
tttagcatatcctataaaacta

SEQ ID NO: 10006124 - DNA, 22 bp, Homo sapiens
tttagcatatttaaggaatgat

SEQ ID NO: 10006125 - DNA, 22 bp, Homo sapiens
tttagcatccaaggttatgact

SEQ ID NO: 10006126 - DNA, 20 bp, Homo sapiens
tttacattttgaaacagtga

SEQ ID NO: 10006127 - DNA, 22 bp, Homo sapiens
tttacagtctgtctagcaatgt

SEQ ID NO: 10006128 - DNA, 22 bp, Homo sapiens
tttacagtctgtctagcaatgt

SEQ ID NO: 10006129 - DNA, 22 bp, Homo sapiens
tttacagtctgtctagcaatgt

SEQ ID NO: 10006130 - DNA, 22 bp, Homo sapiens
tttacagtgagagcttagtgag

SEQ ID NO: 10006131 - DNA, 22 bp, Homo sapiens
tttagaagttcacacatttaaa

SEQ ID NO: 10006132 - DNA, 22 bp, Homo sapiens
tttagaagggctggtcagaaat

SEQ ID NO: 10006133 - DNA, 22 bp, Homo sapiens
tttagaagttcacacatttaaa

SEQ ID NO: 10006134 - DNA, 19 bp, Homo sapiens
tttagaagttgaaactctg

SEQ ID NO: 10006135 - DNA, 19 bp, Homo sapiens
tttagaagttgaaactctg

SEQ ID NO: 10006136 - DNA, 19 bp, Homo sapiens
tttagaagttgaaactctg

SEQ ID NO: 10006137 - DNA, 22 bp, Homo sapiens
tttagaaggactacagtgtgat

SEQ ID NO: 10006138 - DNA, 22 bp, Homo sapiens
tttagaagacagatgcacagcc

SEQ ID NO: 10006139 - DNA, 20 bp, Homo sapiens
tttagaagaatgagcacttt

SEQ ID NO: 10006140 - DNA, 22 bp, Homo sapiens
tttaccaagagttgtcactgtt

SEQ ID NO: 10006141 - DNA, 22 bp, Homo sapiens
tttaccaagagttgtcactgtt

SEQ ID NO: 10006142 - DNA, 20 bp, Homo sapiens
tttaccaactcaccagtatc

SEQ ID NO: 10006143 - DNA, 22 bp, Homo sapiens
tttaccaaagtactctgaggca

SEQ ID NO: 10006144 - DNA, 22 bp, Homo sapiens
tttaccaaatagattatgtcag

SEQ ID NO: 10006145 - DNA, 22 bp, Homo sapiens
tttaccaaggcatagtaatctc

SEQ ID NO: 10006146 - DNA, 22 bp, Homo sapiens
tttaccacaattttaaacaatg

SEQ ID NO: 10006147 - DNA, 22 bp, Homo sapiens
tttaccaagctttaattacata

SEQ ID NO: 10006148 - DNA, 22 bp, Homo sapiens
tttagagaggctctgtaaaatg

SEQ ID NO: 10006149 - DNA, 22 bp, Homo sapiens
tttagagaggctctgtaaaatg

SEQ ID NO: 10006150 - DNA, 22 bp, Homo sapiens
tttagagagaattttcaaagtg

SEQ ID NO: 10006151 - DNA, 22 bp, Homo sapiens
tttagaggaattgggagaacgt

SEQ ID NO: 10006152 - DNA, 22 bp, Homo sapiens
tttagagctgtgctgccacatg

SEQ ID NO: 10006153 - DNA, 22 bp, Homo sapiens
tttagagagtgtaaaaatatat

SEQ ID NO: 10006154 - DNA, 22 bp, Homo sapiens
tttagcaaggagaaataatcct

SEQ ID NO: 10006155 - DNA, 21 bp, Homo sapiens
tttagcaagagtatagtgcat

SEQ ID NO: 10006156 - DNA, 22 bp, Homo sapiens
tttcacaattttaaggagcaaa

SEQ ID NO: 10006157 - DNA, 22 bp, Homo sapiens
tttcacaattttaaggagcaaa

SEQ ID NO: 10006158 - DNA, 22 bp, Homo sapiens
tttcacaattttaaggagcaaa

SEQ ID NO: 10006159 - DNA, 22 bp, Homo sapiens
tttcacaatgcaatcctacttc

SEQ ID NO: 10006160 - DNA, 22 bp, Homo sapiens
tttcacaatgcaatcctacttc

SEQ ID NO: 10006161 - DNA, 22 bp, Homo sapiens
tttcacacccactaggactgtt

SEQ ID NO: 10006162 - DNA, 22 bp, Homo sapiens
tttcacactagtcagaatacca

SEQ ID NO: 10006163 - DNA, 22 bp, Homo sapiens
tttcacactgcagcatcagaga

SEQ ID NO: 10006164 - DNA, 20 bp, Homo sapiens
tttcacaatgaacatgtctc

SEQ ID NO: 10006165 - DNA, 20 bp, Homo sapiens
tttcacaatgaacatgtctc

SEQ ID NO: 10006166 - DNA, 20 bp, Homo sapiens
tttcacaatgaacatgtctc

SEQ ID NO: 10006167 - DNA, 20 bp, Homo sapiens
tttcacaatgaacatgtctc

SEQ ID NO: 10006168 - DNA, 23 bp, Homo sapiens
tttcacaatgagcattacagaat

SEQ ID NO: 10006169 - DNA, 23 bp, Homo sapiens
tttcacaatgagcattacagaat

SEQ ID NO: 10006170 - DNA, 23 bp, Homo sapiens
tttcacaatgagcattacagaat

SEQ ID NO: 10006171 - DNA, 23 bp, Homo sapiens
tttcacaatgagcattacagaat

SEQ ID NO: 10006172 - DNA, 23 bp, Homo sapiens
tttcacaatgagcattacagaat

SEQ ID NO: 10006173 - DNA, 22 bp, Homo sapiens
tttcacagaaaggataacatta

SEQ ID NO: 10006174 - DNA, 22 bp, Homo sapiens
tttcacactgcagcatcagaga

SEQ ID NO: 10006175 - DNA, 22 bp, Homo sapiens
tttcaagaagcaaattaaagtc

SEQ ID NO: 10006176 - DNA, 22 bp, Homo sapiens
tttcaagaacagcagcattcca

SEQ ID NO: 10006177 - DNA, 22 bp, Homo sapiens
tttcaagaacagcagcattcca

SEQ ID NO: 10006178 - DNA, 22 bp, Homo sapiens
tttcaagaggccagagcgaggc

SEQ ID NO: 10006179 - DNA, 22 bp, Homo sapiens
tttcaagagaaaactaacctat

SEQ ID NO: 10006180 - DNA, 22 bp, Homo sapiens
tttcaagacgttaagtcagctt

SEQ ID NO: 10006181 - DNA, 22 bp, Homo sapiens
tttcaagaattgaagaggattt

SEQ ID NO: 10006182 - DNA, 22 bp, Homo sapiens
tttcaagactcattgagtattg

SEQ ID NO: 10006183 - DNA, 17 bp, Homo sapiens
tttcaacatcactcagc

SEQ ID NO: 10006184 - DNA, 22 bp, Homo sapiens
tttcaacatcacctagcagttc

SEQ ID NO: 10006185 - DNA, 22 bp, Homo sapiens
tttcaacatcacctagcagttc

SEQ ID NO: 10006186 - DNA, 22 bp, Homo sapiens
tttcaacatacctcagtgtatg

SEQ ID NO: 10006187 - DNA, 22 bp, Homo sapiens
tttcaacagctctcaaatgatc

SEQ ID NO: 10006188 - DNA, 22 bp, Homo sapiens
tttcaacagctctcaaatgatc

SEQ ID NO: 10006189 - DNA, 22 bp, Homo sapiens
tttcaacagctctcaaatgatc

SEQ ID NO: 10006190 - DNA, 23 bp, Homo sapiens
tttcaacaggcagagaagactta

SEQ ID NO: 10006191 - DNA, 22 bp, Homo sapiens
tttcaacaggatgataataggc

SEQ ID NO: 10006192 - DNA, 22 bp, Homo sapiens
tttcaacaggatgataataggc

SEQ ID NO: 10006193 - DNA, 22 bp, Homo sapiens
tttattctagctcagaatagtt

SEQ ID NO: 10006194 - DNA, 22 bp, Homo sapiens
tttattctagctcagaatagtt

SEQ ID NO: 10006195 - DNA, 22 bp, Homo sapiens
tttattctagctcagaatagtt

SEQ ID NO: 10006196 - DNA, 21 bp, Homo sapiens
tttattctcagatacagggag

SEQ ID NO: 10006197 - DNA, 21 bp, Homo sapiens
tttattctcagatacagggag

SEQ ID NO: 10006198 - DNA, 22 bp, Homo sapiens
tttattctagctcagaatagtt

SEQ ID NO: 10006199 - DNA, 20 bp, Homo sapiens
tttattcacagagaagagtt

SEQ ID NO: 10006200 - DNA, 20 bp, Homo sapiens
tttattcacagagaagagtt

SEQ ID NO: 10006201 - DNA, 22 bp, Homo sapiens
tttattctctagttggtcagat

SEQ ID NO: 10006202 - DNA, 22 bp, Homo sapiens
tttattctgtgctacatgaaga

SEQ ID NO: 10006203 - DNA, 22 bp, Homo sapiens
tttattctgtgctacatgaaga

SEQ ID NO: 10006204 - DNA, 22 bp, Homo sapiens
tttattcttgagagtgagaaga

SEQ ID NO: 10006205 - DNA, 22 bp, Homo sapiens
tttattgagtatctactatgtg

SEQ ID NO: 10006206 - DNA, 22 bp, Homo sapiens
tttcaaagggaagttatgaagt

SEQ ID NO: 10006207 - DNA, 22 bp, Homo sapiens
tttattgacccaaagcgagagt

SEQ ID NO: 10006208 - DNA, 22 bp, Homo sapiens
tttattgacccaaagcgagagt

SEQ ID NO: 10006209 - DNA, 22 bp, Homo sapiens
tttcaacagaatatgatcagag

SEQ ID NO: 10006210 - DNA, 22 bp, Homo sapiens
tttcaacagatctgtcttcagg

SEQ ID NO: 10006211 - DNA, 22 bp, Homo sapiens
tttcaacagaatatgatcagag

SEQ ID NO: 10006212 - DNA, 22 bp, Homo sapiens
tttcaacagaatatgatcagag

SEQ ID NO: 10006213 - DNA, 22 bp, Homo sapiens
tttcaacagatctgtcttcagg

SEQ ID NO: 10006214 - DNA, 22 bp, Homo sapiens
tttcaacaccagagaccatgcg

SEQ ID NO: 10006215 - DNA, 23 bp, Homo sapiens
tttcaacaatgcttagagaaaac

SEQ ID NO: 10006216 - DNA, 22 bp, Homo sapiens
tttcaaaggttttgtcatgtct

SEQ ID NO: 10006217 - DNA, 22 bp, Homo sapiens
tttcaaaggttttgtcatgtct

SEQ ID NO: 10006218 - DNA, 22 bp, Homo sapiens
tttcaaaggtggaagagtgaat

SEQ ID NO: 10006219 - DNA, 22 bp, Homo sapiens
tttcaaaggttttgtcatgtct

SEQ ID NO: 10006220 - DNA, 23 bp, Homo sapiens
tttcaacaatgcttagagaaaac

SEQ ID NO: 10006221 - DNA, 22 bp, Homo sapiens
tttcattgatgggtgatagaaa

SEQ ID NO: 10006222 - DNA, 21 bp, Homo sapiens
tttcccagcagagatagctgg

SEQ ID NO: 10006223 - DNA, 22 bp, Homo sapiens
tttcccaggccctcagggctgc

SEQ ID NO: 10006224 - DNA, 22 bp, Homo sapiens
tttccccaggtagatagataat

SEQ ID NO: 10006225 - DNA, 22 bp, Homo sapiens
tttcattgagactatagacatc

SEQ ID NO: 10006226 - DNA, 22 bp, Homo sapiens
tttcattgaactaaagaatctg

SEQ ID NO: 10006227 - DNA, 21 bp, Homo sapiens
tttcattgaatgagataaggt

SEQ ID NO: 10006228 - DNA, 21 bp, Homo sapiens
tttcattgaatgagataaggt

SEQ ID NO: 10006229 - DNA, 21 bp, Homo sapiens
tttcattgaatgagataaggt

SEQ ID NO: 10006230 - DNA, 22 bp, Homo sapiens
tttcattatgttcctggaagag

SEQ ID NO: 10006231 - DNA, 22 bp, Homo sapiens
tttcattcatgtgttaaaggtg

SEQ ID NO: 10006232 - DNA, 21 bp, Homo sapiens
tttcattgaatgagataaggt

SEQ ID NO: 10006233 - DNA, 22 bp, Homo sapiens
tttcattcattatacagtagag

SEQ ID NO: 10006234 - DNA, 22 bp, Homo sapiens
tttcattcattatacagtagag

SEQ ID NO: 10006235 - DNA, 22 bp, Homo sapiens
tttcagagctcagcagctagag

SEQ ID NO: 10006236 - DNA, 22 bp, Homo sapiens
tttcatgaggctgcataaggag

SEQ ID NO: 10006237 - DNA, 22 bp, Homo sapiens
tttcatcttgattctatatggc

SEQ ID NO: 10006238 - DNA, 22 bp, Homo sapiens
tttcatcttgattctatatggc

SEQ ID NO: 10006239 - DNA, 22 bp, Homo sapiens
tttcatcttgattctatatggc

SEQ ID NO: 10006240 - DNA, 22 bp, Homo sapiens
tttcatggctaggactagagtg

SEQ ID NO: 10006241 - DNA, 22 bp, Homo sapiens
tttcatgattaacttagtgaat

SEQ ID NO: 10006242 - DNA, 22 bp, Homo sapiens
tttcatgtggcgatgtctctgg

SEQ ID NO: 10006243 - DNA, 22 bp, Homo sapiens
tttcatgtgttgaatgtgtaca

SEQ ID NO: 10006244 - DNA, 22 bp, Homo sapiens
tttcatgttacagtgtaaaagt

SEQ ID NO: 10006245 - DNA, 22 bp, Homo sapiens
tttcatgtcattccatttcaga

SEQ ID NO: 10006246 - DNA, 22 bp, Homo sapiens
tttcatgtactgtcgaagttga

SEQ ID NO: 10006247 - DNA, 22 bp, Homo sapiens
tttcatgtacttttttgataga

SEQ ID NO: 10006248 - DNA, 22 bp, Homo sapiens
tttcatgtatttcccaaagctt

SEQ ID NO: 10006249 - DNA, 22 bp, Homo sapiens
tttcagagaattagaagctgat

SEQ ID NO: 10006250 - DNA, 22 bp, Homo sapiens
tttcagagcctttatctctcta

SEQ ID NO: 10006251 - DNA, 22 bp, Homo sapiens
tttcagactgcccatgtttgcc

SEQ ID NO: 10006252 - DNA, 22 bp, Homo sapiens
tttcagactccaaattcataag

SEQ ID NO: 10006253 - DNA, 22 bp, Homo sapiens
tttcagactgctgtgtgaaact

SEQ ID NO: 10006254 - DNA, 22 bp, Homo sapiens
tttcagaaagctgaacatatga

SEQ ID NO: 10006255 - DNA, 22 bp, Homo sapiens
tttcagaaagctgaacatatga

SEQ ID NO: 10006256 - DNA, 22 bp, Homo sapiens
tttcagaaacgattatgaacac

SEQ ID NO: 10006257 - DNA, 22 bp, Homo sapiens
tttcagaaacgattatgaacac

SEQ ID NO: 10006258 - DNA, 22 bp, Homo sapiens
tttcagaaagcatcatcaaagt

SEQ ID NO: 10006259 - DNA, 22 bp, Homo sapiens
tttcagaaacgattatgaacac

SEQ ID NO: 10006260 - DNA, 20 bp, Homo sapiens
tttcactgtggtgctggaga

SEQ ID NO: 10006261 - DNA, 22 bp, Homo sapiens
tttcactgtgttggtcaggccg

SEQ ID NO: 10006262 - DNA, 22 bp, Homo sapiens
tttcactgggcttgcagaaatc

SEQ ID NO: 10006263 - DNA, 20 bp, Homo sapiens
tttcactggcttgataaggt

SEQ ID NO: 10006264 - DNA, 22 bp, Homo sapiens
tttcacatttgttttaagaagt

SEQ ID NO: 10006265 - DNA, 22 bp, Homo sapiens
tttcacatttgttttaagaagt

SEQ ID NO: 10006266 - DNA, 22 bp, Homo sapiens
tttcacattttatacttaagcc

SEQ ID NO: 10006267 - DNA, 23 bp, Homo sapiens
tttcacagcttttattctgcatc

SEQ ID NO: 10006268 - DNA, 22 bp, Homo sapiens
tttcacattttatacttaagcc

SEQ ID NO: 10006269 - DNA, 22 bp, Homo sapiens
tttcacagcatataggtgtact

SEQ ID NO: 10006270 - DNA, 22 bp, Homo sapiens
tttcacagcagaatttctgagg

SEQ ID NO: 10006271 - DNA, 18 bp, Homo sapiens
tttcacagattcatgact

SEQ ID NO: 10006272 - DNA, 22 bp, Homo sapiens
tttcacagatgttttggagtct

SEQ ID NO: 10006273 - DNA, 22 bp, Homo sapiens
tttcacagctgggtggcagagt

SEQ ID NO: 10006274 - DNA, 22 bp, Homo sapiens
ttcttttggactcaaagagaac

SEQ ID NO: 10006275 - DNA, 22 bp, Homo sapiens
ttcttttctttaggcattgtgt

SEQ ID NO: 10006276 - DNA, 22 bp, Homo sapiens
ttcttttcttggcaggagtaga

SEQ ID NO: 10006277 - DNA, 22 bp, Homo sapiens
ttgaaaggcctgtttatccagc

SEQ ID NO: 10006278 - DNA, 22 bp, Homo sapiens
ttgaaaggaatacagaggccta

SEQ ID NO: 10006279 - DNA, 22 bp, Homo sapiens
ttgaaaggcacaggcacctggg

SEQ ID NO: 10006280 - DNA, 22 bp, Homo sapiens
ttctttttaaagtgtgtatgca

SEQ ID NO: 10006281 - DNA, 22 bp, Homo sapiens
ttcttttggactcaaagagaac

SEQ ID NO: 10006282 - DNA, 22 bp, Homo sapiens
ttctttttaaagtgtgtatgca

SEQ ID NO: 10006283 - DNA, 22 bp, Homo sapiens
ttgaaatatttgggagtgtttg

SEQ ID NO: 10006284 - DNA, 22 bp, Homo sapiens
ttgaaatatggattgaccttga

SEQ ID NO: 10006285 - DNA, 22 bp, Homo sapiens
ttgaaagggatatatctttctg

SEQ ID NO: 10006286 - DNA, 22 bp, Homo sapiens
ttgaagaaattattttatatag

SEQ ID NO: 10006287 - DNA, 22 bp, Homo sapiens
ttgaagaaagtcatatataatg

SEQ ID NO: 10006288 - DNA, 22 bp, Homo sapiens
ttgaagaaagtcatatataatg

SEQ ID NO: 10006289 - DNA, 23 bp, Homo sapiens
ttgaatttctcttgcaatattta

SEQ ID NO: 10006290 - DNA, 22 bp, Homo sapiens
ttgaatttagattgtatgttga

SEQ ID NO: 10006291 - DNA, 22 bp, Homo sapiens
ttgaacattaacttcagtctat

SEQ ID NO: 10006292 - DNA, 22 bp, Homo sapiens
ttgaacattggcaatttcatat

SEQ ID NO: 10006293 - DNA, 22 bp, Homo sapiens
ttgaacattttctatgttatag

SEQ ID NO: 10006294 - DNA, 22 bp, Homo sapiens
ttgaaccaggaacaattagctc

SEQ ID NO: 10006295 - DNA, 19 bp, Homo sapiens
ttgaaattgtttgatatgg

SEQ ID NO: 10006296 - DNA, 22 bp, Homo sapiens
ttgaaattttaggccttgcaat

SEQ ID NO: 10006297 - DNA, 22 bp, Homo sapiens
ttgaacaatcaaaagaattcat

SEQ ID NO: 10006298 - DNA, 22 bp, Homo sapiens
ttgaacaatttggtatacaaac

SEQ ID NO: 10006299 - DNA, 22 bp, Homo sapiens
ttgaacaatttggtatacaaac

SEQ ID NO: 10006300 - DNA, 22 bp, Homo sapiens
ttgaacattaacttcagtctat

SEQ ID NO: 10006301 - DNA, 22 bp, Homo sapiens
ttgaacattaacttcagtctat

SEQ ID NO: 10006302 - DNA, 19 bp, Homo sapiens
ttgaaattgtttgatatgg

SEQ ID NO: 10006303 - DNA, 22 bp, Homo sapiens
ttcttttaatgtctggctttca

SEQ ID NO: 10006304 - DNA, 22 bp, Homo sapiens
ttcttttaatagagatcctgtg

SEQ ID NO: 10006305 - DNA, 22 bp, Homo sapiens
ttcttttaaaagagagcagaaa

SEQ ID NO: 10006306 - DNA, 22 bp, Homo sapiens
ttcttttaatagagatcctgtg

SEQ ID NO: 10006307 - DNA, 22 bp, Homo sapiens
ttcttttaatgtctggctttca

SEQ ID NO: 10006308 - DNA, 22 bp, Homo sapiens
ttcttttaatgttctgaagttt

SEQ ID NO: 10006309 - DNA, 17 bp, Homo sapiens
ttcttttctgagccttg

SEQ ID NO: 10006310 - DNA, 22 bp, Homo sapiens
ttcttttctgcagctggtattt

SEQ ID NO: 10006311 - DNA, 22 bp, Homo sapiens
ttcttttctgcagctggtattt

SEQ ID NO: 10006312 - DNA, 22 bp, Homo sapiens
ttcttttaatgttctgaagttt

SEQ ID NO: 10006313 - DNA, 22 bp, Homo sapiens
ttcttttcggcctgtgagaagg

SEQ ID NO: 10006314 - DNA, 17 bp, Homo sapiens
ttcttttctgagccttg

SEQ ID NO: 10006315 - DNA, 22 bp, Homo sapiens
ttctttgtgcatccaattttct

SEQ ID NO: 10006316 - DNA, 22 bp, Homo sapiens
ttctttgtagcaaaacgtgtat

SEQ ID NO: 10006317 - DNA, 22 bp, Homo sapiens
ttctttggtgttacccagctca

SEQ ID NO: 10006318 - DNA, 19 bp, Homo sapiens
ttctttggtggtggtgacc

SEQ ID NO: 10006319 - DNA, 19 bp, Homo sapiens
ttctttggtggtggtgacc

SEQ ID NO: 10006320 - DNA, 22 bp, Homo sapiens
ttctttggtgttacccagctca

SEQ ID NO: 10006321 - DNA, 22 bp, Homo sapiens
ttctttgtttgataagtatgct

SEQ ID NO: 10006322 - DNA, 22 bp, Homo sapiens
ttctttgtttgataagtatgct

SEQ ID NO: 10006323 - DNA, 20 bp, Homo sapiens
ttctttgttccttacatttg

SEQ ID NO: 10006324 - DNA, 22 bp, Homo sapiens
ttcttattcttgaaatgtggga

SEQ ID NO: 10006325 - DNA, 22 bp, Homo sapiens
ttcttattgggagaccttttct

SEQ ID NO: 10006326 - DNA, 22 bp, Homo sapiens
ttcttattcttgaaatgtggga

SEQ ID NO: 10006327 - DNA, 22 bp, Homo sapiens
ttcttattatgtgctctgtgaa

SEQ ID NO: 10006328 - DNA, 22 bp, Homo sapiens
ttcttcaaaacaacactggcct

SEQ ID NO: 10006329 - DNA, 22 bp, Homo sapiens
ttcttcaaaatccagcatgatt

SEQ ID NO: 10006330 - DNA, 21 bp, Homo sapiens
ttcttcaaagaagaaggcaca

SEQ ID NO: 10006331 - DNA, 22 bp, Homo sapiens
ttcttcaattttccatatactg

SEQ ID NO: 10006332 - DNA, 22 bp, Homo sapiens
ttctttggtgggagattgaggt

SEQ ID NO: 10006333 - DNA, 22 bp, Homo sapiens
ttctttggtgggagattgaggt

SEQ ID NO: 10006334 - DNA, 22 bp, Homo sapiens
ttcttcaagggtaaaggcaacg

SEQ ID NO: 10006335 - DNA, 22 bp, Homo sapiens
ttcttcaaccatctacataaac

SEQ ID NO: 10006336 - DNA, 22 bp, Homo sapiens
ttcttcaacaaggacactgtta

SEQ ID NO: 10006337 - DNA, 22 bp, Homo sapiens
ttcttcaaagtaatagagacta

SEQ ID NO: 10006338 - DNA, 22 bp, Homo sapiens
ttctggagaggaacagaaaggt

SEQ ID NO: 10006339 - DNA, 22 bp, Homo sapiens
ttctggagaggaacagaaaggt

SEQ ID NO: 10006340 - DNA, 22 bp, Homo sapiens
ttctggagattgagaaggcatt

SEQ ID NO: 10006341 - DNA, 22 bp, Homo sapiens
ttctggagattgagaaggcatt

SEQ ID NO: 10006342 - DNA, 22 bp, Homo sapiens
ttctggagccccaagatctgta

SEQ ID NO: 10006343 - DNA, 22 bp, Homo sapiens
ttctggagccccaagatctgta

SEQ ID NO: 10006344 - DNA, 22 bp, Homo sapiens
ttctggagacccagcaacaggg

SEQ ID NO: 10006345 - DNA, 22 bp, Homo sapiens
ttctggaattcttgcagccact

SEQ ID NO: 10006346 - DNA, 22 bp, Homo sapiens
ttctggaattcttgcagccact

SEQ ID NO: 10006347 - DNA, 22 bp, Homo sapiens
ttctggacacgtgactctcatt

SEQ ID NO: 10006348 - DNA, 19 bp, Homo sapiens
ttctggacagcagaaacca

SEQ ID NO: 10006349 - DNA, 22 bp, Homo sapiens
ttctggacttgccttgctgatg

SEQ ID NO: 10006350 - DNA, 22 bp, Homo sapiens
ttctggaatatttgacacaatt

SEQ ID NO: 10006351 - DNA, 22 bp, Homo sapiens
ttctggaatatttgacacaatt

SEQ ID NO: 10006352 - DNA, 22 bp, Homo sapiens
ttctctgggttaggggaactat

SEQ ID NO: 10006353 - DNA, 22 bp, Homo sapiens
ttctctgggacaggaacagttt

SEQ ID NO: 10006354 - DNA, 22 bp, Homo sapiens
ttctctggacagtgaagagagg

SEQ ID NO: 10006355 - DNA, 22 bp, Homo sapiens
ttctggaaatgcacaactaatt

SEQ ID NO: 10006356 - DNA, 22 bp, Homo sapiens
ttctggaatactaagttccttt

SEQ ID NO: 10006357 - DNA, 22 bp, Homo sapiens
ttctggaagtggaatttttgta

SEQ ID NO: 10006358 - DNA, 22 bp, Homo sapiens
ttctgtctgtaaacttctcaat

SEQ ID NO: 10006359 - DNA, 22 bp, Homo sapiens
ttctgtctggaaaaggacatag

SEQ ID NO: 10006360 - DNA, 22 bp, Homo sapiens
ttctgtctgtaaacttctcaat

SEQ ID NO: 10006361 - DNA, 22 bp, Homo sapiens
ttctgtcttcccactgaggagc

SEQ ID NO: 10006362 - DNA, 22 bp, Homo sapiens
ttctgtctctgtgtttacatta

SEQ ID NO: 10006363 - DNA, 22 bp, Homo sapiens
ttctgtctctgtgtttacatta

SEQ ID NO: 10006364 - DNA, 22 bp, Homo sapiens
ttctgtaagggatttattctga

SEQ ID NO: 10006365 - DNA, 22 bp, Homo sapiens
ttctgtaattctgttagtttca

SEQ ID NO: 10006366 - DNA, 18 bp, Homo sapiens
ttctgtgcatctttctat

SEQ ID NO: 10006367 - DNA, 17 bp, Homo sapiens
ttctgtgcttcctggct

SEQ ID NO: 10006368 - DNA, 22 bp, Homo sapiens
ttctgtggaatatgaactagca

SEQ ID NO: 10006369 - DNA, 22 bp, Homo sapiens
ttctgtggaggtttggaacatt

SEQ ID NO: 10006370 - DNA, 22 bp, Homo sapiens
ttctgtgtcttcttgttctgtg

SEQ ID NO: 10006371 - DNA, 22 bp, Homo sapiens
ttctgtgtgccagagttgtgct

SEQ ID NO: 10006372 - DNA, 22 bp, Homo sapiens
ttctgtggttgaaaggagagat

SEQ ID NO: 10006373 - DNA, 22 bp, Homo sapiens
ttctgtggttgaaaggagagat

SEQ ID NO: 10006374 - DNA, 22 bp, Homo sapiens
ttctgtgtcttcttgttctgtg

SEQ ID NO: 10006375 - DNA, 22 bp, Homo sapiens
ttcttaggagcattagtaattt

SEQ ID NO: 10006376 - DNA, 22 bp, Homo sapiens
ttcttagatgattaatgatggg

SEQ ID NO: 10006377 - DNA, 22 bp, Homo sapiens
ttcttagagatggttaaaaata

SEQ ID NO: 10006378 - DNA, 22 bp, Homo sapiens
ttcttatgttcacataattcca

SEQ ID NO: 10006379 - DNA, 22 bp, Homo sapiens
ttctgtgttctgtgcaatgagc

SEQ ID NO: 10006380 - DNA, 22 bp, Homo sapiens
ttctgtgttgtgacattctaga

SEQ ID NO: 10006381 - DNA, 22 bp, Homo sapiens
ttctgtgttgtgacattctaga

SEQ ID NO: 10006382 - DNA, 22 bp, Homo sapiens
ttctgtgttgtgacattctaga

SEQ ID NO: 10006383 - DNA, 22 bp, Homo sapiens
ttcttacattactttacatgtg

SEQ ID NO: 10006384 - DNA, 22 bp, Homo sapiens
ttcttacattagtctgtgcttt

SEQ ID NO: 10006385 - DNA, 22 bp, Homo sapiens
ttcttacattagtctgtgcttt

SEQ ID NO: 10006386 - DNA, 22 bp, Homo sapiens
ttcttacattactttacatgtg

SEQ ID NO: 10006387 - DNA, 22 bp, Homo sapiens
ttctgtgtgggtagctcctgtt

SEQ ID NO: 10006388 - DNA, 22 bp, Homo sapiens
ttctgtgtgcttactggtgttc

SEQ ID NO: 10006389 - DNA, 22 bp, Homo sapiens
ttctgtgtgtctcagcaagctg

SEQ ID NO: 10006390 - DNA, 19 bp, Homo sapiens
ttctgtgttaattccttta

SEQ ID NO: 10006391 - DNA, 22 bp, Homo sapiens
ttctgtgtgggtagctcctgtt

SEQ ID NO: 10006392 - DNA, 22 bp, Homo sapiens
ttctgtgtgcttactggtgttc

SEQ ID NO: 10006393 - DNA, 22 bp, Homo sapiens
ttcctgagcttttaacctagtc

SEQ ID NO: 10006394 - DNA, 22 bp, Homo sapiens
ttcctgagtcccgggtaaagat

SEQ ID NO: 10006395 - DNA, 17 bp, Homo sapiens
ttccagtttagtattgt

SEQ ID NO: 10006396 - DNA, 22 bp, Homo sapiens
ttccagttcttctgtaagcact

SEQ ID NO: 10006397 - DNA, 22 bp, Homo sapiens
ttccagttggcactgcaattta

SEQ ID NO: 10006398 - DNA, 19 bp, Homo sapiens
ttccagttctaatctcttc

SEQ ID NO: 10006399 - DNA, 22 bp, Homo sapiens
ttcctggcctctctctgagcag

SEQ ID NO: 10006400 - DNA, 22 bp, Homo sapiens
ttcctggccccacccctggaga

SEQ ID NO: 10006401 - DNA, 22 bp, Homo sapiens
ttcctggccaagcagagtggaa

SEQ ID NO: 10006402 - DNA, 22 bp, Homo sapiens
ttcctggcaaagtgagcatcac

SEQ ID NO: 10006403 - DNA, 22 bp, Homo sapiens
ttcctggcacatagttagtgct

SEQ ID NO: 10006404 - DNA, 22 bp, Homo sapiens
ttcctggagagttttcccaaag

SEQ ID NO: 10006405 - DNA, 22 bp, Homo sapiens
ttcctgcctacatgccttatgc

SEQ ID NO: 10006406 - DNA, 22 bp, Homo sapiens
ttcctgcctacatgccttatgc

SEQ ID NO: 10006407 - DNA, 22 bp, Homo sapiens
ttcctgcgcccttctcgcccgc

SEQ ID NO: 10006408 - DNA, 22 bp, Homo sapiens
ttccttgagaaaggcacaagtt

SEQ ID NO: 10006409 - DNA, 22 bp, Homo sapiens
ttccttgaatgagtcatggaaa

SEQ ID NO: 10006410 - DNA, 22 bp, Homo sapiens
ttccttgaccactgcataatga

SEQ ID NO: 10006411 - DNA, 22 bp, Homo sapiens
ttccttgaatgagtcatggaaa

SEQ ID NO: 10006412 - DNA, 22 bp, Homo sapiens
ttccttcttttacaccataaat

SEQ ID NO: 10006413 - DNA, 22 bp, Homo sapiens
ttccttctttgtggtagaaagt

SEQ ID NO: 10006414 - DNA, 22 bp, Homo sapiens
ttccttgaaagctggacatggg

SEQ ID NO: 10006415 - DNA, 22 bp, Homo sapiens
ttccttggatacaagtaacttt

SEQ ID NO: 10006416 - DNA, 22 bp, Homo sapiens
ttccttggccacactggtgctt

SEQ ID NO: 10006417 - DNA, 22 bp, Homo sapiens
ttccttggccacactggtgctt

SEQ ID NO: 10006418 - DNA, 22 bp, Homo sapiens
ttccttggccccatgcccaggg

SEQ ID NO: 10006419 - DNA, 22 bp, Homo sapiens
ttccttggccacactggtgctt

SEQ ID NO: 10006420 - DNA, 20 bp, Homo sapiens
ttccttggattgtgtcttga

SEQ ID NO: 10006421 - DNA, 22 bp, Homo sapiens
ttccttgattagtacatgaagg

SEQ ID NO: 10006422 - DNA, 22 bp, Homo sapiens
ttccttgattagtacatgaagg

SEQ ID NO: 10006423 - DNA, 22 bp, Homo sapiens
ttccttgccctctgggatcttg

SEQ ID NO: 10006424 - DNA, 22 bp, Homo sapiens
ttccttggaaattctgacttca

SEQ ID NO: 10006425 - DNA, 22 bp, Homo sapiens
ttccttggaaattctgacttca

SEQ ID NO: 10006426 - DNA, 22 bp, Homo sapiens
ttccttggagcgctaaagctct

SEQ ID NO: 10006427 - DNA, 22 bp, Homo sapiens
ttccttcttccagaggctgccc

SEQ ID NO: 10006428 - DNA, 22 bp, Homo sapiens
ttccttcttccaaacccatcat

SEQ ID NO: 10006429 - DNA, 22 bp, Homo sapiens
ttccttcttccaaacccatcat

SEQ ID NO: 10006430 - DNA, 22 bp, Homo sapiens
ttccttcttgtaatgatctgcc

SEQ ID NO: 10006431 - DNA, 22 bp, Homo sapiens
ttccttcttcctttagtaacca

SEQ ID NO: 10006432 - DNA, 18 bp, Homo sapiens
ttccttctgatgtatatg

SEQ ID NO: 10006433 - DNA, 22 bp, Homo sapiens
ttccttctggagcccggggagc

SEQ ID NO: 10006434 - DNA, 22 bp, Homo sapiens
ttccttctggaagcttcagggg

SEQ ID NO: 10006435 - DNA, 22 bp, Homo sapiens
ttccttctggaggctccagggg

SEQ ID NO: 10006436 - DNA, 22 bp, Homo sapiens
ttccttcttcattgtgttacag

SEQ ID NO: 10006437 - DNA, 22 bp, Homo sapiens
ttcctggtgacctcactggtag

SEQ ID NO: 10006438 - DNA, 22 bp, Homo sapiens
ttcctggtgagatttcgttctg

SEQ ID NO: 10006439 - DNA, 22 bp, Homo sapiens
ttcctggtttatacctgtatca

SEQ ID NO: 10006440 - DNA, 22 bp, Homo sapiens
ttcctggttggattctgattaa

SEQ ID NO: 10006441 - DNA, 22 bp, Homo sapiens
ttcctggtaacaatctcaaagt

SEQ ID NO: 10006442 - DNA, 22 bp, Homo sapiens
ttcctggtaaattatgtccagg

SEQ ID NO: 10006443 - DNA, 22 bp, Homo sapiens
ttcctggtaacaatctcaaagt

SEQ ID NO: 10006444 - DNA, 22 bp, Homo sapiens
ttcctggtcctattatatacac

SEQ ID NO: 10006445 - DNA, 22 bp, Homo sapiens
ttcctggtcccgttcttcactg

SEQ ID NO: 10006446 - DNA, 22 bp, Homo sapiens
ttcctggtcctattatatacac

SEQ ID NO: 10006447 - DNA, 22 bp, Homo sapiens
ttcctggtctgtgccattcaga

SEQ ID NO: 10006448 - DNA, 19 bp, Homo sapiens
ttcctggggttccattgtg

SEQ ID NO: 10006449 - DNA, 22 bp, Homo sapiens
ttcctgggttccctctcattct

SEQ ID NO: 10006450 - DNA, 22 bp, Homo sapiens
ttcctgggttgtgcattgtaca

SEQ ID NO: 10006451 - DNA, 22 bp, Homo sapiens
ttcctggggcttagcaatggag

SEQ ID NO: 10006452 - DNA, 22 bp, Homo sapiens
ttcctgggggcagcagtcttga

SEQ ID NO: 10006453 - DNA, 22 bp, Homo sapiens
ttcctggggtgaagatattttt

SEQ ID NO: 10006454 - DNA, 22 bp, Homo sapiens
ttcctggggggatagatttcac

SEQ ID NO: 10006455 - DNA, 22 bp, Homo sapiens
ttcctggggggatagatttcac

SEQ ID NO: 10006456 - DNA, 22 bp, Homo sapiens
ttcctgggggcagcagtcttga

SEQ ID NO: 10006457 - DNA, 22 bp, Homo sapiens
ttctctgacccccttaaatatt

SEQ ID NO: 10006458 - DNA, 22 bp, Homo sapiens
ttctctgagatagactaagtgg

SEQ ID NO: 10006459 - DNA, 22 bp, Homo sapiens
ttctctgcagctcctggctggg

SEQ ID NO: 10006460 - DNA, 22 bp, Homo sapiens
ttctctgcattgtaaagagcca

SEQ ID NO: 10006461 - DNA, 22 bp, Homo sapiens
ttctctgcagcttaggcccagt

SEQ ID NO: 10006462 - DNA, 22 bp, Homo sapiens
ttctctgatcttgctagactga

SEQ ID NO: 10006463 - DNA, 22 bp, Homo sapiens
ttctctgcctcacaggtctaag

SEQ ID NO: 10006464 - DNA, 22 bp, Homo sapiens
ttctctgctctcacatacagaa

SEQ ID NO: 10006465 - DNA, 22 bp, Homo sapiens
ttctctctggacctgggatgcg

SEQ ID NO: 10006466 - DNA, 22 bp, Homo sapiens
ttctctctggacctgggatgcg

SEQ ID NO: 10006467 - DNA, 22 bp, Homo sapiens
ttctctctgtgtcattatggac

SEQ ID NO: 10006468 - DNA, 22 bp, Homo sapiens
ttctctcttactgccatgctgt

SEQ ID NO: 10006469 - DNA, 22 bp, Homo sapiens
ttctctcttactgccatgctgt

SEQ ID NO: 10006470 - DNA, 22 bp, Homo sapiens
ttctctcttactgccatgctgt

SEQ ID NO: 10006471 - DNA, 22 bp, Homo sapiens
ttctctctgttatggattttac

SEQ ID NO: 10006472 - DNA, 22 bp, Homo sapiens
ttctctcttactgccatgctgt

SEQ ID NO: 10006473 - DNA, 22 bp, Homo sapiens
ttctctcttccagttcccactt

SEQ ID NO: 10006474 - DNA, 22 bp, Homo sapiens
ttctctcttccagttcccactt

SEQ ID NO: 10006475 - DNA, 22 bp, Homo sapiens
ttctctcttttgggtaggaggt

SEQ ID NO: 10006476 - DNA, 22 bp, Homo sapiens
ttctctgaaggccatgctcact

SEQ ID NO: 10006477 - DNA, 22 bp, Homo sapiens
ttctctgaaggccatgctcact

SEQ ID NO: 10006478 - DNA, 22 bp, Homo sapiens
ttctctaatggtgatgattaga

SEQ ID NO: 10006479 - DNA, 22 bp, Homo sapiens
ttctctaatacattttgacaaa

SEQ ID NO: 10006480 - DNA, 22 bp, Homo sapiens
ttctctaatggtgatgattaga

SEQ ID NO: 10006481 - DNA, 22 bp, Homo sapiens
ttctctaagagttatatgaatt

SEQ ID NO: 10006482 - DNA, 22 bp, Homo sapiens
ttctctaagccttagtttcttc

SEQ ID NO: 10006483 - DNA, 20 bp, Homo sapiens
ttctctagccttcccctggg

SEQ ID NO: 10006484 - DNA, 19 bp, Homo sapiens
ttctctattatgtcttctc

SEQ ID NO: 10006485 - DNA, 22 bp, Homo sapiens
ttctctagtgcaaattgtttga

SEQ ID NO: 10006486 - DNA, 22 bp, Homo sapiens
ttctctcctacccagtatccat

SEQ ID NO: 10006487 - DNA, 22 bp, Homo sapiens
ttctctcccatgaagcttctat

SEQ ID NO: 10006488 - DNA, 22 bp, Homo sapiens
ttctctctgagagcatctggaa

SEQ ID NO: 10006489 - DNA, 22 bp, Homo sapiens
ttctctctgagagcatctggaa

SEQ ID NO: 10006490 - DNA, 22 bp, Homo sapiens
ttctctctgagagcatctggaa

SEQ ID NO: 10006491 - DNA, 22 bp, Homo sapiens
ttctctcctcctagaggctttt

SEQ ID NO: 10006492 - DNA, 21 bp, Homo sapiens
ttctctccatatgcccagccc

SEQ ID NO: 10006493 - DNA, 22 bp, Homo sapiens
ttctctccagactgcagtgggt

SEQ ID NO: 10006494 - DNA, 22 bp, Homo sapiens
ttctccagacaacagagggtga

SEQ ID NO: 10006495 - DNA, 22 bp, Homo sapiens
ttctccaaggatacagtcctgt

SEQ ID NO: 10006496 - DNA, 22 bp, Homo sapiens
ttctccaacacaagcatgatgt

SEQ ID NO: 10006497 - DNA, 22 bp, Homo sapiens
ttctcagggttggcctcaaatc

SEQ ID NO: 10006498 - DNA, 22 bp, Homo sapiens
ttctcagggtttgtgcaggctt

SEQ ID NO: 10006499 - DNA, 22 bp, Homo sapiens
ttctcagggtcttgtgcaaggg

SEQ ID NO: 10006500 - DNA, 22 bp, Homo sapiens
ttctcaggtagtgctgatgctg

SEQ ID NO: 10006501 - DNA, 22 bp, Homo sapiens
ttctcctgagttcccaggtcta

SEQ ID NO: 10006502 - DNA, 23 bp, Homo sapiens
ttctcctgaggaagcagggactg

SEQ ID NO: 10006503 - DNA, 23 bp, Homo sapiens
ttctcctgaggaagcagggactg

SEQ ID NO: 10006504 - DNA, 22 bp, Homo sapiens
ttctctaagagatgcagaagtt

SEQ ID NO: 10006505 - DNA, 22 bp, Homo sapiens
ttctccagaccctcctgcagac

SEQ ID NO: 10006506 - DNA, 22 bp, Homo sapiens
ttctccagaccactgcctctgt

SEQ ID NO: 10006507 - DNA, 22 bp, Homo sapiens
ttctccagaccactgcctctgt

SEQ ID NO: 10006508 - DNA, 22 bp, Homo sapiens
ttccttggtagagagaatattt

SEQ ID NO: 10006509 - DNA, 22 bp, Homo sapiens
ttccttggtgcgcctgctgcag

SEQ ID NO: 10006510 - DNA, 22 bp, Homo sapiens
ttccttggtgcccgatgtattt

SEQ ID NO: 10006511 - DNA, 22 bp, Homo sapiens
ttccttggtagggacaactctg

SEQ ID NO: 10006512 - DNA, 22 bp, Homo sapiens
ttccttgggttctgatgtgttt

SEQ ID NO: 10006513 - DNA, 18 bp, Homo sapiens
ttccttggtaacatatgc

SEQ ID NO: 10006514 - DNA, 17 bp, Homo sapiens
ttccttgggtgctgggt

SEQ ID NO: 10006515 - DNA, 17 bp, Homo sapiens
ttccttgggtgctgggt

SEQ ID NO: 10006516 - DNA, 22 bp, Homo sapiens
ttccttgggttctgatgtgttt

SEQ ID NO: 10006517 - DNA, 22 bp, Homo sapiens
ttccttgggaaatgctcgttta

SEQ ID NO: 10006518 - DNA, 22 bp, Homo sapiens
ttccttgggagaaaaaatatat

SEQ ID NO: 10006519 - DNA, 22 bp, Homo sapiens
ttccttgggaaatgctcgttta

SEQ ID NO: 10006520 - DNA, 17 bp, Homo sapiens
ttccttgggtgctgggt

SEQ ID NO: 10006521 - DNA, 22 bp, Homo sapiens
ttccttggtgcgcctgctgcag

SEQ ID NO: 10006522 - DNA, 22 bp, Homo sapiens
ttccttgtggaaactatggacg

SEQ ID NO: 10006523 - DNA, 22 bp, Homo sapiens
ttctcaggaactcagtgtcagc

SEQ ID NO: 10006524 - DNA, 23 bp, Homo sapiens
ttctcaggagcccccaggtcagg

SEQ ID NO: 10006525 - DNA, 22 bp, Homo sapiens
ttctcaggcacttcttccccgc

SEQ ID NO: 10006526 - DNA, 22 bp, Homo sapiens
ttctcaggctgtggagccgtct

SEQ ID NO: 10006527 - DNA, 22 bp, Homo sapiens
ttctcaggctctgagaccctat

SEQ ID NO: 10006528 - DNA, 22 bp, Homo sapiens
ttctcagggtctggatggcctg

SEQ ID NO: 10006529 - DNA, 22 bp, Homo sapiens
ttctcagggcatctcatgaccc

SEQ ID NO: 10006530 - DNA, 22 bp, Homo sapiens
ttctcagggtagaggtgacact

SEQ ID NO: 10006531 - DNA, 22 bp, Homo sapiens
ttctcagggccctgtgttagct

SEQ ID NO: 10006532 - DNA, 22 bp, Homo sapiens
ttcaaagataatgtagcatttt

SEQ ID NO: 10006533 - DNA, 22 bp, Homo sapiens
ttcaaagagttgggtgtctggg

SEQ ID NO: 10006534 - DNA, 22 bp, Homo sapiens
ttcaaagagaaattgtattttc

SEQ ID NO: 10006535 - DNA, 21 bp, Homo sapiens
ttcaaagagtgggcattgtca

SEQ ID NO: 10006536 - DNA, 21 bp, Homo sapiens
ttcaaagagtgggcattgtca

SEQ ID NO: 10006537 - DNA, 21 bp, Homo sapiens
ttcaaagacttgatgctgacc

SEQ ID NO: 10006538 - DNA, 21 bp, Homo sapiens
ttcaaagacttgatgctgacc

SEQ ID NO: 10006539 - DNA, 22 bp, Homo sapiens
ttcaaagaccttacttggcaaa

SEQ ID NO: 10006540 - DNA, 22 bp, Homo sapiens
ttcaaacttaaggagcagcaga

SEQ ID NO: 10006541 - DNA, 22 bp, Homo sapiens
ttcaaacttaaggagcagcaga

SEQ ID NO: 10006542 - DNA, 22 bp, Homo sapiens
ttcaaagaattttgagacctga

SEQ ID NO: 10006543 - DNA, 20 bp, Homo sapiens
ttcaaagaccctcaggtcca

SEQ ID NO: 10006544 - DNA, 20 bp, Homo sapiens
ttcaaagaccctcaggtcca

SEQ ID NO: 10006545 - DNA, 22 bp, Homo sapiens
ttcacaatggcaaaccattaaa

SEQ ID NO: 10006546 - DNA, 22 bp, Homo sapiens
ttcacaatggcaaaccattaaa

SEQ ID NO: 10006547 - DNA, 22 bp, Homo sapiens
ttcacaatggcaaaccattaaa

SEQ ID NO: 10006548 - DNA, 22 bp, Homo sapiens
ttcacaataggagcatgcaaat

SEQ ID NO: 10006549 - DNA, 22 bp, Homo sapiens
ttcacaataggagcatgcaaat

SEQ ID NO: 10006550 - DNA, 23 bp, Homo sapiens
ttcaaagcttaagctctttccac

SEQ ID NO: 10006551 - DNA, 22 bp, Homo sapiens
ttcacaatgccagcaaccactt

SEQ ID NO: 10006552 - DNA, 23 bp, Homo sapiens
ttcaaagatcttctgaaatctgt

SEQ ID NO: 10006553 - DNA, 23 bp, Homo sapiens
ttcaaagatcttctgaaatctgt

SEQ ID NO: 10006554 - DNA, 22 bp, Homo sapiens
ttcaaagatggagggatagatt

SEQ ID NO: 10006555 - DNA, 22 bp, Homo sapiens
ttcaaagataattaccaaacat

SEQ ID NO: 10006556 - DNA, 22 bp, Homo sapiens
ttcaaagataattaccaaacat

SEQ ID NO: 10006557 - DNA, 22 bp, Homo sapiens
ttcaaagcagagggtcaataca

SEQ ID NO: 10006558 - DNA, 22 bp, Homo sapiens
ttcaaagcaatagaaagagtga

SEQ ID NO: 10006559 - DNA, 22 bp, Homo sapiens
ttcaaagcagagggtcaataca

SEQ ID NO: 10006560 - DNA, 22 bp, Homo sapiens
ttcaaagattttcccaaagctc

SEQ ID NO: 10006561 - DNA, 22 bp, Homo sapiens
ttcaaagcaagacacaattcct

SEQ ID NO: 10006562 - DNA, 22 bp, Homo sapiens
ttcaaagattagcatacgcaat

SEQ ID NO: 10006563 - DNA, 22 bp, Homo sapiens
ttcaaagattagcatacgcaat

SEQ ID NO: 10006564 - DNA, 18 bp, Homo sapiens
ttcacaggaaatgtcttt

SEQ ID NO: 10006565 - DNA, 22 bp, Homo sapiens
ttcacagatgtattggaactcc

SEQ ID NO: 10006566 - DNA, 22 bp, Homo sapiens
ttcacagatttccctgcacatg

SEQ ID NO: 10006567 - DNA, 22 bp, Homo sapiens
ttcacagatgcctgatgtgtgg

SEQ ID NO: 10006568 - DNA, 22 bp, Homo sapiens
ttcacaggatagctattgcacg

SEQ ID NO: 10006569 - DNA, 22 bp, Homo sapiens
ttcacagggcagatcatttctg

SEQ ID NO: 10006570 - DNA, 22 bp, Homo sapiens
ttcacagggcagcagctgagcc

SEQ ID NO: 10006571 - DNA, 22 bp, Homo sapiens
ttcacagggccactggcaggag

SEQ ID NO: 10006572 - DNA, 22 bp, Homo sapiens
ttcagagaaactgaggtttaga

SEQ ID NO: 10006573 - DNA, 22 bp, Homo sapiens
ttcacaggtgagcattaggccg

SEQ ID NO: 10006574 - DNA, 22 bp, Homo sapiens
ttcagagaattggataattcgt

SEQ ID NO: 10006575 - DNA, 22 bp, Homo sapiens
ttcagagacatgttctagatca

SEQ ID NO: 10006576 - DNA, 22 bp, Homo sapiens
ttcagagatgacacctggtgtt

SEQ ID NO: 10006577 - DNA, 20 bp, Homo sapiens
ttcagagatagggtctttaa

SEQ ID NO: 10006578 - DNA, 22 bp, Homo sapiens
ttcagagctggtgtctacagct

SEQ ID NO: 10006579 - DNA, 22 bp, Homo sapiens
ttcagcaaccagaaaggctggg

SEQ ID NO: 10006580 - DNA, 22 bp, Homo sapiens
ttcagcaaatggcttgagataa

SEQ ID NO: 10006581 - DNA, 22 bp, Homo sapiens
ttcagcaattttttaagctaat

SEQ ID NO: 10006582 - DNA, 22 bp, Homo sapiens
ttcagcacagttcaagatggta

SEQ ID NO: 10006583 - DNA, 22 bp, Homo sapiens
ttcagcagagaaattacataat

SEQ ID NO: 10006584 - DNA, 22 bp, Homo sapiens
ttcagcactgactgagtggtta

SEQ ID NO: 10006585 - DNA, 22 bp, Homo sapiens
ttcagtgtgaagcttctgaaag

SEQ ID NO: 10006586 - DNA, 22 bp, Homo sapiens
ttcagtgtgaagcttctgaaag

SEQ ID NO: 10006587 - DNA, 22 bp, Homo sapiens
ttcagtgtccctagtagaagtt

SEQ ID NO: 10006588 - DNA, 22 bp, Homo sapiens
ttcagtgtgcctaagtcagttg

SEQ ID NO: 10006589 - DNA, 22 bp, Homo sapiens
ttcagtgtcacaagagcaagcc

SEQ ID NO: 10006590 - DNA, 22 bp, Homo sapiens
ttcagtgtccctagtagaagtt

SEQ ID NO: 10006591 - DNA, 18 bp, Homo sapiens
ttcagcagcagacacact

SEQ ID NO: 10006592 - DNA, 22 bp, Homo sapiens
ttcagtgtcacaagagcaagcc

SEQ ID NO: 10006593 - DNA, 20 bp, Homo sapiens
ttcatttgggaaaatctgcg

SEQ ID NO: 10006594 - DNA, 19 bp, Homo sapiens
ttcatttgtatctgctcac

SEQ ID NO: 10006595 - DNA, 22 bp, Homo sapiens
ttcatttgtggttatttacaat

SEQ ID NO: 10006596 - DNA, 22 bp, Homo sapiens
ttcatttgtctgctatagatcc

SEQ ID NO: 10006597 - DNA, 22 bp, Homo sapiens
ttcatttgtctgctatagatcc

SEQ ID NO: 10006598 - DNA, 22 bp, Homo sapiens
ttcatttgtctgctatagatcc

SEQ ID NO: 10006599 - DNA, 22 bp, Homo sapiens
ttccaggaacaaactcacctta

SEQ ID NO: 10006600 - DNA, 22 bp, Homo sapiens
ttcattttctttcacgctgctg

SEQ ID NO: 10006601 - DNA, 22 bp, Homo sapiens
ttcatttgtggttatttacaat

SEQ ID NO: 10006602 - DNA, 22 bp, Homo sapiens
ttcattttataaaccctgctga

SEQ ID NO: 10006603 - DNA, 22 bp, Homo sapiens
ttccagggctaggtaatgggta

SEQ ID NO: 10006604 - DNA, 22 bp, Homo sapiens
ttccaggggcagcagtgatggt

SEQ ID NO: 10006605 - DNA, 22 bp, Homo sapiens
ttccagggttaatttatatggt

SEQ ID NO: 10006606 - DNA, 22 bp, Homo sapiens
ttccagggaagagcaaggcagt

SEQ ID NO: 10006607 - DNA, 22 bp, Homo sapiens
ttccagggcagcaagtgaatgg

SEQ ID NO: 10006608 - DNA, 18 bp, Homo sapiens
ttccagtagctgtatcac

SEQ ID NO: 10006609 - DNA, 22 bp, Homo sapiens
ttccagttcccatgaggattaa

SEQ ID NO: 10006610 - DNA, 19 bp, Homo sapiens
ttccagttctaatctcttc

SEQ ID NO: 10006611 - DNA, 22 bp, Homo sapiens
ttccagttcagatgcaacaggg

SEQ ID NO: 10006612 - DNA, 22 bp, Homo sapiens
ttccagttcactccatttctgg

SEQ ID NO: 10006613 - DNA, 22 bp, Homo sapiens
ttccagttaaggaagctattct

SEQ ID NO: 10006614 - DNA, 22 bp, Homo sapiens
ttccagtgaccatagagtatgg

SEQ ID NO: 10006615 - DNA, 22 bp, Homo sapiens
ttcagttttattgtactgctat

SEQ ID NO: 10006616 - DNA, 22 bp, Homo sapiens
ttcataaacaaattaaggcctg

SEQ ID NO: 10006617 - DNA, 22 bp, Homo sapiens
ttcataaacaactgatggtaat

SEQ ID NO: 10006618 - DNA, 21 bp, Homo sapiens
ttcataaaccattctcatgca

SEQ ID NO: 10006619 - DNA, 23 bp, Homo sapiens
ttcataactcaaggtgatataat

SEQ ID NO: 10006620 - DNA, 23 bp, Homo sapiens
ttcataactcaaggtgatataat

SEQ ID NO: 10006621 - DNA, 22 bp, Homo sapiens
ttcataaacaactgatggtaat

SEQ ID NO: 10006622 - DNA, 22 bp, Homo sapiens
ttcataaacaactgatggtaat

SEQ ID NO: 10006623 - DNA, 22 bp, Homo sapiens
ttcagtgttactcaaggggcag

SEQ ID NO: 10006624 - DNA, 22 bp, Homo sapiens
ttcagtgttcttttctgttagc

SEQ ID NO: 10006625 - DNA, 22 bp, Homo sapiens
ttcagtgttcttttctgttagc

SEQ ID NO: 10006626 - DNA, 22 bp, Homo sapiens
ttcagtgttaatcttgggagaa

SEQ ID NO: 10006627 - DNA, 22 bp, Homo sapiens
ttcagtgttaatcttgggagaa

SEQ ID NO: 10006628 - DNA, 22 bp, Homo sapiens
ttcagtgttaaattcaaagagt

SEQ ID NO: 10006629 - DNA, 22 bp, Homo sapiens
ttcagtgtttgtagagataact

SEQ ID NO: 10006630 - DNA, 22 bp, Homo sapiens
ttcagtgtggcccatgaagagg

SEQ ID NO: 10006631 - DNA, 22 bp, Homo sapiens
ttcagtgtggcccatgaagagg

SEQ ID NO: 10006632 - DNA, 22 bp, Homo sapiens
ttcagtgtgcttcaggacgtta

SEQ ID NO: 10006633 - DNA, 22 bp, Homo sapiens
ttcagtgtgcttcaggacgtta

SEQ ID NO: 10006634 - DNA, 22 bp, Homo sapiens
ttcagtgtgtgatacctgctgt

SEQ ID NO: 10006635 - DNA, 22 bp, Homo sapiens
ttcagtgtggtgcacagttttg

SEQ ID NO: 10006636 - DNA, 22 bp, Homo sapiens
ttcatttgagtttatagttgct

SEQ ID NO: 10006637 - DNA, 22 bp, Homo sapiens
ttcatttgccatcagtgtaatg

SEQ ID NO: 10006638 - DNA, 22 bp, Homo sapiens
ttcatttattcagcaggtattt

SEQ ID NO: 10006639 - DNA, 22 bp, Homo sapiens
ttcatttattcagcaggtattt

SEQ ID NO: 10006640 - DNA, 23 bp, Homo sapiens
ttcatttaggagttcataagagc

SEQ ID NO: 10006641 - DNA, 23 bp, Homo sapiens
ttcatttaggagttcataagagc

SEQ ID NO: 10006642 - DNA, 23 bp, Homo sapiens
ttcatttaggagttcataagagc

SEQ ID NO: 10006643 - DNA, 22 bp, Homo sapiens
ttcatttaatcagaatctctaa

SEQ ID NO: 10006644 - DNA, 22 bp, Homo sapiens
ttcatttaatcagaatctctaa

SEQ ID NO: 10006645 - DNA, 22 bp, Homo sapiens
ttcatttaatcagaatctctaa

SEQ ID NO: 10006646 - DNA, 22 bp, Homo sapiens
ttcatttaatttgtgtattaac

SEQ ID NO: 10006647 - DNA, 22 bp, Homo sapiens
ttcatttaatttgtgtattaac

SEQ ID NO: 10006648 - DNA, 22 bp, Homo sapiens
ttcatttaatttgtgtattaac

SEQ ID NO: 10006649 - DNA, 22 bp, Homo sapiens
ttcattgcagttcttcaggtta

SEQ ID NO: 10006650 - DNA, 19 bp, Homo sapiens
ttcataacttttatatcct

SEQ ID NO: 10006651 - DNA, 19 bp, Homo sapiens
ttcataagtttagtgaggg

SEQ ID NO: 10006652 - DNA, 22 bp, Homo sapiens
ttcattgtactttaagagatgc

SEQ ID NO: 10006653 - DNA, 22 bp, Homo sapiens
tcctgcctgcaatcccagcact

SEQ ID NO: 10006654 - DNA, 18 bp, Homo sapiens
tcctgcctgcgggctccc

SEQ ID NO: 10006655 - DNA, 19 bp, Homo sapiens
tcctgcctggggccgcctg

SEQ ID NO: 10006656 - DNA, 18 bp, Homo sapiens
tcctgcctgcgggctccc

SEQ ID NO: 10006657 - DNA, 22 bp, Homo sapiens
tcctgcctgtttacctgtactt

SEQ ID NO: 10006658 - DNA, 18 bp, Homo sapiens
tcctgcctgtgccccagg

SEQ ID NO: 10006659 - DNA, 18 bp, Homo sapiens
tcctgcctgtgccccagg

SEQ ID NO: 10006660 - DNA, 21 bp, Homo sapiens
tcctgctgagaaacagatggt

SEQ ID NO: 10006661 - DNA, 22 bp, Homo sapiens
tcctgctgaccagtaaatgaat

SEQ ID NO: 10006662 - DNA, 20 bp, Homo sapiens
tcctgctgaccttcacaagc

SEQ ID NO: 10006663 - DNA, 22 bp, Homo sapiens
tcctgctgccatttcaagtgct

SEQ ID NO: 10006664 - DNA, 22 bp, Homo sapiens
ttagccttagaagcttagcaaa

SEQ ID NO: 10006665 - DNA, 22 bp, Homo sapiens
ttagccaggggagcagcttgtc

SEQ ID NO: 10006666 - DNA, 22 bp, Homo sapiens
tcctgctggaatggaaaatgaa

SEQ ID NO: 10006667 - DNA, 22 bp, Homo sapiens
tcctgctggaagtagggaatga

SEQ ID NO: 10006668 - DNA, 22 bp, Homo sapiens
tcctgctgctcttgggaaacct

SEQ ID NO: 10006669 - DNA, 22 bp, Homo sapiens
ttagccagtgaaatggagaaat

SEQ ID NO: 10006670 - DNA, 22 bp, Homo sapiens
ttagccatgttgaagatttaga

SEQ ID NO: 10006671 - DNA, 22 bp, Homo sapiens
ttatagaaggagcattcactta

SEQ ID NO: 10006672 - DNA, 22 bp, Homo sapiens
ttatagaacagcctcctctaga

SEQ ID NO: 10006673 - DNA, 22 bp, Homo sapiens
ttatagaacggttctgtgcaaa

SEQ ID NO: 10006674 - DNA, 22 bp, Homo sapiens
ttatactaaaacgcattgaatt

SEQ ID NO: 10006675 - DNA, 22 bp, Homo sapiens
ttatactttatactacatcatt

SEQ ID NO: 10006676 - DNA, 22 bp, Homo sapiens
ttatactttatactacatcatt

SEQ ID NO: 10006677 - DNA, 22 bp, Homo sapiens
ttatagaatggtggattttctg

SEQ ID NO: 10006678 - DNA, 22 bp, Homo sapiens
ttatagatctaaatgtgaaggg

SEQ ID NO: 10006679 - DNA, 22 bp, Homo sapiens
ttatagatctaaatgtgaaggg

SEQ ID NO: 10006680 - DNA, 22 bp, Homo sapiens
ttatagcagcatgatttacaat

SEQ ID NO: 10006681 - DNA, 22 bp, Homo sapiens
ttatagcaggtgactaatgagt

SEQ ID NO: 10006682 - DNA, 22 bp, Homo sapiens
ttatatactgtggtagtactgt

SEQ ID NO: 10006683 - DNA, 22 bp, Homo sapiens
ttatataaagataacttttctt

SEQ ID NO: 10006684 - DNA, 22 bp, Homo sapiens
ttataggaaatagttcatgcga

SEQ ID NO: 10006685 - DNA, 22 bp, Homo sapiens
ttataggaatctgcatgtgtga

SEQ ID NO: 10006686 - DNA, 22 bp, Homo sapiens
ttataggaaaagttctagaaaa

SEQ ID NO: 10006687 - DNA, 22 bp, Homo sapiens
ttatagtatgtgcatatgtgtg

SEQ ID NO: 10006688 - DNA, 22 bp, Homo sapiens
ttatagtatgtgcatatgtgtg

SEQ ID NO: 10006689 - DNA, 22 bp, Homo sapiens
ttatagtattaggtactcaaca

SEQ ID NO: 10006690 - DNA, 22 bp, Homo sapiens
ttatagtattaggtactcaaca

SEQ ID NO: 10006691 - DNA, 22 bp, Homo sapiens
ttatagttagtaggtcattaaa

SEQ ID NO: 10006692 - DNA, 22 bp, Homo sapiens
ttatagtattaggtactcaaca

SEQ ID NO: 10006693 - DNA, 22 bp, Homo sapiens
ttatacatgtttataaggttga

SEQ ID NO: 10006694 - DNA, 22 bp, Homo sapiens
ttatacatgtgttttgagatga

SEQ ID NO: 10006695 - DNA, 22 bp, Homo sapiens
ttcaaacagtgtagaatatatg

SEQ ID NO: 10006696 - DNA, 22 bp, Homo sapiens
ttcaaacagttgcacaacttat

SEQ ID NO: 10006697 - DNA, 22 bp, Homo sapiens
ttcaaacagttgcacaacttat

SEQ ID NO: 10006698 - DNA, 22 bp, Homo sapiens
ttcaaacagttgcacaacttat

SEQ ID NO: 10006699 - DNA, 22 bp, Homo sapiens
ttcaaacattcaaataaaccgg

SEQ ID NO: 10006700 - DNA, 22 bp, Homo sapiens
ttcaaacattcaaataaaccgg

SEQ ID NO: 10006701 - DNA, 22 bp, Homo sapiens
ttcaaacctatctaagaaatag

SEQ ID NO: 10006702 - DNA, 22 bp, Homo sapiens
ttcaaaccttcacttgcagagt

SEQ ID NO: 10006703 - DNA, 22 bp, Homo sapiens
ttcaaactagttaaaagtcaga

SEQ ID NO: 10006704 - DNA, 22 bp, Homo sapiens
ttcaaactcttgctctgctagt

SEQ ID NO: 10006705 - DNA, 22 bp, Homo sapiens
ttcaaactcttgctctgctagt

SEQ ID NO: 10006706 - DNA, 22 bp, Homo sapiens
ttcaaactctgagtagttctgc

SEQ ID NO: 10006707 - DNA, 22 bp, Homo sapiens
ttcaaactatgacttcagctac

SEQ ID NO: 10006708 - DNA, 22 bp, Homo sapiens
ttcaaactagttaaaagtcaga

SEQ ID NO: 10006709 - DNA, 22 bp, Homo sapiens
ttcaaacagatgactctgctct

SEQ ID NO: 10006710 - DNA, 22 bp, Homo sapiens
ttcaaacactgttggcactggg

SEQ ID NO: 10006711 - DNA, 22 bp, Homo sapiens
ttcaaacagatgactctgctct

SEQ ID NO: 10006712 - DNA, 22 bp, Homo sapiens
ttcaaacacagacagcagcatg

SEQ ID NO: 10006713 - DNA, 22 bp, Homo sapiens
ttcaaacacagacagcagcatg

SEQ ID NO: 10006714 - DNA, 22 bp, Homo sapiens
ttcaaacactggcttagccaat

SEQ ID NO: 10006715 - DNA, 22 bp, Homo sapiens
ttattgtggactactgttctgg

SEQ ID NO: 10006716 - DNA, 22 bp, Homo sapiens
ttattgtagcactttggcagtg

SEQ ID NO: 10006717 - DNA, 22 bp, Homo sapiens
ttattgtcaaaaacaggacact

SEQ ID NO: 10006718 - DNA, 22 bp, Homo sapiens
ttattgtaggcctattgtagaa

SEQ ID NO: 10006719 - DNA, 22 bp, Homo sapiens
ttattgaaatggaagctataac

SEQ ID NO: 10006720 - DNA, 22 bp, Homo sapiens
ttattgaaatggaagctataac

SEQ ID NO: 10006721 - DNA, 22 bp, Homo sapiens
ttattcttttctccagaatccc

SEQ ID NO: 10006722 - DNA, 22 bp, Homo sapiens
ttattaataaagtggcatagcc

SEQ ID NO: 10006723 - DNA, 22 bp, Homo sapiens
ttattaataaagtggcatagcc

SEQ ID NO: 10006724 - DNA, 22 bp, Homo sapiens
ttattaatacatgcacctgcat

SEQ ID NO: 10006725 - DNA, 22 bp, Homo sapiens
ttattaatacatgcacctgcat

SEQ ID NO: 10006726 - DNA, 22 bp, Homo sapiens
ttattaaaatgcggatttggct

SEQ ID NO: 10006727 - DNA, 22 bp, Homo sapiens
ttattaatgagtacaagttatt

SEQ ID NO: 10006728 - DNA, 22 bp, Homo sapiens
ttattaatcttatctttggaaa

SEQ ID NO: 10006729 - DNA, 22 bp, Homo sapiens
ttattaatcttatctttggaaa

SEQ ID NO: 10006730 - DNA, 22 bp, Homo sapiens
ttattaatgagtacaagttatt

SEQ ID NO: 10006731 - DNA, 22 bp, Homo sapiens
ttattaatgagtacaagttatt

SEQ ID NO: 10006732 - DNA, 22 bp, Homo sapiens
ttattaatgagtacaagttatt

SEQ ID NO: 10006733 - DNA, 22 bp, Homo sapiens
ttattaaaatgcggatttggct

SEQ ID NO: 10006734 - DNA, 22 bp, Homo sapiens
ttatatgagtatcatatcactt

SEQ ID NO: 10006735 - DNA, 22 bp, Homo sapiens
ttatatatatgtagaggtcacg

SEQ ID NO: 10006736 - DNA, 22 bp, Homo sapiens
ttatatatatgtagaggtcacg

SEQ ID NO: 10006737 - DNA, 22 bp, Homo sapiens
ttatatatatgtagaggtcacg

SEQ ID NO: 10006738 - DNA, 22 bp, Homo sapiens
ttatatatcttgatttgttcca

SEQ ID NO: 10006739 - DNA, 22 bp, Homo sapiens
ttatatatcttgatttgttcca

SEQ ID NO: 10006740 - DNA, 22 bp, Homo sapiens
ttatatatcttgatttgttcca

SEQ ID NO: 10006741 - DNA, 22 bp, Homo sapiens
ttattatagattatgcaagatt

SEQ ID NO: 10006742 - DNA, 22 bp, Homo sapiens
ttattatggtatttctttgcag

SEQ ID NO: 10006743 - DNA, 22 bp, Homo sapiens
ttattctttaaacatatatgtt

SEQ ID NO: 10006744 - DNA, 22 bp, Homo sapiens
ttattagatctgttagggatcc

SEQ ID NO: 10006745 - DNA, 22 bp, Homo sapiens
ttattacactgaaagaattgcg

SEQ ID NO: 10006746 - DNA, 22 bp, Homo sapiens
ttattagagtgctttgagaaag

SEQ ID NO: 10006747 - DNA, 22 bp, Homo sapiens
ttttaacactcagcactatctc

SEQ ID NO: 10006748 - DNA, 22 bp, Homo sapiens
ttttaacactcagcactatctc

SEQ ID NO: 10006749 - DNA, 21 bp, Homo sapiens
ttttaacaaggatttccctag

SEQ ID NO: 10006750 - DNA, 21 bp, Homo sapiens
ttttaacaaggatttccctag

SEQ ID NO: 10006751 - DNA, 22 bp, Homo sapiens
ttttaaatctccagttgacccc

SEQ ID NO: 10006752 - DNA, 22 bp, Homo sapiens
ttttaaatctccagttgacccc

SEQ ID NO: 10006753 - DNA, 22 bp, Homo sapiens
ttttaaatctccagttgacccc

SEQ ID NO: 10006754 - DNA, 22 bp, Homo sapiens
ttttaaatctccagttgacccc

SEQ ID NO: 10006755 - DNA, 22 bp, Homo sapiens
ttttaaaggctgtatgaccaag

SEQ ID NO: 10006756 - DNA, 22 bp, Homo sapiens
ttttaaaggatactcttgtcta

SEQ ID NO: 10006757 - DNA, 22 bp, Homo sapiens
ttttaaaggcagattatggctt

SEQ ID NO: 10006758 - DNA, 22 bp, Homo sapiens
ttttaaaggcagattatggctt

SEQ ID NO: 10006759 - DNA, 22 bp, Homo sapiens
tttgttcaatccagacaatagc

SEQ ID NO: 10006760 - DNA, 22 bp, Homo sapiens
tttgttcacagggttgttgtag

SEQ ID NO: 10006761 - DNA, 22 bp, Homo sapiens
tttgttcaatatgtgtttgtcc

SEQ ID NO: 10006762 - DNA, 22 bp, Homo sapiens
tttgttcaaggaatagtaaatg

SEQ ID NO: 10006763 - DNA, 22 bp, Homo sapiens
tttgttcaatccagacaatagc

SEQ ID NO: 10006764 - DNA, 22 bp, Homo sapiens
tttgttcaatccagacaatagc

SEQ ID NO: 10006765 - DNA, 22 bp, Homo sapiens
ttttaatactgctattgtagga

SEQ ID NO: 10006766 - DNA, 22 bp, Homo sapiens
ttttaatactgctattgtagga

SEQ ID NO: 10006767 - DNA, 22 bp, Homo sapiens
ttttaatcatgcttctatgtcc

SEQ ID NO: 10006768 - DNA, 22 bp, Homo sapiens
ttttaagaaatgtatgactgtc

SEQ ID NO: 10006769 - DNA, 22 bp, Homo sapiens
ttttaagaaatgtatgactgtc

SEQ ID NO: 10006770 - DNA, 22 bp, Homo sapiens
ttttaatcctcttggtatctta

SEQ ID NO: 10006771 - DNA, 22 bp, Homo sapiens
ttttaatcctcttggtatctta

SEQ ID NO: 10006772 - DNA, 22 bp, Homo sapiens
ttttaatccatctggtaaacct

SEQ ID NO: 10006773 - DNA, 22 bp, Homo sapiens
ttttaattcaaagtgaatagtg

SEQ ID NO: 10006774 - DNA, 22 bp, Homo sapiens
ttttatgtaataaactgtacac

SEQ ID NO: 10006775 - DNA, 22 bp, Homo sapiens
ttttatgtaataaactgtacac

SEQ ID NO: 10006776 - DNA, 22 bp, Homo sapiens
ttttatgtaatccttactgtcg

SEQ ID NO: 10006777 - DNA, 22 bp, Homo sapiens
ttttatgtaatccttactgtcg

SEQ ID NO: 10006778 - DNA, 22 bp, Homo sapiens
ttttatgtgctggactggcagt

SEQ ID NO: 10006779 - DNA, 22 bp, Homo sapiens
ttttatgtcataaggacactca

SEQ ID NO: 10006780 - DNA, 22 bp, Homo sapiens
ttttatgtgctggactggcagt

SEQ ID NO: 10006781 - DNA, 22 bp, Homo sapiens
ttttatgtgctggactggcagt

SEQ ID NO: 10006782 - DNA, 20 bp, Homo sapiens
ttttatgtcaccttcctgtc

SEQ ID NO: 10006783 - DNA, 22 bp, Homo sapiens
ttttaattgcaattatggtccc

SEQ ID NO: 10006784 - DNA, 18 bp, Homo sapiens
ttttaatttcaggggtgg

SEQ ID NO: 10006785 - DNA, 22 bp, Homo sapiens
tttgttaaatatttattgagtg

SEQ ID NO: 10006786 - DNA, 22 bp, Homo sapiens
tttgttaaggagtattgcttct

SEQ ID NO: 10006787 - DNA, 22 bp, Homo sapiens
tttgttaaggagtattgcttct

SEQ ID NO: 10006788 - DNA, 22 bp, Homo sapiens
tttgttaattcttatgttagag

SEQ ID NO: 10006789 - DNA, 22 bp, Homo sapiens
tttgttaaggagtattgcttct

SEQ ID NO: 10006790 - DNA, 22 bp, Homo sapiens
tttgttaattcttatgttagag

SEQ ID NO: 10006791 - DNA, 22 bp, Homo sapiens
tttgttcaaggaatagtaaatg

SEQ ID NO: 10006792 - DNA, 22 bp, Homo sapiens
tttgttcaaggaatagtaaatg

SEQ ID NO: 10006793 - DNA, 22 bp, Homo sapiens
tttgttcaacaggtgaaataga

SEQ ID NO: 10006794 - DNA, 22 bp, Homo sapiens
tttgttcaacaggtgaaataga

SEQ ID NO: 10006795 - DNA, 22 bp, Homo sapiens
tttgttcaaaaattataagata

SEQ ID NO: 10006796 - DNA, 22 bp, Homo sapiens
tttgttataacaataaaaagtc

SEQ ID NO: 10006797 - DNA, 22 bp, Homo sapiens
tttgtgtttgtacaatgcacta

SEQ ID NO: 10006798 - DNA, 22 bp, Homo sapiens
tttgtgtttatgaagttattct

SEQ ID NO: 10006799 - DNA, 22 bp, Homo sapiens
tttgtgttggaagaaatgctac

SEQ ID NO: 10006800 - DNA, 22 bp, Homo sapiens
tttgtgttgtacttctgtgcat

SEQ ID NO: 10006801 - DNA, 22 bp, Homo sapiens
tttgtgttttagctggtgaggc

SEQ ID NO: 10006802 - DNA, 22 bp, Homo sapiens
tttgtgttttcccatactattg

SEQ ID NO: 10006803 - DNA, 22 bp, Homo sapiens
tttgtgttttcccatactattg

SEQ ID NO: 10006804 - DNA, 22 bp, Homo sapiens
tttgttaaatatttattgagtg

SEQ ID NO: 10006805 - DNA, 22 bp, Homo sapiens
tttgttaaaatgcagattctgt

SEQ ID NO: 10006806 - DNA, 22 bp, Homo sapiens
tttgttaaaatgcagattctgt

SEQ ID NO: 10006807 - DNA, 22 bp, Homo sapiens
tttgttaaaatgcagattctgt

SEQ ID NO: 10006808 - DNA, 22 bp, Homo sapiens
tttgttaaaatgcagattctgt

SEQ ID NO: 10006809 - DNA, 22 bp, Homo sapiens
tttgtaaaattagggaattcaa

SEQ ID NO: 10006810 - DNA, 22 bp, Homo sapiens
tttgtaaaattagggaattcaa

SEQ ID NO: 10006811 - DNA, 22 bp, Homo sapiens
tttgtaaaaggaggaagcatgg

SEQ ID NO: 10006812 - DNA, 22 bp, Homo sapiens
tttgtaaaaggaggaagcatgg

SEQ ID NO: 10006813 - DNA, 22 bp, Homo sapiens
tttgtaaatagcagtactcatg

SEQ ID NO: 10006814 - DNA, 22 bp, Homo sapiens
tttgtaaatagcagtactcatg

SEQ ID NO: 10006815 - DNA, 21 bp, Homo sapiens
tttgtgtgtcacgtgcacagg

SEQ ID NO: 10006816 - DNA, 22 bp, Homo sapiens
tttgtgtgtgctcacatagatg

SEQ ID NO: 10006817 - DNA, 22 bp, Homo sapiens
tttgtgtgtgtataggaaagga

SEQ ID NO: 10006818 - DNA, 22 bp, Homo sapiens
tttgtgtgtatatgtatataga

SEQ ID NO: 10006819 - DNA, 22 bp, Homo sapiens
tttgtgtgggggaaacaaggta

SEQ ID NO: 10006820 - DNA, 22 bp, Homo sapiens
tttgtgtggtggatactgggta

SEQ ID NO: 10006821 - DNA, 22 bp, Homo sapiens
tttgtgtggcgttggccggcgg

SEQ ID NO: 10006822 - DNA, 22 bp, Homo sapiens
tttgtgtggcgttggccggcgg

SEQ ID NO: 10006823 - DNA, 22 bp, Homo sapiens
tttgtgtggatggaaggcagta

SEQ ID NO: 10006824 - DNA, 22 bp, Homo sapiens
tttgtgtggatggaaggcagta

SEQ ID NO: 10006825 - DNA, 22 bp, Homo sapiens
tttgtgtgcttggtattgaaga

SEQ ID NO: 10006826 - DNA, 22 bp, Homo sapiens
tttgtaagcaaaaagtccattc

SEQ ID NO: 10006827 - DNA, 22 bp, Homo sapiens
tttgtgtcgtcactgtcttctc

SEQ ID NO: 10006828 - DNA, 22 bp, Homo sapiens
tttgtgtgcaacgcatggagtc

SEQ ID NO: 10006829 - DNA, 22 bp, Homo sapiens
tttgtaaggctaaataatattc

SEQ ID NO: 10006830 - DNA, 22 bp, Homo sapiens
ttttcatttttgtagatgcaag

SEQ ID NO: 10006831 - DNA, 19 bp, Homo sapiens
ttttccacagaaatatgtt

SEQ ID NO: 10006832 - DNA, 22 bp, Homo sapiens
ttttctattaactcattttgca

SEQ ID NO: 10006833 - DNA, 22 bp, Homo sapiens
ttttctattcattgtctatggt

SEQ ID NO: 10006834 - DNA, 22 bp, Homo sapiens
ttttccacagcaccataagatt

SEQ ID NO: 10006835 - DNA, 22 bp, Homo sapiens
ttttcattgttcctcgagcatt

SEQ ID NO: 10006836 - DNA, 22 bp, Homo sapiens
ttttctcttgttaatgtactga

SEQ ID NO: 10006837 - DNA, 22 bp, Homo sapiens
ttttctcttccctctggacctg

SEQ ID NO: 10006838 - DNA, 22 bp, Homo sapiens
ttttctcttccctctggacctg

SEQ ID NO: 10006839 - DNA, 22 bp, Homo sapiens
ttttctattcattgtctatggt

SEQ ID NO: 10006840 - DNA, 22 bp, Homo sapiens
ttttctcagctgcactgtatta

SEQ ID NO: 10006841 - DNA, 22 bp, Homo sapiens
ttttctcttgttaatgtactga

SEQ ID NO: 10006842 - DNA, 22 bp, Homo sapiens
ttttctcttgttaatgtactga

SEQ ID NO: 10006843 - DNA, 22 bp, Homo sapiens
ttttctgaagtttaagacattt

SEQ ID NO: 10006844 - DNA, 22 bp, Homo sapiens
ttttctgaagtttaagacattt

SEQ ID NO: 10006845 - DNA, 22 bp, Homo sapiens
ttttctgactctattgaggtat

SEQ ID NO: 10006846 - DNA, 22 bp, Homo sapiens
ttttctgtaagaggactttaat

SEQ ID NO: 10006847 - DNA, 22 bp, Homo sapiens
ttttctgtaagaggactttaat

SEQ ID NO: 10006848 - DNA, 22 bp, Homo sapiens
ttttctgtattattgtgcttca

SEQ ID NO: 10006849 - DNA, 22 bp, Homo sapiens
ttttctgtattattgtgcttca

SEQ ID NO: 10006850 - DNA, 22 bp, Homo sapiens
ttttctgttacaaagtacagcg

SEQ ID NO: 10006851 - DNA, 22 bp, Homo sapiens
ttttctgtgattctgaggttgg

SEQ ID NO: 10006852 - DNA, 20 bp, Homo sapiens
ttttctgtgccaagaaaact

SEQ ID NO: 10006853 - DNA, 20 bp, Homo sapiens
ttttctgtgccaagaaaact

SEQ ID NO: 10006854 - DNA, 22 bp, Homo sapiens
ttttctgtgccctgctagctgg

SEQ ID NO: 10006855 - DNA, 22 bp, Homo sapiens
ttttcttaggtgctccaagtag

SEQ ID NO: 10006856 - DNA, 22 bp, Homo sapiens
ttttcttaggtgctccaagtag

SEQ ID NO: 10006857 - DNA, 22 bp, Homo sapiens
ttttcttactgtctgtgatcct

SEQ ID NO: 10006858 - DNA, 22 bp, Homo sapiens
ttttcttactgtctgtgatcct

SEQ ID NO: 10006859 - DNA, 22 bp, Homo sapiens
ttttcttatggtgaagcacaaa

SEQ ID NO: 10006860 - DNA, 22 bp, Homo sapiens
ttttcttatggtgaagcacaaa

SEQ ID NO: 10006861 - DNA, 22 bp, Homo sapiens
ttttcttatagagcttaaagtt

SEQ ID NO: 10006862 - DNA, 22 bp, Homo sapiens
ttttcttatggtgaagcacaaa

SEQ ID NO: 10006863 - DNA, 22 bp, Homo sapiens
ttttcttatggtgaagcacaaa

SEQ ID NO: 10006864 - DNA, 22 bp, Homo sapiens
ttttcttatggtgaagcacaaa

SEQ ID NO: 10006865 - DNA, 22 bp, Homo sapiens
ttttattggagtgataccaagc

SEQ ID NO: 10006866 - DNA, 22 bp, Homo sapiens
ttttatgtgtgaaatgctgtct

SEQ ID NO: 10006867 - DNA, 22 bp, Homo sapiens
ttttatgtgtcaaagcagtggt

SEQ ID NO: 10006868 - DNA, 22 bp, Homo sapiens
ttttatgtgtgaaatgctgtct

SEQ ID NO: 10006869 - DNA, 22 bp, Homo sapiens
ttttatgtgtgaaatgctgtct

SEQ ID NO: 10006870 - DNA, 22 bp, Homo sapiens
ttttatgtgtgaaatgctgtct

SEQ ID NO: 10006871 - DNA, 22 bp, Homo sapiens
ttttatgttcctgaagctatct

SEQ ID NO: 10006872 - DNA, 22 bp, Homo sapiens
ttttatgttcctctttatgcga

SEQ ID NO: 10006873 - DNA, 22 bp, Homo sapiens
ttttatgttcctctttatgcga

SEQ ID NO: 10006874 - DNA, 22 bp, Homo sapiens
ttttatgttcctctttatgcga

SEQ ID NO: 10006875 - DNA, 22 bp, Homo sapiens
ttttatgttcctctttatgcga

SEQ ID NO: 10006876 - DNA, 22 bp, Homo sapiens
ttttatgttgctataataggta

SEQ ID NO: 10006877 - DNA, 22 bp, Homo sapiens
ttttatgttcctgaagctatct

SEQ ID NO: 10006878 - DNA, 22 bp, Homo sapiens
ttttatgttcctgaagctatct

SEQ ID NO: 10006879 - DNA, 22 bp, Homo sapiens
ttttattagtggctagatgggg

SEQ ID NO: 10006880 - DNA, 22 bp, Homo sapiens
ttttattagtggctagatgggg

SEQ ID NO: 10006881 - DNA, 22 bp, Homo sapiens
ttttattagtggctagatgggg

SEQ ID NO: 10006882 - DNA, 22 bp, Homo sapiens
ttttcattgttactatgagcta

SEQ ID NO: 10006883 - DNA, 22 bp, Homo sapiens
ttttcattgttactatgagcta

SEQ ID NO: 10006884 - DNA, 22 bp, Homo sapiens
ttttcatgttccttgttaagtg

SEQ ID NO: 10006885 - DNA, 22 bp, Homo sapiens
ttttcattgtaaatcaggaaac

SEQ ID NO: 10006886 - DNA, 22 bp, Homo sapiens
ttttcattagaatgactgagaa

SEQ ID NO: 10006887 - DNA, 22 bp, Homo sapiens
ttttcagttttccaggtagccg

SEQ ID NO: 10006888 - DNA, 22 bp, Homo sapiens
ttttcatagtaatggtgcatgt

SEQ ID NO: 10006889 - DNA, 22 bp, Homo sapiens
ttttcatctctgctttgtacct

SEQ ID NO: 10006890 - DNA, 22 bp, Homo sapiens
ttttcatgtcatgtccttgagg

SEQ ID NO: 10006891 - DNA, 22 bp, Homo sapiens
ttttcatggccaccgcaagtga

SEQ ID NO: 10006892 - DNA, 22 bp, Homo sapiens
ttttcagtttgcactgcagtgc

SEQ ID NO: 10006893 - DNA, 22 bp, Homo sapiens
ttttcacattgtcccagcacta

SEQ ID NO: 10006894 - DNA, 22 bp, Homo sapiens
ttttcacacaaggtgataagtt

SEQ ID NO: 10006895 - DNA, 19 bp, Homo sapiens
ttttcacatactggatcct

SEQ ID NO: 10006896 - DNA, 22 bp, Homo sapiens
ttttcacacaaggtgataagtt

SEQ ID NO: 10006897 - DNA, 22 bp, Homo sapiens
ttttcacacaaggtgataagtt

SEQ ID NO: 10006898 - DNA, 22 bp, Homo sapiens
tttgagtctgcttccattttca

SEQ ID NO: 10006899 - DNA, 22 bp, Homo sapiens
tttgataatacacaagagaaag

SEQ ID NO: 10006900 - DNA, 22 bp, Homo sapiens
tttgataagagctgctgaaact

SEQ ID NO: 10006901 - DNA, 22 bp, Homo sapiens
tttgataacagtgaatatcatg

SEQ ID NO: 10006902 - DNA, 22 bp, Homo sapiens
tttgataacagtgaatatcatg

SEQ ID NO: 10006903 - DNA, 22 bp, Homo sapiens
tttgataacagtgaatatcatg

SEQ ID NO: 10006904 - DNA, 22 bp, Homo sapiens
tttgataagagctgctgaaact

SEQ ID NO: 10006905 - DNA, 22 bp, Homo sapiens
tttgagcttgtagcattgctat

SEQ ID NO: 10006906 - DNA, 22 bp, Homo sapiens
tttgacagcagataaaataaaa

SEQ ID NO: 10006907 - DNA, 22 bp, Homo sapiens
tttgacagatccttaactcagc

SEQ ID NO: 10006908 - DNA, 22 bp, Homo sapiens
tttgaggttagctagcagatca

SEQ ID NO: 10006909 - DNA, 22 bp, Homo sapiens
tttgataattaaaaattgtagt

SEQ ID NO: 10006910 - DNA, 22 bp, Homo sapiens
tttgataattaaaaattgtagt

SEQ ID NO: 10006911 - DNA, 22 bp, Homo sapiens
tttgatatcttggtatacagat

SEQ ID NO: 10006912 - DNA, 22 bp, Homo sapiens
tttgatctatgcgtggtttccc

SEQ ID NO: 10006913 - DNA, 22 bp, Homo sapiens
tttgctttgggaggttgtctgg

SEQ ID NO: 10006914 - DNA, 22 bp, Homo sapiens
tttgctttcttgattcagatta

SEQ ID NO: 10006915 - DNA, 22 bp, Homo sapiens
tttgcttgttcaagatttctgt

SEQ ID NO: 10006916 - DNA, 22 bp, Homo sapiens
tttgatttactggatattctca

SEQ ID NO: 10006917 - DNA, 22 bp, Homo sapiens
tttgatttactggatattctca

SEQ ID NO: 10006918 - DNA, 22 bp, Homo sapiens
tttgattctaagttctgtcaac

SEQ ID NO: 10006919 - DNA, 22 bp, Homo sapiens
tttgatttactataagcagcac

SEQ ID NO: 10006920 - DNA, 22 bp, Homo sapiens
tttgatttactggatattctca

SEQ ID NO: 10006921 - DNA, 22 bp, Homo sapiens
tttgatgatgatgataaagttt

SEQ ID NO: 10006922 - DNA, 21 bp, Homo sapiens
tttggtgctggaaatgccatt

SEQ ID NO: 10006923 - DNA, 22 bp, Homo sapiens
tttggtgagctgcgagtgagga

SEQ ID NO: 10006924 - DNA, 22 bp, Homo sapiens
tttggtcttttatttaaagcag

SEQ ID NO: 10006925 - DNA, 22 bp, Homo sapiens
tttggtctctgtgcatcctcct

SEQ ID NO: 10006926 - DNA, 22 bp, Homo sapiens
tttggtctggaatcttcagggt

SEQ ID NO: 10006927 - DNA, 22 bp, Homo sapiens
tttggtcttggatttatcagtg

SEQ ID NO: 10006928 - DNA, 22 bp, Homo sapiens
tttggttaatttaggcttgcat

SEQ ID NO: 10006929 - DNA, 22 bp, Homo sapiens
tttggtttttacctgctgagag

SEQ ID NO: 10006930 - DNA, 22 bp, Homo sapiens
tttggtattgcacactgtcttc

SEQ ID NO: 10006931 - DNA, 22 bp, Homo sapiens
tttggtcaaatattatcctgag

SEQ ID NO: 10006932 - DNA, 22 bp, Homo sapiens
tttggtcagggtaggacagttg

SEQ ID NO: 10006933 - DNA, 22 bp, Homo sapiens
tttggtctctgtgcatcctcct

SEQ ID NO: 10006934 - DNA, 22 bp, Homo sapiens
tttggtctcattcactcatggg

SEQ ID NO: 10006935 - DNA, 22 bp, Homo sapiens
tttggtctcattcactcatggg

SEQ ID NO: 10006936 - DNA, 17 bp, Homo sapiens
tttggaaagtgatcatt

SEQ ID NO: 10006937 - DNA, 22 bp, Homo sapiens
tttggaaagtgtacaaatttga

SEQ ID NO: 10006938 - DNA, 22 bp, Homo sapiens
tttggaaagtgtgatttcaagg

SEQ ID NO: 10006939 - DNA, 22 bp, Homo sapiens
tttggaaagtgtgatttcaagg

SEQ ID NO: 10006940 - DNA, 22 bp, Homo sapiens
tttggaaattactcattgtcct

SEQ ID NO: 10006941 - DNA, 22 bp, Homo sapiens
tttggaaatacgcgtaggcaga

SEQ ID NO: 10006942 - DNA, 22 bp, Homo sapiens
tttggaaaatattgaactggtt

SEQ ID NO: 10006943 - DNA, 22 bp, Homo sapiens
tttggaaactgatggtacattc

SEQ ID NO: 10006944 - DNA, 22 bp, Homo sapiens
tttggaaacatctcagaaaata

SEQ ID NO: 10006945 - DNA, 22 bp, Homo sapiens
tttggaaactgcctcagctctt

SEQ ID NO: 10006946 - DNA, 22 bp, Homo sapiens
tttggaaaaagcctgaacatag

SEQ ID NO: 10006947 - DNA, 22 bp, Homo sapiens
tttggaaaaagacagcttatga

SEQ ID NO: 10006948 - DNA, 22 bp, Homo sapiens
tttcctcacttcatgagagttt

SEQ ID NO: 10006949 - DNA, 22 bp, Homo sapiens
tttcctctccggggcctccagg

SEQ ID NO: 10006950 - DNA, 22 bp, Homo sapiens
tttcctctccggggcctccagg

SEQ ID NO: 10006951 - DNA, 22 bp, Homo sapiens
tttcctctccaccaggaggtct

SEQ ID NO: 10006952 - DNA, 22 bp, Homo sapiens
tttcccttctttcctgagtaat

SEQ ID NO: 10006953 - DNA, 22 bp, Homo sapiens
tttccctttagcctgagaatcc

SEQ ID NO: 10006954 - DNA, 19 bp, Homo sapiens
tttcctaaaaagctgtgct

SEQ ID NO: 10006955 - DNA, 19 bp, Homo sapiens
tttcctaaaaagctgtgct

SEQ ID NO: 10006956 - DNA, 22 bp, Homo sapiens
tttcctaacacaatgcatgaga

SEQ ID NO: 10006957 - DNA, 22 bp, Homo sapiens
tttccctttagcctgagaatcc

SEQ ID NO: 10006958 - DNA, 19 bp, Homo sapiens
tttcttttcccctcagcac

SEQ ID NO: 10006959 - DNA, 22 bp, Homo sapiens
tttcttttgaatagtgtgtggt

SEQ ID NO: 10006960 - DNA, 19 bp, Homo sapiens
tttcttttcccctcagcac

SEQ ID NO: 10006961 - DNA, 22 bp, Homo sapiens
tttcttttgaatagtgtgtggt

SEQ ID NO: 10006962 - DNA, 22 bp, Homo sapiens
tttcttttccaatatccctact

SEQ ID NO: 10006963 - DNA, 19 bp, Homo sapiens
tttcttttcccctcagcac

SEQ ID NO: 10006964 - DNA, 22 bp, Homo sapiens
tttcttttgctgagaggggcac

SEQ ID NO: 10006965 - DNA, 22 bp, Homo sapiens
tttgaaagcaccatttgagtag

SEQ ID NO: 10006966 - DNA, 22 bp, Homo sapiens
tttcttttgccctgtgggttag

SEQ ID NO: 10006967 - DNA, 22 bp, Homo sapiens
tttcttttgccctgtgggttag

SEQ ID NO: 10006968 - DNA, 22 bp, Homo sapiens
tttcttttgctgagaggggcac

SEQ ID NO: 10006969 - DNA, 22 bp, Homo sapiens
tttcttttgaatagtgtgtggt

SEQ ID NO: 10006970 - DNA, 22 bp, Homo sapiens
tttcttttgccctgtgggttag

SEQ ID NO: 10006971 - DNA, 22 bp, Homo sapiens
tttcttttgccctgtgggttag

SEQ ID NO: 10006972 - DNA, 22 bp, Homo sapiens
tttctttgagtctcagtttgct

SEQ ID NO: 10006973 - DNA, 22 bp, Homo sapiens
tttctttgagtctcagtttgct

SEQ ID NO: 10006974 - DNA, 22 bp, Homo sapiens
tttctttgagtctcagtttgct

SEQ ID NO: 10006975 - DNA, 18 bp, Homo sapiens
tttctttctgcctggggc

SEQ ID NO: 10006976 - DNA, 22 bp, Homo sapiens
tttctttgtagtagcataatca

SEQ ID NO: 10006977 - DNA, 22 bp, Homo sapiens
tttctttgtagtagcataatca

SEQ ID NO: 10006978 - DNA, 22 bp, Homo sapiens
tttctttgtagtagcataatca

SEQ ID NO: 10006979 - DNA, 22 bp, Homo sapiens
tttctttgttgttatcacatca

SEQ ID NO: 10006980 - DNA, 22 bp, Homo sapiens
tttcttttacagtgtggctatt

SEQ ID NO: 10006981 - DNA, 22 bp, Homo sapiens
tttctttgttgttatcacatca

SEQ ID NO: 10006982 - DNA, 22 bp, Homo sapiens
tttcttttacagtgtggctatt

SEQ ID NO: 10006983 - DNA, 22 bp, Homo sapiens
tttgaagagccacagtgaaatt

SEQ ID NO: 10006984 - DNA, 22 bp, Homo sapiens
tttgaagactactgggagtgaa

SEQ ID NO: 10006985 - DNA, 22 bp, Homo sapiens
tttgaatagcataggattacat

SEQ ID NO: 10006986 - DNA, 22 bp, Homo sapiens
tttgaatagggctttgcaggga

SEQ ID NO: 10006987 - DNA, 22 bp, Homo sapiens
tttgaagataaatatggagaaa

SEQ ID NO: 10006988 - DNA, 22 bp, Homo sapiens
tttgaagataaatatggagaaa

SEQ ID NO: 10006989 - DNA, 22 bp, Homo sapiens
tttgaatatacttcaaacaaag

SEQ ID NO: 10006990 - DNA, 19 bp, Homo sapiens
tttgaatataatgcagcta

SEQ ID NO: 10006991 - DNA, 22 bp, Homo sapiens
tttgaatctgatatggcagcat

SEQ ID NO: 10006992 - DNA, 22 bp, Homo sapiens
tttgaaagcctggcttttctct

SEQ ID NO: 10006993 - DNA, 21 bp, Homo sapiens
tttgaaagccctatgttttca

SEQ ID NO: 10006994 - DNA, 21 bp, Homo sapiens
tttgaaagctacatctatagc

SEQ ID NO: 10006995 - DNA, 19 bp, Homo sapiens
tttgaaaggattgttattt

SEQ ID NO: 10006996 - DNA, 22 bp, Homo sapiens
tttgaaagggaaataaactcct

SEQ ID NO: 10006997 - DNA, 22 bp, Homo sapiens
tttgaaagggacaaagtcactg

SEQ ID NO: 10006998 - DNA, 22 bp, Homo sapiens
tttgaaagggaaataaactcct

SEQ ID NO: 10006999 - DNA, 22 bp, Homo sapiens
tttgaaagggttatgagactga

SEQ ID NO: 10007000 - DNA, 22 bp, Homo sapiens
tttgaaaggaagttaatacttt

SEQ ID NO: 10007001 - DNA, 22 bp, Homo sapiens
tttgaaaggaattaggatgaca

SEQ ID NO: 10007002 - DNA, 22 bp, Homo sapiens
tttgaaaggagctttatccaga

SEQ ID NO: 10007003 - DNA, 22 bp, Homo sapiens
tttgaaaggagctttatccaga

SEQ ID NO: 10007004 - DNA, 22 bp, Homo sapiens
tttgacaaatatttattggcac

SEQ ID NO: 10007005 - DNA, 22 bp, Homo sapiens
tttgacagatagatgttatgtt

SEQ ID NO: 10007006 - DNA, 19 bp, Homo sapiens
tttgacagagtttgagcat

SEQ ID NO: 10007007 - DNA, 22 bp, Homo sapiens
tttgacagagctcttagtctct

SEQ ID NO: 10007008 - DNA, 22 bp, Homo sapiens
tttgacagacatttactacatt

SEQ ID NO: 10007009 - DNA, 22 bp, Homo sapiens
tttgacagacatttactacatt

SEQ ID NO: 10007010 - DNA, 22 bp, Homo sapiens
tttgacagaaagttattatttt

SEQ ID NO: 10007011 - DNA, 22 bp, Homo sapiens
tttgacaattcatgacatttat

SEQ ID NO: 10007012 - DNA, 22 bp, Homo sapiens
tttgacaagagggcatcttcag

SEQ ID NO: 10007013 - DNA, 22 bp, Homo sapiens
tttgacaagagggcatcttcag

SEQ ID NO: 10007014 - DNA, 22 bp, Homo sapiens
tttgacaattaggtagaaaaag

SEQ ID NO: 10007015 - DNA, 22 bp, Homo sapiens
tttgacaactgtgcagtttgta

SEQ ID NO: 10007016 - DNA, 22 bp, Homo sapiens
tttgacaactgtgcagtttgta

SEQ ID NO: 10007017 - DNA, 22 bp, Homo sapiens
tttttacacttagcattgagcg

SEQ ID NO: 10007018 - DNA, 22 bp, Homo sapiens
tttttacacttagcattgagcg

SEQ ID NO: 10007019 - DNA, 22 bp, Homo sapiens
tttttacacttagcattgagcg

SEQ ID NO: 10007020 - DNA, 22 bp, Homo sapiens
tttttacacttagcattgagcg

SEQ ID NO: 10007021 - DNA, 19 bp, Homo sapiens
tttttacaagtaggtgtga

SEQ ID NO: 10007022 - DNA, 19 bp, Homo sapiens
tttttacaagtaggtgtga

SEQ ID NO: 10007023 - DNA, 22 bp, Homo sapiens
ttttgtttaaaatcctggatgg

SEQ ID NO: 10007024 - DNA, 22 bp, Homo sapiens
ttttgtttaaaatcctggatgg

SEQ ID NO: 10007025 - DNA, 22 bp, Homo sapiens
ttttcttcctggattttggcat

SEQ ID NO: 10007026 - DNA, 22 bp, Homo sapiens
ttttgttggcttaagaaataca

SEQ ID NO: 10007027 - DNA, 22 bp, Homo sapiens
ttttcttatgtgcagctatatg

SEQ ID NO: 10007028 - DNA, 22 bp, Homo sapiens
ttttcttatgtgcagctatatg

SEQ ID NO: 10007029 - DNA, 22 bp, Homo sapiens
ttttcttatgtgcagctatatg

SEQ ID NO: 10007030 - DNA, 22 bp, Homo sapiens
tttttagaattggctgagaatt

SEQ ID NO: 10007031 - DNA, 22 bp, Homo sapiens
tttttacagtcatggtcactca

SEQ ID NO: 10007032 - DNA, 22 bp, Homo sapiens
tttttacagtcatggtcactca

SEQ ID NO: 10007033 - DNA, 22 bp, Homo sapiens
tttttacagtcatggtcactca

SEQ ID NO: 10007034 - DNA, 22 bp, Homo sapiens
tttttagagtgttaccagtata

SEQ ID NO: 10007035 - DNA, 22 bp, Homo sapiens
tttttagagtgttaccagtata

SEQ ID NO: 10007036 - DNA, 22 bp, Homo sapiens
tttttataccacctctcactta

SEQ ID NO: 10007037 - DNA, 22 bp, Homo sapiens
tttttagtagaggtgggtttca

SEQ ID NO: 10007038 - DNA, 22 bp, Homo sapiens
tttttatactttgctcaagatt

SEQ ID NO: 10007039 - DNA, 22 bp, Homo sapiens
tttttataccacctctcactta

SEQ ID NO: 10007040 - DNA, 22 bp, Homo sapiens
tttttataccacctctcactta

SEQ ID NO: 10007041 - DNA, 22 bp, Homo sapiens
tttttatcttgtatgtgtctct

SEQ ID NO: 10007042 - DNA, 22 bp, Homo sapiens
tttttatctacagattctcagc

SEQ ID NO: 10007043 - DNA, 22 bp, Homo sapiens
tttttcaagacaacctgcatgt

SEQ ID NO: 10007044 - DNA, 22 bp, Homo sapiens
tttttatcttgtatgtgtctct

SEQ ID NO: 10007045 - DNA, 22 bp, Homo sapiens
tttttcagccatgaattacact

SEQ ID NO: 10007046 - DNA, 22 bp, Homo sapiens
tttttcagccatgaattacact

SEQ ID NO: 10007047 - DNA, 22 bp, Homo sapiens
tttttcatattcccctctctgg

SEQ ID NO: 10007048 - DNA, 22 bp, Homo sapiens
tttttcatattcccctctctgg

SEQ ID NO: 10007049 - DNA, 22 bp, Homo sapiens
tttttcatctgattgataactc

SEQ ID NO: 10007050 - DNA, 22 bp, Homo sapiens
tttttcatattcccctctctgg

SEQ ID NO: 10007051 - DNA, 22 bp, Homo sapiens
aattccacagatgtctatctgt

SEQ ID NO: 10007052 - DNA, 22 bp, Homo sapiens
aattccaacagacaaagttaga

SEQ ID NO: 10007053 - DNA, 22 bp, Homo sapiens
aattccaagagcttcctaagtg

SEQ ID NO: 10007054 - DNA, 22 bp, Homo sapiens
aattccacagatgtctatctgt

SEQ ID NO: 10007055 - DNA, 22 bp, Homo sapiens
agaggaagctgagatgcctctt

SEQ ID NO: 10007056 - DNA, 22 bp, Homo sapiens
agagctgggtggtggtgactca

SEQ ID NO: 10007057 - DNA, 22 bp, Homo sapiens
agaggaagtaatcaggacctgc

SEQ ID NO: 10007058 - DNA, 22 bp, Homo sapiens
agaggaagtaatcaggacctgc

SEQ ID NO: 10007059 - DNA, 22 bp, Homo sapiens
agaggaagtaatcaggacctgc

SEQ ID NO: 10007060 - DNA, 21 bp, Homo sapiens
agaggaagtgattggtctggc

SEQ ID NO: 10007061 - DNA, 22 bp, Homo sapiens
aatttcctgggataaaaagcca

SEQ ID NO: 10007062 - DNA, 22 bp, Homo sapiens
aatttcctgggataaaaagcca

SEQ ID NO: 10007063 - DNA, 22 bp, Homo sapiens
aatttcaattacttttgcacca

SEQ ID NO: 10007064 - DNA, 22 bp, Homo sapiens
aatttcacagtgaactttgagg

SEQ ID NO: 10007065 - DNA, 22 bp, Homo sapiens
agaggatggttgaggaagacct

SEQ ID NO: 10007066 - DNA, 22 bp, Homo sapiens
agaggatgttctaggcactcat

SEQ ID NO: 10007067 - DNA, 22 bp, Homo sapiens
aatttcaatgcactcatggttg

SEQ ID NO: 10007068 - DNA, 22 bp, Homo sapiens
aatttcaatgcactcatggttg

SEQ ID NO: 10007069 - DNA, 22 bp, Homo sapiens
agaggaggtggtgatgctttaa

SEQ ID NO: 10007070 - DNA, 22 bp, Homo sapiens
agaggaggtggtgatgctttaa

SEQ ID NO: 10007071 - DNA, 22 bp, Homo sapiens
agaggatgattttaaggacact

SEQ ID NO: 10007072 - DNA, 22 bp, Homo sapiens
agaggatgattttaaggacact

SEQ ID NO: 10007073 - DNA, 22 bp, Homo sapiens
agaggatgattttaaggacact

SEQ ID NO: 10007074 - DNA, 22 bp, Homo sapiens
aattcatatggatatgctagta

SEQ ID NO: 10007075 - DNA, 22 bp, Homo sapiens
aattcatatggatatgctagta

SEQ ID NO: 10007076 - DNA, 22 bp, Homo sapiens
aattcatagcaacaaagaccca

SEQ ID NO: 10007077 - DNA, 22 bp, Homo sapiens
aattcatactctatattgcttt

SEQ ID NO: 10007078 - DNA, 22 bp, Homo sapiens
agagctggaagctgctcttaga

SEQ ID NO: 10007079 - DNA, 22 bp, Homo sapiens
agagctgagaatgtggcttcct

SEQ ID NO: 10007080 - DNA, 22 bp, Homo sapiens
agagctgagaatgtggcttcct

SEQ ID NO: 10007081 - DNA, 22 bp, Homo sapiens
agagctgagcaccaagcatggt

SEQ ID NO: 10007082 - DNA, 22 bp, Homo sapiens
agagctgaggatccagctgagc

SEQ ID NO: 10007083 - DNA, 22 bp, Homo sapiens
agagctgaggatccagctgagc

SEQ ID NO: 10007084 - DNA, 22 bp, Homo sapiens
agagctgcaatttcatgtggtg

SEQ ID NO: 10007085 - DNA, 22 bp, Homo sapiens
agagctgcagggtggacccagg

SEQ ID NO: 10007086 - DNA, 22 bp, Homo sapiens
agagctgcacctatgcagacct

SEQ ID NO: 10007087 - DNA, 22 bp, Homo sapiens
agagctgcaatttcatgtggtg

SEQ ID NO: 10007088 - DNA, 22 bp, Homo sapiens
agagctgcccacacagcagatt

SEQ ID NO: 10007089 - DNA, 22 bp, Homo sapiens
agagctgccgagctggggccat

SEQ ID NO: 10007090 - DNA, 23 bp, Homo sapiens
aattacaaccaagaactggaagg

SEQ ID NO: 10007091 - DNA, 22 bp, Homo sapiens
aattacaaatgtagactctcat

SEQ ID NO: 10007092 - DNA, 22 bp, Homo sapiens
agagctgaattcaagtgctggc

SEQ ID NO: 10007093 - DNA, 22 bp, Homo sapiens
agagcctggctcccagctaccg

SEQ ID NO: 10007094 - DNA, 21 bp, Homo sapiens
aattacagatggaattacaga

SEQ ID NO: 10007095 - DNA, 22 bp, Homo sapiens
aattaatggaaagtaaggaagg

SEQ ID NO: 10007096 - DNA, 22 bp, Homo sapiens
aattaatatttgtggaattaat

SEQ ID NO: 10007097 - DNA, 22 bp, Homo sapiens
aattaagtcacacacctaaacc

SEQ ID NO: 10007098 - DNA, 22 bp, Homo sapiens
aattaagaaaatgttttatgat

SEQ ID NO: 10007099 - DNA, 22 bp, Homo sapiens
aattaagtcacacacctaaacc

SEQ ID NO: 10007100 - DNA, 22 bp, Homo sapiens
aattaagtcacacacctaaacc

SEQ ID NO: 10007101 - DNA, 22 bp, Homo sapiens
aattaacagagggcttattact

SEQ ID NO: 10007102 - DNA, 22 bp, Homo sapiens
aattaacagagggcttattact

SEQ ID NO: 10007103 - DNA, 22 bp, Homo sapiens
agagcacagcagatctctgatg

SEQ ID NO: 10007104 - DNA, 22 bp, Homo sapiens
agagcacaaattagttggtctt

SEQ ID NO: 10007105 - DNA, 22 bp, Homo sapiens
agagcacaaattagttggtctt

SEQ ID NO: 10007106 - DNA, 22 bp, Homo sapiens
agagcacaaattttaaggaggc

SEQ ID NO: 10007107 - DNA, 22 bp, Homo sapiens
agagcacactgacgtcagtctg

SEQ ID NO: 10007108 - DNA, 22 bp, Homo sapiens
agagcacagaagaataggtgct

SEQ ID NO: 10007109 - DNA, 22 bp, Homo sapiens
aatgtattatacataatttgtg

SEQ ID NO: 10007110 - DNA, 22 bp, Homo sapiens
aatgtatgggtgagaaagttga

SEQ ID NO: 10007111 - DNA, 23 bp, Homo sapiens
aatgtatgttagtatcttagaga

SEQ ID NO: 10007112 - DNA, 22 bp, Homo sapiens
aatgtatgtgtatatcaaatca

SEQ ID NO: 10007113 - DNA, 22 bp, Homo sapiens
aatgtataatatttaatgcttt

SEQ ID NO: 10007114 - DNA, 22 bp, Homo sapiens
aatgtataatatttaatgcttt

SEQ ID NO: 10007115 - DNA, 20 bp, Homo sapiens
aatgtatattttatgccagg

SEQ ID NO: 10007116 - DNA, 22 bp, Homo sapiens
aatgtatgagcgtgaaagcact

SEQ ID NO: 10007117 - DNA, 22 bp, Homo sapiens
aatgtatgagcgtgaaagcact

SEQ ID NO: 10007118 - DNA, 22 bp, Homo sapiens
aatgtataaccataggaaattt

SEQ ID NO: 10007119 - DNA, 22 bp, Homo sapiens
aatgtataatatttaatgcttt

SEQ ID NO: 10007120 - DNA, 22 bp, Homo sapiens
aatgtataatatttaatgcttt

SEQ ID NO: 10007121 - DNA, 22 bp, Homo sapiens
aatgtataatatttaatgcttt

SEQ ID NO: 10007122 - DNA, 22 bp, Homo sapiens
agacatttatgtttctctagga

SEQ ID NO: 10007123 - DNA, 22 bp, Homo sapiens
agacatttatgtttctctagga

SEQ ID NO: 10007124 - DNA, 22 bp, Homo sapiens
agacatggtttattttaatggt

SEQ ID NO: 10007125 - DNA, 22 bp, Homo sapiens
agacattatgctgagtgaaaga

SEQ ID NO: 10007126 - DNA, 22 bp, Homo sapiens
agacattatgctgagtgaaaga

SEQ ID NO: 10007127 - DNA, 22 bp, Homo sapiens
aatgctctttgaatttgtcaga

SEQ ID NO: 10007128 - DNA, 22 bp, Homo sapiens
aatgctaacattggtttatatc

SEQ ID NO: 10007129 - DNA, 22 bp, Homo sapiens
aatgctattcattaagcctact

SEQ ID NO: 10007130 - DNA, 22 bp, Homo sapiens
aatgccttgcctgctacaactt

SEQ ID NO: 10007131 - DNA, 22 bp, Homo sapiens
aatgccttgcctgctacaactt

SEQ ID NO: 10007132 - DNA, 22 bp, Homo sapiens
aatgctaaaatggcactaaagt

SEQ ID NO: 10007133 - DNA, 22 bp, Homo sapiens
aatgctaacattggtttatatc

SEQ ID NO: 10007134 - DNA, 22 bp, Homo sapiens
aatgctaaaacacagatttttg

SEQ ID NO: 10007135 - DNA, 22 bp, Homo sapiens
aatgctaaaacacagatttttg

SEQ ID NO: 10007136 - DNA, 22 bp, Homo sapiens
agacatctacctttcattcaaa

SEQ ID NO: 10007137 - DNA, 22 bp, Homo sapiens
agacatctcccatgcattttta

SEQ ID NO: 10007138 - DNA, 22 bp, Homo sapiens
agacatctctatgcaggatctc

SEQ ID NO: 10007139 - DNA, 22 bp, Homo sapiens
agacatcttgcacacatatact

SEQ ID NO: 10007140 - DNA, 22 bp, Homo sapiens
agacatcttgcacacatatact

SEQ ID NO: 10007141 - DNA, 22 bp, Homo sapiens
agacatgaaaattccaaacatc

SEQ ID NO: 10007142 - DNA, 22 bp, Homo sapiens
agacatgacagatagttgctag

SEQ ID NO: 10007143 - DNA, 19 bp, Homo sapiens
agacatgagacacaggatg

SEQ ID NO: 10007144 - DNA, 22 bp, Homo sapiens
agacatgccaagaaacccagtg

SEQ ID NO: 10007145 - DNA, 22 bp, Homo sapiens
agacatcagcttgtgtgcaggg

SEQ ID NO: 10007146 - DNA, 22 bp, Homo sapiens
agacatcaatgatcagaggtag

SEQ ID NO: 10007147 - DNA, 23 bp, Homo sapiens
agacatcaggatggtggctggga

SEQ ID NO: 10007148 - DNA, 19 bp, Homo sapiens
aatgctgcttctttttgca

SEQ ID NO: 10007149 - DNA, 21 bp, Homo sapiens
aatgctgcccagtaagatggc

SEQ ID NO: 10007150 - DNA, 22 bp, Homo sapiens
aatgctgctctcataattatag

SEQ ID NO: 10007151 - DNA, 22 bp, Homo sapiens
aatgctgcaagaggtgaaaaga

SEQ ID NO: 10007152 - DNA, 22 bp, Homo sapiens
agagaagggcctgtatgtaatc

SEQ ID NO: 10007153 - DNA, 22 bp, Homo sapiens
agagaagggcctgtatgtaatc

SEQ ID NO: 10007154 - DNA, 22 bp, Homo sapiens
agagaagggggaaagatctcac

SEQ ID NO: 10007155 - DNA, 22 bp, Homo sapiens
aatgtgtagcatttaatgcagt

SEQ ID NO: 10007156 - DNA, 22 bp, Homo sapiens
aatgtgtagcatttaatgcagt

SEQ ID NO: 10007157 - DNA, 22 bp, Homo sapiens
aatgtgtagatgttgcattcct

SEQ ID NO: 10007158 - DNA, 22 bp, Homo sapiens
aatgtgtagatgttgcattcct

SEQ ID NO: 10007159 - DNA, 22 bp, Homo sapiens
aatgtgtagcagaaccaggatt

SEQ ID NO: 10007160 - DNA, 22 bp, Homo sapiens
agagaaggggtaaagagtcctg

SEQ ID NO: 10007161 - DNA, 22 bp, Homo sapiens
aatgtgtactttttcatgctca

SEQ ID NO: 10007162 - DNA, 22 bp, Homo sapiens
agagaagggcctgtatgtaatc

SEQ ID NO: 10007163 - DNA, 21 bp, Homo sapiens
agagaagggattccaggccct

SEQ ID NO: 10007164 - DNA, 21 bp, Homo sapiens
agagaagggactcttccagtc

SEQ ID NO: 10007165 - DNA, 21 bp, Homo sapiens
agagaagggattccaggccct

SEQ ID NO: 10007166 - DNA, 22 bp, Homo sapiens
agagaaggcatagaacttgagt

SEQ ID NO: 10007167 - DNA, 22 bp, Homo sapiens
agagaaggcatagaacttgagt

SEQ ID NO: 10007168 - DNA, 22 bp, Homo sapiens
agagaaggcatagaacttgagt

SEQ ID NO: 10007169 - DNA, 19 bp, Homo sapiens
agagaaggatcctatggtt

SEQ ID NO: 10007170 - DNA, 19 bp, Homo sapiens
agagaaggatcctatggtt

SEQ ID NO: 10007171 - DNA, 19 bp, Homo sapiens
agagaaggatcctatggtt

SEQ ID NO: 10007172 - DNA, 22 bp, Homo sapiens
agagaaattctcagtggaagat

SEQ ID NO: 10007173 - DNA, 22 bp, Homo sapiens
aatgtattatacataatttgtg

SEQ ID NO: 10007174 - DNA, 22 bp, Homo sapiens
agagaaatggggtaatctttca

SEQ ID NO: 10007175 - DNA, 22 bp, Homo sapiens
agagcaagtgacagaaacaggg

SEQ ID NO: 10007176 - DNA, 22 bp, Homo sapiens
agagcaagtgacagaaacaggg

SEQ ID NO: 10007177 - DNA, 23 bp, Homo sapiens
agagcaaggaaatgaggtgtgat

SEQ ID NO: 10007178 - DNA, 23 bp, Homo sapiens
agagcaaggaaatgaggtgtgat

SEQ ID NO: 10007179 - DNA, 22 bp, Homo sapiens
agagcaagtgacagaaacaggg

SEQ ID NO: 10007180 - DNA, 22 bp, Homo sapiens
agagcaagtgacagaaacaggg

SEQ ID NO: 10007181 - DNA, 22 bp, Homo sapiens
agagcaagtgacagaaacaggg

SEQ ID NO: 10007182 - DNA, 22 bp, Homo sapiens
agagcaagtgacagaaacaggg

SEQ ID NO: 10007183 - DNA, 22 bp, Homo sapiens
agagcaaagggacatggaagag

SEQ ID NO: 10007184 - DNA, 22 bp, Homo sapiens
agagcaaatagagaagccagct

SEQ ID NO: 10007185 - DNA, 22 bp, Homo sapiens
agagatgaaaagggtactgagg

SEQ ID NO: 10007186 - DNA, 22 bp, Homo sapiens
aatgtgtgttcggggcccagag

SEQ ID NO: 10007187 - DNA, 22 bp, Homo sapiens
aatgtgtgaacttcagagcatc

SEQ ID NO: 10007188 - DNA, 22 bp, Homo sapiens
aatgtgtgaacactaatgcaac

SEQ ID NO: 10007189 - DNA, 22 bp, Homo sapiens
aatgtgtgcctgttaaggggca

SEQ ID NO: 10007190 - DNA, 22 bp, Homo sapiens
aatgtgtgtatttctaggcgag

SEQ ID NO: 10007191 - DNA, 22 bp, Homo sapiens
aatgtgtatatgaacatacagg

SEQ ID NO: 10007192 - DNA, 22 bp, Homo sapiens
aatgtgtatgaggaagagagaa

SEQ ID NO: 10007193 - DNA, 22 bp, Homo sapiens
aatgtgtataagggagagctaa

SEQ ID NO: 10007194 - DNA, 22 bp, Homo sapiens
aatgtgtatactggcaattaag

SEQ ID NO: 10007195 - DNA, 22 bp, Homo sapiens
aatgtgtatatgaacatacagg

SEQ ID NO: 10007196 - DNA, 22 bp, Homo sapiens
aatgtgtataagggagagctaa

SEQ ID NO: 10007197 - DNA, 22 bp, Homo sapiens
aatgtgtagtcattgatcaaga

SEQ ID NO: 10007198 - DNA, 22 bp, Homo sapiens
aatttctccaagaatgcttaga

SEQ ID NO: 10007199 - DNA, 22 bp, Homo sapiens
aatttctccaagaatgcttaga

SEQ ID NO: 10007200 - DNA, 22 bp, Homo sapiens
aatttctcggttttgatattgt

SEQ ID NO: 10007201 - DNA, 22 bp, Homo sapiens
aatttctcactctcttgatcac

SEQ ID NO: 10007202 - DNA, 22 bp, Homo sapiens
aatttctaattgaatctctctt

SEQ ID NO: 10007203 - DNA, 22 bp, Homo sapiens
aatttctctctcatgcttcatg

SEQ ID NO: 10007204 - DNA, 22 bp, Homo sapiens
aatttcttcagctctaaaatgg

SEQ ID NO: 10007205 - DNA, 22 bp, Homo sapiens
aatttcttcagctctaaaatgg

SEQ ID NO: 10007206 - DNA, 22 bp, Homo sapiens
aatttcttcagctctaaaatgg

SEQ ID NO: 10007207 - DNA, 18 bp, Homo sapiens
aatttctttgacaactta

SEQ ID NO: 10007208 - DNA, 18 bp, Homo sapiens
aatttctttgacaactta

SEQ ID NO: 10007209 - DNA, 18 bp, Homo sapiens
aatttctttgacaactta

SEQ ID NO: 10007210 - DNA, 22 bp, Homo sapiens
aatttggagagaaacaagtagg

SEQ ID NO: 10007211 - DNA, 22 bp, Homo sapiens
aatttggagagagattaatgtt

SEQ ID NO: 10007212 - DNA, 22 bp, Homo sapiens
aatttggcagtgtcttgaagta

SEQ ID NO: 10007213 - DNA, 22 bp, Homo sapiens
aatttggaagatgttgtttatc

SEQ ID NO: 10007214 - DNA, 22 bp, Homo sapiens
aatttgccttaccttcttccaa

SEQ ID NO: 10007215 - DNA, 21 bp, Homo sapiens
agagttactgtcatcctaggt

SEQ ID NO: 10007216 - DNA, 22 bp, Homo sapiens
agagttatggacttaatgcagg

SEQ ID NO: 10007217 - DNA, 22 bp, Homo sapiens
agagttatattggttgagaatt

SEQ ID NO: 10007218 - DNA, 22 bp, Homo sapiens
agagtgtgtggggctgaggtca

SEQ ID NO: 10007219 - DNA, 22 bp, Homo sapiens
agagtgtggaaatgttcagagt

SEQ ID NO: 10007220 - DNA, 22 bp, Homo sapiens
aatttgtacaaaatgtttataa

SEQ ID NO: 10007221 - DNA, 22 bp, Homo sapiens
aatttggggaggttcagactct

SEQ ID NO: 10007222 - DNA, 22 bp, Homo sapiens
aatttgggcgaggagggaggca

SEQ ID NO: 10007223 - DNA, 22 bp, Homo sapiens
agagtgaagttcatcgtgcagc

SEQ ID NO: 10007224 - DNA, 22 bp, Homo sapiens
aatttgtataaaatggtgtttt

SEQ ID NO: 10007225 - DNA, 22 bp, Homo sapiens
aatttgtacaaaatgtttataa

SEQ ID NO: 10007226 - DNA, 22 bp, Homo sapiens
agagtgacagccactgcagtaa

SEQ ID NO: 10007227 - DNA, 20 bp, Homo sapiens
agagtgggtgtcacaggctg

SEQ ID NO: 10007228 - DNA, 22 bp, Homo sapiens
acaaagtttgtggtattccaag

SEQ ID NO: 10007229 - DNA, 22 bp, Homo sapiens
acaaagtttcttctaacatctg

SEQ ID NO: 10007230 - DNA, 22 bp, Homo sapiens
acaaagtgctgacattacaggc

SEQ ID NO: 10007231 - DNA, 22 bp, Homo sapiens
acaaagtgtgcggagcccaggg

SEQ ID NO: 10007232 - DNA, 22 bp, Homo sapiens
acaaagtgttttctgaaggcct

SEQ ID NO: 10007233 - DNA, 22 bp, Homo sapiens
acaaagtgtgcggagcccaggg

SEQ ID NO: 10007234 - DNA, 22 bp, Homo sapiens
acaaagtgttttctgaaggcct

SEQ ID NO: 10007235 - DNA, 22 bp, Homo sapiens
acaaatagagattcaaataaag

SEQ ID NO: 10007236 - DNA, 22 bp, Homo sapiens
acaaatagaaaatctggattgg

SEQ ID NO: 10007237 - DNA, 22 bp, Homo sapiens
acaaataggtagatttgcaaca

SEQ ID NO: 10007238 - DNA, 22 bp, Homo sapiens
acaaataggtagatttgcaaca

SEQ ID NO: 10007239 - DNA, 22 bp, Homo sapiens
agatctttagtgaagctaaatc

SEQ ID NO: 10007240 - DNA, 22 bp, Homo sapiens
agatctttagtgaagctaaatc

SEQ ID NO: 10007241 - DNA, 22 bp, Homo sapiens
agatgcagaaaaactaagtgat

SEQ ID NO: 10007242 - DNA, 22 bp, Homo sapiens
acaaagtgaaaagcatcgaatt

SEQ ID NO: 10007243 - DNA, 22 bp, Homo sapiens
acaaagtctctaataatcttct

SEQ ID NO: 10007244 - DNA, 22 bp, Homo sapiens
acaaagtgcacaagatgagaac

SEQ ID NO: 10007245 - DNA, 19 bp, Homo sapiens
acaaagtgcgtgctctttt

SEQ ID NO: 10007246 - DNA, 22 bp, Homo sapiens
acaaagtgaattgcatcgagtt

SEQ ID NO: 10007247 - DNA, 19 bp, Homo sapiens
acaaagtgcgtgctctttt

SEQ ID NO: 10007248 - DNA, 22 bp, Homo sapiens
agagttcacactcagtgcaccc

SEQ ID NO: 10007249 - DNA, 20 bp, Homo sapiens
acaaagtattgaggacaagt

SEQ ID NO: 10007250 - DNA, 20 bp, Homo sapiens
acaaagtattgaggacaagt

SEQ ID NO: 10007251 - DNA, 22 bp, Homo sapiens
agagttccacgtacagcttttg

SEQ ID NO: 10007252 - DNA, 22 bp, Homo sapiens
acaaagtcacaataattaacct

SEQ ID NO: 10007253 - DNA, 22 bp, Homo sapiens
acaacagtagcctttacaaggc

SEQ ID NO: 10007254 - DNA, 22 bp, Homo sapiens
agatgctgattgaatagatttc

SEQ ID NO: 10007255 - DNA, 22 bp, Homo sapiens
acaacagagctggactgagagg

SEQ ID NO: 10007256 - DNA, 22 bp, Homo sapiens
agatgctgctccacaggccagg

SEQ ID NO: 10007257 - DNA, 22 bp, Homo sapiens
agatgctgcctctcctcacaag

SEQ ID NO: 10007258 - DNA, 22 bp, Homo sapiens
agatgcatgtttatgtctttcc

SEQ ID NO: 10007259 - DNA, 21 bp, Homo sapiens
agatgcagttatgagatgcag

SEQ ID NO: 10007260 - DNA, 21 bp, Homo sapiens
agatgcagtttgcaggtgggt

SEQ ID NO: 10007261 - DNA, 21 bp, Homo sapiens
agatgcagtttgcaggtgggt

SEQ ID NO: 10007262 - DNA, 22 bp, Homo sapiens
agatgcagagtttgctgtggac

SEQ ID NO: 10007263 - DNA, 22 bp, Homo sapiens
agatgcagacttggttcaggca

SEQ ID NO: 10007264 - DNA, 22 bp, Homo sapiens
acaacattcttaaatacactga

SEQ ID NO: 10007265 - DNA, 22 bp, Homo sapiens
agattttggctggctggagaga

SEQ ID NO: 10007266 - DNA, 22 bp, Homo sapiens
acaacagtccagtatagactgt

SEQ ID NO: 10007267 - DNA, 22 bp, Homo sapiens
acaacagtgtggtggaaggagc

SEQ ID NO: 10007268 - DNA, 22 bp, Homo sapiens
acaacagtgtggtggaaggagc

SEQ ID NO: 10007269 - DNA, 22 bp, Homo sapiens
acaacagtccagtatagactgt

SEQ ID NO: 10007270 - DNA, 22 bp, Homo sapiens
acaacattatacatagaaagct

SEQ ID NO: 10007271 - DNA, 22 bp, Homo sapiens
acaacattatacatagaaagct

SEQ ID NO: 10007272 - DNA, 22 bp, Homo sapiens
acaacatcagctgagaccttca

SEQ ID NO: 10007273 - DNA, 22 bp, Homo sapiens
agcaaagctgattaagagcaca

SEQ ID NO: 10007274 - DNA, 21 bp, Homo sapiens
agcaaaggcaggagaggtttc

SEQ ID NO: 10007275 - DNA, 19 bp, Homo sapiens
agcaaatacatcaaaattg

SEQ ID NO: 10007276 - DNA, 19 bp, Homo sapiens
agcaaatacatcaaaattg

SEQ ID NO: 10007277 - DNA, 19 bp, Homo sapiens
agcaaatacatcaaaattg

SEQ ID NO: 10007278 - DNA, 22 bp, Homo sapiens
acaatagaaggaaactgacata

SEQ ID NO: 10007279 - DNA, 22 bp, Homo sapiens
acaatagaaggaaactgacata

SEQ ID NO: 10007280 - DNA, 22 bp, Homo sapiens
acaatagaaataattaagcaca

SEQ ID NO: 10007281 - DNA, 22 bp, Homo sapiens
acaatagaaataattaagcaca

SEQ ID NO: 10007282 - DNA, 20 bp, Homo sapiens
acaatacaggttgtgtctga

SEQ ID NO: 10007283 - DNA, 20 bp, Homo sapiens
acaatacaggttgtgtctga

SEQ ID NO: 10007284 - DNA, 22 bp, Homo sapiens
acaatactattttcagtatcct

SEQ ID NO: 10007285 - DNA, 20 bp, Homo sapiens
acaatacaggttgtgtctga

SEQ ID NO: 10007286 - DNA, 22 bp, Homo sapiens
acaataatgtattgccaaaagt

SEQ ID NO: 10007287 - DNA, 22 bp, Homo sapiens
acaataatgtattgccaaaagt

SEQ ID NO: 10007288 - DNA, 19 bp, Homo sapiens
agcaaatataatagtgttc

SEQ ID NO: 10007289 - DNA, 22 bp, Homo sapiens
agcaaatacttttcactgagcc

SEQ ID NO: 10007290 - DNA, 22 bp, Homo sapiens
agcaaatacttgaataaaaaga

SEQ ID NO: 10007291 - DNA, 22 bp, Homo sapiens
agcaaatacatttttagcataa

SEQ ID NO: 10007292 - DNA, 22 bp, Homo sapiens
agcaaatacatttttagcataa

SEQ ID NO: 10007293 - DNA, 22 bp, Homo sapiens
agcaaatacttgaataaaaaga

SEQ ID NO: 10007294 - DNA, 19 bp, Homo sapiens
agcaaatataatagtgttc

SEQ ID NO: 10007295 - DNA, 18 bp, Homo sapiens
agcaaatattaagtgcat

SEQ ID NO: 10007296 - DNA, 22 bp, Homo sapiens
acaagtttttgatagactagaa

SEQ ID NO: 10007297 - DNA, 22 bp, Homo sapiens
acaagtttttgatagactagaa

SEQ ID NO: 10007298 - DNA, 22 bp, Homo sapiens
acaagttttggaagtcttaagg

SEQ ID NO: 10007299 - DNA, 22 bp, Homo sapiens
acaagttttggaagtcttaagg

SEQ ID NO: 10007300 - DNA, 22 bp, Homo sapiens
acacaaattgtaggataattgc

SEQ ID NO: 10007301 - DNA, 22 bp, Homo sapiens
acacaacagaagagcaattgca

SEQ ID NO: 10007302 - DNA, 22 bp, Homo sapiens
acacaacagaagagcaattgca

SEQ ID NO: 10007303 - DNA, 22 bp, Homo sapiens
acacaaattgtaggataattgc

SEQ ID NO: 10007304 - DNA, 22 bp, Homo sapiens
acacaacagaagagcaattgca

SEQ ID NO: 10007305 - DNA, 22 bp, Homo sapiens
acacaacagaagagcaattgca

SEQ ID NO: 10007306 - DNA, 22 bp, Homo sapiens
acacaagaagttaatgggcaaa

SEQ ID NO: 10007307 - DNA, 21 bp, Homo sapiens
acacaacaggcagtcattttc

SEQ ID NO: 10007308 - DNA, 22 bp, Homo sapiens
agcacagggcccagcctaggcc

SEQ ID NO: 10007309 - DNA, 22 bp, Homo sapiens
agcacaggtaatacagagtaac

SEQ ID NO: 10007310 - DNA, 22 bp, Homo sapiens
agcacaggtaatacagagtaac

SEQ ID NO: 10007311 - DNA, 22 bp, Homo sapiens
acacaaattgtaggataattgc

SEQ ID NO: 10007312 - DNA, 22 bp, Homo sapiens
agcacagggacaatgccaggtg

SEQ ID NO: 10007313 - DNA, 22 bp, Homo sapiens
agcacagggacaatgccaggtg

SEQ ID NO: 10007314 - DNA, 22 bp, Homo sapiens
agcacagggcccagcctaggcc

SEQ ID NO: 10007315 - DNA, 22 bp, Homo sapiens
agcacaggctttggtgtgaggg

SEQ ID NO: 10007316 - DNA, 22 bp, Homo sapiens
agcacaaaagcagccacagatg

SEQ ID NO: 10007317 - DNA, 22 bp, Homo sapiens
agcacacagtattagccattgt

SEQ ID NO: 10007318 - DNA, 22 bp, Homo sapiens
agcacacaggccacctccactt

SEQ ID NO: 10007319 - DNA, 22 bp, Homo sapiens
agcacacatcacttctgctcat

SEQ ID NO: 10007320 - DNA, 22 bp, Homo sapiens
agcacacatcacttctgctcat

SEQ ID NO: 10007321 - DNA, 22 bp, Homo sapiens
agcacagaaagcacatttgaaa

SEQ ID NO: 10007322 - DNA, 22 bp, Homo sapiens
agcacaggaccaaggaagctgt

SEQ ID NO: 10007323 - DNA, 22 bp, Homo sapiens
agcacaggaacatggagatggg

SEQ ID NO: 10007324 - DNA, 21 bp, Homo sapiens
agcacagctttaagccatgtg

SEQ ID NO: 10007325 - DNA, 22 bp, Homo sapiens
agcacagaatgaggtggaagtg

SEQ ID NO: 10007326 - DNA, 19 bp, Homo sapiens
agcacagacaagaccagca

SEQ ID NO: 10007327 - DNA, 22 bp, Homo sapiens
agcacagaatggcttggaagcc

SEQ ID NO: 10007328 - DNA, 22 bp, Homo sapiens
acacatctatattgcatctgca

SEQ ID NO: 10007329 - DNA, 22 bp, Homo sapiens
acacatctatctctacacaagg

SEQ ID NO: 10007330 - DNA, 22 bp, Homo sapiens
acacatcatgccaagtttcacc

SEQ ID NO: 10007331 - DNA, 22 bp, Homo sapiens
acacatcagaaatatgaatgag

SEQ ID NO: 10007332 - DNA, 22 bp, Homo sapiens
acacatcagaaatatgaatgag

SEQ ID NO: 10007333 - DNA, 22 bp, Homo sapiens
acacatcatgccaagtttcacc

SEQ ID NO: 10007334 - DNA, 22 bp, Homo sapiens
agcagggactgagccagtggga

SEQ ID NO: 10007335 - DNA, 22 bp, Homo sapiens
agcagggactgagccagtggga

SEQ ID NO: 10007336 - DNA, 22 bp, Homo sapiens
acacatatgtcattgaaaaatc

SEQ ID NO: 10007337 - DNA, 19 bp, Homo sapiens
agcagggacatggaacttt

SEQ ID NO: 10007338 - DNA, 22 bp, Homo sapiens
acacagttgattgtcactcagg

SEQ ID NO: 10007339 - DNA, 22 bp, Homo sapiens
acacagttggtggctcagtctg

SEQ ID NO: 10007340 - DNA, 22 bp, Homo sapiens
acacagtttatggtattctgtt

SEQ ID NO: 10007341 - DNA, 22 bp, Homo sapiens
acacagtttatggtattctgtt

SEQ ID NO: 10007342 - DNA, 22 bp, Homo sapiens
acacagtttaaacgattagtac

SEQ ID NO: 10007343 - DNA, 22 bp, Homo sapiens
acacagttcgttgttttctact

SEQ ID NO: 10007344 - DNA, 22 bp, Homo sapiens
acacagttcttagcaggtgtct

SEQ ID NO: 10007345 - DNA, 22 bp, Homo sapiens
acacagttctttcactgttggt

SEQ ID NO: 10007346 - DNA, 22 bp, Homo sapiens
acacagttctttcactgttggt

SEQ ID NO: 10007347 - DNA, 22 bp, Homo sapiens
acacagttcaggatcaaatagc

SEQ ID NO: 10007348 - DNA, 22 bp, Homo sapiens
acacagttcgtgcttttctatt

SEQ ID NO: 10007349 - DNA, 19 bp, Homo sapiens
agcaggccacagggccagc

SEQ ID NO: 10007350 - DNA, 16 bp, Homo sapiens
acacagttttaaggca

SEQ ID NO: 10007351 - DNA, 22 bp, Homo sapiens
agcaggcttgttatgtctgaga

SEQ ID NO: 10007352 - DNA, 22 bp, Homo sapiens
agcaggctttccacagaaggag

SEQ ID NO: 10007353 - DNA, 22 bp, Homo sapiens
agcaggctttcaagagtcttct

SEQ ID NO: 10007354 - DNA, 22 bp, Homo sapiens
acacagtatgacattggcagag

SEQ ID NO: 10007355 - DNA, 22 bp, Homo sapiens
acacagtatgcatctagaaatt

SEQ ID NO: 10007356 - DNA, 22 bp, Homo sapiens
acacagtatgcatctagaaatt

SEQ ID NO: 10007357 - DNA, 22 bp, Homo sapiens
acacagtatgcatctagaaatt

SEQ ID NO: 10007358 - DNA, 22 bp, Homo sapiens
acacagtattacaataggtgct

SEQ ID NO: 10007359 - DNA, 22 bp, Homo sapiens
acacagtagtttgtcattgcta

SEQ ID NO: 10007360 - DNA, 22 bp, Homo sapiens
acacagtatcaaatttcatctt

SEQ ID NO: 10007361 - DNA, 22 bp, Homo sapiens
acacagtatgaaaagtctagtt

SEQ ID NO: 10007362 - DNA, 22 bp, Homo sapiens
acacagtatgaaaagtctagtt

SEQ ID NO: 10007363 - DNA, 18 bp, Homo sapiens
acacacacacctgtgtat

SEQ ID NO: 10007364 - DNA, 18 bp, Homo sapiens
acacacacacctgtgtat

SEQ ID NO: 10007365 - DNA, 22 bp, Homo sapiens
acacacacaagcaggttgtgga

SEQ ID NO: 10007366 - DNA, 18 bp, Homo sapiens
acacacacacctgtgtat

SEQ ID NO: 10007367 - DNA, 22 bp, Homo sapiens
acacacacaagcaggttgtgga

SEQ ID NO: 10007368 - DNA, 22 bp, Homo sapiens
acacacacaagcaggttgtgga

SEQ ID NO: 10007369 - DNA, 22 bp, Homo sapiens
acacagtgtgtgcagtcggacg

SEQ ID NO: 10007370 - DNA, 22 bp, Homo sapiens
acacagtgtccttctacttgcc

SEQ ID NO: 10007371 - DNA, 22 bp, Homo sapiens
acacagtgtcttaggtagtgtc

SEQ ID NO: 10007372 - DNA, 22 bp, Homo sapiens
acacagtgtgtgcagtcggacg

SEQ ID NO: 10007373 - DNA, 22 bp, Homo sapiens
acacagtggtgtttacaaaatt

SEQ ID NO: 10007374 - DNA, 22 bp, Homo sapiens
acacagtggtgtttacaaaatt

SEQ ID NO: 10007375 - DNA, 22 bp, Homo sapiens
acacagtgtcagggcaggggcc

SEQ ID NO: 10007376 - DNA, 22 bp, Homo sapiens
acacagtgtcagggcaggggcc

SEQ ID NO: 10007377 - DNA, 22 bp, Homo sapiens
acacagtgtcagggcaggggcc

SEQ ID NO: 10007378 - DNA, 22 bp, Homo sapiens
acacagtattacaataggtgct

SEQ ID NO: 10007379 - DNA, 22 bp, Homo sapiens
acacagtattacaataggtgct

SEQ ID NO: 10007380 - DNA, 22 bp, Homo sapiens
acacagtattgtgactataact

SEQ ID NO: 10007381 - DNA, 22 bp, Homo sapiens
acacagtattgtgactataact

SEQ ID NO: 10007382 - DNA, 22 bp, Homo sapiens
acacagtattgtgactataact

SEQ ID NO: 10007383 - DNA, 22 bp, Homo sapiens
acacagtgccaaattgcagtta

SEQ ID NO: 10007384 - DNA, 22 bp, Homo sapiens
acacagtgccaaattgcagtta

SEQ ID NO: 10007385 - DNA, 22 bp, Homo sapiens
acacagtggtgagtctggacct

SEQ ID NO: 10007386 - DNA, 18 bp, Homo sapiens
acacagtggatgcctggt

SEQ ID NO: 10007387 - DNA, 22 bp, Homo sapiens
acacacaactcattgtgtaata

SEQ ID NO: 10007388 - DNA, 22 bp, Homo sapiens
acacacaactcattgtgtaata

SEQ ID NO: 10007389 - DNA, 22 bp, Homo sapiens
acacaatgtcatcataatgtca

SEQ ID NO: 10007390 - DNA, 19 bp, Homo sapiens
acacaatgacacatatata

SEQ ID NO: 10007391 - DNA, 19 bp, Homo sapiens
acacaatgacacatatata

SEQ ID NO: 10007392 - DNA, 22 bp, Homo sapiens
acacaataaatttatcctttga

SEQ ID NO: 10007393 - DNA, 22 bp, Homo sapiens
acacaatacagggctcaaaata

SEQ ID NO: 10007394 - DNA, 22 bp, Homo sapiens
acacaataaatttatcctttga

SEQ ID NO: 10007395 - DNA, 23 bp, Homo sapiens
acacaagggtaactgccagccat

SEQ ID NO: 10007396 - DNA, 23 bp, Homo sapiens
acacaatagagtactattcagcc

SEQ ID NO: 10007397 - DNA, 23 bp, Homo sapiens
acacaatagagtactattcagcc

SEQ ID NO: 10007398 - DNA, 22 bp, Homo sapiens
acacaagattgtgtattgaatt

SEQ ID NO: 10007399 - DNA, 22 bp, Homo sapiens
acacaagaataatgatgaaggt

SEQ ID NO: 10007400 - DNA, 22 bp, Homo sapiens
acacaagggcctatagtgtatt

SEQ ID NO: 10007401 - DNA, 22 bp, Homo sapiens
acacaagggcctatagtgtatt

SEQ ID NO: 10007402 - DNA, 22 bp, Homo sapiens
acacaagattgtgtattgaatt

SEQ ID NO: 10007403 - DNA, 22 bp, Homo sapiens
acacaagattgtgtattgaatt

SEQ ID NO: 10007404 - DNA, 22 bp, Homo sapiens
acacaagattgtgtattgaatt

SEQ ID NO: 10007405 - DNA, 22 bp, Homo sapiens
agccagctgttctggggcagca

SEQ ID NO: 10007406 - DNA, 22 bp, Homo sapiens
agccagctgtactgcctgctca

SEQ ID NO: 10007407 - DNA, 22 bp, Homo sapiens
agccagctggtgggtcagctgg

SEQ ID NO: 10007408 - DNA, 22 bp, Homo sapiens
agccagctgtggctatggctcc

SEQ ID NO: 10007409 - DNA, 22 bp, Homo sapiens
agccagctgtcctccctttcct

SEQ ID NO: 10007410 - DNA, 22 bp, Homo sapiens
agccagctgtactgcctgctca

SEQ ID NO: 10007411 - DNA, 22 bp, Homo sapiens
agccaggaagagaggcctcacc

SEQ ID NO: 10007412 - DNA, 22 bp, Homo sapiens
agccaggaagagaggcctcacc

SEQ ID NO: 10007413 - DNA, 22 bp, Homo sapiens
agccagctttcacaaatgaaga

SEQ ID NO: 10007414 - DNA, 22 bp, Homo sapiens
agccagcttctttacggtggca

SEQ ID NO: 10007415 - DNA, 22 bp, Homo sapiens
agccagagggaatctttgggga

SEQ ID NO: 10007416 - DNA, 22 bp, Homo sapiens
agccagaggccagcctgcctca

SEQ ID NO: 10007417 - DNA, 22 bp, Homo sapiens
agccagaggtcatgagcacagg

SEQ ID NO: 10007418 - DNA, 22 bp, Homo sapiens
agccagctggagaccactgttt

SEQ ID NO: 10007419 - DNA, 22 bp, Homo sapiens
agccagctggagaccactgttt

SEQ ID NO: 10007420 - DNA, 22 bp, Homo sapiens
agccagctgctcgggggaaaca

SEQ ID NO: 10007421 - DNA, 22 bp, Homo sapiens
agccagctggtgggtcagctgg

SEQ ID NO: 10007422 - DNA, 22 bp, Homo sapiens
agccagctggagaccactgttt

SEQ ID NO: 10007423 - DNA, 22 bp, Homo sapiens
agccagctgcctttcacatctg

SEQ ID NO: 10007424 - DNA, 22 bp, Homo sapiens
agccagaggtcatgagcacagg

SEQ ID NO: 10007425 - DNA, 22 bp, Homo sapiens
acactgttcctgaaattgttat

SEQ ID NO: 10007426 - DNA, 20 bp, Homo sapiens
acactgttcttcacacattt

SEQ ID NO: 10007427 - DNA, 22 bp, Homo sapiens
acactgttccacactaagaagg

SEQ ID NO: 10007428 - DNA, 22 bp, Homo sapiens
acactgttcctgaaattgttat

SEQ ID NO: 10007429 - DNA, 22 bp, Homo sapiens
acacttaatcttactgaggatc

SEQ ID NO: 10007430 - DNA, 22 bp, Homo sapiens
acactgttctttgcactgagaa

SEQ ID NO: 10007431 - DNA, 22 bp, Homo sapiens
acactgttgctggcacagacag

SEQ ID NO: 10007432 - DNA, 22 bp, Homo sapiens
acactgttgctggcacagacag

SEQ ID NO: 10007433 - DNA, 22 bp, Homo sapiens
acacttaacttctgagaataaa

SEQ ID NO: 10007434 - DNA, 22 bp, Homo sapiens
acacttaagcatgaagtataaa

SEQ ID NO: 10007435 - DNA, 22 bp, Homo sapiens
agccacagtctgatgcctgaga

SEQ ID NO: 10007436 - DNA, 22 bp, Homo sapiens
agccagaggaacttgatgactg

SEQ ID NO: 10007437 - DNA, 22 bp, Homo sapiens
agccagagattgagatgcaggc

SEQ ID NO: 10007438 - DNA, 22 bp, Homo sapiens
agccagagattgagatgcaggc

SEQ ID NO: 10007439 - DNA, 22 bp, Homo sapiens
agccagagattgagatgcaggc

SEQ ID NO: 10007440 - DNA, 22 bp, Homo sapiens
agccaaggtatcatgagaggca

SEQ ID NO: 10007441 - DNA, 22 bp, Homo sapiens
agccaaggtcgccccagggcaa

SEQ ID NO: 10007442 - DNA, 22 bp, Homo sapiens
agccaaggtcgccccagggcaa

SEQ ID NO: 10007443 - DNA, 22 bp, Homo sapiens
agccaaggtcgccccagggcaa

SEQ ID NO: 10007444 - DNA, 22 bp, Homo sapiens
agccaaggcagctagagctctg

SEQ ID NO: 10007445 - DNA, 22 bp, Homo sapiens
agccaaggcagctagagctctg

SEQ ID NO: 10007446 - DNA, 22 bp, Homo sapiens
agccaaggcagctagagctctg

SEQ ID NO: 10007447 - DNA, 22 bp, Homo sapiens
agccaagggtcagctgcacaga

SEQ ID NO: 10007448 - DNA, 22 bp, Homo sapiens
agccaagggtcagctgcacaga

SEQ ID NO: 10007449 - DNA, 22 bp, Homo sapiens
agccaagggtcagctgcacaga

SEQ ID NO: 10007450 - DNA, 22 bp, Homo sapiens
agccaaggtatcatgagaggca

SEQ ID NO: 10007451 - DNA, 22 bp, Homo sapiens
agccaaggtatcatgagaggca

SEQ ID NO: 10007452 - DNA, 22 bp, Homo sapiens
agccaaggtatcatgagaggca

SEQ ID NO: 10007453 - DNA, 22 bp, Homo sapiens
agccaaggagtgcaggtggctt

SEQ ID NO: 10007454 - DNA, 22 bp, Homo sapiens
agccaaggagtgcaggtggctt

SEQ ID NO: 10007455 - DNA, 22 bp, Homo sapiens
agccaaggagtgcaggtggctt

SEQ ID NO: 10007456 - DNA, 22 bp, Homo sapiens
agccaaggagtgcaggtggctt

SEQ ID NO: 10007457 - DNA, 22 bp, Homo sapiens
agccaaggagtgcaggtggctt

SEQ ID NO: 10007458 - DNA, 22 bp, Homo sapiens
agccaaggagtgcaggtggctt

SEQ ID NO: 10007459 - DNA, 18 bp, Homo sapiens
agccaaggaggaggagga

SEQ ID NO: 10007460 - DNA, 18 bp, Homo sapiens
agccaaggaggaggagga

SEQ ID NO: 10007461 - DNA, 18 bp, Homo sapiens
agccaaggaggaggagga

SEQ ID NO: 10007462 - DNA, 22 bp, Homo sapiens
agccaaggactcagtggtaggc

SEQ ID NO: 10007463 - DNA, 22 bp, Homo sapiens
agcatttacctcaatgcatctg

SEQ ID NO: 10007464 - DNA, 22 bp, Homo sapiens
acacccagcttttgaatgccct

SEQ ID NO: 10007465 - DNA, 22 bp, Homo sapiens
acacccagctgggccacctcca

SEQ ID NO: 10007466 - DNA, 22 bp, Homo sapiens
acacccagagcgccagtgccga

SEQ ID NO: 10007467 - DNA, 21 bp, Homo sapiens
acacccacttatgcccgcttg

SEQ ID NO: 10007468 - DNA, 22 bp, Homo sapiens
acacccagagcgccagtgccga

SEQ ID NO: 10007469 - DNA, 22 bp, Homo sapiens
acacccagagcgccagtgccga

SEQ ID NO: 10007470 - DNA, 22 bp, Homo sapiens
acacccagattatgcacacaaa

SEQ ID NO: 10007471 - DNA, 22 bp, Homo sapiens
acaccagggcctagccagggcg

SEQ ID NO: 10007472 - DNA, 22 bp, Homo sapiens
agcaggtgtagggctctttgta

SEQ ID NO: 10007473 - DNA, 22 bp, Homo sapiens
agcaggtgtatataaggctgag

SEQ ID NO: 10007474 - DNA, 22 bp, Homo sapiens
agcaggtgagcacagccaggct

SEQ ID NO: 10007475 - DNA, 22 bp, Homo sapiens
agcaggtggtaggcagtcagca

SEQ ID NO: 10007476 - DNA, 22 bp, Homo sapiens
agcaggtggtaggcagtcagca

SEQ ID NO: 10007477 - DNA, 22 bp, Homo sapiens
agctgagcacattcaaacaggt

SEQ ID NO: 10007478 - DNA, 22 bp, Homo sapiens
acagcagccttgttggtttcga

SEQ ID NO: 10007479 - DNA, 22 bp, Homo sapiens
acagcagcgtcaacttaaaatt

SEQ ID NO: 10007480 - DNA, 22 bp, Homo sapiens
agctgagggcaggatggggtga

SEQ ID NO: 10007481 - DNA, 22 bp, Homo sapiens
agctgagggcaggatggggtga

SEQ ID NO: 10007482 - DNA, 22 bp, Homo sapiens
agctgagggttcggtgtccaca

SEQ ID NO: 10007483 - DNA, 21 bp, Homo sapiens
agctgaggtaaggcaagagag

SEQ ID NO: 10007484 - DNA, 23 bp, Homo sapiens
agctgaggtgcagatccaaagaa

SEQ ID NO: 10007485 - DNA, 17 bp, Homo sapiens
acagcaggcccggaggg

SEQ ID NO: 10007486 - DNA, 18 bp, Homo sapiens
acagcaggtttcattctt

SEQ ID NO: 10007487 - DNA, 22 bp, Homo sapiens
acagcaggttacagtggcacag

SEQ ID NO: 10007488 - DNA, 22 bp, Homo sapiens
acagcaggttttaactttgaag

SEQ ID NO: 10007489 - DNA, 22 bp, Homo sapiens
acagcagagtgtgagatagcca

SEQ ID NO: 10007490 - DNA, 22 bp, Homo sapiens
acagcagatctggctacaggtt

SEQ ID NO: 10007491 - DNA, 22 bp, Homo sapiens
acagcagagtggagatgagcac

SEQ ID NO: 10007492 - DNA, 22 bp, Homo sapiens
acagcagagtgtgagatagcca

SEQ ID NO: 10007493 - DNA, 22 bp, Homo sapiens
acagcagaccactactagtagg

SEQ ID NO: 10007494 - DNA, 22 bp, Homo sapiens
acagatagatgataatggcttt

SEQ ID NO: 10007495 - DNA, 22 bp, Homo sapiens
acagatacaaatatacaaatac

SEQ ID NO: 10007496 - DNA, 20 bp, Homo sapiens
acagataccctgtgctggtg

SEQ ID NO: 10007497 - DNA, 22 bp, Homo sapiens
acagatataaactatagtagtg

SEQ ID NO: 10007498 - DNA, 22 bp, Homo sapiens
acagcagcaatagcagtgacat

SEQ ID NO: 10007499 - DNA, 22 bp, Homo sapiens
acagcagcaatagcagtgacat

SEQ ID NO: 10007500 - DNA, 22 bp, Homo sapiens
acagcagcactattgacatttt

SEQ ID NO: 10007501 - DNA, 21 bp, Homo sapiens
acagcagcaatctgtctttcc

SEQ ID NO: 10007502 - DNA, 21 bp, Homo sapiens
acagcagcaatctgtctttcc

SEQ ID NO: 10007503 - DNA, 22 bp, Homo sapiens
acagcagccttgttggtttcga

SEQ ID NO: 10007504 - DNA, 20 bp, Homo sapiens
acagcagccttgctagaaac

SEQ ID NO: 10007505 - DNA, 22 bp, Homo sapiens
acagcagcctgcagccctgtgt

SEQ ID NO: 10007506 - DNA, 22 bp, Homo sapiens
acagcagccagccactgtgagc

SEQ ID NO: 10007507 - DNA, 22 bp, Homo sapiens
acagcagcctgcagccctgtgt

SEQ ID NO: 10007508 - DNA, 22 bp, Homo sapiens
acagcagcataaactgactaag

SEQ ID NO: 10007509 - DNA, 22 bp, Homo sapiens
acagcagcataaactgactaag

SEQ ID NO: 10007510 - DNA, 22 bp, Homo sapiens
acagcagcatcctatttcactc

SEQ ID NO: 10007511 - DNA, 22 bp, Homo sapiens
acagcagcactattgacatttt

SEQ ID NO: 10007512 - DNA, 22 bp, Homo sapiens
acagcagcagaccagcatatgt

SEQ ID NO: 10007513 - DNA, 22 bp, Homo sapiens
acagaggggtcacagcctgaag

SEQ ID NO: 10007514 - DNA, 22 bp, Homo sapiens
acagagggtctgggcacaggac

SEQ ID NO: 10007515 - DNA, 22 bp, Homo sapiens
acagagggggccttggagtgca

SEQ ID NO: 10007516 - DNA, 22 bp, Homo sapiens
acagagggggccttggagtgca

SEQ ID NO: 10007517 - DNA, 19 bp, Homo sapiens
acagagggcaactgagaaa

SEQ ID NO: 10007518 - DNA, 22 bp, Homo sapiens
acagaggtaggacatgagatat

SEQ ID NO: 10007519 - DNA, 22 bp, Homo sapiens
acagaggtcacctttgtatctt

SEQ ID NO: 10007520 - DNA, 22 bp, Homo sapiens
acagaggtaggacatgagatat

SEQ ID NO: 10007521 - DNA, 22 bp, Homo sapiens
acagagggtgtggaggaagacg

SEQ ID NO: 10007522 - DNA, 22 bp, Homo sapiens
acagagggtctgggcacaggac

SEQ ID NO: 10007523 - DNA, 22 bp, Homo sapiens
acagagggtgtggaggaagacg

SEQ ID NO: 10007524 - DNA, 22 bp, Homo sapiens
acagagggtttctaaggatttg

SEQ ID NO: 10007525 - DNA, 23 bp, Homo sapiens
acagaggcttaaatgagtggcag

SEQ ID NO: 10007526 - DNA, 22 bp, Homo sapiens
acagaggctgcgcttgggaacg

SEQ ID NO: 10007527 - DNA, 22 bp, Homo sapiens
acagaggctgcgcttgggaacg

SEQ ID NO: 10007528 - DNA, 22 bp, Homo sapiens
acagaggcctcggcctgcccag

SEQ ID NO: 10007529 - DNA, 22 bp, Homo sapiens
acagaggcctcgtaggtacaac

SEQ ID NO: 10007530 - DNA, 22 bp, Homo sapiens
acagaggccccgtgggagagcc

SEQ ID NO: 10007531 - DNA, 22 bp, Homo sapiens
acagaggccgcctctctcacgg

SEQ ID NO: 10007532 - DNA, 19 bp, Homo sapiens
agcggttctcaaagtcagg

SEQ ID NO: 10007533 - DNA, 22 bp, Homo sapiens
agccttagggattgaggttgct

SEQ ID NO: 10007534 - DNA, 22 bp, Homo sapiens
acagaggtcatggagagttctc

SEQ ID NO: 10007535 - DNA, 16 bp, Homo sapiens
agccttaggaacagcc

SEQ ID NO: 10007536 - DNA, 22 bp, Homo sapiens
agcgtgtgcctcggggtacacg

SEQ ID NO: 10007537 - DNA, 22 bp, Homo sapiens
agcgtggactgctgggcaaggt

SEQ ID NO: 10007538 - DNA, 22 bp, Homo sapiens
agcgtggatgtggggcgcggct

SEQ ID NO: 10007539 - DNA, 22 bp, Homo sapiens
agcgtgtgtgcgggtcttcttt

SEQ ID NO: 10007540 - DNA, 22 bp, Homo sapiens
agcgtgtggagaactaagcaga

SEQ ID NO: 10007541 - DNA, 22 bp, Homo sapiens
agcgtgaattagttggtacaca

SEQ ID NO: 10007542 - DNA, 22 bp, Homo sapiens
agcggtggtgtcggcagcggct

SEQ ID NO: 10007543 - DNA, 21 bp, Homo sapiens
agcgtcaatatcgtcaacagg

SEQ ID NO: 10007544 - DNA, 22 bp, Homo sapiens
agctaaactaggtaaacagcag

SEQ ID NO: 10007545 - DNA, 22 bp, Homo sapiens
acagataattagcataaatgct

SEQ ID NO: 10007546 - DNA, 22 bp, Homo sapiens
acagataattagcataaatgct

SEQ ID NO: 10007547 - DNA, 20 bp, Homo sapiens
acagaatatgctggttgtgg

SEQ ID NO: 10007548 - DNA, 22 bp, Homo sapiens
acagaatagtagcttaaagtca

SEQ ID NO: 10007549 - DNA, 22 bp, Homo sapiens
acagaatagtagcttaaagtca

SEQ ID NO: 10007550 - DNA, 22 bp, Homo sapiens
acagaatagagactgcctgctc

SEQ ID NO: 10007551 - DNA, 22 bp, Homo sapiens
acagaatactcataagaagggg

SEQ ID NO: 10007552 - DNA, 22 bp, Homo sapiens
acagaataggtacagtcagtca

SEQ ID NO: 10007553 - DNA, 22 bp, Homo sapiens
acagaatattggttactgttgc

SEQ ID NO: 10007554 - DNA, 22 bp, Homo sapiens
acagaatattggttactgttgc

SEQ ID NO: 10007555 - DNA, 22 bp, Homo sapiens
acagaatattgtaagtgccact

SEQ ID NO: 10007556 - DNA, 22 bp, Homo sapiens
acagaatgcgtagtgcatgttg

SEQ ID NO: 10007557 - DNA, 21 bp, Homo sapiens
acagaggcatacagcttaagg

SEQ ID NO: 10007558 - DNA, 17 bp, Homo sapiens
acagaggcaggagtgga

SEQ ID NO: 10007559 - DNA, 22 bp, Homo sapiens
acagaggcagtgtgagatactg

SEQ ID NO: 10007560 - DNA, 22 bp, Homo sapiens
acagaatgggatttgaatattt

SEQ ID NO: 10007561 - DNA, 22 bp, Homo sapiens
acagaatgggatttgaatattt

SEQ ID NO: 10007562 - DNA, 22 bp, Homo sapiens
acagaattaaagtgtttgtgga

SEQ ID NO: 10007563 - DNA, 22 bp, Homo sapiens
acagaattaacatttgatgaat

SEQ ID NO: 10007564 - DNA, 22 bp, Homo sapiens
acagagctgtacatgtgccatg

SEQ ID NO: 10007565 - DNA, 22 bp, Homo sapiens
acagaacttcctgctggagtgg

SEQ ID NO: 10007566 - DNA, 22 bp, Homo sapiens
acagaagtccccatgaagaagc

SEQ ID NO: 10007567 - DNA, 23 bp, Homo sapiens
acagaataccattgactaggtgt

SEQ ID NO: 10007568 - DNA, 22 bp, Homo sapiens
acagaagtttcaagtaagaagt

SEQ ID NO: 10007569 - DNA, 22 bp, Homo sapiens
acagaagtgtgtgtgtaggaat

SEQ ID NO: 10007570 - DNA, 22 bp, Homo sapiens
acagaagtgtctttttcattca

SEQ ID NO: 10007571 - DNA, 22 bp, Homo sapiens
aagtcctttaatatcacatagt

SEQ ID NO: 10007572 - DNA, 22 bp, Homo sapiens
aagtccttgaagaaacagttct

SEQ ID NO: 10007573 - DNA, 22 bp, Homo sapiens
acctgcctatcagctgcctgct

SEQ ID NO: 10007574 - DNA, 22 bp, Homo sapiens
acctgcctagttggttctgccc

SEQ ID NO: 10007575 - DNA, 22 bp, Homo sapiens
aagtcctagacttggatagttt

SEQ ID NO: 10007576 - DNA, 22 bp, Homo sapiens
aagtcctaattttaggaggaga

SEQ ID NO: 10007577 - DNA, 22 bp, Homo sapiens
aagtcctaaacacacacaaggc

SEQ ID NO: 10007578 - DNA, 22 bp, Homo sapiens
aagtcctgccacctataagcct

SEQ ID NO: 10007579 - DNA, 18 bp, Homo sapiens
aagtccatgggtttggga

SEQ ID NO: 10007580 - DNA, 22 bp, Homo sapiens
aagtccatgatcaagatgtggc

SEQ ID NO: 10007581 - DNA, 22 bp, Homo sapiens
aagtccattaggcccctgcctg

SEQ ID NO: 10007582 - DNA, 22 bp, Homo sapiens
aagtccattcttccagccagct

SEQ ID NO: 10007583 - DNA, 22 bp, Homo sapiens
aagtccattcttccagccagct

SEQ ID NO: 10007584 - DNA, 22 bp, Homo sapiens
aagtccataggtttcatgaggg

SEQ ID NO: 10007585 - DNA, 22 bp, Homo sapiens
aagtccatagtttgcattacag

SEQ ID NO: 10007586 - DNA, 22 bp, Homo sapiens
aagtccatagtttgcattaggg

SEQ ID NO: 10007587 - DNA, 22 bp, Homo sapiens
aagtccatctctgccccacaca

SEQ ID NO: 10007588 - DNA, 22 bp, Homo sapiens
aagtatatactaaatgttaatc

SEQ ID NO: 10007589 - DNA, 20 bp, Homo sapiens
aagtatatgtccgtgtactt

SEQ ID NO: 10007590 - DNA, 20 bp, Homo sapiens
aagtatatgtccgtgtactt

SEQ ID NO: 10007591 - DNA, 22 bp, Homo sapiens
aagtatctcaaaaacagtaatc

SEQ ID NO: 10007592 - DNA, 22 bp, Homo sapiens
aagtagcattttcaaaatgtat

SEQ ID NO: 10007593 - DNA, 22 bp, Homo sapiens
aagtatacttaggcataatggt

SEQ ID NO: 10007594 - DNA, 22 bp, Homo sapiens
aagtagttagtccgcctgctct

SEQ ID NO: 10007595 - DNA, 22 bp, Homo sapiens
aagtaggaatccgaatgagtag

SEQ ID NO: 10007596 - DNA, 19 bp, Homo sapiens
aagtagtcatcccattctt

SEQ ID NO: 10007597 - DNA, 22 bp, Homo sapiens
acctctggacactgcatccttc

SEQ ID NO: 10007598 - DNA, 22 bp, Homo sapiens
acctctggacactgcatccttc

SEQ ID NO: 10007599 - DNA, 22 bp, Homo sapiens
acctctcttgtagctgctggtg

SEQ ID NO: 10007600 - DNA, 22 bp, Homo sapiens
acctctctgggcctgcttcctg

SEQ ID NO: 10007601 - DNA, 22 bp, Homo sapiens
acctcctggctgctcatggaac

SEQ ID NO: 10007602 - DNA, 22 bp, Homo sapiens
acctcctggcttatcatggaca

SEQ ID NO: 10007603 - DNA, 22 bp, Homo sapiens
acctcctggtgcccaagtgttt

SEQ ID NO: 10007604 - DNA, 20 bp, Homo sapiens
acctcctggaagcaggtgcc

SEQ ID NO: 10007605 - DNA, 22 bp, Homo sapiens
aaggtgtcaccagattggcagg

SEQ ID NO: 10007606 - DNA, 21 bp, Homo sapiens
acccaggggaagcagaaactg

SEQ ID NO: 10007607 - DNA, 22 bp, Homo sapiens
acccagggctcaagcgtaggca

SEQ ID NO: 10007608 - DNA, 22 bp, Homo sapiens
acccaggccattggcaagagtc

SEQ ID NO: 10007609 - DNA, 22 bp, Homo sapiens
acccagggcagccagcggggag

SEQ ID NO: 10007610 - DNA, 22 bp, Homo sapiens
acatttcagatgtaatgtgatg

SEQ ID NO: 10007611 - DNA, 22 bp, Homo sapiens
acatttcagatgtaatgtgatg

SEQ ID NO: 10007612 - DNA, 22 bp, Homo sapiens
acatttcagatgtaatgtgatg

SEQ ID NO: 10007613 - DNA, 22 bp, Homo sapiens
acatttcagaatcacacagctt

SEQ ID NO: 10007614 - DNA, 22 bp, Homo sapiens
acatttcagaatcacacagctt

SEQ ID NO: 10007615 - DNA, 22 bp, Homo sapiens
acatttcagatgtaatgtgatg

SEQ ID NO: 10007616 - DNA, 20 bp, Homo sapiens
aagggcagagggaacagact

SEQ ID NO: 10007617 - DNA, 22 bp, Homo sapiens
acatgcatgtgaatatggacac

SEQ ID NO: 10007618 - DNA, 22 bp, Homo sapiens
aagggagacagttgtgtgagga

SEQ ID NO: 10007619 - DNA, 22 bp, Homo sapiens
aagggcagaaagggacgctttg

SEQ ID NO: 10007620 - DNA, 22 bp, Homo sapiens
aagggcagaatagagaagatgg

SEQ ID NO: 10007621 - DNA, 22 bp, Homo sapiens
acatttcagattcatgaagtga

SEQ ID NO: 10007622 - DNA, 22 bp, Homo sapiens
acatttcagcgtgcatgacatg

SEQ ID NO: 10007623 - DNA, 22 bp, Homo sapiens
acatttcagcgtgcatgacatg

SEQ ID NO: 10007624 - DNA, 22 bp, Homo sapiens
acatttcagtgagctattgaag

SEQ ID NO: 10007625 - DNA, 22 bp, Homo sapiens
acatttcagtaagtgttaattt

SEQ ID NO: 10007626 - DNA, 22 bp, Homo sapiens
acatttcagtgagctattgaag

SEQ ID NO: 10007627 - DNA, 22 bp, Homo sapiens
acatttcagtgagctattgaag

SEQ ID NO: 10007628 - DNA, 22 bp, Homo sapiens
aagggctgcaatccaaaacact

SEQ ID NO: 10007629 - DNA, 22 bp, Homo sapiens
aagggctggccctgggaagagt

SEQ ID NO: 10007630 - DNA, 22 bp, Homo sapiens
aagggctggccctgggaagagt

SEQ ID NO: 10007631 - DNA, 19 bp, Homo sapiens
aagggctgggcacctcact

SEQ ID NO: 10007632 - DNA, 22 bp, Homo sapiens
accagagctggctctgagcacc

SEQ ID NO: 10007633 - DNA, 22 bp, Homo sapiens
aagggctggccacattctgggt

SEQ ID NO: 10007634 - DNA, 22 bp, Homo sapiens
aagggctggatctctctgagca

SEQ ID NO: 10007635 - DNA, 22 bp, Homo sapiens
aaggggtgggcattagagcagt

SEQ ID NO: 10007636 - DNA, 22 bp, Homo sapiens
aaggggtgggcattagagcagt

SEQ ID NO: 10007637 - DNA, 22 bp, Homo sapiens
aagggtgaagggtggtggccta

SEQ ID NO: 10007638 - DNA, 22 bp, Homo sapiens
aagggtgggccctggcagccat

SEQ ID NO: 10007639 - DNA, 22 bp, Homo sapiens
aagggtggatttctgagctcta

SEQ ID NO: 10007640 - DNA, 22 bp, Homo sapiens
aagggtggatttctgagctcta

SEQ ID NO: 10007641 - DNA, 22 bp, Homo sapiens
aagggtggatttctgagctcta

SEQ ID NO: 10007642 - DNA, 22 bp, Homo sapiens
aagggtgggcaccgccaggtca

SEQ ID NO: 10007643 - DNA, 22 bp, Homo sapiens
aagggtgttgatcagagaggat

SEQ ID NO: 10007644 - DNA, 22 bp, Homo sapiens
aagggtggtgtaggagatcaaa

SEQ ID NO: 10007645 - DNA, 22 bp, Homo sapiens
aagggttagttggattatttat

SEQ ID NO: 10007646 - DNA, 22 bp, Homo sapiens
aagggttgaagataaataaggt

SEQ ID NO: 10007647 - DNA, 22 bp, Homo sapiens
aaggtaatatttttctctctaa

SEQ ID NO: 10007648 - DNA, 22 bp, Homo sapiens
aagggtttgtctccctcaaggc

SEQ ID NO: 10007649 - DNA, 22 bp, Homo sapiens
aaggtaatgaaacagcagctaa

SEQ ID NO: 10007650 - DNA, 22 bp, Homo sapiens
aaggtaatcagcctttccacaa

SEQ ID NO: 10007651 - DNA, 22 bp, Homo sapiens
aaggtacagttttaagaataag

SEQ ID NO: 10007652 - DNA, 22 bp, Homo sapiens
acccaggcagcaggagctaaag

SEQ ID NO: 10007653 - DNA, 22 bp, Homo sapiens
aaggtacagggtattagattat

SEQ ID NO: 10007654 - DNA, 22 bp, Homo sapiens
aaggtacaggcattgctgcagc

SEQ ID NO: 10007655 - DNA, 22 bp, Homo sapiens
aaggtacagggaaggagcaaga

SEQ ID NO: 10007656 - DNA, 22 bp, Homo sapiens
aaggtacaaagttatacagcgt

SEQ ID NO: 10007657 - DNA, 22 bp, Homo sapiens
aaggtacaaagtattatttaaa

SEQ ID NO: 10007658 - DNA, 22 bp, Homo sapiens
aaggtacagaaattaacaagga

SEQ ID NO: 10007659 - DNA, 22 bp, Homo sapiens
aaggtacagaaattaacaagga

SEQ ID NO: 10007660 - DNA, 22 bp, Homo sapiens
accagagcttacatgctagaaa

SEQ ID NO: 10007661 - DNA, 20 bp, Homo sapiens
accagaggaaagagcagtga

SEQ ID NO: 10007662 - DNA, 22 bp, Homo sapiens
accagaggaagggaatctcaag

SEQ ID NO: 10007663 - DNA, 22 bp, Homo sapiens
accagaggaggaattaccttcc

SEQ ID NO: 10007664 - DNA, 22 bp, Homo sapiens
accagagtaatgtgtggaaatt

SEQ ID NO: 10007665 - DNA, 22 bp, Homo sapiens
accagagggagacttcctcttc

SEQ ID NO: 10007666 - DNA, 22 bp, Homo sapiens
aagggggcacagtcactgtaat

SEQ ID NO: 10007667 - DNA, 22 bp, Homo sapiens
aagggggccacacctggtgtga

SEQ ID NO: 10007668 - DNA, 22 bp, Homo sapiens
aagggggccacacctggtgtga

SEQ ID NO: 10007669 - DNA, 22 bp, Homo sapiens
aagggggcgaagacgtgattga

SEQ ID NO: 10007670 - DNA, 22 bp, Homo sapiens
aagggggcccagcactaagttg

SEQ ID NO: 10007671 - DNA, 22 bp, Homo sapiens
aaggggaaaaagtgttaggagt

SEQ ID NO: 10007672 - DNA, 22 bp, Homo sapiens
aagggggcggcagccagtggaa

SEQ ID NO: 10007673 - DNA, 22 bp, Homo sapiens
aagggggcggcagccagtggaa

SEQ ID NO: 10007674 - DNA, 22 bp, Homo sapiens
aaggaagggaaatagtgatgtc

SEQ ID NO: 10007675 - DNA, 22 bp, Homo sapiens
aaggaagggaaatagtgatgtc

SEQ ID NO: 10007676 - DNA, 22 bp, Homo sapiens
aaggaagggaaatagtgatgtc

SEQ ID NO: 10007677 - DNA, 22 bp, Homo sapiens
aaggaagggaaatagtgatgtc

SEQ ID NO: 10007678 - DNA, 22 bp, Homo sapiens
aaggaaggaattgatcatgcgc

SEQ ID NO: 10007679 - DNA, 22 bp, Homo sapiens
aaggaaggaattgatcatgcgc

SEQ ID NO: 10007680 - DNA, 22 bp, Homo sapiens
aaggaagggaaatagtgatgtc

SEQ ID NO: 10007681 - DNA, 22 bp, Homo sapiens
aaggaagatgctggcctgggga

SEQ ID NO: 10007682 - DNA, 22 bp, Homo sapiens
aaggaagaatcatcacgttggg

SEQ ID NO: 10007683 - DNA, 19 bp, Homo sapiens
aaggaatggctttaagtag

SEQ ID NO: 10007684 - DNA, 22 bp, Homo sapiens
aaggaattccctttctgacaga

SEQ ID NO: 10007685 - DNA, 22 bp, Homo sapiens
aaggaaggttcatagtcaaaga

SEQ ID NO: 10007686 - DNA, 22 bp, Homo sapiens
aaggaaggtactcagtgattct

SEQ ID NO: 10007687 - DNA, 22 bp, Homo sapiens
aaggaaggttcatagtcaaaga

SEQ ID NO: 10007688 - DNA, 19 bp, Homo sapiens
aaggacacaacagagatag

SEQ ID NO: 10007689 - DNA, 18 bp, Homo sapiens
aaggacacagtccctgct

SEQ ID NO: 10007690 - DNA, 22 bp, Homo sapiens
aaggacagaaacagattgctgg

SEQ ID NO: 10007691 - DNA, 22 bp, Homo sapiens
aaggacagaaacagattgctgg

SEQ ID NO: 10007692 - DNA, 22 bp, Homo sapiens
aaggacaggagaaaacgggatc

SEQ ID NO: 10007693 - DNA, 22 bp, Homo sapiens
aaggacaggagaaaacgggatc

SEQ ID NO: 10007694 - DNA, 22 bp, Homo sapiens
aaggacaggcacagtggtggag

SEQ ID NO: 10007695 - DNA, 22 bp, Homo sapiens
aaggacagagagccattccaga

SEQ ID NO: 10007696 - DNA, 22 bp, Homo sapiens
aaggatgattggtaatgacact

SEQ ID NO: 10007697 - DNA, 22 bp, Homo sapiens
aaggatgtcagtcattttggat

SEQ ID NO: 10007698 - DNA, 22 bp, Homo sapiens
aaggatgaacattaatacatca

SEQ ID NO: 10007699 - DNA, 22 bp, Homo sapiens
aaggaggccctctccttctgga

SEQ ID NO: 10007700 - DNA, 22 bp, Homo sapiens
aaggatcatagtaaacattgat

SEQ ID NO: 10007701 - DNA, 22 bp, Homo sapiens
aaggcaaaagaggtgtcatcac

SEQ ID NO: 10007702 - DNA, 22 bp, Homo sapiens
aaggatttttggaatgagatgg

SEQ ID NO: 10007703 - DNA, 22 bp, Homo sapiens
aaggcaaaagaggtgtcatcac

SEQ ID NO: 10007704 - DNA, 22 bp, Homo sapiens
aaggcaaatgtgttcttttagt

SEQ ID NO: 10007705 - DNA, 22 bp, Homo sapiens
aaggcaaatgtgttcttttagt

SEQ ID NO: 10007706 - DNA, 22 bp, Homo sapiens
aaggcaaatgtgttcttttagt

SEQ ID NO: 10007707 - DNA, 22 bp, Homo sapiens
aaggatttgtccaaagtcacac

SEQ ID NO: 10007708 - DNA, 22 bp, Homo sapiens
aaggaagaagggaagttactta

SEQ ID NO: 10007709 - DNA, 22 bp, Homo sapiens
aagcttctttacaggagagatt

SEQ ID NO: 10007710 - DNA, 20 bp, Homo sapiens
aagcttccttgggcgcccgg

SEQ ID NO: 10007711 - DNA, 23 bp, Homo sapiens
aagcttccttgactggcccctag

SEQ ID NO: 10007712 - DNA, 23 bp, Homo sapiens
aagcttctatctctgcagaagga

SEQ ID NO: 10007713 - DNA, 23 bp, Homo sapiens
aagcttctagggtgggcaagatg

SEQ ID NO: 10007714 - DNA, 23 bp, Homo sapiens
aagcttctatctctgcagaagga

SEQ ID NO: 10007715 - DNA, 22 bp, Homo sapiens
aagctgttagggagtggtaggt

SEQ ID NO: 10007716 - DNA, 22 bp, Homo sapiens
aagctgttctccagtgactcag

SEQ ID NO: 10007717 - DNA, 22 bp, Homo sapiens
aagctgttctctaagtttcatg

SEQ ID NO: 10007718 - DNA, 22 bp, Homo sapiens
aagctgttctgaatcagtaagt

SEQ ID NO: 10007719 - DNA, 22 bp, Homo sapiens
aagctgttctgaatcagtaagt

SEQ ID NO: 10007720 - DNA, 22 bp, Homo sapiens
aagctgttgaagtaattcagcc

SEQ ID NO: 10007721 - DNA, 22 bp, Homo sapiens
aagctgtttgcagtggatggag

SEQ ID NO: 10007722 - DNA, 22 bp, Homo sapiens
aagcttatatcagaacaatgct

SEQ ID NO: 10007723 - DNA, 22 bp, Homo sapiens
aagcttaggtacagaagttaag

SEQ ID NO: 10007724 - DNA, 20 bp, Homo sapiens
aagcttcacttcatttgatc

SEQ ID NO: 10007725 - DNA, 20 bp, Homo sapiens
aagcttcacttcatttgatc

SEQ ID NO: 10007726 - DNA, 22 bp, Homo sapiens
acagctggagccctatggctgg

SEQ ID NO: 10007727 - DNA, 22 bp, Homo sapiens
aagctggagagtttcacagatg

SEQ ID NO: 10007728 - DNA, 22 bp, Homo sapiens
acagctggagtgaggatggagt

SEQ ID NO: 10007729 - DNA, 22 bp, Homo sapiens
aagctgtgaaatctctagtgca

SEQ ID NO: 10007730 - DNA, 22 bp, Homo sapiens
aagctgtgaaatctctagtgca

SEQ ID NO: 10007731 - DNA, 21 bp, Homo sapiens
aagctgtgttccactgatagc

SEQ ID NO: 10007732 - DNA, 22 bp, Homo sapiens
aagctgtgtgcagatgatctca

SEQ ID NO: 10007733 - DNA, 21 bp, Homo sapiens
aagctgtgttccactgatagc

SEQ ID NO: 10007734 - DNA, 22 bp, Homo sapiens
aagctgtgtgactatttctgag

SEQ ID NO: 10007735 - DNA, 22 bp, Homo sapiens
aagctgtgtgcagatgatctca

SEQ ID NO: 10007736 - DNA, 22 bp, Homo sapiens
aagctgtgtgcagatgatctca

SEQ ID NO: 10007737 - DNA, 22 bp, Homo sapiens
aagctgtgtaagttgcttggtt

SEQ ID NO: 10007738 - DNA, 22 bp, Homo sapiens
aagctgtggtaaagggtagagg

SEQ ID NO: 10007739 - DNA, 22 bp, Homo sapiens
aagctgtgtattacagaatatt

SEQ ID NO: 10007740 - DNA, 22 bp, Homo sapiens
aagctgtgtattacagaatatt

SEQ ID NO: 10007741 - DNA, 22 bp, Homo sapiens
aagctgtgtcctagaggtgtaa

SEQ ID NO: 10007742 - DNA, 22 bp, Homo sapiens
aagctgtgtgactatttctgag

SEQ ID NO: 10007743 - DNA, 22 bp, Homo sapiens
aagctgtggcttggaggaaaca

SEQ ID NO: 10007744 - DNA, 22 bp, Homo sapiens
aagctgtggcttggaggaaaca

SEQ ID NO: 10007745 - DNA, 22 bp, Homo sapiens
aagctgtgcctttgcctagaat

SEQ ID NO: 10007746 - DNA, 22 bp, Homo sapiens
aagctgtgcaggaactgcttgc

SEQ ID NO: 10007747 - DNA, 22 bp, Homo sapiens
aagctgtgaagagcaagtgagg

SEQ ID NO: 10007748 - DNA, 22 bp, Homo sapiens
aagctgtgagctggatgctcca

SEQ ID NO: 10007749 - DNA, 22 bp, Homo sapiens
aagctgtgaagagcaagtgagg

SEQ ID NO: 10007750 - DNA, 22 bp, Homo sapiens
acatgaatgcagccataacact

SEQ ID NO: 10007751 - DNA, 22 bp, Homo sapiens
acatgaagcaagaaagatgcta

SEQ ID NO: 10007752 - DNA, 22 bp, Homo sapiens
acatgaagtggtcagatcaaac

SEQ ID NO: 10007753 - DNA, 22 bp, Homo sapiens
acatgaagtggtcagatcaaac

SEQ ID NO: 10007754 - DNA, 22 bp, Homo sapiens
acatgaagcaagaaagatgcta

SEQ ID NO: 10007755 - DNA, 22 bp, Homo sapiens
acatctcacttctttgaaggct

SEQ ID NO: 10007756 - DNA, 20 bp, Homo sapiens
acatgaacagggctacagca

SEQ ID NO: 10007757 - DNA, 22 bp, Homo sapiens
acatgaaatgcagcctgtaacc

SEQ ID NO: 10007758 - DNA, 22 bp, Homo sapiens
acatgaaattctagctgaaccc

SEQ ID NO: 10007759 - DNA, 22 bp, Homo sapiens
acatgaaattctagctgaaccc

SEQ ID NO: 10007760 - DNA, 22 bp, Homo sapiens
acatgaacactgcttgccacat

SEQ ID NO: 10007761 - DNA, 22 bp, Homo sapiens
acatctagaagatctgggagat

SEQ ID NO: 10007762 - DNA, 22 bp, Homo sapiens
acatctagactcttgccctctt

SEQ ID NO: 10007763 - DNA, 22 bp, Homo sapiens
acatctagactcttgccctctt

SEQ ID NO: 10007764 - DNA, 22 bp, Homo sapiens
acatctcaaattccaggctcca

SEQ ID NO: 10007765 - DNA, 22 bp, Homo sapiens
acatctcaaattccaggctcca

SEQ ID NO: 10007766 - DNA, 22 bp, Homo sapiens
acatcctcccgatctactggct

SEQ ID NO: 10007767 - DNA, 22 bp, Homo sapiens
acatcctcccgatctactggct

SEQ ID NO: 10007768 - DNA, 22 bp, Homo sapiens
acatgcataggagaagtcttta

SEQ ID NO: 10007769 - DNA, 22 bp, Homo sapiens
acatgcatatacttaaatatgt

SEQ ID NO: 10007770 - DNA, 22 bp, Homo sapiens
acatgcatactgctgccaacgc

SEQ ID NO: 10007771 - DNA, 21 bp, Homo sapiens
acatgcatagagagatttctg

SEQ ID NO: 10007772 - DNA, 21 bp, Homo sapiens
acatgcatagagagatttctg

SEQ ID NO: 10007773 - DNA, 22 bp, Homo sapiens
acatgcatctctgggacacatg

SEQ ID NO: 10007774 - DNA, 22 bp, Homo sapiens
acatgcatgaaatccataaaca

SEQ ID NO: 10007775 - DNA, 22 bp, Homo sapiens
acatgcatctccaggctcattt

SEQ ID NO: 10007776 - DNA, 19 bp, Homo sapiens
acatgcatatggacagttg

SEQ ID NO: 10007777 - DNA, 22 bp, Homo sapiens
acatgcatatacttaaatatgt

SEQ ID NO: 10007778 - DNA, 22 bp, Homo sapiens
acatgcatgtcatcagcccttt

SEQ ID NO: 10007779 - DNA, 22 bp, Homo sapiens
acatgcatgtctatgggcaggt

SEQ ID NO: 10007780 - DNA, 22 bp, Homo sapiens
acatgcatggtgttgggttgga

SEQ ID NO: 10007781 - DNA, 22 bp, Homo sapiens
acatgcatggggtaatggtatt

SEQ ID NO: 10007782 - DNA, 22 bp, Homo sapiens
acatgcatggctgcttaaatta

SEQ ID NO: 10007783 - DNA, 22 bp, Homo sapiens
acatgcatggagggaaaatgtc

SEQ ID NO: 10007784 - DNA, 22 bp, Homo sapiens
acatgcatggacatgtatatat

SEQ ID NO: 10007785 - DNA, 22 bp, Homo sapiens
acatgcatgctttggtgggtgt

SEQ ID NO: 10007786 - DNA, 22 bp, Homo sapiens
acatgacaaaatgcacaggatt

SEQ ID NO: 10007787 - DNA, 19 bp, Homo sapiens
acatgacaacaggggaggc

SEQ ID NO: 10007788 - DNA, 22 bp, Homo sapiens
acatgacagggaatgaggtgaa

SEQ ID NO: 10007789 - DNA, 22 bp, Homo sapiens
acatgacagtgactttataaga

SEQ ID NO: 10007790 - DNA, 22 bp, Homo sapiens
acatgacagtgcttagcaaact

SEQ ID NO: 10007791 - DNA, 22 bp, Homo sapiens
acatgacagtgcttagcaaact

SEQ ID NO: 10007792 - DNA, 22 bp, Homo sapiens
acatgcatacaagcacatgtag

SEQ ID NO: 10007793 - DNA, 22 bp, Homo sapiens
acatgcatacgtgtgtttaaaa

SEQ ID NO: 10007794 - DNA, 22 bp, Homo sapiens
acatgcatacacgtacatacct

SEQ ID NO: 10007795 - DNA, 22 bp, Homo sapiens
aaggcaattggcttgtataaga

SEQ ID NO: 10007796 - DNA, 22 bp, Homo sapiens
aaggcaattggcttgtataaga

SEQ ID NO: 10007797 - DNA, 22 bp, Homo sapiens
aaggcaattggcttgtataaga

SEQ ID NO: 10007798 - DNA, 22 bp, Homo sapiens
aaggcaatttggaagaggcaga

SEQ ID NO: 10007799 - DNA, 22 bp, Homo sapiens
aaggcaatagtattaaactgga

SEQ ID NO: 10007800 - DNA, 22 bp, Homo sapiens
aaggcaatagtattaaactgga

SEQ ID NO: 10007801 - DNA, 22 bp, Homo sapiens
aaggcaaggttcaccgtgctat

SEQ ID NO: 10007802 - DNA, 22 bp, Homo sapiens
aaggcaactgtaaaacatgcac

SEQ ID NO: 10007803 - DNA, 22 bp, Homo sapiens
aaggcaatgtaaattacagctt

SEQ ID NO: 10007804 - DNA, 22 bp, Homo sapiens
aaggcaattgagaagaaacaga

SEQ ID NO: 10007805 - DNA, 22 bp, Homo sapiens
aaggcaattgagaagaaacaga

SEQ ID NO: 10007806 - DNA, 22 bp, Homo sapiens
aaggcaatgactgatttagaat

SEQ ID NO: 10007807 - DNA, 22 bp, Homo sapiens
aaggcaatgagggagatagagt

SEQ ID NO: 10007808 - DNA, 22 bp, Homo sapiens
aaggcaatgagggagatagagt

SEQ ID NO: 10007809 - DNA, 22 bp, Homo sapiens
aaggcaatgactgatttagaat

SEQ ID NO: 10007810 - DNA, 22 bp, Homo sapiens
aaggcaatggcaagagaaagca

SEQ ID NO: 10007811 - DNA, 22 bp, Homo sapiens
aaggcaatggtttctgtgcctt

SEQ ID NO: 10007812 - DNA, 22 bp, Homo sapiens
aaggcaatggcaagagaaagca

SEQ ID NO: 10007813 - DNA, 22 bp, Homo sapiens
aaggcatggcagggtttacaca

SEQ ID NO: 10007814 - DNA, 22 bp, Homo sapiens
aaggcattgagcagttacagta

SEQ ID NO: 10007815 - DNA, 22 bp, Homo sapiens
aaggccagagcgtgtcctgcct

SEQ ID NO: 10007816 - DNA, 22 bp, Homo sapiens
aaggccagagtactagaggctg

SEQ ID NO: 10007817 - DNA, 22 bp, Homo sapiens
aaggccagagtactagaggctg

SEQ ID NO: 10007818 - DNA, 22 bp, Homo sapiens
aaggccagagcagactggagtt

SEQ ID NO: 10007819 - DNA, 22 bp, Homo sapiens
aaggccagattctctctagggg

SEQ ID NO: 10007820 - DNA, 22 bp, Homo sapiens
aaggccagattcactttacaat

SEQ ID NO: 10007821 - DNA, 22 bp, Homo sapiens
aaggccagccctaatgatgctc

SEQ ID NO: 10007822 - DNA, 22 bp, Homo sapiens
acatccattttgttcaaaagca

SEQ ID NO: 10007823 - DNA, 18 bp, Homo sapiens
actctgggacctgttatt

SEQ ID NO: 10007824 - DNA, 22 bp, Homo sapiens
actcttgtctcaacttttgtat

SEQ ID NO: 10007825 - DNA, 22 bp, Homo sapiens
actctttagaggtacatctctt

SEQ ID NO: 10007826 - DNA, 22 bp, Homo sapiens
actcttgaactgattaagaatg

SEQ ID NO: 10007827 - DNA, 22 bp, Homo sapiens
aagtgtttaaattatttgcagg

SEQ ID NO: 10007828 - DNA, 22 bp, Homo sapiens
aagtgttagggtaaagttggta

SEQ ID NO: 10007829 - DNA, 22 bp, Homo sapiens
aagtgttaaaagattaaatgct

SEQ ID NO: 10007830 - DNA, 22 bp, Homo sapiens
aagtgttacagaaacaaatgaa

SEQ ID NO: 10007831 - DNA, 22 bp, Homo sapiens
aagtgttaaagacttgaacact

SEQ ID NO: 10007832 - DNA, 22 bp, Homo sapiens
aagtgtttacttaaagtcatgg

SEQ ID NO: 10007833 - DNA, 22 bp, Homo sapiens
aagtgtttacttaaagtcatgg

SEQ ID NO: 10007834 - DNA, 22 bp, Homo sapiens
aagtgtttatttataacgatct

SEQ ID NO: 10007835 - DNA, 22 bp, Homo sapiens
aagtgtgttgactgaattgggg

SEQ ID NO: 10007836 - DNA, 22 bp, Homo sapiens
aagtgtgttgactgaattgggg

SEQ ID NO: 10007837 - DNA, 22 bp, Homo sapiens
aagtgtggggtctcagagctga

SEQ ID NO: 10007838 - DNA, 22 bp, Homo sapiens
aagtgtgacactgtgttaatta

SEQ ID NO: 10007839 - DNA, 22 bp, Homo sapiens
aagtgtgagacacacaaaatta

SEQ ID NO: 10007840 - DNA, 22 bp, Homo sapiens
aagtgtcttttagccactttta

SEQ ID NO: 10007841 - DNA, 22 bp, Homo sapiens
acctgcctcagtgcagctggat

SEQ ID NO: 10007842 - DNA, 22 bp, Homo sapiens
acctgcctatggagccacatgg

SEQ ID NO: 10007843 - DNA, 22 bp, Homo sapiens
aagtgtctgatggagcgaaatg

SEQ ID NO: 10007844 - DNA, 22 bp, Homo sapiens
aagtgtctgcaaaatgacagag

SEQ ID NO: 10007845 - DNA, 22 bp, Homo sapiens
aagtgtctgctggctctaccct

SEQ ID NO: 10007846 - DNA, 22 bp, Homo sapiens
aagtgtcttaactccttttggg

SEQ ID NO: 10007847 - DNA, 22 bp, Homo sapiens
actgcaggagacacagctgctg

SEQ ID NO: 10007848 - DNA, 22 bp, Homo sapiens
actgcagccttgaactctgggc

SEQ ID NO: 10007849 - DNA, 22 bp, Homo sapiens
actgcagcctttgggctcataa

SEQ ID NO: 10007850 - DNA, 22 bp, Homo sapiens
actgcagccttgaactctgggc

SEQ ID NO: 10007851 - DNA, 22 bp, Homo sapiens
actgcactccagcctgggtgac

SEQ ID NO: 10007852 - DNA, 22 bp, Homo sapiens
aagttccttgaatgaagctagg

SEQ ID NO: 10007853 - DNA, 22 bp, Homo sapiens
aagttcctgggccaagtccagg

SEQ ID NO: 10007854 - DNA, 22 bp, Homo sapiens
aagttctaaggtgcattattct

SEQ ID NO: 10007855 - DNA, 22 bp, Homo sapiens
aagttcgaaatttagggagatg

SEQ ID NO: 10007856 - DNA, 22 bp, Homo sapiens
aagttcgtaggtgagctgctgc

SEQ ID NO: 10007857 - DNA, 22 bp, Homo sapiens
aagttctaacaggaggtctctt

SEQ ID NO: 10007858 - DNA, 22 bp, Homo sapiens
aagttctaacatctacgtggaa

SEQ ID NO: 10007859 - DNA, 22 bp, Homo sapiens
actgcagggcatcctggccaag

SEQ ID NO: 10007860 - DNA, 22 bp, Homo sapiens
actgcaggtggatggcacttta

SEQ ID NO: 10007861 - DNA, 22 bp, Homo sapiens
actgcatcgctcgcttaggtcc

SEQ ID NO: 10007862 - DNA, 22 bp, Homo sapiens
actgcatctgaaacatgggtca

SEQ ID NO: 10007863 - DNA, 22 bp, Homo sapiens
actgcatctgaaacatgggtca

SEQ ID NO: 10007864 - DNA, 22 bp, Homo sapiens
actgcatctgaactgtgaatgg

SEQ ID NO: 10007865 - DNA, 22 bp, Homo sapiens
actgcatctgaaacatgggtca

SEQ ID NO: 10007866 - DNA, 21 bp, Homo sapiens
actgcatctgaagtcccagga

SEQ ID NO: 10007867 - DNA, 22 bp, Homo sapiens
aagttttcctgtgtccaagatg

SEQ ID NO: 10007868 - DNA, 22 bp, Homo sapiens
aagttttattggctatagcact

SEQ ID NO: 10007869 - DNA, 22 bp, Homo sapiens
aagttcaagtagtgttacatgg

SEQ ID NO: 10007870 - DNA, 22 bp, Homo sapiens
aagttcaagtctcctgagtata

SEQ ID NO: 10007871 - DNA, 22 bp, Homo sapiens
aagttcaagtgtaatctttatt

SEQ ID NO: 10007872 - DNA, 22 bp, Homo sapiens
aagttcaatcagatgaaaaagc

SEQ ID NO: 10007873 - DNA, 22 bp, Homo sapiens
aagttcctatatccaaatacag

SEQ ID NO: 10007874 - DNA, 22 bp, Homo sapiens
aagttcctcaaataaaacatga

SEQ ID NO: 10007875 - DNA, 22 bp, Homo sapiens
aagttcctcttctctgcaggga

SEQ ID NO: 10007876 - DNA, 18 bp, Homo sapiens
aagttccacaagagatct

SEQ ID NO: 10007877 - DNA, 22 bp, Homo sapiens
aagttcatcaaagagtaaatat

SEQ ID NO: 10007878 - DNA, 22 bp, Homo sapiens
actcttttataaagcatcttga

SEQ ID NO: 10007879 - DNA, 18 bp, Homo sapiens
actctttctgcccacagg

SEQ ID NO: 10007880 - DNA, 22 bp, Homo sapiens
actctttagaggtacatctctt

SEQ ID NO: 10007881 - DNA, 22 bp, Homo sapiens
aagttcaaggctctagagttcc

SEQ ID NO: 10007882 - DNA, 22 bp, Homo sapiens
actgaaaaagacatcttggtaa

SEQ ID NO: 10007883 - DNA, 22 bp, Homo sapiens
actgaaaaagtatgattcactg

SEQ ID NO: 10007884 - DNA, 22 bp, Homo sapiens
actgtcctcgaagtacctgtgc

SEQ ID NO: 10007885 - DNA, 22 bp, Homo sapiens
actgtctcctcatcatgcctgg

SEQ ID NO: 10007886 - DNA, 22 bp, Homo sapiens
actgtcctggagctcacactct

SEQ ID NO: 10007887 - DNA, 22 bp, Homo sapiens
aatagaacaataattgtaaact

SEQ ID NO: 10007888 - DNA, 23 bp, Homo sapiens
actgtctgatatgttttccatca

SEQ ID NO: 10007889 - DNA, 22 bp, Homo sapiens
aatagaatgtaatctaatacat

SEQ ID NO: 10007890 - DNA, 22 bp, Homo sapiens
actgtctctctagcagttcagg

SEQ ID NO: 10007891 - DNA, 22 bp, Homo sapiens
aatagcatagagttaaaatgca

SEQ ID NO: 10007892 - DNA, 22 bp, Homo sapiens
aatagcataagatgtcaaatag

SEQ ID NO: 10007893 - DNA, 22 bp, Homo sapiens
aatagcatcttctgagacaaag

SEQ ID NO: 10007894 - DNA, 22 bp, Homo sapiens
aatagcatcctaaaacatactt

SEQ ID NO: 10007895 - DNA, 22 bp, Homo sapiens
aatagcatagagttaaaatgca

SEQ ID NO: 10007896 - DNA, 22 bp, Homo sapiens
aatagcaattacatttgcacca

SEQ ID NO: 10007897 - DNA, 22 bp, Homo sapiens
aatagcaattacatttgcacca

SEQ ID NO: 10007898 - DNA, 22 bp, Homo sapiens
aatagcaaatgctcatttgaaa

SEQ ID NO: 10007899 - DNA, 22 bp, Homo sapiens
aatagcaaagttatcaaattaa

SEQ ID NO: 10007900 - DNA, 22 bp, Homo sapiens
aatagcaaacagacatgcacaa

SEQ ID NO: 10007901 - DNA, 22 bp, Homo sapiens
actgtacaaatattgcaaaata

SEQ ID NO: 10007902 - DNA, 22 bp, Homo sapiens
actgtccattcactcatattca

SEQ ID NO: 10007903 - DNA, 22 bp, Homo sapiens
actgtccagaagatagaaatat

SEQ ID NO: 10007904 - DNA, 22 bp, Homo sapiens
actgtccaagcatgcctggctt

SEQ ID NO: 10007905 - DNA, 22 bp, Homo sapiens
actgtacatgcatcttgtctat

SEQ ID NO: 10007906 - DNA, 22 bp, Homo sapiens
actgtcatgcattatggcatgt

SEQ ID NO: 10007907 - DNA, 22 bp, Homo sapiens
actgtcattaatgaatgtaata

SEQ ID NO: 10007908 - DNA, 22 bp, Homo sapiens
actgtacacgtgtcatttacag

SEQ ID NO: 10007909 - DNA, 22 bp, Homo sapiens
actgtacatatggattctaaga

SEQ ID NO: 10007910 - DNA, 22 bp, Homo sapiens
actgtacacgtgtcatttacag

SEQ ID NO: 10007911 - DNA, 22 bp, Homo sapiens
actgtacacagtggtgtactgt

SEQ ID NO: 10007912 - DNA, 20 bp, Homo sapiens
aataaaagaagccttcaccc

SEQ ID NO: 10007913 - DNA, 22 bp, Homo sapiens
aagtttttggtagagaaaagta

SEQ ID NO: 10007914 - DNA, 22 bp, Homo sapiens
aagtttttggtagagaaaagta

SEQ ID NO: 10007915 - DNA, 22 bp, Homo sapiens
aagtttttgattctaagagaga

SEQ ID NO: 10007916 - DNA, 22 bp, Homo sapiens
aagtttttgattctaagagaga

SEQ ID NO: 10007917 - DNA, 22 bp, Homo sapiens
aagttttgaaatactgaagtgt

SEQ ID NO: 10007918 - DNA, 20 bp, Homo sapiens
aagttttctccaaatacagt

SEQ ID NO: 10007919 - DNA, 22 bp, Homo sapiens
actgggaggcaaagagcaagga

SEQ ID NO: 10007920 - DNA, 22 bp, Homo sapiens
actgggaggcatctggagctga

SEQ ID NO: 10007921 - DNA, 22 bp, Homo sapiens
actgggagggtcttgaagaggg

SEQ ID NO: 10007922 - DNA, 22 bp, Homo sapiens
actgggagtcatgaggaaggag

SEQ ID NO: 10007923 - DNA, 22 bp, Homo sapiens
actgggagttctccatgtccct

SEQ ID NO: 10007924 - DNA, 22 bp, Homo sapiens
aataagttgcctgttgaatcat

SEQ ID NO: 10007925 - DNA, 22 bp, Homo sapiens
aataagtgagtttagcaagttt

SEQ ID NO: 10007926 - DNA, 22 bp, Homo sapiens
aataagtacttggggataactt

SEQ ID NO: 10007927 - DNA, 23 bp, Homo sapiens
aataaggccaaactatctggtct

SEQ ID NO: 10007928 - DNA, 22 bp, Homo sapiens
aataagccagcccatgtgaccc

SEQ ID NO: 10007929 - DNA, 22 bp, Homo sapiens
aataagcaagcctgtgtgcaag

SEQ ID NO: 10007930 - DNA, 22 bp, Homo sapiens
actggggaatggaactgggaat

SEQ ID NO: 10007931 - DNA, 22 bp, Homo sapiens
aataatacttcgtaaagttgtt

SEQ ID NO: 10007932 - DNA, 22 bp, Homo sapiens
aataatagcagagtttacaatc

SEQ ID NO: 10007933 - DNA, 22 bp, Homo sapiens
aataatacatgagattaatgtt

SEQ ID NO: 10007934 - DNA, 22 bp, Homo sapiens
aataataagatactaagggagt

SEQ ID NO: 10007935 - DNA, 19 bp, Homo sapiens
aatctagaaatatgtgttc

SEQ ID NO: 10007936 - DNA, 22 bp, Homo sapiens
aatctacatttcagttttgccc

SEQ ID NO: 10007937 - DNA, 22 bp, Homo sapiens
aatctacatagagatcaaatga

SEQ ID NO: 10007938 - DNA, 22 bp, Homo sapiens
aatctacatagagatcaaatga

SEQ ID NO: 10007939 - DNA, 22 bp, Homo sapiens
aatctacatgcaatatttttag

SEQ ID NO: 10007940 - DNA, 22 bp, Homo sapiens
aatctaagccaccagtagtttc

SEQ ID NO: 10007941 - DNA, 22 bp, Homo sapiens
aatctaaggacttagcattgct

SEQ ID NO: 10007942 - DNA, 22 bp, Homo sapiens
aatctacatagagatcaaatga

SEQ ID NO: 10007943 - DNA, 22 bp, Homo sapiens
aatctacatagagatcaaatga

SEQ ID NO: 10007944 - DNA, 22 bp, Homo sapiens
aatctaagggaaattggagatg

SEQ ID NO: 10007945 - DNA, 22 bp, Homo sapiens
aatctagagtgctaggtctgtg

SEQ ID NO: 10007946 - DNA, 22 bp, Homo sapiens
aatctagagacaatttgaatat

SEQ ID NO: 10007947 - DNA, 22 bp, Homo sapiens
aatctagagaactgtggggcag

SEQ ID NO: 10007948 - DNA, 22 bp, Homo sapiens
aatctagaattttaggggtata

SEQ ID NO: 10007949 - DNA, 23 bp, Homo sapiens
aatctagaatgacctactcatct

SEQ ID NO: 10007950 - DNA, 22 bp, Homo sapiens
aatctagtttcagactttgagt

SEQ ID NO: 10007951 - DNA, 22 bp, Homo sapiens
aatctagattcggatcaaaggg

SEQ ID NO: 10007952 - DNA, 22 bp, Homo sapiens
aatctagagttcccagcataaa

SEQ ID NO: 10007953 - DNA, 22 bp, Homo sapiens
agaaagggagagccagcacacg

SEQ ID NO: 10007954 - DNA, 22 bp, Homo sapiens
agaaagggaactggcaaagcca

SEQ ID NO: 10007955 - DNA, 22 bp, Homo sapiens
agaaagggaactggcaaagcca

SEQ ID NO: 10007956 - DNA, 22 bp, Homo sapiens
agaaagggaactggcaaagcca

SEQ ID NO: 10007957 - DNA, 22 bp, Homo sapiens
agaaagggatgaggtagctgct

SEQ ID NO: 10007958 - DNA, 22 bp, Homo sapiens
aatccttactgaatgagaaaaa

SEQ ID NO: 10007959 - DNA, 22 bp, Homo sapiens
aatccttactgaatgagaaaaa

SEQ ID NO: 10007960 - DNA, 22 bp, Homo sapiens
aatcgcttggtaattttaaaag

SEQ ID NO: 10007961 - DNA, 22 bp, Homo sapiens
aatcacaaatgcaagttgtcac

SEQ ID NO: 10007962 - DNA, 22 bp, Homo sapiens
aatcacaaatgcaagttgtcac

SEQ ID NO: 10007963 - DNA, 22 bp, Homo sapiens
aatcacaaatttagacagagct

SEQ ID NO: 10007964 - DNA, 22 bp, Homo sapiens
aatcacaaatttagacagagct

SEQ ID NO: 10007965 - DNA, 22 bp, Homo sapiens
aatcacaattacttttgcacca

SEQ ID NO: 10007966 - DNA, 22 bp, Homo sapiens
aatcacagagtccagcagatga

SEQ ID NO: 10007967 - DNA, 22 bp, Homo sapiens
agaaagctggaagagctgggat

SEQ ID NO: 10007968 - DNA, 22 bp, Homo sapiens
agaaagcttatgaatgggcaag

SEQ ID NO: 10007969 - DNA, 22 bp, Homo sapiens
agaaagcttatgaatgggcaag

SEQ ID NO: 10007970 - DNA, 22 bp, Homo sapiens
agaaagcttatgaatgggcaag

SEQ ID NO: 10007971 - DNA, 22 bp, Homo sapiens
agaaactgaattatttctgagg

SEQ ID NO: 10007972 - DNA, 22 bp, Homo sapiens
agaaagctggagtcaagcagag

SEQ ID NO: 10007973 - DNA, 22 bp, Homo sapiens
agaaaggagcaccgtgggggat

SEQ ID NO: 10007974 - DNA, 22 bp, Homo sapiens
agaaaggagaccagctctgccc

SEQ ID NO: 10007975 - DNA, 22 bp, Homo sapiens
agaaaggaggaagaatgacctc

SEQ ID NO: 10007976 - DNA, 22 bp, Homo sapiens
agaaaggaggaagaatgacctc

SEQ ID NO: 10007977 - DNA, 22 bp, Homo sapiens
actttgaaggggaacattttaa

SEQ ID NO: 10007978 - DNA, 22 bp, Homo sapiens
aatagtaaaagatacagctaat

SEQ ID NO: 10007979 - DNA, 22 bp, Homo sapiens
aataggctcaaatgttcttctc

SEQ ID NO: 10007980 - DNA, 22 bp, Homo sapiens
aataggcagttggatatgcaag

SEQ ID NO: 10007981 - DNA, 22 bp, Homo sapiens
aataggaagtcacatcaaggga

SEQ ID NO: 10007982 - DNA, 22 bp, Homo sapiens
aataggaagtcacatcaaggga

SEQ ID NO: 10007983 - DNA, 22 bp, Homo sapiens
aataggaagcaccaaattctcc

SEQ ID NO: 10007984 - DNA, 22 bp, Homo sapiens
aataggaaaatatttaacaaga

SEQ ID NO: 10007985 - DNA, 22 bp, Homo sapiens
aatagctttctcatgacttcac

SEQ ID NO: 10007986 - DNA, 22 bp, Homo sapiens
aatagctttggtcaccatctgg

SEQ ID NO: 10007987 - DNA, 22 bp, Homo sapiens
aatagcttggacccattgcttt

SEQ ID NO: 10007988 - DNA, 22 bp, Homo sapiens
aatagctttctcatgacttcac

SEQ ID NO: 10007989 - DNA, 22 bp, Homo sapiens
aatagccaaagtgcatttatga

SEQ ID NO: 10007990 - DNA, 22 bp, Homo sapiens
aatagcatgtaagtttaaaaga

SEQ ID NO: 10007991 - DNA, 22 bp, Homo sapiens
aatagcatgtaagtttaaaaga

SEQ ID NO: 10007992 - DNA, 22 bp, Homo sapiens
aatagcatgttcatgataaaat

SEQ ID NO: 10007993 - DNA, 17 bp, Homo sapiens
aatagctgctcagagag

SEQ ID NO: 10007994 - DNA, 22 bp, Homo sapiens
aatagcttagtcctgattctgt

SEQ ID NO: 10007995 - DNA, 22 bp, Homo sapiens
aatagcttagtcctgattctgt

SEQ ID NO: 10007996 - DNA, 22 bp, Homo sapiens
aatagcttagtcctgattctgt

SEQ ID NO: 10007997 - DNA, 22 bp, Homo sapiens
aatagcttatgggatagatgtt

SEQ ID NO: 10007998 - DNA, 23 bp, Homo sapiens
aatagctggtaatgatagcacaa

SEQ ID NO: 10007999 - DNA, 22 bp, Homo sapiens
acttttatgataatcaatgttc

SEQ ID NO: 10008000 - DNA, 22 bp, Homo sapiens
acttttatgataatcaatgttc

SEQ ID NO: 10008001 - DNA, 22 bp, Homo sapiens
acttttaaggggccttgattta

SEQ ID NO: 10008002 - DNA, 22 bp, Homo sapiens
acttttatcaaggaagtgatct

SEQ ID NO: 10008003 - DNA, 22 bp, Homo sapiens
acttttatcaaggaagtgatct

SEQ ID NO: 10008004 - DNA, 22 bp, Homo sapiens
acttttatgataatcaatgttc

SEQ ID NO: 10008005 - DNA, 21 bp, Homo sapiens
aatcaagagtactggtgtggc

SEQ ID NO: 10008006 - DNA, 22 bp, Homo sapiens
aatcaagagttgtgtaatattt

SEQ ID NO: 10008007 - DNA, 22 bp, Homo sapiens
aatcaatgttagtcatgaattt

SEQ ID NO: 10008008 - DNA, 23 bp, Homo sapiens
aatcaagttttgatgaggaagcc

SEQ ID NO: 10008009 - DNA, 22 bp, Homo sapiens
aatcaatgttagtcatgaattt

SEQ ID NO: 10008010 - DNA, 22 bp, Homo sapiens
actttgttttcatgaaacagct

SEQ ID NO: 10008011 - DNA, 22 bp, Homo sapiens
actttgttttatagcacataag

SEQ ID NO: 10008012 - DNA, 22 bp, Homo sapiens
acttttaaatgagtttcagttg

SEQ ID NO: 10008013 - DNA, 22 bp, Homo sapiens
acttttaaatgagtttcagttg

SEQ ID NO: 10008014 - DNA, 22 bp, Homo sapiens
acttttaaatgagtttcagttg

SEQ ID NO: 10008015 - DNA, 22 bp, Homo sapiens
actttgttcctttcacaaagaa

SEQ ID NO: 10008016 - DNA, 22 bp, Homo sapiens
actttgttctaatagtatctct

SEQ ID NO: 10008017 - DNA, 22 bp, Homo sapiens
actttgttgaagaatatgttag

SEQ ID NO: 10008018 - DNA, 22 bp, Homo sapiens
actttgttgaagaatatgttag

SEQ ID NO: 10008019 - DNA, 22 bp, Homo sapiens
actttgttgatgaaatagtttt

SEQ ID NO: 10008020 - DNA, 22 bp, Homo sapiens
actttgttgatgaaatagtttt

SEQ ID NO: 10008021 - DNA, 22 bp, Homo sapiens
agaaggaaggaagcattctgtt

SEQ ID NO: 10008022 - DNA, 22 bp, Homo sapiens
agaaggaaacagctgtgctttg

SEQ ID NO: 10008023 - DNA, 22 bp, Homo sapiens
agaaggaaacagctgtgctttg

SEQ ID NO: 10008024 - DNA, 22 bp, Homo sapiens
agaagccagcttcagctgcccg

SEQ ID NO: 10008025 - DNA, 22 bp, Homo sapiens
agaagccagtcgctctcccgca

SEQ ID NO: 10008026 - DNA, 22 bp, Homo sapiens
agaagccagcttcagctgcccg

SEQ ID NO: 10008027 - DNA, 22 bp, Homo sapiens
agaagccagattgtagtgggac

SEQ ID NO: 10008028 - DNA, 22 bp, Homo sapiens
agaagccagccttgcctccttt

SEQ ID NO: 10008029 - DNA, 22 bp, Homo sapiens
agaagctgtggtatgaaatgtg

SEQ ID NO: 10008030 - DNA, 22 bp, Homo sapiens
agaagcttgaaggagcagtgac

SEQ ID NO: 10008031 - DNA, 22 bp, Homo sapiens
agaagcttgaaggagcagtgac

SEQ ID NO: 10008032 - DNA, 22 bp, Homo sapiens
agaaggaaacagctgtgctttg

SEQ ID NO: 10008033 - DNA, 22 bp, Homo sapiens
agaaggaaaacctgtcttatgt

SEQ ID NO: 10008034 - DNA, 22 bp, Homo sapiens
agaaggaaaacctgtcttatgt

SEQ ID NO: 10008035 - DNA, 22 bp, Homo sapiens
aatgcattccactgagatttgt

SEQ ID NO: 10008036 - DNA, 22 bp, Homo sapiens
aatgcattagctacatatgtct

SEQ ID NO: 10008037 - DNA, 22 bp, Homo sapiens
aatgcattgattgctggaaata

SEQ ID NO: 10008038 - DNA, 22 bp, Homo sapiens
aatgcatgtttcctctcagcag

SEQ ID NO: 10008039 - DNA, 22 bp, Homo sapiens
aatgcattaaagttagagactt

SEQ ID NO: 10008040 - DNA, 22 bp, Homo sapiens
aatgcatatgtaggcaagcagt

SEQ ID NO: 10008041 - DNA, 22 bp, Homo sapiens
aatgcataccatgtcatctttg

SEQ ID NO: 10008042 - DNA, 22 bp, Homo sapiens
aatgcatacgtgtttgtggcaa

SEQ ID NO: 10008043 - DNA, 22 bp, Homo sapiens
aatgcatacgtgtttgtggcaa

SEQ ID NO: 10008044 - DNA, 22 bp, Homo sapiens
aatgcataatggtttgtgacaa

SEQ ID NO: 10008045 - DNA, 22 bp, Homo sapiens
aatgcacaaaggtgtctattgc

SEQ ID NO: 10008046 - DNA, 22 bp, Homo sapiens
aatgccaatgggcagaactaga

SEQ ID NO: 10008047 - DNA, 22 bp, Homo sapiens
aatgccaatgggcagaactaga

SEQ ID NO: 10008048 - DNA, 22 bp, Homo sapiens
aatgccaacttggatatacatt

SEQ ID NO: 10008049 - DNA, 22 bp, Homo sapiens
aatgccaatattcatttgtgtt

SEQ ID NO: 10008050 - DNA, 22 bp, Homo sapiens
aatgccttataggctgaaaatt

SEQ ID NO: 10008051 - DNA, 22 bp, Homo sapiens
aatgaagaaatggacatcttta

SEQ ID NO: 10008052 - DNA, 22 bp, Homo sapiens
aatgaagataaaatgggatgga

SEQ ID NO: 10008053 - DNA, 22 bp, Homo sapiens
aatgaagattatggtgattaag

SEQ ID NO: 10008054 - DNA, 22 bp, Homo sapiens
aatgaagacacatctttctcat

SEQ ID NO: 10008055 - DNA, 22 bp, Homo sapiens
aatgaagccactgaagacaatc

SEQ ID NO: 10008056 - DNA, 20 bp, Homo sapiens
aatgaagttattaatgatgt

SEQ ID NO: 10008057 - DNA, 21 bp, Homo sapiens
aatgaagtggctattttgagg

SEQ ID NO: 10008058 - DNA, 20 bp, Homo sapiens
aatgaagttattaatgatgt

SEQ ID NO: 10008059 - DNA, 22 bp, Homo sapiens
aatgaagttctattcattttct

SEQ ID NO: 10008060 - DNA, 22 bp, Homo sapiens
aatgaataccgtttcactcagt

SEQ ID NO: 10008061 - DNA, 22 bp, Homo sapiens
aatgaataccgtttcactcagt

SEQ ID NO: 10008062 - DNA, 22 bp, Homo sapiens
aatgaataccgtttcactcagt

SEQ ID NO: 10008063 - DNA, 22 bp, Homo sapiens
agaagccaccagctgaggaaga

SEQ ID NO: 10008064 - DNA, 22 bp, Homo sapiens
aatgaatgaaccacatataaca

SEQ ID NO: 10008065 - DNA, 22 bp, Homo sapiens
agaagcagctttcaaggtgatt

SEQ ID NO: 10008066 - DNA, 22 bp, Homo sapiens
agaagccaccagctgaggaaga

SEQ ID NO: 10008067 - DNA, 18 bp, Homo sapiens
agaagccacgaggagtcc

SEQ ID NO: 10008068 - DNA, 22 bp, Homo sapiens
agaagccactggaggttgagat

SEQ ID NO: 10008069 - DNA, 22 bp, Homo sapiens
agaagccagaggcagtgggtac

SEQ ID NO: 10008070 - DNA, 22 bp, Homo sapiens
agaagccagaatattcatggat

SEQ ID NO: 10008071 - DNA, 22 bp, Homo sapiens
agaacttttggagacttttagt

SEQ ID NO: 10008072 - DNA, 22 bp, Homo sapiens
agaacttcagcaaaaccagtta

SEQ ID NO: 10008073 - DNA, 22 bp, Homo sapiens
agaacttaggaacaacagctta

SEQ ID NO: 10008074 - DNA, 22 bp, Homo sapiens
agaacttaattcagtgacttaa

SEQ ID NO: 10008075 - DNA, 22 bp, Homo sapiens
agaacttacattatagagctgt

SEQ ID NO: 10008076 - DNA, 22 bp, Homo sapiens
agaacttaggaacaacagctta

SEQ ID NO: 10008077 - DNA, 22 bp, Homo sapiens
agaagaaactgtcggggatatt

SEQ ID NO: 10008078 - DNA, 22 bp, Homo sapiens
agaagaaactgtcggggatatt

SEQ ID NO: 10008079 - DNA, 22 bp, Homo sapiens
aatgaagaaatggacatcttta

SEQ ID NO: 10008080 - DNA, 22 bp, Homo sapiens
aatgaactgtgttaactgaata

SEQ ID NO: 10008081 - DNA, 22 bp, Homo sapiens
aatgaactggagaacaatgacc

SEQ ID NO: 10008082 - DNA, 22 bp, Homo sapiens
agaagaaagattgaaggttcct

SEQ ID NO: 10008083 - DNA, 22 bp, Homo sapiens
agaacgctattcagaacactgg

SEQ ID NO: 10008084 - DNA, 22 bp, Homo sapiens
agaacctttctttagaaattca

SEQ ID NO: 10008085 - DNA, 22 bp, Homo sapiens
agaacaattgccccaaagcttg

SEQ ID NO: 10008086 - DNA, 20 bp, Homo sapiens
agaactgaatcattttgggt

SEQ ID NO: 10008087 - DNA, 22 bp, Homo sapiens
agaactctttatctgtggaatg

SEQ ID NO: 10008088 - DNA, 22 bp, Homo sapiens
agaactgatttgaaggttgggg

SEQ ID NO: 10008089 - DNA, 22 bp, Homo sapiens
agaactctaggattggctggat

SEQ ID NO: 10008090 - DNA, 22 bp, Homo sapiens
agaactctatattcatgaacaa

SEQ ID NO: 10008091 - DNA, 22 bp, Homo sapiens
agaactctcgctggatcagact

SEQ ID NO: 10008092 - DNA, 22 bp, Homo sapiens
agaactctgaacactgtctgga

SEQ ID NO: 10008093 - DNA, 22 bp, Homo sapiens
agaactgtcacgagtgacaaag

SEQ ID NO: 10008094 - DNA, 17 bp, Homo sapiens
agaactgtagtagctcc

SEQ ID NO: 10008095 - DNA, 22 bp, Homo sapiens
aaaagtattttgagcactttat

SEQ ID NO: 10008096 - DNA, 22 bp, Homo sapiens
aaaagtgttcaggaagaataat

SEQ ID NO: 10008097 - DNA, 22 bp, Homo sapiens
aaaagtatttatggctatgtaa

SEQ ID NO: 10008098 - DNA, 22 bp, Homo sapiens
aaaagtatttatggctatgtaa

SEQ ID NO: 10008099 - DNA, 19 bp, Homo sapiens
aaaaggaatattctttggg

SEQ ID NO: 10008100 - DNA, 21 bp, Homo sapiens
aaaaggaaggtctgtttgggg

SEQ ID NO: 10008101 - DNA, 22 bp, Homo sapiens
aaaagctttgttaataggtttg

SEQ ID NO: 10008102 - DNA, 22 bp, Homo sapiens
aaaagctttgccagatgagttg

SEQ ID NO: 10008103 - DNA, 22 bp, Homo sapiens
aaaagctagtcaatgatgtatt

SEQ ID NO: 10008104 - DNA, 22 bp, Homo sapiens
aaaagctagtcaatgatgtatt

SEQ ID NO: 10008105 - DNA, 22 bp, Homo sapiens
aaaagttccctggttagaaaag

SEQ ID NO: 10008106 - DNA, 22 bp, Homo sapiens
aaaagttcattagtgagcttct

SEQ ID NO: 10008107 - DNA, 22 bp, Homo sapiens
aaaagtttaagactcattctag

SEQ ID NO: 10008108 - DNA, 22 bp, Homo sapiens
aaaagtttaagactcattctag

SEQ ID NO: 10008109 - DNA, 22 bp, Homo sapiens
aaaagtttaagactcattctag

SEQ ID NO: 10008110 - DNA, 22 bp, Homo sapiens
aaaagtttaagactcattctag

SEQ ID NO: 10008111 - DNA, 22 bp, Homo sapiens
aaaagttattgatgcaggacaa

SEQ ID NO: 10008112 - DNA, 22 bp, Homo sapiens
aaaagttacctctgtaatataa

SEQ ID NO: 10008113 - DNA, 22 bp, Homo sapiens
aaaagttagctattagtaggtg

SEQ ID NO: 10008114 - DNA, 22 bp, Homo sapiens
aaaagttaactgtgttcatgca

SEQ ID NO: 10008115 - DNA, 22 bp, Homo sapiens
aaaatactactgtcttcttccc

SEQ ID NO: 10008116 - DNA, 22 bp, Homo sapiens
aaaatactactgtcttcttccc

SEQ ID NO: 10008117 - DNA, 22 bp, Homo sapiens
aaaatacacatactaggggaaa

SEQ ID NO: 10008118 - DNA, 22 bp, Homo sapiens
aaaatgagacacatgtgactcc

SEQ ID NO: 10008119 - DNA, 22 bp, Homo sapiens
aaaatgagatacagtttgaaag

SEQ ID NO: 10008120 - DNA, 22 bp, Homo sapiens
aaaatctgcttccttttacaga

SEQ ID NO: 10008121 - DNA, 22 bp, Homo sapiens
aaaatctggcaacactaagttt

SEQ ID NO: 10008122 - DNA, 22 bp, Homo sapiens
aaaatacacatactaggggaaa

SEQ ID NO: 10008123 - DNA, 22 bp, Homo sapiens
aaaataacttctactatttgca

SEQ ID NO: 10008124 - DNA, 21 bp, Homo sapiens
aaaagtttgacaggaaaggga

SEQ ID NO: 10008125 - DNA, 22 bp, Homo sapiens
aaaagtttaagactcattctag

SEQ ID NO: 10008126 - DNA, 22 bp, Homo sapiens
aaaagtttgtgcaaacactcag

SEQ ID NO: 10008127 - DNA, 22 bp, Homo sapiens
aaaagtttgtgcaaacactcag

SEQ ID NO: 10008128 - DNA, 22 bp, Homo sapiens
aaaagtttgtgcaaacactcag

SEQ ID NO: 10008129 - DNA, 22 bp, Homo sapiens
aaaagtttgtgcaaacactcag

SEQ ID NO: 10008130 - DNA, 22 bp, Homo sapiens
aaagcagccacagagagagcgt

SEQ ID NO: 10008131 - DNA, 22 bp, Homo sapiens
aaagcagcagcacgtggaagag

SEQ ID NO: 10008132 - DNA, 22 bp, Homo sapiens
aaagcagcagcacctgcatttc

SEQ ID NO: 10008133 - DNA, 22 bp, Homo sapiens
aaagcagcagcacgtggaagag

SEQ ID NO: 10008134 - DNA, 22 bp, Homo sapiens
aaagcagcagaatctctcaggg

SEQ ID NO: 10008135 - DNA, 22 bp, Homo sapiens
aaagcagcagcacctgcatttc

SEQ ID NO: 10008136 - DNA, 22 bp, Homo sapiens
aaagcagcagcacctgcatttc

SEQ ID NO: 10008137 - DNA, 22 bp, Homo sapiens
aaagcaatggatgagaatctgt

SEQ ID NO: 10008138 - DNA, 22 bp, Homo sapiens
aaagcaatggatgagaatctgt

SEQ ID NO: 10008139 - DNA, 22 bp, Homo sapiens
aaagcaatggatgagaatctgt

SEQ ID NO: 10008140 - DNA, 22 bp, Homo sapiens
aaagcaatggatgagaatctgt

SEQ ID NO: 10008141 - DNA, 22 bp, Homo sapiens
aaaatgtctgctgttggtttat

SEQ ID NO: 10008142 - DNA, 22 bp, Homo sapiens
aaaatgtctgctgttggtttat

SEQ ID NO: 10008143 - DNA, 22 bp, Homo sapiens
aaaatgtatgatggaggtgcta

SEQ ID NO: 10008144 - DNA, 21 bp, Homo sapiens
aaaatgtagacttttccctga

SEQ ID NO: 10008145 - DNA, 22 bp, Homo sapiens
aaagcagcggtgtctttactgc

SEQ ID NO: 10008146 - DNA, 22 bp, Homo sapiens
aaagcagctgatctcagagcct

SEQ ID NO: 10008147 - DNA, 22 bp, Homo sapiens
aaagcagctgatagtctcatct

SEQ ID NO: 10008148 - DNA, 22 bp, Homo sapiens
aaagcagcggtgtctttactgc

SEQ ID NO: 10008149 - DNA, 22 bp, Homo sapiens
aaagcagctgatagtctcatct

SEQ ID NO: 10008150 - DNA, 22 bp, Homo sapiens
aaagcagctgtttgactttcca

SEQ ID NO: 10008151 - DNA, 22 bp, Homo sapiens
aaagcagggtccaaggagatgt

SEQ ID NO: 10008152 - DNA, 22 bp, Homo sapiens
aaagcagggtccaaggagatgt

SEQ ID NO: 10008153 - DNA, 22 bp, Homo sapiens
aaagcagggatgaggctagagg

SEQ ID NO: 10008154 - DNA, 22 bp, Homo sapiens
aaaatgatgctgtaatttggca

SEQ ID NO: 10008155 - DNA, 22 bp, Homo sapiens
aaaatgagccatgaaccaacca

SEQ ID NO: 10008156 - DNA, 22 bp, Homo sapiens
aaaatgatatcctgacttttat

SEQ ID NO: 10008157 - DNA, 22 bp, Homo sapiens
aaaatgcaaacctacctacata

SEQ ID NO: 10008158 - DNA, 18 bp, Homo sapiens
aaaatgcaggcgacatgg

SEQ ID NO: 10008159 - DNA, 22 bp, Homo sapiens
aaaatgctgggaaagttggaat

SEQ ID NO: 10008160 - DNA, 22 bp, Homo sapiens
aaaatgctatttcatggaggag

SEQ ID NO: 10008161 - DNA, 22 bp, Homo sapiens
aaaatgctcatcagcgatggct

SEQ ID NO: 10008162 - DNA, 22 bp, Homo sapiens
aaaatggcttaataggcaataa

SEQ ID NO: 10008163 - DNA, 22 bp, Homo sapiens
aaaatggctgtggtctggcaag

SEQ ID NO: 10008164 - DNA, 20 bp, Homo sapiens
aaaatggccttgtattaaaa

SEQ ID NO: 10008165 - DNA, 22 bp, Homo sapiens
aaaatggatagtgcgtcttctc

SEQ ID NO: 10008166 - DNA, 22 bp, Homo sapiens
aaaatggtctcagctggcacca

SEQ ID NO: 10008167 - DNA, 22 bp, Homo sapiens
aaaatgtaaagcttgagtgtag

SEQ ID NO: 10008168 - DNA, 22 bp, Homo sapiens
aaaatgtaaagcttgagtgtag

SEQ ID NO: 10008169 - DNA, 22 bp, Homo sapiens
aaaacattctgtgaactctcaa

SEQ ID NO: 10008170 - DNA, 22 bp, Homo sapiens
aaaacattctgtgaactctcaa

SEQ ID NO: 10008171 - DNA, 22 bp, Homo sapiens
aaaacatgtccatacagaaact

SEQ ID NO: 10008172 - DNA, 22 bp, Homo sapiens
aaaacatgtccatacagaaact

SEQ ID NO: 10008173 - DNA, 22 bp, Homo sapiens
aaaagaggttaaccaggtgtgt

SEQ ID NO: 10008174 - DNA, 22 bp, Homo sapiens
aaaagaggagtggtttatgaca

SEQ ID NO: 10008175 - DNA, 22 bp, Homo sapiens
aaaagagtgactgataagtata

SEQ ID NO: 10008176 - DNA, 22 bp, Homo sapiens
aaaagagtgactgataagtata

SEQ ID NO: 10008177 - DNA, 22 bp, Homo sapiens
aaaagagtcttaggcagtcata

SEQ ID NO: 10008178 - DNA, 22 bp, Homo sapiens
aaaagagtcttaggcagtcata

SEQ ID NO: 10008179 - DNA, 22 bp, Homo sapiens
aaaagaggttaaccaggtgtgt

SEQ ID NO: 10008180 - DNA, 22 bp, Homo sapiens
aaaagcaaggcagtctgtctga

SEQ ID NO: 10008181 - DNA, 22 bp, Homo sapiens
aaaagcaaggcagtctgtctga

SEQ ID NO: 10008182 - DNA, 22 bp, Homo sapiens
aaaagcaagttgcctaggttga

SEQ ID NO: 10008183 - DNA, 22 bp, Homo sapiens
aaaagcaaggcagtctgtctga

SEQ ID NO: 10008184 - DNA, 22 bp, Homo sapiens
aaaagcaaggcagtctgtctga

SEQ ID NO: 10008185 - DNA, 22 bp, Homo sapiens
aaaagattgttagggagaatgt

SEQ ID NO: 10008186 - DNA, 22 bp, Homo sapiens
aaaagcaagaggctggattaaa

SEQ ID NO: 10008187 - DNA, 22 bp, Homo sapiens
aaaagatgaaatggtgtcttgg

SEQ ID NO: 10008188 - DNA, 22 bp, Homo sapiens
aaaagagtgtttcaactttggc

SEQ ID NO: 10008189 - DNA, 22 bp, Homo sapiens
aaaagagtgtttcaactttggc

SEQ ID NO: 10008190 - DNA, 22 bp, Homo sapiens
aaaagagtgactgataagtata

SEQ ID NO: 10008191 - DNA, 22 bp, Homo sapiens
aaaaatttatggttcttctctg

SEQ ID NO: 10008192 - DNA, 22 bp, Homo sapiens
aaaacacaagaagcagggtaca

SEQ ID NO: 10008193 - DNA, 22 bp, Homo sapiens
aaaaatgttatctactgtccga

SEQ ID NO: 10008194 - DNA, 22 bp, Homo sapiens
aaaaatgttatctactgtccga

SEQ ID NO: 10008195 - DNA, 22 bp, Homo sapiens
aaaaatgttatctactgtccga

SEQ ID NO: 10008196 - DNA, 22 bp, Homo sapiens
aaaaatgtgaccacagggtgtt

SEQ ID NO: 10008197 - DNA, 22 bp, Homo sapiens
aaaaatctatgactgcttctcc

SEQ ID NO: 10008198 - DNA, 22 bp, Homo sapiens
aaaaatctatgactgcttctcc

SEQ ID NO: 10008199 - DNA, 22 bp, Homo sapiens
aaaacagttataaacagagtca

SEQ ID NO: 10008200 - DNA, 22 bp, Homo sapiens
aaaacagttataaacagagtca

SEQ ID NO: 10008201 - DNA, 22 bp, Homo sapiens
aaaacaggagttttggtaggct

SEQ ID NO: 10008202 - DNA, 22 bp, Homo sapiens
aaaagagcttggttgattttgc

SEQ ID NO: 10008203 - DNA, 22 bp, Homo sapiens
aaaacagtttttgctaactgct

SEQ ID NO: 10008204 - DNA, 22 bp, Homo sapiens
aaaagaggaactcttatatact

SEQ ID NO: 10008205 - DNA, 22 bp, Homo sapiens
aaaagaggaactcttatatact

SEQ ID NO: 10008206 - DNA, 22 bp, Homo sapiens
aaaagaggaactcttatatact

SEQ ID NO: 10008207 - DNA, 22 bp, Homo sapiens
aaaagaggagtggtttatgaca

SEQ ID NO: 10008208 - DNA, 22 bp, Homo sapiens
aaaacagtttttgctaactgct

SEQ ID NO: 10008209 - DNA, 22 bp, Homo sapiens
aaaacagtttaggcatcacagt

SEQ ID NO: 10008210 - DNA, 22 bp, Homo sapiens
aaaacagtttaggcatcacagt

SEQ ID NO: 10008211 - DNA, 22 bp, Homo sapiens
aaaacacaagaagcagggtaca

SEQ ID NO: 10008212 - DNA, 22 bp, Homo sapiens
aaaacacaagaagcagggtaca

SEQ ID NO: 10008213 - DNA, 22 bp, Homo sapiens
aaaacacactggaccaatttaa

SEQ ID NO: 10008214 - DNA, 22 bp, Homo sapiens
aaaacacactggaccaatttaa

SEQ ID NO: 10008215 - DNA, 22 bp, Homo sapiens
aaaacactgcctgcttgactga

SEQ ID NO: 10008216 - DNA, 22 bp, Homo sapiens
aaaacagaggtgcctgggccca

SEQ ID NO: 10008217 - DNA, 22 bp, Homo sapiens
aaaacagacagccagtgtagag

SEQ ID NO: 10008218 - DNA, 22 bp, Homo sapiens
aaaacagacagccagtgtagag

SEQ ID NO: 10008219 - DNA, 22 bp, Homo sapiens
aaaagccatgcatacctaagag

SEQ ID NO: 10008220 - DNA, 22 bp, Homo sapiens
aaaagcatctcaaaggagcttc

SEQ ID NO: 10008221 - DNA, 22 bp, Homo sapiens
aaaagcattacatggtacgtat

SEQ ID NO: 10008222 - DNA, 22 bp, Homo sapiens
aaaagcagtaaatgtatgacct

SEQ ID NO: 10008223 - DNA, 22 bp, Homo sapiens
aaaagcagtaaatgtatgacct

SEQ ID NO: 10008224 - DNA, 22 bp, Homo sapiens
aaaagcagttatctgggaggaa

SEQ ID NO: 10008225 - DNA, 22 bp, Homo sapiens
aaaagcagaccacgctttgtgg

SEQ ID NO: 10008226 - DNA, 22 bp, Homo sapiens
aaaagcagagactctggagcta

SEQ ID NO: 10008227 - DNA, 22 bp, Homo sapiens
aaaagcaattgcgggttttgcc

SEQ ID NO: 10008228 - DNA, 20 bp, Homo sapiens
aaaagcagccagagatggta

SEQ ID NO: 10008229 - DNA, 22 bp, Homo sapiens
aaaagcagatctccaaagtcta

SEQ ID NO: 10008230 - DNA, 22 bp, Homo sapiens
aaaagcaattgcgggttttgcc

SEQ ID NO: 10008231 - DNA, 22 bp, Homo sapiens
aaaagcaattgcagttcttgcc

SEQ ID NO: 10008232 - DNA, 22 bp, Homo sapiens
aaatacagagttgcttaaaagc

SEQ ID NO: 10008233 - DNA, 22 bp, Homo sapiens
aaatacagagttatggacctca

SEQ ID NO: 10008234 - DNA, 22 bp, Homo sapiens
aaatacagagttgcttaaaagc

SEQ ID NO: 10008235 - DNA, 22 bp, Homo sapiens
aaatacaatttcaggctgtaat

SEQ ID NO: 10008236 - DNA, 22 bp, Homo sapiens
aaatacacgtacatgtgtaaaa

SEQ ID NO: 10008237 - DNA, 22 bp, Homo sapiens
aaataaaggtccactttagggc

SEQ ID NO: 10008238 - DNA, 22 bp, Homo sapiens
aaataacagtcagggacaacat

SEQ ID NO: 10008239 - DNA, 22 bp, Homo sapiens
aaactgttatagcagaaaggac

SEQ ID NO: 10008240 - DNA, 23 bp, Homo sapiens
aaactgttgcttcaatgtatcct

SEQ ID NO: 10008241 - DNA, 22 bp, Homo sapiens
aaactgttgtggtttatcatta

SEQ ID NO: 10008242 - DNA, 22 bp, Homo sapiens
aaactgtttccctccataacct

SEQ ID NO: 10008243 - DNA, 23 bp, Homo sapiens
aaatgacatatggtttctgaagg

SEQ ID NO: 10008244 - DNA, 22 bp, Homo sapiens
aaactgtgagctagtaaatagg

SEQ ID NO: 10008245 - DNA, 22 bp, Homo sapiens
aaactgtgagctagtaaatagg

SEQ ID NO: 10008246 - DNA, 22 bp, Homo sapiens
aaatgacagagctgggactagt

SEQ ID NO: 10008247 - DNA, 22 bp, Homo sapiens
aaatgacagagctgggactagt

SEQ ID NO: 10008248 - DNA, 22 bp, Homo sapiens
aaatgacagagtaagctgttta

SEQ ID NO: 10008249 - DNA, 22 bp, Homo sapiens
aaatgacagttctctctgagta

SEQ ID NO: 10008250 - DNA, 22 bp, Homo sapiens
aaatgacaataaaagtccatgc

SEQ ID NO: 10008251 - DNA, 22 bp, Homo sapiens
aaatgacactaggctttttgca

SEQ ID NO: 10008252 - DNA, 22 bp, Homo sapiens
aaatgacactcattcagtgtca

SEQ ID NO: 10008253 - DNA, 22 bp, Homo sapiens
aaatgacactaggctttttgca

SEQ ID NO: 10008254 - DNA, 22 bp, Homo sapiens
aaatgaacatcaagaatagcct

SEQ ID NO: 10008255 - DNA, 21 bp, Homo sapiens
aaatgaatgtggtagtgcaag

SEQ ID NO: 10008256 - DNA, 21 bp, Homo sapiens
aaatgaatgtggtagtgcaag

SEQ ID NO: 10008257 - DNA, 22 bp, Homo sapiens
aaacttcagtgaatgacttatg

SEQ ID NO: 10008258 - DNA, 22 bp, Homo sapiens
aaacttcatggataatataaag

SEQ ID NO: 10008259 - DNA, 23 bp, Homo sapiens
aaacttcagtagtgtcatcagcc

SEQ ID NO: 10008260 - DNA, 22 bp, Homo sapiens
aaacttcagtaggagccaacct

SEQ ID NO: 10008261 - DNA, 22 bp, Homo sapiens
aaacttcaagattcaagcctgg

SEQ ID NO: 10008262 - DNA, 17 bp, Homo sapiens
aaacttcacggtcagcc

SEQ ID NO: 10008263 - DNA, 22 bp, Homo sapiens
aaacttcagactccccacttct

SEQ ID NO: 10008264 - DNA, 22 bp, Homo sapiens
aaacttcaaggatttgcaaatc

SEQ ID NO: 10008265 - DNA, 22 bp, Homo sapiens
aaatgtctgtatgagaaagaga

SEQ ID NO: 10008266 - DNA, 22 bp, Homo sapiens
aaatgtctttatctcatgtaac

SEQ ID NO: 10008267 - DNA, 22 bp, Homo sapiens
aaatgtctgagacttctgaact

SEQ ID NO: 10008268 - DNA, 22 bp, Homo sapiens
aaatgtctgtatgagaaagaga

SEQ ID NO: 10008269 - DNA, 22 bp, Homo sapiens
aaatgtctatctggcatattcc

SEQ ID NO: 10008270 - DNA, 22 bp, Homo sapiens
aaatgtctttcaatagagaaat

SEQ ID NO: 10008271 - DNA, 22 bp, Homo sapiens
aaatgtctttcttctgctacgt

SEQ ID NO: 10008272 - DNA, 22 bp, Homo sapiens
aaagacacaaatgtagaccaaa

SEQ ID NO: 10008273 - DNA, 23 bp, Homo sapiens
aaatgtgagggaaaatctttctg

SEQ ID NO: 10008274 - DNA, 22 bp, Homo sapiens
aaatgtgacagatgcagtacag

SEQ ID NO: 10008275 - DNA, 22 bp, Homo sapiens
aaagacacacagtgcttcagtt

SEQ ID NO: 10008276 - DNA, 22 bp, Homo sapiens
aaagacacatgtctcttagatt

SEQ ID NO: 10008277 - DNA, 22 bp, Homo sapiens
aaagacagatggcaaggatgat

SEQ ID NO: 10008278 - DNA, 22 bp, Homo sapiens
aaagacagatggcaaggatgat

SEQ ID NO: 10008279 - DNA, 22 bp, Homo sapiens
aaagacatatttctaagtttat

SEQ ID NO: 10008280 - DNA, 22 bp, Homo sapiens
aaagacatcagaaccagctgag

SEQ ID NO: 10008281 - DNA, 22 bp, Homo sapiens
aaagacagtggattcaaaatcc

SEQ ID NO: 10008282 - DNA, 22 bp, Homo sapiens
aaagtcattgctgttatcaatg

SEQ ID NO: 10008283 - DNA, 22 bp, Homo sapiens
aaagtcatctgtcctaggctct

SEQ ID NO: 10008284 - DNA, 22 bp, Homo sapiens
aaagtcatctgtcctaggctct

SEQ ID NO: 10008285 - DNA, 22 bp, Homo sapiens
aaagtcatctaggagcagattt

SEQ ID NO: 10008286 - DNA, 22 bp, Homo sapiens
aaagtcatccaaatttttatgt

SEQ ID NO: 10008287 - DNA, 22 bp, Homo sapiens
aaataaactgaagcacagagag

SEQ ID NO: 10008288 - DNA, 22 bp, Homo sapiens
aaagtttttaagcaagaccctt

SEQ ID NO: 10008289 - DNA, 22 bp, Homo sapiens
aaataaactgaagcacagagag

SEQ ID NO: 10008290 - DNA, 22 bp, Homo sapiens
aaagttttctgccttcattaga

SEQ ID NO: 10008291 - DNA, 22 bp, Homo sapiens
aaagttttctgccttcattaga

SEQ ID NO: 10008292 - DNA, 22 bp, Homo sapiens
aaagttttgttgattgtggaat

SEQ ID NO: 10008293 - DNA, 22 bp, Homo sapiens
aaagttttctgccttcattaga

SEQ ID NO: 10008294 - DNA, 23 bp, Homo sapiens
aaagttctagaatgacttcctgt

SEQ ID NO: 10008295 - DNA, 22 bp, Homo sapiens
aaagttctaaaactctttgtga

SEQ ID NO: 10008296 - DNA, 22 bp, Homo sapiens
aaagttttattcaagcattagt

SEQ ID NO: 10008297 - DNA, 19 bp, Homo sapiens
aaagttttattctcatttg

SEQ ID NO: 10008298 - DNA, 22 bp, Homo sapiens
aaagtacagatggtgaggttgg

SEQ ID NO: 10008299 - DNA, 22 bp, Homo sapiens
aaagtacacacagagccaagaa

SEQ ID NO: 10008300 - DNA, 22 bp, Homo sapiens
aaagtacaatattgagattgat

SEQ ID NO: 10008301 - DNA, 22 bp, Homo sapiens
aaaggttaatgttgtcatgtta

SEQ ID NO: 10008302 - DNA, 22 bp, Homo sapiens
aaagtacatgagattcaagggg

SEQ ID NO: 10008303 - DNA, 22 bp, Homo sapiens
aaagtacatgtttggccatttg

SEQ ID NO: 10008304 - DNA, 22 bp, Homo sapiens
aaagtacatgtttggccatttg

SEQ ID NO: 10008305 - DNA, 22 bp, Homo sapiens
aaaattttcagcttgacttgat

SEQ ID NO: 10008306 - DNA, 22 bp, Homo sapiens
aaaattttactggtgtttcctt

SEQ ID NO: 10008307 - DNA, 22 bp, Homo sapiens
aaaatttccaccatctttgtgt

SEQ ID NO: 10008308 - DNA, 22 bp, Homo sapiens
aaaattgtgaaggtttctgaaa

SEQ ID NO: 10008309 - DNA, 22 bp, Homo sapiens
aaaatttccaccatctttgtgt

SEQ ID NO: 10008310 - DNA, 22 bp, Homo sapiens
aaaattgtcgaacagtagtaac

SEQ ID NO: 10008311 - DNA, 22 bp, Homo sapiens
aaagccagggacagtgtgcatg

SEQ ID NO: 10008312 - DNA, 22 bp, Homo sapiens
aaagctagaaggaaattttatg

SEQ ID NO: 10008313 - DNA, 22 bp, Homo sapiens
aaagccagggacagtgtgcatg

SEQ ID NO: 10008314 - DNA, 22 bp, Homo sapiens
aaagctagtaatattttaatcc

SEQ ID NO: 10008315 - DNA, 22 bp, Homo sapiens
aaagctagtaatattttaatcc

SEQ ID NO: 10008316 - DNA, 22 bp, Homo sapiens
aaagctatagggtcaagcattt

SEQ ID NO: 10008317 - DNA, 22 bp, Homo sapiens
aaagctatagggtcaagcattt

SEQ ID NO: 10008318 - DNA, 22 bp, Homo sapiens
aaagctatttattacagagaat

SEQ ID NO: 10008319 - DNA, 22 bp, Homo sapiens
aaagctatttattacagagaat

SEQ ID NO: 10008320 - DNA, 22 bp, Homo sapiens
aaagctatttgtgagttataga

SEQ ID NO: 10008321 - DNA, 22 bp, Homo sapiens
aaagctatttgttatgagagaa

SEQ ID NO: 10008322 - DNA, 22 bp, Homo sapiens
aaagctattcaacacgaacatg

SEQ ID NO: 10008323 - DNA, 22 bp, Homo sapiens
aaagctatttattacagagaat

SEQ ID NO: 10008324 - DNA, 22 bp, Homo sapiens
aaagctatgaggcatgcatttc

SEQ ID NO: 10008325 - DNA, 22 bp, Homo sapiens
aaaggactaggtgttgccaaaa

SEQ ID NO: 10008326 - DNA, 22 bp, Homo sapiens
aaaggacatgtcaatatcaggc

SEQ ID NO: 10008327 - DNA, 22 bp, Homo sapiens
aaaggacatgtcaatatcaggc

SEQ ID NO: 10008328 - DNA, 22 bp, Homo sapiens
aaaggacacacaggaggtgtct

SEQ ID NO: 10008329 - DNA, 22 bp, Homo sapiens
aaaggaatgagcttctgttagg

SEQ ID NO: 10008330 - DNA, 22 bp, Homo sapiens
aaaggaatattcaaaacagtca

SEQ ID NO: 10008331 - DNA, 22 bp, Homo sapiens
aaagctcttactgtactagtga

SEQ ID NO: 10008332 - DNA, 22 bp, Homo sapiens
aaagctctggtttggagcattt

SEQ ID NO: 10008333 - DNA, 22 bp, Homo sapiens
aaagctctgagaagcactgcaa

SEQ ID NO: 10008334 - DNA, 22 bp, Homo sapiens
aaagctctgagaagcactgcaa

SEQ ID NO: 10008335 - DNA, 22 bp, Homo sapiens
aaagctctctgaacaccagacc

SEQ ID NO: 10008336 - DNA, 22 bp, Homo sapiens
aaaggttaaggtgttcaagaaa

SEQ ID NO: 10008337 - DNA, 22 bp, Homo sapiens
aaaggagataaagggcccttca

SEQ ID NO: 10008338 - DNA, 22 bp, Homo sapiens
aaaggagagtgagtcagatgcc

SEQ ID NO: 10008339 - DNA, 22 bp, Homo sapiens
aaaggagacttcagatctcctt

SEQ ID NO: 10008340 - DNA, 22 bp, Homo sapiens
aaaggagagtaggttactccat

SEQ ID NO: 10008341 - DNA, 22 bp, Homo sapiens
aaaggagacagtcttacctgga

SEQ ID NO: 10008342 - DNA, 22 bp, Homo sapiens
aaaggagaaaacatacaggact

SEQ ID NO: 10008343 - DNA, 22 bp, Homo sapiens
aaaggactagtctttctaccat

SEQ ID NO: 10008344 - DNA, 22 bp, Homo sapiens
aaatgcttcacctcattaaact

SEQ ID NO: 10008345 - DNA, 22 bp, Homo sapiens
aaatgcttcacctcattaaact

SEQ ID NO: 10008346 - DNA, 22 bp, Homo sapiens
aaatgcttgctcttgattattt

SEQ ID NO: 10008347 - DNA, 22 bp, Homo sapiens
aaatgcttgtaaattttccatg

SEQ ID NO: 10008348 - DNA, 22 bp, Homo sapiens
aaatgctttggtgctggtacag

SEQ ID NO: 10008349 - DNA, 22 bp, Homo sapiens
aaatgctttggtgctggtacag

SEQ ID NO: 10008350 - DNA, 22 bp, Homo sapiens
aaatgcttgtatatttcttggt

SEQ ID NO: 10008351 - DNA, 20 bp, Homo sapiens
aaatgcttttgacacatatt

SEQ ID NO: 10008352 - DNA, 20 bp, Homo sapiens
aaatgcttttgacacatatt

SEQ ID NO: 10008353 - DNA, 21 bp, Homo sapiens
aaatgctttgtatatatctgt

SEQ ID NO: 10008354 - DNA, 20 bp, Homo sapiens
aaatgcttttgacacatatt

SEQ ID NO: 10008355 - DNA, 22 bp, Homo sapiens
aaatgctgtgttttaacataga

SEQ ID NO: 10008356 - DNA, 22 bp, Homo sapiens
aaatgctgtgttttaacataga

SEQ ID NO: 10008357 - DNA, 22 bp, Homo sapiens
aaatgctgttcttttaggtaga

SEQ ID NO: 10008358 - DNA, 20 bp, Homo sapiens
aaatgctgtgctgttgccat

SEQ ID NO: 10008359 - DNA, 19 bp, Homo sapiens
aaatgctgtggagggctcc

SEQ ID NO: 10008360 - DNA, 22 bp, Homo sapiens
aaatgcttattagtgtcacaaa

SEQ ID NO: 10008361 - DNA, 22 bp, Homo sapiens
aaatgcttattagtgtcacaaa

SEQ ID NO: 10008362 - DNA, 22 bp, Homo sapiens
aaatgcttattagtgtcacaaa

SEQ ID NO: 10008363 - DNA, 22 bp, Homo sapiens
aaatgcttagaggtgttcaaat

SEQ ID NO: 10008364 - DNA, 22 bp, Homo sapiens
aaatgcttagaggtgttcaaat

SEQ ID NO: 10008365 - DNA, 22 bp, Homo sapiens
aaatgctgtagatcagtgagtt

SEQ ID NO: 10008366 - DNA, 22 bp, Homo sapiens
aaatgctgtcagtgttattgga

SEQ ID NO: 10008367 - DNA, 20 bp, Homo sapiens
aaatgctgtaatgtttggga

SEQ ID NO: 10008368 - DNA, 22 bp, Homo sapiens
aaatgctgggaaccattggatc

SEQ ID NO: 10008369 - DNA, 22 bp, Homo sapiens
aaatgctgggaaccattggatc

SEQ ID NO: 10008370 - DNA, 22 bp, Homo sapiens
aaatgctgtaactgatattctg

SEQ ID NO: 10008371 - DNA, 18 bp, Homo sapiens
aaatgctgctcaaattcc

SEQ ID NO: 10008372 - DNA, 22 bp, Homo sapiens
aaatgctgcagctagtgtgttt

SEQ ID NO: 10008373 - DNA, 22 bp, Homo sapiens
aaatgctgagtgtttagagatc

SEQ ID NO: 10008374 - DNA, 22 bp, Homo sapiens
aaatgctgagtgtttagagatc

SEQ ID NO: 10008375 - DNA, 22 bp, Homo sapiens
aaatgccaaggagagactgtta

SEQ ID NO: 10008376 - DNA, 22 bp, Homo sapiens
aaatgcacaataaagtaaaggc

SEQ ID NO: 10008377 - DNA, 22 bp, Homo sapiens
aaatgcaattcaggaagacaag

SEQ ID NO: 10008378 - DNA, 22 bp, Homo sapiens
aaatgcaattgtatgtactcca

SEQ ID NO: 10008379 - DNA, 22 bp, Homo sapiens
aaatgcaaggattttgttaggc

SEQ ID NO: 10008380 - DNA, 22 bp, Homo sapiens
aaatgcaaggcacattcctttt

SEQ ID NO: 10008381 - DNA, 22 bp, Homo sapiens
aaatgcaaggccatgtgaagga

SEQ ID NO: 10008382 - DNA, 22 bp, Homo sapiens
aaatgcaaggccatgtgaagga

SEQ ID NO: 10008383 - DNA, 22 bp, Homo sapiens
aaatgatgtggagtgaaattgt

SEQ ID NO: 10008384 - DNA, 20 bp, Homo sapiens
aaatgatgggaataatctat

SEQ ID NO: 10008385 - DNA, 22 bp, Homo sapiens
aaatgatgctacagttttccca

SEQ ID NO: 10008386 - DNA, 22 bp, Homo sapiens
aaatcagaaaatatggagagga

SEQ ID NO: 10008387 - DNA, 22 bp, Homo sapiens
aaatcagaaaatatggagagga

SEQ ID NO: 10008388 - DNA, 21 bp, Homo sapiens
aaatcactgtccaatcttggt

SEQ ID NO: 10008389 - DNA, 22 bp, Homo sapiens
aaatcactgattaaagttagaa

SEQ ID NO: 10008390 - DNA, 22 bp, Homo sapiens
aaatcaaggagggattatattt

SEQ ID NO: 10008391 - DNA, 22 bp, Homo sapiens
aaatcactaagttatagtgtgg

SEQ ID NO: 10008392 - DNA, 22 bp, Homo sapiens
aaatcacagggtctctaagtat

SEQ ID NO: 10008393 - DNA, 23 bp, Homo sapiens
aaatattcttttttagtaagtgc

SEQ ID NO: 10008394 - DNA, 22 bp, Homo sapiens
aaatattgttttggtaagcttc

SEQ ID NO: 10008395 - DNA, 22 bp, Homo sapiens
aaatattgttttggtaagcttc

SEQ ID NO: 10008396 - DNA, 22 bp, Homo sapiens
aaatatttgtctgaggcggttg

SEQ ID NO: 10008397 - DNA, 22 bp, Homo sapiens
aaatcaaaagacatgtgtttta

SEQ ID NO: 10008398 - DNA, 22 bp, Homo sapiens
aaatcaaaagacatgtgtttta

SEQ ID NO: 10008399 - DNA, 22 bp, Homo sapiens
aaatcaaaagacatgtgtttta

SEQ ID NO: 10008400 - DNA, 22 bp, Homo sapiens
aaatcagacacagtgaaagtta

SEQ ID NO: 10008401 - DNA, 22 bp, Homo sapiens
aaatcagacttgaattttcatc

SEQ ID NO: 10008402 - DNA, 22 bp, Homo sapiens
aaatcagacttgaattttcatc

SEQ ID NO: 10008403 - DNA, 22 bp, Homo sapiens
aaatcagaggcaacaactactt

SEQ ID NO: 10008404 - DNA, 22 bp, Homo sapiens
aaatcagaggtcagctgtacca

SEQ ID NO: 10008405 - DNA, 22 bp, Homo sapiens
aaatcagagtctgattttaagg

SEQ ID NO: 10008406 - DNA, 22 bp, Homo sapiens
aaatcagagtctgattttaagg

SEQ ID NO: 10008407 - DNA, 22 bp, Homo sapiens
aaatcagagtctgattttaagg

SEQ ID NO: 10008408 - DNA, 22 bp, Homo sapiens
aaatctttccctttactatcca

SEQ ID NO: 10008409 - DNA, 22 bp, Homo sapiens
aaatcagagtagaattgagcca

SEQ ID NO: 10008410 - DNA, 22 bp, Homo sapiens
aaatgaggccagatcatgcaga

SEQ ID NO: 10008411 - DNA, 23 bp, Homo sapiens
aaatgactaaatgttcttataga

SEQ ID NO: 10008412 - DNA, 23 bp, Homo sapiens
aaatgactaaatgttcttataga

SEQ ID NO: 10008413 - DNA, 22 bp, Homo sapiens
aaatgaggccagatcatgcaga

SEQ ID NO: 10008414 - DNA, 22 bp, Homo sapiens
aaatgaggttaatacagtgctt

SEQ ID NO: 10008415 - DNA, 22 bp, Homo sapiens
aaatgacattaggatcctgcat

SEQ ID NO: 10008416 - DNA, 23 bp, Homo sapiens
aaatgacatatggtttctgaagg

SEQ ID NO: 10008417 - DNA, 22 bp, Homo sapiens
aaatgagtttgcctctagatag

SEQ ID NO: 10008418 - DNA, 22 bp, Homo sapiens
aaatgagtttcctcaatgtcct

SEQ ID NO: 10008419 - DNA, 22 bp, Homo sapiens
aaatgagtagcgatgcacatta

SEQ ID NO: 10008420 - DNA, 22 bp, Homo sapiens
aaatgatagtatggaactagga

SEQ ID NO: 10008421 - DNA, 22 bp, Homo sapiens
aaatacaaaaattagccaggca

SEQ ID NO: 10008422 - DNA, 22 bp, Homo sapiens
aagaagttaaataaatggacca

SEQ ID NO: 10008423 - DNA, 22 bp, Homo sapiens
aaatacaaaaattagccaggca

SEQ ID NO: 10008424 - DNA, 22 bp, Homo sapiens
aagaaggtgtggaaagatgctc

SEQ ID NO: 10008425 - DNA, 22 bp, Homo sapiens
aagaaggtgtggaaagatgctc

SEQ ID NO: 10008426 - DNA, 22 bp, Homo sapiens
aagaaggtgtggaaagatgctc

SEQ ID NO: 10008427 - DNA, 22 bp, Homo sapiens
aagaagtctggagcaatgcaat

SEQ ID NO: 10008428 - DNA, 22 bp, Homo sapiens
aaatacatacactgtacgtggc

SEQ ID NO: 10008429 - DNA, 22 bp, Homo sapiens
aaatacataaaggttgtaccag

SEQ ID NO: 10008430 - DNA, 22 bp, Homo sapiens
aaatacataaaggttgtaccag

SEQ ID NO: 10008431 - DNA, 22 bp, Homo sapiens
aaatacatacactgtacgtggc

SEQ ID NO: 10008432 - DNA, 22 bp, Homo sapiens
aaatacagtggcagcagataat

SEQ ID NO: 10008433 - DNA, 20 bp, Homo sapiens
aagaagccgggaaggcaggc

SEQ ID NO: 10008434 - DNA, 22 bp, Homo sapiens
aagaagcattctttcattggtt

SEQ ID NO: 10008435 - DNA, 22 bp, Homo sapiens
aagaagcaggtcacagacaggg

SEQ ID NO: 10008436 - DNA, 22 bp, Homo sapiens
aagaagcaggtcacagacaggg

SEQ ID NO: 10008437 - DNA, 22 bp, Homo sapiens
aagaagctatacataatttggg

SEQ ID NO: 10008438 - DNA, 22 bp, Homo sapiens
aagaaggaagtgtggacatcac

SEQ ID NO: 10008439 - DNA, 22 bp, Homo sapiens
aaagttgctgtcctagctggct

SEQ ID NO: 10008440 - DNA, 23 bp, Homo sapiens
aaagttgatttgcagtttaagag

SEQ ID NO: 10008441 - DNA, 22 bp, Homo sapiens
aaagttgttcagtaagaaactc

SEQ ID NO: 10008442 - DNA, 22 bp, Homo sapiens
aaagttgtggtttgatgcagtt

SEQ ID NO: 10008443 - DNA, 22 bp, Homo sapiens
aaagttgtgaaaccgaacatgt

SEQ ID NO: 10008444 - DNA, 22 bp, Homo sapiens
aaagttgtaatggaagaaatgc

SEQ ID NO: 10008445 - DNA, 22 bp, Homo sapiens
aaagttctttgcatctttgctc

SEQ ID NO: 10008446 - DNA, 22 bp, Homo sapiens
aaagttctttttctataaatcc

SEQ ID NO: 10008447 - DNA, 22 bp, Homo sapiens
aaagttgaccgaaagattttga

SEQ ID NO: 10008448 - DNA, 22 bp, Homo sapiens
aaagttgataaggtatcgtagt

SEQ ID NO: 10008449 - DNA, 19 bp, Homo sapiens
aaagttgagaaacaatgga

SEQ ID NO: 10008450 - DNA, 22 bp, Homo sapiens
aaagttgagtgctgatctgatt

SEQ ID NO: 10008451 - DNA, 22 bp, Homo sapiens
aagagagacaataggtagcatt

SEQ ID NO: 10008452 - DNA, 22 bp, Homo sapiens
aagagagacaataggtagcatt

SEQ ID NO: 10008453 - DNA, 22 bp, Homo sapiens
aagagagaccatgggggacagg

SEQ ID NO: 10008454 - DNA, 22 bp, Homo sapiens
aaatagtcctgggaatagtact

SEQ ID NO: 10008455 - DNA, 22 bp, Homo sapiens
aaatagtaaagtggtagccatc

SEQ ID NO: 10008456 - DNA, 22 bp, Homo sapiens
aaataggggaccaggaaaggag

SEQ ID NO: 10008457 - DNA, 22 bp, Homo sapiens
aaatataatttctgcctcaata

SEQ ID NO: 10008458 - DNA, 22 bp, Homo sapiens
aaatatagcaattatgcctact

SEQ ID NO: 10008459 - DNA, 22 bp, Homo sapiens
aaatatacggtccctaacagtc

SEQ ID NO: 10008460 - DNA, 22 bp, Homo sapiens
aagataaactcttgatttctga

SEQ ID NO: 10008461 - DNA, 22 bp, Homo sapiens
aagagtttttggagtgtgagtt

SEQ ID NO: 10008462 - DNA, 22 bp, Homo sapiens
aagagttttctctgatggcatt

SEQ ID NO: 10008463 - DNA, 22 bp, Homo sapiens
aagagttttctataatcttggc

SEQ ID NO: 10008464 - DNA, 22 bp, Homo sapiens
aaatattattgcttaaggggag

SEQ ID NO: 10008465 - DNA, 22 bp, Homo sapiens
aaatatgagagtaggagtttgg

SEQ ID NO: 10008466 - DNA, 22 bp, Homo sapiens
aagagttttagacaaactgatt

SEQ ID NO: 10008467 - DNA, 22 bp, Homo sapiens
aagagttttctataatcttggc

SEQ ID NO: 10008468 - DNA, 22 bp, Homo sapiens
aagagtttgtcagatctgcacg

SEQ ID NO: 10008469 - DNA, 22 bp, Homo sapiens
aagagtttctttattaaccttt

SEQ ID NO: 10008470 - DNA, 22 bp, Homo sapiens
aagagtttgacctgtgccatcc

SEQ ID NO: 10008471 - DNA, 22 bp, Homo sapiens
aagagtttgggcaagtcataaa

SEQ ID NO: 10008472 - DNA, 22 bp, Homo sapiens
aagagtttgtcagatctgcacg

SEQ ID NO: 10008473 - DNA, 22 bp, Homo sapiens
aagagtttccatgctctgtgct

SEQ ID NO: 10008474 - DNA, 19 bp, Homo sapiens
aaatatcagagagatgata

SEQ ID NO: 10008475 - DNA, 22 bp, Homo sapiens
aagagtttctgattcagtaggt

SEQ ID NO: 10008476 - DNA, 22 bp, Homo sapiens
aagagtttctttattaaccttt

SEQ ID NO: 10008477 - DNA, 22 bp, Homo sapiens
aagagtttcttactggcatcta

SEQ ID NO: 10008478 - DNA, 22 bp, Homo sapiens
aagagtttctgggtcaaggatt

SEQ ID NO: 10008479 - DNA, 22 bp, Homo sapiens
aaatatagtgacacttatagtc

SEQ ID NO: 10008480 - DNA, 22 bp, Homo sapiens
aaattgtaggatcacatgacct

SEQ ID NO: 10008481 - DNA, 22 bp, Homo sapiens
aaagcagcaacagctgttagaa

SEQ ID NO: 10008482 - DNA, 22 bp, Homo sapiens
aaagcagcaacagctgttagaa

SEQ ID NO: 10008483 - DNA, 22 bp, Homo sapiens
aaattgtctctattttgattcg

SEQ ID NO: 10008484 - DNA, 23 bp, Homo sapiens
aaattgtcgtaaggtggagatgt

SEQ ID NO: 10008485 - DNA, 22 bp, Homo sapiens
aaattgtccttttaagaaacag

SEQ ID NO: 10008486 - DNA, 22 bp, Homo sapiens
aaagcagcaacgtgcatataac

SEQ ID NO: 10008487 - DNA, 22 bp, Homo sapiens
aaagcagcaagtatttgttact

SEQ ID NO: 10008488 - DNA, 22 bp, Homo sapiens
aaagcagcacatggatatcagt

SEQ ID NO: 10008489 - DNA, 22 bp, Homo sapiens
aaagcagggtccaaggagatgt

SEQ ID NO: 10008490 - DNA, 22 bp, Homo sapiens
aaagcaggttatgaccatggcc

SEQ ID NO: 10008491 - DNA, 22 bp, Homo sapiens
aaagcaggttatgaccatggcc

SEQ ID NO: 10008492 - DNA, 22 bp, Homo sapiens
aaagcaggttgcaattacagtg

SEQ ID NO: 10008493 - DNA, 22 bp, Homo sapiens
aaagcagtagttttcaaatagt

SEQ ID NO: 10008494 - DNA, 22 bp, Homo sapiens
aaagcagtataagtaacggaag

SEQ ID NO: 10008495 - DNA, 22 bp, Homo sapiens
aaagcagtatattggtagttgt

SEQ ID NO: 10008496 - DNA, 22 bp, Homo sapiens
aaagcagtctcagacttaagca

SEQ ID NO: 10008497 - DNA, 22 bp, Homo sapiens
aaagcagtccttcccttaaggt

SEQ ID NO: 10008498 - DNA, 22 bp, Homo sapiens
aaagcagtgcaccttaattgat

SEQ ID NO: 10008499 - DNA, 22 bp, Homo sapiens
aaagcagtgcaccttaattgat

SEQ ID NO: 10008500 - DNA, 22 bp, Homo sapiens
aaagcagtctgttttaacctga

SEQ ID NO: 10008501 - DNA, 22 bp, Homo sapiens
aaattccaccagaatcagtaat

SEQ ID NO: 10008502 - DNA, 22 bp, Homo sapiens
aaattcatttttcttagtgtgc

SEQ ID NO: 10008503 - DNA, 22 bp, Homo sapiens
aaattcatatgttgaaatgcta

SEQ ID NO: 10008504 - DNA, 22 bp, Homo sapiens
aaattcatatgttgaaatgcta

SEQ ID NO: 10008505 - DNA, 22 bp, Homo sapiens
aaattccagaaactcagtatat

SEQ ID NO: 10008506 - DNA, 22 bp, Homo sapiens
aaattccagaaactcagtatat

SEQ ID NO: 10008507 - DNA, 22 bp, Homo sapiens
aaattccattaggaaacttcca

SEQ ID NO: 10008508 - DNA, 22 bp, Homo sapiens
aaattgctatatgtgaatgtga

SEQ ID NO: 10008509 - DNA, 22 bp, Homo sapiens
aaattgctctttaaaagtactg

SEQ ID NO: 10008510 - DNA, 22 bp, Homo sapiens
aaattgctgacacttgaccatt

SEQ ID NO: 10008511 - DNA, 22 bp, Homo sapiens
aaattgcttataaagatgaatg

SEQ ID NO: 10008512 - DNA, 22 bp, Homo sapiens
aaattgctgaccaagtatattc

SEQ ID NO: 10008513 - DNA, 22 bp, Homo sapiens
aaattgctgaccaagtatattc

SEQ ID NO: 10008514 - DNA, 22 bp, Homo sapiens
aaattgctgaccaagtatattc

SEQ ID NO: 10008515 - DNA, 22 bp, Homo sapiens
aacatgaaacccaaacagaata

SEQ ID NO: 10008516 - DNA, 22 bp, Homo sapiens
aacatgaaacccaaacagaata

SEQ ID NO: 10008517 - DNA, 22 bp, Homo sapiens
aacatgaaagttgctaagtgca

SEQ ID NO: 10008518 - DNA, 22 bp, Homo sapiens
aacatgaaggtaggatggtttt

SEQ ID NO: 10008519 - DNA, 22 bp, Homo sapiens
aacatgaaagttgctaagtgca

SEQ ID NO: 10008520 - DNA, 22 bp, Homo sapiens
aaaggattagagataccatgcc

SEQ ID NO: 10008521 - DNA, 22 bp, Homo sapiens
aaaggcaagcatttatatagga

SEQ ID NO: 10008522 - DNA, 22 bp, Homo sapiens
aaaggcacacactccttgttat

SEQ ID NO: 10008523 - DNA, 22 bp, Homo sapiens
aaaggattaaataaatgtgctg

SEQ ID NO: 10008524 - DNA, 22 bp, Homo sapiens
aaaggagttactcataaagctt

SEQ ID NO: 10008525 - DNA, 22 bp, Homo sapiens
aaaggaggccacatggctagga

SEQ ID NO: 10008526 - DNA, 22 bp, Homo sapiens
aaaggaggccacatggctagga

SEQ ID NO: 10008527 - DNA, 22 bp, Homo sapiens
aaaggaatattcaaaacagtca

SEQ ID NO: 10008528 - DNA, 22 bp, Homo sapiens
aaagcatgattagatagatgat

SEQ ID NO: 10008529 - DNA, 22 bp, Homo sapiens
aaagcatgctactttatatagg

SEQ ID NO: 10008530 - DNA, 22 bp, Homo sapiens
aaagcatgattagatagatgat

SEQ ID NO: 10008531 - DNA, 22 bp, Homo sapiens
aaagcatggttaaagacagtgg

SEQ ID NO: 10008532 - DNA, 22 bp, Homo sapiens
aaagcatgttgggtccctcttt

SEQ ID NO: 10008533 - DNA, 22 bp, Homo sapiens
aaagcatgtgaatagaatatgg

SEQ ID NO: 10008534 - DNA, 22 bp, Homo sapiens
aaagcatcagatctgacacttc

SEQ ID NO: 10008535 - DNA, 23 bp, Homo sapiens
aaagccaagtcagtctactggaa

SEQ ID NO: 10008536 - DNA, 22 bp, Homo sapiens
aaaggaagtgccactcttcttc

SEQ ID NO: 10008537 - DNA, 22 bp, Homo sapiens
aaagccaaatgaaagatggttc

SEQ ID NO: 10008538 - DNA, 22 bp, Homo sapiens
aaagccaaatgaaagatggttc

SEQ ID NO: 10008539 - DNA, 22 bp, Homo sapiens
aaagcatttcatgtctagaaag

SEQ ID NO: 10008540 - DNA, 20 bp, Homo sapiens
aaagcatttacttgtgattg

SEQ ID NO: 10008541 - DNA, 22 bp, Homo sapiens
aaagcattactagactggattt

SEQ ID NO: 10008542 - DNA, 22 bp, Homo sapiens
aaagcattactagactggattt

SEQ ID NO: 10008543 - DNA, 22 bp, Homo sapiens
aaagcattattctgtggaaaaa

SEQ ID NO: 10008544 - DNA, 22 bp, Homo sapiens
aaaggctttaaaatgtacatat

SEQ ID NO: 10008545 - DNA, 22 bp, Homo sapiens
aaaggcttgtttgaggactggt

SEQ ID NO: 10008546 - DNA, 22 bp, Homo sapiens
aaaggcttgtacagcagccttc

SEQ ID NO: 10008547 - DNA, 22 bp, Homo sapiens
aaaggctggggactgaggaagg

SEQ ID NO: 10008548 - DNA, 22 bp, Homo sapiens
aaaggcttaacagaagaccttt

SEQ ID NO: 10008549 - DNA, 22 bp, Homo sapiens
aaaggctggaaactgaagataa

SEQ ID NO: 10008550 - DNA, 22 bp, Homo sapiens
aaaggctggattcagagaggtg

SEQ ID NO: 10008551 - DNA, 22 bp, Homo sapiens
aaaggcttcacttatttatttt

SEQ ID NO: 10008552 - DNA, 22 bp, Homo sapiens
aaaggcttagacacagaactgt

SEQ ID NO: 10008553 - DNA, 22 bp, Homo sapiens
aaaggcttcggatcagaaggta

SEQ ID NO: 10008554 - DNA, 22 bp, Homo sapiens
aaaggcttctcagaaaggcctt

SEQ ID NO: 10008555 - DNA, 22 bp, Homo sapiens
aaagggaactctaattatcttc

SEQ ID NO: 10008556 - DNA, 22 bp, Homo sapiens
aaagggaactctaattatcttc

SEQ ID NO: 10008557 - DNA, 22 bp, Homo sapiens
aaagggaagttgcacatgttcc

SEQ ID NO: 10008558 - DNA, 22 bp, Homo sapiens
aaagggaagttgcacatgttcc

SEQ ID NO: 10008559 - DNA, 22 bp, Homo sapiens
aaagggaagttgcacatgttcc

SEQ ID NO: 10008560 - DNA, 22 bp, Homo sapiens
aaagggaaaatatttagacata

SEQ ID NO: 10008561 - DNA, 22 bp, Homo sapiens
aaaggctttaaagaaccagaac

SEQ ID NO: 10008562 - DNA, 22 bp, Homo sapiens
aaagggaggggcgataagccgg

SEQ ID NO: 10008563 - DNA, 22 bp, Homo sapiens
aaagggaatgtgtaggacatgt

SEQ ID NO: 10008564 - DNA, 22 bp, Homo sapiens
aaagggaatgtgtaggacatgt

SEQ ID NO: 10008565 - DNA, 22 bp, Homo sapiens
aaagggagcatggctgcaggga

SEQ ID NO: 10008566 - DNA, 22 bp, Homo sapiens
aaagggaatgtgtaggacatgt

SEQ ID NO: 10008567 - DNA, 22 bp, Homo sapiens
aaaggctatgagatagaagata

SEQ ID NO: 10008568 - DNA, 22 bp, Homo sapiens
aaaggctatgagatagaagata

SEQ ID NO: 10008569 - DNA, 22 bp, Homo sapiens
aaaggctcagatgaggccctgg

SEQ ID NO: 10008570 - DNA, 22 bp, Homo sapiens
aaaggctcagaatcggcagacc

SEQ ID NO: 10008571 - DNA, 22 bp, Homo sapiens
aaaggctcaacagctgtacttt

SEQ ID NO: 10008572 - DNA, 22 bp, Homo sapiens
aaaggctcacgcagttagtgat

SEQ ID NO: 10008573 - DNA, 22 bp, Homo sapiens
aaaggctctattgttttcatat

SEQ ID NO: 10008574 - DNA, 22 bp, Homo sapiens
aaaggctctaacaaggagagag

SEQ ID NO: 10008575 - DNA, 22 bp, Homo sapiens
aaaggctctaacaaggagagag

SEQ ID NO: 10008576 - DNA, 22 bp, Homo sapiens
aaaggctccttctcccatgacc

SEQ ID NO: 10008577 - DNA, 22 bp, Homo sapiens
aaaggctccttctcccatgacc

SEQ ID NO: 10008578 - DNA, 22 bp, Homo sapiens
aaaggctcatgaaccaggctcg

SEQ ID NO: 10008579 - DNA, 22 bp, Homo sapiens
aaaggcatgcctccatttctat

SEQ ID NO: 10008580 - DNA, 22 bp, Homo sapiens
aaaggcatgcctccatttctat

SEQ ID NO: 10008581 - DNA, 22 bp, Homo sapiens
aaaggcatgctgctgaatgatg

SEQ ID NO: 10008582 - DNA, 22 bp, Homo sapiens
aaaggcatgattaattctgtgt

SEQ ID NO: 10008583 - DNA, 22 bp, Homo sapiens
aaaggcatgattaattctgtgt

SEQ ID NO: 10008584 - DNA, 22 bp, Homo sapiens
aaaggcatgcatggtctgctcc

SEQ ID NO: 10008585 - DNA, 22 bp, Homo sapiens
aacatgatttagtataatgcag

SEQ ID NO: 10008586 - DNA, 22 bp, Homo sapiens
aacatgattggaaaatgctgtc

SEQ ID NO: 10008587 - DNA, 22 bp, Homo sapiens
aacatgatttagtataatgcag

SEQ ID NO: 10008588 - DNA, 22 bp, Homo sapiens
aacatgatttagtataatgcag

SEQ ID NO: 10008589 - DNA, 22 bp, Homo sapiens
aacatgagtgataaaattacct

SEQ ID NO: 10008590 - DNA, 22 bp, Homo sapiens
aacatgatgacaaaggtatatt

SEQ ID NO: 10008591 - DNA, 22 bp, Homo sapiens
aacatgatgtgaagcatgaact

SEQ ID NO: 10008592 - DNA, 22 bp, Homo sapiens
aacatgatggggaagaacaaga

SEQ ID NO: 10008593 - DNA, 22 bp, Homo sapiens
aacttctaatctgtacagtttt

SEQ ID NO: 10008594 - DNA, 22 bp, Homo sapiens
aacttctgcagaaaagtgcatg

SEQ ID NO: 10008595 - DNA, 22 bp, Homo sapiens
aacttctgacctcaagaactgt

SEQ ID NO: 10008596 - DNA, 22 bp, Homo sapiens
aacttctgcttttacaggcagt

SEQ ID NO: 10008597 - DNA, 22 bp, Homo sapiens
aacttgaaactgttccagaaaa

SEQ ID NO: 10008598 - DNA, 22 bp, Homo sapiens
aaagttacacatctagtaagtg

SEQ ID NO: 10008599 - DNA, 22 bp, Homo sapiens
aaagttctgtagtgcactgact

SEQ ID NO: 10008600 - DNA, 22 bp, Homo sapiens
aaagttctgggggtgtttctgg

SEQ ID NO: 10008601 - DNA, 22 bp, Homo sapiens
aaagttctgggggagaagaacg

SEQ ID NO: 10008602 - DNA, 22 bp, Homo sapiens
aaagttctttctcttatttggt

SEQ ID NO: 10008603 - DNA, 22 bp, Homo sapiens
aaagttcttagattaatcactg

SEQ ID NO: 10008604 - DNA, 22 bp, Homo sapiens
aaagttcttcatttttattgga

SEQ ID NO: 10008605 - DNA, 22 bp, Homo sapiens
aaagttctggcattttctgtct

SEQ ID NO: 10008606 - DNA, 22 bp, Homo sapiens
aaagttctggagaaaataatga

SEQ ID NO: 10008607 - DNA, 22 bp, Homo sapiens
aaagttctgggggagaagaacg

SEQ ID NO: 10008608 - DNA, 22 bp, Homo sapiens
aaagttctgagactgatggcta

SEQ ID NO: 10008609 - DNA, 22 bp, Homo sapiens
aaagttctgatgctgatcaaag

SEQ ID NO: 10008610 - DNA, 22 bp, Homo sapiens
aaagttctgagaagcagtttac

SEQ ID NO: 10008611 - DNA, 23 bp, Homo sapiens
aaagttctcttgcgtgtgggaaa

SEQ ID NO: 10008612 - DNA, 19 bp, Homo sapiens
aaagttctgactgtagagc

SEQ ID NO: 10008613 - DNA, 22 bp, Homo sapiens
aaagttctctatggtgtaaaaa

SEQ ID NO: 10008614 - DNA, 22 bp, Homo sapiens
aaagttctcctggattgtgctg

SEQ ID NO: 10008615 - DNA, 22 bp, Homo sapiens
aaagttctattggatagtgctg

SEQ ID NO: 10008616 - DNA, 22 bp, Homo sapiens
aaagttctatgtaatgtttttt

SEQ ID NO: 10008617 - DNA, 22 bp, Homo sapiens
aaagttacacgactatttatgt

SEQ ID NO: 10008618 - DNA, 22 bp, Homo sapiens
aaagttctagagttgcaagaga

SEQ ID NO: 10008619 - DNA, 22 bp, Homo sapiens
aaagtctttattttgtatcttt

SEQ ID NO: 10008620 - DNA, 22 bp, Homo sapiens
aaagtctttattttgtatcttt

SEQ ID NO: 10008621 - DNA, 22 bp, Homo sapiens
aaagtctttattttgtatcttt

SEQ ID NO: 10008622 - DNA, 22 bp, Homo sapiens
aaagtcttgttacgttccattg

SEQ ID NO: 10008623 - DNA, 20 bp, Homo sapiens
aaagtcttatggttaatttt

SEQ ID NO: 10008624 - DNA, 22 bp, Homo sapiens
aaagtcttcacggcactagtgt

SEQ ID NO: 10008625 - DNA, 22 bp, Homo sapiens
aaagtctgaaagatgctaacat

SEQ ID NO: 10008626 - DNA, 22 bp, Homo sapiens
aaagtctgaaagataagagtga

SEQ ID NO: 10008627 - DNA, 20 bp, Homo sapiens
aaagtctgtttatctctgga

SEQ ID NO: 10008628 - DNA, 22 bp, Homo sapiens
aaagtcttaatgtaagtttagt

SEQ ID NO: 10008629 - DNA, 22 bp, Homo sapiens
aaagtccagagggcacactgaa

SEQ ID NO: 10008630 - DNA, 22 bp, Homo sapiens
aaagtccaattttgttcaggct

SEQ ID NO: 10008631 - DNA, 22 bp, Homo sapiens
aaagtccaggggctggaggcgg

SEQ ID NO: 10008632 - DNA, 22 bp, Homo sapiens
aaagtccagggaaagagcgtct

SEQ ID NO: 10008633 - DNA, 22 bp, Homo sapiens
aaagtcctagcgatccacagaa

SEQ ID NO: 10008634 - DNA, 22 bp, Homo sapiens
aaagtcctttttgccatgcaag

SEQ ID NO: 10008635 - DNA, 22 bp, Homo sapiens
aaagtctaaattattcaataag

SEQ ID NO: 10008636 - DNA, 22 bp, Homo sapiens
aaagtctccactgggaaccaaa

SEQ ID NO: 10008637 - DNA, 22 bp, Homo sapiens
aaagtctccactgggaaccaaa

SEQ ID NO: 10008638 - DNA, 20 bp, Homo sapiens
aaagtctcaacagctgagaa

SEQ ID NO: 10008639 - DNA, 22 bp, Homo sapiens
aaagtctcaggcaaaccaggac

SEQ ID NO: 10008640 - DNA, 22 bp, Homo sapiens
aaagtcctttttgccatgcaag

SEQ ID NO: 10008641 - DNA, 22 bp, Homo sapiens
aaagtcctgtttgaaggacctg

SEQ ID NO: 10008642 - DNA, 22 bp, Homo sapiens
aaagtcctgtttgaaggacctg

SEQ ID NO: 10008643 - DNA, 22 bp, Homo sapiens
aaagtcctgttaactgttaaca

SEQ ID NO: 10008644 - DNA, 22 bp, Homo sapiens
aagcccagctgaaagcattttt

SEQ ID NO: 10008645 - DNA, 22 bp, Homo sapiens
aagcccagcatccctgcaccag

SEQ ID NO: 10008646 - DNA, 22 bp, Homo sapiens
acagctgctctatatctcagcc

SEQ ID NO: 10008647 - DNA, 22 bp, Homo sapiens
acagctgctgcttctcactggg

SEQ ID NO: 10008648 - DNA, 22 bp, Homo sapiens
acagctgctgtggaggttttca

SEQ ID NO: 10008649 - DNA, 22 bp, Homo sapiens
acagctggacaggggagagttt

SEQ ID NO: 10008650 - DNA, 22 bp, Homo sapiens
acagctgctttctcttactatg

SEQ ID NO: 10008651 - DNA, 21 bp, Homo sapiens
acagctggaaattacttgccc

SEQ ID NO: 10008652 - DNA, 22 bp, Homo sapiens
acagctgctgtggaggttttca

SEQ ID NO: 10008653 - DNA, 22 bp, Homo sapiens
acagctgctgtttttgaaggac

SEQ ID NO: 10008654 - DNA, 22 bp, Homo sapiens
acagctgctttctcttactatg

SEQ ID NO: 10008655 - DNA, 23 bp, Homo sapiens
aagccccaaggaacttcctggga

SEQ ID NO: 10008656 - DNA, 22 bp, Homo sapiens
aagccaggttccatggaggagc

SEQ ID NO: 10008657 - DNA, 22 bp, Homo sapiens
aagccaggttccatggaggagc

SEQ ID NO: 10008658 - DNA, 22 bp, Homo sapiens
aagcccagatgtgagaactgag

SEQ ID NO: 10008659 - DNA, 22 bp, Homo sapiens
acagccaggacttggccctctt

SEQ ID NO: 10008660 - DNA, 22 bp, Homo sapiens
acagccaggaattctggagaag

SEQ ID NO: 10008661 - DNA, 22 bp, Homo sapiens
acagcaggttacagtggcacag

SEQ ID NO: 10008662 - DNA, 22 bp, Homo sapiens
acagccagatctgagagatctt

SEQ ID NO: 10008663 - DNA, 22 bp, Homo sapiens
aagcagtgatgcatacagctgt

SEQ ID NO: 10008664 - DNA, 22 bp, Homo sapiens
aagcagtgataagagctaccat

SEQ ID NO: 10008665 - DNA, 22 bp, Homo sapiens
aagcagtgcgctcatctaaggg

SEQ ID NO: 10008666 - DNA, 22 bp, Homo sapiens
aagcagtgttcccagctggccc

SEQ ID NO: 10008667 - DNA, 22 bp, Homo sapiens
aagcagttactatttactatta

SEQ ID NO: 10008668 - DNA, 22 bp, Homo sapiens
aagcagttactatttactatta

SEQ ID NO: 10008669 - DNA, 22 bp, Homo sapiens
aagcataaaacgttacaacatg

SEQ ID NO: 10008670 - DNA, 22 bp, Homo sapiens
aagcagtttttcaactgtttag

SEQ ID NO: 10008671 - DNA, 22 bp, Homo sapiens
aagcataaaacgttacaacatg

SEQ ID NO: 10008672 - DNA, 22 bp, Homo sapiens
aagcataaaacgttacaacatg

SEQ ID NO: 10008673 - DNA, 21 bp, Homo sapiens
acagcagggctggcatgacag

SEQ ID NO: 10008674 - DNA, 21 bp, Homo sapiens
acagcagggctggcatgacag

SEQ ID NO: 10008675 - DNA, 22 bp, Homo sapiens
acagcagggtcacattccctct

SEQ ID NO: 10008676 - DNA, 22 bp, Homo sapiens
aagcagggagaaatttttcttc

SEQ ID NO: 10008677 - DNA, 22 bp, Homo sapiens
aagcaggctcacgccaggcagt

SEQ ID NO: 10008678 - DNA, 21 bp, Homo sapiens
aagcaggacatatgatgccct

SEQ ID NO: 10008679 - DNA, 22 bp, Homo sapiens
acagagcaattcttgggtgttt

SEQ ID NO: 10008680 - DNA, 22 bp, Homo sapiens
aagcaggtgtgagccagtgggc

SEQ ID NO: 10008681 - DNA, 22 bp, Homo sapiens
aagcagtaatgaggtactattt

SEQ ID NO: 10008682 - DNA, 22 bp, Homo sapiens
aagcagggtgtcttgacccatg

SEQ ID NO: 10008683 - DNA, 22 bp, Homo sapiens
aagcagggtgtcttgacccatg

SEQ ID NO: 10008684 - DNA, 22 bp, Homo sapiens
aagcagggctccctggggactc

SEQ ID NO: 10008685 - DNA, 22 bp, Homo sapiens
aagcagggctccctggggactc

SEQ ID NO: 10008686 - DNA, 18 bp, Homo sapiens
aagcagggtccattgtgc

SEQ ID NO: 10008687 - DNA, 18 bp, Homo sapiens
aagcagggtccattgtgc

SEQ ID NO: 10008688 - DNA, 22 bp, Homo sapiens
acagagatgtcagattggcagc

SEQ ID NO: 10008689 - DNA, 22 bp, Homo sapiens
acagagatggcacagagaaggt

SEQ ID NO: 10008690 - DNA, 22 bp, Homo sapiens
acagagcaacttgagtatcctc

SEQ ID NO: 10008691 - DNA, 22 bp, Homo sapiens
acagagatgtggatgagggatt

SEQ ID NO: 10008692 - DNA, 22 bp, Homo sapiens
acagagcaataacagggagagg

SEQ ID NO: 10008693 - DNA, 22 bp, Homo sapiens
acagactgattcattgctcagg

SEQ ID NO: 10008694 - DNA, 22 bp, Homo sapiens
acagactgattcattgctcagg

SEQ ID NO: 10008695 - DNA, 22 bp, Homo sapiens
acagaccaagtttccagcaggt

SEQ ID NO: 10008696 - DNA, 23 bp, Homo sapiens
acagactgtattcaaagtaggac

SEQ ID NO: 10008697 - DNA, 22 bp, Homo sapiens
acagacatttaataaatgctga

SEQ ID NO: 10008698 - DNA, 22 bp, Homo sapiens
acagacatttaataaatgctga

SEQ ID NO: 10008699 - DNA, 22 bp, Homo sapiens
acagaccaaaaaaggatattgg

SEQ ID NO: 10008700 - DNA, 22 bp, Homo sapiens
acagaccaagtttccagcaggt

SEQ ID NO: 10008701 - DNA, 22 bp, Homo sapiens
acagacattttaagacacttta

SEQ ID NO: 10008702 - DNA, 23 bp, Homo sapiens
acagacattccataatgtacacc

SEQ ID NO: 10008703 - DNA, 23 bp, Homo sapiens
acagacaacactgatgagagaaa

SEQ ID NO: 10008704 - DNA, 23 bp, Homo sapiens
acagacattccataatgtacacc

SEQ ID NO: 10008705 - DNA, 22 bp, Homo sapiens
acagaaatatagaaggtaggaa

SEQ ID NO: 10008706 - DNA, 18 bp, Homo sapiens
acagaaatagctgtgcct

SEQ ID NO: 10008707 - DNA, 18 bp, Homo sapiens
acagaaatagctgtgcct

SEQ ID NO: 10008708 - DNA, 18 bp, Homo sapiens
acagaaatagctgtgcct

SEQ ID NO: 10008709 - DNA, 22 bp, Homo sapiens
acagaaataactttttatgttt

SEQ ID NO: 10008710 - DNA, 23 bp, Homo sapiens
acagaaagttctgctggacagag

SEQ ID NO: 10008711 - DNA, 23 bp, Homo sapiens
acagaaagttctgctggacagag

SEQ ID NO: 10008712 - DNA, 22 bp, Homo sapiens
acagaaatattcgtggtgcttg

SEQ ID NO: 10008713 - DNA, 22 bp, Homo sapiens
acagaaatgatgtttggcaata

SEQ ID NO: 10008714 - DNA, 22 bp, Homo sapiens
acagaaatgatgtttggcaata

SEQ ID NO: 10008715 - DNA, 23 bp, Homo sapiens
acagacaacactgatgagagaaa

SEQ ID NO: 10008716 - DNA, 20 bp, Homo sapiens
acacatagataagaagctga

SEQ ID NO: 10008717 - DNA, 22 bp, Homo sapiens
acacataagcctaatcatctcc

SEQ ID NO: 10008718 - DNA, 22 bp, Homo sapiens
acacataagcctaatcatctcc

SEQ ID NO: 10008719 - DNA, 22 bp, Homo sapiens
acacatagaaaataaatagtta

SEQ ID NO: 10008720 - DNA, 22 bp, Homo sapiens
acacatataccactgtaaatga

SEQ ID NO: 10008721 - DNA, 20 bp, Homo sapiens
acacatatagcagcataaac

SEQ ID NO: 10008722 - DNA, 20 bp, Homo sapiens
acacatatagcagcataaac

SEQ ID NO: 10008723 - DNA, 20 bp, Homo sapiens
acacatatagcagcataaac

SEQ ID NO: 10008724 - DNA, 22 bp, Homo sapiens
acacatatatacatatttgtgc

SEQ ID NO: 10008725 - DNA, 20 bp, Homo sapiens
acacatatagcagcataaac

SEQ ID NO: 10008726 - DNA, 22 bp, Homo sapiens
aagatacagacagagccaaaat

SEQ ID NO: 10008727 - DNA, 23 bp, Homo sapiens
aagatacaggtgtggaatggttt

SEQ ID NO: 10008728 - DNA, 22 bp, Homo sapiens
aagatacacgttgtattgaata

SEQ ID NO: 10008729 - DNA, 22 bp, Homo sapiens
acacataagcctaatcatctcc

SEQ ID NO: 10008730 - DNA, 22 bp, Homo sapiens
aagatacatcaaagcaaattgg

SEQ ID NO: 10008731 - DNA, 22 bp, Homo sapiens
aagatacataaaggtagagtct

SEQ ID NO: 10008732 - DNA, 22 bp, Homo sapiens
aagatacatatttgttctagtg

SEQ ID NO: 10008733 - DNA, 22 bp, Homo sapiens
aagatacatatttgttctagtg

SEQ ID NO: 10008734 - DNA, 22 bp, Homo sapiens
acacttgccatgctgcacactg

SEQ ID NO: 10008735 - DNA, 22 bp, Homo sapiens
acacttggagcaacacttatgg

SEQ ID NO: 10008736 - DNA, 22 bp, Homo sapiens
acacttggctctgagtcactac

SEQ ID NO: 10008737 - DNA, 22 bp, Homo sapiens
acagaaagatgatttgaaatgg

SEQ ID NO: 10008738 - DNA, 22 bp, Homo sapiens
acagaaagatgatttgaaatgg

SEQ ID NO: 10008739 - DNA, 20 bp, Homo sapiens
acagaaagctgccttgtccc

SEQ ID NO: 10008740 - DNA, 23 bp, Homo sapiens
acagaaagttctgctggacagag

SEQ ID NO: 10008741 - DNA, 18 bp, Homo sapiens
acacttcctggtggtgtg

SEQ ID NO: 10008742 - DNA, 22 bp, Homo sapiens
acacttctttgtcacctgcttc

SEQ ID NO: 10008743 - DNA, 22 bp, Homo sapiens
acacttcagctccacaaacatt

SEQ ID NO: 10008744 - DNA, 22 bp, Homo sapiens
acacttcagctccacaaacatt

SEQ ID NO: 10008745 - DNA, 19 bp, Homo sapiens
acactggttgttcaagggc

SEQ ID NO: 10008746 - DNA, 22 bp, Homo sapiens
acactggttggttgaatttact

SEQ ID NO: 10008747 - DNA, 22 bp, Homo sapiens
acactggttgaattgtataact

SEQ ID NO: 10008748 - DNA, 22 bp, Homo sapiens
acactggttgttaatagtaaca

SEQ ID NO: 10008749 - DNA, 22 bp, Homo sapiens
acaaaacagtgttcctgcccct

SEQ ID NO: 10008750 - DNA, 22 bp, Homo sapiens
acaaaacagtgttcctgcccct

SEQ ID NO: 10008751 - DNA, 22 bp, Homo sapiens
acaaaacagtgttcctgcccct

SEQ ID NO: 10008752 - DNA, 22 bp, Homo sapiens
aattttatctctaagcaggctt

SEQ ID NO: 10008753 - DNA, 22 bp, Homo sapiens
aagaagatggttaactttcagt

SEQ ID NO: 10008754 - DNA, 19 bp, Homo sapiens
aagaagcaataagctgtga

SEQ ID NO: 10008755 - DNA, 19 bp, Homo sapiens
aagaagcaataagctgtga

SEQ ID NO: 10008756 - DNA, 22 bp, Homo sapiens
aagaacttttggcaagtgttat

SEQ ID NO: 10008757 - DNA, 23 bp, Homo sapiens
aagaactttggtcctgcagagtc

SEQ ID NO: 10008758 - DNA, 22 bp, Homo sapiens
aagaagagaaatgtgctgctgg

SEQ ID NO: 10008759 - DNA, 22 bp, Homo sapiens
aagaacttcctaatatattttc

SEQ ID NO: 10008760 - DNA, 22 bp, Homo sapiens
aagaactttaaagcacttatga

SEQ ID NO: 10008761 - DNA, 22 bp, Homo sapiens
aagaactttgatttcattgcat

SEQ ID NO: 10008762 - DNA, 22 bp, Homo sapiens
aagaactgtgctccaggctcca

SEQ ID NO: 10008763 - DNA, 22 bp, Homo sapiens
aagaacattcgaactattttct

SEQ ID NO: 10008764 - DNA, 22 bp, Homo sapiens
aagaacattgactaagaggggc

SEQ ID NO: 10008765 - DNA, 22 bp, Homo sapiens
aagaacaggttctagaaccatt

SEQ ID NO: 10008766 - DNA, 22 bp, Homo sapiens
aagaacaggttctagaaccatt

SEQ ID NO: 10008767 - DNA, 22 bp, Homo sapiens
aagaacatgttaaaagattcac

SEQ ID NO: 10008768 - DNA, 22 bp, Homo sapiens
aatgtacaagggttccagtttt

SEQ ID NO: 10008769 - DNA, 22 bp, Homo sapiens
aatgtacaataagacaaagagg

SEQ ID NO: 10008770 - DNA, 22 bp, Homo sapiens
aagaacaggttctagaaccatt

SEQ ID NO: 10008771 - DNA, 22 bp, Homo sapiens
aagaacattgatattgtctatg

SEQ ID NO: 10008772 - DNA, 22 bp, Homo sapiens
aagaacattgatattgtctatg

SEQ ID NO: 10008773 - DNA, 22 bp, Homo sapiens
aagaacattttgtagaatgaca

SEQ ID NO: 10008774 - DNA, 22 bp, Homo sapiens
aagaacattttgtagaatgaca

SEQ ID NO: 10008775 - DNA, 22 bp, Homo sapiens
aagaacctatatgctgatgaat

SEQ ID NO: 10008776 - DNA, 21 bp, Homo sapiens
aagaactattgaggtacacag

SEQ ID NO: 10008777 - DNA, 23 bp, Homo sapiens
aagaactgcgaatggagaaagta

SEQ ID NO: 10008778 - DNA, 22 bp, Homo sapiens
acaaatatttactgaatccact

SEQ ID NO: 10008779 - DNA, 22 bp, Homo sapiens
acaaatatttactgaatccact

SEQ ID NO: 10008780 - DNA, 22 bp, Homo sapiens
acaaagctctggaaggctcgtc

SEQ ID NO: 10008781 - DNA, 22 bp, Homo sapiens
acaaagctctggaaggctcgtc

SEQ ID NO: 10008782 - DNA, 22 bp, Homo sapiens
acaaatatttactgaatccact

SEQ ID NO: 10008783 - DNA, 23 bp, Homo sapiens
aagaatctcagaattagaaatac

SEQ ID NO: 10008784 - DNA, 22 bp, Homo sapiens
aagaatctatggtacatccaag

SEQ ID NO: 10008785 - DNA, 23 bp, Homo sapiens
aagaatctcagaattagaaatac

SEQ ID NO: 10008786 - DNA, 22 bp, Homo sapiens
aagaatctatggtacatccaag

SEQ ID NO: 10008787 - DNA, 22 bp, Homo sapiens
aagaatctctgatcaggcttta

SEQ ID NO: 10008788 - DNA, 15 bp, Homo sapiens
aagaatctgaagctt

SEQ ID NO: 10008789 - DNA, 22 bp, Homo sapiens
aagaatctctgatcaggcttta

SEQ ID NO: 10008790 - DNA, 22 bp, Homo sapiens
acaaagctagagaagagaattg

SEQ ID NO: 10008791 - DNA, 22 bp, Homo sapiens
aagaatctccatctgattcact

SEQ ID NO: 10008792 - DNA, 22 bp, Homo sapiens
aagaatctccattcctgtttta

SEQ ID NO: 10008793 - DNA, 22 bp, Homo sapiens
aagaatctctcaagtgtgacaa

SEQ ID NO: 10008794 - DNA, 22 bp, Homo sapiens
aagaatctctctactttattac

SEQ ID NO: 10008795 - DNA, 18 bp, Homo sapiens
aagaatctctgactcttt

SEQ ID NO: 10008796 - DNA, 22 bp, Homo sapiens
acaaatgaatcatacataatgt

SEQ ID NO: 10008797 - DNA, 22 bp, Homo sapiens
acaaatgaatcatacataatgt

SEQ ID NO: 10008798 - DNA, 22 bp, Homo sapiens
acaaatgaatcatacataatgt

SEQ ID NO: 10008799 - DNA, 22 bp, Homo sapiens
acaaatgaatcatacataatgt

SEQ ID NO: 10008800 - DNA, 20 bp, Homo sapiens
acaaattggcagaatgacaa

SEQ ID NO: 10008801 - DNA, 19 bp, Homo sapiens
acaaattgtcctcatcaag

SEQ ID NO: 10008802 - DNA, 22 bp, Homo sapiens
acaaatgaatcatacataatgt

SEQ ID NO: 10008803 - DNA, 22 bp, Homo sapiens
acaaatgaacctgaaatctcag

SEQ ID NO: 10008804 - DNA, 22 bp, Homo sapiens
acaaatgaacatataagcttga

SEQ ID NO: 10008805 - DNA, 22 bp, Homo sapiens
acaaatgaacctgaaatctcag

SEQ ID NO: 10008806 - DNA, 22 bp, Homo sapiens
acaaatctgttttatagacttt

SEQ ID NO: 10008807 - DNA, 22 bp, Homo sapiens
acaaatctgttttatagacttt

SEQ ID NO: 10008808 - DNA, 22 bp, Homo sapiens
acaaatgaacatataagcttga

SEQ ID NO: 10008809 - DNA, 22 bp, Homo sapiens
aagaatcatctgaactttgagg

SEQ ID NO: 10008810 - DNA, 22 bp, Homo sapiens
aagaatcatagagccactgata

SEQ ID NO: 10008811 - DNA, 22 bp, Homo sapiens
aagaatcatcctgcaagagtct

SEQ ID NO: 10008812 - DNA, 22 bp, Homo sapiens
aagaatatctgttttatttagg

SEQ ID NO: 10008813 - DNA, 22 bp, Homo sapiens
acaaaagtgtaggaattcctta

SEQ ID NO: 10008814 - DNA, 22 bp, Homo sapiens
aagaatatctgttttatttagg

SEQ ID NO: 10008815 - DNA, 22 bp, Homo sapiens
aagaatatctgttttatttagg

SEQ ID NO: 10008816 - DNA, 22 bp, Homo sapiens
aagaatatctgttttatttagg

SEQ ID NO: 10008817 - DNA, 22 bp, Homo sapiens
acaaaagtgtaggaattcctta

SEQ ID NO: 10008818 - DNA, 22 bp, Homo sapiens
acaaaagtgagtgtgtctcaga

SEQ ID NO: 10008819 - DNA, 22 bp, Homo sapiens
acaaaagtgagtgtgtctcaga

SEQ ID NO: 10008820 - DNA, 22 bp, Homo sapiens
acaaaagcactgcagagtaagc

SEQ ID NO: 10008821 - DNA, 22 bp, Homo sapiens
acaaaagtgagtgtgtctcaga

SEQ ID NO: 10008822 - DNA, 22 bp, Homo sapiens
acaaaagaataagatgagtcat

SEQ ID NO: 10008823 - DNA, 22 bp, Homo sapiens
acaaaagaataagatgagtcat

SEQ ID NO: 10008824 - DNA, 22 bp, Homo sapiens
acaaaagaataagatgagtcat

SEQ ID NO: 10008825 - DNA, 22 bp, Homo sapiens
acaaaagaataagatgagtcat

SEQ ID NO: 10008826 - DNA, 22 bp, Homo sapiens
acaaaagaataagatgagtcat

SEQ ID NO: 10008827 - DNA, 22 bp, Homo sapiens
acaaaagcactgcagagtaagc

SEQ ID NO: 10008828 - DNA, 22 bp, Homo sapiens
acaaaaccagaaaatctctacc

SEQ ID NO: 10008829 - DNA, 21 bp, Homo sapiens
acaaaagaagctgccttttaa

SEQ ID NO: 10008830 - DNA, 21 bp, Homo sapiens
acaaaagaagctgccttttaa

SEQ ID NO: 10008831 - DNA, 21 bp, Homo sapiens
acaaaagaagctgccttttaa

SEQ ID NO: 10008832 - DNA, 22 bp, Homo sapiens
acaatatgggatatacatttta

SEQ ID NO: 10008833 - DNA, 20 bp, Homo sapiens
acaatatgtagatgaatagc

SEQ ID NO: 10008834 - DNA, 22 bp, Homo sapiens
acaatatagtccatgagcatgc

SEQ ID NO: 10008835 - DNA, 22 bp, Homo sapiens
acaatattgtacccagaagttt

SEQ ID NO: 10008836 - DNA, 20 bp, Homo sapiens
acaatatgtagatgaatagc

SEQ ID NO: 10008837 - DNA, 22 bp, Homo sapiens
acaatgtaggctgaaaaagctt

SEQ ID NO: 10008838 - DNA, 22 bp, Homo sapiens
acaatgtaggctgaaaaagctt

SEQ ID NO: 10008839 - DNA, 22 bp, Homo sapiens
acaatgtaggatatgtacttgt

SEQ ID NO: 10008840 - DNA, 22 bp, Homo sapiens
acaatgtaggatatgtacttgt

SEQ ID NO: 10008841 - DNA, 22 bp, Homo sapiens
acaatgtgggcatgagaaacca

SEQ ID NO: 10008842 - DNA, 22 bp, Homo sapiens
acaatgtgtttttatacatttg

SEQ ID NO: 10008843 - DNA, 22 bp, Homo sapiens
acaatgtgataatttaaagata

SEQ ID NO: 10008844 - DNA, 22 bp, Homo sapiens
acaatgtgcttatgaaggcagt

SEQ ID NO: 10008845 - DNA, 22 bp, Homo sapiens
acaatgtgataatttaaagata

SEQ ID NO: 10008846 - DNA, 22 bp, Homo sapiens
acaatgtctcatattcgtgttc

SEQ ID NO: 10008847 - DNA, 22 bp, Homo sapiens
acaatgtcacctctcatgtttt

SEQ ID NO: 10008848 - DNA, 22 bp, Homo sapiens
acaacaaaatcactagtcttcc

SEQ ID NO: 10008849 - DNA, 22 bp, Homo sapiens
acaaatttattgaagggcatat

SEQ ID NO: 10008850 - DNA, 22 bp, Homo sapiens
acaaattgttgcttcatgaatg

SEQ ID NO: 10008851 - DNA, 22 bp, Homo sapiens
acaaattgttgcttcatgaatg

SEQ ID NO: 10008852 - DNA, 22 bp, Homo sapiens
acaaattgttgcttcatgaatg

SEQ ID NO: 10008853 - DNA, 21 bp, Homo sapiens
acaaattgtttatataggaag

SEQ ID NO: 10008854 - DNA, 22 bp, Homo sapiens
acaacaaaatcactagtcttcc

SEQ ID NO: 10008855 - DNA, 22 bp, Homo sapiens
acaatagacccatgacacatac

SEQ ID NO: 10008856 - DNA, 22 bp, Homo sapiens
acaaggcttcacacagtatgaa

SEQ ID NO: 10008857 - DNA, 22 bp, Homo sapiens
acaatagacaaagtgaatggct

SEQ ID NO: 10008858 - DNA, 22 bp, Homo sapiens
acaatagtaaggtatattgtca

SEQ ID NO: 10008859 - DNA, 20 bp, Homo sapiens
acaatagatttgagcaaagt

SEQ ID NO: 10008860 - DNA, 22 bp, Homo sapiens
acaatagatactgggcacatat

SEQ ID NO: 10008861 - DNA, 22 bp, Homo sapiens
acaatagacccatgacacatac

SEQ ID NO: 10008862 - DNA, 22 bp, Homo sapiens
aagagtttccagttgtggctca

SEQ ID NO: 10008863 - DNA, 22 bp, Homo sapiens
aagagtttatgatataacatgt

SEQ ID NO: 10008864 - DNA, 22 bp, Homo sapiens
aagataacaggaggagtttgta

SEQ ID NO: 10008865 - DNA, 22 bp, Homo sapiens
aagagtttatgatataacatgt

SEQ ID NO: 10008866 - DNA, 22 bp, Homo sapiens
aagataagtaacgagcctcagt

SEQ ID NO: 10008867 - DNA, 22 bp, Homo sapiens
aagataatattcattaactaga

SEQ ID NO: 10008868 - DNA, 22 bp, Homo sapiens
aagatacaaatgtcaatattgg

SEQ ID NO: 10008869 - DNA, 22 bp, Homo sapiens
acacagccccacggtgagcaaa

SEQ ID NO: 10008870 - DNA, 22 bp, Homo sapiens
acacagccgtgaatctgcttct

SEQ ID NO: 10008871 - DNA, 22 bp, Homo sapiens
acacagccagggtagtaaggct

SEQ ID NO: 10008872 - DNA, 22 bp, Homo sapiens
acacagcaaggtctgactttgg

SEQ ID NO: 10008873 - DNA, 22 bp, Homo sapiens
acacagctttcagtcattatct

SEQ ID NO: 10008874 - DNA, 22 bp, Homo sapiens
acacagagccaaaccatatcac

SEQ ID NO: 10008875 - DNA, 22 bp, Homo sapiens
acacagagccagggaatacagt

SEQ ID NO: 10008876 - DNA, 22 bp, Homo sapiens
acacagagccaaaccatatcac

SEQ ID NO: 10008877 - DNA, 22 bp, Homo sapiens
acacagagcaaatcatgacaga

SEQ ID NO: 10008878 - DNA, 22 bp, Homo sapiens
acacagagcttctcaactggga

SEQ ID NO: 10008879 - DNA, 22 bp, Homo sapiens
acacagagctggaactgcttca

SEQ ID NO: 10008880 - DNA, 22 bp, Homo sapiens
acacagcaacttgcagtatgga

SEQ ID NO: 10008881 - DNA, 22 bp, Homo sapiens
acacagcaacttgcagtatgga

SEQ ID NO: 10008882 - DNA, 22 bp, Homo sapiens
acaatgttctacatatacataa

SEQ ID NO: 10008883 - DNA, 22 bp, Homo sapiens
acacagagatgtaaagttaggc

SEQ ID NO: 10008884 - DNA, 17 bp, Homo sapiens
acacagagattaacaca

SEQ ID NO: 10008885 - DNA, 22 bp, Homo sapiens
aaggatagtcacatttttatgt

SEQ ID NO: 10008886 - DNA, 22 bp, Homo sapiens
aaggcactcattcaaggagata

SEQ ID NO: 10008887 - DNA, 22 bp, Homo sapiens
aaggagggttcccaggtcctgg

SEQ ID NO: 10008888 - DNA, 22 bp, Homo sapiens
aaggaggttatcccagtggact

SEQ ID NO: 10008889 - DNA, 22 bp, Homo sapiens
aaggagtctgggccattcagag

SEQ ID NO: 10008890 - DNA, 22 bp, Homo sapiens
aaggatacttttagagcctgag

SEQ ID NO: 10008891 - DNA, 22 bp, Homo sapiens
aaatggaatgtgtttataattc

SEQ ID NO: 10008892 - DNA, 22 bp, Homo sapiens
aaatggaagaagtgcaatactg

SEQ ID NO: 10008893 - DNA, 16 bp, Homo sapiens
aaggagggaagagaat

SEQ ID NO: 10008894 - DNA, 22 bp, Homo sapiens
aaggagaagggtaatcaacaca

SEQ ID NO: 10008895 - DNA, 22 bp, Homo sapiens
aaggagaagggtaatcaacaca

SEQ ID NO: 10008896 - DNA, 20 bp, Homo sapiens
aaatggcacatgggaagtcc

SEQ ID NO: 10008897 - DNA, 18 bp, Homo sapiens
aaatggcacacagacctg

SEQ ID NO: 10008898 - DNA, 22 bp, Homo sapiens
aaatggatgttgagttaaatgt

SEQ ID NO: 10008899 - DNA, 22 bp, Homo sapiens
aaatggcaacagaagggagttc

SEQ ID NO: 10008900 - DNA, 22 bp, Homo sapiens
aaatggcaatcagcagaagcta

SEQ ID NO: 10008901 - DNA, 22 bp, Homo sapiens
aaatggcaacagaagggagttc

SEQ ID NO: 10008902 - DNA, 22 bp, Homo sapiens
aaggctgagagtcacagtccta

SEQ ID NO: 10008903 - DNA, 22 bp, Homo sapiens
aaggctgagacagcacaggtcc

SEQ ID NO: 10008904 - DNA, 22 bp, Homo sapiens
aaggctgagacagcacaggtcc

SEQ ID NO: 10008905 - DNA, 22 bp, Homo sapiens
aaggctgacgtttgtgtttatt

SEQ ID NO: 10008906 - DNA, 22 bp, Homo sapiens
aaggctgaccagtttacacttt

SEQ ID NO: 10008907 - DNA, 22 bp, Homo sapiens
aagggcaggcacccaccctcac

SEQ ID NO: 10008908 - DNA, 22 bp, Homo sapiens
aagggcaggcacccaccctcac

SEQ ID NO: 10008909 - DNA, 22 bp, Homo sapiens
aagggcaggagaagacggatat

SEQ ID NO: 10008910 - DNA, 22 bp, Homo sapiens
aaggccctggcaggaagcagga

SEQ ID NO: 10008911 - DNA, 22 bp, Homo sapiens
aaggccctggatggttttgaga

SEQ ID NO: 10008912 - DNA, 22 bp, Homo sapiens
aaggctgaattcaagggtaggc

SEQ ID NO: 10008913 - DNA, 22 bp, Homo sapiens
aaggccctcatgcgtcagagcc

SEQ ID NO: 10008914 - DNA, 22 bp, Homo sapiens
aaggcccagcgtgacctcagtg

SEQ ID NO: 10008915 - DNA, 22 bp, Homo sapiens
aaggccagactctggaatgaca

SEQ ID NO: 10008916 - DNA, 22 bp, Homo sapiens
aaggccattgtaatgtaaatat

SEQ ID NO: 10008917 - DNA, 22 bp, Homo sapiens
aaggcccacagaactgtctcca

SEQ ID NO: 10008918 - DNA, 22 bp, Homo sapiens
aaggccaggtccctgcagtgca

SEQ ID NO: 10008919 - DNA, 22 bp, Homo sapiens
aaggccaggtccctgcagtgca

SEQ ID NO: 10008920 - DNA, 22 bp, Homo sapiens
aaggccatacaatgaaaggggc

SEQ ID NO: 10008921 - DNA, 22 bp, Homo sapiens
aaggccatctacttacggaatt

SEQ ID NO: 10008922 - DNA, 22 bp, Homo sapiens
aagtcttaaccaaataaatgtt

SEQ ID NO: 10008923 - DNA, 22 bp, Homo sapiens
aagtctggtgctgtcctcaccc

SEQ ID NO: 10008924 - DNA, 22 bp, Homo sapiens
aagtctgggcctccttcccaga

SEQ ID NO: 10008925 - DNA, 22 bp, Homo sapiens
aagtctttcataagtctcttat

SEQ ID NO: 10008926 - DNA, 22 bp, Homo sapiens
aagtcttggtagagaaggactt

SEQ ID NO: 10008927 - DNA, 22 bp, Homo sapiens
aagtcttttgctgtcataggtg

SEQ ID NO: 10008928 - DNA, 22 bp, Homo sapiens
aagtcttgatgatctcctcctt

SEQ ID NO: 10008929 - DNA, 22 bp, Homo sapiens
aagtcttaggaaatagcaaaga

SEQ ID NO: 10008930 - DNA, 22 bp, Homo sapiens
aagtcttacagacaagctgaag

SEQ ID NO: 10008931 - DNA, 22 bp, Homo sapiens
aagtctttttgaatctataact

SEQ ID NO: 10008932 - DNA, 22 bp, Homo sapiens
aagtctttttgaatctataact

SEQ ID NO: 10008933 - DNA, 22 bp, Homo sapiens
aagtgcattagatagaatgatg

SEQ ID NO: 10008934 - DNA, 21 bp, Homo sapiens
aagtgccacccacagatgcat

SEQ ID NO: 10008935 - DNA, 23 bp, Homo sapiens
aagtgctaagtactgtaatcatc

SEQ ID NO: 10008936 - DNA, 22 bp, Homo sapiens
aagtgcctgacctagcctggag

SEQ ID NO: 10008937 - DNA, 22 bp, Homo sapiens
aagtgctagaaccccagcaaca

SEQ ID NO: 10008938 - DNA, 22 bp, Homo sapiens
aagtgctaggattacaggtgtg

SEQ ID NO: 10008939 - DNA, 23 bp, Homo sapiens
aagtgctatgtttataagagctg

SEQ ID NO: 10008940 - DNA, 22 bp, Homo sapiens
aacagttaatgaagaggaagcc

SEQ ID NO: 10008941 - DNA, 22 bp, Homo sapiens
aacagtgtttttcttcagcact

SEQ ID NO: 10008942 - DNA, 22 bp, Homo sapiens
aacagttacccttaagatcttt

SEQ ID NO: 10008943 - DNA, 22 bp, Homo sapiens
aacagtgtcaggattacagata

SEQ ID NO: 10008944 - DNA, 22 bp, Homo sapiens
aacagtggggaaaagagttggt

SEQ ID NO: 10008945 - DNA, 22 bp, Homo sapiens
aacagtggtctggggagtggag

SEQ ID NO: 10008946 - DNA, 22 bp, Homo sapiens
aacagtgtgtacacatcatagg

SEQ ID NO: 10008947 - DNA, 22 bp, Homo sapiens
aacagtgtctgtggttaaaggt

SEQ ID NO: 10008948 - DNA, 22 bp, Homo sapiens
aacagtgtctgtggttaaaggt

SEQ ID NO: 10008949 - DNA, 22 bp, Homo sapiens
aacagtgtgttttgttattaag

SEQ ID NO: 10008950 - DNA, 22 bp, Homo sapiens
aacagtgttttgctctttgccc

SEQ ID NO: 10008951 - DNA, 22 bp, Homo sapiens
aagtgctgagactacaggcatg

SEQ ID NO: 10008952 - DNA, 22 bp, Homo sapiens
aagtgctgggattacaggcatg

SEQ ID NO: 10008953 - DNA, 23 bp, Homo sapiens
aagtgctatgtttataagagctg

SEQ ID NO: 10008954 - DNA, 22 bp, Homo sapiens
aacagtaacgagatgtcctaac

SEQ ID NO: 10008955 - DNA, 22 bp, Homo sapiens
aacagtaagagatgttttatct

SEQ ID NO: 10008956 - DNA, 17 bp, Homo sapiens
aacagtaagccctgttt

SEQ ID NO: 10008957 - DNA, 22 bp, Homo sapiens
aacagtgatatcaagacagaca

SEQ ID NO: 10008958 - DNA, 22 bp, Homo sapiens
aacagtaaagacagaatttatc

SEQ ID NO: 10008959 - DNA, 22 bp, Homo sapiens
aacagtaaagacagaatttatc

SEQ ID NO: 10008960 - DNA, 21 bp, Homo sapiens
aaggtctgtaaagtgacagga

SEQ ID NO: 10008961 - DNA, 22 bp, Homo sapiens
aagggctgctgtagaagcagag

SEQ ID NO: 10008962 - DNA, 22 bp, Homo sapiens
aaggtgtgaagagatgggaaga

SEQ ID NO: 10008963 - DNA, 22 bp, Homo sapiens
aaggtgttcaggttttcccatt

SEQ ID NO: 10008964 - DNA, 22 bp, Homo sapiens
aaggtgtcgggttagctcagcc

SEQ ID NO: 10008965 - DNA, 22 bp, Homo sapiens
aaggtgtcggcagagccgcttc

SEQ ID NO: 10008966 - DNA, 22 bp, Homo sapiens
aagggctggaatatctcttaga

SEQ ID NO: 10008967 - DNA, 22 bp, Homo sapiens
aagggctgctgtagaagcagag

SEQ ID NO: 10008968 - DNA, 22 bp, Homo sapiens
aagggctgccagggggtgccag

SEQ ID NO: 10008969 - DNA, 22 bp, Homo sapiens
aagggcagggagtttgtgtcta

SEQ ID NO: 10008970 - DNA, 22 bp, Homo sapiens
aagggctgcaatccaaaacact

SEQ ID NO: 10008971 - DNA, 22 bp, Homo sapiens
aagggctgcatttgatgtgtca

SEQ ID NO: 10008972 - DNA, 20 bp, Homo sapiens
aagtaatatttgtgtaactg

SEQ ID NO: 10008973 - DNA, 21 bp, Homo sapiens
aagtaatgtgtctcttctacc

SEQ ID NO: 10008974 - DNA, 22 bp, Homo sapiens
aagtaatggttaaataattcta

SEQ ID NO: 10008975 - DNA, 22 bp, Homo sapiens
aagtacaacgcatacagagaaa

SEQ ID NO: 10008976 - DNA, 22 bp, Homo sapiens
aagtacaaattttgaagagctt

SEQ ID NO: 10008977 - DNA, 22 bp, Homo sapiens
aagtacaaattttgaagagctt

SEQ ID NO: 10008978 - DNA, 22 bp, Homo sapiens
aagtacaaattttgaagagctt

SEQ ID NO: 10008979 - DNA, 22 bp, Homo sapiens
aagtacaaattttgaagagctt

SEQ ID NO: 10008980 - DNA, 22 bp, Homo sapiens
aagtacaacgcatacagagaaa

SEQ ID NO: 10008981 - DNA, 22 bp, Homo sapiens
aagtctgagagaaactctctca

SEQ ID NO: 10008982 - DNA, 22 bp, Homo sapiens
aagtctgatcatttcttctata

SEQ ID NO: 10008983 - DNA, 22 bp, Homo sapiens
aagtctgatcatttcttctata

SEQ ID NO: 10008984 - DNA, 22 bp, Homo sapiens
aagtaagtttctctctccaaga

SEQ ID NO: 10008985 - DNA, 22 bp, Homo sapiens
aagtaagtgccttttattctta

SEQ ID NO: 10008986 - DNA, 22 bp, Homo sapiens
aagtaagtcttacattcacatt

SEQ ID NO: 10008987 - DNA, 22 bp, Homo sapiens
aagtaacatctgaacatgatgt

SEQ ID NO: 10008988 - DNA, 22 bp, Homo sapiens
aagtaacatgggaacatctgaa

SEQ ID NO: 10008989 - DNA, 22 bp, Homo sapiens
aagtaacatgggaacatctgaa

SEQ ID NO: 10008990 - DNA, 22 bp, Homo sapiens
aagtaactaaagatatccattt

SEQ ID NO: 10008991 - DNA, 23 bp, Homo sapiens
aagtaacagggataatagcagtt

SEQ ID NO: 10008992 - DNA, 23 bp, Homo sapiens
aaggtgtttgttttcagaaagca

SEQ ID NO: 10008993 - DNA, 23 bp, Homo sapiens
aaggtgtttgttttcagaaagca

SEQ ID NO: 10008994 - DNA, 22 bp, Homo sapiens
aagtaacatctgaacatgatgt

SEQ ID NO: 10008995 - DNA, 22 bp, Homo sapiens
aagtaacaggtgcttagtttat

SEQ ID NO: 10008996 - DNA, 22 bp, Homo sapiens
aatatctgtggccatacaattt

SEQ ID NO: 10008997 - DNA, 22 bp, Homo sapiens
aatatctgtggccatacaattt

SEQ ID NO: 10008998 - DNA, 22 bp, Homo sapiens
aatatttatgacaggaagtagc

SEQ ID NO: 10008999 - DNA, 22 bp, Homo sapiens
aatatttatatttctcttccct

SEQ ID NO: 10009000 - DNA, 22 bp, Homo sapiens
aatatttatgacaggaagtagc

SEQ ID NO: 10009001 - DNA, 22 bp, Homo sapiens
aatatttatgacaggaagtagc

SEQ ID NO: 10009002 - DNA, 22 bp, Homo sapiens
aatatttatatttctcttccct

SEQ ID NO: 10009003 - DNA, 22 bp, Homo sapiens
aatattgtttcaagatcacaga

SEQ ID NO: 10009004 - DNA, 22 bp, Homo sapiens
aatatttctgcagaatggtttt

SEQ ID NO: 10009005 - DNA, 22 bp, Homo sapiens
aatatttctgcagaatggtttt

SEQ ID NO: 10009006 - DNA, 22 bp, Homo sapiens
aatatttatgacaggaagtagc

SEQ ID NO: 10009007 - DNA, 22 bp, Homo sapiens
aatatttcaaaaggaaacacag

SEQ ID NO: 10009008 - DNA, 22 bp, Homo sapiens
aatatttcgttgcgtggctaga

SEQ ID NO: 10009009 - DNA, 22 bp, Homo sapiens
aatctcacatagctaggagtag

SEQ ID NO: 10009010 - DNA, 22 bp, Homo sapiens
aatctcaagctgtaaatacctc

SEQ ID NO: 10009011 - DNA, 22 bp, Homo sapiens
aatccagatgagcaatcatact

SEQ ID NO: 10009012 - DNA, 22 bp, Homo sapiens
aatatttctggtgcttctcact

SEQ ID NO: 10009013 - DNA, 22 bp, Homo sapiens
aatatttctggtgcttctcact

SEQ ID NO: 10009014 - DNA, 22 bp, Homo sapiens
aatacagtaattttgatgagtt

SEQ ID NO: 10009015 - DNA, 19 bp, Homo sapiens
aatacagtgttatagaatt

SEQ ID NO: 10009016 - DNA, 22 bp, Homo sapiens
aatacatatggaattccatgtt

SEQ ID NO: 10009017 - DNA, 22 bp, Homo sapiens
aatacataataagttttgtctg

SEQ ID NO: 10009018 - DNA, 22 bp, Homo sapiens
aatatccattgggagcaaatgg

SEQ ID NO: 10009019 - DNA, 22 bp, Homo sapiens
aatatccattgggagcaaatgg

SEQ ID NO: 10009020 - DNA, 22 bp, Homo sapiens
aatatctagcctttagcagctt

SEQ ID NO: 10009021 - DNA, 22 bp, Homo sapiens
aatatctagcctttagcagctt

SEQ ID NO: 10009022 - DNA, 21 bp, Homo sapiens
aatatccaaatgattagatct

SEQ ID NO: 10009023 - DNA, 22 bp, Homo sapiens
aatataattttattcctagagt

SEQ ID NO: 10009024 - DNA, 22 bp, Homo sapiens
aataatgtacatacatatttcg

SEQ ID NO: 10009025 - DNA, 22 bp, Homo sapiens
aataatgtaggatgataaatga

SEQ ID NO: 10009026 - DNA, 22 bp, Homo sapiens
aataatgtctgctattttaaaa

SEQ ID NO: 10009027 - DNA, 22 bp, Homo sapiens
aataatgtctatggttccaaaa

SEQ ID NO: 10009028 - DNA, 22 bp, Homo sapiens
aataatgtaggatgataaatga

SEQ ID NO: 10009029 - DNA, 23 bp, Homo sapiens
aataatgtcttgtgctctcactt

SEQ ID NO: 10009030 - DNA, 22 bp, Homo sapiens
aatacagaggggtcacaattca

SEQ ID NO: 10009031 - DNA, 22 bp, Homo sapiens
aataatctccctttttgtatgt

SEQ ID NO: 10009032 - DNA, 22 bp, Homo sapiens
aataatatttgaagcttcaaag

SEQ ID NO: 10009033 - DNA, 22 bp, Homo sapiens
aataatatttgaagcttcaaag

SEQ ID NO: 10009034 - DNA, 22 bp, Homo sapiens
aataatatttgaagcttcaaag

SEQ ID NO: 10009035 - DNA, 22 bp, Homo sapiens
aagtgttttgtaaacagaaaag

SEQ ID NO: 10009036 - DNA, 22 bp, Homo sapiens
aacagttgatgtagctttggag

SEQ ID NO: 10009037 - DNA, 22 bp, Homo sapiens
aacagttgatgtagctttggag

SEQ ID NO: 10009038 - DNA, 22 bp, Homo sapiens
aacagtttatcaagtttttaca

SEQ ID NO: 10009039 - DNA, 22 bp, Homo sapiens
aacagtttatgagatatgctat

SEQ ID NO: 10009040 - DNA, 22 bp, Homo sapiens
aacagtttatgataaattctta

SEQ ID NO: 10009041 - DNA, 22 bp, Homo sapiens
aagttacagttatgaaactcac

SEQ ID NO: 10009042 - DNA, 22 bp, Homo sapiens
aatgatgacaggataaagaaca

SEQ ID NO: 10009043 - DNA, 18 bp, Homo sapiens
aatgaaatgtacaccttt

SEQ ID NO: 10009044 - DNA, 18 bp, Homo sapiens
aatgaaatgtacaccttt

SEQ ID NO: 10009045 - DNA, 18 bp, Homo sapiens
aatgaaatgtacaccttt

SEQ ID NO: 10009046 - DNA, 22 bp, Homo sapiens
aatgaaatgaagatatgatcag

SEQ ID NO: 10009047 - DNA, 22 bp, Homo sapiens
aatctggaatatttgcattgta

SEQ ID NO: 10009048 - DNA, 22 bp, Homo sapiens
aatctggagagtcatctctgac

SEQ ID NO: 10009049 - DNA, 22 bp, Homo sapiens
aatctggacttgtctgtgaaga

SEQ ID NO: 10009050 - DNA, 22 bp, Homo sapiens
aatgaaactgtatatagactgt

SEQ ID NO: 10009051 - DNA, 22 bp, Homo sapiens
aatctgtagggaacaactgtac

SEQ ID NO: 10009052 - DNA, 22 bp, Homo sapiens
aatgaaactcgaaataatcaca

SEQ ID NO: 10009053 - DNA, 17 bp, Homo sapiens
aatctcagtggcttaag

SEQ ID NO: 10009054 - DNA, 22 bp, Homo sapiens
aatctcactcaaagaattctct

SEQ ID NO: 10009055 - DNA, 22 bp, Homo sapiens
aatctgaatatttatgtgtatt

SEQ ID NO: 10009056 - DNA, 22 bp, Homo sapiens
aatctgcacccactgaaaatgc

SEQ ID NO: 10009057 - DNA, 22 bp, Homo sapiens
aatctgcacccactgaaaatgc

SEQ ID NO: 10009058 - DNA, 22 bp, Homo sapiens
aatctgagggaacttgaactcc

SEQ ID NO: 10009059 - DNA, 22 bp, Homo sapiens
aatgcttataacgttagaatgt

SEQ ID NO: 10009060 - DNA, 22 bp, Homo sapiens
aatgcttatgggttccataata

SEQ ID NO: 10009061 - DNA, 22 bp, Homo sapiens
aatgcttaattcaatactgtgt

SEQ ID NO: 10009062 - DNA, 22 bp, Homo sapiens
aatgctgtcttttctacttcat

SEQ ID NO: 10009063 - DNA, 22 bp, Homo sapiens
aatgctgtcttttctacttcat

SEQ ID NO: 10009064 - DNA, 22 bp, Homo sapiens
aatgctgtcttagcatgaaagc

SEQ ID NO: 10009065 - DNA, 22 bp, Homo sapiens
aatgcataatggtttgtgacaa

SEQ ID NO: 10009066 - DNA, 22 bp, Homo sapiens
aatgctgtatatcttagctaat

SEQ ID NO: 10009067 - DNA, 22 bp, Homo sapiens
aatgcataatggtttgtgacaa

SEQ ID NO: 10009068 - DNA, 22 bp, Homo sapiens
aatgcagtgagccattaaatgg

SEQ ID NO: 10009069 - DNA, 22 bp, Homo sapiens
aatgcttatgggttccataata

SEQ ID NO: 10009070 - DNA, 22 bp, Homo sapiens
aatgcttccaaaataccaagcc

SEQ ID NO: 10009071 - DNA, 22 bp, Homo sapiens
aatgcttcctcctcacctcagg

SEQ ID NO: 10009072 - DNA, 22 bp, Homo sapiens
aatgcttattattaatagaatg

SEQ ID NO: 10009073 - DNA, 22 bp, Homo sapiens
aatgcttcaacctcccacatgt

SEQ ID NO: 10009074 - DNA, 22 bp, Homo sapiens
aatgctttaattgcatgtagtg

SEQ ID NO: 10009075 - DNA, 22 bp, Homo sapiens
aatgctttaaatcctagtgtaa

SEQ ID NO: 10009076 - DNA, 22 bp, Homo sapiens
aacttcattcctttttatgact

SEQ ID NO: 10009077 - DNA, 22 bp, Homo sapiens
aacttggtaaattgtgtcagat

SEQ ID NO: 10009078 - DNA, 22 bp, Homo sapiens
aacttggtaccaccttctgaag

SEQ ID NO: 10009079 - DNA, 22 bp, Homo sapiens
aactttaaaaaatatgtctgtt

SEQ ID NO: 10009080 - DNA, 20 bp, Homo sapiens
aacttgttttgttttctaat

SEQ ID NO: 10009081 - DNA, 22 bp, Homo sapiens
aacttgtttcttccattcaaca

SEQ ID NO: 10009082 - DNA, 22 bp, Homo sapiens
aacttgttagaaatgcagaatc

SEQ ID NO: 10009083 - DNA, 22 bp, Homo sapiens
aactttaaggctataaattatg

SEQ ID NO: 10009084 - DNA, 22 bp, Homo sapiens
aactttacactgctttacatga

SEQ ID NO: 10009085 - DNA, 22 bp, Homo sapiens
aactttaaagaggaggcttggg

SEQ ID NO: 10009086 - DNA, 22 bp, Homo sapiens
aactttaaagaggaggcttggg

SEQ ID NO: 10009087 - DNA, 22 bp, Homo sapiens
aatgtacaaaccttctttgtag

SEQ ID NO: 10009088 - DNA, 22 bp, Homo sapiens
aatgtacaaaccttctttgtag

SEQ ID NO: 10009089 - DNA, 22 bp, Homo sapiens
aatgtacaaaagtcagccaact

SEQ ID NO: 10009090 - DNA, 22 bp, Homo sapiens
aatgtacaaaagtcagccaact

SEQ ID NO: 10009091 - DNA, 22 bp, Homo sapiens
aatgtacaaaagtcagccaact

SEQ ID NO: 10009092 - DNA, 22 bp, Homo sapiens
aatgtaaagttgggcacaaatg

SEQ ID NO: 10009093 - DNA, 22 bp, Homo sapiens
aatgtaaagttgggcacaaatg

SEQ ID NO: 10009094 - DNA, 22 bp, Homo sapiens
aatgtaacagcaacaacaatgg

SEQ ID NO: 10009095 - DNA, 22 bp, Homo sapiens
aatgtaaacagcaagagaaggg

SEQ ID NO: 10009096 - DNA, 22 bp, Homo sapiens
aatgtaaacagcaagagaaggg

SEQ ID NO: 10009097 - DNA, 22 bp, Homo sapiens
aatgtaaagctcaggtcaggag

SEQ ID NO: 10009098 - DNA, 22 bp, Homo sapiens
aatgtaaagttgggcacaaatg

SEQ ID NO: 10009099 - DNA, 22 bp, Homo sapiens
aatgtaaagttgggcacaaatg

SEQ ID NO: 10009100 - DNA, 17 bp, Homo sapiens
accactttgccaagttg

SEQ ID NO: 10009101 - DNA, 22 bp, Homo sapiens
accactttggtatttcaatttt

SEQ ID NO: 10009102 - DNA, 22 bp, Homo sapiens
accagaagttctccaaaaagat

SEQ ID NO: 10009103 - DNA, 22 bp, Homo sapiens
accagaaaggaataatagaatt

SEQ ID NO: 10009104 - DNA, 22 bp, Homo sapiens
accactttggtatttcaatttt

SEQ ID NO: 10009105 - DNA, 22 bp, Homo sapiens
aggctgtgatgagcctcatgga

SEQ ID NO: 10009106 - DNA, 22 bp, Homo sapiens
accacaggacccatgagtcagt

SEQ ID NO: 10009107 - DNA, 22 bp, Homo sapiens
accactgcccatggtgaaaact

SEQ ID NO: 10009108 - DNA, 22 bp, Homo sapiens
accactgcccatggtgaaaact

SEQ ID NO: 10009109 - DNA, 22 bp, Homo sapiens
aggctgggaaatgtagtcttcc

SEQ ID NO: 10009110 - DNA, 22 bp, Homo sapiens
aggctgggaaatgtattccagc

SEQ ID NO: 10009111 - DNA, 22 bp, Homo sapiens
aggctggctttggtagcatggt

SEQ ID NO: 10009112 - DNA, 22 bp, Homo sapiens
aggctggctttggtagcatggt

SEQ ID NO: 10009113 - DNA, 22 bp, Homo sapiens
aggctgggaaacctgaagttgt

SEQ ID NO: 10009114 - DNA, 22 bp, Homo sapiens
aggctgggaaacctgaagttgt

SEQ ID NO: 10009115 - DNA, 22 bp, Homo sapiens
aggctggcttggctctcctgtg

SEQ ID NO: 10009116 - DNA, 22 bp, Homo sapiens
aggctggctttggtagcatggt

SEQ ID NO: 10009117 - DNA, 19 bp, Homo sapiens
aggctgtgaggggaaggaa

SEQ ID NO: 10009118 - DNA, 19 bp, Homo sapiens
aggctgtgaggggaaggaa

SEQ ID NO: 10009119 - DNA, 19 bp, Homo sapiens
aggctgtgagggaggactc

SEQ ID NO: 10009120 - DNA, 19 bp, Homo sapiens
aggctgtgagggaggactc

SEQ ID NO: 10009121 - DNA, 22 bp, Homo sapiens
aggctgtgagttttgtctcaga

SEQ ID NO: 10009122 - DNA, 22 bp, Homo sapiens
aggctgtgagtagttcttgttg

SEQ ID NO: 10009123 - DNA, 19 bp, Homo sapiens
aggctgtgagggaggactc

SEQ ID NO: 10009124 - DNA, 22 bp, Homo sapiens
aggctgtgagcaagaacaccta

SEQ ID NO: 10009125 - DNA, 19 bp, Homo sapiens
aggctgtgagggaggactc

SEQ ID NO: 10009126 - DNA, 22 bp, Homo sapiens
aggctgtgagaagtccttcagt

SEQ ID NO: 10009127 - DNA, 22 bp, Homo sapiens
aggctgtgagaagtccttcagt

SEQ ID NO: 10009128 - DNA, 18 bp, Homo sapiens
acatttctccttctgacc

SEQ ID NO: 10009129 - DNA, 18 bp, Homo sapiens
acatttctccttctgacc

SEQ ID NO: 10009130 - DNA, 22 bp, Homo sapiens
acatttctccctgcatgcctgc

SEQ ID NO: 10009131 - DNA, 22 bp, Homo sapiens
acatttctcattctcccctaac

SEQ ID NO: 10009132 - DNA, 22 bp, Homo sapiens
acatttctccctgcatgcctgc

SEQ ID NO: 10009133 - DNA, 22 bp, Homo sapiens
acatttctcaggtaagtcattt

SEQ ID NO: 10009134 - DNA, 22 bp, Homo sapiens
acatttctcaggtaagtcattt

SEQ ID NO: 10009135 - DNA, 22 bp, Homo sapiens
acatttctcaggtaagtcattt

SEQ ID NO: 10009136 - DNA, 22 bp, Homo sapiens
acatttctcaggtaagtcattt

SEQ ID NO: 10009137 - DNA, 22 bp, Homo sapiens
acatttctcataggagagccac

SEQ ID NO: 10009138 - DNA, 22 bp, Homo sapiens
acatttctcaggtaagtcattt

SEQ ID NO: 10009139 - DNA, 22 bp, Homo sapiens
acatttctcaggtaagtcattt

SEQ ID NO: 10009140 - DNA, 22 bp, Homo sapiens
acatttctcatctagtagagta

SEQ ID NO: 10009141 - DNA, 18 bp, Homo sapiens
acatttctctctgcgtga

SEQ ID NO: 10009142 - DNA, 22 bp, Homo sapiens
aggctggctggggatgcgtctt

SEQ ID NO: 10009143 - DNA, 22 bp, Homo sapiens
aggctggcttggctctcctgtg

SEQ ID NO: 10009144 - DNA, 23 bp, Homo sapiens
aggctggcttcaggagcctctcc

SEQ ID NO: 10009145 - DNA, 23 bp, Homo sapiens
aggctggcttcaggagcctctcc

SEQ ID NO: 10009146 - DNA, 22 bp, Homo sapiens
aggctgctctgcgaagtcagct

SEQ ID NO: 10009147 - DNA, 22 bp, Homo sapiens
aggctgctctgcgaagtcagct

SEQ ID NO: 10009148 - DNA, 21 bp, Homo sapiens
aggctgctctttcttgtggta

SEQ ID NO: 10009149 - DNA, 22 bp, Homo sapiens
aggctctggcaacagctggtgt

SEQ ID NO: 10009150 - DNA, 22 bp, Homo sapiens
aggctgcagaacagtcaggtgc

SEQ ID NO: 10009151 - DNA, 22 bp, Homo sapiens
aggctctggctactacagagct

SEQ ID NO: 10009152 - DNA, 17 bp, Homo sapiens
aggctgctgggccaggg

SEQ ID NO: 10009153 - DNA, 22 bp, Homo sapiens
aggctgcttcagctgcagggag

SEQ ID NO: 10009154 - DNA, 22 bp, Homo sapiens
acatttctcagggagttttgct

SEQ ID NO: 10009155 - DNA, 22 bp, Homo sapiens
aggctgcttcagctgcagggag

SEQ ID NO: 10009156 - DNA, 22 bp, Homo sapiens
aggctgctggcaggcgtggacg

SEQ ID NO: 10009157 - DNA, 21 bp, Homo sapiens
aggctgctggctcagggtcct

SEQ ID NO: 10009158 - DNA, 22 bp, Homo sapiens
aggctgctgccttggagagtgt

SEQ ID NO: 10009159 - DNA, 22 bp, Homo sapiens
aggctctcactatcctcctagc

SEQ ID NO: 10009160 - DNA, 22 bp, Homo sapiens
aggctctgaaggagaacctgtt

SEQ ID NO: 10009161 - DNA, 22 bp, Homo sapiens
aggctctgaagcaaccctttga

SEQ ID NO: 10009162 - DNA, 22 bp, Homo sapiens
aggctctggacagtgaggagtt

SEQ ID NO: 10009163 - DNA, 22 bp, Homo sapiens
aggctctggagtgtggtgctgg

SEQ ID NO: 10009164 - DNA, 22 bp, Homo sapiens
aggctctggagttagccaggca

SEQ ID NO: 10009165 - DNA, 22 bp, Homo sapiens
aggctctggacagtgaggagtt

SEQ ID NO: 10009166 - DNA, 22 bp, Homo sapiens
aggctccttgttcatcatccat

SEQ ID NO: 10009167 - DNA, 22 bp, Homo sapiens
aggctcctttaccattctggag

SEQ ID NO: 10009168 - DNA, 22 bp, Homo sapiens
aggctccttgttcatcatccat

SEQ ID NO: 10009169 - DNA, 22 bp, Homo sapiens
aggctctataccgctgggagtt

SEQ ID NO: 10009170 - DNA, 22 bp, Homo sapiens
acattaacaccgtgagtttggt

SEQ ID NO: 10009171 - DNA, 22 bp, Homo sapiens
acattaacaccataagtgtgtt

SEQ ID NO: 10009172 - DNA, 22 bp, Homo sapiens
acattaaatttcatagtgatta

SEQ ID NO: 10009173 - DNA, 22 bp, Homo sapiens
acattaaatttcatagtgatta

SEQ ID NO: 10009174 - DNA, 22 bp, Homo sapiens
acattaaatttcatagtgatta

SEQ ID NO: 10009175 - DNA, 22 bp, Homo sapiens
acattaaagagtaaggttagtt

SEQ ID NO: 10009176 - DNA, 22 bp, Homo sapiens
acattaaagagtaaggttagtt

SEQ ID NO: 10009177 - DNA, 22 bp, Homo sapiens
acattaaacttgcttggctgta

SEQ ID NO: 10009178 - DNA, 22 bp, Homo sapiens
acattaaaattgggtggggtaa

SEQ ID NO: 10009179 - DNA, 22 bp, Homo sapiens
acattaaacttgcttggctgta

SEQ ID NO: 10009180 - DNA, 19 bp, Homo sapiens
acatgttttgcagaacagc

SEQ ID NO: 10009181 - DNA, 22 bp, Homo sapiens
acatgttttgtgccttgactag

SEQ ID NO: 10009182 - DNA, 22 bp, Homo sapiens
acattaaaaaatgttgcatgaa

SEQ ID NO: 10009183 - DNA, 22 bp, Homo sapiens
acattaaaatggagaattttga

SEQ ID NO: 10009184 - DNA, 22 bp, Homo sapiens
acattaaaatggagaattttga

SEQ ID NO: 10009185 - DNA, 22 bp, Homo sapiens
acatgtatacaatgtgtaatga

SEQ ID NO: 10009186 - DNA, 22 bp, Homo sapiens
acatgtactgttggtgaagagg

SEQ ID NO: 10009187 - DNA, 21 bp, Homo sapiens
acatgtaagagagtttcaaga

SEQ ID NO: 10009188 - DNA, 20 bp, Homo sapiens
acatgtacagacaggtttct

SEQ ID NO: 10009189 - DNA, 22 bp, Homo sapiens
acatgtacatacacatatgtaa

SEQ ID NO: 10009190 - DNA, 20 bp, Homo sapiens
acatgtactaatgaatacag

SEQ ID NO: 10009191 - DNA, 22 bp, Homo sapiens
acatgtacatacacatatgtaa

SEQ ID NO: 10009192 - DNA, 22 bp, Homo sapiens
acatgtctaagtactcaacaaa

SEQ ID NO: 10009193 - DNA, 22 bp, Homo sapiens
acatgtattgacattatattct

SEQ ID NO: 10009194 - DNA, 22 bp, Homo sapiens
acatgtaaaagataaattaaca

SEQ ID NO: 10009195 - DNA, 22 bp, Homo sapiens
acatgtaaaagataaattaaca

SEQ ID NO: 10009196 - DNA, 22 bp, Homo sapiens
acatgtaaaagataaattaaca

SEQ ID NO: 10009197 - DNA, 22 bp, Homo sapiens
acatgtaaaagataaattaaca

SEQ ID NO: 10009198 - DNA, 22 bp, Homo sapiens
aggcagtgtgtagctggaagag

SEQ ID NO: 10009199 - DNA, 22 bp, Homo sapiens
aggcagtgtgtagctggaagag

SEQ ID NO: 10009200 - DNA, 22 bp, Homo sapiens
aggcagtgtgtagctggaagag

SEQ ID NO: 10009201 - DNA, 22 bp, Homo sapiens
acatgtaaaaggaacatgcatg

SEQ ID NO: 10009202 - DNA, 22 bp, Homo sapiens
acatgtaaaaggaacatgcatg

SEQ ID NO: 10009203 - DNA, 22 bp, Homo sapiens
acatgtaaaaggaacatgcatg

SEQ ID NO: 10009204 - DNA, 22 bp, Homo sapiens
acatgtaacatatatgtagcat

SEQ ID NO: 10009205 - DNA, 22 bp, Homo sapiens
acatgtaagactagcttaaagt

SEQ ID NO: 10009206 - DNA, 21 bp, Homo sapiens
acatgtaagagagtttcaaga

SEQ ID NO: 10009207 - DNA, 22 bp, Homo sapiens
acatgtaagactagcttaaagt

SEQ ID NO: 10009208 - DNA, 22 bp, Homo sapiens
acatgtaagactagcttaaagt

SEQ ID NO: 10009209 - DNA, 22 bp, Homo sapiens
acatgtgaggtgtgagtgatac

SEQ ID NO: 10009210 - DNA, 22 bp, Homo sapiens
acatgtgaaatctcatagttag

SEQ ID NO: 10009211 - DNA, 22 bp, Homo sapiens
acatgtcttttaaagtctaata

SEQ ID NO: 10009212 - DNA, 22 bp, Homo sapiens
acatgtctcttctgaaagacaa

SEQ ID NO: 10009213 - DNA, 22 bp, Homo sapiens
acatgtctcttctgaaagacaa

SEQ ID NO: 10009214 - DNA, 22 bp, Homo sapiens
acatgtctccacccatcttaaa

SEQ ID NO: 10009215 - DNA, 22 bp, Homo sapiens
acatgtgagtaaatttaatgtt

SEQ ID NO: 10009216 - DNA, 20 bp, Homo sapiens
aggctcagctgagctcttgg

SEQ ID NO: 10009217 - DNA, 22 bp, Homo sapiens
aggctcagctggtggtgatcgc

SEQ ID NO: 10009218 - DNA, 20 bp, Homo sapiens
aggctcagctgagctcttgg

SEQ ID NO: 10009219 - DNA, 22 bp, Homo sapiens
aggctcagggacggggcccctt

SEQ ID NO: 10009220 - DNA, 22 bp, Homo sapiens
aggctcaggcaggaatggcgga

SEQ ID NO: 10009221 - DNA, 22 bp, Homo sapiens
agggccagcactcctggcagga

SEQ ID NO: 10009222 - DNA, 22 bp, Homo sapiens
agggccagcactcctggcagga

SEQ ID NO: 10009223 - DNA, 22 bp, Homo sapiens
agggccagcactcctggcagga

SEQ ID NO: 10009224 - DNA, 22 bp, Homo sapiens
agggccagcagcttggccaacc

SEQ ID NO: 10009225 - DNA, 22 bp, Homo sapiens
agggccagcccataatgccaaa

SEQ ID NO: 10009226 - DNA, 22 bp, Homo sapiens
agggccagcccataatgccaaa

SEQ ID NO: 10009227 - DNA, 21 bp, Homo sapiens
agggccagatcaccaaggagc

SEQ ID NO: 10009228 - DNA, 21 bp, Homo sapiens
agggccagatcaccaaggagc

SEQ ID NO: 10009229 - DNA, 22 bp, Homo sapiens
agggccagatgaagccacaagc

SEQ ID NO: 10009230 - DNA, 23 bp, Homo sapiens
agggcactgttgggtgttgagga

SEQ ID NO: 10009231 - DNA, 22 bp, Homo sapiens
agggcatgctggaggagagaca

SEQ ID NO: 10009232 - DNA, 22 bp, Homo sapiens
agggccagttcagaggacatgg

SEQ ID NO: 10009233 - DNA, 22 bp, Homo sapiens
agggcctgtcagcggtgtcctg

SEQ ID NO: 10009234 - DNA, 22 bp, Homo sapiens
agggccagttctacctctgaat

SEQ ID NO: 10009235 - DNA, 22 bp, Homo sapiens
agggctcaatggtgggcatgta

SEQ ID NO: 10009236 - DNA, 22 bp, Homo sapiens
agggctcaccactgtgcactcc

SEQ ID NO: 10009237 - DNA, 22 bp, Homo sapiens
agggctcaccactgtgcactcc

SEQ ID NO: 10009238 - DNA, 22 bp, Homo sapiens
agggccagtgggttgaaaggca

SEQ ID NO: 10009239 - DNA, 22 bp, Homo sapiens
agggccagtattaaggtaatta

SEQ ID NO: 10009240 - DNA, 22 bp, Homo sapiens
agggccagtattaaggtaatta

SEQ ID NO: 10009241 - DNA, 22 bp, Homo sapiens
agggaggcattagctactgcga

SEQ ID NO: 10009242 - DNA, 19 bp, Homo sapiens
agggaggtagcattggaaa

SEQ ID NO: 10009243 - DNA, 22 bp, Homo sapiens
agggaggtaggagcttctagct

SEQ ID NO: 10009244 - DNA, 22 bp, Homo sapiens
agggaggtccatccctgcagag

SEQ ID NO: 10009245 - DNA, 22 bp, Homo sapiens
agggaggtctggctgccctgag

SEQ ID NO: 10009246 - DNA, 20 bp, Homo sapiens
agggaggtgctgggcctgag

SEQ ID NO: 10009247 - DNA, 20 bp, Homo sapiens
agggaggtgctgggcctgag

SEQ ID NO: 10009248 - DNA, 22 bp, Homo sapiens
agggaggtggttccccagtgga

SEQ ID NO: 10009249 - DNA, 22 bp, Homo sapiens
agggatgtgggaactgcaggtt

SEQ ID NO: 10009250 - DNA, 22 bp, Homo sapiens
agggatgtgcagcatccagaca

SEQ ID NO: 10009251 - DNA, 22 bp, Homo sapiens
agggatgtgggaactgcaggtt

SEQ ID NO: 10009252 - DNA, 22 bp, Homo sapiens
agggatgtgacattacagaagc

SEQ ID NO: 10009253 - DNA, 22 bp, Homo sapiens
agggatgttagttgtgagctca

SEQ ID NO: 10009254 - DNA, 22 bp, Homo sapiens
agggcacatctgctgggaatgg

SEQ ID NO: 10009255 - DNA, 21 bp, Homo sapiens
agggcacccccgctgcctacc

SEQ ID NO: 10009256 - DNA, 22 bp, Homo sapiens
agggcacaagactctgagcccc

SEQ ID NO: 10009257 - DNA, 22 bp, Homo sapiens
agggcacagcctaaagcctatg

SEQ ID NO: 10009258 - DNA, 22 bp, Homo sapiens
agggcacaagactctgagcccc

SEQ ID NO: 10009259 - DNA, 22 bp, Homo sapiens
accagagaaaacacagcaggct

SEQ ID NO: 10009260 - DNA, 22 bp, Homo sapiens
accagagaatgtgcatctctaa

SEQ ID NO: 10009261 - DNA, 22 bp, Homo sapiens
accagagaatttagccaagaaa

SEQ ID NO: 10009262 - DNA, 20 bp, Homo sapiens
accagagacctgaatcagtt

SEQ ID NO: 10009263 - DNA, 20 bp, Homo sapiens
accagagacctgaatcagtt

SEQ ID NO: 10009264 - DNA, 22 bp, Homo sapiens
accagagactgcatttctctga

SEQ ID NO: 10009265 - DNA, 22 bp, Homo sapiens
accagagactctttctagtcct

SEQ ID NO: 10009266 - DNA, 20 bp, Homo sapiens
accagagactggggacaagt

SEQ ID NO: 10009267 - DNA, 20 bp, Homo sapiens
accagagatagcaatagtgc

SEQ ID NO: 10009268 - DNA, 22 bp, Homo sapiens
accagagatggggcttctctgt

SEQ ID NO: 10009269 - DNA, 22 bp, Homo sapiens
accagagagcctaggctgggca

SEQ ID NO: 10009270 - DNA, 22 bp, Homo sapiens
accagagagcctaggctgggca

SEQ ID NO: 10009271 - DNA, 22 bp, Homo sapiens
accagagaggctgcagtgtgtg

SEQ ID NO: 10009272 - DNA, 22 bp, Homo sapiens
accagagagagacagggttgtg

SEQ ID NO: 10009273 - DNA, 22 bp, Homo sapiens
agggaggcaggaaagttgtctg

SEQ ID NO: 10009274 - DNA, 22 bp, Homo sapiens
agggaggatctgctccttgtct

SEQ ID NO: 10009275 - DNA, 22 bp, Homo sapiens
accagagctcttcagcacagga

SEQ ID NO: 10009276 - DNA, 22 bp, Homo sapiens
accagagatgtctaataggggc

SEQ ID NO: 10009277 - DNA, 22 bp, Homo sapiens
aggggtggagagtgttgccagt

SEQ ID NO: 10009278 - DNA, 22 bp, Homo sapiens
aggggtggagagtgttgccagt

SEQ ID NO: 10009279 - DNA, 22 bp, Homo sapiens
aggggtgatttgggacaggaca

SEQ ID NO: 10009280 - DNA, 22 bp, Homo sapiens
aggggtggcctgccttactccc

SEQ ID NO: 10009281 - DNA, 22 bp, Homo sapiens
aggggtgacacatatcagtgca

SEQ ID NO: 10009282 - DNA, 22 bp, Homo sapiens
acctccagctttttagagacat

SEQ ID NO: 10009283 - DNA, 22 bp, Homo sapiens
aggggtgatttgggacaggaca

SEQ ID NO: 10009284 - DNA, 22 bp, Homo sapiens
agggtaagcttggggctggcag

SEQ ID NO: 10009285 - DNA, 20 bp, Homo sapiens
agggtcagtagcacagagct

SEQ ID NO: 10009286 - DNA, 23 bp, Homo sapiens
aggggtggtcagtacccgcagtg

SEQ ID NO: 10009287 - DNA, 23 bp, Homo sapiens
aggggtggtcagtacccgcagtg

SEQ ID NO: 10009288 - DNA, 23 bp, Homo sapiens
aggggtggtcagtacccgcagtg

SEQ ID NO: 10009289 - DNA, 22 bp, Homo sapiens
aggggccaccaccaaggaaggt

SEQ ID NO: 10009290 - DNA, 22 bp, Homo sapiens
aggggccattgttctgcccgct

SEQ ID NO: 10009291 - DNA, 22 bp, Homo sapiens
aggggcctcgcaggaccgctcc

SEQ ID NO: 10009292 - DNA, 22 bp, Homo sapiens
aggggcctcagcctcctggtca

SEQ ID NO: 10009293 - DNA, 22 bp, Homo sapiens
aggggcctcctcattggagtgt

SEQ ID NO: 10009294 - DNA, 22 bp, Homo sapiens
aggggcctcgcaggaccgctcc

SEQ ID NO: 10009295 - DNA, 21 bp, Homo sapiens
acctcaagcaacaaccaaggt

SEQ ID NO: 10009296 - DNA, 23 bp, Homo sapiens
agggctgaatgcagagaagcaga

SEQ ID NO: 10009297 - DNA, 22 bp, Homo sapiens
agggctgacaaatggcagtgac

SEQ ID NO: 10009298 - DNA, 22 bp, Homo sapiens
agggctgacaaatggcagtgac

SEQ ID NO: 10009299 - DNA, 23 bp, Homo sapiens
agggctgaatgcagagaagcaga

SEQ ID NO: 10009300 - DNA, 22 bp, Homo sapiens
agggctgacagtaaaagtatga

SEQ ID NO: 10009301 - DNA, 22 bp, Homo sapiens
agggctgacacaccttatcctc

SEQ ID NO: 10009302 - DNA, 22 bp, Homo sapiens
agggctcagtaaacggtggatt

SEQ ID NO: 10009303 - DNA, 22 bp, Homo sapiens
agggctcagggtcaccatctgt

SEQ ID NO: 10009304 - DNA, 22 bp, Homo sapiens
agggctgaagggaggtgctcat

SEQ ID NO: 10009305 - DNA, 22 bp, Homo sapiens
agggctgaaacataatccttct

SEQ ID NO: 10009306 - DNA, 22 bp, Homo sapiens
agggctgaagggaggtgctcat

SEQ ID NO: 10009307 - DNA, 22 bp, Homo sapiens
agggctcactgggaggctataa

SEQ ID NO: 10009308 - DNA, 22 bp, Homo sapiens
agggctcagaacaatgagtgta

SEQ ID NO: 10009309 - DNA, 22 bp, Homo sapiens
agggctcagaaatgtctacggg

SEQ ID NO: 10009310 - DNA, 22 bp, Homo sapiens
agggctcagccagcctgtgtgc

SEQ ID NO: 10009311 - DNA, 22 bp, Homo sapiens
aggggcaggtgctgcacttaga

SEQ ID NO: 10009312 - DNA, 22 bp, Homo sapiens
aggggcagttccaagttttgtg

SEQ ID NO: 10009313 - DNA, 22 bp, Homo sapiens
aggggagctaacaccagagccc

SEQ ID NO: 10009314 - DNA, 22 bp, Homo sapiens
aggggagcttgcctggtcaccc

SEQ ID NO: 10009315 - DNA, 22 bp, Homo sapiens
aggggagcttgcctggtcaccc

SEQ ID NO: 10009316 - DNA, 22 bp, Homo sapiens
aggggagcaaggccgtggtgta

SEQ ID NO: 10009317 - DNA, 22 bp, Homo sapiens
aggggagcaaggccgtggtgta

SEQ ID NO: 10009318 - DNA, 22 bp, Homo sapiens
aggggagcatctgtgatggtta

SEQ ID NO: 10009319 - DNA, 22 bp, Homo sapiens
aggggagccgaggggcatctgt

SEQ ID NO: 10009320 - DNA, 22 bp, Homo sapiens
aggggagcccctggtcctggtg

SEQ ID NO: 10009321 - DNA, 22 bp, Homo sapiens
aggggagcatctgtgatggtta

SEQ ID NO: 10009322 - DNA, 22 bp, Homo sapiens
aggggagcgacattccgtgccg

SEQ ID NO: 10009323 - DNA, 22 bp, Homo sapiens
aggggagccgaggggcatctgt

SEQ ID NO: 10009324 - DNA, 22 bp, Homo sapiens
aggggagccgaggggcatctgt

SEQ ID NO: 10009325 - DNA, 17 bp, Homo sapiens
aggaaagtctgctgtcc

SEQ ID NO: 10009326 - DNA, 19 bp, Homo sapiens
aggaaaggtggccttagca

SEQ ID NO: 10009327 - DNA, 19 bp, Homo sapiens
aggaaaggtggccttagca

SEQ ID NO: 10009328 - DNA, 22 bp, Homo sapiens
aggaaaggtgagagcggccgcg

SEQ ID NO: 10009329 - DNA, 19 bp, Homo sapiens
aggaaaggtggccttagca

SEQ ID NO: 10009330 - DNA, 22 bp, Homo sapiens
aggaaaggtagcgtgccagcag

SEQ ID NO: 10009331 - DNA, 22 bp, Homo sapiens
aggaaaggtagcgtgccagcag

SEQ ID NO: 10009332 - DNA, 22 bp, Homo sapiens
aggaaaggtagcgtgccagcag

SEQ ID NO: 10009333 - DNA, 22 bp, Homo sapiens
aggaaaggggtaggtgtggacg

SEQ ID NO: 10009334 - DNA, 22 bp, Homo sapiens
aggaaataagggacaagacaaa

SEQ ID NO: 10009335 - DNA, 22 bp, Homo sapiens
acagggcatgtgcaagagacat

SEQ ID NO: 10009336 - DNA, 21 bp, Homo sapiens
acagggcatgcagctggctgt

SEQ ID NO: 10009337 - DNA, 22 bp, Homo sapiens
acagggcatttcctctatgtgt

SEQ ID NO: 10009338 - DNA, 22 bp, Homo sapiens
acagggccaatgttagcattga

SEQ ID NO: 10009339 - DNA, 22 bp, Homo sapiens
acagggccacatgtaaacagat

SEQ ID NO: 10009340 - DNA, 22 bp, Homo sapiens
acagggccaagtaaaccctacc

SEQ ID NO: 10009341 - DNA, 22 bp, Homo sapiens
acagggcatttcctctatgtgt

SEQ ID NO: 10009342 - DNA, 22 bp, Homo sapiens
acagggcacctgaggtaggaag

SEQ ID NO: 10009343 - DNA, 22 bp, Homo sapiens
acagggcaggtggctactggtc

SEQ ID NO: 10009344 - DNA, 22 bp, Homo sapiens
acaggctctctattgagtgcag

SEQ ID NO: 10009345 - DNA, 22 bp, Homo sapiens
aggactgggtgcagagggcatc

SEQ ID NO: 10009346 - DNA, 22 bp, Homo sapiens
aggactggccctgaggggaggc

SEQ ID NO: 10009347 - DNA, 22 bp, Homo sapiens
aggactggcagtgtgaggggtc

SEQ ID NO: 10009348 - DNA, 22 bp, Homo sapiens
aggactggcagtgtgaggggtc

SEQ ID NO: 10009349 - DNA, 22 bp, Homo sapiens
aggactgatgatggtgctgaca

SEQ ID NO: 10009350 - DNA, 22 bp, Homo sapiens
aggacaggtgtagtgggctctg

SEQ ID NO: 10009351 - DNA, 22 bp, Homo sapiens
aggacaggtgtagtgggctctg

SEQ ID NO: 10009352 - DNA, 22 bp, Homo sapiens
aggacaggtgtagtgggctctg

SEQ ID NO: 10009353 - DNA, 22 bp, Homo sapiens
aggacatgaagaaagggcaagg

SEQ ID NO: 10009354 - DNA, 22 bp, Homo sapiens
acagggccagcctgggacctgg

SEQ ID NO: 10009355 - DNA, 22 bp, Homo sapiens
acagggccaggtgagaggtgct

SEQ ID NO: 10009356 - DNA, 22 bp, Homo sapiens
acagggccaggtgagaggtgct

SEQ ID NO: 10009357 - DNA, 22 bp, Homo sapiens
acagggccattatctgttctag

SEQ ID NO: 10009358 - DNA, 22 bp, Homo sapiens
acagggccattggaggattata

SEQ ID NO: 10009359 - DNA, 22 bp, Homo sapiens
acagggcctcagctgattctgg

SEQ ID NO: 10009360 - DNA, 22 bp, Homo sapiens
acagggcctcagccagggcaga

SEQ ID NO: 10009361 - DNA, 22 bp, Homo sapiens
acagggccctgtgggccccact

SEQ ID NO: 10009362 - DNA, 22 bp, Homo sapiens
acagggcccttagatcctttta

SEQ ID NO: 10009363 - DNA, 22 bp, Homo sapiens
acagggcccttgccagcacaag

SEQ ID NO: 10009364 - DNA, 22 bp, Homo sapiens
acagggctatattcctcagagc

SEQ ID NO: 10009365 - DNA, 23 bp, Homo sapiens
acagggctagctgacagtggtat

SEQ ID NO: 10009366 - DNA, 22 bp, Homo sapiens
acagggcctggctccaaaagat

SEQ ID NO: 10009367 - DNA, 22 bp, Homo sapiens
acagggcctttgatggattata

SEQ ID NO: 10009368 - DNA, 22 bp, Homo sapiens
acagggccttatatccagaagg

SEQ ID NO: 10009369 - DNA, 22 bp, Homo sapiens
aggacagggattcaaactccca

SEQ ID NO: 10009370 - DNA, 22 bp, Homo sapiens
aggacaggtgtagtgggctctg

SEQ ID NO: 10009371 - DNA, 22 bp, Homo sapiens
acagcttctctgaaattcatgt

SEQ ID NO: 10009372 - DNA, 22 bp, Homo sapiens
acagcttctatttctctgtact

SEQ ID NO: 10009373 - DNA, 22 bp, Homo sapiens
acagcttctcctcgatgtcatg

SEQ ID NO: 10009374 - DNA, 22 bp, Homo sapiens
acagcttcgaggatctcatccc

SEQ ID NO: 10009375 - DNA, 22 bp, Homo sapiens
acaggaagaaagtgcagtagat

SEQ ID NO: 10009376 - DNA, 22 bp, Homo sapiens
acaggaagtgggaagaaacagg

SEQ ID NO: 10009377 - DNA, 22 bp, Homo sapiens
acaggaagtgggaagaaacagg

SEQ ID NO: 10009378 - DNA, 22 bp, Homo sapiens
acaggaagtgggaagaaacagg

SEQ ID NO: 10009379 - DNA, 22 bp, Homo sapiens
acaggaagtgctggcacttaca

SEQ ID NO: 10009380 - DNA, 22 bp, Homo sapiens
acaggaagctggagacccttga

SEQ ID NO: 10009381 - DNA, 22 bp, Homo sapiens
acaggaagctggagacccttga

SEQ ID NO: 10009382 - DNA, 22 bp, Homo sapiens
acaggaagtgctggcacttaca

SEQ ID NO: 10009383 - DNA, 22 bp, Homo sapiens
acaggaagaaagtgcagtagat

SEQ ID NO: 10009384 - DNA, 22 bp, Homo sapiens
acaggaagaaagtgcagtagat

SEQ ID NO: 10009385 - DNA, 22 bp, Homo sapiens
acaggaagaaagtgcagtagat

SEQ ID NO: 10009386 - DNA, 22 bp, Homo sapiens
acaggaagtgggaagaaacagg

SEQ ID NO: 10009387 - DNA, 22 bp, Homo sapiens
acaggaagtttggaaagcctca

SEQ ID NO: 10009388 - DNA, 22 bp, Homo sapiens
acaggaagtttggaaagcctca

SEQ ID NO: 10009389 - DNA, 22 bp, Homo sapiens
acaggaagtttggaaagcctca

SEQ ID NO: 10009390 - DNA, 22 bp, Homo sapiens
acaggacaactcagcagccagc

SEQ ID NO: 10009391 - DNA, 22 bp, Homo sapiens
acagcagtggtgcactgagcca

SEQ ID NO: 10009392 - DNA, 22 bp, Homo sapiens
acagcagttaacgatcagactc

SEQ ID NO: 10009393 - DNA, 22 bp, Homo sapiens
acagcagttactgaaataaagt

SEQ ID NO: 10009394 - DNA, 22 bp, Homo sapiens
acagcagttactgaaataaagt

SEQ ID NO: 10009395 - DNA, 22 bp, Homo sapiens
acagcataatcacttctttctt

SEQ ID NO: 10009396 - DNA, 22 bp, Homo sapiens
acagcagtttagaggacagcca

SEQ ID NO: 10009397 - DNA, 22 bp, Homo sapiens
acagcatggataacaaggcact

SEQ ID NO: 10009398 - DNA, 22 bp, Homo sapiens
acagcattccctttggctgctt

SEQ ID NO: 10009399 - DNA, 22 bp, Homo sapiens
acagcattcaataaataataac

SEQ ID NO: 10009400 - DNA, 21 bp, Homo sapiens
acagcatgtttgtgtgtttgc

SEQ ID NO: 10009401 - DNA, 22 bp, Homo sapiens
acagcatttaaagaaaatgaac

SEQ ID NO: 10009402 - DNA, 22 bp, Homo sapiens
acagcatttaaagaaaatgaac

SEQ ID NO: 10009403 - DNA, 22 bp, Homo sapiens
acagcattgctccatctcaaga

SEQ ID NO: 10009404 - DNA, 22 bp, Homo sapiens
acagccagaggagccaggctgg

SEQ ID NO: 10009405 - DNA, 22 bp, Homo sapiens
acagccagaggagccaggctgg

SEQ ID NO: 10009406 - DNA, 22 bp, Homo sapiens
acagccaaggaattaggaaggg

SEQ ID NO: 10009407 - DNA, 22 bp, Homo sapiens
acaggatggagataatagaaaa

SEQ ID NO: 10009408 - DNA, 22 bp, Homo sapiens
acaggatgataaaggatggcca

SEQ ID NO: 10009409 - DNA, 22 bp, Homo sapiens
acaggatgataaaggatggcca

SEQ ID NO: 10009410 - DNA, 19 bp, Homo sapiens
agcttctttggaaacattt

SEQ ID NO: 10009411 - DNA, 22 bp, Homo sapiens
agcttcttgtagaactcaaaag

SEQ ID NO: 10009412 - DNA, 18 bp, Homo sapiens
aggaaagaaaggcaggtg

SEQ ID NO: 10009413 - DNA, 18 bp, Homo sapiens
aggaaagaaaggcaggtg

SEQ ID NO: 10009414 - DNA, 22 bp, Homo sapiens
aggaaagaagtacattctcatg

SEQ ID NO: 10009415 - DNA, 22 bp, Homo sapiens
acaggcaattagcaagctgtta

SEQ ID NO: 10009416 - DNA, 21 bp, Homo sapiens
acaggcaatttcatatggttc

SEQ ID NO: 10009417 - DNA, 23 bp, Homo sapiens
acaggcaataaagggagtctcca

SEQ ID NO: 10009418 - DNA, 22 bp, Homo sapiens
acaggcaaacacagaaagtagg

SEQ ID NO: 10009419 - DNA, 22 bp, Homo sapiens
acaggcaagtacacaggctcat

SEQ ID NO: 10009420 - DNA, 22 bp, Homo sapiens
acaggacaggtaggattcgcag

SEQ ID NO: 10009421 - DNA, 22 bp, Homo sapiens
acaggacaggctgggctagact

SEQ ID NO: 10009422 - DNA, 22 bp, Homo sapiens
acaggacagtctagtaacagta

SEQ ID NO: 10009423 - DNA, 22 bp, Homo sapiens
acaggacatggcttctgtgacg

SEQ ID NO: 10009424 - DNA, 22 bp, Homo sapiens
agcttcttgggctttacacaaa

SEQ ID NO: 10009425 - DNA, 22 bp, Homo sapiens
agcttcttggctcagcacttgg

SEQ ID NO: 10009426 - DNA, 22 bp, Homo sapiens
agcttcttgaccaagcctgtaa

SEQ ID NO: 10009427 - DNA, 22 bp, Homo sapiens
agcttcttgacggatgttctgg

SEQ ID NO: 10009428 - DNA, 22 bp, Homo sapiens
agcttcttctgatttgtcagtc

SEQ ID NO: 10009429 - DNA, 22 bp, Homo sapiens
agcttcttagttcacttttaat

SEQ ID NO: 10009430 - DNA, 22 bp, Homo sapiens
agcttcttccaggcagtgactc

SEQ ID NO: 10009431 - DNA, 22 bp, Homo sapiens
acaggagaaatctggtcaaaag

SEQ ID NO: 10009432 - DNA, 21 bp, Homo sapiens
agcttccagagcacattccat

SEQ ID NO: 10009433 - DNA, 22 bp, Homo sapiens
agcttccacatctgtcttcagt

SEQ ID NO: 10009434 - DNA, 22 bp, Homo sapiens
acagtgttcacttaacaatgga

SEQ ID NO: 10009435 - DNA, 22 bp, Homo sapiens
acagtgttcctttgttgtgact

SEQ ID NO: 10009436 - DNA, 22 bp, Homo sapiens
acagtgttcacttaacaatgga

SEQ ID NO: 10009437 - DNA, 22 bp, Homo sapiens
acagtgttcactaaggttagct

SEQ ID NO: 10009438 - DNA, 22 bp, Homo sapiens
acagtgttatttctgagtaatg

SEQ ID NO: 10009439 - DNA, 20 bp, Homo sapiens
acagtgttagttatcatctc

SEQ ID NO: 10009440 - DNA, 20 bp, Homo sapiens
acagtgttaggtttttcctt

SEQ ID NO: 10009441 - DNA, 22 bp, Homo sapiens
aggcactttttgcattttagaa

SEQ ID NO: 10009442 - DNA, 22 bp, Homo sapiens
aggcagaaaatagtcatccaaa

SEQ ID NO: 10009443 - DNA, 22 bp, Homo sapiens
acagtgttctgaaagttgaggg

SEQ ID NO: 10009444 - DNA, 22 bp, Homo sapiens
acagtgttacttgatagtgtat

SEQ ID NO: 10009445 - DNA, 22 bp, Homo sapiens
aggcacctcagctgagcctggg

SEQ ID NO: 10009446 - DNA, 22 bp, Homo sapiens
acagtggcctcaaagaaagaga

SEQ ID NO: 10009447 - DNA, 22 bp, Homo sapiens
acagtggagctcagatgaaaat

SEQ ID NO: 10009448 - DNA, 22 bp, Homo sapiens
acagtggaggccatatggtcct

SEQ ID NO: 10009449 - DNA, 22 bp, Homo sapiens
acagtggatatattaaatgaga

SEQ ID NO: 10009450 - DNA, 22 bp, Homo sapiens
acagtggagttggggtagccct

SEQ ID NO: 10009451 - DNA, 22 bp, Homo sapiens
acagtggaggccatatggtcct

SEQ ID NO: 10009452 - DNA, 22 bp, Homo sapiens
acagtggatgtgatgtccaggt

SEQ ID NO: 10009453 - DNA, 22 bp, Homo sapiens
acagtggatgtgatgtccaggt

SEQ ID NO: 10009454 - DNA, 22 bp, Homo sapiens
acagtggcagtattagggcaga

SEQ ID NO: 10009455 - DNA, 22 bp, Homo sapiens
acagtggatgacatccttttgc

SEQ ID NO: 10009456 - DNA, 22 bp, Homo sapiens
acagtggatgtgatgtccaggt

SEQ ID NO: 10009457 - DNA, 22 bp, Homo sapiens
acagtggatgtgatgtccaggt

SEQ ID NO: 10009458 - DNA, 22 bp, Homo sapiens
acagtggagaaggcatgaggct

SEQ ID NO: 10009459 - DNA, 22 bp, Homo sapiens
acagtggagaaggcatgaggct

SEQ ID NO: 10009460 - DNA, 22 bp, Homo sapiens
acagtggagaagcaaatgcagt

SEQ ID NO: 10009461 - DNA, 22 bp, Homo sapiens
acagtggaatggtgggcctgca

SEQ ID NO: 10009462 - DNA, 22 bp, Homo sapiens
acagtggaatttgtagatgtgt

SEQ ID NO: 10009463 - DNA, 22 bp, Homo sapiens
acagtggaagcatgatgctatc

SEQ ID NO: 10009464 - DNA, 22 bp, Homo sapiens
acagtggaagaagcactgaact

SEQ ID NO: 10009465 - DNA, 20 bp, Homo sapiens
acagtggaaattgatgtctg

SEQ ID NO: 10009466 - DNA, 20 bp, Homo sapiens
acagtggaaattgatgtctg

SEQ ID NO: 10009467 - DNA, 22 bp, Homo sapiens
acagtggaaatgtgggagggga

SEQ ID NO: 10009468 - DNA, 22 bp, Homo sapiens
acagtggaaatgtgggagggga

SEQ ID NO: 10009469 - DNA, 22 bp, Homo sapiens
acagtgcttagcacagagtaga

SEQ ID NO: 10009470 - DNA, 22 bp, Homo sapiens
acagtgcttctgatatgatgcc

SEQ ID NO: 10009471 - DNA, 19 bp, Homo sapiens
acagtgcttctgagtgagg

SEQ ID NO: 10009472 - DNA, 19 bp, Homo sapiens
acagtgcttctgagtgagg

SEQ ID NO: 10009473 - DNA, 19 bp, Homo sapiens
acagtgcttctgagtgagg

SEQ ID NO: 10009474 - DNA, 22 bp, Homo sapiens
acagtgcttggcacacagtaat

SEQ ID NO: 10009475 - DNA, 22 bp, Homo sapiens
acagtggaaagaacatggattt

SEQ ID NO: 10009476 - DNA, 22 bp, Homo sapiens
acagtggaaagaaacgaattag

SEQ ID NO: 10009477 - DNA, 22 bp, Homo sapiens
aggaggccgatttcagaggtcg

SEQ ID NO: 10009478 - DNA, 17 bp, Homo sapiens
aggaggccctggcgttt

SEQ ID NO: 10009479 - DNA, 22 bp, Homo sapiens
aggaggccctagagctctagag

SEQ ID NO: 10009480 - DNA, 22 bp, Homo sapiens
aggaggcagtctgtcccttagc

SEQ ID NO: 10009481 - DNA, 22 bp, Homo sapiens
aggaggcagtctgtcccttagc

SEQ ID NO: 10009482 - DNA, 22 bp, Homo sapiens
aggaggccaggccctcaagcct

SEQ ID NO: 10009483 - DNA, 22 bp, Homo sapiens
aggaggccaggccctcaagcct

SEQ ID NO: 10009484 - DNA, 19 bp, Homo sapiens
aggaggccatgccactaga

SEQ ID NO: 10009485 - DNA, 21 bp, Homo sapiens
aggaggccagtactgctgaac

SEQ ID NO: 10009486 - DNA, 22 bp, Homo sapiens
aggaggccctagagctctagag

SEQ ID NO: 10009487 - DNA, 22 bp, Homo sapiens
aggaggcccctcctgggttgct

SEQ ID NO: 10009488 - DNA, 21 bp, Homo sapiens
acagtgagaaataaatggaaa

SEQ ID NO: 10009489 - DNA, 17 bp, Homo sapiens
acagtgagaagtcatct

SEQ ID NO: 10009490 - DNA, 22 bp, Homo sapiens
acagtgaatgcccaagaaaagt

SEQ ID NO: 10009491 - DNA, 22 bp, Homo sapiens
acagtgaatgagaatggagaaa

SEQ ID NO: 10009492 - DNA, 22 bp, Homo sapiens
acagtgaatgagaatggagaaa

SEQ ID NO: 10009493 - DNA, 22 bp, Homo sapiens
acagtgaatgcccaagaaaagt

SEQ ID NO: 10009494 - DNA, 22 bp, Homo sapiens
acagtgaatgcccaagaaaagt

SEQ ID NO: 10009495 - DNA, 22 bp, Homo sapiens
acagtgacaacccaggataaat

SEQ ID NO: 10009496 - DNA, 22 bp, Homo sapiens
aggaggcaggaagtctatggga

SEQ ID NO: 10009497 - DNA, 22 bp, Homo sapiens
acagtgagcggtagtgattgct

SEQ ID NO: 10009498 - DNA, 22 bp, Homo sapiens
acagtgaatccaaattcctacc

SEQ ID NO: 10009499 - DNA, 22 bp, Homo sapiens
acagtgaataagacatgtgctt

SEQ ID NO: 10009500 - DNA, 23 bp, Homo sapiens
acagtgaaacacgcagtaagagt

SEQ ID NO: 10009501 - DNA, 23 bp, Homo sapiens
acagtgaaacacgcagtaagagt

SEQ ID NO: 10009502 - DNA, 22 bp, Homo sapiens
acagtgaaaagaatattagaat

SEQ ID NO: 10009503 - DNA, 22 bp, Homo sapiens
acagtgaaaagtagctaacaca

SEQ ID NO: 10009504 - DNA, 22 bp, Homo sapiens
acagtgaaaattctattgattt

SEQ ID NO: 10009505 - DNA, 22 bp, Homo sapiens
acagtgaaaattctattgattt

SEQ ID NO: 10009506 - DNA, 22 bp, Homo sapiens
acagtgaaaattctattgattt

SEQ ID NO: 10009507 - DNA, 22 bp, Homo sapiens
acagtgaaaataatatcttcaa

SEQ ID NO: 10009508 - DNA, 22 bp, Homo sapiens
acagtctggaagcagggggcaa

SEQ ID NO: 10009509 - DNA, 22 bp, Homo sapiens
acagtctggaggctgcttcatt

SEQ ID NO: 10009510 - DNA, 22 bp, Homo sapiens
acagtgaaaagaatattagaat

SEQ ID NO: 10009511 - DNA, 22 bp, Homo sapiens
acagtgaaaagaatattagaat

SEQ ID NO: 10009512 - DNA, 22 bp, Homo sapiens
aggcagtgtgggccaagcttcc

SEQ ID NO: 10009513 - DNA, 22 bp, Homo sapiens
aggcagtgtggagggctgttgc

SEQ ID NO: 10009514 - DNA, 23 bp, Homo sapiens
aggcagtgtctcttatcctgtcc

SEQ ID NO: 10009515 - DNA, 22 bp, Homo sapiens
aggcagtgtgtagctggaagag

SEQ ID NO: 10009516 - DNA, 22 bp, Homo sapiens
aggcagtgtgtagctggaagag

SEQ ID NO: 10009517 - DNA, 22 bp, Homo sapiens
aggcagtgtattgctagcggct

SEQ ID NO: 10009518 - DNA, 20 bp, Homo sapiens
aggcagtgtagagatgagta

SEQ ID NO: 10009519 - DNA, 20 bp, Homo sapiens
aggcagtgtagagatgagta

SEQ ID NO: 10009520 - DNA, 23 bp, Homo sapiens
aggcagtggtggtaacatgtcaa

SEQ ID NO: 10009521 - DNA, 22 bp, Homo sapiens
acatctttgctcttatagagct

SEQ ID NO: 10009522 - DNA, 22 bp, Homo sapiens
aggcagtggtgtttgctggtgg

SEQ ID NO: 10009523 - DNA, 23 bp, Homo sapiens
aggcagtggtggtaacatgtcaa

SEQ ID NO: 10009524 - DNA, 22 bp, Homo sapiens
acatctgttcttctcttgtccc

SEQ ID NO: 10009525 - DNA, 22 bp, Homo sapiens
acatctgtttgagaaaaagaag

SEQ ID NO: 10009526 - DNA, 22 bp, Homo sapiens
acatctgtttgagaaaaagaag

SEQ ID NO: 10009527 - DNA, 22 bp, Homo sapiens
acatctgtttgagaaaaagaag

SEQ ID NO: 10009528 - DNA, 22 bp, Homo sapiens
acatatatgtaaagtactttgt

SEQ ID NO: 10009529 - DNA, 22 bp, Homo sapiens
acatatatgtgcacatgtgcag

SEQ ID NO: 10009530 - DNA, 22 bp, Homo sapiens
acatatattactagtaaagaca

SEQ ID NO: 10009531 - DNA, 22 bp, Homo sapiens
acatatatgtaaagtactttgt

SEQ ID NO: 10009532 - DNA, 22 bp, Homo sapiens
acatatatgcgtgggctcatgg

SEQ ID NO: 10009533 - DNA, 22 bp, Homo sapiens
acatataagggatcagtgacag

SEQ ID NO: 10009534 - DNA, 22 bp, Homo sapiens
acatatattactagtaaagaca

SEQ ID NO: 10009535 - DNA, 22 bp, Homo sapiens
acatatattactagtaaagaca

SEQ ID NO: 10009536 - DNA, 22 bp, Homo sapiens
acatctcatgaatgataaatca

SEQ ID NO: 10009537 - DNA, 22 bp, Homo sapiens
acatctcatgaatgataaatca

SEQ ID NO: 10009538 - DNA, 18 bp, Homo sapiens
aggcaggtgctggaagtc

SEQ ID NO: 10009539 - DNA, 22 bp, Homo sapiens
aggcagcaatgaatgaaatgga

SEQ ID NO: 10009540 - DNA, 22 bp, Homo sapiens
aggcagcaagattatttaatcc

SEQ ID NO: 10009541 - DNA, 22 bp, Homo sapiens
aggcagcaaagaaatgatgctg

SEQ ID NO: 10009542 - DNA, 22 bp, Homo sapiens
aggcagatttaggagaaaagaa

SEQ ID NO: 10009543 - DNA, 22 bp, Homo sapiens
aggcagcaaagaaatgatgctg

SEQ ID NO: 10009544 - DNA, 22 bp, Homo sapiens
aggcagcaaatgtctggaacag

SEQ ID NO: 10009545 - DNA, 22 bp, Homo sapiens
aggcagcaaatgtctggaacag

SEQ ID NO: 10009546 - DNA, 22 bp, Homo sapiens
aggcagcaagattatttaatcc

SEQ ID NO: 10009547 - DNA, 22 bp, Homo sapiens
aggcaggtgttaaccctctgag

SEQ ID NO: 10009548 - DNA, 22 bp, Homo sapiens
aggcaggtgggtcacttgagtc

SEQ ID NO: 10009549 - DNA, 22 bp, Homo sapiens
aggcaggtgggtcacttgagtc

SEQ ID NO: 10009550 - DNA, 18 bp, Homo sapiens
aggcaggtgctggaagtc

SEQ ID NO: 10009551 - DNA, 22 bp, Homo sapiens
aggcaggtgttgggagacacca

SEQ ID NO: 10009552 - DNA, 22 bp, Homo sapiens
aggcaggtgttgggagacacca

SEQ ID NO: 10009553 - DNA, 22 bp, Homo sapiens
aggcagacaaggtccctggtct

SEQ ID NO: 10009554 - DNA, 22 bp, Homo sapiens
aggcagaccatgaatcatgacc

SEQ ID NO: 10009555 - DNA, 22 bp, Homo sapiens
aggcagaatgttggaaaggaag

SEQ ID NO: 10009556 - DNA, 22 bp, Homo sapiens
aggcagaagccagccagggtcc

SEQ ID NO: 10009557 - DNA, 21 bp, Homo sapiens
aggcagaaagagcccaggctg

SEQ ID NO: 10009558 - DNA, 22 bp, Homo sapiens
aggcagatggtaactgtgatat

SEQ ID NO: 10009559 - DNA, 22 bp, Homo sapiens
aggcagagaaaaaccagatatg

SEQ ID NO: 10009560 - DNA, 22 bp, Homo sapiens
agtcctgttggttccagaggtg

SEQ ID NO: 10009561 - DNA, 22 bp, Homo sapiens
agtcctgtgcaaatgcatctga

SEQ ID NO: 10009562 - DNA, 22 bp, Homo sapiens
actctggggtgatgtctctgag

SEQ ID NO: 10009563 - DNA, 20 bp, Homo sapiens
actctggggctcattagggg

SEQ ID NO: 10009564 - DNA, 22 bp, Homo sapiens
actctgggcccaccctcagagt

SEQ ID NO: 10009565 - DNA, 22 bp, Homo sapiens
actctgggccccaggtggagct

SEQ ID NO: 10009566 - DNA, 22 bp, Homo sapiens
actctgggccccaggtggagct

SEQ ID NO: 10009567 - DNA, 22 bp, Homo sapiens
actctgggctgttaggagctgt

SEQ ID NO: 10009568 - DNA, 22 bp, Homo sapiens
actctggggcgctactccaact

SEQ ID NO: 10009569 - DNA, 22 bp, Homo sapiens
agtccagccttcaatcttagtg

SEQ ID NO: 10009570 - DNA, 22 bp, Homo sapiens
agtccagagaggaggctgtgtg

SEQ ID NO: 10009571 - DNA, 22 bp, Homo sapiens
agtccagaccccggcagctggt

SEQ ID NO: 10009572 - DNA, 18 bp, Homo sapiens
actctgggacctgttatt

SEQ ID NO: 10009573 - DNA, 22 bp, Homo sapiens
actctgggatcttgaaaagagt

SEQ ID NO: 10009574 - DNA, 22 bp, Homo sapiens
actctgggatgagaaaagggtt

SEQ ID NO: 10009575 - DNA, 22 bp, Homo sapiens
actctgggcccaccctcagagt

SEQ ID NO: 10009576 - DNA, 22 bp, Homo sapiens
agtcagtggatttaccatgcgt

SEQ ID NO: 10009577 - DNA, 22 bp, Homo sapiens
agtcagtggctccgagcctggt

SEQ ID NO: 10009578 - DNA, 22 bp, Homo sapiens
agtcagtggctccgagcctggt

SEQ ID NO: 10009579 - DNA, 22 bp, Homo sapiens
agtcagtgggagaagtgtgaag

SEQ ID NO: 10009580 - DNA, 22 bp, Homo sapiens
agtcagtgggagaagtgtgaag

SEQ ID NO: 10009581 - DNA, 22 bp, Homo sapiens
agtcagtggctccgagcctggt

SEQ ID NO: 10009582 - DNA, 22 bp, Homo sapiens
agtcagtgtagaaagcccaggc

SEQ ID NO: 10009583 - DNA, 23 bp, Homo sapiens
agtcagtgtaagtttggaatgca

SEQ ID NO: 10009584 - DNA, 23 bp, Homo sapiens
agtcagtgtaagtttggaatgca

SEQ ID NO: 10009585 - DNA, 22 bp, Homo sapiens
agtcagtgaaaactagaatgtt

SEQ ID NO: 10009586 - DNA, 22 bp, Homo sapiens
agtcagtgaaaactagaatgtt

SEQ ID NO: 10009587 - DNA, 22 bp, Homo sapiens
agtcagtgaatggtgtatgcta

SEQ ID NO: 10009588 - DNA, 22 bp, Homo sapiens
agtcagtgaaggcattgctcaa

SEQ ID NO: 10009589 - DNA, 22 bp, Homo sapiens
agtaagtacctccacttgattg

SEQ ID NO: 10009590 - DNA, 22 bp, Homo sapiens
agtaagttttgatagcattagg

SEQ ID NO: 10009591 - DNA, 22 bp, Homo sapiens
agtcaggggttggacggggcca

SEQ ID NO: 10009592 - DNA, 22 bp, Homo sapiens
agtaacatgagtttttctaatg

SEQ ID NO: 10009593 - DNA, 22 bp, Homo sapiens
agtaagcaatagagtgagaatt

SEQ ID NO: 10009594 - DNA, 22 bp, Homo sapiens
agtaagattcttctgaaaaatt

SEQ ID NO: 10009595 - DNA, 22 bp, Homo sapiens
agtaactatgcttgagaatcag

SEQ ID NO: 10009596 - DNA, 23 bp, Homo sapiens
agtaacatgcaaataacagtctg

SEQ ID NO: 10009597 - DNA, 22 bp, Homo sapiens
agtaacatttagcttctcactg

SEQ ID NO: 10009598 - DNA, 22 bp, Homo sapiens
actcagagcttggctccttgct

SEQ ID NO: 10009599 - DNA, 22 bp, Homo sapiens
actcagaggaaagttgagattg

SEQ ID NO: 10009600 - DNA, 22 bp, Homo sapiens
actcagaggcagctgctcaccc

SEQ ID NO: 10009601 - DNA, 22 bp, Homo sapiens
actcagagtctgtttggtacct

SEQ ID NO: 10009602 - DNA, 20 bp, Homo sapiens
actcagatgctcacaacagg

SEQ ID NO: 10009603 - DNA, 22 bp, Homo sapiens
actcagctcaggagctggctgg

SEQ ID NO: 10009604 - DNA, 22 bp, Homo sapiens
agggtgagggtctggccttgag

SEQ ID NO: 10009605 - DNA, 22 bp, Homo sapiens
agggtgcaaaagcaaggacagt

SEQ ID NO: 10009606 - DNA, 23 bp, Homo sapiens
agggtgagcaagctatggagacc

SEQ ID NO: 10009607 - DNA, 23 bp, Homo sapiens
agggtgagcaagctatggagacc

SEQ ID NO: 10009608 - DNA, 23 bp, Homo sapiens
agggtgagcaagctatggagacc

SEQ ID NO: 10009609 - DNA, 22 bp, Homo sapiens
agggtgcaggtgtggagtctag

SEQ ID NO: 10009610 - DNA, 22 bp, Homo sapiens
agggtgcagaaggagcctagga

SEQ ID NO: 10009611 - DNA, 19 bp, Homo sapiens
agggtccagggagcggctc

SEQ ID NO: 10009612 - DNA, 22 bp, Homo sapiens
agggtccagtaacagatgccag

SEQ ID NO: 10009613 - DNA, 23 bp, Homo sapiens
agggtccagggatcaccaggtgt

SEQ ID NO: 10009614 - DNA, 22 bp, Homo sapiens
agggtcagttctgtgaggtgtt

SEQ ID NO: 10009615 - DNA, 22 bp, Homo sapiens
agggtcagtgatgagggagccc

SEQ ID NO: 10009616 - DNA, 18 bp, Homo sapiens
agggtcagtgtcactggc

SEQ ID NO: 10009617 - DNA, 22 bp, Homo sapiens
aggtgcaggagctgtgcaggga

SEQ ID NO: 10009618 - DNA, 21 bp, Homo sapiens
aggtgcaggcctcaagcccca

SEQ ID NO: 10009619 - DNA, 22 bp, Homo sapiens
aggtgcaggagctgtgcaggga

SEQ ID NO: 10009620 - DNA, 22 bp, Homo sapiens
aggtgcaggagctgtgcaggga

SEQ ID NO: 10009621 - DNA, 19 bp, Homo sapiens
aggtgcaggtcacagggga

SEQ ID NO: 10009622 - DNA, 22 bp, Homo sapiens
aggtgaggataggtggccaagg

SEQ ID NO: 10009623 - DNA, 22 bp, Homo sapiens
agggtgcagtcacaggaaatgt

SEQ ID NO: 10009624 - DNA, 22 bp, Homo sapiens
aggtgcagtgaaggaaaaggaa

SEQ ID NO: 10009625 - DNA, 23 bp, Homo sapiens
aggtgccaactgagagctgagag

SEQ ID NO: 10009626 - DNA, 22 bp, Homo sapiens
aggtgccagatgcacagctgaa

SEQ ID NO: 10009627 - DNA, 22 bp, Homo sapiens
aggtgccaattttcagtgaaca

SEQ ID NO: 10009628 - DNA, 21 bp, Homo sapiens
aggtgccaaggagaagcaggc

SEQ ID NO: 10009629 - DNA, 22 bp, Homo sapiens
aggtgccacctctggtgctgtc

SEQ ID NO: 10009630 - DNA, 22 bp, Homo sapiens
aggtgccactctcatgggctac

SEQ ID NO: 10009631 - DNA, 22 bp, Homo sapiens
aggttcccaggatctgtctggg

SEQ ID NO: 10009632 - DNA, 22 bp, Homo sapiens
aggttcccaggatctgtctggg

SEQ ID NO: 10009633 - DNA, 22 bp, Homo sapiens
aggttcccagagatagagctgt

SEQ ID NO: 10009634 - DNA, 22 bp, Homo sapiens
aggttccagggattaggatgtg

SEQ ID NO: 10009635 - DNA, 22 bp, Homo sapiens
aggtgtccaatcctggttggat

SEQ ID NO: 10009636 - DNA, 22 bp, Homo sapiens
aggtggtgtttggttacatgag

SEQ ID NO: 10009637 - DNA, 20 bp, Homo sapiens
aggtgtccacgtggcagggt

SEQ ID NO: 10009638 - DNA, 20 bp, Homo sapiens
aggtgtccacgtggcagggt

SEQ ID NO: 10009639 - DNA, 23 bp, Homo sapiens
aggttctcttatcatctctgccc

SEQ ID NO: 10009640 - DNA, 22 bp, Homo sapiens
aggttctggcattgctcagtaa

SEQ ID NO: 10009641 - DNA, 22 bp, Homo sapiens
aggttccttatggggatggcta

SEQ ID NO: 10009642 - DNA, 22 bp, Homo sapiens
aggttccttatggggatggcta

SEQ ID NO: 10009643 - DNA, 20 bp, Homo sapiens
aggttcctttgtggagaatt

SEQ ID NO: 10009644 - DNA, 22 bp, Homo sapiens
actcacatttcatcaggccaag

SEQ ID NO: 10009645 - DNA, 22 bp, Homo sapiens
actcacagggcctcagttttcc

SEQ ID NO: 10009646 - DNA, 22 bp, Homo sapiens
actcagagcctcgagggactgc

SEQ ID NO: 10009647 - DNA, 22 bp, Homo sapiens
aggtggaacgttcaggtgctag

SEQ ID NO: 10009648 - DNA, 22 bp, Homo sapiens
aggtggagaagagatgggcagt

SEQ ID NO: 10009649 - DNA, 22 bp, Homo sapiens
aggtggagaagagatgggcagt

SEQ ID NO: 10009650 - DNA, 22 bp, Homo sapiens
aggtggagacccagagaaggcg

SEQ ID NO: 10009651 - DNA, 16 bp, Homo sapiens
aggtggagaagttcac

SEQ ID NO: 10009652 - DNA, 22 bp, Homo sapiens
aggtggagacccagagaaggcg

SEQ ID NO: 10009653 - DNA, 22 bp, Homo sapiens
aggtggagacccagagaaggcg

SEQ ID NO: 10009654 - DNA, 22 bp, Homo sapiens
aggtggggttcagtctcagccg

SEQ ID NO: 10009655 - DNA, 22 bp, Homo sapiens
agtgctttccttcttgtgacat

SEQ ID NO: 10009656 - DNA, 22 bp, Homo sapiens
agtgcttcttaaacctttctac

SEQ ID NO: 10009657 - DNA, 22 bp, Homo sapiens
agtgcttctggtgggcgtgagg

SEQ ID NO: 10009658 - DNA, 22 bp, Homo sapiens
agtgctttgagcgtttgaaaag

SEQ ID NO: 10009659 - DNA, 22 bp, Homo sapiens
agtggcagacacaatgtgggca

SEQ ID NO: 10009660 - DNA, 22 bp, Homo sapiens
agtggcagagcaggtgctggaa

SEQ ID NO: 10009661 - DNA, 22 bp, Homo sapiens
agtggcagacacaatgtgggca

SEQ ID NO: 10009662 - DNA, 22 bp, Homo sapiens
agtgggagcggcagtcggggac

SEQ ID NO: 10009663 - DNA, 22 bp, Homo sapiens
agtgggagccagcagcttgggg

SEQ ID NO: 10009664 - DNA, 22 bp, Homo sapiens
agtgggagccagcagcttgggg

SEQ ID NO: 10009665 - DNA, 22 bp, Homo sapiens
agtggggccgcggtcctgccct

SEQ ID NO: 10009666 - DNA, 22 bp, Homo sapiens
agtggggccgcggtcctgccct

SEQ ID NO: 10009667 - DNA, 22 bp, Homo sapiens
agtgggaggcggctgacgggcg

SEQ ID NO: 10009668 - DNA, 22 bp, Homo sapiens
agtggctggaattgcaggtgcg

SEQ ID NO: 10009669 - DNA, 22 bp, Homo sapiens
agtggcagagccaagatatgat

SEQ ID NO: 10009670 - DNA, 22 bp, Homo sapiens
agtggcagagccaagtagagcc

SEQ ID NO: 10009671 - DNA, 22 bp, Homo sapiens
agtgggagccagcagcttgggg

SEQ ID NO: 10009672 - DNA, 20 bp, Homo sapiens
agtgggagagggcagactgc

SEQ ID NO: 10009673 - DNA, 20 bp, Homo sapiens
agtgggagagggcagactgc

SEQ ID NO: 10009674 - DNA, 22 bp, Homo sapiens
agtgctgtccagtttcacaggt

SEQ ID NO: 10009675 - DNA, 22 bp, Homo sapiens
agtgctgtcccgacaactgagg

SEQ ID NO: 10009676 - DNA, 22 bp, Homo sapiens
agtgctgtctccttcccccggg

SEQ ID NO: 10009677 - DNA, 22 bp, Homo sapiens
agtgctgtccagtttcacaggt

SEQ ID NO: 10009678 - DNA, 23 bp, Homo sapiens
agtgctgaattgaaagctccagg

SEQ ID NO: 10009679 - DNA, 22 bp, Homo sapiens
agtgctgaagactggctaggga

SEQ ID NO: 10009680 - DNA, 20 bp, Homo sapiens
agtgcaagaaagcacagctg

SEQ ID NO: 10009681 - DNA, 22 bp, Homo sapiens
agtgcaaagggctgttgagaag

SEQ ID NO: 10009682 - DNA, 22 bp, Homo sapiens
agtgcaaagaaatcagctttgt

SEQ ID NO: 10009683 - DNA, 22 bp, Homo sapiens
agtgcaaactttattgtgacct

SEQ ID NO: 10009684 - DNA, 22 bp, Homo sapiens
agtgcaaaattcagaagcaatt

SEQ ID NO: 10009685 - DNA, 22 bp, Homo sapiens
agtgattttatcaatttactca

SEQ ID NO: 10009686 - DNA, 22 bp, Homo sapiens
agtgatttggcggcagagttag

SEQ ID NO: 10009687 - DNA, 22 bp, Homo sapiens
agtgaggaaatccattatcaag

SEQ ID NO: 10009688 - DNA, 17 bp, Homo sapiens
agtgaggagattggaag

SEQ ID NO: 10009689 - DNA, 22 bp, Homo sapiens
agtgaggataccaatgtgtaga

SEQ ID NO: 10009690 - DNA, 20 bp, Homo sapiens
agtgaggcagttcagtgggc

SEQ ID NO: 10009691 - DNA, 23 bp, Homo sapiens
agtgagcagctgtagggcaagga

SEQ ID NO: 10009692 - DNA, 19 bp, Homo sapiens
agtgagcatccagagaggt

SEQ ID NO: 10009693 - DNA, 22 bp, Homo sapiens
agtgagcattcgtttggaaccc

SEQ ID NO: 10009694 - DNA, 22 bp, Homo sapiens
agtcctttgctgaactgtcaca

SEQ ID NO: 10009695 - DNA, 22 bp, Homo sapiens
agtccttttgttttgagatgag

SEQ ID NO: 10009696 - DNA, 22 bp, Homo sapiens
agtcctttgggaaaaatgacta

SEQ ID NO: 10009697 - DNA, 22 bp, Homo sapiens
actggggcagtgggcagtggtt

SEQ ID NO: 10009698 - DNA, 22 bp, Homo sapiens
actggggcaggaaagtatgctg

SEQ ID NO: 10009699 - DNA, 22 bp, Homo sapiens
actggggagttgaagcactttc

SEQ ID NO: 10009700 - DNA, 22 bp, Homo sapiens
actgggtgtaaaggacttaagc

SEQ ID NO: 10009701 - DNA, 22 bp, Homo sapiens
actgggtggctgcctccttctc

SEQ ID NO: 10009702 - DNA, 22 bp, Homo sapiens
actggggcctcctccatgctct

SEQ ID NO: 10009703 - DNA, 22 bp, Homo sapiens
actggtaacaatggaagcttct

SEQ ID NO: 10009704 - DNA, 22 bp, Homo sapiens
agttacaaacactatcagttct

SEQ ID NO: 10009705 - DNA, 22 bp, Homo sapiens
agttacaaccatgacacaagca

SEQ ID NO: 10009706 - DNA, 22 bp, Homo sapiens
agttacaaacactatcagttct

SEQ ID NO: 10009707 - DNA, 22 bp, Homo sapiens
agttcaagcaatgctggaagaa

SEQ ID NO: 10009708 - DNA, 22 bp, Homo sapiens
agttcaaagctgcagtaatgga

SEQ ID NO: 10009709 - DNA, 22 bp, Homo sapiens
agttcaattgttttgtaaaagt

SEQ ID NO: 10009710 - DNA, 22 bp, Homo sapiens
agttcaatagaaaaatatatta

SEQ ID NO: 10009711 - DNA, 22 bp, Homo sapiens
agttcaaactctataagaactt

SEQ ID NO: 10009712 - DNA, 22 bp, Homo sapiens
agttcaaagctgcagtaatgga

SEQ ID NO: 10009713 - DNA, 20 bp, Homo sapiens
agttactaagtgctggaacc

SEQ ID NO: 10009714 - DNA, 19 bp, Homo sapiens
agttatttctaaatttacc

SEQ ID NO: 10009715 - DNA, 22 bp, Homo sapiens
agttattttggaaaatgagtca

SEQ ID NO: 10009716 - DNA, 22 bp, Homo sapiens
agttattttggaaaatgagtca

SEQ ID NO: 10009717 - DNA, 22 bp, Homo sapiens
agttattttacatggaagtttg

SEQ ID NO: 10009718 - DNA, 19 bp, Homo sapiens
agttatttctaaatttacc

SEQ ID NO: 10009719 - DNA, 22 bp, Homo sapiens
agttacaaccatgacacaagca

SEQ ID NO: 10009720 - DNA, 22 bp, Homo sapiens
agttacaaccatgacacaagca

SEQ ID NO: 10009721 - DNA, 22 bp, Homo sapiens
agttacaaacactatcagttct

SEQ ID NO: 10009722 - DNA, 22 bp, Homo sapiens
agttacaaccatgacacaagca

SEQ ID NO: 10009723 - DNA, 21 bp, Homo sapiens
agttacaagtttattcagagg

SEQ ID NO: 10009724 - DNA, 22 bp, Homo sapiens
agttacaagctattttacttaa

SEQ ID NO: 10009725 - DNA, 22 bp, Homo sapiens
agttacaagtacaggctttgga

SEQ ID NO: 10009726 - DNA, 22 bp, Homo sapiens
agttacacataaacattaaagg

SEQ ID NO: 10009727 - DNA, 22 bp, Homo sapiens
agttacatataagaagacagac

SEQ ID NO: 10009728 - DNA, 21 bp, Homo sapiens
agttacatgtatagataaagt

SEQ ID NO: 10009729 - DNA, 22 bp, Homo sapiens
agtgtctttatagactgacaat

SEQ ID NO: 10009730 - DNA, 22 bp, Homo sapiens
agtgtctttagcaagtttagtc

SEQ ID NO: 10009731 - DNA, 22 bp, Homo sapiens
agtgtcttacatgaattgattt

SEQ ID NO: 10009732 - DNA, 22 bp, Homo sapiens
agtgtctgttgcttttgcagtg

SEQ ID NO: 10009733 - DNA, 22 bp, Homo sapiens
agtgtctgttgttcagaactct

SEQ ID NO: 10009734 - DNA, 22 bp, Homo sapiens
agtgtgtaagggatcaaagagt

SEQ ID NO: 10009735 - DNA, 22 bp, Homo sapiens
agtgtgtacataattgtacgcc

SEQ ID NO: 10009736 - DNA, 22 bp, Homo sapiens
agtgtggtcgggagcgcggggc

SEQ ID NO: 10009737 - DNA, 17 bp, Homo sapiens
agtgtgtgaaatggtgg

SEQ ID NO: 10009738 - DNA, 17 bp, Homo sapiens
agtgtgtgaaatggtgg

SEQ ID NO: 10009739 - DNA, 17 bp, Homo sapiens
agtgtgtgaaatggtgg

SEQ ID NO: 10009740 - DNA, 22 bp, Homo sapiens
agtgtgtcttatcctgggagaa

SEQ ID NO: 10009741 - DNA, 17 bp, Homo sapiens
agtgtgtgaaatggtgg

SEQ ID NO: 10009742 - DNA, 22 bp, Homo sapiens
agtgtgtgaccttttaatttaa

SEQ ID NO: 10009743 - DNA, 22 bp, Homo sapiens
agtgtgtacataattgtacgcc

SEQ ID NO: 10009744 - DNA, 19 bp, Homo sapiens
agtgtgtactgaaagcact

SEQ ID NO: 10009745 - DNA, 22 bp, Homo sapiens
agtgtgtcagttgaaagagatt

SEQ ID NO: 10009746 - DNA, 22 bp, Homo sapiens
agtgtgtccagaaatctgtatt

SEQ ID NO: 10009747 - DNA, 22 bp, Homo sapiens
agtgtgtcgagggagggtccag

SEQ ID NO: 10009748 - DNA, 22 bp, Homo sapiens
agtgtgtccaggaagcagatgg

SEQ ID NO: 10009749 - DNA, 22 bp, Homo sapiens
agtgtgtctgatcacttgtgag

SEQ ID NO: 10009750 - DNA, 20 bp, Homo sapiens
agtgtgtctcggaggtaagt

SEQ ID NO: 10009751 - DNA, 22 bp, Homo sapiens
agtgggggccaacgagggcagc

SEQ ID NO: 10009752 - DNA, 22 bp, Homo sapiens
agtgggggctggctctgtctgt

SEQ ID NO: 10009753 - DNA, 22 bp, Homo sapiens
agtgggggcagagcctctctcg

SEQ ID NO: 10009754 - DNA, 22 bp, Homo sapiens
agtggggcggacaggaccagga

SEQ ID NO: 10009755 - DNA, 22 bp, Homo sapiens
agtggggccggtgaggccgagg

SEQ ID NO: 10009756 - DNA, 22 bp, Homo sapiens
agtgtctgaaccaccggggcat

SEQ ID NO: 10009757 - DNA, 22 bp, Homo sapiens
agtgtctgaaccaccggggcat

SEQ ID NO: 10009758 - DNA, 22 bp, Homo sapiens
agtgtctgaacctgcagtggga

SEQ ID NO: 10009759 - DNA, 22 bp, Homo sapiens
agtgtctggtgagggctctctc

SEQ ID NO: 10009760 - DNA, 20 bp, Homo sapiens
agtgtctggtgcagggcctc

SEQ ID NO: 10009761 - DNA, 20 bp, Homo sapiens
agtgtctggtgcagggcctc

SEQ ID NO: 10009762 - DNA, 22 bp, Homo sapiens
agtgtctggtgagggctctctc

SEQ ID NO: 10009763 - DNA, 22 bp, Homo sapiens
agtgtctgtgatgaggtcagga

SEQ ID NO: 10009764 - DNA, 22 bp, Homo sapiens
agtgtctgtgaggggaattcct

SEQ ID NO: 10009765 - DNA, 22 bp, Homo sapiens
agtgtctgtgttttctattgct

SEQ ID NO: 10009766 - DNA, 22 bp, Homo sapiens
agtgtctgttacgcttgcagaa

SEQ ID NO: 10009767 - DNA, 22 bp, Homo sapiens
agtgtctgttgagtttcaaaag

SEQ ID NO: 10009768 - DNA, 22 bp, Homo sapiens
agtgtctgtgatgaggtcagga

SEQ ID NO: 10009769 - DNA, 22 bp, Homo sapiens
agtgtctgtgatgaggtcagga

SEQ ID NO: 10009770 - DNA, 22 bp, Homo sapiens
agtgtctgtgttttctattgct

SEQ ID NO: 10009771 - DNA, 22 bp, Homo sapiens
agtgtctgtgctttgcagcaaa

SEQ ID NO: 10009772 - DNA, 22 bp, Homo sapiens
atattaattatttacacatgag

SEQ ID NO: 10009773 - DNA, 22 bp, Homo sapiens
agaaagtttgtttttatccata

SEQ ID NO: 10009774 - DNA, 22 bp, Homo sapiens
agaaagttttgtgctatatatg

SEQ ID NO: 10009775 - DNA, 22 bp, Homo sapiens
agaaagttttgtgctatatatg

SEQ ID NO: 10009776 - DNA, 22 bp, Homo sapiens
agaaatatgctgattagatgaa

SEQ ID NO: 10009777 - DNA, 22 bp, Homo sapiens
agaaatcagaaccctgaagttc

SEQ ID NO: 10009778 - DNA, 22 bp, Homo sapiens
agaaatcacttagaggaagtga

SEQ ID NO: 10009779 - DNA, 22 bp, Homo sapiens
agaaatcacttagaggaagtga

SEQ ID NO: 10009780 - DNA, 22 bp, Homo sapiens
agaaatcacttagaggaagtga

SEQ ID NO: 10009781 - DNA, 22 bp, Homo sapiens
agaaatcacttaatgaacgtag

SEQ ID NO: 10009782 - DNA, 22 bp, Homo sapiens
agaaatcacaggaggcagaagg

SEQ ID NO: 10009783 - DNA, 22 bp, Homo sapiens
agaaatcacaggaggcagaagg

SEQ ID NO: 10009784 - DNA, 22 bp, Homo sapiens
agaaatcaatatctatatgttg

SEQ ID NO: 10009785 - DNA, 20 bp, Homo sapiens
agaaatattgagttcagagg

SEQ ID NO: 10009786 - DNA, 22 bp, Homo sapiens
agaaatctttcctgaagtgttt

SEQ ID NO: 10009787 - DNA, 22 bp, Homo sapiens
agaaatcttggagtctgtggta

SEQ ID NO: 10009788 - DNA, 22 bp, Homo sapiens
atcaatgcttgccaaatggaag

SEQ ID NO: 10009789 - DNA, 22 bp, Homo sapiens
atcaattttgaggatacaagaa

SEQ ID NO: 10009790 - DNA, 22 bp, Homo sapiens
atcaagcatatataaaactgca

SEQ ID NO: 10009791 - DNA, 22 bp, Homo sapiens
atcaagcacttctacatgacat

SEQ ID NO: 10009792 - DNA, 22 bp, Homo sapiens
atcaagcatatataaaactgca

SEQ ID NO: 10009793 - DNA, 22 bp, Homo sapiens
atcaagctggcatatgtagttc

SEQ ID NO: 10009794 - DNA, 22 bp, Homo sapiens
atcaagaattgggagctattga

SEQ ID NO: 10009795 - DNA, 22 bp, Homo sapiens
atcaagagtattgacaagacca

SEQ ID NO: 10009796 - DNA, 22 bp, Homo sapiens
atcaagagttatatttcatagt

SEQ ID NO: 10009797 - DNA, 22 bp, Homo sapiens
atcaagagttatatttcatagt

SEQ ID NO: 10009798 - DNA, 22 bp, Homo sapiens
atcaagtgaagggctcttgaag

SEQ ID NO: 10009799 - DNA, 22 bp, Homo sapiens
atcaagttctgtcacatttgtc

SEQ ID NO: 10009800 - DNA, 22 bp, Homo sapiens
atcaagttttcttagttgactg

SEQ ID NO: 10009801 - DNA, 22 bp, Homo sapiens
atcaatatcagatcagacagga

SEQ ID NO: 10009802 - DNA, 22 bp, Homo sapiens
atcaatatcagatcagacagga

SEQ ID NO: 10009803 - DNA, 22 bp, Homo sapiens
atcaatgctctgtacccagaat

SEQ ID NO: 10009804 - DNA, 22 bp, Homo sapiens
agaaagaacgttggttatctta

SEQ ID NO: 10009805 - DNA, 22 bp, Homo sapiens
agaaagaacgttggttatctta

SEQ ID NO: 10009806 - DNA, 22 bp, Homo sapiens
agaaagacaaaatgcagtggct

SEQ ID NO: 10009807 - DNA, 22 bp, Homo sapiens
agaaagaacgcacttgtgctgc

SEQ ID NO: 10009808 - DNA, 22 bp, Homo sapiens
agaaagaacgcacttgtgctgc

SEQ ID NO: 10009809 - DNA, 17 bp, Homo sapiens
agaaagaggatccacag

SEQ ID NO: 10009810 - DNA, 17 bp, Homo sapiens
agaaagaggatccacag

SEQ ID NO: 10009811 - DNA, 22 bp, Homo sapiens
agaaagacgtgatgaagaagta

SEQ ID NO: 10009812 - DNA, 22 bp, Homo sapiens
agaaagagctcgggattaacag

SEQ ID NO: 10009813 - DNA, 22 bp, Homo sapiens
agaaagagctcgggattaacag

SEQ ID NO: 10009814 - DNA, 22 bp, Homo sapiens
agaaagagctcgggattaacag

SEQ ID NO: 10009815 - DNA, 22 bp, Homo sapiens
atattaatgggatttagtcagg

SEQ ID NO: 10009816 - DNA, 22 bp, Homo sapiens
atattaatgggatttagtcagg

SEQ ID NO: 10009817 - DNA, 22 bp, Homo sapiens
atattaaatggattttgggagc

SEQ ID NO: 10009818 - DNA, 22 bp, Homo sapiens
atattaaatggattttgggagc

SEQ ID NO: 10009819 - DNA, 22 bp, Homo sapiens
atattaaaactatggttttcag

SEQ ID NO: 10009820 - DNA, 22 bp, Homo sapiens
atattaaaactatggttttcag

SEQ ID NO: 10009821 - DNA, 22 bp, Homo sapiens
atattaaaactatggttttcag

SEQ ID NO: 10009822 - DNA, 22 bp, Homo sapiens
atattaaatggattttgggagc

SEQ ID NO: 10009823 - DNA, 22 bp, Homo sapiens
atattaagatgctattggtttt

SEQ ID NO: 10009824 - DNA, 22 bp, Homo sapiens
atattaatgagcaagtaagtga

SEQ ID NO: 10009825 - DNA, 22 bp, Homo sapiens
atatagtttaagaaagtacagt

SEQ ID NO: 10009826 - DNA, 22 bp, Homo sapiens
atatagttgggtttcattctac

SEQ ID NO: 10009827 - DNA, 22 bp, Homo sapiens
atatagtcaaacatatatgtgt

SEQ ID NO: 10009828 - DNA, 22 bp, Homo sapiens
atatagtcacactttgcaggca

SEQ ID NO: 10009829 - DNA, 22 bp, Homo sapiens
atatagtcaaacatatatgtgt

SEQ ID NO: 10009830 - DNA, 22 bp, Homo sapiens
atatagtttaagaaagtacagt

SEQ ID NO: 10009831 - DNA, 20 bp, Homo sapiens
agaaacatttcttgagaact

SEQ ID NO: 10009832 - DNA, 22 bp, Homo sapiens
agaaactgcagctcagagaagt

SEQ ID NO: 10009833 - DNA, 22 bp, Homo sapiens
agaaactgcagctcagagaagt

SEQ ID NO: 10009834 - DNA, 21 bp, Homo sapiens
agaaactgactcctagaggca

SEQ ID NO: 10009835 - DNA, 22 bp, Homo sapiens
agaaacttcagctattcttttg

SEQ ID NO: 10009836 - DNA, 22 bp, Homo sapiens
agaaacttcagctattcttttg

SEQ ID NO: 10009837 - DNA, 22 bp, Homo sapiens
agaaaagggcaggagggataca

SEQ ID NO: 10009838 - DNA, 22 bp, Homo sapiens
agaaaagggcaggagggataca

SEQ ID NO: 10009839 - DNA, 22 bp, Homo sapiens
atatacttttcactaatggcta

SEQ ID NO: 10009840 - DNA, 22 bp, Homo sapiens
atatagaaggtgctatttacat

SEQ ID NO: 10009841 - DNA, 22 bp, Homo sapiens
atatagaatacacagggaaagt

SEQ ID NO: 10009842 - DNA, 22 bp, Homo sapiens
atatagagtaattatttggtgt

SEQ ID NO: 10009843 - DNA, 22 bp, Homo sapiens
atataggttatcatatttgccc

SEQ ID NO: 10009844 - DNA, 22 bp, Homo sapiens
atatagtaagcagtctgtaaat

SEQ ID NO: 10009845 - DNA, 22 bp, Homo sapiens
atatagtatgtcctccagaatt

SEQ ID NO: 10009846 - DNA, 22 bp, Homo sapiens
agaaatgtttatggctgcctat

SEQ ID NO: 10009847 - DNA, 22 bp, Homo sapiens
agaaatgttgaatacacaaaat

SEQ ID NO: 10009848 - DNA, 22 bp, Homo sapiens
agaaatgttgaatacatcagga

SEQ ID NO: 10009849 - DNA, 22 bp, Homo sapiens
agaagcagggcagggaaaagca

SEQ ID NO: 10009850 - DNA, 22 bp, Homo sapiens
agaagcagggcagggaaaagca

SEQ ID NO: 10009851 - DNA, 22 bp, Homo sapiens
agaagcactagagggtatggaa

SEQ ID NO: 10009852 - DNA, 22 bp, Homo sapiens
agaagcagttattttttgcaca

SEQ ID NO: 10009853 - DNA, 22 bp, Homo sapiens
agaagccaaatgccagtgacct

SEQ ID NO: 10009854 - DNA, 20 bp, Homo sapiens
agaagcattcaaagaaaact

SEQ ID NO: 10009855 - DNA, 22 bp, Homo sapiens
agaaatgtgagccccttatcaa

SEQ ID NO: 10009856 - DNA, 22 bp, Homo sapiens
agaaatgtggaggaacagggct

SEQ ID NO: 10009857 - DNA, 20 bp, Homo sapiens
agaaatgtgaaaggctgagt

SEQ ID NO: 10009858 - DNA, 20 bp, Homo sapiens
agaaatgtgaaaggctgagt

SEQ ID NO: 10009859 - DNA, 22 bp, Homo sapiens
agaaatgtggatcgttttaaaa

SEQ ID NO: 10009860 - DNA, 22 bp, Homo sapiens
agaaatgttacagttgttattt

SEQ ID NO: 10009861 - DNA, 22 bp, Homo sapiens
agaaatgttgaatacacaaaat

SEQ ID NO: 10009862 - DNA, 22 bp, Homo sapiens
agaaatgtcaggaaagaagtcc

SEQ ID NO: 10009863 - DNA, 22 bp, Homo sapiens
agaaatgtcaggaaagaagtcc

SEQ ID NO: 10009864 - DNA, 21 bp, Homo sapiens
agaaatgtatcattcttttcc

SEQ ID NO: 10009865 - DNA, 22 bp, Homo sapiens
agaaatgctcttcctgaccaga

SEQ ID NO: 10009866 - DNA, 22 bp, Homo sapiens
agaaatggaaatccaagcaact

SEQ ID NO: 10009867 - DNA, 22 bp, Homo sapiens
agaaatggtgagtgagagcccc

SEQ ID NO: 10009868 - DNA, 22 bp, Homo sapiens
agaaatgtaattgcaactgtct

SEQ ID NO: 10009869 - DNA, 22 bp, Homo sapiens
agaagccatagtctgggaggca

SEQ ID NO: 10009870 - DNA, 21 bp, Homo sapiens
agaagccatgccagtaaaatt

SEQ ID NO: 10009871 - DNA, 22 bp, Homo sapiens
agaagccatggtatgcaactac

SEQ ID NO: 10009872 - DNA, 21 bp, Homo sapiens
agaagccatgtggtggagaac

SEQ ID NO: 10009873 - DNA, 21 bp, Homo sapiens
agaagccatgtggtggagaac

SEQ ID NO: 10009874 - DNA, 22 bp, Homo sapiens
agaagccatagtatctcagggt

SEQ ID NO: 10009875 - DNA, 22 bp, Homo sapiens
agaagccatagtctgggaggca

SEQ ID NO: 10009876 - DNA, 22 bp, Homo sapiens
atcctgggaagtggcctcctcc

SEQ ID NO: 10009877 - DNA, 22 bp, Homo sapiens
agaagccaccagctgaggaaga

SEQ ID NO: 10009878 - DNA, 22 bp, Homo sapiens
atcctgggaagctgacattgaa

SEQ ID NO: 10009879 - DNA, 22 bp, Homo sapiens
atcctgcttgttacttatagag

SEQ ID NO: 10009880 - DNA, 20 bp, Homo sapiens
atcctggaatccaaatggag

SEQ ID NO: 10009881 - DNA, 22 bp, Homo sapiens
atcctgagttcctgcctctaaa

SEQ ID NO: 10009882 - DNA, 22 bp, Homo sapiens
atcctgagttctcagagtctcc

SEQ ID NO: 10009883 - DNA, 22 bp, Homo sapiens
atcctgagttcctgcctctaaa

SEQ ID NO: 10009884 - DNA, 23 bp, Homo sapiens
atcctgctgatggccctccagga

SEQ ID NO: 10009885 - DNA, 22 bp, Homo sapiens
atcctgctgctgtggacttctc

SEQ ID NO: 10009886 - DNA, 22 bp, Homo sapiens
agaagctaattcatgtcttatg

SEQ ID NO: 10009887 - DNA, 22 bp, Homo sapiens
agaagctgacagatgcagcagg

SEQ ID NO: 10009888 - DNA, 20 bp, Homo sapiens
agaagctgatactgatggaa

SEQ ID NO: 10009889 - DNA, 20 bp, Homo sapiens
atctgcttgcctgtcctcgg

SEQ ID NO: 10009890 - DNA, 22 bp, Homo sapiens
atctgcttttgagaatttactt

SEQ ID NO: 10009891 - DNA, 22 bp, Homo sapiens
agaagctgcctacatgaccagc

SEQ ID NO: 10009892 - DNA, 22 bp, Homo sapiens
agaagcctcatcctctctagtg

SEQ ID NO: 10009893 - DNA, 21 bp, Homo sapiens
agaagccatttgttaggactt

SEQ ID NO: 10009894 - DNA, 21 bp, Homo sapiens
agaagcctggggaatgtggct

SEQ ID NO: 10009895 - DNA, 21 bp, Homo sapiens
agaagcctgggtggaggtggg

SEQ ID NO: 10009896 - DNA, 22 bp, Homo sapiens
agaagcctgttgagagggccgt

SEQ ID NO: 10009897 - DNA, 21 bp, Homo sapiens
agaagcctgatgaggtctgct

SEQ ID NO: 10009898 - DNA, 18 bp, Homo sapiens
agaagcctgcctcaatgc

SEQ ID NO: 10009899 - DNA, 22 bp, Homo sapiens
agaagccattctcagttcctga

SEQ ID NO: 10009900 - DNA, 22 bp, Homo sapiens
agaagccatgtttagtaggatg

SEQ ID NO: 10009901 - DNA, 22 bp, Homo sapiens
agaagccattccctgtaggctc

SEQ ID NO: 10009902 - DNA, 22 bp, Homo sapiens
agaagccatgtttagtaggatg

SEQ ID NO: 10009903 - DNA, 22 bp, Homo sapiens
agaagccatgtttagtaggatg

SEQ ID NO: 10009904 - DNA, 22 bp, Homo sapiens
atacacagccattatgaattag

SEQ ID NO: 10009905 - DNA, 22 bp, Homo sapiens
atacacactgctatcctttttt

SEQ ID NO: 10009906 - DNA, 22 bp, Homo sapiens
atacacagctacattgaacaat

SEQ ID NO: 10009907 - DNA, 22 bp, Homo sapiens
atacacagctacattgaacaat

SEQ ID NO: 10009908 - DNA, 22 bp, Homo sapiens
atacacagcgatgagaggaggc

SEQ ID NO: 10009909 - DNA, 20 bp, Homo sapiens
atacacattcatagaaaaat

SEQ ID NO: 10009910 - DNA, 22 bp, Homo sapiens
atacacatttgctagagatggg

SEQ ID NO: 10009911 - DNA, 22 bp, Homo sapiens
atacactaatcatgtgctcagt

SEQ ID NO: 10009912 - DNA, 22 bp, Homo sapiens
atacactactaagcacagattg

SEQ ID NO: 10009913 - DNA, 22 bp, Homo sapiens
atacactactaagcacagattg

SEQ ID NO: 10009914 - DNA, 22 bp, Homo sapiens
atacaagttgtgataatgtaaa

SEQ ID NO: 10009915 - DNA, 22 bp, Homo sapiens
atacaatccagccattgccaca

SEQ ID NO: 10009916 - DNA, 20 bp, Homo sapiens
atacaatcatgaggaaaaag

SEQ ID NO: 10009917 - DNA, 22 bp, Homo sapiens
atacaatccagccattgccaca

SEQ ID NO: 10009918 - DNA, 22 bp, Homo sapiens
atacaatctagtctgtcagcaa

SEQ ID NO: 10009919 - DNA, 22 bp, Homo sapiens
atacaatgaagtatagatgaaa

SEQ ID NO: 10009920 - DNA, 22 bp, Homo sapiens
atacaatctagtctgtcagcaa

SEQ ID NO: 10009921 - DNA, 22 bp, Homo sapiens
atacaatgaagtatagatgaaa

SEQ ID NO: 10009922 - DNA, 22 bp, Homo sapiens
atacacacaatcaggttttgta

SEQ ID NO: 10009923 - DNA, 22 bp, Homo sapiens
atacacacgtgcacgtgggaaa

SEQ ID NO: 10009924 - DNA, 22 bp, Homo sapiens
atacacacatatgtgagttttg

SEQ ID NO: 10009925 - DNA, 22 bp, Homo sapiens
atacaatgggtgcaaagatgtg

SEQ ID NO: 10009926 - DNA, 22 bp, Homo sapiens
atacaattattctgcagatatt

SEQ ID NO: 10009927 - DNA, 22 bp, Homo sapiens
atacaatgggtgcaaagatgtg

SEQ ID NO: 10009928 - DNA, 22 bp, Homo sapiens
ataaggaatttagaatagggaa

SEQ ID NO: 10009929 - DNA, 22 bp, Homo sapiens
ataaggaatgatgtatcagttt

SEQ ID NO: 10009930 - DNA, 22 bp, Homo sapiens
ataaggaaatgaaactctaata

SEQ ID NO: 10009931 - DNA, 22 bp, Homo sapiens
ataaggaacctgggcttaagag

SEQ ID NO: 10009932 - DNA, 22 bp, Homo sapiens
ataagcttcctgttagaaaccg

SEQ ID NO: 10009933 - DNA, 22 bp, Homo sapiens
ataagcttgatgtaactaacca

SEQ ID NO: 10009934 - DNA, 22 bp, Homo sapiens
ataagctttgctggagagacct

SEQ ID NO: 10009935 - DNA, 22 bp, Homo sapiens
ataaggtataaggcctattttt

SEQ ID NO: 10009936 - DNA, 22 bp, Homo sapiens
atacaaagacaaatctcaatct

SEQ ID NO: 10009937 - DNA, 22 bp, Homo sapiens
atacaagttgcccaaatgatta

SEQ ID NO: 10009938 - DNA, 22 bp, Homo sapiens
ataacagactgatttttaaatg

SEQ ID NO: 10009939 - DNA, 22 bp, Homo sapiens
ataacagacttagagttacaag

SEQ ID NO: 10009940 - DNA, 22 bp, Homo sapiens
ataacagacttagagttacaag

SEQ ID NO: 10009941 - DNA, 22 bp, Homo sapiens
ataacagacttagagttacaag

SEQ ID NO: 10009942 - DNA, 22 bp, Homo sapiens
ataacagagagctactgaactg

SEQ ID NO: 10009943 - DNA, 22 bp, Homo sapiens
ataacaatagtggtagtgctgg

SEQ ID NO: 10009944 - DNA, 22 bp, Homo sapiens
ataacactaaatgtatgtaaca

SEQ ID NO: 10009945 - DNA, 22 bp, Homo sapiens
ataacagaataagtcattaccg

SEQ ID NO: 10009946 - DNA, 22 bp, Homo sapiens
ataacagaataagtcattaccg

SEQ ID NO: 10009947 - DNA, 22 bp, Homo sapiens
ataaatttataattgtttcctg

SEQ ID NO: 10009948 - DNA, 22 bp, Homo sapiens
ataaatttataattgtttcctg

SEQ ID NO: 10009949 - DNA, 22 bp, Homo sapiens
ataacaatagtggtagtgctgg

SEQ ID NO: 10009950 - DNA, 22 bp, Homo sapiens
ataaattttcttgctgtactta

SEQ ID NO: 10009951 - DNA, 22 bp, Homo sapiens
ataaattttcttgctgtactta

SEQ ID NO: 10009952 - DNA, 22 bp, Homo sapiens
ataacaagtatttattgagcat

SEQ ID NO: 10009953 - DNA, 22 bp, Homo sapiens
agttgactctcaagatcctgtt

SEQ ID NO: 10009954 - DNA, 22 bp, Homo sapiens
agttgagggtgggagagaaatg

SEQ ID NO: 10009955 - DNA, 19 bp, Homo sapiens
ataaataaaaagtgggaga

SEQ ID NO: 10009956 - DNA, 22 bp, Homo sapiens
ataaattgtgcttttgacatct

SEQ ID NO: 10009957 - DNA, 22 bp, Homo sapiens
ataaattgtgcttttgacatct

SEQ ID NO: 10009958 - DNA, 21 bp, Homo sapiens
ataaattctgagaggctctgc

SEQ ID NO: 10009959 - DNA, 22 bp, Homo sapiens
ataaattctctgatgtatagta

SEQ ID NO: 10009960 - DNA, 22 bp, Homo sapiens
ataaattatgaatggccctttt

SEQ ID NO: 10009961 - DNA, 22 bp, Homo sapiens
ataaattctctgatgtatagta

SEQ ID NO: 10009962 - DNA, 22 bp, Homo sapiens
agttcagcaaataaaacatagt

SEQ ID NO: 10009963 - DNA, 22 bp, Homo sapiens
agttcagcttcaagctatgagg

SEQ ID NO: 10009964 - DNA, 22 bp, Homo sapiens
agttcagcttcccaggtcactg

SEQ ID NO: 10009965 - DNA, 22 bp, Homo sapiens
agttcaggcataaggcatgaac

SEQ ID NO: 10009966 - DNA, 23 bp, Homo sapiens
agttcagctcagttcagtgagca

SEQ ID NO: 10009967 - DNA, 22 bp, Homo sapiens
agttcagccatttgttaactat

SEQ ID NO: 10009968 - DNA, 22 bp, Homo sapiens
agttcagaggttaatttatttg

SEQ ID NO: 10009969 - DNA, 22 bp, Homo sapiens
agttcagagtaaatgttgaagg

SEQ ID NO: 10009970 - DNA, 22 bp, Homo sapiens
agttcactttctgtagtggaag

SEQ ID NO: 10009971 - DNA, 22 bp, Homo sapiens
agttcagaaatgtctttgcaaa

SEQ ID NO: 10009972 - DNA, 22 bp, Homo sapiens
agttcacatatctgttttattt

SEQ ID NO: 10009973 - DNA, 22 bp, Homo sapiens
agttcacagaatggccagaact

SEQ ID NO: 10009974 - DNA, 22 bp, Homo sapiens
agttgacatccataacaggaag

SEQ ID NO: 10009975 - DNA, 22 bp, Homo sapiens
agttgaaggttggctgatccat

SEQ ID NO: 10009976 - DNA, 22 bp, Homo sapiens
agttgaaagccttatttctctg

SEQ ID NO: 10009977 - DNA, 22 bp, Homo sapiens
agttgaaattaagagagagttt

SEQ ID NO: 10009978 - DNA, 22 bp, Homo sapiens
agttgaaaattaagtgaatttc

SEQ ID NO: 10009979 - DNA, 22 bp, Homo sapiens
agttcttttgtgaacatatgct

SEQ ID NO: 10009980 - DNA, 22 bp, Homo sapiens
agttctttgtgagtaatacaga

SEQ ID NO: 10009981 - DNA, 22 bp, Homo sapiens
agttcttttaccaaggcaaatg

SEQ ID NO: 10009982 - DNA, 22 bp, Homo sapiens
atagtgttgatagcagtggagt

SEQ ID NO: 10009983 - DNA, 22 bp, Homo sapiens
atagtgtgttagtgacataggc

SEQ ID NO: 10009984 - DNA, 22 bp, Homo sapiens
atagtgttacccttcttaaagt

SEQ ID NO: 10009985 - DNA, 22 bp, Homo sapiens
atagttacaaagactttttaaa

SEQ ID NO: 10009986 - DNA, 22 bp, Homo sapiens
ataggaaatcgctattaaccta

SEQ ID NO: 10009987 - DNA, 22 bp, Homo sapiens
atagctttcttaaatatataaa

SEQ ID NO: 10009988 - DNA, 22 bp, Homo sapiens
atagctttttgtcatagagtct

SEQ ID NO: 10009989 - DNA, 22 bp, Homo sapiens
atagctttcttaaatatataaa

SEQ ID NO: 10009990 - DNA, 22 bp, Homo sapiens
ataggaaagaaaattatgtagg

SEQ ID NO: 10009991 - DNA, 22 bp, Homo sapiens
atagccaggagatgatggggga

SEQ ID NO: 10009992 - DNA, 22 bp, Homo sapiens
atagccagcatatagcagggag

SEQ ID NO: 10009993 - DNA, 22 bp, Homo sapiens
atagctgtttttaggccaaata

SEQ ID NO: 10009994 - DNA, 22 bp, Homo sapiens
agaaaaggcttgaagaggtttt

SEQ ID NO: 10009995 - DNA, 22 bp, Homo sapiens
agaaaaggattgatggatcaga

SEQ ID NO: 10009996 - DNA, 22 bp, Homo sapiens
agaaaagaggctttctaagcat

SEQ ID NO: 10009997 - DNA, 17 bp, Homo sapiens
agaaaagagaccagcag

SEQ ID NO: 10009998 - DNA, 17 bp, Homo sapiens
agaaaagagaccagcag

SEQ ID NO: 10009999 - DNA, 17 bp, Homo sapiens
agaaaagagaccagcag

SEQ ID NO: 10010000 - DNA, 22 bp, Homo sapiens
agaaaagaggctttctaagcat

SEQ ID NO: 10010001 - DNA, 22 bp, Homo sapiens
agaaaagaggctttctaagcat

SEQ ID NO: 10010002 - DNA, 22 bp, Homo sapiens
agaaaagaggctttctaagcat

SEQ ID NO: 10010003 - DNA, 22 bp, Homo sapiens
agaaaagaggctttctaagcat

SEQ ID NO: 10010004 - DNA, 22 bp, Homo sapiens
agaaaacttgtcacagctctca

SEQ ID NO: 10010005 - DNA, 22 bp, Homo sapiens
agaaaacttgtcacagctctca

SEQ ID NO: 10010006 - DNA, 22 bp, Homo sapiens
agaaaacttgctcgagcctgtt

SEQ ID NO: 10010007 - DNA, 22 bp, Homo sapiens
agaaaacttgtcacagctctca

SEQ ID NO: 10010008 - DNA, 22 bp, Homo sapiens
agaaaactgggaggagagcttc

SEQ ID NO: 10010009 - DNA, 20 bp, Homo sapiens
agaaaaagtgtggaaatttc

SEQ ID NO: 10010010 - DNA, 20 bp, Homo sapiens
agaaaaagtgtggaaatttc

SEQ ID NO: 10010011 - DNA, 22 bp, Homo sapiens
atagttcactaatagcaaaagc

SEQ ID NO: 10010012 - DNA, 22 bp, Homo sapiens
atagttctggatgtacttatag

SEQ ID NO: 10010013 - DNA, 22 bp, Homo sapiens
atagttctagacctatagttct

SEQ ID NO: 10010014 - DNA, 22 bp, Homo sapiens
atagttctcactcagaatttga

SEQ ID NO: 10010015 - DNA, 23 bp, Homo sapiens
atagttctgcttagaaatcagtg

SEQ ID NO: 10010016 - DNA, 23 bp, Homo sapiens
atagttctgcttagaaatcagtg

SEQ ID NO: 10010017 - DNA, 22 bp, Homo sapiens
agaaaaagtcaaggaattggac

SEQ ID NO: 10010018 - DNA, 22 bp, Homo sapiens
atagttggtccatgaaaaaagt

SEQ ID NO: 10010019 - DNA, 22 bp, Homo sapiens
atagaacaaggtagacagcttt

SEQ ID NO: 10010020 - DNA, 22 bp, Homo sapiens
atagaacacagatgggcgtggc

SEQ ID NO: 10010021 - DNA, 22 bp, Homo sapiens
atagaaccacccagagcctttt

SEQ ID NO: 10010022 - DNA, 19 bp, Homo sapiens
atagaacctgcagtttcaa

SEQ ID NO: 10010023 - DNA, 22 bp, Homo sapiens
atagaacctgttgtgaaattca

SEQ ID NO: 10010024 - DNA, 20 bp, Homo sapiens
atagaagtattatgtaatgt

SEQ ID NO: 10010025 - DNA, 22 bp, Homo sapiens
atagaagctgataaactacttc

SEQ ID NO: 10010026 - DNA, 22 bp, Homo sapiens
atagaagcaagaacagaatgga

SEQ ID NO: 10010027 - DNA, 22 bp, Homo sapiens
atagaagaggaaactgaggttg

SEQ ID NO: 10010028 - DNA, 22 bp, Homo sapiens
atagaagatagcttttgtttct

SEQ ID NO: 10010029 - DNA, 23 bp, Homo sapiens
atagaagattattgcaacagtcc

SEQ ID NO: 10010030 - DNA, 23 bp, Homo sapiens
atagaagattattgcaacagtcc

SEQ ID NO: 10010031 - DNA, 22 bp, Homo sapiens
atacactggacatcattgcatt

SEQ ID NO: 10010032 - DNA, 22 bp, Homo sapiens
atacactggcctttgcagagcc

SEQ ID NO: 10010033 - DNA, 22 bp, Homo sapiens
atagaaatgtattttggactag

SEQ ID NO: 10010034 - DNA, 22 bp, Homo sapiens
atacttaatgtcagtttgatgt

SEQ ID NO: 10010035 - DNA, 22 bp, Homo sapiens
actttacaggcacttcaagtat

SEQ ID NO: 10010036 - DNA, 22 bp, Homo sapiens
actttacagatggtttcctgac

SEQ ID NO: 10010037 - DNA, 22 bp, Homo sapiens
atagaataaggcacagattctt

SEQ ID NO: 10010038 - DNA, 22 bp, Homo sapiens
atagaataaggcacagattctt

SEQ ID NO: 10010039 - DNA, 22 bp, Homo sapiens
atagaataatggttgtcaggag

SEQ ID NO: 10010040 - DNA, 22 bp, Homo sapiens
atagaataaggcacagattctt

SEQ ID NO: 10010041 - DNA, 20 bp, Homo sapiens
atagaagtattatgtaatgt

SEQ ID NO: 10010042 - DNA, 22 bp, Homo sapiens
atagcatggccaggaagctggg

SEQ ID NO: 10010043 - DNA, 22 bp, Homo sapiens
atagcatggcctgtgacacttt

SEQ ID NO: 10010044 - DNA, 22 bp, Homo sapiens
atagatcatttgcattggtcgt

SEQ ID NO: 10010045 - DNA, 23 bp, Homo sapiens
actttagataaattatgtgcaca

SEQ ID NO: 10010046 - DNA, 22 bp, Homo sapiens
actttagatattcctctgtaca

SEQ ID NO: 10010047 - DNA, 22 bp, Homo sapiens
actttagaaaaggaacagagga

SEQ ID NO: 10010048 - DNA, 22 bp, Homo sapiens
actttagaagtaaggatgagtt

SEQ ID NO: 10010049 - DNA, 22 bp, Homo sapiens
actttagaccatcttccacagt

SEQ ID NO: 10010050 - DNA, 22 bp, Homo sapiens
actttagagaaatgtagaagta

SEQ ID NO: 10010051 - DNA, 22 bp, Homo sapiens
actttactccccaacataaatg

SEQ ID NO: 10010052 - DNA, 22 bp, Homo sapiens
actttagaaaagcatccataga

SEQ ID NO: 10010053 - DNA, 22 bp, Homo sapiens
actttagaaaagcatccataga

SEQ ID NO: 10010054 - DNA, 22 bp, Homo sapiens
cactgcaacctccacctcctgg

SEQ ID NO: 10010055 - DNA, 22 bp, Homo sapiens
cactgcactccagcactccagc

SEQ ID NO: 10010056 - DNA, 22 bp, Homo sapiens
cactgcactccagcactccagc

SEQ ID NO: 10010057 - DNA, 22 bp, Homo sapiens
cactgcaccctcaaactcctgg

SEQ ID NO: 10010058 - DNA, 22 bp, Homo sapiens
cactgcactccatcctgggaaa

SEQ ID NO: 10010059 - DNA, 22 bp, Homo sapiens
cactgcactccatcctgggaaa

SEQ ID NO: 10010060 - DNA, 22 bp, Homo sapiens
cactgcactccatcctgggaaa

SEQ ID NO: 10010061 - DNA, 22 bp, Homo sapiens
cactgcactccatcctgggaaa

SEQ ID NO: 10010062 - DNA, 22 bp, Homo sapiens
cactgcactccagcccgggcaa

SEQ ID NO: 10010063 - DNA, 22 bp, Homo sapiens
cactgcactccagcccgggcaa

SEQ ID NO: 10010064 - DNA, 22 bp, Homo sapiens
cactgcactccagcccgggcaa

SEQ ID NO: 10010065 - DNA, 22 bp, Homo sapiens
cactgcactccagcccgggcaa

SEQ ID NO: 10010066 - DNA, 21 bp, Homo sapiens
agcattcaaaagatgccataa

SEQ ID NO: 10010067 - DNA, 21 bp, Homo sapiens
agcattcaaaagatgccataa

SEQ ID NO: 10010068 - DNA, 22 bp, Homo sapiens
agcattaggtgtgtttcagagg

SEQ ID NO: 10010069 - DNA, 19 bp, Homo sapiens
agcattaggcaaattttga

SEQ ID NO: 10010070 - DNA, 22 bp, Homo sapiens
cactgcacttcagcctgggtga

SEQ ID NO: 10010071 - DNA, 22 bp, Homo sapiens
cactgcacttcagcctgggtga

SEQ ID NO: 10010072 - DNA, 22 bp, Homo sapiens
cactgcactccatcctgggaaa

SEQ ID NO: 10010073 - DNA, 22 bp, Homo sapiens
cactgcacttcagcctgggtga

SEQ ID NO: 10010074 - DNA, 22 bp, Homo sapiens
agcatttagtctttattgcagc

SEQ ID NO: 10010075 - DNA, 22 bp, Homo sapiens
agcatttagttagtaaatgttt

SEQ ID NO: 10010076 - DNA, 22 bp, Homo sapiens
agcatttattgacctgctgctg

SEQ ID NO: 10010077 - DNA, 22 bp, Homo sapiens
agcatttgaaaactatttaatt

SEQ ID NO: 10010078 - DNA, 20 bp, Homo sapiens
agcatttgaaatatgactat

SEQ ID NO: 10010079 - DNA, 20 bp, Homo sapiens
agcattttatggtaggaaac

SEQ ID NO: 10010080 - DNA, 17 bp, Homo sapiens
agcatttgtgttaacag

SEQ ID NO: 10010081 - DNA, 22 bp, Homo sapiens
cactttgaagagctttttgaca

SEQ ID NO: 10010082 - DNA, 22 bp, Homo sapiens
cagaaagacctgattggcagtt

SEQ ID NO: 10010083 - DNA, 22 bp, Homo sapiens
cagaaagacctgggctcaagag

SEQ ID NO: 10010084 - DNA, 22 bp, Homo sapiens
agccaaagatcagtgtgcaagt

SEQ ID NO: 10010085 - DNA, 20 bp, Homo sapiens
cagaaagaaggtagattttt

SEQ ID NO: 10010086 - DNA, 22 bp, Homo sapiens
cagaaagacctgattggcagtt

SEQ ID NO: 10010087 - DNA, 22 bp, Homo sapiens
agccaaatctaaagtgaatatt

SEQ ID NO: 10010088 - DNA, 23 bp, Homo sapiens
agccaaatcttaacttctgttac

SEQ ID NO: 10010089 - DNA, 22 bp, Homo sapiens
agccaaatacaaactggggtgg

SEQ ID NO: 10010090 - DNA, 22 bp, Homo sapiens
agccaaagatcagtgtgcaagt

SEQ ID NO: 10010091 - DNA, 20 bp, Homo sapiens
agccaaaggagaacagtgct

SEQ ID NO: 10010092 - DNA, 22 bp, Homo sapiens
agccaaaggcaccagagacact

SEQ ID NO: 10010093 - DNA, 22 bp, Homo sapiens
cagaaactatgtaagaaagtga

SEQ ID NO: 10010094 - DNA, 22 bp, Homo sapiens
cagaaactatgtaagaaagtga

SEQ ID NO: 10010095 - DNA, 22 bp, Homo sapiens
cagaaactagatttagacacaa

SEQ ID NO: 10010096 - DNA, 22 bp, Homo sapiens
cagaaactagatttagacacaa

SEQ ID NO: 10010097 - DNA, 22 bp, Homo sapiens
cagaaacatgtataaagttgta

SEQ ID NO: 10010098 - DNA, 22 bp, Homo sapiens
cagaaacatgtataaagttgta

SEQ ID NO: 10010099 - DNA, 22 bp, Homo sapiens
cagaaacatgtataaagttgta

SEQ ID NO: 10010100 - DNA, 22 bp, Homo sapiens
cagaaacttctggtgtcaaata

SEQ ID NO: 10010101 - DNA, 21 bp, Homo sapiens
cagaaacttgctttgccttct

SEQ ID NO: 10010102 - DNA, 22 bp, Homo sapiens
cagaaactgtttgttaatattt

SEQ ID NO: 10010103 - DNA, 22 bp, Homo sapiens
cagaaactgcttgtggtcatct

SEQ ID NO: 10010104 - DNA, 22 bp, Homo sapiens
cagaaactttctttactgagca

SEQ ID NO: 10010105 - DNA, 22 bp, Homo sapiens
cagaaacttttgatgagtgtat

SEQ ID NO: 10010106 - DNA, 22 bp, Homo sapiens
cacatgtagtaagcaggcaatg

SEQ ID NO: 10010107 - DNA, 22 bp, Homo sapiens
cacatgtacagaagcaggctgg

SEQ ID NO: 10010108 - DNA, 22 bp, Homo sapiens
cacaggctcttctcacttgatt

SEQ ID NO: 10010109 - DNA, 22 bp, Homo sapiens
cacaggctctccagggcctgga

SEQ ID NO: 10010110 - DNA, 22 bp, Homo sapiens
cacaggctctccagggcctgga

SEQ ID NO: 10010111 - DNA, 22 bp, Homo sapiens
cacaggctctccagggcctgga

SEQ ID NO: 10010112 - DNA, 23 bp, Homo sapiens
cacatggaggaccgttcttataa

SEQ ID NO: 10010113 - DNA, 22 bp, Homo sapiens
cacatggaagagatacagtgag

SEQ ID NO: 10010114 - DNA, 22 bp, Homo sapiens
cacatggaagagatacagtgag

SEQ ID NO: 10010115 - DNA, 22 bp, Homo sapiens
agcaggcctcatgcaccagcta

SEQ ID NO: 10010116 - DNA, 22 bp, Homo sapiens
agcaggctaagggacctgttta

SEQ ID NO: 10010117 - DNA, 22 bp, Homo sapiens
agcaggctaatcttgctgaaca

SEQ ID NO: 10010118 - DNA, 22 bp, Homo sapiens
agcaggctaatcttgctgaaca

SEQ ID NO: 10010119 - DNA, 20 bp, Homo sapiens
cacaggctatatgagagcca

SEQ ID NO: 10010120 - DNA, 20 bp, Homo sapiens
cacaggctatatgagagcca

SEQ ID NO: 10010121 - DNA, 22 bp, Homo sapiens
cacatttaaaggttgaagctga

SEQ ID NO: 10010122 - DNA, 22 bp, Homo sapiens
cacattgtattgtggaaagtta

SEQ ID NO: 10010123 - DNA, 22 bp, Homo sapiens
cacatttaaaaaatccacgatc

SEQ ID NO: 10010124 - DNA, 22 bp, Homo sapiens
cacatttaaaaaatccacgatc

SEQ ID NO: 10010125 - DNA, 22 bp, Homo sapiens
cacatttaaaaaatccacgatc

SEQ ID NO: 10010126 - DNA, 22 bp, Homo sapiens
cacatttaaaggttgaagctga

SEQ ID NO: 10010127 - DNA, 22 bp, Homo sapiens
cacattgataattaaggcctcc

SEQ ID NO: 10010128 - DNA, 22 bp, Homo sapiens
cacattgaacttgtctggtggg

SEQ ID NO: 10010129 - DNA, 21 bp, Homo sapiens
cacattgaatacagagatgga

SEQ ID NO: 10010130 - DNA, 21 bp, Homo sapiens
cacattgaatacagagatgga

SEQ ID NO: 10010131 - DNA, 22 bp, Homo sapiens
cacattgataattaaggcctcc

SEQ ID NO: 10010132 - DNA, 22 bp, Homo sapiens
cacattgaaccatatattagtg

SEQ ID NO: 10010133 - DNA, 23 bp, Homo sapiens
cacattgaacactctctttcctg

SEQ ID NO: 10010134 - DNA, 22 bp, Homo sapiens
cacattgaaatgacccaataat

SEQ ID NO: 10010135 - DNA, 22 bp, Homo sapiens
cacattgtagagattagaaaga

SEQ ID NO: 10010136 - DNA, 22 bp, Homo sapiens
cacattgtagagattagaaaga

SEQ ID NO: 10010137 - DNA, 22 bp, Homo sapiens
cacattgtattgtggaaagtta

SEQ ID NO: 10010138 - DNA, 22 bp, Homo sapiens
cacattgggatgaagtctaaaa

SEQ ID NO: 10010139 - DNA, 22 bp, Homo sapiens
cacattgctccacagggttaac

SEQ ID NO: 10010140 - DNA, 22 bp, Homo sapiens
cacattgattcagtcctgtgtg

SEQ ID NO: 10010141 - DNA, 22 bp, Homo sapiens
cacattgcagacgtatattatt

SEQ ID NO: 10010142 - DNA, 22 bp, Homo sapiens
cacatttaagcagatgtggacc

SEQ ID NO: 10010143 - DNA, 22 bp, Homo sapiens
cacctgcaaggagctttcattt

SEQ ID NO: 10010144 - DNA, 22 bp, Homo sapiens
cacatttaagtgcttgttcaga

SEQ ID NO: 10010145 - DNA, 22 bp, Homo sapiens
cactaaaactacattggaaaca

SEQ ID NO: 10010146 - DNA, 22 bp, Homo sapiens
cactaaaactacattggaaaca

SEQ ID NO: 10010147 - DNA, 22 bp, Homo sapiens
cactaaatgtttcaatgtggga

SEQ ID NO: 10010148 - DNA, 22 bp, Homo sapiens
cacgggagacgtgatcttggac

SEQ ID NO: 10010149 - DNA, 22 bp, Homo sapiens
cactacaggggtccacagctga

SEQ ID NO: 10010150 - DNA, 22 bp, Homo sapiens
cactacagaatcaaatacgggc

SEQ ID NO: 10010151 - DNA, 22 bp, Homo sapiens
cactacaggggtccacagctga

SEQ ID NO: 10010152 - DNA, 22 bp, Homo sapiens
agcaggtggacagaggaagaaa

SEQ ID NO: 10010153 - DNA, 22 bp, Homo sapiens
agcaggtggacagaggaagaaa

SEQ ID NO: 10010154 - DNA, 22 bp, Homo sapiens
cactaggctggagtgcagtggc

SEQ ID NO: 10010155 - DNA, 22 bp, Homo sapiens
cactagaaaggtacagattatg

SEQ ID NO: 10010156 - DNA, 22 bp, Homo sapiens
cactagaaaggtacagattatg

SEQ ID NO: 10010157 - DNA, 22 bp, Homo sapiens
cactagaaccaatgacatttct

SEQ ID NO: 10010158 - DNA, 22 bp, Homo sapiens
cactagaaccaatgacatttct

SEQ ID NO: 10010159 - DNA, 22 bp, Homo sapiens
cactagaaaggtacagattatg

SEQ ID NO: 10010160 - DNA, 22 bp, Homo sapiens
cactagaaccaatgacatttct

SEQ ID NO: 10010161 - DNA, 22 bp, Homo sapiens
cactgaaatcgaaaaatgtagg

SEQ ID NO: 10010162 - DNA, 22 bp, Homo sapiens
cactgaaatcgaaaaatgtagg

SEQ ID NO: 10010163 - DNA, 22 bp, Homo sapiens
agcaggtgggcatgaaagctga

SEQ ID NO: 10010164 - DNA, 22 bp, Homo sapiens
cactgaaatcgaaaaatgtagg

SEQ ID NO: 10010165 - DNA, 22 bp, Homo sapiens
agcaggtggatttagacgggag

SEQ ID NO: 10010166 - DNA, 22 bp, Homo sapiens
agcaggtggccacgaggaggag

SEQ ID NO: 10010167 - DNA, 22 bp, Homo sapiens
agcaggtggccacgaggaggag

SEQ ID NO: 10010168 - DNA, 22 bp, Homo sapiens
caatttcttgttaattctcagg

SEQ ID NO: 10010169 - DNA, 19 bp, Homo sapiens
caatttggcagattctccc

SEQ ID NO: 10010170 - DNA, 22 bp, Homo sapiens
caatttggttacttccttagaa

SEQ ID NO: 10010171 - DNA, 22 bp, Homo sapiens
caatttggtttatgtgttcaga

SEQ ID NO: 10010172 - DNA, 22 bp, Homo sapiens
caattcaatggcaaagtattgt

SEQ ID NO: 10010173 - DNA, 22 bp, Homo sapiens
caattcaagttgagtacagctt

SEQ ID NO: 10010174 - DNA, 22 bp, Homo sapiens
caattcaatggcaaagtattgt

SEQ ID NO: 10010175 - DNA, 22 bp, Homo sapiens
caatttctggaactaattctga

SEQ ID NO: 10010176 - DNA, 22 bp, Homo sapiens
caattattcagtgacttaagag

SEQ ID NO: 10010177 - DNA, 22 bp, Homo sapiens
caattcaaaccagtctgtctct

SEQ ID NO: 10010178 - DNA, 22 bp, Homo sapiens
caattcaaatgcatagttcaca

SEQ ID NO: 10010179 - DNA, 22 bp, Homo sapiens
caattcaacttgcctttgtagc

SEQ ID NO: 10010180 - DNA, 22 bp, Homo sapiens
caattcaacttgcctttgtagc

SEQ ID NO: 10010181 - DNA, 22 bp, Homo sapiens
caattttattggtccaaataca

SEQ ID NO: 10010182 - DNA, 22 bp, Homo sapiens
caattttattggtccaaataca

SEQ ID NO: 10010183 - DNA, 22 bp, Homo sapiens
caatttttaaactatgaagttg

SEQ ID NO: 10010184 - DNA, 22 bp, Homo sapiens
cacacagaaccgctcgccactt

SEQ ID NO: 10010185 - DNA, 22 bp, Homo sapiens
cacacatcaacctagacattgt

SEQ ID NO: 10010186 - DNA, 22 bp, Homo sapiens
cacacatgtgagcagagaggcg

SEQ ID NO: 10010187 - DNA, 22 bp, Homo sapiens
cacacatgtgggatccgcaggg

SEQ ID NO: 10010188 - DNA, 22 bp, Homo sapiens
cacacatgtgtgcagcttagaa

SEQ ID NO: 10010189 - DNA, 22 bp, Homo sapiens
cacagaaaaaggcttgaaaatc

SEQ ID NO: 10010190 - DNA, 22 bp, Homo sapiens
cacagaaaggctcaaatcccaa

SEQ ID NO: 10010191 - DNA, 22 bp, Homo sapiens
cacagaaaaaggcttgaaaatc

SEQ ID NO: 10010192 - DNA, 22 bp, Homo sapiens
cacacatggtagcaggtacaag

SEQ ID NO: 10010193 - DNA, 22 bp, Homo sapiens
cacacatggtagcaggtacaag

SEQ ID NO: 10010194 - DNA, 22 bp, Homo sapiens
cacacatggtcagtggctactc

SEQ ID NO: 10010195 - DNA, 22 bp, Homo sapiens
cacacatgtctctccatgctct

SEQ ID NO: 10010196 - DNA, 22 bp, Homo sapiens
cacacatgaagttgctgagcta

SEQ ID NO: 10010197 - DNA, 22 bp, Homo sapiens
cacacatgaatccctagtacct

SEQ ID NO: 10010198 - DNA, 22 bp, Homo sapiens
cacacatgaatccctagtacct

SEQ ID NO: 10010199 - DNA, 22 bp, Homo sapiens
cacagctgccctactccatgtg

SEQ ID NO: 10010200 - DNA, 22 bp, Homo sapiens
cacagctgccctaactgtactc

SEQ ID NO: 10010201 - DNA, 22 bp, Homo sapiens
cacagctgccccctctctaact

SEQ ID NO: 10010202 - DNA, 22 bp, Homo sapiens
cacagctgccctactccatgtg

SEQ ID NO: 10010203 - DNA, 22 bp, Homo sapiens
cacagctgcttgttagaatagc

SEQ ID NO: 10010204 - DNA, 22 bp, Homo sapiens
cacagctgcttgttagaatagc

SEQ ID NO: 10010205 - DNA, 22 bp, Homo sapiens
cacagctgccatggctgcactt

SEQ ID NO: 10010206 - DNA, 22 bp, Homo sapiens
cacagctgccatgcagtcagtg

SEQ ID NO: 10010207 - DNA, 22 bp, Homo sapiens
cacagctgcacagaggaggtgc

SEQ ID NO: 10010208 - DNA, 22 bp, Homo sapiens
cacagaaattattaggatgctt

SEQ ID NO: 10010209 - DNA, 22 bp, Homo sapiens
cacagaaattattaggatgctt

SEQ ID NO: 10010210 - DNA, 22 bp, Homo sapiens
cacagaaatattgtgtcccttg

SEQ ID NO: 10010211 - DNA, 22 bp, Homo sapiens
cacagaaatattgtgtcccttg

SEQ ID NO: 10010212 - DNA, 22 bp, Homo sapiens
cacagctgaccaccctgctccc

SEQ ID NO: 10010213 - DNA, 22 bp, Homo sapiens
cacagaacaccaaagaaccttc

SEQ ID NO: 10010214 - DNA, 20 bp, Homo sapiens
cacagaacaaattgcaggac

SEQ ID NO: 10010215 - DNA, 20 bp, Homo sapiens
cacagaacaaattgcaggac

SEQ ID NO: 10010216 - DNA, 22 bp, Homo sapiens
cacagaacaccaaagaaccttc

SEQ ID NO: 10010217 - DNA, 22 bp, Homo sapiens
cacaggaaatgattctgcagca

SEQ ID NO: 10010218 - DNA, 22 bp, Homo sapiens
cacaggaaatgattctgcagca

SEQ ID NO: 10010219 - DNA, 22 bp, Homo sapiens
cacaggaaatgattctgcagca

SEQ ID NO: 10010220 - DNA, 22 bp, Homo sapiens
cacaggaacaaagaagacaatt

SEQ ID NO: 10010221 - DNA, 22 bp, Homo sapiens
cacaggaagatctcccagaggt

SEQ ID NO: 10010222 - DNA, 19 bp, Homo sapiens
cacagctggcgctgaccgc

SEQ ID NO: 10010223 - DNA, 22 bp, Homo sapiens
cacagctggaatggggtacctg

SEQ ID NO: 10010224 - DNA, 22 bp, Homo sapiens
cacagctgggaaaatttgtaca

SEQ ID NO: 10010225 - DNA, 22 bp, Homo sapiens
cacagctggggaagctgaggcc

SEQ ID NO: 10010226 - DNA, 22 bp, Homo sapiens
cacaggaaaaatgggtccttta

SEQ ID NO: 10010227 - DNA, 22 bp, Homo sapiens
cacagctggggaagctgaggcc

SEQ ID NO: 10010228 - DNA, 22 bp, Homo sapiens
cacaggaaaataaaagatctaa

SEQ ID NO: 10010229 - DNA, 20 bp, Homo sapiens
cacaggaaagctactcagtt

SEQ ID NO: 10010230 - DNA, 22 bp, Homo sapiens
caagtgaagatatacagaaaat

SEQ ID NO: 10010231 - DNA, 22 bp, Homo sapiens
caatgatagattttacaaatta

SEQ ID NO: 10010232 - DNA, 22 bp, Homo sapiens
caatgttttgttgaatgaatag

SEQ ID NO: 10010233 - DNA, 22 bp, Homo sapiens
caattacatttattgagcattc

SEQ ID NO: 10010234 - DNA, 22 bp, Homo sapiens
caattacatttattgagcattc

SEQ ID NO: 10010235 - DNA, 22 bp, Homo sapiens
caattacatttattgagcattc

SEQ ID NO: 10010236 - DNA, 22 bp, Homo sapiens
caatgtttttccttccttaata

SEQ ID NO: 10010237 - DNA, 22 bp, Homo sapiens
caattacatttattgagcattc

SEQ ID NO: 10010238 - DNA, 21 bp, Homo sapiens
caattacagatggctcagggg

SEQ ID NO: 10010239 - DNA, 22 bp, Homo sapiens
caattatatttagaatgataca

SEQ ID NO: 10010240 - DNA, 22 bp, Homo sapiens
caattatatttagaatgataca

SEQ ID NO: 10010241 - DNA, 22 bp, Homo sapiens
caattatatttagaatgataca

SEQ ID NO: 10010242 - DNA, 22 bp, Homo sapiens
caattatatttagaatgataca

SEQ ID NO: 10010243 - DNA, 21 bp, Homo sapiens
caattacttttgcaccgactt

SEQ ID NO: 10010244 - DNA, 22 bp, Homo sapiens
caattacttttgcaccaatata

SEQ ID NO: 10010245 - DNA, 22 bp, Homo sapiens
caagggacctgagatggtctct

SEQ ID NO: 10010246 - DNA, 22 bp, Homo sapiens
caagggaaggctaagggcaaca

SEQ ID NO: 10010247 - DNA, 22 bp, Homo sapiens
caagggaaggctaagggcaaca

SEQ ID NO: 10010248 - DNA, 22 bp, Homo sapiens
caagggaattgtgtgtgagagg

SEQ ID NO: 10010249 - DNA, 22 bp, Homo sapiens
caagggagttgctgcatgcagg

SEQ ID NO: 10010250 - DNA, 22 bp, Homo sapiens
caagggcaggagaggatggatg

SEQ ID NO: 10010251 - DNA, 22 bp, Homo sapiens
caagggcttcaagtggccaaga

SEQ ID NO: 10010252 - DNA, 22 bp, Homo sapiens
caagctttatccgccatgtagg

SEQ ID NO: 10010253 - DNA, 22 bp, Homo sapiens
caaggaaaacagatgatcaaca

SEQ ID NO: 10010254 - DNA, 22 bp, Homo sapiens
caaggaaaacagatgatcaaca

SEQ ID NO: 10010255 - DNA, 22 bp, Homo sapiens
caaggaaacatgaaatgcattg

SEQ ID NO: 10010256 - DNA, 22 bp, Homo sapiens
caaggaaaagaagtatttcaga

SEQ ID NO: 10010257 - DNA, 22 bp, Homo sapiens
caaggaaacatgaaatgcattg

SEQ ID NO: 10010258 - DNA, 22 bp, Homo sapiens
agcaattatggagttgttgacg

SEQ ID NO: 10010259 - DNA, 22 bp, Homo sapiens
agcaattatggagttgttgacg

SEQ ID NO: 10010260 - DNA, 22 bp, Homo sapiens
agcaattattgtataagaacaa

SEQ ID NO: 10010261 - DNA, 22 bp, Homo sapiens
agcaattttcccttagtctttg

SEQ ID NO: 10010262 - DNA, 22 bp, Homo sapiens
agcaatttctcgcaccagacgc

SEQ ID NO: 10010263 - DNA, 21 bp, Homo sapiens
agcagacagcccaagaaaatc

SEQ ID NO: 10010264 - DNA, 21 bp, Homo sapiens
agcagacagcccaagaaaatc

SEQ ID NO: 10010265 - DNA, 22 bp, Homo sapiens
agcagacaggtaggaggataaa

SEQ ID NO: 10010266 - DNA, 22 bp, Homo sapiens
agcagacaggctgccacagtgc

SEQ ID NO: 10010267 - DNA, 22 bp, Homo sapiens
agcagacatatctcatgtcaca

SEQ ID NO: 10010268 - DNA, 22 bp, Homo sapiens
agcagacatatctcatgtcaca

SEQ ID NO: 10010269 - DNA, 22 bp, Homo sapiens
caaggaaggagagatgatgggt

SEQ ID NO: 10010270 - DNA, 22 bp, Homo sapiens
caaggaaggagagatgatgggt

SEQ ID NO: 10010271 - DNA, 22 bp, Homo sapiens
caaggcatttcgcttagagaga

SEQ ID NO: 10010272 - DNA, 22 bp, Homo sapiens
caagggaagaggacagggacct

SEQ ID NO: 10010273 - DNA, 22 bp, Homo sapiens
caaggcattaccatggctagag

SEQ ID NO: 10010274 - DNA, 22 bp, Homo sapiens
caaggcattgtgtaagcacttg

SEQ ID NO: 10010275 - DNA, 22 bp, Homo sapiens
agcagagaccatatagcccaga

SEQ ID NO: 10010276 - DNA, 22 bp, Homo sapiens
agcagacatggcttggatgtgg

SEQ ID NO: 10010277 - DNA, 22 bp, Homo sapiens
cagagcagtccttgtcaatcag

SEQ ID NO: 10010278 - DNA, 22 bp, Homo sapiens
cagagcagtccttgtcaatcag

SEQ ID NO: 10010279 - DNA, 22 bp, Homo sapiens
cagagcagtagaaaacagcctt

SEQ ID NO: 10010280 - DNA, 18 bp, Homo sapiens
cagagcagtatgaatgtt

SEQ ID NO: 10010281 - DNA, 22 bp, Homo sapiens
cagagcaggtatctttggtgaa

SEQ ID NO: 10010282 - DNA, 22 bp, Homo sapiens
cagagcaggtatctttggtgaa

SEQ ID NO: 10010283 - DNA, 22 bp, Homo sapiens
cagagcagtaaatctggggcac

SEQ ID NO: 10010284 - DNA, 20 bp, Homo sapiens
cagagccagggttttgtttt

SEQ ID NO: 10010285 - DNA, 22 bp, Homo sapiens
cagagccaggtctaggagtctc

SEQ ID NO: 10010286 - DNA, 22 bp, Homo sapiens
cagagccaggcctgccctcttt

SEQ ID NO: 10010287 - DNA, 22 bp, Homo sapiens
cagagccaggcctgccctcttt

SEQ ID NO: 10010288 - DNA, 22 bp, Homo sapiens
cagagccagggttgcacccctg

SEQ ID NO: 10010289 - DNA, 22 bp, Homo sapiens
cagagcagtctggagatccagc

SEQ ID NO: 10010290 - DNA, 22 bp, Homo sapiens
cagagcagtctggagatccagc

SEQ ID NO: 10010291 - DNA, 22 bp, Homo sapiens
cagagctgttactattcatgaa

SEQ ID NO: 10010292 - DNA, 22 bp, Homo sapiens
cagagctgtgataaatagatat

SEQ ID NO: 10010293 - DNA, 22 bp, Homo sapiens
cagagctgtccaaaccctgaca

SEQ ID NO: 10010294 - DNA, 22 bp, Homo sapiens
cagagctgtccaaaccctgaca

SEQ ID NO: 10010295 - DNA, 21 bp, Homo sapiens
cagagctgtccaaaccctgac

SEQ ID NO: 10010296 - DNA, 20 bp, Homo sapiens
cagagctgttatggatgatg

SEQ ID NO: 10010297 - DNA, 22 bp, Homo sapiens
cagagctgttgcggggcttggc

SEQ ID NO: 10010298 - DNA, 22 bp, Homo sapiens
cagagctgttgcggggcttggc

SEQ ID NO: 10010299 - DNA, 22 bp, Homo sapiens
cagagctgtcatttgccagtga

SEQ ID NO: 10010300 - DNA, 21 bp, Homo sapiens
cagagctgtccaaaccctgac

SEQ ID NO: 10010301 - DNA, 23 bp, Homo sapiens
cagagctggctcagagctgcctg

SEQ ID NO: 10010302 - DNA, 22 bp, Homo sapiens
cagagccatcatgatatggagt

SEQ ID NO: 10010303 - DNA, 22 bp, Homo sapiens
cagagccatcatgatatggagt

SEQ ID NO: 10010304 - DNA, 22 bp, Homo sapiens
cagagccagtcagtcagaaact

SEQ ID NO: 10010305 - DNA, 22 bp, Homo sapiens
cagagccatcatgatatggagt

SEQ ID NO: 10010306 - DNA, 22 bp, Homo sapiens
cagagcagggtgcaccttgggc

SEQ ID NO: 10010307 - DNA, 22 bp, Homo sapiens
cagagcaccagtgggagacaag

SEQ ID NO: 10010308 - DNA, 22 bp, Homo sapiens
agccaggggagtcagctgctgg

SEQ ID NO: 10010309 - DNA, 22 bp, Homo sapiens
agccaggggagtcagctgctgg

SEQ ID NO: 10010310 - DNA, 22 bp, Homo sapiens
agccagggacgctgcaggctac

SEQ ID NO: 10010311 - DNA, 22 bp, Homo sapiens
agccagggacgctgcaggctac

SEQ ID NO: 10010312 - DNA, 23 bp, Homo sapiens
agccagggcactggtggagattg

SEQ ID NO: 10010313 - DNA, 22 bp, Homo sapiens
agccagggaaggataacaagaa

SEQ ID NO: 10010314 - DNA, 22 bp, Homo sapiens
agccagggacgctgcaggctac

SEQ ID NO: 10010315 - DNA, 22 bp, Homo sapiens
agccagggacgctgcaggctac

SEQ ID NO: 10010316 - DNA, 22 bp, Homo sapiens
agccaggctgcagttggctggc

SEQ ID NO: 10010317 - DNA, 16 bp, Homo sapiens
agccaggctgcctcgg

SEQ ID NO: 10010318 - DNA, 16 bp, Homo sapiens
agccaggctgcctcgg

SEQ ID NO: 10010319 - DNA, 16 bp, Homo sapiens
agccaggctgcctcgg

SEQ ID NO: 10010320 - DNA, 22 bp, Homo sapiens
agccaggctgcagttggctggc

SEQ ID NO: 10010321 - DNA, 22 bp, Homo sapiens
agccaggctcaaggcctgctcc

SEQ ID NO: 10010322 - DNA, 22 bp, Homo sapiens
agccaggctgcagttggctggc

SEQ ID NO: 10010323 - DNA, 22 bp, Homo sapiens
agccaggccttttctcaaggtt

SEQ ID NO: 10010324 - DNA, 22 bp, Homo sapiens
agccaagaggagcctaaagcga

SEQ ID NO: 10010325 - DNA, 22 bp, Homo sapiens
agccaagaggagcctaaagcga

SEQ ID NO: 10010326 - DNA, 22 bp, Homo sapiens
agccaagcaccactggcactcg

SEQ ID NO: 10010327 - DNA, 22 bp, Homo sapiens
agccaagaggagcctaaagcga

SEQ ID NO: 10010328 - DNA, 22 bp, Homo sapiens
agccaagcaccactggcactcg

SEQ ID NO: 10010329 - DNA, 22 bp, Homo sapiens
agccaagcactcaactcctgga

SEQ ID NO: 10010330 - DNA, 22 bp, Homo sapiens
agccaagagacagatgcccacc

SEQ ID NO: 10010331 - DNA, 22 bp, Homo sapiens
agccaagacatttagaaaagct

SEQ ID NO: 10010332 - DNA, 22 bp, Homo sapiens
agccaagagatgaggctgcagg

SEQ ID NO: 10010333 - DNA, 22 bp, Homo sapiens
agccaagaatcatgagctaata

SEQ ID NO: 10010334 - DNA, 22 bp, Homo sapiens
agccaagaatcatgagctaata

SEQ ID NO: 10010335 - DNA, 20 bp, Homo sapiens
agccaagaacaggcagaacc

SEQ ID NO: 10010336 - DNA, 22 bp, Homo sapiens
agccaagaagtgagtaatagta

SEQ ID NO: 10010337 - DNA, 22 bp, Homo sapiens
agccaactaggagattaaggta

SEQ ID NO: 10010338 - DNA, 19 bp, Homo sapiens
agcctggagggctggtcac

SEQ ID NO: 10010339 - DNA, 22 bp, Homo sapiens
agcctggaggccaggagacagt

SEQ ID NO: 10010340 - DNA, 22 bp, Homo sapiens
cagcactgctgctgtacacaca

SEQ ID NO: 10010341 - DNA, 18 bp, Homo sapiens
agcctggagggttgaagt

SEQ ID NO: 10010342 - DNA, 22 bp, Homo sapiens
agcctggagaagatgtgtattg

SEQ ID NO: 10010343 - DNA, 22 bp, Homo sapiens
agcctggaattaaggaaatgca

SEQ ID NO: 10010344 - DNA, 22 bp, Homo sapiens
agcctggacagctacggagaac

SEQ ID NO: 10010345 - DNA, 22 bp, Homo sapiens
agcctggagaggcgccatacac

SEQ ID NO: 10010346 - DNA, 22 bp, Homo sapiens
agcctggaggaggagttgagca

SEQ ID NO: 10010347 - DNA, 22 bp, Homo sapiens
agcctggagcttgagttatgag

SEQ ID NO: 10010348 - DNA, 22 bp, Homo sapiens
cagatgaagatcatagaatagt

SEQ ID NO: 10010349 - DNA, 22 bp, Homo sapiens
agcctggaagaacctgaagtct

SEQ ID NO: 10010350 - DNA, 22 bp, Homo sapiens
agcctgcttcctcagggaacaa

SEQ ID NO: 10010351 - DNA, 22 bp, Homo sapiens
agcctgcttgagagtcctggct

SEQ ID NO: 10010352 - DNA, 22 bp, Homo sapiens
cagatgaactgtgactgaaaat

SEQ ID NO: 10010353 - DNA, 22 bp, Homo sapiens
cagatctgtttgccagatcagc

SEQ ID NO: 10010354 - DNA, 21 bp, Homo sapiens
cagatctgtaggtactaccat

SEQ ID NO: 10010355 - DNA, 22 bp, Homo sapiens
cagatctgctcctctgtccatg

SEQ ID NO: 10010356 - DNA, 22 bp, Homo sapiens
cagatctgtagtaaaagatctc

SEQ ID NO: 10010357 - DNA, 22 bp, Homo sapiens
agcctagctgtgtgaggccatc

SEQ ID NO: 10010358 - DNA, 22 bp, Homo sapiens
agccgagctctgagcagggcct

SEQ ID NO: 10010359 - DNA, 22 bp, Homo sapiens
agccgcaagaagtacagcagca

SEQ ID NO: 10010360 - DNA, 22 bp, Homo sapiens
agcccttggtattttccgatcc

SEQ ID NO: 10010361 - DNA, 18 bp, Homo sapiens
cagatccaggcagctatt

SEQ ID NO: 10010362 - DNA, 22 bp, Homo sapiens
cagatattaggagctcaataat

SEQ ID NO: 10010363 - DNA, 22 bp, Homo sapiens
cagatcaagctgtatggtcaga

SEQ ID NO: 10010364 - DNA, 22 bp, Homo sapiens
cagaggagtgggccgttatggt

SEQ ID NO: 10010365 - DNA, 22 bp, Homo sapiens
cagagtgaaataggggatcaag

SEQ ID NO: 10010366 - DNA, 21 bp, Homo sapiens
cagaggtggcctgacctctga

SEQ ID NO: 10010367 - DNA, 22 bp, Homo sapiens
cagaggagttcagtacacagcc

SEQ ID NO: 10010368 - DNA, 22 bp, Homo sapiens
cagaggtgctggagtgagtcct

SEQ ID NO: 10010369 - DNA, 22 bp, Homo sapiens
cagagtgaacagtgggatgtgc

SEQ ID NO: 10010370 - DNA, 22 bp, Homo sapiens
cagagtgaaataggggatcaag

SEQ ID NO: 10010371 - DNA, 22 bp, Homo sapiens
cagaggaggccaccgcataggc

SEQ ID NO: 10010372 - DNA, 22 bp, Homo sapiens
cagaggaggccaccgcataggc

SEQ ID NO: 10010373 - DNA, 17 bp, Homo sapiens
cagaggagctttggggg

SEQ ID NO: 10010374 - DNA, 22 bp, Homo sapiens
cagaggaggcggtatacactgc

SEQ ID NO: 10010375 - DNA, 22 bp, Homo sapiens
cagaggaggccaccgcataggc

SEQ ID NO: 10010376 - DNA, 22 bp, Homo sapiens
cagaggaggccaccgcataggc

SEQ ID NO: 10010377 - DNA, 22 bp, Homo sapiens
cagaggaggcggtatacactgc

SEQ ID NO: 10010378 - DNA, 17 bp, Homo sapiens
cagaggagctttggggg

SEQ ID NO: 10010379 - DNA, 18 bp, Homo sapiens
cagaggagagacattcag

SEQ ID NO: 10010380 - DNA, 18 bp, Homo sapiens
cagaggagagacattcag

SEQ ID NO: 10010381 - DNA, 22 bp, Homo sapiens
cagagcttcagggaataagaat

SEQ ID NO: 10010382 - DNA, 22 bp, Homo sapiens
cagaggagaattgcgggatcat

SEQ ID NO: 10010383 - DNA, 22 bp, Homo sapiens
agccctgagccagcctggtcag

SEQ ID NO: 10010384 - DNA, 20 bp, Homo sapiens
agccctgtttcctggagaga

SEQ ID NO: 10010385 - DNA, 18 bp, Homo sapiens
cagagtgggccaagagac

SEQ ID NO: 10010386 - DNA, 22 bp, Homo sapiens
cagagtggcgaccccctcagct

SEQ ID NO: 10010387 - DNA, 22 bp, Homo sapiens
agccctcctggggccacgctgg

SEQ ID NO: 10010388 - DNA, 22 bp, Homo sapiens
cagagtggagatgtgtgtggaa

SEQ ID NO: 10010389 - DNA, 22 bp, Homo sapiens
cagagtggcactctgctggatg

SEQ ID NO: 10010390 - DNA, 22 bp, Homo sapiens
cagagtggagatgtgtgtggaa

SEQ ID NO: 10010391 - DNA, 22 bp, Homo sapiens
cagagtggcagtcccaggccca

SEQ ID NO: 10010392 - DNA, 22 bp, Homo sapiens
cagctgctttcagcaggaggga

SEQ ID NO: 10010393 - DNA, 20 bp, Homo sapiens
agctgaggcacctgaggtta

SEQ ID NO: 10010394 - DNA, 22 bp, Homo sapiens
cagctggcagccctggccctgc

SEQ ID NO: 10010395 - DNA, 22 bp, Homo sapiens
cagctggcagaacctgcatcca

SEQ ID NO: 10010396 - DNA, 22 bp, Homo sapiens
cagctggcaagtggagcagggt

SEQ ID NO: 10010397 - DNA, 22 bp, Homo sapiens
agctgagctcaggctgatgtaa

SEQ ID NO: 10010398 - DNA, 22 bp, Homo sapiens
agctgagctagtagttccagtg

SEQ ID NO: 10010399 - DNA, 21 bp, Homo sapiens
agctgagcccagaagactggt

SEQ ID NO: 10010400 - DNA, 22 bp, Homo sapiens
agctgagctgcagatgactgta

SEQ ID NO: 10010401 - DNA, 17 bp, Homo sapiens
agctgagctggccaggg

SEQ ID NO: 10010402 - DNA, 22 bp, Homo sapiens
agctgaggaggaatgatgggta

SEQ ID NO: 10010403 - DNA, 22 bp, Homo sapiens
agctgaggaggaatgatgggta

SEQ ID NO: 10010404 - DNA, 22 bp, Homo sapiens
agctgaggacgtgaagggcggc

SEQ ID NO: 10010405 - DNA, 22 bp, Homo sapiens
agctctggcactggcgcgggat

SEQ ID NO: 10010406 - DNA, 23 bp, Homo sapiens
agctctggcgttggggaggtagt

SEQ ID NO: 10010407 - DNA, 18 bp, Homo sapiens
agctctggcatacttgaa

SEQ ID NO: 10010408 - DNA, 22 bp, Homo sapiens
agctgagccagcagcaacagga

SEQ ID NO: 10010409 - DNA, 20 bp, Homo sapiens
agctgaagatctggatgggg

SEQ ID NO: 10010410 - DNA, 22 bp, Homo sapiens
agctctgggagtagttccacct

SEQ ID NO: 10010411 - DNA, 22 bp, Homo sapiens
agctctgggagtagttccacct

SEQ ID NO: 10010412 - DNA, 22 bp, Homo sapiens
agctctgggagtagttccacct

SEQ ID NO: 10010413 - DNA, 22 bp, Homo sapiens
cagctgcccaagccccagatgt

SEQ ID NO: 10010414 - DNA, 22 bp, Homo sapiens
cagctgcccaggccacctggag

SEQ ID NO: 10010415 - DNA, 22 bp, Homo sapiens
cagctgccatgacatgtcctgc

SEQ ID NO: 10010416 - DNA, 22 bp, Homo sapiens
cagctgccagcttctctccatc

SEQ ID NO: 10010417 - DNA, 18 bp, Homo sapiens
cagctgccagctcatgga

SEQ ID NO: 10010418 - DNA, 18 bp, Homo sapiens
cagctgccagctcatgga

SEQ ID NO: 10010419 - DNA, 22 bp, Homo sapiens
cagctgccacttgctctcggct

SEQ ID NO: 10010420 - DNA, 22 bp, Homo sapiens
cagctgccccgctggctgacca

SEQ ID NO: 10010421 - DNA, 22 bp, Homo sapiens
cagctgcccatcctgggaaatg

SEQ ID NO: 10010422 - DNA, 22 bp, Homo sapiens
cagctgccccataaatcacagt

SEQ ID NO: 10010423 - DNA, 21 bp, Homo sapiens
agctctggagcagcaatcaag

SEQ ID NO: 10010424 - DNA, 21 bp, Homo sapiens
agctctggagcagcaatcaag

SEQ ID NO: 10010425 - DNA, 22 bp, Homo sapiens
agctctggaataatgatgtgat

SEQ ID NO: 10010426 - DNA, 22 bp, Homo sapiens
cagctgagagtagaaatggagg

SEQ ID NO: 10010427 - DNA, 22 bp, Homo sapiens
cagcggtggcaaggtgactgtg

SEQ ID NO: 10010428 - DNA, 22 bp, Homo sapiens
cagcggaggacagatgggagct

SEQ ID NO: 10010429 - DNA, 18 bp, Homo sapiens
cagcctctgattggttgc

SEQ ID NO: 10010430 - DNA, 22 bp, Homo sapiens
cagcctctgagccttggcagat

SEQ ID NO: 10010431 - DNA, 22 bp, Homo sapiens
cagcctctctgtatctcaggat

SEQ ID NO: 10010432 - DNA, 22 bp, Homo sapiens
cagcctctctgtatctcaggat

SEQ ID NO: 10010433 - DNA, 22 bp, Homo sapiens
cagcctctgacaccacagtcgt

SEQ ID NO: 10010434 - DNA, 22 bp, Homo sapiens
cagcctttatggaaaggcctgg

SEQ ID NO: 10010435 - DNA, 22 bp, Homo sapiens
cagcctttctgtttcctaaggt

SEQ ID NO: 10010436 - DNA, 22 bp, Homo sapiens
cagccttcgacagttggagtag

SEQ ID NO: 10010437 - DNA, 22 bp, Homo sapiens
cagcctcttgcactttgaaggc

SEQ ID NO: 10010438 - DNA, 20 bp, Homo sapiens
cagcctccactcactcagct

SEQ ID NO: 10010439 - DNA, 22 bp, Homo sapiens
cagccctggtgaggttggctat

SEQ ID NO: 10010440 - DNA, 22 bp, Homo sapiens
cagcctctctgtatctcaggat

SEQ ID NO: 10010441 - DNA, 22 bp, Homo sapiens
cagcctctaagcacagcctctc

SEQ ID NO: 10010442 - DNA, 22 bp, Homo sapiens
cagcctctaagcacagcctctc

SEQ ID NO: 10010443 - DNA, 22 bp, Homo sapiens
cagcctcctgggacactcaccg

SEQ ID NO: 10010444 - DNA, 22 bp, Homo sapiens
cagcccaggtctctcttccagt

SEQ ID NO: 10010445 - DNA, 22 bp, Homo sapiens
cagcccagtgcacgcccgtttc

SEQ ID NO: 10010446 - DNA, 22 bp, Homo sapiens
cagccatactgacatcaacaaa

SEQ ID NO: 10010447 - DNA, 22 bp, Homo sapiens
cagcccaaagccccaggctaga

SEQ ID NO: 10010448 - DNA, 22 bp, Homo sapiens
cagccagtgtgaccgaggagga

SEQ ID NO: 10010449 - DNA, 22 bp, Homo sapiens
cagccagtggttgaagatgcag

SEQ ID NO: 10010450 - DNA, 22 bp, Homo sapiens
cagccagctggcactgtgagta

SEQ ID NO: 10010451 - DNA, 22 bp, Homo sapiens
agcgctgtgggcgtgcgaggag

SEQ ID NO: 10010452 - DNA, 22 bp, Homo sapiens
agcgctgtgggcgtgcgaggag

SEQ ID NO: 10010453 - DNA, 22 bp, Homo sapiens
cagccagctggcactgtgagta

SEQ ID NO: 10010454 - DNA, 22 bp, Homo sapiens
agcgctgtgggcgtgcgaggag

SEQ ID NO: 10010455 - DNA, 22 bp, Homo sapiens
cagcacttggtgccattgagtg

SEQ ID NO: 10010456 - DNA, 22 bp, Homo sapiens
cagcacttcaatgagcatttca

SEQ ID NO: 10010457 - DNA, 22 bp, Homo sapiens
cagcactgtgataactgagcca

SEQ ID NO: 10010458 - DNA, 22 bp, Homo sapiens
cagcactgcttcgcagccaggg

SEQ ID NO: 10010459 - DNA, 22 bp, Homo sapiens
cagcatggccatttctcgctgc

SEQ ID NO: 10010460 - DNA, 22 bp, Homo sapiens
cagcatggagacaaagtgggca

SEQ ID NO: 10010461 - DNA, 22 bp, Homo sapiens
cagcatggcttgagtgtttcct

SEQ ID NO: 10010462 - DNA, 22 bp, Homo sapiens
cagcatggggatcactgtaggc

SEQ ID NO: 10010463 - DNA, 22 bp, Homo sapiens
cagcatggagacaaagtgggca

SEQ ID NO: 10010464 - DNA, 22 bp, Homo sapiens
cagcagaaaatgtgggtgattt

SEQ ID NO: 10010465 - DNA, 22 bp, Homo sapiens
cagcagaaaatacctgtaactc

SEQ ID NO: 10010466 - DNA, 22 bp, Homo sapiens
cagcatcaccaacttgagcaat

SEQ ID NO: 10010467 - DNA, 22 bp, Homo sapiens
agcgccactgcactccagcctg

SEQ ID NO: 10010468 - DNA, 22 bp, Homo sapiens
agcgagggaggtctgaggacag

SEQ ID NO: 10010469 - DNA, 22 bp, Homo sapiens
agcgagtgggtcagcgttgcag

SEQ ID NO: 10010470 - DNA, 22 bp, Homo sapiens
agcgaggttttgcagatacagc

SEQ ID NO: 10010471 - DNA, 22 bp, Homo sapiens
agcgagtgggtcagcgttgcag

SEQ ID NO: 10010472 - DNA, 22 bp, Homo sapiens
agcgccactgcactccagcctg

SEQ ID NO: 10010473 - DNA, 22 bp, Homo sapiens
agcgccactgcactccagcctg

SEQ ID NO: 10010474 - DNA, 22 bp, Homo sapiens
agcgcgctcgatggtttccgcg

SEQ ID NO: 10010475 - DNA, 22 bp, Homo sapiens
agcgcgctgtcagactggctcg

SEQ ID NO: 10010476 - DNA, 22 bp, Homo sapiens
agcgcgctctaggacaccgcgg

SEQ ID NO: 10010477 - DNA, 21 bp, Homo sapiens
agcgcctgcaacaaggcagat

SEQ ID NO: 10010478 - DNA, 22 bp, Homo sapiens
agcgccgcccctgctggtgttg

SEQ ID NO: 10010479 - DNA, 22 bp, Homo sapiens
cagcatggtggagctgctcttt

SEQ ID NO: 10010480 - DNA, 22 bp, Homo sapiens
cagcatggtggagctgctcttt

SEQ ID NO: 10010481 - DNA, 22 bp, Homo sapiens
agcgagggaggtctgaggacag

SEQ ID NO: 10010482 - DNA, 22 bp, Homo sapiens
agcgagcacattgagtgaagaa

SEQ ID NO: 10010483 - DNA, 22 bp, Homo sapiens
cagcatggggcttggagtcagc

SEQ ID NO: 10010484 - DNA, 22 bp, Homo sapiens
cagcatggggatcactgtaggc

SEQ ID NO: 10010485 - DNA, 22 bp, Homo sapiens
cagcatggtgccagtgagtcca

SEQ ID NO: 10010486 - DNA, 22 bp, Homo sapiens
cagcatggtgccagtgagtcca

SEQ ID NO: 10010487 - DNA, 22 bp, Homo sapiens
atttctcttcctcctagggttg

SEQ ID NO: 10010488 - DNA, 22 bp, Homo sapiens
atttctcttagcaagacattac

SEQ ID NO: 10010489 - DNA, 23 bp, Homo sapiens
atttgaaactttcttgtttccag

SEQ ID NO: 10010490 - DNA, 23 bp, Homo sapiens
atttgaaactttcttgtttccag

SEQ ID NO: 10010491 - DNA, 22 bp, Homo sapiens
atttgaaaacctgagcctcccg

SEQ ID NO: 10010492 - DNA, 22 bp, Homo sapiens
atttgaaaacctgagcctcccg

SEQ ID NO: 10010493 - DNA, 22 bp, Homo sapiens
atttcttttcaagagggtgctt

SEQ ID NO: 10010494 - DNA, 22 bp, Homo sapiens
atttcttttcaagagggtgctt

SEQ ID NO: 10010495 - DNA, 22 bp, Homo sapiens
atttctttctggccacggtttt

SEQ ID NO: 10010496 - DNA, 23 bp, Homo sapiens
atttacagctgtgtgagcaagtt

SEQ ID NO: 10010497 - DNA, 22 bp, Homo sapiens
atttacaggacagcttggcatt

SEQ ID NO: 10010498 - DNA, 22 bp, Homo sapiens
atttacaggacagcttggcatt

SEQ ID NO: 10010499 - DNA, 22 bp, Homo sapiens
atttacaggtagaattttaagt

SEQ ID NO: 10010500 - DNA, 22 bp, Homo sapiens
atttacagccttgaaaacagca

SEQ ID NO: 10010501 - DNA, 22 bp, Homo sapiens
atttacagccttgaaaacagca

SEQ ID NO: 10010502 - DNA, 22 bp, Homo sapiens
atttacagatgatgctatttga

SEQ ID NO: 10010503 - DNA, 22 bp, Homo sapiens
atttacagccttgaaaacagca

SEQ ID NO: 10010504 - DNA, 22 bp, Homo sapiens
atttacagccttgccatctata

SEQ ID NO: 10010505 - DNA, 23 bp, Homo sapiens
atttacagctgtgtgagcaagtt

SEQ ID NO: 10010506 - DNA, 22 bp, Homo sapiens
agatgagaatttttagagtgct

SEQ ID NO: 10010507 - DNA, 21 bp, Homo sapiens
agatgaggatactgaggccta

SEQ ID NO: 10010508 - DNA, 21 bp, Homo sapiens
agatgaggatactgaggccta

SEQ ID NO: 10010509 - DNA, 21 bp, Homo sapiens
agatgaggatactgaggccta

SEQ ID NO: 10010510 - DNA, 21 bp, Homo sapiens
agatgaggatactgaggccta

SEQ ID NO: 10010511 - DNA, 22 bp, Homo sapiens
agatgaggggtagaaaggactt

SEQ ID NO: 10010512 - DNA, 22 bp, Homo sapiens
agatgagtaaatggagtcttcc

SEQ ID NO: 10010513 - DNA, 22 bp, Homo sapiens
agatgaggggtagaaaggactt

SEQ ID NO: 10010514 - DNA, 23 bp, Homo sapiens
agatgaggcttctccatgttggt

SEQ ID NO: 10010515 - DNA, 22 bp, Homo sapiens
atttgaaatctgggttactctg

SEQ ID NO: 10010516 - DNA, 22 bp, Homo sapiens
atttgaaatctgggttactctg

SEQ ID NO: 10010517 - DNA, 22 bp, Homo sapiens
atttgaaatcccttctactgta

SEQ ID NO: 10010518 - DNA, 22 bp, Homo sapiens
atttgaaatcccttctactgta

SEQ ID NO: 10010519 - DNA, 22 bp, Homo sapiens
atttgaaatcccttctactgta

SEQ ID NO: 10010520 - DNA, 19 bp, Homo sapiens
atttgaaagctgtgcttgc

SEQ ID NO: 10010521 - DNA, 19 bp, Homo sapiens
atttgaaagctgtgcttgc

SEQ ID NO: 10010522 - DNA, 22 bp, Homo sapiens
atttgaagaaagttttctagat

SEQ ID NO: 10010523 - DNA, 22 bp, Homo sapiens
atttgaagtaagtaatgagtat

SEQ ID NO: 10010524 - DNA, 22 bp, Homo sapiens
atttgaatggcttaacacaacg

SEQ ID NO: 10010525 - DNA, 22 bp, Homo sapiens
agattgtagaaactgtagcatt

SEQ ID NO: 10010526 - DNA, 22 bp, Homo sapiens
agatttaaatttgctacaattc

SEQ ID NO: 10010527 - DNA, 22 bp, Homo sapiens
agatttaaatttgctacaattc

SEQ ID NO: 10010528 - DNA, 22 bp, Homo sapiens
agatttaaatttgctacaattc

SEQ ID NO: 10010529 - DNA, 22 bp, Homo sapiens
agatttacaaaggatttgcttt

SEQ ID NO: 10010530 - DNA, 22 bp, Homo sapiens
agatttatgtggtcacactcag

SEQ ID NO: 10010531 - DNA, 22 bp, Homo sapiens
agatttatgtggtcacactcag

SEQ ID NO: 10010532 - DNA, 22 bp, Homo sapiens
agatttatgtggtcacactcag

SEQ ID NO: 10010533 - DNA, 21 bp, Homo sapiens
attttgtacatagaatttgtc

SEQ ID NO: 10010534 - DNA, 22 bp, Homo sapiens
attttctgtaactatttctata

SEQ ID NO: 10010535 - DNA, 22 bp, Homo sapiens
attttctgtaactatttctata

SEQ ID NO: 10010536 - DNA, 22 bp, Homo sapiens
agattcatgggtctaaccagtg

SEQ ID NO: 10010537 - DNA, 22 bp, Homo sapiens
agattcatgggaaagctttagg

SEQ ID NO: 10010538 - DNA, 22 bp, Homo sapiens
agattcattgtggatattttct

SEQ ID NO: 10010539 - DNA, 22 bp, Homo sapiens
agattcaggactggccacagcc

SEQ ID NO: 10010540 - DNA, 22 bp, Homo sapiens
agattcagttaaggctggtaga

SEQ ID NO: 10010541 - DNA, 22 bp, Homo sapiens
agatgtttgtaaacacactgct

SEQ ID NO: 10010542 - DNA, 22 bp, Homo sapiens
agatgtttcagtaatttatctt

SEQ ID NO: 10010543 - DNA, 22 bp, Homo sapiens
agatgatatactacatggcttc

SEQ ID NO: 10010544 - DNA, 22 bp, Homo sapiens
agattctcggtccgggcagccc

SEQ ID NO: 10010545 - DNA, 22 bp, Homo sapiens
agattctactctagatccatgg

SEQ ID NO: 10010546 - DNA, 22 bp, Homo sapiens
agattcctcagtcatgaagcct

SEQ ID NO: 10010547 - DNA, 22 bp, Homo sapiens
agattccagatcccaaaaatga

SEQ ID NO: 10010548 - DNA, 22 bp, Homo sapiens
agattgaatatagagattcttg

SEQ ID NO: 10010549 - DNA, 22 bp, Homo sapiens
agattgatagatgtttctaaaa

SEQ ID NO: 10010550 - DNA, 22 bp, Homo sapiens
agattggttccttgctttgaaa

SEQ ID NO: 10010551 - DNA, 22 bp, Homo sapiens
caaagtgctgggattacaggct

SEQ ID NO: 10010552 - DNA, 22 bp, Homo sapiens
caaagtgctgggattacaggct

SEQ ID NO: 10010553 - DNA, 22 bp, Homo sapiens
caaagtgctgggattataggca

SEQ ID NO: 10010554 - DNA, 22 bp, Homo sapiens
caaagtgctgggattagtgctg

SEQ ID NO: 10010555 - DNA, 22 bp, Homo sapiens
caaagtgctgggattacaggtg

SEQ ID NO: 10010556 - DNA, 22 bp, Homo sapiens
caaagtgctgggattacaggtg

SEQ ID NO: 10010557 - DNA, 22 bp, Homo sapiens
caaacattttctacttccagga

SEQ ID NO: 10010558 - DNA, 22 bp, Homo sapiens
caaacattttgagtggtttctg

SEQ ID NO: 10010559 - DNA, 22 bp, Homo sapiens
caaacattttgagtggtttctg

SEQ ID NO: 10010560 - DNA, 22 bp, Homo sapiens
caaacatttgttggaacccctg

SEQ ID NO: 10010561 - DNA, 22 bp, Homo sapiens
caaacattttctacttccagga

SEQ ID NO: 10010562 - DNA, 22 bp, Homo sapiens
caaacattttaaataagggata

SEQ ID NO: 10010563 - DNA, 22 bp, Homo sapiens
caaacatttaggaggagggagg

SEQ ID NO: 10010564 - DNA, 22 bp, Homo sapiens
caaacatttgacttctctcagg

SEQ ID NO: 10010565 - DNA, 22 bp, Homo sapiens
caaacattgggggcttcaacac

SEQ ID NO: 10010566 - DNA, 22 bp, Homo sapiens
caaacattgggggcttcaacac

SEQ ID NO: 10010567 - DNA, 22 bp, Homo sapiens
caaacattgctaccagaggttt

SEQ ID NO: 10010568 - DNA, 22 bp, Homo sapiens
caaacattgggggcttcaacac

SEQ ID NO: 10010569 - DNA, 22 bp, Homo sapiens
agcaatcagcttctttgtgttt

SEQ ID NO: 10010570 - DNA, 22 bp, Homo sapiens
caaacattgctaccagaggttt

SEQ ID NO: 10010571 - DNA, 22 bp, Homo sapiens
agcaataagggatcctctataa

SEQ ID NO: 10010572 - DNA, 22 bp, Homo sapiens
agcaatagataaaacatttacc

SEQ ID NO: 10010573 - DNA, 22 bp, Homo sapiens
caaagtttggctctcatgacat

SEQ ID NO: 10010574 - DNA, 22 bp, Homo sapiens
caaagttttagtaaacatatat

SEQ ID NO: 10010575 - DNA, 22 bp, Homo sapiens
caaagttttagtaaacatatat

SEQ ID NO: 10010576 - DNA, 22 bp, Homo sapiens
caaagtttggctctcatgacat

SEQ ID NO: 10010577 - DNA, 22 bp, Homo sapiens
caaagtttggctctcatgacat

SEQ ID NO: 10010578 - DNA, 22 bp, Homo sapiens
caaagtttaaagtagatttcag

SEQ ID NO: 10010579 - DNA, 22 bp, Homo sapiens
caaagttctcggctcaagtcct

SEQ ID NO: 10010580 - DNA, 22 bp, Homo sapiens
agcaatgaaatgaaatcagtct

SEQ ID NO: 10010581 - DNA, 22 bp, Homo sapiens
agcaatgaaatgaaatcagtct

SEQ ID NO: 10010582 - DNA, 23 bp, Homo sapiens
agcaatctgtgtttcagcaagcc

SEQ ID NO: 10010583 - DNA, 22 bp, Homo sapiens
caaataattactatcctcactt

SEQ ID NO: 10010584 - DNA, 22 bp, Homo sapiens
agcaatgactttgaaatcatga

SEQ ID NO: 10010585 - DNA, 22 bp, Homo sapiens
agcaatgactttgaaatcatga

SEQ ID NO: 10010586 - DNA, 22 bp, Homo sapiens
agcaatgactttgaaatcatga

SEQ ID NO: 10010587 - DNA, 22 bp, Homo sapiens
agcaatgactggctatatgatt

SEQ ID NO: 10010588 - DNA, 22 bp, Homo sapiens
agcaatgaccagtgatcttgta

SEQ ID NO: 10010589 - DNA, 22 bp, Homo sapiens
agcaatgactggctatatgatt

SEQ ID NO: 10010590 - DNA, 22 bp, Homo sapiens
agcaatgtaaaccctgaagttg

SEQ ID NO: 10010591 - DNA, 22 bp, Homo sapiens
agcaatgtggaccagctcaggg

SEQ ID NO: 10010592 - DNA, 22 bp, Homo sapiens
agcaatgttggggttagaggac

SEQ ID NO: 10010593 - DNA, 22 bp, Homo sapiens
agcaatgttggcctatatacct

SEQ ID NO: 10010594 - DNA, 22 bp, Homo sapiens
agcaatgtgacccctgacagca

SEQ ID NO: 10010595 - DNA, 23 bp, Homo sapiens
agcaatgctgggagactctgtaa

SEQ ID NO: 10010596 - DNA, 22 bp, Homo sapiens
agcaatgatgttttcaagtagg

SEQ ID NO: 10010597 - DNA, 22 bp, Homo sapiens
agcaatgatgttttcaagtagg

SEQ ID NO: 10010598 - DNA, 22 bp, Homo sapiens
agcaatgcaatcttaaccttga

SEQ ID NO: 10010599 - DNA, 22 bp, Homo sapiens
attttgttgatggtggagtagc

SEQ ID NO: 10010600 - DNA, 20 bp, Homo sapiens
attttgtttatgttcctctc

SEQ ID NO: 10010601 - DNA, 22 bp, Homo sapiens
attttttagccaagactctgca

SEQ ID NO: 10010602 - DNA, 22 bp, Homo sapiens
attttttagccaagactctgca

SEQ ID NO: 10010603 - DNA, 22 bp, Homo sapiens
attttttagccaagactctgca

SEQ ID NO: 10010604 - DNA, 22 bp, Homo sapiens
attttttatataccaaggtggg

SEQ ID NO: 10010605 - DNA, 22 bp, Homo sapiens
attttttcagattgagtgttaa

SEQ ID NO: 10010606 - DNA, 22 bp, Homo sapiens
attttttcagattgagtgttaa

SEQ ID NO: 10010607 - DNA, 22 bp, Homo sapiens
attttttatataccaaggtggg

SEQ ID NO: 10010608 - DNA, 22 bp, Homo sapiens
attttttatataccaaggtggg

SEQ ID NO: 10010609 - DNA, 22 bp, Homo sapiens
attttgttatagaactctgtga

SEQ ID NO: 10010610 - DNA, 22 bp, Homo sapiens
attttgttaatgtcaccgtgct

SEQ ID NO: 10010611 - DNA, 22 bp, Homo sapiens
attttgtgggttctgctgatgt

SEQ ID NO: 10010612 - DNA, 22 bp, Homo sapiens
attttgtgaaccctcaagcaat

SEQ ID NO: 10010613 - DNA, 22 bp, Homo sapiens
attttgtgaaccctcaagcaat

SEQ ID NO: 10010614 - DNA, 22 bp, Homo sapiens
attttgtggcagatgcagaacc

SEQ ID NO: 10010615 - DNA, 22 bp, Homo sapiens
attttgtggcagatgcagaacc

SEQ ID NO: 10010616 - DNA, 22 bp, Homo sapiens
attttgttgaggtaattgtcaa

SEQ ID NO: 10010617 - DNA, 22 bp, Homo sapiens
attttgttatcagggctttgca

SEQ ID NO: 10010618 - DNA, 22 bp, Homo sapiens
attttgttataggagctgaaat

SEQ ID NO: 10010619 - DNA, 22 bp, Homo sapiens
attttgttatagaactctgtga

SEQ ID NO: 10010620 - DNA, 22 bp, Homo sapiens
attttgttataggagctgaaat

SEQ ID NO: 10010621 - DNA, 22 bp, Homo sapiens
attttgttatcagggctttgca

SEQ ID NO: 10010622 - DNA, 22 bp, Homo sapiens
attttgttataggagctgaaat

SEQ ID NO: 10010623 - DNA, 22 bp, Homo sapiens
agcaataacagaaaactttcct

SEQ ID NO: 10010624 - DNA, 22 bp, Homo sapiens
agcaataacagaaaactttcct

SEQ ID NO: 10010625 - DNA, 22 bp, Homo sapiens
agcaataaccactctaatttat

SEQ ID NO: 10010626 - DNA, 23 bp, Homo sapiens
agcaataagaagggatacatgtg

SEQ ID NO: 10010627 - DNA, 23 bp, Homo sapiens
agcaataagaagggatacatgtg

SEQ ID NO: 10010628 - DNA, 22 bp, Homo sapiens
agcaataaatgtaaaggttaag

SEQ ID NO: 10010629 - DNA, 22 bp, Homo sapiens
agcaagtagtaccaagtagctc

SEQ ID NO: 10010630 - DNA, 22 bp, Homo sapiens
agcaaggggcagtgaaagtgtg

SEQ ID NO: 10010631 - DNA, 22 bp, Homo sapiens
agcaaggggcagtgaaagtgtg

SEQ ID NO: 10010632 - DNA, 22 bp, Homo sapiens
agcaaggtggagaaggatgggt

SEQ ID NO: 10010633 - DNA, 22 bp, Homo sapiens
agcaaggctgggtctaatgggg

SEQ ID NO: 10010634 - DNA, 22 bp, Homo sapiens
agcaaggctcttaatgcccaaa

SEQ ID NO: 10010635 - DNA, 22 bp, Homo sapiens
agcaaggcttcagagctgtctg

SEQ ID NO: 10010636 - DNA, 22 bp, Homo sapiens
agcaaggctcggtcagggtgat

SEQ ID NO: 10010637 - DNA, 22 bp, Homo sapiens
agcaaggctcttaatgcccaaa

SEQ ID NO: 10010638 - DNA, 22 bp, Homo sapiens
attttttctgtaaactggcctt

SEQ ID NO: 10010639 - DNA, 22 bp, Homo sapiens
attttttcccagttagccagga

SEQ ID NO: 10010640 - DNA, 22 bp, Homo sapiens
attttttcccagttagccagga

SEQ ID NO: 10010641 - DNA, 22 bp, Homo sapiens
attgttaaagtaataaccatgg

SEQ ID NO: 10010642 - DNA, 22 bp, Homo sapiens
agataaattcctaagatttcag

SEQ ID NO: 10010643 - DNA, 22 bp, Homo sapiens
agataaattcctaagatttcag

SEQ ID NO: 10010644 - DNA, 22 bp, Homo sapiens
agataattatgtcaatttcttg

SEQ ID NO: 10010645 - DNA, 22 bp, Homo sapiens
agataattatttacttcaaagt

SEQ ID NO: 10010646 - DNA, 22 bp, Homo sapiens
agataattatttacttcaaagt

SEQ ID NO: 10010647 - DNA, 22 bp, Homo sapiens
agataattatttacttcaaagt

SEQ ID NO: 10010648 - DNA, 22 bp, Homo sapiens
agatacaactcagaagtgtggt

SEQ ID NO: 10010649 - DNA, 22 bp, Homo sapiens
agatacaactcagaagtgtggt

SEQ ID NO: 10010650 - DNA, 22 bp, Homo sapiens
agatacaaaggcctacagagca

SEQ ID NO: 10010651 - DNA, 22 bp, Homo sapiens
agatacaaaggcctacagagca

SEQ ID NO: 10010652 - DNA, 22 bp, Homo sapiens
agatacaaaaagggagaagatt

SEQ ID NO: 10010653 - DNA, 22 bp, Homo sapiens
agatacaaaagataagatttag

SEQ ID NO: 10010654 - DNA, 22 bp, Homo sapiens
agatacacagccctgccatcac

SEQ ID NO: 10010655 - DNA, 22 bp, Homo sapiens
atttacagatgatgctatttga

SEQ ID NO: 10010656 - DNA, 22 bp, Homo sapiens
atttacagacgtggattagtgc

SEQ ID NO: 10010657 - DNA, 22 bp, Homo sapiens
atttacagacgtggattagtgc

SEQ ID NO: 10010658 - DNA, 23 bp, Homo sapiens
agatacagatctacgtgtcaatg

SEQ ID NO: 10010659 - DNA, 22 bp, Homo sapiens
agatacaagaggcctgacgtgt

SEQ ID NO: 10010660 - DNA, 22 bp, Homo sapiens
agatacaactgtttaaacatta

SEQ ID NO: 10010661 - DNA, 22 bp, Homo sapiens
agatacaagttaagagaaagga

SEQ ID NO: 10010662 - DNA, 22 bp, Homo sapiens
agatacaagttaagagaaagga

SEQ ID NO: 10010663 - DNA, 22 bp, Homo sapiens
agatacaagttaagagaaagga

SEQ ID NO: 10010664 - DNA, 22 bp, Homo sapiens
agatacaaggcagagatgtgca

SEQ ID NO: 10010665 - DNA, 22 bp, Homo sapiens
agatacaaggcagagatgtgca

SEQ ID NO: 10010666 - DNA, 22 bp, Homo sapiens
attgtatttccagcttgaatgt

SEQ ID NO: 10010667 - DNA, 22 bp, Homo sapiens
attgtgtcctcattgaccttca

SEQ ID NO: 10010668 - DNA, 22 bp, Homo sapiens
attgttaaagtaataaccatgg

SEQ ID NO: 10010669 - DNA, 22 bp, Homo sapiens
attgtgtggtgaatgatcagct

SEQ ID NO: 10010670 - DNA, 22 bp, Homo sapiens
attgtgtttgaatgaggctcca

SEQ ID NO: 10010671 - DNA, 22 bp, Homo sapiens
attgttaaactgaagcattact

SEQ ID NO: 10010672 - DNA, 22 bp, Homo sapiens
attgagaattgtgagtttggag

SEQ ID NO: 10010673 - DNA, 22 bp, Homo sapiens
attgagaatatgatttagtata

SEQ ID NO: 10010674 - DNA, 22 bp, Homo sapiens
attggtgcaatagtcaggagct

SEQ ID NO: 10010675 - DNA, 22 bp, Homo sapiens
attggtctgtgagctgttgaca

SEQ ID NO: 10010676 - DNA, 22 bp, Homo sapiens
attggtgcaattatgagggtgt

SEQ ID NO: 10010677 - DNA, 22 bp, Homo sapiens
attggtctggggaaatgaagag

SEQ ID NO: 10010678 - DNA, 22 bp, Homo sapiens
attgtatacaagcttaattgtt

SEQ ID NO: 10010679 - DNA, 22 bp, Homo sapiens
attgtatcccccaggtgtttaa

SEQ ID NO: 10010680 - DNA, 22 bp, Homo sapiens
attgtataagtctatttacaat

SEQ ID NO: 10010681 - DNA, 22 bp, Homo sapiens
attggtgcatgtaggtgatgct

SEQ ID NO: 10010682 - DNA, 22 bp, Homo sapiens
attggtgcattttacaaaactc

SEQ ID NO: 10010683 - DNA, 22 bp, Homo sapiens
attggtgctctggcacattcct

SEQ ID NO: 10010684 - DNA, 22 bp, Homo sapiens
attgtataacagcatgtatttt

SEQ ID NO: 10010685 - DNA, 22 bp, Homo sapiens
attgtataacagcatgtatttt

SEQ ID NO: 10010686 - DNA, 22 bp, Homo sapiens
attgtataagtctatttacaat

SEQ ID NO: 10010687 - DNA, 22 bp, Homo sapiens
attgagaaaggcttatgtttgc

SEQ ID NO: 10010688 - DNA, 22 bp, Homo sapiens
attgaaattgatgaaattcttg

SEQ ID NO: 10010689 - DNA, 22 bp, Homo sapiens
attgagaagaaaatctaatata

SEQ ID NO: 10010690 - DNA, 22 bp, Homo sapiens
attgagaagcttgcagattttt

SEQ ID NO: 10010691 - DNA, 22 bp, Homo sapiens
attgaaagcacaaagaacaagt

SEQ ID NO: 10010692 - DNA, 22 bp, Homo sapiens
attgaaagcacaaagaacaagt

SEQ ID NO: 10010693 - DNA, 22 bp, Homo sapiens
attgaaagcatggatttggatt

SEQ ID NO: 10010694 - DNA, 22 bp, Homo sapiens
attgaaagcatggatttggatt

SEQ ID NO: 10010695 - DNA, 21 bp, Homo sapiens
attgaaagtcaacaatcagtt

SEQ ID NO: 10010696 - DNA, 22 bp, Homo sapiens
attgaaaggttttgagcagata

SEQ ID NO: 10010697 - DNA, 22 bp, Homo sapiens
attgaaaatgacatttgtgccc

SEQ ID NO: 10010698 - DNA, 22 bp, Homo sapiens
attgaaaatgacatttgtgccc

SEQ ID NO: 10010699 - DNA, 22 bp, Homo sapiens
attgaaacaagttgctttctat

SEQ ID NO: 10010700 - DNA, 22 bp, Homo sapiens
attgaaagataggctactgtgg

SEQ ID NO: 10010701 - DNA, 22 bp, Homo sapiens
attgaaaatataattctaggag

SEQ ID NO: 10010702 - DNA, 22 bp, Homo sapiens
attgaaaataaggccagaaaca

SEQ ID NO: 10010703 - DNA, 22 bp, Homo sapiens
attgaaaatataattctaggag

SEQ ID NO: 10010704 - DNA, 22 bp, Homo sapiens
attgaaaaatgactattgctta

SEQ ID NO: 10010705 - DNA, 22 bp, Homo sapiens
attgaaaaattcacaattctgg

SEQ ID NO: 10010706 - DNA, 22 bp, Homo sapiens
attgaaaaatgactattgctta

SEQ ID NO: 10010707 - DNA, 22 bp, Homo sapiens
attgaaaataaggccagaaaca

SEQ ID NO: 10010708 - DNA, 22 bp, Homo sapiens
attgaaaataaggccagaaaca

SEQ ID NO: 10010709 - DNA, 22 bp, Homo sapiens
attgaaaaattcacaattctgg

SEQ ID NO: 10010710 - DNA, 22 bp, Homo sapiens
attctaaatcagagagctctgt

SEQ ID NO: 10010711 - DNA, 22 bp, Homo sapiens
attctaaatcagagagctctgt

SEQ ID NO: 10010712 - DNA, 22 bp, Homo sapiens
attctaaatgtaatttagaatt

SEQ ID NO: 10010713 - DNA, 22 bp, Homo sapiens
attctaaagcttgtggagctta

SEQ ID NO: 10010714 - DNA, 22 bp, Homo sapiens
attctaaagcttgtggagctta

SEQ ID NO: 10010715 - DNA, 22 bp, Homo sapiens
attctaagcacgctgaagtctt

SEQ ID NO: 10010716 - DNA, 23 bp, Homo sapiens
attctaagatgtgatcttataac

SEQ ID NO: 10010717 - DNA, 22 bp, Homo sapiens
attctaagtgcttgtggtggtt

SEQ ID NO: 10010718 - DNA, 22 bp, Homo sapiens
attctaatgccctggccccagc

SEQ ID NO: 10010719 - DNA, 22 bp, Homo sapiens
attctaatggcagagactcctg

SEQ ID NO: 10010720 - DNA, 22 bp, Homo sapiens
attctacaaaagaactggatct

SEQ ID NO: 10010721 - DNA, 22 bp, Homo sapiens
attctaattagttctacatgtt

SEQ ID NO: 10010722 - DNA, 22 bp, Homo sapiens
attctacaaaagaactggatct

SEQ ID NO: 10010723 - DNA, 22 bp, Homo sapiens
attcaaaagaccatgcagactc

SEQ ID NO: 10010724 - DNA, 22 bp, Homo sapiens
attcaaaagaccatgcagactc

SEQ ID NO: 10010725 - DNA, 22 bp, Homo sapiens
attcaaaagaccatgcagactc

SEQ ID NO: 10010726 - DNA, 22 bp, Homo sapiens
attcaaaagaccatgcagactc

SEQ ID NO: 10010727 - DNA, 22 bp, Homo sapiens
attcaaaccccatagacaactt

SEQ ID NO: 10010728 - DNA, 22 bp, Homo sapiens
attcaaacctcatttattgttc

SEQ ID NO: 10010729 - DNA, 22 bp, Homo sapiens
attcaaactgtgttaggcagca

SEQ ID NO: 10010730 - DNA, 22 bp, Homo sapiens
attcaaaccccatagacaactt

SEQ ID NO: 10010731 - DNA, 22 bp, Homo sapiens
attcaaacaggccaattgacct

SEQ ID NO: 10010732 - DNA, 22 bp, Homo sapiens
attcaaacaggaagaaatcatt

SEQ ID NO: 10010733 - DNA, 22 bp, Homo sapiens
attcaaacaggaagaaatcatt

SEQ ID NO: 10010734 - DNA, 22 bp, Homo sapiens
attcaaacaggaagaaatcatt

SEQ ID NO: 10010735 - DNA, 22 bp, Homo sapiens
attcaaactgtgttaggcagca

SEQ ID NO: 10010736 - DNA, 22 bp, Homo sapiens
attcaaagaacctttagcattg

SEQ ID NO: 10010737 - DNA, 22 bp, Homo sapiens
attcttctgcctactttcatcc

SEQ ID NO: 10010738 - DNA, 22 bp, Homo sapiens
attcttctgcctactttcatcc

SEQ ID NO: 10010739 - DNA, 19 bp, Homo sapiens
attcttctcttcctgctgt

SEQ ID NO: 10010740 - DNA, 22 bp, Homo sapiens
attctctgtgcagatttaagac

SEQ ID NO: 10010741 - DNA, 20 bp, Homo sapiens
attctctgacaccgcccccg

SEQ ID NO: 10010742 - DNA, 22 bp, Homo sapiens
attctctgaagtctttcagggc

SEQ ID NO: 10010743 - DNA, 20 bp, Homo sapiens
attctacaagaataagcatg

SEQ ID NO: 10010744 - DNA, 22 bp, Homo sapiens
attctctcttctgctgcccgtg

SEQ ID NO: 10010745 - DNA, 22 bp, Homo sapiens
attctctctagaagctgagatg

SEQ ID NO: 10010746 - DNA, 22 bp, Homo sapiens
attctctctagaagctgagatg

SEQ ID NO: 10010747 - DNA, 22 bp, Homo sapiens
attctctctctatgaaaactga

SEQ ID NO: 10010748 - DNA, 22 bp, Homo sapiens
attctctcatttatctgtccta

SEQ ID NO: 10010749 - DNA, 22 bp, Homo sapiens
attctctagtctcttccataaa

SEQ ID NO: 10010750 - DNA, 22 bp, Homo sapiens
agaggccagggacactgctcaa

SEQ ID NO: 10010751 - DNA, 22 bp, Homo sapiens
agaggccagggacactgctcaa

SEQ ID NO: 10010752 - DNA, 22 bp, Homo sapiens
agaggccctctctgctcagtct

SEQ ID NO: 10010753 - DNA, 22 bp, Homo sapiens
agaggaaatggataaagggtga

SEQ ID NO: 10010754 - DNA, 21 bp, Homo sapiens
agaggaagaagagtgtattat

SEQ ID NO: 10010755 - DNA, 22 bp, Homo sapiens
agaggaacccagacagggcttt

SEQ ID NO: 10010756 - DNA, 22 bp, Homo sapiens
agaggaaacataggtttttaaa

SEQ ID NO: 10010757 - DNA, 22 bp, Homo sapiens
agagctttttgacatctctcta

SEQ ID NO: 10010758 - DNA, 23 bp, Homo sapiens
agagctttccagtttcttggtga

SEQ ID NO: 10010759 - DNA, 23 bp, Homo sapiens
agagctttctaaaatgtaaatct

SEQ ID NO: 10010760 - DNA, 22 bp, Homo sapiens
agagctttgggacatttgctag

SEQ ID NO: 10010761 - DNA, 22 bp, Homo sapiens
agagctttagctgctggtctgg

SEQ ID NO: 10010762 - DNA, 22 bp, Homo sapiens
agagcttttacttacattctat

SEQ ID NO: 10010763 - DNA, 22 bp, Homo sapiens
agagcttttacttacattctat

SEQ ID NO: 10010764 - DNA, 22 bp, Homo sapiens
agagcttttacttacattctat

SEQ ID NO: 10010765 - DNA, 22 bp, Homo sapiens
agagctttgtttgattgtcaga

SEQ ID NO: 10010766 - DNA, 23 bp, Homo sapiens
agagctttctaaaatgtaaatct

SEQ ID NO: 10010767 - DNA, 22 bp, Homo sapiens
agagctttgtttgattgtcaga

SEQ ID NO: 10010768 - DNA, 22 bp, Homo sapiens
agagcttttctgtaataacatc

SEQ ID NO: 10010769 - DNA, 22 bp, Homo sapiens
agagcttttgggaattcaggta

SEQ ID NO: 10010770 - DNA, 22 bp, Homo sapiens
agagcttttctgtaataacatc

SEQ ID NO: 10010771 - DNA, 22 bp, Homo sapiens
agagcttttctgtaataacatc

SEQ ID NO: 10010772 - DNA, 22 bp, Homo sapiens
attaatacattatagggattgt

SEQ ID NO: 10010773 - DNA, 22 bp, Homo sapiens
attaataaaataccactttgtt

SEQ ID NO: 10010774 - DNA, 22 bp, Homo sapiens
agagcttcactggagagcacat

SEQ ID NO: 10010775 - DNA, 22 bp, Homo sapiens
attaatacattatagggattgt

SEQ ID NO: 10010776 - DNA, 19 bp, Homo sapiens
agaggcctcagcagctggc

SEQ ID NO: 10010777 - DNA, 19 bp, Homo sapiens
agaggcctcagcagctggc

SEQ ID NO: 10010778 - DNA, 22 bp, Homo sapiens
agaggcctaaccaagatgtcct

SEQ ID NO: 10010779 - DNA, 22 bp, Homo sapiens
agaggcctaaccaagatgtcct

SEQ ID NO: 10010780 - DNA, 22 bp, Homo sapiens
agaggcctaattgctacccttt

SEQ ID NO: 10010781 - DNA, 22 bp, Homo sapiens
agaggccgggtgcctgctcaga

SEQ ID NO: 10010782 - DNA, 22 bp, Homo sapiens
agaggccggccgagcccatggg

SEQ ID NO: 10010783 - DNA, 22 bp, Homo sapiens
agaggccctggctagagcagct

SEQ ID NO: 10010784 - DNA, 22 bp, Homo sapiens
agaggccctgggctggtgtgct

SEQ ID NO: 10010785 - DNA, 22 bp, Homo sapiens
agaggcctctagggcccctcag

SEQ ID NO: 10010786 - DNA, 22 bp, Homo sapiens
agaggcctccgaaaggtgggct

SEQ ID NO: 10010787 - DNA, 22 bp, Homo sapiens
attatttctcactcacataata

SEQ ID NO: 10010788 - DNA, 22 bp, Homo sapiens
attatttctcactcacataata

SEQ ID NO: 10010789 - DNA, 22 bp, Homo sapiens
attatttgacttgagaacaggt

SEQ ID NO: 10010790 - DNA, 22 bp, Homo sapiens
attatttgtgtccacagaatac

SEQ ID NO: 10010791 - DNA, 18 bp, Homo sapiens
agagatgggagttggaaa

SEQ ID NO: 10010792 - DNA, 17 bp, Homo sapiens
atgtatattaactctga

SEQ ID NO: 10010793 - DNA, 17 bp, Homo sapiens
atgtatattaactctga

SEQ ID NO: 10010794 - DNA, 20 bp, Homo sapiens
atgtatattactggctgtga

SEQ ID NO: 10010795 - DNA, 22 bp, Homo sapiens
atgtatatgtgaaagatgttta

SEQ ID NO: 10010796 - DNA, 22 bp, Homo sapiens
atgtatatgtgtgcacgcacag

SEQ ID NO: 10010797 - DNA, 22 bp, Homo sapiens
atgtatatgcatgcattcaaag

SEQ ID NO: 10010798 - DNA, 22 bp, Homo sapiens
atgtatatgcatgcattcaaag

SEQ ID NO: 10010799 - DNA, 22 bp, Homo sapiens
atgtatatgcatgcattcaaag

SEQ ID NO: 10010800 - DNA, 22 bp, Homo sapiens
atgtatacgtgcaggtcacagg

SEQ ID NO: 10010801 - DNA, 22 bp, Homo sapiens
atgtataatgctaattagctag

SEQ ID NO: 10010802 - DNA, 22 bp, Homo sapiens
atgtatacgtgcaagtcacagg

SEQ ID NO: 10010803 - DNA, 22 bp, Homo sapiens
atgtataggagttatctgttgt

SEQ ID NO: 10010804 - DNA, 22 bp, Homo sapiens
atgtatactaacacatgcagtt

SEQ ID NO: 10010805 - DNA, 22 bp, Homo sapiens
atgtatatacttacatgtgtgg

SEQ ID NO: 10010806 - DNA, 22 bp, Homo sapiens
atgtatatacttacatgtgtgg

SEQ ID NO: 10010807 - DNA, 22 bp, Homo sapiens
atgtatatgaagctagtatttt

SEQ ID NO: 10010808 - DNA, 22 bp, Homo sapiens
atgtatatgaagctagtatttt

SEQ ID NO: 10010809 - DNA, 22 bp, Homo sapiens
atgtatatgaagctagtatttt

SEQ ID NO: 10010810 - DNA, 22 bp, Homo sapiens
atgtagttagaagattcaaaca

SEQ ID NO: 10010811 - DNA, 21 bp, Homo sapiens
atgtagggtttgccttctcta

SEQ ID NO: 10010812 - DNA, 22 bp, Homo sapiens
atgtagtactgggtatgtttct

SEQ ID NO: 10010813 - DNA, 22 bp, Homo sapiens
atgtagtatttggaaatgtaaa

SEQ ID NO: 10010814 - DNA, 22 bp, Homo sapiens
atgtacatagcatcatctagga

SEQ ID NO: 10010815 - DNA, 22 bp, Homo sapiens
atgtacatactgcattttcaaa

SEQ ID NO: 10010816 - DNA, 17 bp, Homo sapiens
agagagaaaagggccat

SEQ ID NO: 10010817 - DNA, 17 bp, Homo sapiens
agagagaaaagggccat

SEQ ID NO: 10010818 - DNA, 22 bp, Homo sapiens
agagactgtggctctttgaagg

SEQ ID NO: 10010819 - DNA, 22 bp, Homo sapiens
agagactgtgtccatcgtgcct

SEQ ID NO: 10010820 - DNA, 22 bp, Homo sapiens
agagactgtgtccatcgtgcct

SEQ ID NO: 10010821 - DNA, 21 bp, Homo sapiens
agagactgtcactgcagtacc

SEQ ID NO: 10010822 - DNA, 22 bp, Homo sapiens
agagactgtgccagccccatgc

SEQ ID NO: 10010823 - DNA, 22 bp, Homo sapiens
agagactgtcacataacagagg

SEQ ID NO: 10010824 - DNA, 22 bp, Homo sapiens
atgggccttgacacatggagtg

SEQ ID NO: 10010825 - DNA, 22 bp, Homo sapiens
atgggctaaacttagaggatat

SEQ ID NO: 10010826 - DNA, 22 bp, Homo sapiens
atgggctatcaaatggaggtat

SEQ ID NO: 10010827 - DNA, 22 bp, Homo sapiens
atgggctcggcgctgctgggat

SEQ ID NO: 10010828 - DNA, 22 bp, Homo sapiens
atgggctctatgtctaggagat

SEQ ID NO: 10010829 - DNA, 22 bp, Homo sapiens
agagactgatggatcaccaaat

SEQ ID NO: 10010830 - DNA, 22 bp, Homo sapiens
agagactgcaaatcataagaat

SEQ ID NO: 10010831 - DNA, 22 bp, Homo sapiens
agagactgcaaatcataagaat

SEQ ID NO: 10010832 - DNA, 22 bp, Homo sapiens
agagactgcaatgagtggtagg

SEQ ID NO: 10010833 - DNA, 22 bp, Homo sapiens
agagactgcaatgagtggtagg

SEQ ID NO: 10010834 - DNA, 22 bp, Homo sapiens
agagactggagttacgagttca

SEQ ID NO: 10010835 - DNA, 22 bp, Homo sapiens
agagactggcttctaaaatggc

SEQ ID NO: 10010836 - DNA, 22 bp, Homo sapiens
agagactgtaatgagaggtaca

SEQ ID NO: 10010837 - DNA, 22 bp, Homo sapiens
agagactgtacgtggcaagtat

SEQ ID NO: 10010838 - DNA, 22 bp, Homo sapiens
agagactgctttatattgtact

SEQ ID NO: 10010839 - DNA, 22 bp, Homo sapiens
agagaacattagcaaaaacagc

SEQ ID NO: 10010840 - DNA, 22 bp, Homo sapiens
agagaacattagcaaaaacagc

SEQ ID NO: 10010841 - DNA, 22 bp, Homo sapiens
agagaacattagcaaaaacagc

SEQ ID NO: 10010842 - DNA, 22 bp, Homo sapiens
agagaagacttacagccacagt

SEQ ID NO: 10010843 - DNA, 22 bp, Homo sapiens
agagaacagcctcctagagaaa

SEQ ID NO: 10010844 - DNA, 22 bp, Homo sapiens
agagaacagcctcctagagaaa

SEQ ID NO: 10010845 - DNA, 22 bp, Homo sapiens
agagaacagcctcctagagaaa

SEQ ID NO: 10010846 - DNA, 22 bp, Homo sapiens
agagaacatattttgtatgatt

SEQ ID NO: 10010847 - DNA, 22 bp, Homo sapiens
atggacagattaacacagtaga

SEQ ID NO: 10010848 - DNA, 22 bp, Homo sapiens
atggacagattaacacagtaga

SEQ ID NO: 10010849 - DNA, 21 bp, Homo sapiens
atggacaattgagtgtctgtc

SEQ ID NO: 10010850 - DNA, 22 bp, Homo sapiens
atggacagcaactggaagcttc

SEQ ID NO: 10010851 - DNA, 22 bp, Homo sapiens
atggaatgtttatacacagttg

SEQ ID NO: 10010852 - DNA, 22 bp, Homo sapiens
atggaatgtttatacacagttg

SEQ ID NO: 10010853 - DNA, 22 bp, Homo sapiens
atggaatgtttcctcttttatt

SEQ ID NO: 10010854 - DNA, 22 bp, Homo sapiens
atggacaatgccaatacagttt

SEQ ID NO: 10010855 - DNA, 22 bp, Homo sapiens
atggacaatgccaatacagttt

SEQ ID NO: 10010856 - DNA, 22 bp, Homo sapiens
atggacaaatgtaaggcataat

SEQ ID NO: 10010857 - DNA, 23 bp, Homo sapiens
atggacagggtttcagggtcaca

SEQ ID NO: 10010858 - DNA, 23 bp, Homo sapiens
atggacagggtttcagggtcaca

SEQ ID NO: 10010859 - DNA, 18 bp, Homo sapiens
atgggaggggccaagaga

SEQ ID NO: 10010860 - DNA, 18 bp, Homo sapiens
atgggaggggccaagaga

SEQ ID NO: 10010861 - DNA, 22 bp, Homo sapiens
atgggcagtaacagtggcagtc

SEQ ID NO: 10010862 - DNA, 22 bp, Homo sapiens
atgggcagttaggaggccagga

SEQ ID NO: 10010863 - DNA, 23 bp, Homo sapiens
atgggccaagcaagacccatgac

SEQ ID NO: 10010864 - DNA, 22 bp, Homo sapiens
atgggcctgttcctatgctggt

SEQ ID NO: 10010865 - DNA, 22 bp, Homo sapiens
atgggcagtgtattggaaggaa

SEQ ID NO: 10010866 - DNA, 22 bp, Homo sapiens
atgggcagtgtattggaaggaa

SEQ ID NO: 10010867 - DNA, 22 bp, Homo sapiens
atgggcagttaggaggccagga

SEQ ID NO: 10010868 - DNA, 22 bp, Homo sapiens
atgggcagtaacagtggcagtc

SEQ ID NO: 10010869 - DNA, 23 bp, Homo sapiens
atgtgcaaagtgctacagtatag

SEQ ID NO: 10010870 - DNA, 22 bp, Homo sapiens
atgtgcaacttcagcagaaagg

SEQ ID NO: 10010871 - DNA, 22 bp, Homo sapiens
atgtgcaacttttctgtctttt

SEQ ID NO: 10010872 - DNA, 22 bp, Homo sapiens
atgtgcaaggagtggctgttgt

SEQ ID NO: 10010873 - DNA, 22 bp, Homo sapiens
atgtgcacacagtgtcatgcaa

SEQ ID NO: 10010874 - DNA, 22 bp, Homo sapiens
atgtgcaattattaagaagaga

SEQ ID NO: 10010875 - DNA, 22 bp, Homo sapiens
atgtgcagttggtggccaggag

SEQ ID NO: 10010876 - DNA, 22 bp, Homo sapiens
atgtgcagttggtggccaggag

SEQ ID NO: 10010877 - DNA, 22 bp, Homo sapiens
atgtgcaggatccaggctccta

SEQ ID NO: 10010878 - DNA, 22 bp, Homo sapiens
atgtgcagcttttctagagaag

SEQ ID NO: 10010879 - DNA, 21 bp, Homo sapiens
atgtgcagcaagcagcatgct

SEQ ID NO: 10010880 - DNA, 23 bp, Homo sapiens
atgtgcacatctccttgtccacc

SEQ ID NO: 10010881 - DNA, 18 bp, Homo sapiens
atgtgcaattttgtattt

SEQ ID NO: 10010882 - DNA, 22 bp, Homo sapiens
agagattctgtgtcaaaacgaa

SEQ ID NO: 10010883 - DNA, 22 bp, Homo sapiens
agagattcatgtttactgtagg

SEQ ID NO: 10010884 - DNA, 22 bp, Homo sapiens
agagatgttcattcagcatgtt

SEQ ID NO: 10010885 - DNA, 22 bp, Homo sapiens
agagatgttcattcagcatgtt

SEQ ID NO: 10010886 - DNA, 22 bp, Homo sapiens
agagatgtcgccttgcccaggg

SEQ ID NO: 10010887 - DNA, 22 bp, Homo sapiens
atgttattttggaaaatacaaa

SEQ ID NO: 10010888 - DNA, 22 bp, Homo sapiens
atgttacacataggcataaatg

SEQ ID NO: 10010889 - DNA, 22 bp, Homo sapiens
agagccaggactgtgtctcact

SEQ ID NO: 10010890 - DNA, 22 bp, Homo sapiens
agagccaggaagtggcgtgggg

SEQ ID NO: 10010891 - DNA, 22 bp, Homo sapiens
agagccaggaagtggcgtgggg

SEQ ID NO: 10010892 - DNA, 22 bp, Homo sapiens
agagccaggaagtggcgtgggg

SEQ ID NO: 10010893 - DNA, 22 bp, Homo sapiens
atgttcaagtacctttgtgtct

SEQ ID NO: 10010894 - DNA, 22 bp, Homo sapiens
atgttcaacagtttgcacacat

SEQ ID NO: 10010895 - DNA, 22 bp, Homo sapiens
atgttcaagtacctttgtgtct

SEQ ID NO: 10010896 - DNA, 22 bp, Homo sapiens
atgttcaaactttttacacacc

SEQ ID NO: 10010897 - DNA, 22 bp, Homo sapiens
atgttcaaagatcgtgctatcc

SEQ ID NO: 10010898 - DNA, 22 bp, Homo sapiens
atgttcaaagatcgtgctatcc

SEQ ID NO: 10010899 - DNA, 22 bp, Homo sapiens
atgttcaaagatcgtgctatcc

SEQ ID NO: 10010900 - DNA, 22 bp, Homo sapiens
atgttcaaactttttacacacc

SEQ ID NO: 10010901 - DNA, 22 bp, Homo sapiens
atgttcatagcatcggtattca

SEQ ID NO: 10010902 - DNA, 22 bp, Homo sapiens
atgttcagttagcactgaagtc

SEQ ID NO: 10010903 - DNA, 22 bp, Homo sapiens
atgttcatatccccattctgat

SEQ ID NO: 10010904 - DNA, 18 bp, Homo sapiens
atgttcatatttttaggg

SEQ ID NO: 10010905 - DNA, 22 bp, Homo sapiens
atgttccttccagagagcagaa

SEQ ID NO: 10010906 - DNA, 22 bp, Homo sapiens
atgttcattagtcaacatttct

SEQ ID NO: 10010907 - DNA, 22 bp, Homo sapiens
atgttcatttgacaagtagtga

SEQ ID NO: 10010908 - DNA, 22 bp, Homo sapiens
atgttcattttcttaatgtgcc

SEQ ID NO: 10010909 - DNA, 22 bp, Homo sapiens
atgttcattttatggcgatgcc

SEQ ID NO: 10010910 - DNA, 22 bp, Homo sapiens
atgttcatgtggctgctggcag

SEQ ID NO: 10010911 - DNA, 22 bp, Homo sapiens
atgttcatgattggttttggcg

SEQ ID NO: 10010912 - DNA, 22 bp, Homo sapiens
atgttcatccatgtcgtagcag

SEQ ID NO: 10010913 - DNA, 22 bp, Homo sapiens
atgttcatctacaaggcattgt

SEQ ID NO: 10010914 - DNA, 22 bp, Homo sapiens
atgttcatcaacacattacaag

SEQ ID NO: 10010915 - DNA, 22 bp, Homo sapiens
agagccttgcctggggccctgt

SEQ ID NO: 10010916 - DNA, 23 bp, Homo sapiens
agagccttttcacacttcaatgt

SEQ ID NO: 10010917 - DNA, 22 bp, Homo sapiens
agagccttgctctaaatttctc

SEQ ID NO: 10010918 - DNA, 22 bp, Homo sapiens
agagcctttggagctgctatta

SEQ ID NO: 10010919 - DNA, 22 bp, Homo sapiens
atgttctacagatggaaagggg

SEQ ID NO: 10010920 - DNA, 22 bp, Homo sapiens
agagccttgaagatctggaaaa

SEQ ID NO: 10010921 - DNA, 22 bp, Homo sapiens
agagcctgttttgtgggagatg

SEQ ID NO: 10010922 - DNA, 22 bp, Homo sapiens
atgttctatatcattattgtga

SEQ ID NO: 10010923 - DNA, 22 bp, Homo sapiens
attaagtgactaaagtaatgct

SEQ ID NO: 10010924 - DNA, 22 bp, Homo sapiens
attaagtgactaaagtaatgct

SEQ ID NO: 10010925 - DNA, 22 bp, Homo sapiens
attaagtgactaaagtaatgct

SEQ ID NO: 10010926 - DNA, 18 bp, Homo sapiens
attaaggaattctttaga

SEQ ID NO: 10010927 - DNA, 22 bp, Homo sapiens
attaaggaggtaaactatggtt

SEQ ID NO: 10010928 - DNA, 22 bp, Homo sapiens
agagctctgcagctggcctcag

SEQ ID NO: 10010929 - DNA, 22 bp, Homo sapiens
attaaatactgcaggctaagca

SEQ ID NO: 10010930 - DNA, 22 bp, Homo sapiens
agagctccgtgcctggctgcca

SEQ ID NO: 10010931 - DNA, 22 bp, Homo sapiens
agagctccagggttttgtagtg

SEQ ID NO: 10010932 - DNA, 22 bp, Homo sapiens
agacagtgtaatgtaattgtta

SEQ ID NO: 10010933 - DNA, 22 bp, Homo sapiens
agacagtgtggttggtggttcc

SEQ ID NO: 10010934 - DNA, 19 bp, Homo sapiens
agacataaagagtttgcaa

SEQ ID NO: 10010935 - DNA, 22 bp, Homo sapiens
agacataaacttactgaaatac

SEQ ID NO: 10010936 - DNA, 22 bp, Homo sapiens
agacagttgatatactataaaa

SEQ ID NO: 10010937 - DNA, 22 bp, Homo sapiens
agacagtgtgtgtatatatggt

SEQ ID NO: 10010938 - DNA, 22 bp, Homo sapiens
agacataagtgctatgacattg

SEQ ID NO: 10010939 - DNA, 22 bp, Homo sapiens
agacataagtgctatgacattg

SEQ ID NO: 10010940 - DNA, 22 bp, Homo sapiens
agacataagcgagcatcacagg

SEQ ID NO: 10010941 - DNA, 22 bp, Homo sapiens
agacagtgctatcccatctgtg

SEQ ID NO: 10010942 - DNA, 22 bp, Homo sapiens
agacagtgctatcccatctgtg

SEQ ID NO: 10010943 - DNA, 22 bp, Homo sapiens
atgccaggtacaggggtagggt

SEQ ID NO: 10010944 - DNA, 22 bp, Homo sapiens
atgccagggtcatcccctgggt

SEQ ID NO: 10010945 - DNA, 19 bp, Homo sapiens
atgcaacaaaagtgtaaga

SEQ ID NO: 10010946 - DNA, 22 bp, Homo sapiens
atgcaaattctttgcttcttct

SEQ ID NO: 10010947 - DNA, 22 bp, Homo sapiens
atgcaacagtcagtacatccgg

SEQ ID NO: 10010948 - DNA, 22 bp, Homo sapiens
atgccagaaggcagaatttatc

SEQ ID NO: 10010949 - DNA, 22 bp, Homo sapiens
atgccactgcactccagcctag

SEQ ID NO: 10010950 - DNA, 22 bp, Homo sapiens
atgccacttcattccagcctcg

SEQ ID NO: 10010951 - DNA, 22 bp, Homo sapiens
atgccacttcattccagcctcg

SEQ ID NO: 10010952 - DNA, 22 bp, Homo sapiens
atgccaggaacaaacagtggtg

SEQ ID NO: 10010953 - DNA, 22 bp, Homo sapiens
atgccaggaacaaacagtggtg

SEQ ID NO: 10010954 - DNA, 22 bp, Homo sapiens
atgccaggaacaaacagtggtg

SEQ ID NO: 10010955 - DNA, 22 bp, Homo sapiens
atgccagacattaacgactatg

SEQ ID NO: 10010956 - DNA, 22 bp, Homo sapiens
atgccagcctctaagcacttta

SEQ ID NO: 10010957 - DNA, 22 bp, Homo sapiens
atgctgagactggagcagctgg

SEQ ID NO: 10010958 - DNA, 22 bp, Homo sapiens
atgctgaggacaaagagatcaa

SEQ ID NO: 10010959 - DNA, 22 bp, Homo sapiens
atgctgagcagagctgacatgc

SEQ ID NO: 10010960 - DNA, 22 bp, Homo sapiens
atgcttaggttaaatttgtaat

SEQ ID NO: 10010961 - DNA, 22 bp, Homo sapiens
atgcttaatgagggtatatatg

SEQ ID NO: 10010962 - DNA, 22 bp, Homo sapiens
atgctgaattgatgcgagggag

SEQ ID NO: 10010963 - DNA, 22 bp, Homo sapiens
atgctgaagagttcatgattat

SEQ ID NO: 10010964 - DNA, 22 bp, Homo sapiens
atgctgaagagtgcacaggcta

SEQ ID NO: 10010965 - DNA, 22 bp, Homo sapiens
atgcgtgtttgtatacacacaa

SEQ ID NO: 10010966 - DNA, 22 bp, Homo sapiens
atgcgtgtgtgcaaaccattgc

SEQ ID NO: 10010967 - DNA, 22 bp, Homo sapiens
atgcgtgtaggaacagtgtcta

SEQ ID NO: 10010968 - DNA, 22 bp, Homo sapiens
atgcgtgcaggggtcctcctgg

SEQ ID NO: 10010969 - DNA, 22 bp, Homo sapiens
agacatatattgcaattcactg

SEQ ID NO: 10010970 - DNA, 22 bp, Homo sapiens
atgcttcttgagatagaaacac

SEQ ID NO: 10010971 - DNA, 22 bp, Homo sapiens
atgcttcttgtatttggctgac

SEQ ID NO: 10010972 - DNA, 22 bp, Homo sapiens
agagaacagcattgcagctttg

SEQ ID NO: 10010973 - DNA, 22 bp, Homo sapiens
agagaacagacagatgcaatga

SEQ ID NO: 10010974 - DNA, 22 bp, Homo sapiens
agagaacaaattaaaggtggtt

SEQ ID NO: 10010975 - DNA, 22 bp, Homo sapiens
agagaacaaattaaaggtggtt

SEQ ID NO: 10010976 - DNA, 22 bp, Homo sapiens
atgcttcctcccttccactcaa

SEQ ID NO: 10010977 - DNA, 22 bp, Homo sapiens
atgcttccttaccagaagatga

SEQ ID NO: 10010978 - DNA, 22 bp, Homo sapiens
atgcttctcctgaacatccctg

SEQ ID NO: 10010979 - DNA, 22 bp, Homo sapiens
atgcttctcagctcaaggcaaa

SEQ ID NO: 10010980 - DNA, 18 bp, Homo sapiens
atgcttctgatagaagca

SEQ ID NO: 10010981 - DNA, 22 bp, Homo sapiens
atgcttccctttgctccacatg

SEQ ID NO: 10010982 - DNA, 21 bp, Homo sapiens
atcttaaaaggtcttaacttt

SEQ ID NO: 10010983 - DNA, 21 bp, Homo sapiens
atcttaaaaggtcttaacttt

SEQ ID NO: 10010984 - DNA, 21 bp, Homo sapiens
atcttaaaaggtcttaacttt

SEQ ID NO: 10010985 - DNA, 22 bp, Homo sapiens
atctgttgtttttcaccaccca

SEQ ID NO: 10010986 - DNA, 22 bp, Homo sapiens
atctgggggagctgctcatgga

SEQ ID NO: 10010987 - DNA, 22 bp, Homo sapiens
atctggcttacgaagcactggt

SEQ ID NO: 10010988 - DNA, 17 bp, Homo sapiens
atctggctgcttctaga

SEQ ID NO: 10010989 - DNA, 22 bp, Homo sapiens
atgaccagtgttgctggccccg

SEQ ID NO: 10010990 - DNA, 22 bp, Homo sapiens
atgacattgacagacctgctgc

SEQ ID NO: 10010991 - DNA, 22 bp, Homo sapiens
atgacattgaatatgttaacta

SEQ ID NO: 10010992 - DNA, 22 bp, Homo sapiens
atgacatttatacagtgagctt

SEQ ID NO: 10010993 - DNA, 22 bp, Homo sapiens
atgactgctctgggctcccatg

SEQ ID NO: 10010994 - DNA, 19 bp, Homo sapiens
atgactcttattgtctgaa

SEQ ID NO: 10010995 - DNA, 22 bp, Homo sapiens
atgacctgaggccttactctag

SEQ ID NO: 10010996 - DNA, 18 bp, Homo sapiens
atcttaacttgatggagt

SEQ ID NO: 10010997 - DNA, 22 bp, Homo sapiens
atcttaaacagaggaatgactt

SEQ ID NO: 10010998 - DNA, 18 bp, Homo sapiens
atcttaacttgatggagt

SEQ ID NO: 10010999 - DNA, 22 bp, Homo sapiens
atcttacacgataactgttagt

SEQ ID NO: 10011000 - DNA, 22 bp, Homo sapiens
atcttacactgttgggtttctc

SEQ ID NO: 10011001 - DNA, 22 bp, Homo sapiens
atcttacattccctcaccattt

SEQ ID NO: 10011002 - DNA, 23 bp, Homo sapiens
atcttacatatttagcacctgaa

SEQ ID NO: 10011003 - DNA, 22 bp, Homo sapiens
atcttagaagtttgataaaatc

SEQ ID NO: 10011004 - DNA, 22 bp, Homo sapiens
atcttagacccttggtagaaaa

SEQ ID NO: 10011005 - DNA, 22 bp, Homo sapiens
atcttagagagtcgtgttttgt

SEQ ID NO: 10011006 - DNA, 22 bp, Homo sapiens
atgacaatacttcaataagctg

SEQ ID NO: 10011007 - DNA, 22 bp, Homo sapiens
atgacttcgttttctctctgca

SEQ ID NO: 10011008 - DNA, 22 bp, Homo sapiens
atgacttcacctctgtgaagca

SEQ ID NO: 10011009 - DNA, 22 bp, Homo sapiens
atgagaaaattcattccatcca

SEQ ID NO: 10011010 - DNA, 22 bp, Homo sapiens
atgatatagagagtagattaaa

SEQ ID NO: 10011011 - DNA, 22 bp, Homo sapiens
atgatatatgtgttgagcttgc

SEQ ID NO: 10011012 - DNA, 20 bp, Homo sapiens
atgattctgggctacactgg

SEQ ID NO: 10011013 - DNA, 22 bp, Homo sapiens
atgattctcattttataaactt

SEQ ID NO: 10011014 - DNA, 20 bp, Homo sapiens
atgattcatgatgatgtctc

SEQ ID NO: 10011015 - DNA, 22 bp, Homo sapiens
atgattgcctgtgtgtgagaaa

SEQ ID NO: 10011016 - DNA, 22 bp, Homo sapiens
atgatttaaagtcattgtgaac

SEQ ID NO: 10011017 - DNA, 22 bp, Homo sapiens
atgatttccagttgttgctaag

SEQ ID NO: 10011018 - DNA, 22 bp, Homo sapiens
atgcaaatgctagagaatgttg

SEQ ID NO: 10011019 - DNA, 22 bp, Homo sapiens
atgattttctgataaagaactg

SEQ ID NO: 10011020 - DNA, 22 bp, Homo sapiens
atgcaaatgtcaccacttctaa

SEQ ID NO: 10011021 - DNA, 22 bp, Homo sapiens
atgcaaattaacatatagtaga

SEQ ID NO: 10011022 - DNA, 22 bp, Homo sapiens
atgcaaattaacatatagtaga

SEQ ID NO: 10011023 - DNA, 22 bp, Homo sapiens
atttccatgccttagcttaagg

SEQ ID NO: 10011024 - DNA, 22 bp, Homo sapiens
atttccatgaagtttagttata

SEQ ID NO: 10011025 - DNA, 22 bp, Homo sapiens
atttccattatcatgacaaatt

SEQ ID NO: 10011026 - DNA, 22 bp, Homo sapiens
atttccattatcatgacaaatt

SEQ ID NO: 10011027 - DNA, 22 bp, Homo sapiens
atttccattatcatgacaaatt

SEQ ID NO: 10011028 - DNA, 22 bp, Homo sapiens
atttccatgtccaaaaattagt

SEQ ID NO: 10011029 - DNA, 22 bp, Homo sapiens
atttccatgtccaaaaattagt

SEQ ID NO: 10011030 - DNA, 22 bp, Homo sapiens
atttccatgtcggtattttata

SEQ ID NO: 10011031 - DNA, 22 bp, Homo sapiens
atttccatgtcggtattttata

SEQ ID NO: 10011032 - DNA, 22 bp, Homo sapiens
atttccatgtcggtattttata

SEQ ID NO: 10011033 - DNA, 22 bp, Homo sapiens
gcccacagtacgaggctcaggc

SEQ ID NO: 10011034 - DNA, 17 bp, Homo sapiens
gcccacccttaggagct

SEQ ID NO: 10011035 - DNA, 22 bp, Homo sapiens
gcccacatttttggcttagagg

SEQ ID NO: 10011036 - DNA, 22 bp, Homo sapiens
atttctgtaacttatgaaagtt

SEQ ID NO: 10011037 - DNA, 22 bp, Homo sapiens
atttctgtaacttatgaaagtt

SEQ ID NO: 10011038 - DNA, 22 bp, Homo sapiens
atttctgtaacttatgaaagtt

SEQ ID NO: 10011039 - DNA, 22 bp, Homo sapiens
atttctgtagtccacattcttt

SEQ ID NO: 10011040 - DNA, 22 bp, Homo sapiens
atttctgtagtccacattcttt

SEQ ID NO: 10011041 - DNA, 22 bp, Homo sapiens
atttctgtagtccacattcttt

SEQ ID NO: 10011042 - DNA, 22 bp, Homo sapiens
atttctgatacccggtcaccct

SEQ ID NO: 10011043 - DNA, 22 bp, Homo sapiens
atttctgataaacgtaagctgc

SEQ ID NO: 10011044 - DNA, 22 bp, Homo sapiens
atttctgataaacgtaagctgc

SEQ ID NO: 10011045 - DNA, 22 bp, Homo sapiens
atttctgttatacctttctcag

SEQ ID NO: 10011046 - DNA, 22 bp, Homo sapiens
atttctgttatacctttctcag

SEQ ID NO: 10011047 - DNA, 22 bp, Homo sapiens
atttctgtggcttcattctcct

SEQ ID NO: 10011048 - DNA, 22 bp, Homo sapiens
atttctgtggcttcattctcct

SEQ ID NO: 10011049 - DNA, 22 bp, Homo sapiens
atttctgtggcttcattctcct

SEQ ID NO: 10011050 - DNA, 22 bp, Homo sapiens
atttctgtatcctgctgtcaga

SEQ ID NO: 10011051 - DNA, 22 bp, Homo sapiens
atttctgtgcagtaaatggtga

SEQ ID NO: 10011052 - DNA, 22 bp, Homo sapiens
atttctgtgcagtaaatggtga

SEQ ID NO: 10011053 - DNA, 22 bp, Homo sapiens
gccccaggttgcctgtcccagg

SEQ ID NO: 10011054 - DNA, 22 bp, Homo sapiens
atttctgttgcttataaattac

SEQ ID NO: 10011055 - DNA, 22 bp, Homo sapiens
atttctgttgcttataaattac

SEQ ID NO: 10011056 - DNA, 22 bp, Homo sapiens
gccccaggttgcctgtcccagg

SEQ ID NO: 10011057 - DNA, 22 bp, Homo sapiens
atttcatgtgaagaagagataa

SEQ ID NO: 10011058 - DNA, 22 bp, Homo sapiens
gccaggtggctgagcagctgca

SEQ ID NO: 10011059 - DNA, 22 bp, Homo sapiens
atttccaggctgttttgtgaat

SEQ ID NO: 10011060 - DNA, 22 bp, Homo sapiens
atttccaggctgttttgtgaat

SEQ ID NO: 10011061 - DNA, 22 bp, Homo sapiens
atttccagtactattttctgct

SEQ ID NO: 10011062 - DNA, 22 bp, Homo sapiens
gccaggtctgggtagcagagga

SEQ ID NO: 10011063 - DNA, 19 bp, Homo sapiens
gccaggtcttgggtccagg

SEQ ID NO: 10011064 - DNA, 22 bp, Homo sapiens
gccaggtggaggttgcagtgag

SEQ ID NO: 10011065 - DNA, 22 bp, Homo sapiens
gccaggctggaaagaacagaca

SEQ ID NO: 10011066 - DNA, 22 bp, Homo sapiens
gccaggctggaaagaacagaca

SEQ ID NO: 10011067 - DNA, 22 bp, Homo sapiens
gccaggctggccagcaccttct

SEQ ID NO: 10011068 - DNA, 22 bp, Homo sapiens
gccaggctggtcttgaactcct

SEQ ID NO: 10011069 - DNA, 19 bp, Homo sapiens
gccaggcctggacctgcag

SEQ ID NO: 10011070 - DNA, 19 bp, Homo sapiens
gccaggcctggacctgcag

SEQ ID NO: 10011071 - DNA, 22 bp, Homo sapiens
gccaggctgctggctgctgtcc

SEQ ID NO: 10011072 - DNA, 22 bp, Homo sapiens
gccacaggtgggctctgggaaa

SEQ ID NO: 10011073 - DNA, 22 bp, Homo sapiens
gccacaggtgggctctgggaaa

SEQ ID NO: 10011074 - DNA, 22 bp, Homo sapiens
gccacaggtggaattaagaaat

SEQ ID NO: 10011075 - DNA, 22 bp, Homo sapiens
gccacaggtgggctctgggaaa

SEQ ID NO: 10011076 - DNA, 22 bp, Homo sapiens
gccacaggtaggaacctacctc

SEQ ID NO: 10011077 - DNA, 22 bp, Homo sapiens
gccacaggtcggctagagggtc

SEQ ID NO: 10011078 - DNA, 22 bp, Homo sapiens
gccacaggtactatgggagaga

SEQ ID NO: 10011079 - DNA, 22 bp, Homo sapiens
gccacaggtactatgggagaga

SEQ ID NO: 10011080 - DNA, 22 bp, Homo sapiens
gccacaggtactatgggagaga

SEQ ID NO: 10011081 - DNA, 22 bp, Homo sapiens
gcctcttgtttccttacatgga

SEQ ID NO: 10011082 - DNA, 22 bp, Homo sapiens
gcctctgatggaggccagcgct

SEQ ID NO: 10011083 - DNA, 22 bp, Homo sapiens
gcctctgagtttggagaagagc

SEQ ID NO: 10011084 - DNA, 22 bp, Homo sapiens
gcctagggtgctcagggacgag

SEQ ID NO: 10011085 - DNA, 20 bp, Homo sapiens
gcctagggtcacttcagtga

SEQ ID NO: 10011086 - DNA, 22 bp, Homo sapiens
gcctagggttggcctgagaatc

SEQ ID NO: 10011087 - DNA, 22 bp, Homo sapiens
gcctattttattatgcatgtaa

SEQ ID NO: 10011088 - DNA, 19 bp, Homo sapiens
gcctatgtcttcaaatcat

SEQ ID NO: 10011089 - DNA, 22 bp, Homo sapiens
gcctatggattggagaaggagc

SEQ ID NO: 10011090 - DNA, 22 bp, Homo sapiens
gcctagggatgacaaatattct

SEQ ID NO: 10011091 - DNA, 21 bp, Homo sapiens
gcctagggagatgggactgcc

SEQ ID NO: 10011092 - DNA, 22 bp, Homo sapiens
gcctaggggtaagagtactggc

SEQ ID NO: 10011093 - DNA, 20 bp, Homo sapiens
gcctaggggttgggaaagca

SEQ ID NO: 10011094 - DNA, 22 bp, Homo sapiens
atttggaaatgtaagaatgcaa

SEQ ID NO: 10011095 - DNA, 22 bp, Homo sapiens
atttggaaatgtaagaatgcaa

SEQ ID NO: 10011096 - DNA, 22 bp, Homo sapiens
atttggaacttataataagttt

SEQ ID NO: 10011097 - DNA, 22 bp, Homo sapiens
atttggaacttataataagttt

SEQ ID NO: 10011098 - DNA, 22 bp, Homo sapiens
atttggaacttataataagttt

SEQ ID NO: 10011099 - DNA, 22 bp, Homo sapiens
atttggaactgggcatgcaaac

SEQ ID NO: 10011100 - DNA, 22 bp, Homo sapiens
gcccccagaagggccacagatt

SEQ ID NO: 10011101 - DNA, 22 bp, Homo sapiens
gcccccagacctcagtgggctg

SEQ ID NO: 10011102 - DNA, 22 bp, Homo sapiens
gcccccgtagtagatgaggcgc

SEQ ID NO: 10011103 - DNA, 22 bp, Homo sapiens
atttgccttttaaactcacaat

SEQ ID NO: 10011104 - DNA, 22 bp, Homo sapiens
atttgccttttaaactcacaat

SEQ ID NO: 10011105 - DNA, 19 bp, Homo sapiens
atttggaaataaggtcttc

SEQ ID NO: 10011106 - DNA, 22 bp, Homo sapiens
gcctgagaaggacacagcaggt

SEQ ID NO: 10011107 - DNA, 22 bp, Homo sapiens
gcctgagaaggataggaagcga

SEQ ID NO: 10011108 - DNA, 22 bp, Homo sapiens
gcctgagagtctgcatttctaa

SEQ ID NO: 10011109 - DNA, 22 bp, Homo sapiens
gcctgagagttgaagttcagtg

SEQ ID NO: 10011110 - DNA, 22 bp, Homo sapiens
gcctgagagttgaagttcagtg

SEQ ID NO: 10011111 - DNA, 22 bp, Homo sapiens
gcctgagattctgcatttctaa

SEQ ID NO: 10011112 - DNA, 22 bp, Homo sapiens
atttggaagcttgaagattatt

SEQ ID NO: 10011113 - DNA, 22 bp, Homo sapiens
atttggaaggagctgcacagca

SEQ ID NO: 10011114 - DNA, 22 bp, Homo sapiens
atttggaaggtttacaaagaga

SEQ ID NO: 10011115 - DNA, 22 bp, Homo sapiens
atttggaaggtttacaaagaga

SEQ ID NO: 10011116 - DNA, 22 bp, Homo sapiens
atttggaaggtttacaaagaga

SEQ ID NO: 10011117 - DNA, 22 bp, Homo sapiens
atttggaagtttggagtgaagg

SEQ ID NO: 10011118 - DNA, 22 bp, Homo sapiens
gcctggagttgtggtgaagcca

SEQ ID NO: 10011119 - DNA, 22 bp, Homo sapiens
gcctggattccttgtttctcag

SEQ ID NO: 10011120 - DNA, 22 bp, Homo sapiens
gcctggattacaaacagccaac

SEQ ID NO: 10011121 - DNA, 22 bp, Homo sapiens
gcctggaggaatgtagctgagg

SEQ ID NO: 10011122 - DNA, 22 bp, Homo sapiens
atttggaatagctgtagaaata

SEQ ID NO: 10011123 - DNA, 22 bp, Homo sapiens
gcctggcaaggccctgttgact

SEQ ID NO: 10011124 - DNA, 22 bp, Homo sapiens
gcctggcacattgcagtggatt

SEQ ID NO: 10011125 - DNA, 22 bp, Homo sapiens
attttactactccaattaatga

SEQ ID NO: 10011126 - DNA, 22 bp, Homo sapiens
attttactactccaattaatga

SEQ ID NO: 10011127 - DNA, 22 bp, Homo sapiens
caaatgcatagtttataagaag

SEQ ID NO: 10011128 - DNA, 22 bp, Homo sapiens
caaatgcatagtttataagaag

SEQ ID NO: 10011129 - DNA, 22 bp, Homo sapiens
caaatgcatagtttataagaag

SEQ ID NO: 10011130 - DNA, 22 bp, Homo sapiens
caaatgaatttccctgcaaatg

SEQ ID NO: 10011131 - DNA, 22 bp, Homo sapiens
caaatgaatttccctgcaaatg

SEQ ID NO: 10011132 - DNA, 22 bp, Homo sapiens
gctgactgatggacacagcacc

SEQ ID NO: 10011133 - DNA, 22 bp, Homo sapiens
gctgacctttgccaggaaggca

SEQ ID NO: 10011134 - DNA, 22 bp, Homo sapiens
gctgacctgtggcagaagctca

SEQ ID NO: 10011135 - DNA, 22 bp, Homo sapiens
gctgactcagatgcagctggat

SEQ ID NO: 10011136 - DNA, 20 bp, Homo sapiens
gctgacccctgctgtcatgc

SEQ ID NO: 10011137 - DNA, 22 bp, Homo sapiens
gctgacctgctctcagcagaga

SEQ ID NO: 10011138 - DNA, 22 bp, Homo sapiens
caaatgctaacttctttccaaa

SEQ ID NO: 10011139 - DNA, 22 bp, Homo sapiens
caaatgctactaataggcaagt

SEQ ID NO: 10011140 - DNA, 22 bp, Homo sapiens
caaatgcatgagaaataagagg

SEQ ID NO: 10011141 - DNA, 22 bp, Homo sapiens
caaatgcatgagaaataagagg

SEQ ID NO: 10011142 - DNA, 22 bp, Homo sapiens
caaatgcatgagaaataagagg

SEQ ID NO: 10011143 - DNA, 22 bp, Homo sapiens
caaatgcatgagaaataagagg

SEQ ID NO: 10011144 - DNA, 22 bp, Homo sapiens
caaatggatacaggcaaacatt

SEQ ID NO: 10011145 - DNA, 22 bp, Homo sapiens
caaatggctggcatccttctac

SEQ ID NO: 10011146 - DNA, 22 bp, Homo sapiens
caaatgctggccctgctactta

SEQ ID NO: 10011147 - DNA, 21 bp, Homo sapiens
caaatgctggctggatgagga

SEQ ID NO: 10011148 - DNA, 21 bp, Homo sapiens
caaatgctggctggatgagga

SEQ ID NO: 10011149 - DNA, 22 bp, Homo sapiens
caaatgctggccctgctactta

SEQ ID NO: 10011150 - DNA, 22 bp, Homo sapiens
caaatgctatgattttgagttt

SEQ ID NO: 10011151 - DNA, 22 bp, Homo sapiens
caaatgctatgattttgagttt

SEQ ID NO: 10011152 - DNA, 22 bp, Homo sapiens
caaatgctactaataggcaagt

SEQ ID NO: 10011153 - DNA, 22 bp, Homo sapiens
gctgaaatcccagcattcccca

SEQ ID NO: 10011154 - DNA, 22 bp, Homo sapiens
gctgaaatgaaaacacaggtcg

SEQ ID NO: 10011155 - DNA, 22 bp, Homo sapiens
gctgaaatgaaaacacaggtcg

SEQ ID NO: 10011156 - DNA, 22 bp, Homo sapiens
gctcttgggggacagatggagt

SEQ ID NO: 10011157 - DNA, 22 bp, Homo sapiens
caaatagactctagaatttatt

SEQ ID NO: 10011158 - DNA, 22 bp, Homo sapiens
caaatagactctagaatttatt

SEQ ID NO: 10011159 - DNA, 22 bp, Homo sapiens
gctcttgtcaaaaattagttga

SEQ ID NO: 10011160 - DNA, 22 bp, Homo sapiens
gctcttgtcaaaaattagttga

SEQ ID NO: 10011161 - DNA, 22 bp, Homo sapiens
gctcttgtcagagaggccagct

SEQ ID NO: 10011162 - DNA, 22 bp, Homo sapiens
caaatactctggatgtgtttgt

SEQ ID NO: 10011163 - DNA, 22 bp, Homo sapiens
caaatactgagcacgcaatcaa

SEQ ID NO: 10011164 - DNA, 22 bp, Homo sapiens
caaatactacgattcttgcagt

SEQ ID NO: 10011165 - DNA, 22 bp, Homo sapiens
caaatactgagtttattttcaa

SEQ ID NO: 10011166 - DNA, 22 bp, Homo sapiens
caaatactgtactgaacactgt

SEQ ID NO: 10011167 - DNA, 18 bp, Homo sapiens
caaatactgttgtcttat

SEQ ID NO: 10011168 - DNA, 22 bp, Homo sapiens
caaatactgtactgaacactgt

SEQ ID NO: 10011169 - DNA, 22 bp, Homo sapiens
caaatactgggtaagttaattt

SEQ ID NO: 10011170 - DNA, 22 bp, Homo sapiens
caaatactgggtaagttaattt

SEQ ID NO: 10011171 - DNA, 22 bp, Homo sapiens
caaatactgggtaagttaattt

SEQ ID NO: 10011172 - DNA, 22 bp, Homo sapiens
caaatacttttagcctattgag

SEQ ID NO: 10011173 - DNA, 22 bp, Homo sapiens
caaatagaactcacagacaaga

SEQ ID NO: 10011174 - DNA, 22 bp, Homo sapiens
caaatagaactcacagacaaga

SEQ ID NO: 10011175 - DNA, 22 bp, Homo sapiens
caaatagaactcacagacaaga

SEQ ID NO: 10011176 - DNA, 21 bp, Homo sapiens
caaatagacatggctagagga

SEQ ID NO: 10011177 - DNA, 22 bp, Homo sapiens
caaatagaaggtactcagagaa

SEQ ID NO: 10011178 - DNA, 22 bp, Homo sapiens
caaatagaaggtactcagagaa

SEQ ID NO: 10011179 - DNA, 21 bp, Homo sapiens
caaatacttagaaacttaaga

SEQ ID NO: 10011180 - DNA, 21 bp, Homo sapiens
caaatacttagaaacttaaga

SEQ ID NO: 10011181 - DNA, 22 bp, Homo sapiens
caaatacttactgaacctgtgc

SEQ ID NO: 10011182 - DNA, 22 bp, Homo sapiens
caaatactttatatacttcaaa

SEQ ID NO: 10011183 - DNA, 22 bp, Homo sapiens
caaatactttatatacttcaaa

SEQ ID NO: 10011184 - DNA, 22 bp, Homo sapiens
caaatactaaacataagatttt

SEQ ID NO: 10011185 - DNA, 22 bp, Homo sapiens
caaagtgctggaattacaggtg

SEQ ID NO: 10011186 - DNA, 22 bp, Homo sapiens
caaataattactatcctcactt

SEQ ID NO: 10011187 - DNA, 22 bp, Homo sapiens
caaaggaggtgataggccctct

SEQ ID NO: 10011188 - DNA, 22 bp, Homo sapiens
caaagtgctggaattacaggtg

SEQ ID NO: 10011189 - DNA, 22 bp, Homo sapiens
caaaggacccataattaaaacc

SEQ ID NO: 10011190 - DNA, 22 bp, Homo sapiens
caaaggaggtaatgggtgtgag

SEQ ID NO: 10011191 - DNA, 22 bp, Homo sapiens
caaagctataaattcagacaga

SEQ ID NO: 10011192 - DNA, 22 bp, Homo sapiens
caaagccctggaaagatgaaga

SEQ ID NO: 10011193 - DNA, 22 bp, Homo sapiens
caaaggaaatactaatctggaa

SEQ ID NO: 10011194 - DNA, 22 bp, Homo sapiens
caaagctgtgaattcctacaaa

SEQ ID NO: 10011195 - DNA, 22 bp, Homo sapiens
caaaggaaatactaatctggaa

SEQ ID NO: 10011196 - DNA, 22 bp, Homo sapiens
caaagctggaaaaggaggctgg

SEQ ID NO: 10011197 - DNA, 22 bp, Homo sapiens
caaagctgatactcagcaagta

SEQ ID NO: 10011198 - DNA, 22 bp, Homo sapiens
caaagctgtaccccaacctatg

SEQ ID NO: 10011199 - DNA, 22 bp, Homo sapiens
caaagctgtaccccaacctatg

SEQ ID NO: 10011200 - DNA, 22 bp, Homo sapiens
caaagctgtgaattcctacaaa

SEQ ID NO: 10011201 - DNA, 22 bp, Homo sapiens
caaacatagtgaagcaatgaca

SEQ ID NO: 10011202 - DNA, 22 bp, Homo sapiens
caaacatagtgaagcaatgaca

SEQ ID NO: 10011203 - DNA, 22 bp, Homo sapiens
caaacattcaagtacaagtctt

SEQ ID NO: 10011204 - DNA, 22 bp, Homo sapiens
caaacatagtgaagcaatgaca

SEQ ID NO: 10011205 - DNA, 22 bp, Homo sapiens
caaacatagtgaagcaatgaca

SEQ ID NO: 10011206 - DNA, 22 bp, Homo sapiens
caaaattctgcatttctaataa

SEQ ID NO: 10011207 - DNA, 22 bp, Homo sapiens
caaaatgttctggcacctttaa

SEQ ID NO: 10011208 - DNA, 22 bp, Homo sapiens
caaaatgtgagtcccacctcaa

SEQ ID NO: 10011209 - DNA, 22 bp, Homo sapiens
caaaatgtgagtcccacctcaa

SEQ ID NO: 10011210 - DNA, 23 bp, Homo sapiens
caaaatggtttaaaagtggcata

SEQ ID NO: 10011211 - DNA, 22 bp, Homo sapiens
caaaatgatgtgattttattgt

SEQ ID NO: 10011212 - DNA, 22 bp, Homo sapiens
caaaatagatgttaacctggaa

SEQ ID NO: 10011213 - DNA, 22 bp, Homo sapiens
caaaataccacgacttgtttta

SEQ ID NO: 10011214 - DNA, 22 bp, Homo sapiens
caaaataccacgacttgtttta

SEQ ID NO: 10011215 - DNA, 22 bp, Homo sapiens
caaaatagatgttaacctggaa

SEQ ID NO: 10011216 - DNA, 20 bp, Homo sapiens
caaagcagtaggataaaaat

SEQ ID NO: 10011217 - DNA, 22 bp, Homo sapiens
caaagcagtgatccttaaagga

SEQ ID NO: 10011218 - DNA, 18 bp, Homo sapiens
caaagcaggtgacagtgt

SEQ ID NO: 10011219 - DNA, 22 bp, Homo sapiens
caaagcaggaagctcctgacag

SEQ ID NO: 10011220 - DNA, 21 bp, Homo sapiens
caaagccaggcaactctctcc

SEQ ID NO: 10011221 - DNA, 22 bp, Homo sapiens
caaagccaggctttctaatgta

SEQ ID NO: 10011222 - DNA, 22 bp, Homo sapiens
caaagccatagagtagataaga

SEQ ID NO: 10011223 - DNA, 22 bp, Homo sapiens
caaagccatagagtagataaga

SEQ ID NO: 10011224 - DNA, 22 bp, Homo sapiens
caaagaggttttgagggcagct

SEQ ID NO: 10011225 - DNA, 22 bp, Homo sapiens
caaacattcaagtacaagtctt

SEQ ID NO: 10011226 - DNA, 22 bp, Homo sapiens
caaacattcaagtacaagtctt

SEQ ID NO: 10011227 - DNA, 22 bp, Homo sapiens
caaacattcaagtacaagtctt

SEQ ID NO: 10011228 - DNA, 22 bp, Homo sapiens
caaacattcagatgcaatggta

SEQ ID NO: 10011229 - DNA, 22 bp, Homo sapiens
caaagcagagaactgtctcatt

SEQ ID NO: 10011230 - DNA, 22 bp, Homo sapiens
atttttctctccactccattaa

SEQ ID NO: 10011231 - DNA, 22 bp, Homo sapiens
atttttctctccactccattaa

SEQ ID NO: 10011232 - DNA, 22 bp, Homo sapiens
atttttctctccactccattaa

SEQ ID NO: 10011233 - DNA, 22 bp, Homo sapiens
atttttctctccactccattaa

SEQ ID NO: 10011234 - DNA, 22 bp, Homo sapiens
atttttctctcacacttaccag

SEQ ID NO: 10011235 - DNA, 22 bp, Homo sapiens
atttttctctcacacttaccag

SEQ ID NO: 10011236 - DNA, 22 bp, Homo sapiens
atttttctctcacacttaccag

SEQ ID NO: 10011237 - DNA, 22 bp, Homo sapiens
caaaataccacgacttgtttta

SEQ ID NO: 10011238 - DNA, 22 bp, Homo sapiens
atttttctctttccactgagat

SEQ ID NO: 10011239 - DNA, 19 bp, Homo sapiens
atttttcttcctctgtgca

SEQ ID NO: 10011240 - DNA, 19 bp, Homo sapiens
atttttcttcctctgtgca

SEQ ID NO: 10011241 - DNA, 22 bp, Homo sapiens
attttgtttcctttggagtaga

SEQ ID NO: 10011242 - DNA, 20 bp, Homo sapiens
attttgtttatgttcctctc

SEQ ID NO: 10011243 - DNA, 22 bp, Homo sapiens
atttttatgacaaaccatcctc

SEQ ID NO: 10011244 - DNA, 22 bp, Homo sapiens
atttttcagcttcattgaggca

SEQ ID NO: 10011245 - DNA, 22 bp, Homo sapiens
atttttcaactttggaaatggc

SEQ ID NO: 10011246 - DNA, 22 bp, Homo sapiens
attttgctgtggtacattagga

SEQ ID NO: 10011247 - DNA, 22 bp, Homo sapiens
attttgctgtggtacattagga

SEQ ID NO: 10011248 - DNA, 22 bp, Homo sapiens
attttagagctccaagtacagc

SEQ ID NO: 10011249 - DNA, 22 bp, Homo sapiens
attttagagctccaagtacagc

SEQ ID NO: 10011250 - DNA, 22 bp, Homo sapiens
attttagagctccaagtacagc

SEQ ID NO: 10011251 - DNA, 22 bp, Homo sapiens
attttagagaaacaaacgtagg

SEQ ID NO: 10011252 - DNA, 22 bp, Homo sapiens
attttacttagtgtaatgtcca

SEQ ID NO: 10011253 - DNA, 22 bp, Homo sapiens
attgtcacttaaaagtgcatgt

SEQ ID NO: 10011254 - DNA, 22 bp, Homo sapiens
attgtcagagtttgagaaagta

SEQ ID NO: 10011255 - DNA, 22 bp, Homo sapiens
attgtcatcgatgttagccagt

SEQ ID NO: 10011256 - DNA, 17 bp, Homo sapiens
attgtctcttcacttat

SEQ ID NO: 10011257 - DNA, 22 bp, Homo sapiens
attgtccatctccacattaatg

SEQ ID NO: 10011258 - DNA, 22 bp, Homo sapiens
attgtcgtcaatggacacatag

SEQ ID NO: 10011259 - DNA, 22 bp, Homo sapiens
attgtcattccagtcattgtta

SEQ ID NO: 10011260 - DNA, 20 bp, Homo sapiens
gcatcaaggtacgctctcca

SEQ ID NO: 10011261 - DNA, 22 bp, Homo sapiens
gcatcaagacgatgtgaaatcg

SEQ ID NO: 10011262 - DNA, 22 bp, Homo sapiens
gcatattttcacaagctcttgg

SEQ ID NO: 10011263 - DNA, 22 bp, Homo sapiens
gcatattttcacaagctcttgg

SEQ ID NO: 10011264 - DNA, 22 bp, Homo sapiens
gcatattttcacaagctcttgg

SEQ ID NO: 10011265 - DNA, 22 bp, Homo sapiens
gcatcaagacgatgtgaaatcg

SEQ ID NO: 10011266 - DNA, 22 bp, Homo sapiens
gcatagaatttagagacaaaag

SEQ ID NO: 10011267 - DNA, 22 bp, Homo sapiens
gcatatgatcacgtgtgtcggt

SEQ ID NO: 10011268 - DNA, 22 bp, Homo sapiens
gcatatggcttcatttaattct

SEQ ID NO: 10011269 - DNA, 22 bp, Homo sapiens
gcatatgatcacgtgtgtcggt

SEQ ID NO: 10011270 - DNA, 22 bp, Homo sapiens
gcagtgtgacgctgttctccgt

SEQ ID NO: 10011271 - DNA, 23 bp, Homo sapiens
gcagtgtgaatccagtgtttcag

SEQ ID NO: 10011272 - DNA, 22 bp, Homo sapiens
gcagtgtgaccgagcttgcttc

SEQ ID NO: 10011273 - DNA, 22 bp, Homo sapiens
gcagtgtgtggtgagggctgcc

SEQ ID NO: 10011274 - DNA, 22 bp, Homo sapiens
gcagtgtgtctcttggcttcct

SEQ ID NO: 10011275 - DNA, 22 bp, Homo sapiens
gcatacaaaggtttacaactga

SEQ ID NO: 10011276 - DNA, 22 bp, Homo sapiens
gcatacaaaggtttacaactga

SEQ ID NO: 10011277 - DNA, 22 bp, Homo sapiens
gcatagaaggttttggtatcaa

SEQ ID NO: 10011278 - DNA, 22 bp, Homo sapiens
gccaaactacaagttaaatttt

SEQ ID NO: 10011279 - DNA, 22 bp, Homo sapiens
gcattctctctctaaatgttgt

SEQ ID NO: 10011280 - DNA, 22 bp, Homo sapiens
attgtgaattgagagtacttct

SEQ ID NO: 10011281 - DNA, 22 bp, Homo sapiens
attgtgaatagtgccgcagtaa

SEQ ID NO: 10011282 - DNA, 22 bp, Homo sapiens
attgtgaatagtgccgcagtaa

SEQ ID NO: 10011283 - DNA, 22 bp, Homo sapiens
attgtgaatagtgccgcagtaa

SEQ ID NO: 10011284 - DNA, 22 bp, Homo sapiens
attgtctttccactgagaagtt

SEQ ID NO: 10011285 - DNA, 22 bp, Homo sapiens
attgtctttaaaaatatacaac

SEQ ID NO: 10011286 - DNA, 22 bp, Homo sapiens
attgtctttaaaaatatacaac

SEQ ID NO: 10011287 - DNA, 22 bp, Homo sapiens
attgtcttaaacaaatgtgttt

SEQ ID NO: 10011288 - DNA, 22 bp, Homo sapiens
attgtcttctggtcttatcttt

SEQ ID NO: 10011289 - DNA, 22 bp, Homo sapiens
attgtcttctgtcttatagttc

SEQ ID NO: 10011290 - DNA, 22 bp, Homo sapiens
attgtcttggcattcaaattag

SEQ ID NO: 10011291 - DNA, 22 bp, Homo sapiens
gccaagagtttccagctgcaag

SEQ ID NO: 10011292 - DNA, 22 bp, Homo sapiens
gccaagagtttccagctgcaag

SEQ ID NO: 10011293 - DNA, 22 bp, Homo sapiens
gccaagagtttccagctgcaag

SEQ ID NO: 10011294 - DNA, 21 bp, Homo sapiens
gccaagaacaagacagacatg

SEQ ID NO: 10011295 - DNA, 21 bp, Homo sapiens
gccaagaacaagacagacatg

SEQ ID NO: 10011296 - DNA, 22 bp, Homo sapiens
gccacagggcagatgcgcagag

SEQ ID NO: 10011297 - DNA, 22 bp, Homo sapiens
gccacagggcgagcggaggcca

SEQ ID NO: 10011298 - DNA, 22 bp, Homo sapiens
gccacagggcagatgcgcagag

SEQ ID NO: 10011299 - DNA, 22 bp, Homo sapiens
gccacagggcagatgcgcagag

SEQ ID NO: 10011300 - DNA, 22 bp, Homo sapiens
gccacagggaggcgttttcagg

SEQ ID NO: 10011301 - DNA, 22 bp, Homo sapiens
gccacagggattgttttgtgag

SEQ ID NO: 10011302 - DNA, 22 bp, Homo sapiens
gccaaaggattctatggagata

SEQ ID NO: 10011303 - DNA, 17 bp, Homo sapiens
gccaaagggttccaatc

SEQ ID NO: 10011304 - DNA, 22 bp, Homo sapiens
gccaaatacagtagtcattgcc

SEQ ID NO: 10011305 - DNA, 22 bp, Homo sapiens
gccaaataagtggaatcacaca

SEQ ID NO: 10011306 - DNA, 22 bp, Homo sapiens
gccaaataagtgtccggccctc

SEQ ID NO: 10011307 - DNA, 22 bp, Homo sapiens
gccaaagtcctccagccatgca

SEQ ID NO: 10011308 - DNA, 22 bp, Homo sapiens
gccaaagtccacttgctttctg

SEQ ID NO: 10011309 - DNA, 22 bp, Homo sapiens
gccaaagtacctagccctctgc

SEQ ID NO: 10011310 - DNA, 22 bp, Homo sapiens
gccaaagtacctagccctctgc

SEQ ID NO: 10011311 - DNA, 22 bp, Homo sapiens
gccaaatatggtggacagtttg

SEQ ID NO: 10011312 - DNA, 22 bp, Homo sapiens
gccaaataccattaaccagaaa

SEQ ID NO: 10011313 - DNA, 22 bp, Homo sapiens
gccaaatataattctccacctt

SEQ ID NO: 10011314 - DNA, 22 bp, Homo sapiens
gccaaatactggaatcatagaa

SEQ ID NO: 10011315 - DNA, 20 bp, Homo sapiens
gccaacgcgctggggctgcc

SEQ ID NO: 10011316 - DNA, 22 bp, Homo sapiens
attgatttgaacaaagatatta

SEQ ID NO: 10011317 - DNA, 22 bp, Homo sapiens
attgattctgtaagtcaacaat

SEQ ID NO: 10011318 - DNA, 22 bp, Homo sapiens
gcagggctgctgaaacttgttt

SEQ ID NO: 10011319 - DNA, 22 bp, Homo sapiens
gcagggctgcagagggcactgt

SEQ ID NO: 10011320 - DNA, 22 bp, Homo sapiens
gcaggcctgtcttgctcgccct

SEQ ID NO: 10011321 - DNA, 22 bp, Homo sapiens
gcaggcctgcccagcaggatgg

SEQ ID NO: 10011322 - DNA, 22 bp, Homo sapiens
gcaggcctgactgtagggggca

SEQ ID NO: 10011323 - DNA, 22 bp, Homo sapiens
gcaggcctttatccctgcctca

SEQ ID NO: 10011324 - DNA, 22 bp, Homo sapiens
attgatcatgcagatgcttcac

SEQ ID NO: 10011325 - DNA, 22 bp, Homo sapiens
attgatcatgcagatgcttcac

SEQ ID NO: 10011326 - DNA, 22 bp, Homo sapiens
gcagctgctggagggaggcagg

SEQ ID NO: 10011327 - DNA, 22 bp, Homo sapiens
gcagctgctgtggcatcaagct

SEQ ID NO: 10011328 - DNA, 22 bp, Homo sapiens
attccttctttgagaataagca

SEQ ID NO: 10011329 - DNA, 22 bp, Homo sapiens
gcagctggaagtgacactctgt

SEQ ID NO: 10011330 - DNA, 22 bp, Homo sapiens
attccttgcacatcagatagtt

SEQ ID NO: 10011331 - DNA, 22 bp, Homo sapiens
gcagctgcgctggtgtggggca

SEQ ID NO: 10011332 - DNA, 22 bp, Homo sapiens
gcagctgcgctggtgtggggca

SEQ ID NO: 10011333 - DNA, 22 bp, Homo sapiens
gcagctgctcacattctcacaa

SEQ ID NO: 10011334 - DNA, 22 bp, Homo sapiens
gcagctgctggaagttcctgcc

SEQ ID NO: 10011335 - DNA, 22 bp, Homo sapiens
gcagctgctggaagttcctgcc

SEQ ID NO: 10011336 - DNA, 22 bp, Homo sapiens
gcagctgctggaagttcctgcc

SEQ ID NO: 10011337 - DNA, 22 bp, Homo sapiens
gcagctgcctattcagggcttg

SEQ ID NO: 10011338 - DNA, 22 bp, Homo sapiens
gcagctgcctattcagggcttg

SEQ ID NO: 10011339 - DNA, 22 bp, Homo sapiens
gcagctgccttcagctggatgg

SEQ ID NO: 10011340 - DNA, 22 bp, Homo sapiens
gcagctgccttcagctggatgg

SEQ ID NO: 10011341 - DNA, 22 bp, Homo sapiens
gcagctgcctattcagggcttg

SEQ ID NO: 10011342 - DNA, 22 bp, Homo sapiens
gcagcgaggtgatgaaatagct

SEQ ID NO: 10011343 - DNA, 22 bp, Homo sapiens
gcagcgaggtgatgaaatagct

SEQ ID NO: 10011344 - DNA, 22 bp, Homo sapiens
attcttcttgagtcttggactc

SEQ ID NO: 10011345 - DNA, 22 bp, Homo sapiens
attcttgcagtatacaactact

SEQ ID NO: 10011346 - DNA, 22 bp, Homo sapiens
attcttgcttcacactcctctg

SEQ ID NO: 10011347 - DNA, 22 bp, Homo sapiens
attccttgctctcatcaacctt

SEQ ID NO: 10011348 - DNA, 22 bp, Homo sapiens
attccttggaacagatgcgaag

SEQ ID NO: 10011349 - DNA, 22 bp, Homo sapiens
attccttgtatatctacatgca

SEQ ID NO: 10011350 - DNA, 22 bp, Homo sapiens
attcttgtttaatttgcatccc

SEQ ID NO: 10011351 - DNA, 19 bp, Homo sapiens
attcttgttaagtgtcatc

SEQ ID NO: 10011352 - DNA, 22 bp, Homo sapiens
attctttcatataaaggctcag

SEQ ID NO: 10011353 - DNA, 22 bp, Homo sapiens
attctttcaaggaatagttatt

SEQ ID NO: 10011354 - DNA, 23 bp, Homo sapiens
attagaaaggctttctggtgaaa

SEQ ID NO: 10011355 - DNA, 22 bp, Homo sapiens
gatttccaggacgggaggtggg

SEQ ID NO: 10011356 - DNA, 22 bp, Homo sapiens
gatttctcactgtggatttcct

SEQ ID NO: 10011357 - DNA, 22 bp, Homo sapiens
gatttctcatttgtggattgaa

SEQ ID NO: 10011358 - DNA, 22 bp, Homo sapiens
gatttctcaatcctagtactat

SEQ ID NO: 10011359 - DNA, 22 bp, Homo sapiens
gatttctagtaagtcatgaagg

SEQ ID NO: 10011360 - DNA, 22 bp, Homo sapiens
gatttctagtaagtcatgaagg

SEQ ID NO: 10011361 - DNA, 22 bp, Homo sapiens
gatttctagttcattatctatt

SEQ ID NO: 10011362 - DNA, 17 bp, Homo sapiens
gatttcctgaagttctt

SEQ ID NO: 10011363 - DNA, 22 bp, Homo sapiens
gatttccttgcatattggtaat

SEQ ID NO: 10011364 - DNA, 22 bp, Homo sapiens
gatttcctcactaacatccatc

SEQ ID NO: 10011365 - DNA, 17 bp, Homo sapiens
gatttcctgaagttctt

SEQ ID NO: 10011366 - DNA, 22 bp, Homo sapiens
gatttcctagacatggggcaga

SEQ ID NO: 10011367 - DNA, 22 bp, Homo sapiens
gatttcctagacatggggcaga

SEQ ID NO: 10011368 - DNA, 22 bp, Homo sapiens
gatttcctaatgtggatctctg

SEQ ID NO: 10011369 - DNA, 22 bp, Homo sapiens
gatttccatgattgggccagaa

SEQ ID NO: 10011370 - DNA, 22 bp, Homo sapiens
gatttcctaatgtggatctctg

SEQ ID NO: 10011371 - DNA, 21 bp, Homo sapiens
attacatccctggtgatacat

SEQ ID NO: 10011372 - DNA, 22 bp, Homo sapiens
attacatatgttggcaacattt

SEQ ID NO: 10011373 - DNA, 22 bp, Homo sapiens
attacagtgggtaaacagaatt

SEQ ID NO: 10011374 - DNA, 22 bp, Homo sapiens
attactagattgtcaagattta

SEQ ID NO: 10011375 - DNA, 22 bp, Homo sapiens
attactctgtctgcctctgacc

SEQ ID NO: 10011376 - DNA, 22 bp, Homo sapiens
attacctatgctctagtaatca

SEQ ID NO: 10011377 - DNA, 22 bp, Homo sapiens
attacccagtctgtggtattct

SEQ ID NO: 10011378 - DNA, 22 bp, Homo sapiens
attacccagggtaggaattcct

SEQ ID NO: 10011379 - DNA, 22 bp, Homo sapiens
attacaatcgagagaaacaaat

SEQ ID NO: 10011380 - DNA, 22 bp, Homo sapiens
attacagtggacagctatgcac

SEQ ID NO: 10011381 - DNA, 22 bp, Homo sapiens
attacaatcgagagaaacaaat

SEQ ID NO: 10011382 - DNA, 22 bp, Homo sapiens
attacaatcgagagaaacaaat

SEQ ID NO: 10011383 - DNA, 22 bp, Homo sapiens
attacaataatacatgctcatt

SEQ ID NO: 10011384 - DNA, 22 bp, Homo sapiens
gatattctacctgctgaccaag

SEQ ID NO: 10011385 - DNA, 22 bp, Homo sapiens
gatattcaactaaagtgaatta

SEQ ID NO: 10011386 - DNA, 22 bp, Homo sapiens
attcaactgtaaacttgttcac

SEQ ID NO: 10011387 - DNA, 22 bp, Homo sapiens
attcaactatgtatagtcttct

SEQ ID NO: 10011388 - DNA, 22 bp, Homo sapiens
attcaacatattctgagtaaaa

SEQ ID NO: 10011389 - DNA, 22 bp, Homo sapiens
attcaactagtgattgtgttat

SEQ ID NO: 10011390 - DNA, 22 bp, Homo sapiens
attcaacatattctgagtaaaa

SEQ ID NO: 10011391 - DNA, 22 bp, Homo sapiens
attcaaattaagttaattcagc

SEQ ID NO: 10011392 - DNA, 22 bp, Homo sapiens
attcaaattaagttaattcagc

SEQ ID NO: 10011393 - DNA, 22 bp, Homo sapiens
attcaaagtagatgaagtttca

SEQ ID NO: 10011394 - DNA, 22 bp, Homo sapiens
attcaaagtactagctattttt

SEQ ID NO: 10011395 - DNA, 22 bp, Homo sapiens
attcaaagtctagatgtagtgt

SEQ ID NO: 10011396 - DNA, 22 bp, Homo sapiens
attatttccttgctttgaggaa

SEQ ID NO: 10011397 - DNA, 22 bp, Homo sapiens
attatttccttgctttgaggaa

SEQ ID NO: 10011398 - DNA, 22 bp, Homo sapiens
attcaaagtactagctattttt

SEQ ID NO: 10011399 - DNA, 22 bp, Homo sapiens
attcaaagtaataaccagaact

SEQ ID NO: 10011400 - DNA, 20 bp, Homo sapiens
attagtgcatctggacatgc

SEQ ID NO: 10011401 - DNA, 22 bp, Homo sapiens
attagtgcccaggctgcctctt

SEQ ID NO: 10011402 - DNA, 22 bp, Homo sapiens
attaggaaatgtgttgcaagca

SEQ ID NO: 10011403 - DNA, 22 bp, Homo sapiens
attagatacacagatttccact

SEQ ID NO: 10011404 - DNA, 20 bp, Homo sapiens
attagcttggagacagtggc

SEQ ID NO: 10011405 - DNA, 22 bp, Homo sapiens
attagcttctgtgcatggactt

SEQ ID NO: 10011406 - DNA, 22 bp, Homo sapiens
attagtaaaacattgtatatgt

SEQ ID NO: 10011407 - DNA, 22 bp, Homo sapiens
attaggtaatctttagatacac

SEQ ID NO: 10011408 - DNA, 22 bp, Homo sapiens
attaggcatatatgcttttaat

SEQ ID NO: 10011409 - DNA, 22 bp, Homo sapiens
gcacgtggaatgctcatgagcc

SEQ ID NO: 10011410 - DNA, 22 bp, Homo sapiens
gcactagaagtacgccttgtaa

SEQ ID NO: 10011411 - DNA, 22 bp, Homo sapiens
gcactaaaccaacatgtaataa

SEQ ID NO: 10011412 - DNA, 22 bp, Homo sapiens
attcacatgatgtatgtagggc

SEQ ID NO: 10011413 - DNA, 22 bp, Homo sapiens
attcacagtttcctcatattct

SEQ ID NO: 10011414 - DNA, 22 bp, Homo sapiens
attcacaatgatacataagcga

SEQ ID NO: 10011415 - DNA, 22 bp, Homo sapiens
attcacaagttgatggatattt

SEQ ID NO: 10011416 - DNA, 22 bp, Homo sapiens
attcacaatgatacataagcga

SEQ ID NO: 10011417 - DNA, 22 bp, Homo sapiens
attcacaatagcagcttgcatg

SEQ ID NO: 10011418 - DNA, 22 bp, Homo sapiens
attcacaatagcagcttgcatg

SEQ ID NO: 10011419 - DNA, 22 bp, Homo sapiens
attcaaggttggctcaggaatt

SEQ ID NO: 10011420 - DNA, 22 bp, Homo sapiens
attcaaggtttattcagtttag

SEQ ID NO: 10011421 - DNA, 22 bp, Homo sapiens
attcaagtaaacactgaaggaa

SEQ ID NO: 10011422 - DNA, 22 bp, Homo sapiens
gcacctggggtacacagctaca

SEQ ID NO: 10011423 - DNA, 22 bp, Homo sapiens
attcaagaggaacaatgaagat

SEQ ID NO: 10011424 - DNA, 22 bp, Homo sapiens
attcaagattaattctatgtca

SEQ ID NO: 10011425 - DNA, 22 bp, Homo sapiens
attcaaggtatttaaaacataa

SEQ ID NO: 10011426 - DNA, 22 bp, Homo sapiens
attcaaggtatttaaaacataa

SEQ ID NO: 10011427 - DNA, 22 bp, Homo sapiens
gcacctggtttatataatcata

SEQ ID NO: 10011428 - DNA, 22 bp, Homo sapiens
gcacggctaatttttgtatttt

SEQ ID NO: 10011429 - DNA, 21 bp, Homo sapiens
attcagaaagggaataaactc

SEQ ID NO: 10011430 - DNA, 21 bp, Homo sapiens
attcagaaagggaataaactc

SEQ ID NO: 10011431 - DNA, 22 bp, Homo sapiens
attcactgtgggtcctttggat

SEQ ID NO: 10011432 - DNA, 22 bp, Homo sapiens
attcactgtcagcttgcatggg

SEQ ID NO: 10011433 - DNA, 22 bp, Homo sapiens
attcacatgcccaagcagcacc

SEQ ID NO: 10011434 - DNA, 22 bp, Homo sapiens
attcacatttagcctctgacat

SEQ ID NO: 10011435 - DNA, 22 bp, Homo sapiens
attcagaatggcaaacttctag

SEQ ID NO: 10011436 - DNA, 20 bp, Homo sapiens
attcagaataggcatgtaaa

SEQ ID NO: 10011437 - DNA, 22 bp, Homo sapiens
attcagactcttgagcagtccc

SEQ ID NO: 10011438 - DNA, 22 bp, Homo sapiens
attcagactatgaacacgtcag

SEQ ID NO: 10011439 - DNA, 22 bp, Homo sapiens
attcagaattttggggagctaa

SEQ ID NO: 10011440 - DNA, 22 bp, Homo sapiens
gcagcagaggccctactctttg

SEQ ID NO: 10011441 - DNA, 21 bp, Homo sapiens
gcagcagaggcttgacagaca

SEQ ID NO: 10011442 - DNA, 21 bp, Homo sapiens
gcagcagaggcttgacagaca

SEQ ID NO: 10011443 - DNA, 22 bp, Homo sapiens
gcagcagagtagacagagccct

SEQ ID NO: 10011444 - DNA, 22 bp, Homo sapiens
gcagcagagaccccaggaagga

SEQ ID NO: 10011445 - DNA, 22 bp, Homo sapiens
gcagcagagaccccaggaagga

SEQ ID NO: 10011446 - DNA, 22 bp, Homo sapiens
gcagcagagaccccaggaagga

SEQ ID NO: 10011447 - DNA, 22 bp, Homo sapiens
gcagcagagaccccaggaagga

SEQ ID NO: 10011448 - DNA, 20 bp, Homo sapiens
gcagcagacagacaggggac

SEQ ID NO: 10011449 - DNA, 22 bp, Homo sapiens
attcataacggcaaatgtcacc

SEQ ID NO: 10011450 - DNA, 22 bp, Homo sapiens
attcatctgtacttcaatatct

SEQ ID NO: 10011451 - DNA, 22 bp, Homo sapiens
attcatcagctaatggacattt

SEQ ID NO: 10011452 - DNA, 22 bp, Homo sapiens
attcatctatgactctaatgtg

SEQ ID NO: 10011453 - DNA, 22 bp, Homo sapiens
attcatcagctaatggacattt

SEQ ID NO: 10011454 - DNA, 22 bp, Homo sapiens
attcatatcatagagttattga

SEQ ID NO: 10011455 - DNA, 22 bp, Homo sapiens
attcatatcatagagttattga

SEQ ID NO: 10011456 - DNA, 22 bp, Homo sapiens
attcataacggcaaatgtcacc

SEQ ID NO: 10011457 - DNA, 22 bp, Homo sapiens
attcataagtaaatgattacct

SEQ ID NO: 10011458 - DNA, 22 bp, Homo sapiens
gcagcagagtagacagagccct

SEQ ID NO: 10011459 - DNA, 22 bp, Homo sapiens
gcagcagagtttgggagatggt

SEQ ID NO: 10011460 - DNA, 22 bp, Homo sapiens
gcagcagagtagacagagccct

SEQ ID NO: 10011461 - DNA, 22 bp, Homo sapiens
gcagcagagtttgggagatggt

SEQ ID NO: 10011462 - DNA, 22 bp, Homo sapiens
atgctattccagaatgtaaatt

SEQ ID NO: 10011463 - DNA, 22 bp, Homo sapiens
atgctattttacataggaatgg

SEQ ID NO: 10011464 - DNA, 22 bp, Homo sapiens
atgctatttaccacacatcatt

SEQ ID NO: 10011465 - DNA, 22 bp, Homo sapiens
atgctcagggcacactctggac

SEQ ID NO: 10011466 - DNA, 22 bp, Homo sapiens
atgctccttggcttcaaagcca

SEQ ID NO: 10011467 - DNA, 22 bp, Homo sapiens
atgctccttggcttcaaagcca

SEQ ID NO: 10011468 - DNA, 22 bp, Homo sapiens
atgctctctgtcctgctcagag

SEQ ID NO: 10011469 - DNA, 22 bp, Homo sapiens
atgctctgggcaggagccctgg

SEQ ID NO: 10011470 - DNA, 22 bp, Homo sapiens
gactgggagggttcagctgggt

SEQ ID NO: 10011471 - DNA, 21 bp, Homo sapiens
gactggagagaggaagtctgg

SEQ ID NO: 10011472 - DNA, 22 bp, Homo sapiens
gactggaaagcctgtcctcaga

SEQ ID NO: 10011473 - DNA, 22 bp, Homo sapiens
gactggaaagcctgtcctcaga

SEQ ID NO: 10011474 - DNA, 22 bp, Homo sapiens
gactacagatagccaattaagt

SEQ ID NO: 10011475 - DNA, 22 bp, Homo sapiens
gactacaggccggcatcagaga

SEQ ID NO: 10011476 - DNA, 22 bp, Homo sapiens
gacgcactgaaggctggttacc

SEQ ID NO: 10011477 - DNA, 22 bp, Homo sapiens
gacctttttactgtgtacgctg

SEQ ID NO: 10011478 - DNA, 22 bp, Homo sapiens
gacctttagtgtcatgttatat

SEQ ID NO: 10011479 - DNA, 22 bp, Homo sapiens
gacaccaggaatagttctgtct

SEQ ID NO: 10011480 - DNA, 22 bp, Homo sapiens
gacaccagcaaggctgtgagga

SEQ ID NO: 10011481 - DNA, 18 bp, Homo sapiens
gacaccagcctctgcccc

SEQ ID NO: 10011482 - DNA, 22 bp, Homo sapiens
gacaccagagactgatgaggcc

SEQ ID NO: 10011483 - DNA, 16 bp, Homo sapiens
gacacatgggggaaaa

SEQ ID NO: 10011484 - DNA, 22 bp, Homo sapiens
gacacatgaccataaatgctaa

SEQ ID NO: 10011485 - DNA, 22 bp, Homo sapiens
gacacatatgcgtatagtttag

SEQ ID NO: 10011486 - DNA, 19 bp, Homo sapiens
gacacagttggttcctttg

SEQ ID NO: 10011487 - DNA, 22 bp, Homo sapiens
gacacagtttttctcacggtgg

SEQ ID NO: 10011488 - DNA, 22 bp, Homo sapiens
gacacagtttttctcacggtgg

SEQ ID NO: 10011489 - DNA, 22 bp, Homo sapiens
gacaattgcttttgccgaataa

SEQ ID NO: 10011490 - DNA, 21 bp, Homo sapiens
gacacaaagggtagtaatggt

SEQ ID NO: 10011491 - DNA, 22 bp, Homo sapiens
gacacaaagtttgtcagaaatt

SEQ ID NO: 10011492 - DNA, 22 bp, Homo sapiens
gacacaaagtttgtcagaaatt

SEQ ID NO: 10011493 - DNA, 21 bp, Homo sapiens
gacacaaagggtagtaatggt

SEQ ID NO: 10011494 - DNA, 21 bp, Homo sapiens
gacacaaagggtagtaatggt

SEQ ID NO: 10011495 - DNA, 21 bp, Homo sapiens
gacacaaagggtagtaatggt

SEQ ID NO: 10011496 - DNA, 21 bp, Homo sapiens
gacacaaagggtagtaatggt

SEQ ID NO: 10011497 - DNA, 22 bp, Homo sapiens
atgctatgtttggtgttggaga

SEQ ID NO: 10011498 - DNA, 22 bp, Homo sapiens
atgctattccagaatgtaaatt

SEQ ID NO: 10011499 - DNA, 22 bp, Homo sapiens
gaccacagaggtgtgggagaga

SEQ ID NO: 10011500 - DNA, 22 bp, Homo sapiens
gaccaaggccaggccagggcgt

SEQ ID NO: 10011501 - DNA, 22 bp, Homo sapiens
gacatttattagaaaactatca

SEQ ID NO: 10011502 - DNA, 22 bp, Homo sapiens
gacataaatgaagtttgactat

SEQ ID NO: 10011503 - DNA, 22 bp, Homo sapiens
gacataaagttcttgcttgaat

SEQ ID NO: 10011504 - DNA, 22 bp, Homo sapiens
gaatcacactcgtaagtgagtt

SEQ ID NO: 10011505 - DNA, 22 bp, Homo sapiens
gaatcaattgtgaagactatga

SEQ ID NO: 10011506 - DNA, 22 bp, Homo sapiens
gaatcaattatccaggctgttg

SEQ ID NO: 10011507 - DNA, 22 bp, Homo sapiens
gaatcaatggtagattaagtaa

SEQ ID NO: 10011508 - DNA, 22 bp, Homo sapiens
gaatcaaatcaagttcttttga

SEQ ID NO: 10011509 - DNA, 22 bp, Homo sapiens
gaatcaaatcaagttcttttga

SEQ ID NO: 10011510 - DNA, 22 bp, Homo sapiens
gaatatttttaaagggactaat

SEQ ID NO: 10011511 - DNA, 22 bp, Homo sapiens
gaatattttcagtacagatggt

SEQ ID NO: 10011512 - DNA, 22 bp, Homo sapiens
gaatattttcagtacagatggt

SEQ ID NO: 10011513 - DNA, 22 bp, Homo sapiens
gaatattttcagtacagatggt

SEQ ID NO: 10011514 - DNA, 22 bp, Homo sapiens
gaatattttcagtacagatggt

SEQ ID NO: 10011515 - DNA, 22 bp, Homo sapiens
gacaataaaatgatcttacagt

SEQ ID NO: 10011516 - DNA, 22 bp, Homo sapiens
gacaataaagtgatacatggga

SEQ ID NO: 10011517 - DNA, 22 bp, Homo sapiens
gacaataagaacagatactgtg

SEQ ID NO: 10011518 - DNA, 22 bp, Homo sapiens
gacaataagaacagatactgtg

SEQ ID NO: 10011519 - DNA, 22 bp, Homo sapiens
gacaataaagtgatacatggga

SEQ ID NO: 10011520 - DNA, 22 bp, Homo sapiens
gaataattgtgatgcttgaagt

SEQ ID NO: 10011521 - DNA, 22 bp, Homo sapiens
gaataattttgatcagaaggga

SEQ ID NO: 10011522 - DNA, 22 bp, Homo sapiens
gaataattttgatcagaaggga

SEQ ID NO: 10011523 - DNA, 22 bp, Homo sapiens
gaatacaaacttaaggctttac

SEQ ID NO: 10011524 - DNA, 22 bp, Homo sapiens
gaataatcatatcgtctcacat

SEQ ID NO: 10011525 - DNA, 22 bp, Homo sapiens
gaataattgtgatgcttgaagt

SEQ ID NO: 10011526 - DNA, 22 bp, Homo sapiens
gaataatattgactttgcaggc

SEQ ID NO: 10011527 - DNA, 22 bp, Homo sapiens
gaatacaaagcagaactcatac

SEQ ID NO: 10011528 - DNA, 22 bp, Homo sapiens
gaatacaaataataccaaggtg

SEQ ID NO: 10011529 - DNA, 22 bp, Homo sapiens
gaataatagcagaaattagcag

SEQ ID NO: 10011530 - DNA, 22 bp, Homo sapiens
gaataacattttttcctttaca

SEQ ID NO: 10011531 - DNA, 22 bp, Homo sapiens
atgcacaggaccacacataatg

SEQ ID NO: 10011532 - DNA, 22 bp, Homo sapiens
gaagtcttcatctgatgctctg

SEQ ID NO: 10011533 - DNA, 22 bp, Homo sapiens
atgcacacgtaccctacaaggc

SEQ ID NO: 10011534 - DNA, 22 bp, Homo sapiens
atgcacacaagcttatgtatta

SEQ ID NO: 10011535 - DNA, 22 bp, Homo sapiens
atgcacagaaaaattgcttact

SEQ ID NO: 10011536 - DNA, 22 bp, Homo sapiens
gaaggctgtttctggtagtgat

SEQ ID NO: 10011537 - DNA, 22 bp, Homo sapiens
atgcacaagttatatgtatgga

SEQ ID NO: 10011538 - DNA, 22 bp, Homo sapiens
atgcacaatgttttgatttgag

SEQ ID NO: 10011539 - DNA, 22 bp, Homo sapiens
atgcacaattaggatatagctt

SEQ ID NO: 10011540 - DNA, 22 bp, Homo sapiens
gaaggctgtcagagaggagggc

SEQ ID NO: 10011541 - DNA, 22 bp, Homo sapiens
gaaggctggggccttctcatct

SEQ ID NO: 10011542 - DNA, 22 bp, Homo sapiens
gaaggctggggcatcagtgaaa

SEQ ID NO: 10011543 - DNA, 22 bp, Homo sapiens
gaaggctgtcagagaggagggc

SEQ ID NO: 10011544 - DNA, 22 bp, Homo sapiens
gaaggctgtggctggtctcagt

SEQ ID NO: 10011545 - DNA, 22 bp, Homo sapiens
gaaggctggaaggcaagtagga

SEQ ID NO: 10011546 - DNA, 22 bp, Homo sapiens
gaaggctggctttctgagagca

SEQ ID NO: 10011547 - DNA, 22 bp, Homo sapiens
gaaggctggaaggcaagtagga

SEQ ID NO: 10011548 - DNA, 22 bp, Homo sapiens
gaaggctggctttctgagagca

SEQ ID NO: 10011549 - DNA, 22 bp, Homo sapiens
gaacaatagtggtaacaaagcc

SEQ ID NO: 10011550 - DNA, 22 bp, Homo sapiens
gaaggcaacaccaggatgcact

SEQ ID NO: 10011551 - DNA, 22 bp, Homo sapiens
gaaggctgctgggaagtgtggt

SEQ ID NO: 10011552 - DNA, 22 bp, Homo sapiens
gaacaatagtggtaacaaagcc

SEQ ID NO: 10011553 - DNA, 22 bp, Homo sapiens
gaaggcaacaccaggatgcact

SEQ ID NO: 10011554 - DNA, 22 bp, Homo sapiens
gaacaaggattcccaaagaaga

SEQ ID NO: 10011555 - DNA, 22 bp, Homo sapiens
gaacaaacacatcccagcagtg

SEQ ID NO: 10011556 - DNA, 22 bp, Homo sapiens
gaacaaacacatcccagcagtg

SEQ ID NO: 10011557 - DNA, 22 bp, Homo sapiens
gaacaaacagtcaggacagtct

SEQ ID NO: 10011558 - DNA, 22 bp, Homo sapiens
gaacaaacagaagaggcggaac

SEQ ID NO: 10011559 - DNA, 22 bp, Homo sapiens
gaacaaactgggtcccaatgat

SEQ ID NO: 10011560 - DNA, 22 bp, Homo sapiens
gaacaaattctcatcaacttgt

SEQ ID NO: 10011561 - DNA, 22 bp, Homo sapiens
gaacaaattggagaaatcagga

SEQ ID NO: 10011562 - DNA, 22 bp, Homo sapiens
gaacaaattctcatcaacttgt

SEQ ID NO: 10011563 - DNA, 22 bp, Homo sapiens
gaacaaattggagaaatcagga

SEQ ID NO: 10011564 - DNA, 22 bp, Homo sapiens
ctttcctagaaatatatactta

SEQ ID NO: 10011565 - DNA, 22 bp, Homo sapiens
ctttcctagatggccatctttc

SEQ ID NO: 10011566 - DNA, 22 bp, Homo sapiens
atgaaaagttcgatctagaagg

SEQ ID NO: 10011567 - DNA, 22 bp, Homo sapiens
ctttccaggaatcctcacagcc

SEQ ID NO: 10011568 - DNA, 18 bp, Homo sapiens
cttcttgtttgatttggg

SEQ ID NO: 10011569 - DNA, 22 bp, Homo sapiens
atctggagtgggacacagaaat

SEQ ID NO: 10011570 - DNA, 22 bp, Homo sapiens
atctggagtttcagttttctgg

SEQ ID NO: 10011571 - DNA, 22 bp, Homo sapiens
ctttcttaatttttaaggacac

SEQ ID NO: 10011572 - DNA, 22 bp, Homo sapiens
atgaagacaggtctcatcacca

SEQ ID NO: 10011573 - DNA, 22 bp, Homo sapiens
atgaaccttgatttgttcatct

SEQ ID NO: 10011574 - DNA, 22 bp, Homo sapiens
atgaagacaaactgggtagaaa

SEQ ID NO: 10011575 - DNA, 22 bp, Homo sapiens
atgaagacaaacgacgttgcaa

SEQ ID NO: 10011576 - DNA, 22 bp, Homo sapiens
atgaagacaaactgggtagaaa

SEQ ID NO: 10011577 - DNA, 22 bp, Homo sapiens
atgaagacaaactgggtagaaa

SEQ ID NO: 10011578 - DNA, 22 bp, Homo sapiens
atgaagaaaaatccagctgtcc

SEQ ID NO: 10011579 - DNA, 22 bp, Homo sapiens
atgaaaattctatgcaggccag

SEQ ID NO: 10011580 - DNA, 22 bp, Homo sapiens
atgaaaatgtacatgtgtataa

SEQ ID NO: 10011581 - DNA, 22 bp, Homo sapiens
atgaaaatactgtggttgatag

SEQ ID NO: 10011582 - DNA, 22 bp, Homo sapiens
atgaaacaagggtattttctct

SEQ ID NO: 10011583 - DNA, 22 bp, Homo sapiens
atgaaacacacacgcgcatact

SEQ ID NO: 10011584 - DNA, 22 bp, Homo sapiens
atgaaattaatcaacacataca

SEQ ID NO: 10011585 - DNA, 22 bp, Homo sapiens
atgaaacagtgtgtatagcaaa

SEQ ID NO: 10011586 - DNA, 22 bp, Homo sapiens
atgaaacagtgaattagtcaag

SEQ ID NO: 10011587 - DNA, 22 bp, Homo sapiens
atgaaacagtgtgtatagcaaa

SEQ ID NO: 10011588 - DNA, 22 bp, Homo sapiens
atgaaacagagtacttaatata

SEQ ID NO: 10011589 - DNA, 22 bp, Homo sapiens
atgaacagtatgcaacatgatt

SEQ ID NO: 10011590 - DNA, 22 bp, Homo sapiens
atgaacagaggaatagaattct

SEQ ID NO: 10011591 - DNA, 22 bp, Homo sapiens
atgaaattcatctgagaatgct

SEQ ID NO: 10011592 - DNA, 22 bp, Homo sapiens
gaaagtatttaagtccatattt

SEQ ID NO: 10011593 - DNA, 22 bp, Homo sapiens
gaaagtattctccctgaatttt

SEQ ID NO: 10011594 - DNA, 22 bp, Homo sapiens
gaaagtattctccctgaatttt

SEQ ID NO: 10011595 - DNA, 22 bp, Homo sapiens
gaaagtatttaagtccatattt

SEQ ID NO: 10011596 - DNA, 22 bp, Homo sapiens
gaaagtatttacattaacatct

SEQ ID NO: 10011597 - DNA, 22 bp, Homo sapiens
gaaagtatttacattaacatct

SEQ ID NO: 10011598 - DNA, 22 bp, Homo sapiens
gaaagtattcacaaagttcttg

SEQ ID NO: 10011599 - DNA, 22 bp, Homo sapiens
gaaagtattcacaaagttcttg

SEQ ID NO: 10011600 - DNA, 22 bp, Homo sapiens
gaaagtattagcctagaagtca

SEQ ID NO: 10011601 - DNA, 22 bp, Homo sapiens
gaaagtattagcctagaagtca

SEQ ID NO: 10011602 - DNA, 22 bp, Homo sapiens
gaaaggtttggcttttcagtag

SEQ ID NO: 10011603 - DNA, 22 bp, Homo sapiens
gaaagtaacatttcttgaatta

SEQ ID NO: 10011604 - DNA, 22 bp, Homo sapiens
gaaagtatgccatctacctctt

SEQ ID NO: 10011605 - DNA, 22 bp, Homo sapiens
gaaatactgcacaccctgtaag

SEQ ID NO: 10011606 - DNA, 21 bp, Homo sapiens
gaaatactgccttaggagctg

SEQ ID NO: 10011607 - DNA, 22 bp, Homo sapiens
gaaatacagttgggaggaggta

SEQ ID NO: 10011608 - DNA, 22 bp, Homo sapiens
gaaatacagttgggaggaggta

SEQ ID NO: 10011609 - DNA, 22 bp, Homo sapiens
gaaagtgcagtcagacaaggca

SEQ ID NO: 10011610 - DNA, 22 bp, Homo sapiens
gaaatagacactttctatgaat

SEQ ID NO: 10011611 - DNA, 22 bp, Homo sapiens
gaaatagacactttctatgaat

SEQ ID NO: 10011612 - DNA, 20 bp, Homo sapiens
gaaatacttacccaactgtt

SEQ ID NO: 10011613 - DNA, 22 bp, Homo sapiens
gaaatactgtaaagttattatt

SEQ ID NO: 10011614 - DNA, 22 bp, Homo sapiens
gaaatagaagctgccaatttct

SEQ ID NO: 10011615 - DNA, 22 bp, Homo sapiens
gaaatagaagctgccaatttct

SEQ ID NO: 10011616 - DNA, 22 bp, Homo sapiens
atgatatttgcaatgtgcttgc

SEQ ID NO: 10011617 - DNA, 22 bp, Homo sapiens
atgatatttgcaatgtgcttgc

SEQ ID NO: 10011618 - DNA, 22 bp, Homo sapiens
gaaatagatctctgggatgcaa

SEQ ID NO: 10011619 - DNA, 22 bp, Homo sapiens
gaaatagaggacagctggatca

SEQ ID NO: 10011620 - DNA, 22 bp, Homo sapiens
gaaatttattatctacatcatt

SEQ ID NO: 10011621 - DNA, 19 bp, Homo sapiens
atgatctgcccttgtaata

SEQ ID NO: 10011622 - DNA, 20 bp, Homo sapiens
gaaacattggcagcaactga

SEQ ID NO: 10011623 - DNA, 22 bp, Homo sapiens
gaaacattgagcagaaggagaa

SEQ ID NO: 10011624 - DNA, 22 bp, Homo sapiens
gaaacattcagtcaacagtgtt

SEQ ID NO: 10011625 - DNA, 22 bp, Homo sapiens
gaaacatgtctgacaatttacc

SEQ ID NO: 10011626 - DNA, 22 bp, Homo sapiens
gaaacattcatatgagaaacct

SEQ ID NO: 10011627 - DNA, 22 bp, Homo sapiens
gaaacattcatatgagaaacct

SEQ ID NO: 10011628 - DNA, 22 bp, Homo sapiens
gaaacattcagtcaacagtgtt

SEQ ID NO: 10011629 - DNA, 22 bp, Homo sapiens
gaaacattcagtcaacagtgtt

SEQ ID NO: 10011630 - DNA, 22 bp, Homo sapiens
gaaaatgtgtcatccctactgt

SEQ ID NO: 10011631 - DNA, 22 bp, Homo sapiens
gaaaatgtgtcatccctactgt

SEQ ID NO: 10011632 - DNA, 22 bp, Homo sapiens
gaaaatgttagcttcatagtca

SEQ ID NO: 10011633 - DNA, 22 bp, Homo sapiens
gaaacagtcaactttctttccc

SEQ ID NO: 10011634 - DNA, 22 bp, Homo sapiens
ctttctttcgaagacgtgatta

SEQ ID NO: 10011635 - DNA, 22 bp, Homo sapiens
ctttctttcgaagacgtgatta

SEQ ID NO: 10011636 - DNA, 22 bp, Homo sapiens
ctttcttgcataatttgaaacc

SEQ ID NO: 10011637 - DNA, 22 bp, Homo sapiens
atgacagtactggtgacaatac

SEQ ID NO: 10011638 - DNA, 22 bp, Homo sapiens
atgacatcaacagtggtgctgt

SEQ ID NO: 10011639 - DNA, 22 bp, Homo sapiens
gaaagcagtatttagttctgtt

SEQ ID NO: 10011640 - DNA, 22 bp, Homo sapiens
atgacatgaggcatctttggag

SEQ ID NO: 10011641 - DNA, 22 bp, Homo sapiens
gaaagcagtaaatgggtcccat

SEQ ID NO: 10011642 - DNA, 22 bp, Homo sapiens
gaaagcagtatttagttctgtt

SEQ ID NO: 10011643 - DNA, 22 bp, Homo sapiens
gaaaggttgggtgaatggtgga

SEQ ID NO: 10011644 - DNA, 22 bp, Homo sapiens
gaaaggttgtaacaagactctt

SEQ ID NO: 10011645 - DNA, 22 bp, Homo sapiens
gaaaggtttaagtaggatttgt

SEQ ID NO: 10011646 - DNA, 22 bp, Homo sapiens
gaaaggtttcatctacttttca

SEQ ID NO: 10011647 - DNA, 21 bp, Homo sapiens
atgacagatgctgcagatcgt

SEQ ID NO: 10011648 - DNA, 22 bp, Homo sapiens
atgacagatagtcttcatttgc

SEQ ID NO: 10011649 - DNA, 22 bp, Homo sapiens
atgacagatgctgtggggaggt

SEQ ID NO: 10011650 - DNA, 21 bp, Homo sapiens
atgacagatgctgcagatcgt

SEQ ID NO: 10011651 - DNA, 22 bp, Homo sapiens
gaaacatttgttgagtacttgc

SEQ ID NO: 10011652 - DNA, 22 bp, Homo sapiens
atgtcccagctgagagacaact

SEQ ID NO: 10011653 - DNA, 20 bp, Homo sapiens
atgtagatgaaagcaaaggc

SEQ ID NO: 10011654 - DNA, 22 bp, Homo sapiens
atgtagatttgcttctcctgcc

SEQ ID NO: 10011655 - DNA, 22 bp, Homo sapiens
atgtagatgttcacttgatttt

SEQ ID NO: 10011656 - DNA, 22 bp, Homo sapiens
atgtagaaataatttcagttcc

SEQ ID NO: 10011657 - DNA, 22 bp, Homo sapiens
atgtagaagctgacagtgctgt

SEQ ID NO: 10011658 - DNA, 22 bp, Homo sapiens
atgtagaacaggttaatgacag

SEQ ID NO: 10011659 - DNA, 22 bp, Homo sapiens
atgtagaacaggttaatgacag

SEQ ID NO: 10011660 - DNA, 22 bp, Homo sapiens
atgtagaagtgggcattataga

SEQ ID NO: 10011661 - DNA, 22 bp, Homo sapiens
atgtagaattccttctactttg

SEQ ID NO: 10011662 - DNA, 22 bp, Homo sapiens
atgtagagtagaatagtacaac

SEQ ID NO: 10011663 - DNA, 22 bp, Homo sapiens
atgtagaggagtttctggtctg

SEQ ID NO: 10011664 - DNA, 22 bp, Homo sapiens
atgtagagctccttgatcctcc

SEQ ID NO: 10011665 - DNA, 20 bp, Homo sapiens
atgtcctgttgctgccccag

SEQ ID NO: 10011666 - DNA, 22 bp, Homo sapiens
atgtcctggtcctccaccatgg

SEQ ID NO: 10011667 - DNA, 20 bp, Homo sapiens
atgtcctgcttctcctcacc

SEQ ID NO: 10011668 - DNA, 21 bp, Homo sapiens
atgtcctggctaccagcgcag

SEQ ID NO: 10011669 - DNA, 22 bp, Homo sapiens
atgtccttcctgagatccctgt

SEQ ID NO: 10011670 - DNA, 22 bp, Homo sapiens
atgtccttgagaccctcctcgg

SEQ ID NO: 10011671 - DNA, 22 bp, Homo sapiens
atgtctctcaggtttaacttta

SEQ ID NO: 10011672 - DNA, 22 bp, Homo sapiens
atgtctctgccccagagagctt

SEQ ID NO: 10011673 - DNA, 22 bp, Homo sapiens
atgtctctctctgagtgccaga

SEQ ID NO: 10011674 - DNA, 22 bp, Homo sapiens
atgtctctgccccagagagctt

SEQ ID NO: 10011675 - DNA, 22 bp, Homo sapiens
atgtctctgctgtggttagctt

SEQ ID NO: 10011676 - DNA, 22 bp, Homo sapiens
atgtcctttgtatccctaggca

SEQ ID NO: 10011677 - DNA, 22 bp, Homo sapiens
atgtccttttatttaaagcagg

SEQ ID NO: 10011678 - DNA, 22 bp, Homo sapiens
atgtctatatagtcaataatca

SEQ ID NO: 10011679 - DNA, 22 bp, Homo sapiens
atgtctatatagtcaataatca

SEQ ID NO: 10011680 - DNA, 21 bp, Homo sapiens
atgtctatgacatatttcctt

SEQ ID NO: 10011681 - DNA, 22 bp, Homo sapiens
atgtctatgttctttactgtgt

SEQ ID NO: 10011682 - DNA, 22 bp, Homo sapiens
atgtctatggaatttccacaca

SEQ ID NO: 10011683 - DNA, 22 bp, Homo sapiens
atgtgacagtgtttgacagatg

SEQ ID NO: 10011684 - DNA, 21 bp, Homo sapiens
atgtgaaatatcatcagagca

SEQ ID NO: 10011685 - DNA, 22 bp, Homo sapiens
atgtgaagcttgtgctaacata

SEQ ID NO: 10011686 - DNA, 21 bp, Homo sapiens
atgtgaaatatcatcagagca

SEQ ID NO: 10011687 - DNA, 22 bp, Homo sapiens
atgtgaaacgcaatgggatcat

SEQ ID NO: 10011688 - DNA, 20 bp, Homo sapiens
atgtgaaagatcagttgtct

SEQ ID NO: 10011689 - DNA, 22 bp, Homo sapiens
atgtgaaagaggtgttcagtgg

SEQ ID NO: 10011690 - DNA, 20 bp, Homo sapiens
atgtgaaagatcagttgtct

SEQ ID NO: 10011691 - DNA, 20 bp, Homo sapiens
atgtgaaagatcagttgtct

SEQ ID NO: 10011692 - DNA, 22 bp, Homo sapiens
atgtgaggaagaaagaggtaag

SEQ ID NO: 10011693 - DNA, 22 bp, Homo sapiens
atgtgactttgtgtcttccatc

SEQ ID NO: 10011694 - DNA, 22 bp, Homo sapiens
atgtgagggctcaggctgactg

SEQ ID NO: 10011695 - DNA, 22 bp, Homo sapiens
atgtgagggaaatcagtcagaa

SEQ ID NO: 10011696 - DNA, 22 bp, Homo sapiens
gaggtggatgttgcagtgagct

SEQ ID NO: 10011697 - DNA, 22 bp, Homo sapiens
gaggtggatgttgcagtgagct

SEQ ID NO: 10011698 - DNA, 22 bp, Homo sapiens
atgtctctttactcttagaacc

SEQ ID NO: 10011699 - DNA, 19 bp, Homo sapiens
atgtctctgtagcacatac

SEQ ID NO: 10011700 - DNA, 20 bp, Homo sapiens
atgtctgaagtaatccattt

SEQ ID NO: 10011701 - DNA, 22 bp, Homo sapiens
atgtctgataaataatgcataa

SEQ ID NO: 10011702 - DNA, 22 bp, Homo sapiens
gagggcagagacagtgattcac

SEQ ID NO: 10011703 - DNA, 20 bp, Homo sapiens
gagggctcgtggatggataa

SEQ ID NO: 10011704 - DNA, 22 bp, Homo sapiens
gagggctgaagattgtggcccc

SEQ ID NO: 10011705 - DNA, 22 bp, Homo sapiens
gagggctctgtctggaagggaa

SEQ ID NO: 10011706 - DNA, 22 bp, Homo sapiens
gagggctctgaaaggaggtcac

SEQ ID NO: 10011707 - DNA, 22 bp, Homo sapiens
atgtttaatcggctgcctttcc

SEQ ID NO: 10011708 - DNA, 22 bp, Homo sapiens
gataatccaagattgcctcact

SEQ ID NO: 10011709 - DNA, 22 bp, Homo sapiens
gataatccactctgctgacttt

SEQ ID NO: 10011710 - DNA, 22 bp, Homo sapiens
gataatatctggtttattcacc

SEQ ID NO: 10011711 - DNA, 22 bp, Homo sapiens
gagttctaaaggcagaacataa

SEQ ID NO: 10011712 - DNA, 22 bp, Homo sapiens
atgtttaaatttatagacagtg

SEQ ID NO: 10011713 - DNA, 22 bp, Homo sapiens
atgtttaaatttatagacagtg

SEQ ID NO: 10011714 - DNA, 22 bp, Homo sapiens
atgtttaaagggttgagaaata

SEQ ID NO: 10011715 - DNA, 22 bp, Homo sapiens
atgtttaaatttatagacagtg

SEQ ID NO: 10011716 - DNA, 22 bp, Homo sapiens
atgtttaagaaagtcttccata

SEQ ID NO: 10011717 - DNA, 22 bp, Homo sapiens
atgtttaagaaagtcttccata

SEQ ID NO: 10011718 - DNA, 22 bp, Homo sapiens
atgtttaagaaagtcttccata

SEQ ID NO: 10011719 - DNA, 22 bp, Homo sapiens
atgtttaagaaagtcttccata

SEQ ID NO: 10011720 - DNA, 22 bp, Homo sapiens
atgtttaaggaactggtttgct

SEQ ID NO: 10011721 - DNA, 22 bp, Homo sapiens
atgttggagtcgtaaggcatgg

SEQ ID NO: 10011722 - DNA, 22 bp, Homo sapiens
atgttggagtcgtaaggcatgg

SEQ ID NO: 10011723 - DNA, 22 bp, Homo sapiens
atgtttaaaggagtcagagact

SEQ ID NO: 10011724 - DNA, 22 bp, Homo sapiens
atgttgtgtttgactgttaccc

SEQ ID NO: 10011725 - DNA, 22 bp, Homo sapiens
gatacaaattcatgtctgaatt

SEQ ID NO: 10011726 - DNA, 22 bp, Homo sapiens
gatacaagactaataggaaaca

SEQ ID NO: 10011727 - DNA, 22 bp, Homo sapiens
gatacacaaaagtctagtgagg

SEQ ID NO: 10011728 - DNA, 22 bp, Homo sapiens
gatacacaaaagtctagtgagg

SEQ ID NO: 10011729 - DNA, 22 bp, Homo sapiens
gatacaaattcatgtctgaatt

SEQ ID NO: 10011730 - DNA, 22 bp, Homo sapiens
gatacacaagtggaaggagacg

SEQ ID NO: 10011731 - DNA, 22 bp, Homo sapiens
gatatcattgagcccaggagtt

SEQ ID NO: 10011732 - DNA, 22 bp, Homo sapiens
gatatgaagtggcattgtgaag

SEQ ID NO: 10011733 - DNA, 22 bp, Homo sapiens
gataatgtgccgataatttcta

SEQ ID NO: 10011734 - DNA, 22 bp, Homo sapiens
gataatgtgccgataatttcta

SEQ ID NO: 10011735 - DNA, 22 bp, Homo sapiens
gataatttaagtcttgggggct

SEQ ID NO: 10011736 - DNA, 22 bp, Homo sapiens
gataatttctccatctcaaggt

SEQ ID NO: 10011737 - DNA, 22 bp, Homo sapiens
gataatttgatacctcaatcag

SEQ ID NO: 10011738 - DNA, 22 bp, Homo sapiens
gataatttgatacctcaatcag

SEQ ID NO: 10011739 - DNA, 22 bp, Homo sapiens
gatacaaaatataaatggagag

SEQ ID NO: 10011740 - DNA, 22 bp, Homo sapiens
gatacaaaatataaatggagag

SEQ ID NO: 10011741 - DNA, 22 bp, Homo sapiens
gaggtggcagaggcctggacct

SEQ ID NO: 10011742 - DNA, 22 bp, Homo sapiens
gaggtggcactgtgaggagcac

SEQ ID NO: 10011743 - DNA, 22 bp, Homo sapiens
gaggtggcaatttaatgcagtc

SEQ ID NO: 10011744 - DNA, 22 bp, Homo sapiens
gaggtggcccttgctcagcctt

SEQ ID NO: 10011745 - DNA, 22 bp, Homo sapiens
gaggtggccaagcgaggaaggg

SEQ ID NO: 10011746 - DNA, 22 bp, Homo sapiens
gaggtggcgcgccatccctgcc

SEQ ID NO: 10011747 - DNA, 22 bp, Homo sapiens
atgtgtctaattccaggagcac

SEQ ID NO: 10011748 - DNA, 22 bp, Homo sapiens
atgtgtctaattccaggagcac

SEQ ID NO: 10011749 - DNA, 22 bp, Homo sapiens
atgtgtctctaaaatttagtaa

SEQ ID NO: 10011750 - DNA, 17 bp, Homo sapiens
atgtgtctagtgcaacc

SEQ ID NO: 10011751 - DNA, 22 bp, Homo sapiens
atgtgtctagattgctgtaccg

SEQ ID NO: 10011752 - DNA, 17 bp, Homo sapiens
atgtgtctgagtgtcct

SEQ ID NO: 10011753 - DNA, 20 bp, Homo sapiens
atgtgtctgcctctgtgttc

SEQ ID NO: 10011754 - DNA, 22 bp, Homo sapiens
atgtgtctgatggccctgaatt

SEQ ID NO: 10011755 - DNA, 22 bp, Homo sapiens
atgtgtctggcatggaaagtgt

SEQ ID NO: 10011756 - DNA, 22 bp, Homo sapiens
atgtgtctggcatggaaagtgt

SEQ ID NO: 10011757 - DNA, 22 bp, Homo sapiens
atgtgtctgaccactgtattgg

SEQ ID NO: 10011758 - DNA, 17 bp, Homo sapiens
atgtgtctgagtgtcct

SEQ ID NO: 10011759 - DNA, 22 bp, Homo sapiens
atgtgtctctaccaatgcaatt

SEQ ID NO: 10011760 - DNA, 22 bp, Homo sapiens
atgttctgtttcttaatcttga

SEQ ID NO: 10011761 - DNA, 22 bp, Homo sapiens
atgttctgcctccattttgagt

SEQ ID NO: 10011762 - DNA, 22 bp, Homo sapiens
atgttctgcctccattttgagt

SEQ ID NO: 10011763 - DNA, 22 bp, Homo sapiens
atgttctgaatcaagcaactct

SEQ ID NO: 10011764 - DNA, 19 bp, Homo sapiens
atgttctatcctccaagtt

SEQ ID NO: 10011765 - DNA, 19 bp, Homo sapiens
atgttctatcctccaagtt

SEQ ID NO: 10011766 - DNA, 22 bp, Homo sapiens
atgttatttctgaaagatcatt

SEQ ID NO: 10011767 - DNA, 22 bp, Homo sapiens
atgtgtctggcatggctctatt

SEQ ID NO: 10011768 - DNA, 22 bp, Homo sapiens
atgtgtctggttattgacatgc

SEQ ID NO: 10011769 - DNA, 22 bp, Homo sapiens
atgtgtctggcatggctctatt

SEQ ID NO: 10011770 - DNA, 20 bp, Homo sapiens
atgtgtctgtaaacaactct

SEQ ID NO: 10011771 - DNA, 22 bp, Homo sapiens
atgtgtcttctaagccaagcct

SEQ ID NO: 10011772 - DNA, 22 bp, Homo sapiens
atgtgtcttatttgattccaca

SEQ ID NO: 10011773 - DNA, 20 bp, Homo sapiens
atgtgtcttagagcatcagg

SEQ ID NO: 10011774 - DNA, 22 bp, Homo sapiens
atgtgtctgtgggcacacacac

SEQ ID NO: 10011775 - DNA, 20 bp, Homo sapiens
atgttcttcatttaatgttc

SEQ ID NO: 10011776 - DNA, 22 bp, Homo sapiens
atgttcttctatctttattaaa

SEQ ID NO: 10011777 - DNA, 22 bp, Homo sapiens
atgttcttggatgttgtgtata

SEQ ID NO: 10011778 - DNA, 22 bp, Homo sapiens
atgttctttcagccagtgcatc

SEQ ID NO: 10011779 - DNA, 22 bp, Homo sapiens
gagatgggcgagaaggtggact

SEQ ID NO: 10011780 - DNA, 22 bp, Homo sapiens
gagatgggcgagaaggtggact

SEQ ID NO: 10011781 - DNA, 22 bp, Homo sapiens
gagatgggcgagaaggtggact

SEQ ID NO: 10011782 - DNA, 22 bp, Homo sapiens
atggagggaaaagtggagagcc

SEQ ID NO: 10011783 - DNA, 22 bp, Homo sapiens
gagagcaatggggacgggcagg

SEQ ID NO: 10011784 - DNA, 22 bp, Homo sapiens
gagagcagactctcaaagctgg

SEQ ID NO: 10011785 - DNA, 22 bp, Homo sapiens
gagagagctctgtgcctgggat

SEQ ID NO: 10011786 - DNA, 22 bp, Homo sapiens
gagagaggcctccatgtactga

SEQ ID NO: 10011787 - DNA, 22 bp, Homo sapiens
gagagaggcctccatgtactga

SEQ ID NO: 10011788 - DNA, 22 bp, Homo sapiens
gagagaggcctccatgtactga

SEQ ID NO: 10011789 - DNA, 22 bp, Homo sapiens
gagagaggcctccatgtactga

SEQ ID NO: 10011790 - DNA, 22 bp, Homo sapiens
gagagagaggtgctgccaggca

SEQ ID NO: 10011791 - DNA, 22 bp, Homo sapiens
gagagagagctaatattaagct

SEQ ID NO: 10011792 - DNA, 22 bp, Homo sapiens
gagagagaaggcctgtgggtgt

SEQ ID NO: 10011793 - DNA, 22 bp, Homo sapiens
gagagagaagtgggtgtcacct

SEQ ID NO: 10011794 - DNA, 22 bp, Homo sapiens
gagagagaagtgggtgtcacct

SEQ ID NO: 10011795 - DNA, 22 bp, Homo sapiens
gactggggctctagccaggcct

SEQ ID NO: 10011796 - DNA, 22 bp, Homo sapiens
gagacagtggttgcagaagctc

SEQ ID NO: 10011797 - DNA, 22 bp, Homo sapiens
gagatggggaataggagcaagc

SEQ ID NO: 10011798 - DNA, 17 bp, Homo sapiens
gagatgggtggatcacc

SEQ ID NO: 10011799 - DNA, 17 bp, Homo sapiens
gagatgggtggatcacc

SEQ ID NO: 10011800 - DNA, 22 bp, Homo sapiens
atggccagagaaggcagggtca

SEQ ID NO: 10011801 - DNA, 22 bp, Homo sapiens
atggctttgaagtaatgtaatt

SEQ ID NO: 10011802 - DNA, 22 bp, Homo sapiens
atggctttttagactttggtac

SEQ ID NO: 10011803 - DNA, 22 bp, Homo sapiens
atggcttgcttttagagagatc

SEQ ID NO: 10011804 - DNA, 22 bp, Homo sapiens
atggctttccggactttggcca

SEQ ID NO: 10011805 - DNA, 22 bp, Homo sapiens
atggctggcactggcctgggtt

SEQ ID NO: 10011806 - DNA, 22 bp, Homo sapiens
atggctggcatccaggtgggct

SEQ ID NO: 10011807 - DNA, 22 bp, Homo sapiens
atggccagagaggccagcctgg

SEQ ID NO: 10011808 - DNA, 22 bp, Homo sapiens
atggctggcatccaggtgggct

SEQ ID NO: 10011809 - DNA, 17 bp, Homo sapiens
atggcttccattgacca

SEQ ID NO: 10011810 - DNA, 22 bp, Homo sapiens
atggcttccaaggccctccgtg

SEQ ID NO: 10011811 - DNA, 21 bp, Homo sapiens
atggcttctcaggtgcactga

SEQ ID NO: 10011812 - DNA, 22 bp, Homo sapiens
atggggagagaagggctgagct

SEQ ID NO: 10011813 - DNA, 22 bp, Homo sapiens
atggggagagaagggctgagct

SEQ ID NO: 10011814 - DNA, 22 bp, Homo sapiens
atggggagagcctctgtcccca

SEQ ID NO: 10011815 - DNA, 22 bp, Homo sapiens
atggggagagcctctgtcccca

SEQ ID NO: 10011816 - DNA, 22 bp, Homo sapiens
atggggaagagccagtgagctg

SEQ ID NO: 10011817 - DNA, 22 bp, Homo sapiens
atggggagagaagggctgagct

SEQ ID NO: 10011818 - DNA, 22 bp, Homo sapiens
atgggctgggatctgagtgtca

SEQ ID NO: 10011819 - DNA, 22 bp, Homo sapiens
atgggctgtcctagtccagccc

SEQ ID NO: 10011820 - DNA, 22 bp, Homo sapiens
atgggctgtccattgctggctg

SEQ ID NO: 10011821 - DNA, 22 bp, Homo sapiens
atgggaaggttttgagagcggg

SEQ ID NO: 10011822 - DNA, 22 bp, Homo sapiens
atgggctgaggtgggatagaag

SEQ ID NO: 10011823 - DNA, 22 bp, Homo sapiens
atgggctgaggaagctcctgag

SEQ ID NO: 10011824 - DNA, 22 bp, Homo sapiens
atgggctgacccagtcgtggca

SEQ ID NO: 10011825 - DNA, 22 bp, Homo sapiens
gaggcacatatatacagagccc

SEQ ID NO: 10011826 - DNA, 22 bp, Homo sapiens
gaggcacatatatacagagccc

SEQ ID NO: 10011827 - DNA, 22 bp, Homo sapiens
gaggcagcagggctggttcctt

SEQ ID NO: 10011828 - DNA, 22 bp, Homo sapiens
gaggcagcatctatggtgggaa

SEQ ID NO: 10011829 - DNA, 22 bp, Homo sapiens
atggtggtagaagcactatgtg

SEQ ID NO: 10011830 - DNA, 22 bp, Homo sapiens
atggtggtgaagagcacagtga

SEQ ID NO: 10011831 - DNA, 22 bp, Homo sapiens
atggtgtccccagcctttgaag

SEQ ID NO: 10011832 - DNA, 22 bp, Homo sapiens
gaggcagcctcagtggacctcg

SEQ ID NO: 10011833 - DNA, 22 bp, Homo sapiens
gaggcagcatggtaccttggag

SEQ ID NO: 10011834 - DNA, 22 bp, Homo sapiens
gaggcagcattcgcatagacag

SEQ ID NO: 10011835 - DNA, 18 bp, Homo sapiens
atggtctcatactgggag

SEQ ID NO: 10011836 - DNA, 22 bp, Homo sapiens
gaggagaatgcgcaccacatat

SEQ ID NO: 10011837 - DNA, 22 bp, Homo sapiens
gaggagaagggcacggagaaaa

SEQ ID NO: 10011838 - DNA, 22 bp, Homo sapiens
gaggagaagctattggaaggac

SEQ ID NO: 10011839 - DNA, 22 bp, Homo sapiens
gaggagaagggcacggagaaaa

SEQ ID NO: 10011840 - DNA, 22 bp, Homo sapiens
gaggagaagggcacggagaaaa

SEQ ID NO: 10011841 - DNA, 22 bp, Homo sapiens
atggtgaagcttcatgggtgtt

SEQ ID NO: 10011842 - DNA, 22 bp, Homo sapiens
gaggagaagctaagaaacacag

SEQ ID NO: 10011843 - DNA, 22 bp, Homo sapiens
gaggagaagctattggaaggac

SEQ ID NO: 10011844 - DNA, 22 bp, Homo sapiens
gaggagaagctattggaaggac

SEQ ID NO: 10011845 - DNA, 22 bp, Homo sapiens
gaggagaagctaagaaacacag

SEQ ID NO: 10011846 - DNA, 22 bp, Homo sapiens
gaggagaagctaagaaacacag

SEQ ID NO: 10011847 - DNA, 22 bp, Homo sapiens
gaggagaagctaagaaacacag

SEQ ID NO: 10011848 - DNA, 22 bp, Homo sapiens
gaggagaaatttggggacctga

SEQ ID NO: 10011849 - DNA, 22 bp, Homo sapiens
gaggagaaatttggggacctga

SEQ ID NO: 10011850 - DNA, 22 bp, Homo sapiens
gaggagaaattatccttggtgt

SEQ ID NO: 10011851 - DNA, 22 bp, Homo sapiens
gggcagtgggtggctgcagcct

SEQ ID NO: 10011852 - DNA, 22 bp, Homo sapiens
gggcagtgggtggctgcagcct

SEQ ID NO: 10011853 - DNA, 22 bp, Homo sapiens
gggcagtgggtggctgcagcct

SEQ ID NO: 10011854 - DNA, 22 bp, Homo sapiens
gggcagtggttacacagctgag

SEQ ID NO: 10011855 - DNA, 22 bp, Homo sapiens
cagagacaggaatcagctgcag

SEQ ID NO: 10011856 - DNA, 22 bp, Homo sapiens
cagagacaggagtgctcccagt

SEQ ID NO: 10011857 - DNA, 22 bp, Homo sapiens
gggcaggtatttatcttctatt

SEQ ID NO: 10011858 - DNA, 22 bp, Homo sapiens
cagagacaggatctcgaagact

SEQ ID NO: 10011859 - DNA, 22 bp, Homo sapiens
cagagacaggcttgccctccac

SEQ ID NO: 10011860 - DNA, 22 bp, Homo sapiens
gggcagcattctgtgggcaggt

SEQ ID NO: 10011861 - DNA, 22 bp, Homo sapiens
gggcagcattctgtgggcaggt

SEQ ID NO: 10011862 - DNA, 22 bp, Homo sapiens
gggcagcatttgaaaaacagat

SEQ ID NO: 10011863 - DNA, 22 bp, Homo sapiens
gggcagcattctgtgggcaggt

SEQ ID NO: 10011864 - DNA, 22 bp, Homo sapiens
gggcagcatgaggaccctcatc

SEQ ID NO: 10011865 - DNA, 22 bp, Homo sapiens
gggcagcatgtcactagcatgg

SEQ ID NO: 10011866 - DNA, 22 bp, Homo sapiens
gggcagcccagaactgctgcag

SEQ ID NO: 10011867 - DNA, 22 bp, Homo sapiens
gggcagcagccactcatttagc

SEQ ID NO: 10011868 - DNA, 22 bp, Homo sapiens
gggcagcagcaggaggtctctg

SEQ ID NO: 10011869 - DNA, 22 bp, Homo sapiens
gggcagcagcaggaggtctctg

SEQ ID NO: 10011870 - DNA, 22 bp, Homo sapiens
gggcagcagagccctgccgagt

SEQ ID NO: 10011871 - DNA, 21 bp, Homo sapiens
gggcagcagcagcaacaaggg

SEQ ID NO: 10011872 - DNA, 22 bp, Homo sapiens
gggcagcagaggatcccttaat

SEQ ID NO: 10011873 - DNA, 22 bp, Homo sapiens
gggcagcatgaggaccctcatc

SEQ ID NO: 10011874 - DNA, 22 bp, Homo sapiens
gggcagcatcaggaggggcttt

SEQ ID NO: 10011875 - DNA, 22 bp, Homo sapiens
gggcagcatcaggaggggcttt

SEQ ID NO: 10011876 - DNA, 22 bp, Homo sapiens
gggcagcagttgccctaatcaa

SEQ ID NO: 10011877 - DNA, 22 bp, Homo sapiens
gggcagcaggctccacgttcct

SEQ ID NO: 10011878 - DNA, 22 bp, Homo sapiens
gggcagcataacaatcactgaa

SEQ ID NO: 10011879 - DNA, 22 bp, Homo sapiens
gggcagcagttgccctaatcaa

SEQ ID NO: 10011880 - DNA, 22 bp, Homo sapiens
cagacctgaggagcactgagcc

SEQ ID NO: 10011881 - DNA, 22 bp, Homo sapiens
cagacctgaggttgagtaccag

SEQ ID NO: 10011882 - DNA, 22 bp, Homo sapiens
cagacctgaggagcactgagcc

SEQ ID NO: 10011883 - DNA, 22 bp, Homo sapiens
cagacctggaaaacaggcttgc

SEQ ID NO: 10011884 - DNA, 20 bp, Homo sapiens
cagacctgcacccacttcga

SEQ ID NO: 10011885 - DNA, 23 bp, Homo sapiens
cagacctggcagtcatcctcaac

SEQ ID NO: 10011886 - DNA, 22 bp, Homo sapiens
cagactctcttccatgcatcac

SEQ ID NO: 10011887 - DNA, 19 bp, Homo sapiens
cagacctgtccagcctgtg

SEQ ID NO: 10011888 - DNA, 19 bp, Homo sapiens
cagacctgtccagcctgtg

SEQ ID NO: 10011889 - DNA, 23 bp, Homo sapiens
cagacctggcagtcatcctcaac

SEQ ID NO: 10011890 - DNA, 22 bp, Homo sapiens
cagactctcttccatgcatcac

SEQ ID NO: 10011891 - DNA, 22 bp, Homo sapiens
cagactctgatgcagccttgtg

SEQ ID NO: 10011892 - DNA, 22 bp, Homo sapiens
cagactcttgagctgattgtat

SEQ ID NO: 10011893 - DNA, 22 bp, Homo sapiens
cagactgagggcatcacatacg

SEQ ID NO: 10011894 - DNA, 22 bp, Homo sapiens
cagactgaaaatccctggtagt

SEQ ID NO: 10011895 - DNA, 22 bp, Homo sapiens
cagactgactttctgtggctat

SEQ ID NO: 10011896 - DNA, 22 bp, Homo sapiens
cagactggccacatctgcactg

SEQ ID NO: 10011897 - DNA, 22 bp, Homo sapiens
cagactggccacatctgcactg

SEQ ID NO: 10011898 - DNA, 22 bp, Homo sapiens
cagactgagggcatcacatacg

SEQ ID NO: 10011899 - DNA, 22 bp, Homo sapiens
cagactgagggcatcacatacg

SEQ ID NO: 10011900 - DNA, 22 bp, Homo sapiens
cagactgggagtcaggaagaag

SEQ ID NO: 10011901 - DNA, 22 bp, Homo sapiens
gggcagagaaatggacagttgg

SEQ ID NO: 10011902 - DNA, 22 bp, Homo sapiens
ggcttcagaagactggacaggt

SEQ ID NO: 10011903 - DNA, 22 bp, Homo sapiens
cagacagggtcctgtccgtcac

SEQ ID NO: 10011904 - DNA, 22 bp, Homo sapiens
ggcttcagatttctcagttgtt

SEQ ID NO: 10011905 - DNA, 22 bp, Homo sapiens
ggcttcagaggggaggtagtgc

SEQ ID NO: 10011906 - DNA, 22 bp, Homo sapiens
ggcttatattgctctattcaca

SEQ ID NO: 10011907 - DNA, 22 bp, Homo sapiens
ggcttatatattttcacttgcc

SEQ ID NO: 10011908 - DNA, 17 bp, Homo sapiens
ggcttacaggtgccagc

SEQ ID NO: 10011909 - DNA, 22 bp, Homo sapiens
ggcttagaaggcaaatgacttg

SEQ ID NO: 10011910 - DNA, 22 bp, Homo sapiens
ggcttagcaactcctgaggctc

SEQ ID NO: 10011911 - DNA, 22 bp, Homo sapiens
ggcttagattgacactgatctc

SEQ ID NO: 10011912 - DNA, 22 bp, Homo sapiens
cagaccagaaggaagccgacaa

SEQ ID NO: 10011913 - DNA, 22 bp, Homo sapiens
cagacccaggatccaaatgttg

SEQ ID NO: 10011914 - DNA, 23 bp, Homo sapiens
cagaccctcaatccacttgtttt

SEQ ID NO: 10011915 - DNA, 22 bp, Homo sapiens
cagaccctcgggtgagttggcc

SEQ ID NO: 10011916 - DNA, 22 bp, Homo sapiens
cagaccctgggccacagaggag

SEQ ID NO: 10011917 - DNA, 22 bp, Homo sapiens
cagaccctcttctattggtggg

SEQ ID NO: 10011918 - DNA, 22 bp, Homo sapiens
cagagcctaaaacgactccact

SEQ ID NO: 10011919 - DNA, 22 bp, Homo sapiens
cagagcctaaaacgactccact

SEQ ID NO: 10011920 - DNA, 22 bp, Homo sapiens
cagagcctaaaacgactccact

SEQ ID NO: 10011921 - DNA, 22 bp, Homo sapiens
gggctgactcaaccttgcaaag

SEQ ID NO: 10011922 - DNA, 22 bp, Homo sapiens
cagagcctcatcatccactcca

SEQ ID NO: 10011923 - DNA, 22 bp, Homo sapiens
cagagcctcatcatccactcca

SEQ ID NO: 10011924 - DNA, 22 bp, Homo sapiens
cagagcctcagaatcctgtgga

SEQ ID NO: 10011925 - DNA, 19 bp, Homo sapiens
cagagcctcagagctagaa

SEQ ID NO: 10011926 - DNA, 19 bp, Homo sapiens
cagagcctcagagctagaa

SEQ ID NO: 10011927 - DNA, 22 bp, Homo sapiens
gggctgaaaggccgcctcagat

SEQ ID NO: 10011928 - DNA, 22 bp, Homo sapiens
gggctgaaaggccgcctcagat

SEQ ID NO: 10011929 - DNA, 22 bp, Homo sapiens
gggctgaaaggccgcctcagat

SEQ ID NO: 10011930 - DNA, 22 bp, Homo sapiens
gggctgacaaccatctgacaag

SEQ ID NO: 10011931 - DNA, 22 bp, Homo sapiens
gggctgaactcaagtcagctcc

SEQ ID NO: 10011932 - DNA, 22 bp, Homo sapiens
gggcagtgtcggggcccaggga

SEQ ID NO: 10011933 - DNA, 22 bp, Homo sapiens
gggcagtgtcgaggtctggtcc

SEQ ID NO: 10011934 - DNA, 22 bp, Homo sapiens
gggccacggaaggaccagtggg

SEQ ID NO: 10011935 - DNA, 22 bp, Homo sapiens
gggccagacccttggcgatctg

SEQ ID NO: 10011936 - DNA, 22 bp, Homo sapiens
cagagcctctcagaggtcagac

SEQ ID NO: 10011937 - DNA, 22 bp, Homo sapiens
cagagcctctcagaggtcagac

SEQ ID NO: 10011938 - DNA, 22 bp, Homo sapiens
cagagcctgccacctttctccc

SEQ ID NO: 10011939 - DNA, 23 bp, Homo sapiens
cagagctggctcagagctgcctg

SEQ ID NO: 10011940 - DNA, 22 bp, Homo sapiens
cagagctggctctgcatgtaca

SEQ ID NO: 10011941 - DNA, 22 bp, Homo sapiens
cagagcctgctcacgtctctgt

SEQ ID NO: 10011942 - DNA, 22 bp, Homo sapiens
cagagctgcttcccagtttgtg

SEQ ID NO: 10011943 - DNA, 22 bp, Homo sapiens
cagagctgggatcccatgggcg

SEQ ID NO: 10011944 - DNA, 23 bp, Homo sapiens
cagagctggcttcatgggtgtgc

SEQ ID NO: 10011945 - DNA, 22 bp, Homo sapiens
cagagctgggatcccatgggcg

SEQ ID NO: 10011946 - DNA, 22 bp, Homo sapiens
cagagctgggtttgggaaacct

SEQ ID NO: 10011947 - DNA, 22 bp, Homo sapiens
cagagctgggtttgggaaacct

SEQ ID NO: 10011948 - DNA, 22 bp, Homo sapiens
cagagctgggatcccatgggcg

SEQ ID NO: 10011949 - DNA, 22 bp, Homo sapiens
cagagctgggcatggtgaaagg

SEQ ID NO: 10011950 - DNA, 22 bp, Homo sapiens
cagagctgggcatggtgaaagg

SEQ ID NO: 10011951 - DNA, 20 bp, Homo sapiens
cagaggcaaggagacttgga

SEQ ID NO: 10011952 - DNA, 22 bp, Homo sapiens
cagaggcaaaagaggtggaggt

SEQ ID NO: 10011953 - DNA, 22 bp, Homo sapiens
gggctgagtgacctcaggccaa

SEQ ID NO: 10011954 - DNA, 22 bp, Homo sapiens
cagaggacttcccactcatctg

SEQ ID NO: 10011955 - DNA, 22 bp, Homo sapiens
cagaggatgatctggcctctct

SEQ ID NO: 10011956 - DNA, 22 bp, Homo sapiens
cagaggattccctagtgacctg

SEQ ID NO: 10011957 - DNA, 22 bp, Homo sapiens
gggctgagtgacctcaggccaa

SEQ ID NO: 10011958 - DNA, 22 bp, Homo sapiens
gggctgagtgacctcaggccaa

SEQ ID NO: 10011959 - DNA, 22 bp, Homo sapiens
gggctgagtcatctggggcctc

SEQ ID NO: 10011960 - DNA, 22 bp, Homo sapiens
gggctgagtctgctgcctgtca

SEQ ID NO: 10011961 - DNA, 22 bp, Homo sapiens
gggctgagtcatctggggcctc

SEQ ID NO: 10011962 - DNA, 22 bp, Homo sapiens
gggctgaggggtatctcatggg

SEQ ID NO: 10011963 - DNA, 22 bp, Homo sapiens
cagagctgggtttgggaaacct

SEQ ID NO: 10011964 - DNA, 22 bp, Homo sapiens
gggctgaggggtatctcatggg

SEQ ID NO: 10011965 - DNA, 22 bp, Homo sapiens
gggctgaggggtatctcatggg

SEQ ID NO: 10011966 - DNA, 21 bp, Homo sapiens
cagcacagtactgggtcttgc

SEQ ID NO: 10011967 - DNA, 22 bp, Homo sapiens
cagcacaattttcaggagtcca

SEQ ID NO: 10011968 - DNA, 22 bp, Homo sapiens
ggtgctgggaacgaggaattca

SEQ ID NO: 10011969 - DNA, 22 bp, Homo sapiens
cagcacaattttcaggagtcca

SEQ ID NO: 10011970 - DNA, 22 bp, Homo sapiens
ggtgctgatgttattgatgctg

SEQ ID NO: 10011971 - DNA, 22 bp, Homo sapiens
ggtgctgatgaagatgtagcct

SEQ ID NO: 10011972 - DNA, 22 bp, Homo sapiens
ggtgctgatgagttaggagagg

SEQ ID NO: 10011973 - DNA, 22 bp, Homo sapiens
ggtgctgattaagaactgtata

SEQ ID NO: 10011974 - DNA, 22 bp, Homo sapiens
ggtgctgattcactgacttctg

SEQ ID NO: 10011975 - DNA, 22 bp, Homo sapiens
ggtgctgatttgttgctgagat

SEQ ID NO: 10011976 - DNA, 22 bp, Homo sapiens
ggtgctggacacgtggcactcc

SEQ ID NO: 10011977 - DNA, 22 bp, Homo sapiens
ggtgctgactctgtcgtgagca

SEQ ID NO: 10011978 - DNA, 22 bp, Homo sapiens
ggtgctgacattcagagtctgg

SEQ ID NO: 10011979 - DNA, 22 bp, Homo sapiens
ggtgctgacattcagagtctgg

SEQ ID NO: 10011980 - DNA, 19 bp, Homo sapiens
ggtgctgacatcatgcttt

SEQ ID NO: 10011981 - DNA, 22 bp, Homo sapiens
ggtgctgaattctggaggaggc

SEQ ID NO: 10011982 - DNA, 22 bp, Homo sapiens
ggtgctgaataaatactagtta

SEQ ID NO: 10011983 - DNA, 21 bp, Homo sapiens
cagcaaggaagtcgagtaggt

SEQ ID NO: 10011984 - DNA, 22 bp, Homo sapiens
cagcaaggactgggcatgtgaa

SEQ ID NO: 10011985 - DNA, 22 bp, Homo sapiens
ggtgctgaaggactataacggt

SEQ ID NO: 10011986 - DNA, 22 bp, Homo sapiens
ggtgctgactgaggatggcttg

SEQ ID NO: 10011987 - DNA, 22 bp, Homo sapiens
ggtgctgaggccttggcaggga

SEQ ID NO: 10011988 - DNA, 22 bp, Homo sapiens
ggtgctgagagcctaggagggc

SEQ ID NO: 10011989 - DNA, 22 bp, Homo sapiens
ggtgctgacttcacagtcttac

SEQ ID NO: 10011990 - DNA, 22 bp, Homo sapiens
ggtgctgatctaaatttaggac

SEQ ID NO: 10011991 - DNA, 22 bp, Homo sapiens
ggtgctgatagtaacaataata

SEQ ID NO: 10011992 - DNA, 22 bp, Homo sapiens
ggtgctgatattgttttggtga

SEQ ID NO: 10011993 - DNA, 20 bp, Homo sapiens
ggtgctgataagaaagaagt

SEQ ID NO: 10011994 - DNA, 22 bp, Homo sapiens
ggtgctgagtgagctagaggct

SEQ ID NO: 10011995 - DNA, 22 bp, Homo sapiens
ggtgctgagtgagctagaggct

SEQ ID NO: 10011996 - DNA, 22 bp, Homo sapiens
cagcacagtgaccagacccact

SEQ ID NO: 10011997 - DNA, 22 bp, Homo sapiens
cagcacagtgaccagacccact

SEQ ID NO: 10011998 - DNA, 22 bp, Homo sapiens
cagcacagtgcagatgctgact

SEQ ID NO: 10011999 - DNA, 22 bp, Homo sapiens
cagcacagtttcccccatgagc

SEQ ID NO: 10012000 - DNA, 22 bp, Homo sapiens
cagcacatttactcagccctca

SEQ ID NO: 10012001 - DNA, 22 bp, Homo sapiens
cagcacatctgattatatgact

SEQ ID NO: 10012002 - DNA, 22 bp, Homo sapiens
cagcacataagccgaagactgt

SEQ ID NO: 10012003 - DNA, 22 bp, Homo sapiens
cagcacataagccgaagactgt

SEQ ID NO: 10012004 - DNA, 22 bp, Homo sapiens
ggtctggaataaggtccaggaa

SEQ ID NO: 10012005 - DNA, 22 bp, Homo sapiens
ggtctggaataaggtccaggaa

SEQ ID NO: 10012006 - DNA, 22 bp, Homo sapiens
ggtgacagtggttaaaatttgt

SEQ ID NO: 10012007 - DNA, 22 bp, Homo sapiens
ggtgacctcacctggtcccacc

SEQ ID NO: 10012008 - DNA, 22 bp, Homo sapiens
ggtctgaggctccaaggaggtg

SEQ ID NO: 10012009 - DNA, 22 bp, Homo sapiens
ggtctgagtagagggctggcga

SEQ ID NO: 10012010 - DNA, 22 bp, Homo sapiens
ggtctgaggctccaaggaggtg

SEQ ID NO: 10012011 - DNA, 22 bp, Homo sapiens
ggtctgagcttgagcccatgct

SEQ ID NO: 10012012 - DNA, 22 bp, Homo sapiens
ggtctgagcttgagcccatgct

SEQ ID NO: 10012013 - DNA, 18 bp, Homo sapiens
ggtctgagatcgtttttc

SEQ ID NO: 10012014 - DNA, 22 bp, Homo sapiens
ggtctgagatatttgttcagct

SEQ ID NO: 10012015 - DNA, 22 bp, Homo sapiens
ggtctgagtgccagggagagaa

SEQ ID NO: 10012016 - DNA, 22 bp, Homo sapiens
ggtctgcccactactctccatt

SEQ ID NO: 10012017 - DNA, 22 bp, Homo sapiens
cagcaagattaagggcagaaaa

SEQ ID NO: 10012018 - DNA, 22 bp, Homo sapiens
cagcaagatttttaaagcaagg

SEQ ID NO: 10012019 - DNA, 22 bp, Homo sapiens
cagcaagatttttaaagcaagg

SEQ ID NO: 10012020 - DNA, 21 bp, Homo sapiens
cagcaaggaagtcgagtaggt

SEQ ID NO: 10012021 - DNA, 22 bp, Homo sapiens
cagcaagagggtaaggttgaag

SEQ ID NO: 10012022 - DNA, 22 bp, Homo sapiens
cagcaagagaggcagggcaaat

SEQ ID NO: 10012023 - DNA, 22 bp, Homo sapiens
cagcaagagaggcagggcaaat

SEQ ID NO: 10012024 - DNA, 22 bp, Homo sapiens
cagcaagagttggggttgttgg

SEQ ID NO: 10012025 - DNA, 22 bp, Homo sapiens
cagcaagatggtgaatgagacg

SEQ ID NO: 10012026 - DNA, 22 bp, Homo sapiens
cagcaagagttggggttgttgg

SEQ ID NO: 10012027 - DNA, 22 bp, Homo sapiens
cagcaagagggtaaggttgaag

SEQ ID NO: 10012028 - DNA, 22 bp, Homo sapiens
cagcaagagttggggttgttgg

SEQ ID NO: 10012029 - DNA, 22 bp, Homo sapiens
cagcaagacttcagggcttggt

SEQ ID NO: 10012030 - DNA, 22 bp, Homo sapiens
cagcaagacttcagggcttggt

SEQ ID NO: 10012031 - DNA, 22 bp, Homo sapiens
cagcaagagactgttctctaag

SEQ ID NO: 10012032 - DNA, 22 bp, Homo sapiens
ggtgagactttagaagagccag

SEQ ID NO: 10012033 - DNA, 17 bp, Homo sapiens
ggtgagacctcccactc

SEQ ID NO: 10012034 - DNA, 22 bp, Homo sapiens
ggtgacggggcccaggtttcct

SEQ ID NO: 10012035 - DNA, 22 bp, Homo sapiens
ggtgacgaatccatagcatcga

SEQ ID NO: 10012036 - DNA, 22 bp, Homo sapiens
ggtgacgaatccatagcatcga

SEQ ID NO: 10012037 - DNA, 22 bp, Homo sapiens
cagcaagacaggattcccgtgg

SEQ ID NO: 10012038 - DNA, 22 bp, Homo sapiens
cagcaagacagtttcctaagtg

SEQ ID NO: 10012039 - DNA, 21 bp, Homo sapiens
cagcaagacatgtttatcaag

SEQ ID NO: 10012040 - DNA, 21 bp, Homo sapiens
cagcaagacatgtttatcaag

SEQ ID NO: 10012041 - DNA, 22 bp, Homo sapiens
cagcaagacagtttcctaagtg

SEQ ID NO: 10012042 - DNA, 22 bp, Homo sapiens
cagcaagacaaggaacaaactg

SEQ ID NO: 10012043 - DNA, 22 bp, Homo sapiens
ggtcacaggggagaagagtgat

SEQ ID NO: 10012044 - DNA, 22 bp, Homo sapiens
ggtcagggttccaggtatcttc

SEQ ID NO: 10012045 - DNA, 22 bp, Homo sapiens
ggtcacagggaagggctctcaa

SEQ ID NO: 10012046 - DNA, 22 bp, Homo sapiens
ggtcaggtagctctgacaggcc

SEQ ID NO: 10012047 - DNA, 22 bp, Homo sapiens
cagaggtagaaggcatgcagtg

SEQ ID NO: 10012048 - DNA, 22 bp, Homo sapiens
ggtcacagggaagggctctcaa

SEQ ID NO: 10012049 - DNA, 23 bp, Homo sapiens
cagagggttccatggagcatggt

SEQ ID NO: 10012050 - DNA, 22 bp, Homo sapiens
ggtcagtctctcccgagtgttg

SEQ ID NO: 10012051 - DNA, 22 bp, Homo sapiens
ggtcagtgacttttttctgtgg

SEQ ID NO: 10012052 - DNA, 22 bp, Homo sapiens
ggtctgagatatttgttcagct

SEQ ID NO: 10012053 - DNA, 19 bp, Homo sapiens
cagagtccttgaccagtcc

SEQ ID NO: 10012054 - DNA, 22 bp, Homo sapiens
cagagtctggactgcaggctcc

SEQ ID NO: 10012055 - DNA, 22 bp, Homo sapiens
cagagtcctgcaccagctccag

SEQ ID NO: 10012056 - DNA, 22 bp, Homo sapiens
cagagtcctggacacagagaca

SEQ ID NO: 10012057 - DNA, 22 bp, Homo sapiens
ggtcatgtgtccaggaggtagc

SEQ ID NO: 10012058 - DNA, 22 bp, Homo sapiens
ggtcatgagggagcagtgcagg

SEQ ID NO: 10012059 - DNA, 22 bp, Homo sapiens
cagagtcagctagtcttgggat

SEQ ID NO: 10012060 - DNA, 22 bp, Homo sapiens
cagagtcatatcagagaatatg

SEQ ID NO: 10012061 - DNA, 22 bp, Homo sapiens
cagagtcatgggccgtcaggca

SEQ ID NO: 10012062 - DNA, 22 bp, Homo sapiens
cagagtcattgacttccaggag

SEQ ID NO: 10012063 - DNA, 22 bp, Homo sapiens
cagagtccaattgctcagagcg

SEQ ID NO: 10012064 - DNA, 22 bp, Homo sapiens
cagagtcccagatgcccctcct

SEQ ID NO: 10012065 - DNA, 22 bp, Homo sapiens
cagagtccccagcggcgcgggc

SEQ ID NO: 10012066 - DNA, 22 bp, Homo sapiens
cagagggtgtgaaggggatgaa

SEQ ID NO: 10012067 - DNA, 23 bp, Homo sapiens
cagagggttccatggagcatggt

SEQ ID NO: 10012068 - DNA, 21 bp, Homo sapiens
cagaggggctagcctggctgc

SEQ ID NO: 10012069 - DNA, 22 bp, Homo sapiens
cagaggggctgacacccttggc

SEQ ID NO: 10012070 - DNA, 21 bp, Homo sapiens
cagaggggctagcctggctgc

SEQ ID NO: 10012071 - DNA, 22 bp, Homo sapiens
cagaggggataacaggtgtaga

SEQ ID NO: 10012072 - DNA, 22 bp, Homo sapiens
cagagggctcggcggccgctcc

SEQ ID NO: 10012073 - DNA, 22 bp, Homo sapiens
cagaggctttgccctggaaacc

SEQ ID NO: 10012074 - DNA, 22 bp, Homo sapiens
cagagggctgtgtaaggatgtt

SEQ ID NO: 10012075 - DNA, 22 bp, Homo sapiens
cagagggcttcaggttcaggat

SEQ ID NO: 10012076 - DNA, 22 bp, Homo sapiens
cagagggctcggcggccgctcc

SEQ ID NO: 10012077 - DNA, 22 bp, Homo sapiens
cagagggctgccctgagttcgt

SEQ ID NO: 10012078 - DNA, 22 bp, Homo sapiens
cagaggcacaagaaagcaaggc

SEQ ID NO: 10012079 - DNA, 22 bp, Homo sapiens
cagaggcacaagaaagcaaggc

SEQ ID NO: 10012080 - DNA, 22 bp, Homo sapiens
cagaggcacaagaaagcaaggc

SEQ ID NO: 10012081 - DNA, 22 bp, Homo sapiens
cagaggcacagcttcttttaat

SEQ ID NO: 10012082 - DNA, 22 bp, Homo sapiens
cagaggcacagtgcgggccact

SEQ ID NO: 10012083 - DNA, 19 bp, Homo sapiens
cagaggcaccaggtataga

SEQ ID NO: 10012084 - DNA, 22 bp, Homo sapiens
ggggagaccatctgaaggtgat

SEQ ID NO: 10012085 - DNA, 22 bp, Homo sapiens
ggggagcaatagttgaggtgtg

SEQ ID NO: 10012086 - DNA, 22 bp, Homo sapiens
ggggagcaatagttgaggtgtg

SEQ ID NO: 10012087 - DNA, 22 bp, Homo sapiens
gtcatgagaaatctttgaaggt

SEQ ID NO: 10012088 - DNA, 22 bp, Homo sapiens
gtcatgaaattctagagcttga

SEQ ID NO: 10012089 - DNA, 22 bp, Homo sapiens
gtcatgtgaaatttggcaggcc

SEQ ID NO: 10012090 - DNA, 22 bp, Homo sapiens
gtcatgtgacccaacctgagcc

SEQ ID NO: 10012091 - DNA, 22 bp, Homo sapiens
gtcatgtgaataagtgtggggt

SEQ ID NO: 10012092 - DNA, 22 bp, Homo sapiens
gtcatcttaaggactgctatag

SEQ ID NO: 10012093 - DNA, 22 bp, Homo sapiens
gtcatattgaagaagactggca

SEQ ID NO: 10012094 - DNA, 22 bp, Homo sapiens
gtcatccaacaagaggctcttg

SEQ ID NO: 10012095 - DNA, 22 bp, Homo sapiens
gtcatccagactttgcctctgc

SEQ ID NO: 10012096 - DNA, 22 bp, Homo sapiens
gtcatatacactgcatgtaatc

SEQ ID NO: 10012097 - DNA, 22 bp, Homo sapiens
gtcatattataaatgttctgtt

SEQ ID NO: 10012098 - DNA, 22 bp, Homo sapiens
gtcataaagacagaaacattcc

SEQ ID NO: 10012099 - DNA, 22 bp, Homo sapiens
gtcatagaggcctatataattt

SEQ ID NO: 10012100 - DNA, 22 bp, Homo sapiens
gtcataatcacagttttatgca

SEQ ID NO: 10012101 - DNA, 22 bp, Homo sapiens
cagcaggctgtggaaatcctgg

SEQ ID NO: 10012102 - DNA, 22 bp, Homo sapiens
cagcaggctgcgattgctcatt

SEQ ID NO: 10012103 - DNA, 22 bp, Homo sapiens
cagcaggctgcgattgctcatt

SEQ ID NO: 10012104 - DNA, 22 bp, Homo sapiens
cagcaggctctgagtggctgcc

SEQ ID NO: 10012105 - DNA, 22 bp, Homo sapiens
gtcccaggcagagtcaggaggg

SEQ ID NO: 10012106 - DNA, 22 bp, Homo sapiens
gtcccaggagttgctgggcctt

SEQ ID NO: 10012107 - DNA, 22 bp, Homo sapiens
cagcagcttttgcattctcatt

SEQ ID NO: 10012108 - DNA, 22 bp, Homo sapiens
cagcagctttgccaagtcagcc

SEQ ID NO: 10012109 - DNA, 20 bp, Homo sapiens
cagcaggaaaagtgcctcag

SEQ ID NO: 10012110 - DNA, 22 bp, Homo sapiens
cagcagcttttgcattctcatt

SEQ ID NO: 10012111 - DNA, 22 bp, Homo sapiens
cagcagcttctgttgatcagaa

SEQ ID NO: 10012112 - DNA, 22 bp, Homo sapiens
cagcagcttctgttgatcagaa

SEQ ID NO: 10012113 - DNA, 22 bp, Homo sapiens
cagcagctttgccaagtcagcc

SEQ ID NO: 10012114 - DNA, 22 bp, Homo sapiens
cagcagctttgccaagtcagcc

SEQ ID NO: 10012115 - DNA, 22 bp, Homo sapiens
cagcagcttctgttgatcagaa

SEQ ID NO: 10012116 - DNA, 22 bp, Homo sapiens
cagcagctggtgagacacagcc

SEQ ID NO: 10012117 - DNA, 22 bp, Homo sapiens
cagcagctggtgagacacagcc

SEQ ID NO: 10012118 - DNA, 22 bp, Homo sapiens
cagcagctggtgagacacagcc

SEQ ID NO: 10012119 - DNA, 22 bp, Homo sapiens
cagcagctggttgaatccttct

SEQ ID NO: 10012120 - DNA, 22 bp, Homo sapiens
cagcagctggttatacctgtgg

SEQ ID NO: 10012121 - DNA, 22 bp, Homo sapiens
cagcagctggttatacctgtgg

SEQ ID NO: 10012122 - DNA, 22 bp, Homo sapiens
cagcagctggttgaatccttct

SEQ ID NO: 10012123 - DNA, 22 bp, Homo sapiens
cagcagctgtttacggaacacc

SEQ ID NO: 10012124 - DNA, 22 bp, Homo sapiens
gtcataaagacagaaacattcc

SEQ ID NO: 10012125 - DNA, 22 bp, Homo sapiens
cagcaggaaacttaaaggtaat

SEQ ID NO: 10012126 - DNA, 20 bp, Homo sapiens
cagcaggaaaagtgcctcag

SEQ ID NO: 10012127 - DNA, 22 bp, Homo sapiens
cagcaggaaggtttcccctgca

SEQ ID NO: 10012128 - DNA, 22 bp, Homo sapiens
cagcagctagaggaagggcaga

SEQ ID NO: 10012129 - DNA, 22 bp, Homo sapiens
cagcagctacttggagcagcag

SEQ ID NO: 10012130 - DNA, 22 bp, Homo sapiens
cagcaccttccttaactccagg

SEQ ID NO: 10012131 - DNA, 22 bp, Homo sapiens
cagcagctgcaaatggaaacag

SEQ ID NO: 10012132 - DNA, 22 bp, Homo sapiens
cagcagctgcctcagctgggga

SEQ ID NO: 10012133 - DNA, 23 bp, Homo sapiens
cagcagctgcctggttttttggt

SEQ ID NO: 10012134 - DNA, 23 bp, Homo sapiens
cagcagctgcctggttttttggt

SEQ ID NO: 10012135 - DNA, 22 bp, Homo sapiens
cagcagctgatggggaagtgat

SEQ ID NO: 10012136 - DNA, 22 bp, Homo sapiens
cagcagctgatggggaagtgat

SEQ ID NO: 10012137 - DNA, 22 bp, Homo sapiens
cagcagctgcgtgcccaggccg

SEQ ID NO: 10012138 - DNA, 22 bp, Homo sapiens
cagcagctgcgtgcccaggccg

SEQ ID NO: 10012139 - DNA, 22 bp, Homo sapiens
cagcagctgcgtgcccaggccg

SEQ ID NO: 10012140 - DNA, 22 bp, Homo sapiens
cagcagctggtgagacacagcc

SEQ ID NO: 10012141 - DNA, 22 bp, Homo sapiens
cagcagctgggaaggaggctga

SEQ ID NO: 10012142 - DNA, 22 bp, Homo sapiens
cagcagctgggaaggaggctga

SEQ ID NO: 10012143 - DNA, 22 bp, Homo sapiens
gtctggagccaccctaagcatt

SEQ ID NO: 10012144 - DNA, 22 bp, Homo sapiens
cagccaggcctggtgaccaaag

SEQ ID NO: 10012145 - DNA, 22 bp, Homo sapiens
cagccaggcccccgagtcgttg

SEQ ID NO: 10012146 - DNA, 22 bp, Homo sapiens
gtctggaaaggtatttgtctca

SEQ ID NO: 10012147 - DNA, 22 bp, Homo sapiens
gtctggacaggactatttctaa

SEQ ID NO: 10012148 - DNA, 22 bp, Homo sapiens
gtctggactgcaaaataaggat

SEQ ID NO: 10012149 - DNA, 22 bp, Homo sapiens
gtccctgggtctaaggcagtaa

SEQ ID NO: 10012150 - DNA, 19 bp, Homo sapiens
gtcccttcactcctgctgg

SEQ ID NO: 10012151 - DNA, 19 bp, Homo sapiens
gtcccttcactcctgctgg

SEQ ID NO: 10012152 - DNA, 22 bp, Homo sapiens
gtcccttcctcattccacttta

SEQ ID NO: 10012153 - DNA, 22 bp, Homo sapiens
gtccctggatctgggacagctg

SEQ ID NO: 10012154 - DNA, 22 bp, Homo sapiens
gtcccaggcttatgtggagctt

SEQ ID NO: 10012155 - DNA, 19 bp, Homo sapiens
gtccctgggcagaggcacc

SEQ ID NO: 10012156 - DNA, 22 bp, Homo sapiens
cagcccctcacagagctgtcct

SEQ ID NO: 10012157 - DNA, 22 bp, Homo sapiens
cagcccctcacagagctgtcct

SEQ ID NO: 10012158 - DNA, 22 bp, Homo sapiens
cagccccatggtgtgctccagc

SEQ ID NO: 10012159 - DNA, 22 bp, Homo sapiens
cagcccgccctgaactttcggg

SEQ ID NO: 10012160 - DNA, 22 bp, Homo sapiens
cagccccatggtgtgctccagc

SEQ ID NO: 10012161 - DNA, 22 bp, Homo sapiens
cagccaggtatgggcgtgcggg

SEQ ID NO: 10012162 - DNA, 22 bp, Homo sapiens
cagccagggagggcaaatgaga

SEQ ID NO: 10012163 - DNA, 22 bp, Homo sapiens
cagccagggtcaggcagcttct

SEQ ID NO: 10012164 - DNA, 22 bp, Homo sapiens
cagccagggtcaggcagcttct

SEQ ID NO: 10012165 - DNA, 22 bp, Homo sapiens
gtctgtgtgcacagcgagtgcc

SEQ ID NO: 10012166 - DNA, 18 bp, Homo sapiens
gtctgtgtggcttgggga

SEQ ID NO: 10012167 - DNA, 22 bp, Homo sapiens
gtctgtgtgcacagagctttgg

SEQ ID NO: 10012168 - DNA, 19 bp, Homo sapiens
gtctgtgtatttgttgctg

SEQ ID NO: 10012169 - DNA, 22 bp, Homo sapiens
gtctgtgcttattcagcagggg

SEQ ID NO: 10012170 - DNA, 22 bp, Homo sapiens
gtctgtctctctccagagtgca

SEQ ID NO: 10012171 - DNA, 22 bp, Homo sapiens
gtctgtcatctgagatggagtg

SEQ ID NO: 10012172 - DNA, 22 bp, Homo sapiens
gtctgtccacttggaagctccc

SEQ ID NO: 10012173 - DNA, 22 bp, Homo sapiens
gtctgtatcagaggagtgaatg

SEQ ID NO: 10012174 - DNA, 22 bp, Homo sapiens
gtctgtcccaatagccaacagg

SEQ ID NO: 10012175 - DNA, 22 bp, Homo sapiens
gtctgtccatcagcaaaggctt

SEQ ID NO: 10012176 - DNA, 22 bp, Homo sapiens
gtctgtccatcagcaaaggctt

SEQ ID NO: 10012177 - DNA, 22 bp, Homo sapiens
gtctgtcctgtacccagcatct

SEQ ID NO: 10012178 - DNA, 22 bp, Homo sapiens
gtctgtccttttcatctcccaa

SEQ ID NO: 10012179 - DNA, 22 bp, Homo sapiens
gtctgtacccacgtcctgctag

SEQ ID NO: 10012180 - DNA, 20 bp, Homo sapiens
gtgcccagttggtgacagac

SEQ ID NO: 10012181 - DNA, 22 bp, Homo sapiens
gtgcccagttgaggccaggact

SEQ ID NO: 10012182 - DNA, 22 bp, Homo sapiens
gtgcccagttgaggccaggact

SEQ ID NO: 10012183 - DNA, 22 bp, Homo sapiens
gtgcccagttgaggccaggact

SEQ ID NO: 10012184 - DNA, 22 bp, Homo sapiens
gtgcccagtgcaggcccgcagg

SEQ ID NO: 10012185 - DNA, 22 bp, Homo sapiens
gtgcccagtgcaggcccgcagg

SEQ ID NO: 10012186 - DNA, 23 bp, Homo sapiens
gtgctgtgagccccttggcctcc

SEQ ID NO: 10012187 - DNA, 22 bp, Homo sapiens
gtgctgtgcgctttttctgtat

SEQ ID NO: 10012188 - DNA, 22 bp, Homo sapiens
gtgctgagtagaatgaatgcct

SEQ ID NO: 10012189 - DNA, 22 bp, Homo sapiens
gtgctgtgtctatcaggaataa

SEQ ID NO: 10012190 - DNA, 22 bp, Homo sapiens
gtgctgtgtgatccatgctggc

SEQ ID NO: 10012191 - DNA, 22 bp, Homo sapiens
gtgctgtgtgatccatgctggc

SEQ ID NO: 10012192 - DNA, 18 bp, Homo sapiens
gtgctgtgggcagtggcc

SEQ ID NO: 10012193 - DNA, 22 bp, Homo sapiens
gtgctgtgcgctttttctgtat

SEQ ID NO: 10012194 - DNA, 18 bp, Homo sapiens
gtgctgtgggcagtggcc

SEQ ID NO: 10012195 - DNA, 22 bp, Homo sapiens
cagccctgctcttagtgtctcc

SEQ ID NO: 10012196 - DNA, 22 bp, Homo sapiens
cagccctgcttccccgctagtt

SEQ ID NO: 10012197 - DNA, 22 bp, Homo sapiens
cagccctgcggaggtgtatact

SEQ ID NO: 10012198 - DNA, 22 bp, Homo sapiens
cagccctgcagccatggcctgt

SEQ ID NO: 10012199 - DNA, 22 bp, Homo sapiens
cagccctggcccaggtgcctta

SEQ ID NO: 10012200 - DNA, 20 bp, Homo sapiens
cagcctccactcactcagct

SEQ ID NO: 10012201 - DNA, 20 bp, Homo sapiens
cagcctccactcactcagct

SEQ ID NO: 10012202 - DNA, 22 bp, Homo sapiens
cagccctggaacagctgactca

SEQ ID NO: 10012203 - DNA, 22 bp, Homo sapiens
cagcctgacaccagctttgggc

SEQ ID NO: 10012204 - DNA, 22 bp, Homo sapiens
cagcctgccgtcagccaggtag

SEQ ID NO: 10012205 - DNA, 22 bp, Homo sapiens
cagcctgccctggaagcccagc

SEQ ID NO: 10012206 - DNA, 20 bp, Homo sapiens
cagcctgcatcatctgcagc

SEQ ID NO: 10012207 - DNA, 22 bp, Homo sapiens
cagcctgcagggctgcctgttg

SEQ ID NO: 10012208 - DNA, 22 bp, Homo sapiens
cagcctgcagggctgcctgttg

SEQ ID NO: 10012209 - DNA, 16 bp, Homo sapiens
cagcctgcagtggtca

SEQ ID NO: 10012210 - DNA, 22 bp, Homo sapiens
cagcctggcctgggactgctga

SEQ ID NO: 10012211 - DNA, 22 bp, Homo sapiens
cagcctgggctccagagtccct

SEQ ID NO: 10012212 - DNA, 22 bp, Homo sapiens
cagcctgtggcagaggtctaat

SEQ ID NO: 10012213 - DNA, 22 bp, Homo sapiens
cagcctggagccacagcccagg

SEQ ID NO: 10012214 - DNA, 21 bp, Homo sapiens
cagcctgctgctccagggcca

SEQ ID NO: 10012215 - DNA, 22 bp, Homo sapiens
cagcctgctagggcaatgcctt

SEQ ID NO: 10012216 - DNA, 22 bp, Homo sapiens
cagcctgctctcagatgttgag

SEQ ID NO: 10012217 - DNA, 22 bp, Homo sapiens
gtgcccagtcctgccttgacag

SEQ ID NO: 10012218 - DNA, 22 bp, Homo sapiens
cagctatagatggactgaagag

SEQ ID NO: 10012219 - DNA, 22 bp, Homo sapiens
cagctagggagtggcagagctt

SEQ ID NO: 10012220 - DNA, 22 bp, Homo sapiens
cagctactcctcccatgacttc

SEQ ID NO: 10012221 - DNA, 22 bp, Homo sapiens
cagctaccatggtttgttccag

SEQ ID NO: 10012222 - DNA, 22 bp, Homo sapiens
cagctacagttccactgagcat

SEQ ID NO: 10012223 - DNA, 22 bp, Homo sapiens
cagctacagaggccacatggct

SEQ ID NO: 10012224 - DNA, 22 bp, Homo sapiens
cagctacaaatacttttgtatg

SEQ ID NO: 10012225 - DNA, 22 bp, Homo sapiens
cagctaaggctccttctaggta

SEQ ID NO: 10012226 - DNA, 22 bp, Homo sapiens
ggaaggggccttgagcaaactg

SEQ ID NO: 10012227 - DNA, 22 bp, Homo sapiens
cacagaactggttaatagcaga

SEQ ID NO: 10012228 - DNA, 22 bp, Homo sapiens
cacagaactggttaatagcaga

SEQ ID NO: 10012229 - DNA, 22 bp, Homo sapiens
cacagaagaatcatgctgtgtt

SEQ ID NO: 10012230 - DNA, 22 bp, Homo sapiens
cacagaataattcacatggctc

SEQ ID NO: 10012231 - DNA, 22 bp, Homo sapiens
cacagaagtttcatagtctcga

SEQ ID NO: 10012232 - DNA, 21 bp, Homo sapiens
cacagaatatacattttagtt

SEQ ID NO: 10012233 - DNA, 22 bp, Homo sapiens
ggaaggggagctggaaagggta

SEQ ID NO: 10012234 - DNA, 22 bp, Homo sapiens
ggaaggggagctggaaagggta

SEQ ID NO: 10012235 - DNA, 21 bp, Homo sapiens
cacacagctgcccttaggtag

SEQ ID NO: 10012236 - DNA, 22 bp, Homo sapiens
cacacagctcaggggcactgcc

SEQ ID NO: 10012237 - DNA, 22 bp, Homo sapiens
cacacagctcaggggcactgcc

SEQ ID NO: 10012238 - DNA, 18 bp, Homo sapiens
caatgttttagatctcta

SEQ ID NO: 10012239 - DNA, 22 bp, Homo sapiens
caatgtttgtgatctactgact

SEQ ID NO: 10012240 - DNA, 22 bp, Homo sapiens
caatgtttgttagagctctaga

SEQ ID NO: 10012241 - DNA, 22 bp, Homo sapiens
caatgtttgttagagctctaga

SEQ ID NO: 10012242 - DNA, 22 bp, Homo sapiens
cacaatttgttttatcagtatt

SEQ ID NO: 10012243 - DNA, 22 bp, Homo sapiens
cacacagacagctctctgaaga

SEQ ID NO: 10012244 - DNA, 22 bp, Homo sapiens
cacacagacagctctctgaaga

SEQ ID NO: 10012245 - DNA, 22 bp, Homo sapiens
cacacagacagctctctgaaga

SEQ ID NO: 10012246 - DNA, 22 bp, Homo sapiens
cacacagatggtaagggaggga

SEQ ID NO: 10012247 - DNA, 22 bp, Homo sapiens
cacacagatggtaagggaggga

SEQ ID NO: 10012248 - DNA, 22 bp, Homo sapiens
cacagaggatttttagggcagt

SEQ ID NO: 10012249 - DNA, 22 bp, Homo sapiens
cacagaggatttttagggcagt

SEQ ID NO: 10012250 - DNA, 22 bp, Homo sapiens
cacagagagctacgtgcagcgt

SEQ ID NO: 10012251 - DNA, 22 bp, Homo sapiens
cacagaggactgtagcggggag

SEQ ID NO: 10012252 - DNA, 22 bp, Homo sapiens
cacagaggaaaggcagttggta

SEQ ID NO: 10012253 - DNA, 22 bp, Homo sapiens
cacagaggaaatgactttctta

SEQ ID NO: 10012254 - DNA, 22 bp, Homo sapiens
cacagaggaaatgactttctta

SEQ ID NO: 10012255 - DNA, 22 bp, Homo sapiens
ggactgggattctggatctgct

SEQ ID NO: 10012256 - DNA, 22 bp, Homo sapiens
ggactgggattctggatctgct

SEQ ID NO: 10012257 - DNA, 22 bp, Homo sapiens
ggactgggattctggatctgct

SEQ ID NO: 10012258 - DNA, 22 bp, Homo sapiens
ggactgggcatgggtgctctgc

SEQ ID NO: 10012259 - DNA, 22 bp, Homo sapiens
ggactgggcatgggtgctctgc

SEQ ID NO: 10012260 - DNA, 22 bp, Homo sapiens
ggactgggtaggagcccagggc

SEQ ID NO: 10012261 - DNA, 22 bp, Homo sapiens
ggactgggccaggggttggact

SEQ ID NO: 10012262 - DNA, 17 bp, Homo sapiens
ggactgggcggggcagg

SEQ ID NO: 10012263 - DNA, 22 bp, Homo sapiens
cacagaattttctctttacaat

SEQ ID NO: 10012264 - DNA, 22 bp, Homo sapiens
cacagacccagaagggatgaag

SEQ ID NO: 10012265 - DNA, 22 bp, Homo sapiens
cacagaatggaccagttttaga

SEQ ID NO: 10012266 - DNA, 22 bp, Homo sapiens
ggactgggagaatggaggcaag

SEQ ID NO: 10012267 - DNA, 22 bp, Homo sapiens
cacagagaaaatgttggtgctt

SEQ ID NO: 10012268 - DNA, 23 bp, Homo sapiens
ggagctgctgttgggggagctgc

SEQ ID NO: 10012269 - DNA, 22 bp, Homo sapiens
ggagctgcttcttgctgtgggt

SEQ ID NO: 10012270 - DNA, 22 bp, Homo sapiens
ggagctgctttgatctgaagaa

SEQ ID NO: 10012271 - DNA, 22 bp, Homo sapiens
ggagctgctttgatctgaagaa

SEQ ID NO: 10012272 - DNA, 22 bp, Homo sapiens
ggagctggagagtacagagttt

SEQ ID NO: 10012273 - DNA, 22 bp, Homo sapiens
ggagcctgacagtgcccagcat

SEQ ID NO: 10012274 - DNA, 22 bp, Homo sapiens
ggagcctgcgggagctcccatt

SEQ ID NO: 10012275 - DNA, 22 bp, Homo sapiens
ggagctgctccttcagccaagt

SEQ ID NO: 10012276 - DNA, 22 bp, Homo sapiens
ggagctgctcagagccagtccc

SEQ ID NO: 10012277 - DNA, 22 bp, Homo sapiens
cacagaggctcaaagccaggtg

SEQ ID NO: 10012278 - DNA, 22 bp, Homo sapiens
cacagagtggaggcttggcctg

SEQ ID NO: 10012279 - DNA, 22 bp, Homo sapiens
cacagaggtgatagtggtcaag

SEQ ID NO: 10012280 - DNA, 22 bp, Homo sapiens
cacagataaggatgttaatttt

SEQ ID NO: 10012281 - DNA, 19 bp, Homo sapiens
cacagatgattgacacata

SEQ ID NO: 10012282 - DNA, 22 bp, Homo sapiens
ggagcaggcagggccgtgtctg

SEQ ID NO: 10012283 - DNA, 22 bp, Homo sapiens
ggagccctgccctaggcagctc

SEQ ID NO: 10012284 - DNA, 22 bp, Homo sapiens
cacagattatgagacgagatac

SEQ ID NO: 10012285 - DNA, 22 bp, Homo sapiens
cacagatttcctaagcatcaat

SEQ ID NO: 10012286 - DNA, 22 bp, Homo sapiens
cacagatttctggtcttcaccc

SEQ ID NO: 10012287 - DNA, 22 bp, Homo sapiens
cacagatttctggtcttcaccc

SEQ ID NO: 10012288 - DNA, 22 bp, Homo sapiens
cacagcttgtttagtgactcac

SEQ ID NO: 10012289 - DNA, 22 bp, Homo sapiens
cacagcttgtttagtgactcac

SEQ ID NO: 10012290 - DNA, 22 bp, Homo sapiens
cacaggaatcagcattaatggc

SEQ ID NO: 10012291 - DNA, 22 bp, Homo sapiens
cacaggaatataagtttgagtt

SEQ ID NO: 10012292 - DNA, 22 bp, Homo sapiens
cacaggaagtggtcagtgccag

SEQ ID NO: 10012293 - DNA, 22 bp, Homo sapiens
cacaggaataagtcaaacttca

SEQ ID NO: 10012294 - DNA, 22 bp, Homo sapiens
cacaggaatctgcattttgacc

SEQ ID NO: 10012295 - DNA, 22 bp, Homo sapiens
cacaggaatgaacagggaaaga

SEQ ID NO: 10012296 - DNA, 22 bp, Homo sapiens
cacaggaatgaacagggaaaga

SEQ ID NO: 10012297 - DNA, 22 bp, Homo sapiens
cacaggaattagcagcctaaaa

SEQ ID NO: 10012298 - DNA, 22 bp, Homo sapiens
cacaggaccaattcacattcca

SEQ ID NO: 10012299 - DNA, 22 bp, Homo sapiens
ggaggcagaatagagtgtgggt

SEQ ID NO: 10012300 - DNA, 22 bp, Homo sapiens
ggaggcaggaaagacaggttca

SEQ ID NO: 10012301 - DNA, 22 bp, Homo sapiens
cacaggcttttctgacataggc

SEQ ID NO: 10012302 - DNA, 22 bp, Homo sapiens
cacaggcttgtcagcatgaggc

SEQ ID NO: 10012303 - DNA, 21 bp, Homo sapiens
cacaggcttctatacacaatg

SEQ ID NO: 10012304 - DNA, 22 bp, Homo sapiens
cacaggcttgtcagcatgaggc

SEQ ID NO: 10012305 - DNA, 22 bp, Homo sapiens
cacaggcttgtcagcatgaggc

SEQ ID NO: 10012306 - DNA, 23 bp, Homo sapiens
cacaggctgcgcataagcttctc

SEQ ID NO: 10012307 - DNA, 21 bp, Homo sapiens
cacaggcttctatacacaatg

SEQ ID NO: 10012308 - DNA, 22 bp, Homo sapiens
ggaggccaaagtgtgggcggct

SEQ ID NO: 10012309 - DNA, 22 bp, Homo sapiens
ggaggcaggaaagacaggttca

SEQ ID NO: 10012310 - DNA, 20 bp, Homo sapiens
cacaggccttgtgagcagac

SEQ ID NO: 10012311 - DNA, 22 bp, Homo sapiens
ggaggccaaggcaggcggatca

SEQ ID NO: 10012312 - DNA, 22 bp, Homo sapiens
ggaggccaaggaggagcttgcc

SEQ ID NO: 10012313 - DNA, 22 bp, Homo sapiens
ggaggccaaggaggagcttgcc

SEQ ID NO: 10012314 - DNA, 22 bp, Homo sapiens
ggaggccaaggagggcggatca

SEQ ID NO: 10012315 - DNA, 22 bp, Homo sapiens
caagtcaaagactagaactagt

SEQ ID NO: 10012316 - DNA, 22 bp, Homo sapiens
caagtattttaaggactagtgg

SEQ ID NO: 10012317 - DNA, 22 bp, Homo sapiens
gctgtggcctggcgcagagctg

SEQ ID NO: 10012318 - DNA, 22 bp, Homo sapiens
gctgtggcctggcgcagagctg

SEQ ID NO: 10012319 - DNA, 22 bp, Homo sapiens
gctgttcattagaaatagaatg

SEQ ID NO: 10012320 - DNA, 22 bp, Homo sapiens
gctgttcctgcttagaggtcgg

SEQ ID NO: 10012321 - DNA, 22 bp, Homo sapiens
gctgttcccatgtggggctcag

SEQ ID NO: 10012322 - DNA, 22 bp, Homo sapiens
gctgttattttacaagacttat

SEQ ID NO: 10012323 - DNA, 22 bp, Homo sapiens
caagtttacaatgtgtatgtgt

SEQ ID NO: 10012324 - DNA, 22 bp, Homo sapiens
caagtttacaatgtgtatgtgt

SEQ ID NO: 10012325 - DNA, 22 bp, Homo sapiens
caagtttaaggcactgataagt

SEQ ID NO: 10012326 - DNA, 22 bp, Homo sapiens
gctgttctttgcatctctggtg

SEQ ID NO: 10012327 - DNA, 22 bp, Homo sapiens
gctgttctttggtcaaaggtat

SEQ ID NO: 10012328 - DNA, 22 bp, Homo sapiens
gctgttctttgcatctctggtg

SEQ ID NO: 10012329 - DNA, 22 bp, Homo sapiens
gctgttctttcagcccagggct

SEQ ID NO: 10012330 - DNA, 21 bp, Homo sapiens
gctgttctttcagctggtctt

SEQ ID NO: 10012331 - DNA, 18 bp, Homo sapiens
gctgttcttcgcactggc

SEQ ID NO: 10012332 - DNA, 22 bp, Homo sapiens
gctgttctagcttcagtttcgc

SEQ ID NO: 10012333 - DNA, 22 bp, Homo sapiens
gctgttctaggagctgtgagca

SEQ ID NO: 10012334 - DNA, 22 bp, Homo sapiens
gctgttctccgatgaccccgtg

SEQ ID NO: 10012335 - DNA, 19 bp, Homo sapiens
gctgttctgaccatcaccc

SEQ ID NO: 10012336 - DNA, 20 bp, Homo sapiens
gctgttctgaagcagaaggc

SEQ ID NO: 10012337 - DNA, 22 bp, Homo sapiens
gctgttctctgtaacatgcatt

SEQ ID NO: 10012338 - DNA, 22 bp, Homo sapiens
gctgttctgcgtcccaggctgg

SEQ ID NO: 10012339 - DNA, 22 bp, Homo sapiens
gctgttctgtccccatgggtaa

SEQ ID NO: 10012340 - DNA, 22 bp, Homo sapiens
gctgttctgcgtcccaggctgg

SEQ ID NO: 10012341 - DNA, 22 bp, Homo sapiens
gctgttctgcaccagacttcag

SEQ ID NO: 10012342 - DNA, 22 bp, Homo sapiens
caaggtcccagcccctcttggc

SEQ ID NO: 10012343 - DNA, 22 bp, Homo sapiens
caaggtgccatgctgggcgggg

SEQ ID NO: 10012344 - DNA, 22 bp, Homo sapiens
caaggtgccatgctgggcgggg

SEQ ID NO: 10012345 - DNA, 22 bp, Homo sapiens
caaggtttacattgggctatca

SEQ ID NO: 10012346 - DNA, 22 bp, Homo sapiens
caaggtttgaaaacgccatggc

SEQ ID NO: 10012347 - DNA, 22 bp, Homo sapiens
caaggttttgcttgtaagggaa

SEQ ID NO: 10012348 - DNA, 22 bp, Homo sapiens
caaggttttggaagattttcgt

SEQ ID NO: 10012349 - DNA, 22 bp, Homo sapiens
caaggtttcgagttcccaacca

SEQ ID NO: 10012350 - DNA, 22 bp, Homo sapiens
caaggtttctatgctcaaagga

SEQ ID NO: 10012351 - DNA, 22 bp, Homo sapiens
caaggtttactttatgatccag

SEQ ID NO: 10012352 - DNA, 22 bp, Homo sapiens
caaggttctatagcaaaatctg

SEQ ID NO: 10012353 - DNA, 22 bp, Homo sapiens
caagtatatttgaacatgtaaa

SEQ ID NO: 10012354 - DNA, 22 bp, Homo sapiens
caagtatttcctgatggcctgt

SEQ ID NO: 10012355 - DNA, 22 bp, Homo sapiens
caagtaacttgattaaggtaag

SEQ ID NO: 10012356 - DNA, 22 bp, Homo sapiens
caagtaaagaatcacatttctt

SEQ ID NO: 10012357 - DNA, 22 bp, Homo sapiens
caagtacaaaatgatatttagt

SEQ ID NO: 10012358 - DNA, 22 bp, Homo sapiens
caatgtcaaggagaccaaaacg

SEQ ID NO: 10012359 - DNA, 22 bp, Homo sapiens
caatgtcatgattttccattag

SEQ ID NO: 10012360 - DNA, 22 bp, Homo sapiens
caatgtttactggggacccaga

SEQ ID NO: 10012361 - DNA, 22 bp, Homo sapiens
caatgtttgagtaggagcataa

SEQ ID NO: 10012362 - DNA, 22 bp, Homo sapiens
caatgtttgagtaggagcataa

SEQ ID NO: 10012363 - DNA, 22 bp, Homo sapiens
caatgtttcttgtaaccagtga

SEQ ID NO: 10012364 - DNA, 22 bp, Homo sapiens
caatgtgtttgcatattaaaat

SEQ ID NO: 10012365 - DNA, 18 bp, Homo sapiens
gctttctgtagaaaaggg

SEQ ID NO: 10012366 - DNA, 18 bp, Homo sapiens
gctttctgtagaaaaggg

SEQ ID NO: 10012367 - DNA, 22 bp, Homo sapiens
gctttctgtaggtagttactgt

SEQ ID NO: 10012368 - DNA, 22 bp, Homo sapiens
gctttctgtggtgatgtaaagg

SEQ ID NO: 10012369 - DNA, 21 bp, Homo sapiens
gctttctgtggactctgcacc

SEQ ID NO: 10012370 - DNA, 21 bp, Homo sapiens
gctttctgtggactctgcacc

SEQ ID NO: 10012371 - DNA, 22 bp, Homo sapiens
gctttctgtgcagtgaacacta

SEQ ID NO: 10012372 - DNA, 22 bp, Homo sapiens
gctttctgggctatagaacggg

SEQ ID NO: 10012373 - DNA, 22 bp, Homo sapiens
gctttctggttctcaaagcact

SEQ ID NO: 10012374 - DNA, 22 bp, Homo sapiens
gctttctgggctatagaacggg

SEQ ID NO: 10012375 - DNA, 22 bp, Homo sapiens
gctttctgcctgggctccattt

SEQ ID NO: 10012376 - DNA, 22 bp, Homo sapiens
gctttctgctctgtaaaatggg

SEQ ID NO: 10012377 - DNA, 22 bp, Homo sapiens
gcttgggcttaactgtaggttc

SEQ ID NO: 10012378 - DNA, 22 bp, Homo sapiens
gcttggggagctcagtgtcctt

SEQ ID NO: 10012379 - DNA, 17 bp, Homo sapiens
gcttgggctgcctgttg

SEQ ID NO: 10012380 - DNA, 22 bp, Homo sapiens
caagtttgctgatccttgtttt

SEQ ID NO: 10012381 - DNA, 22 bp, Homo sapiens
caagtttggattatgaaaaagt

SEQ ID NO: 10012382 - DNA, 22 bp, Homo sapiens
caagtttagtcatggtggtagt

SEQ ID NO: 10012383 - DNA, 22 bp, Homo sapiens
caagtttactactacctgtgtg

SEQ ID NO: 10012384 - DNA, 22 bp, Homo sapiens
caagttttgattttgcagtaaa

SEQ ID NO: 10012385 - DNA, 22 bp, Homo sapiens
caagttttagaaatatctggat

SEQ ID NO: 10012386 - DNA, 22 bp, Homo sapiens
caagttttgcatagttctgtat

SEQ ID NO: 10012387 - DNA, 21 bp, Homo sapiens
caataaactgcacattgagac

SEQ ID NO: 10012388 - DNA, 22 bp, Homo sapiens
gctggctgggtccctgagaggc

SEQ ID NO: 10012389 - DNA, 22 bp, Homo sapiens
gctggctgggtccctgagaggc

SEQ ID NO: 10012390 - DNA, 22 bp, Homo sapiens
gctggctggctgtgcaaaggca

SEQ ID NO: 10012391 - DNA, 22 bp, Homo sapiens
caaggccttcgtctcctagctt

SEQ ID NO: 10012392 - DNA, 21 bp, Homo sapiens
gctggctgtcccagggaagca

SEQ ID NO: 10012393 - DNA, 22 bp, Homo sapiens
caaggcttatcagccaggagcc

SEQ ID NO: 10012394 - DNA, 22 bp, Homo sapiens
caaggcttcagtgtgacaaaac

SEQ ID NO: 10012395 - DNA, 22 bp, Homo sapiens
caagggaagaggacagggacct

SEQ ID NO: 10012396 - DNA, 22 bp, Homo sapiens
caagggtgaaggctcctccagg

SEQ ID NO: 10012397 - DNA, 22 bp, Homo sapiens
caaggccacgttctgcatgcgg

SEQ ID NO: 10012398 - DNA, 22 bp, Homo sapiens
caaggcagctgtagggatttgg

SEQ ID NO: 10012399 - DNA, 22 bp, Homo sapiens
gctggaggctggagtgcagtgg

SEQ ID NO: 10012400 - DNA, 22 bp, Homo sapiens
caaggccagttcaccaagggca

SEQ ID NO: 10012401 - DNA, 22 bp, Homo sapiens
caaggccagttcaccaagggca

SEQ ID NO: 10012402 - DNA, 22 bp, Homo sapiens
caaggccactgctcaggtttcc

SEQ ID NO: 10012403 - DNA, 22 bp, Homo sapiens
caaggccagagccagcgataag

SEQ ID NO: 10012404 - DNA, 22 bp, Homo sapiens
caaggccatgagcagcgagtgt

SEQ ID NO: 10012405 - DNA, 22 bp, Homo sapiens
caaggccctgcaacctgacttg

SEQ ID NO: 10012406 - DNA, 22 bp, Homo sapiens
caaggcctaatcatactgctaa

SEQ ID NO: 10012407 - DNA, 22 bp, Homo sapiens
caaggcctgcctctggcagaaa

SEQ ID NO: 10012408 - DNA, 22 bp, Homo sapiens
caaggcctgcctctggcagaaa

SEQ ID NO: 10012409 - DNA, 22 bp, Homo sapiens
caaggcctcctgggcccagaga

SEQ ID NO: 10012410 - DNA, 22 bp, Homo sapiens
caagcagggagcatcaagggag

SEQ ID NO: 10012411 - DNA, 22 bp, Homo sapiens
caagccaggaaggatccagcac

SEQ ID NO: 10012412 - DNA, 22 bp, Homo sapiens
caagccagcagtttaatgactc

SEQ ID NO: 10012413 - DNA, 22 bp, Homo sapiens
caagccaggtgaacataacaag

SEQ ID NO: 10012414 - DNA, 22 bp, Homo sapiens
caagccaggtgaacataacaag

SEQ ID NO: 10012415 - DNA, 22 bp, Homo sapiens
caagccagtcagctcagtagat

SEQ ID NO: 10012416 - DNA, 22 bp, Homo sapiens
caagccagtcagctcagtagat

SEQ ID NO: 10012417 - DNA, 22 bp, Homo sapiens
gctggaggatggactggaagaa

SEQ ID NO: 10012418 - DNA, 22 bp, Homo sapiens
gctggaggaggaagtgtgaggg

SEQ ID NO: 10012419 - DNA, 22 bp, Homo sapiens
caagccagtgatgtttgctgcc

SEQ ID NO: 10012420 - DNA, 22 bp, Homo sapiens
caaatgtatgttttcctatgta

SEQ ID NO: 10012421 - DNA, 22 bp, Homo sapiens
caaatgtattctcacttcaggg

SEQ ID NO: 10012422 - DNA, 22 bp, Homo sapiens
caaatgtattctcacttcaggg

SEQ ID NO: 10012423 - DNA, 22 bp, Homo sapiens
caagatttaagagtcagccttg

SEQ ID NO: 10012424 - DNA, 22 bp, Homo sapiens
caagcagggatactgcagggag

SEQ ID NO: 10012425 - DNA, 22 bp, Homo sapiens
caagcaggaggagaagtttctg

SEQ ID NO: 10012426 - DNA, 22 bp, Homo sapiens
caaatgtaattgcggtttttgc

SEQ ID NO: 10012427 - DNA, 22 bp, Homo sapiens
caaatgtaattgcggtttttgc

SEQ ID NO: 10012428 - DNA, 22 bp, Homo sapiens
caaatgtaatggcaggttttgc

SEQ ID NO: 10012429 - DNA, 22 bp, Homo sapiens
caaatgtaatggcaggttttgc

SEQ ID NO: 10012430 - DNA, 23 bp, Homo sapiens
caaatgtagtgtgtccacccctg

SEQ ID NO: 10012431 - DNA, 22 bp, Homo sapiens
caaatgtatcagcccagggatt

SEQ ID NO: 10012432 - DNA, 22 bp, Homo sapiens
caaatgtatcagcccagggatt

SEQ ID NO: 10012433 - DNA, 22 bp, Homo sapiens
caaatgtatgttttcctatgta

SEQ ID NO: 10012434 - DNA, 22 bp, Homo sapiens
caaatgtataaatgtactttct

SEQ ID NO: 10012435 - DNA, 22 bp, Homo sapiens
caaatgtataaatgtactttct

SEQ ID NO: 10012436 - DNA, 22 bp, Homo sapiens
caaatgtataaatgtactttct

SEQ ID NO: 10012437 - DNA, 22 bp, Homo sapiens
caaatgtaaattcttttgaagc

SEQ ID NO: 10012438 - DNA, 22 bp, Homo sapiens
caaatgtaaattcttttgaagc

SEQ ID NO: 10012439 - DNA, 22 bp, Homo sapiens
caaatgtaataaggagtttccc

SEQ ID NO: 10012440 - DNA, 22 bp, Homo sapiens
caaatgtaataaggagtttccc

SEQ ID NO: 10012441 - DNA, 20 bp, Homo sapiens
caaatggcttttatttcctt

SEQ ID NO: 10012442 - DNA, 20 bp, Homo sapiens
caaatggcttttatttcctt

SEQ ID NO: 10012443 - DNA, 22 bp, Homo sapiens
caaatggctggcatccttctac

SEQ ID NO: 10012444 - DNA, 22 bp, Homo sapiens
cacataaatggtgccatgtttt

SEQ ID NO: 10012445 - DNA, 22 bp, Homo sapiens
cacataaatggtgccatgtttt

SEQ ID NO: 10012446 - DNA, 22 bp, Homo sapiens
cacataaatggtgccatgtttt

SEQ ID NO: 10012447 - DNA, 22 bp, Homo sapiens
cacataagaaatgaatatgaga

SEQ ID NO: 10012448 - DNA, 22 bp, Homo sapiens
cacagttttgtcttggtttcca

SEQ ID NO: 10012449 - DNA, 22 bp, Homo sapiens
cacatacaaggcacactggagg

SEQ ID NO: 10012450 - DNA, 22 bp, Homo sapiens
cacatacattcatgttactcta

SEQ ID NO: 10012451 - DNA, 22 bp, Homo sapiens
cacatacattcatgttactcta

SEQ ID NO: 10012452 - DNA, 22 bp, Homo sapiens
cacatacttgtgtgtacatatg

SEQ ID NO: 10012453 - DNA, 22 bp, Homo sapiens
cacatacatgcacacctaaata

SEQ ID NO: 10012454 - DNA, 22 bp, Homo sapiens
cacatacatgcacacctaaata

SEQ ID NO: 10012455 - DNA, 22 bp, Homo sapiens
cacatacatgcacacctaaata

SEQ ID NO: 10012456 - DNA, 22 bp, Homo sapiens
cacatacatacgtatgtataca

SEQ ID NO: 10012457 - DNA, 22 bp, Homo sapiens
cacatacatacgtatgtataca

SEQ ID NO: 10012458 - DNA, 22 bp, Homo sapiens
cacatacatacgtatgtataca

SEQ ID NO: 10012459 - DNA, 22 bp, Homo sapiens
cacatacatacgtatgtataca

SEQ ID NO: 10012460 - DNA, 19 bp, Homo sapiens
cacatacagaaaagagtaa

SEQ ID NO: 10012461 - DNA, 22 bp, Homo sapiens
cacatacaatggtgttatttgg

SEQ ID NO: 10012462 - DNA, 22 bp, Homo sapiens
cacatacaatggtgttatttgg

SEQ ID NO: 10012463 - DNA, 22 bp, Homo sapiens
cacagggaacaactagaacaaa

SEQ ID NO: 10012464 - DNA, 22 bp, Homo sapiens
cacaggcttttttggctgatgt

SEQ ID NO: 10012465 - DNA, 22 bp, Homo sapiens
cacaggcttttctgacataggc

SEQ ID NO: 10012466 - DNA, 22 bp, Homo sapiens
cacagggaaccaaggctgggcc

SEQ ID NO: 10012467 - DNA, 22 bp, Homo sapiens
cacagggaaccaaggctgggcc

SEQ ID NO: 10012468 - DNA, 22 bp, Homo sapiens
ggaggtcccaggcctggcagca

SEQ ID NO: 10012469 - DNA, 22 bp, Homo sapiens
ggaggtgacgaaaagaaattgt

SEQ ID NO: 10012470 - DNA, 22 bp, Homo sapiens
ggaggtgaggccgtagggtgtg

SEQ ID NO: 10012471 - DNA, 22 bp, Homo sapiens
ggaggtggagctggaagttcca

SEQ ID NO: 10012472 - DNA, 22 bp, Homo sapiens
ggaggtggagctggaagttcca

SEQ ID NO: 10012473 - DNA, 22 bp, Homo sapiens
ggaggtggaggttgcaatgagc

SEQ ID NO: 10012474 - DNA, 22 bp, Homo sapiens
ggaggtggaggttgcaatgagc

SEQ ID NO: 10012475 - DNA, 22 bp, Homo sapiens
ggaggtggaggttgcaatgagc

SEQ ID NO: 10012476 - DNA, 22 bp, Homo sapiens
cacatttagaggttagcatggt

SEQ ID NO: 10012477 - DNA, 22 bp, Homo sapiens
cacatttagaggttagcatggt

SEQ ID NO: 10012478 - DNA, 22 bp, Homo sapiens
cacatttagaggttagcatggt

SEQ ID NO: 10012479 - DNA, 18 bp, Homo sapiens
cacatttacctggctccc

SEQ ID NO: 10012480 - DNA, 22 bp, Homo sapiens
cacatttacttttatcccttgg

SEQ ID NO: 10012481 - DNA, 22 bp, Homo sapiens
cacatttaggttcctatagcca

SEQ ID NO: 10012482 - DNA, 22 bp, Homo sapiens
cacatttaggttcctatagcca

SEQ ID NO: 10012483 - DNA, 22 bp, Homo sapiens
cacatttatctgttctttctag

SEQ ID NO: 10012484 - DNA, 22 bp, Homo sapiens
cacatttatctgttctttctag

SEQ ID NO: 10012485 - DNA, 22 bp, Homo sapiens
cacatttatctctctccggtga

SEQ ID NO: 10012486 - DNA, 22 bp, Homo sapiens
cacatacttgtgtgtacatatg

SEQ ID NO: 10012487 - DNA, 22 bp, Homo sapiens
cacatagataggcagaagaaca

SEQ ID NO: 10012488 - DNA, 23 bp, Homo sapiens
cacatatagcagccactaaggtc

SEQ ID NO: 10012489 - DNA, 22 bp, Homo sapiens
cacatatacctcttcttgagtt

SEQ ID NO: 10012490 - DNA, 23 bp, Homo sapiens
cacatatagcagccactaaggtc

SEQ ID NO: 10012491 - DNA, 23 bp, Homo sapiens
cacatatagcagccactaaggtc

SEQ ID NO: 10012492 - DNA, 22 bp, Homo sapiens
cacatatatgaaatgaggaatt

SEQ ID NO: 10012493 - DNA, 22 bp, Homo sapiens
cacatttacatataaaactttc

SEQ ID NO: 10012494 - DNA, 22 bp, Homo sapiens
cacatttacatataaaactttc

SEQ ID NO: 10012495 - DNA, 22 bp, Homo sapiens
cacattctttcacagttctgaa

SEQ ID NO: 10012496 - DNA, 22 bp, Homo sapiens
cacatttacatataaaactttc

SEQ ID NO: 10012497 - DNA, 22 bp, Homo sapiens
ggcaggcatcatcagttgatca

SEQ ID NO: 10012498 - DNA, 22 bp, Homo sapiens
ggcaggcatcatgtggtcatta

SEQ ID NO: 10012499 - DNA, 22 bp, Homo sapiens
ggcaggcatggccactccctag

SEQ ID NO: 10012500 - DNA, 22 bp, Homo sapiens
ggcagggaggaggtgaaagtga

SEQ ID NO: 10012501 - DNA, 20 bp, Homo sapiens
ggcagggagggatactgagg

SEQ ID NO: 10012502 - DNA, 22 bp, Homo sapiens
ggcagggagagcatgctgataa

SEQ ID NO: 10012503 - DNA, 22 bp, Homo sapiens
cacatttcattggcttacgtaa

SEQ ID NO: 10012504 - DNA, 22 bp, Homo sapiens
cacatttatttgaggctaattg

SEQ ID NO: 10012505 - DNA, 22 bp, Homo sapiens
ggcaggcaggagcgtgcttggg

SEQ ID NO: 10012506 - DNA, 22 bp, Homo sapiens
cacatttccttggcctttaatt

SEQ ID NO: 10012507 - DNA, 20 bp, Homo sapiens
ggcaggcaggaggtttccag

SEQ ID NO: 10012508 - DNA, 22 bp, Homo sapiens
ggcaggcaggtcttcatggccc

SEQ ID NO: 10012509 - DNA, 22 bp, Homo sapiens
ggcaggcaggtcttcatggccc

SEQ ID NO: 10012510 - DNA, 22 bp, Homo sapiens
ggcaggcagtgtggtgtgaaac

SEQ ID NO: 10012511 - DNA, 22 bp, Homo sapiens
ggccactgctgctctggtggag

SEQ ID NO: 10012512 - DNA, 22 bp, Homo sapiens
ggccactgctctccagcctggg

SEQ ID NO: 10012513 - DNA, 22 bp, Homo sapiens
ggccactgctctccagcctggg

SEQ ID NO: 10012514 - DNA, 22 bp, Homo sapiens
ggccactgccctggctacaccg

SEQ ID NO: 10012515 - DNA, 22 bp, Homo sapiens
ggccctgttagagctcccacaa

SEQ ID NO: 10012516 - DNA, 22 bp, Homo sapiens
ggccctgttagagctcccacaa

SEQ ID NO: 10012517 - DNA, 22 bp, Homo sapiens
ggccctgtggttttgcaaagtc

SEQ ID NO: 10012518 - DNA, 22 bp, Homo sapiens
ggccctgtgatggatgtattag

SEQ ID NO: 10012519 - DNA, 22 bp, Homo sapiens
ggccctgtgatggatgtattag

SEQ ID NO: 10012520 - DNA, 22 bp, Homo sapiens
ggccctgtggttttgcaaagtc

SEQ ID NO: 10012521 - DNA, 22 bp, Homo sapiens
ggccctgtccccttcagttttg

SEQ ID NO: 10012522 - DNA, 22 bp, Homo sapiens
ggccctgtcctggctgtctccg

SEQ ID NO: 10012523 - DNA, 22 bp, Homo sapiens
ggccctgtcctggctgtctccg

SEQ ID NO: 10012524 - DNA, 22 bp, Homo sapiens
ggccctgtctgtctgcccagct

SEQ ID NO: 10012525 - DNA, 19 bp, Homo sapiens
ggccctgtaggatgtgagt

SEQ ID NO: 10012526 - DNA, 22 bp, Homo sapiens
ggccccaggtagaagatataga

SEQ ID NO: 10012527 - DNA, 22 bp, Homo sapiens
cacctgtacagggccgggctgg

SEQ ID NO: 10012528 - DNA, 22 bp, Homo sapiens
cacctgttgtttattcatctct

SEQ ID NO: 10012529 - DNA, 22 bp, Homo sapiens
ggccgggcaggtctcagccagc

SEQ ID NO: 10012530 - DNA, 22 bp, Homo sapiens
cacgagggcacacgtgggaggg

SEQ ID NO: 10012531 - DNA, 22 bp, Homo sapiens
caccttgagggggaaaataatc

SEQ ID NO: 10012532 - DNA, 22 bp, Homo sapiens
caccttttgtgtctgcgtttgt

SEQ ID NO: 10012533 - DNA, 22 bp, Homo sapiens
caccttttgtgtctgcgtttgt

SEQ ID NO: 10012534 - DNA, 22 bp, Homo sapiens
ggcattcaaagaatggtaatta

SEQ ID NO: 10012535 - DNA, 22 bp, Homo sapiens
ggcatttatttgtctcattctt

SEQ ID NO: 10012536 - DNA, 20 bp, Homo sapiens
ggcatttatgaaccaagcct

SEQ ID NO: 10012537 - DNA, 23 bp, Homo sapiens
ggccactgaattttctgcatctt

SEQ ID NO: 10012538 - DNA, 23 bp, Homo sapiens
ggccactgaattttctgcatctt

SEQ ID NO: 10012539 - DNA, 22 bp, Homo sapiens
ggccaagctctcattccagcac

SEQ ID NO: 10012540 - DNA, 22 bp, Homo sapiens
ggccaaatttggccatgagcat

SEQ ID NO: 10012541 - DNA, 21 bp, Homo sapiens
ggccaacatggtctcatctct

SEQ ID NO: 10012542 - DNA, 22 bp, Homo sapiens
ggccaaatctgtaaggcaagat

SEQ ID NO: 10012543 - DNA, 22 bp, Homo sapiens
ggccaaatgaaatctgagcaat

SEQ ID NO: 10012544 - DNA, 22 bp, Homo sapiens
ggccaaatgaaggcaatgggac

SEQ ID NO: 10012545 - DNA, 22 bp, Homo sapiens
ggccaaatttatttgcagctgg

SEQ ID NO: 10012546 - DNA, 22 bp, Homo sapiens
ggccaaaagcataatcctcaca

SEQ ID NO: 10012547 - DNA, 22 bp, Homo sapiens
ggccaaatcctccatggtggct

SEQ ID NO: 10012548 - DNA, 22 bp, Homo sapiens
ggcatttgagccattggcctgt

SEQ ID NO: 10012549 - DNA, 22 bp, Homo sapiens
ggcaggtgcacctgagccatct

SEQ ID NO: 10012550 - DNA, 22 bp, Homo sapiens
ggcaggtgatctagagtcaata

SEQ ID NO: 10012551 - DNA, 22 bp, Homo sapiens
ggcagggcaggaaagtcaggaa

SEQ ID NO: 10012552 - DNA, 22 bp, Homo sapiens
ggcagggagtggagactcccta

SEQ ID NO: 10012553 - DNA, 20 bp, Homo sapiens
ggcagggagggatactgagg

SEQ ID NO: 10012554 - DNA, 22 bp, Homo sapiens
ggcagggagtggagactcccta

SEQ ID NO: 10012555 - DNA, 22 bp, Homo sapiens
ggctccagggtctctccttgtg

SEQ ID NO: 10012556 - DNA, 22 bp, Homo sapiens
ggctccagggagtggagagaag

SEQ ID NO: 10012557 - DNA, 22 bp, Homo sapiens
ggctccagggtacccctggatg

SEQ ID NO: 10012558 - DNA, 22 bp, Homo sapiens
ggctccagggtacccctggatg

SEQ ID NO: 10012559 - DNA, 22 bp, Homo sapiens
ggctccaggtttaagggtatgt

SEQ ID NO: 10012560 - DNA, 22 bp, Homo sapiens
ggctctgggttctgcaatgcgt

SEQ ID NO: 10012561 - DNA, 22 bp, Homo sapiens
ggctctgggttctgcaatgcgt

SEQ ID NO: 10012562 - DNA, 22 bp, Homo sapiens
ggctgaggcggcgatgcccttg

SEQ ID NO: 10012563 - DNA, 22 bp, Homo sapiens
ggctgagcttttcatgatggtt

SEQ ID NO: 10012564 - DNA, 22 bp, Homo sapiens
ggctgagcttatatatgtgctg

SEQ ID NO: 10012565 - DNA, 22 bp, Homo sapiens
ggctgagcctggagcatctggt

SEQ ID NO: 10012566 - DNA, 22 bp, Homo sapiens
ggctgagcctggagcatctggt

SEQ ID NO: 10012567 - DNA, 22 bp, Homo sapiens
ggctgagctcaggggcagcagg

SEQ ID NO: 10012568 - DNA, 22 bp, Homo sapiens
ggctgagcgtggctgccgtggg

SEQ ID NO: 10012569 - DNA, 22 bp, Homo sapiens
ggctctggtgccctggctccca

SEQ ID NO: 10012570 - DNA, 22 bp, Homo sapiens
ggctctggtgggaaggttagat

SEQ ID NO: 10012571 - DNA, 22 bp, Homo sapiens
ggctctggtggcaattgactgg

SEQ ID NO: 10012572 - DNA, 22 bp, Homo sapiens
ggctgagccccctctgcgtagg

SEQ ID NO: 10012573 - DNA, 22 bp, Homo sapiens
ggctctggtgagggtaggagat

SEQ ID NO: 10012574 - DNA, 22 bp, Homo sapiens
ggctctggtgccctggctccca

SEQ ID NO: 10012575 - DNA, 22 bp, Homo sapiens
ggctctggtgccctggctccca

SEQ ID NO: 10012576 - DNA, 22 bp, Homo sapiens
ggctctggtgagggtaggagat

SEQ ID NO: 10012577 - DNA, 22 bp, Homo sapiens
ggctctggtcagtgaggggcct

SEQ ID NO: 10012578 - DNA, 22 bp, Homo sapiens
ggcctgtaatcccagctactca

SEQ ID NO: 10012579 - DNA, 22 bp, Homo sapiens
ggcctgtccagcctgcctggct

SEQ ID NO: 10012580 - DNA, 22 bp, Homo sapiens
ggcctgtctcacccccgggtgc

SEQ ID NO: 10012581 - DNA, 22 bp, Homo sapiens
ggcctgaggcgtcccagctgtg

SEQ ID NO: 10012582 - DNA, 22 bp, Homo sapiens
ggcctgaggccaccagcagccc

SEQ ID NO: 10012583 - DNA, 22 bp, Homo sapiens
ggcctgagcagacagcatgatg

SEQ ID NO: 10012584 - DNA, 20 bp, Homo sapiens
ggcctgagcatggctggcag

SEQ ID NO: 10012585 - DNA, 20 bp, Homo sapiens
ggcctgagcatggctggcag

SEQ ID NO: 10012586 - DNA, 22 bp, Homo sapiens
ggcctgaggcaatagtcagaca

SEQ ID NO: 10012587 - DNA, 22 bp, Homo sapiens
ggcctgagctctggggaggcaa

SEQ ID NO: 10012588 - DNA, 22 bp, Homo sapiens
ggcctgagcttgggcagcgtat

SEQ ID NO: 10012589 - DNA, 22 bp, Homo sapiens
ggcctgtgctgagaacctggct

SEQ ID NO: 10012590 - DNA, 22 bp, Homo sapiens
ggcctgtgcacatgtgcaggaa

SEQ ID NO: 10012591 - DNA, 22 bp, Homo sapiens
ggcctgtggctttggcgtctaa

SEQ ID NO: 10012592 - DNA, 22 bp, Homo sapiens
ggcctgtgggaggacagctggg

SEQ ID NO: 10012593 - DNA, 22 bp, Homo sapiens
ggcctgtggtttctagtaggtt

SEQ ID NO: 10012594 - DNA, 22 bp, Homo sapiens
ggcctgtgtctgtgcctgtcct

SEQ ID NO: 10012595 - DNA, 22 bp, Homo sapiens
ggcctgtgtcctccttgccctg

SEQ ID NO: 10012596 - DNA, 22 bp, Homo sapiens
ggcctgtgtcctccttgccctg

SEQ ID NO: 10012597 - DNA, 22 bp, Homo sapiens
ggctcaggctggagtgcagtgg

SEQ ID NO: 10012598 - DNA, 22 bp, Homo sapiens
ggctcaggggccaggcctgtcc

SEQ ID NO: 10012599 - DNA, 22 bp, Homo sapiens
ggctcagggaatgaggaagaat

SEQ ID NO: 10012600 - DNA, 22 bp, Homo sapiens
cagaaatacccagcatttggag

SEQ ID NO: 10012601 - DNA, 22 bp, Homo sapiens
cagaaataaagtggacagagta

SEQ ID NO: 10012602 - DNA, 22 bp, Homo sapiens
cagaaataaagtggacagagta

SEQ ID NO: 10012603 - DNA, 22 bp, Homo sapiens
cagaaatacccagcatttggag

SEQ ID NO: 10012604 - DNA, 22 bp, Homo sapiens
cagaaatagacaatggcagtgg

SEQ ID NO: 10012605 - DNA, 22 bp, Homo sapiens
ggctgggaggatgacttgctac

SEQ ID NO: 10012606 - DNA, 22 bp, Homo sapiens
ggctgggaggatgacttgctac

SEQ ID NO: 10012607 - DNA, 22 bp, Homo sapiens
cagaaaggactttggttggctt

SEQ ID NO: 10012608 - DNA, 22 bp, Homo sapiens
cagaaaggactttggttggctt

SEQ ID NO: 10012609 - DNA, 22 bp, Homo sapiens
cagaaaggacagagtgagggtg

SEQ ID NO: 10012610 - DNA, 22 bp, Homo sapiens
cagaaaggacagagtgagggtg

SEQ ID NO: 10012611 - DNA, 22 bp, Homo sapiens
cagaaagctctttcaatcttgc

SEQ ID NO: 10012612 - DNA, 22 bp, Homo sapiens
cagaaagcttaggcaagttgga

SEQ ID NO: 10012613 - DNA, 18 bp, Homo sapiens
cagaaagttatttactct

SEQ ID NO: 10012614 - DNA, 23 bp, Homo sapiens
cagaaagtttgagaagatacatc

SEQ ID NO: 10012615 - DNA, 22 bp, Homo sapiens
cagaaaggcacccactgggtct

SEQ ID NO: 10012616 - DNA, 22 bp, Homo sapiens
cagaaagtgatttgctattcca

SEQ ID NO: 10012617 - DNA, 22 bp, Homo sapiens
ggctgtgtttctgtttgacatt

SEQ ID NO: 10012618 - DNA, 22 bp, Homo sapiens
ggctgtgaaccctggcagtgtg

SEQ ID NO: 10012619 - DNA, 22 bp, Homo sapiens
ggctgtgttccaagtgtcagga

SEQ ID NO: 10012620 - DNA, 22 bp, Homo sapiens
ggctgtgaaccctggcagtgtg

SEQ ID NO: 10012621 - DNA, 22 bp, Homo sapiens
ggctgtgaagtagcaggggcag

SEQ ID NO: 10012622 - DNA, 21 bp, Homo sapiens
ggctggtgtttagctgtgata

SEQ ID NO: 10012623 - DNA, 22 bp, Homo sapiens
ggctggtgttacagtcggcagc

SEQ ID NO: 10012624 - DNA, 22 bp, Homo sapiens
ggctgtccttggccaaggcact

SEQ ID NO: 10012625 - DNA, 22 bp, Homo sapiens
ggctgtagtcagtgacatggta

SEQ ID NO: 10012626 - DNA, 22 bp, Homo sapiens
ggctgccctagagctggcaagg

SEQ ID NO: 10012627 - DNA, 22 bp, Homo sapiens
ggctgccctcggggtcgcaggc

SEQ ID NO: 10012628 - DNA, 22 bp, Homo sapiens
ggctgccctcgtctactgccca

SEQ ID NO: 10012629 - DNA, 22 bp, Homo sapiens
ggctgccctgggaggcaagggt

SEQ ID NO: 10012630 - DNA, 22 bp, Homo sapiens
ggctgcctaacccttaagtgtc

SEQ ID NO: 10012631 - DNA, 22 bp, Homo sapiens
ggctgcctactttcccagagtt

SEQ ID NO: 10012632 - DNA, 22 bp, Homo sapiens
ggctgcctagacttggaatttc

SEQ ID NO: 10012633 - DNA, 22 bp, Homo sapiens
cagaaagacctgggctcaagag

SEQ ID NO: 10012634 - DNA, 22 bp, Homo sapiens
cagaaacatgtataaagttgta

SEQ ID NO: 10012635 - DNA, 22 bp, Homo sapiens
cagaaagccctatgtacagtgg

SEQ ID NO: 10012636 - DNA, 22 bp, Homo sapiens
cagaaagccgacttacaatgga

SEQ ID NO: 10012637 - DNA, 22 bp, Homo sapiens
cagaaagcgggatgcagcatgt

SEQ ID NO: 10012638 - DNA, 22 bp, Homo sapiens
cagaaagccgacttacaatgga

SEQ ID NO: 10012639 - DNA, 20 bp, Homo sapiens
cagaaagcatgttccagggc

SEQ ID NO: 10012640 - DNA, 22 bp, Homo sapiens
cagaaagccaactccaactgtc

SEQ ID NO: 10012641 - DNA, 22 bp, Homo sapiens
cactttaactcacatttcagct

SEQ ID NO: 10012642 - DNA, 22 bp, Homo sapiens
cactttgtgtgggatcaggggt

SEQ ID NO: 10012643 - DNA, 22 bp, Homo sapiens
cactttgtttattgtgcagtta

SEQ ID NO: 10012644 - DNA, 17 bp, Homo sapiens
cactttgttgctgtggg

SEQ ID NO: 10012645 - DNA, 23 bp, Homo sapiens
cagaaaacccagagctcagtccc

SEQ ID NO: 10012646 - DNA, 22 bp, Homo sapiens
cagaaaacaaacctatcctgag

SEQ ID NO: 10012647 - DNA, 22 bp, Homo sapiens
cagaaaagggtgtttgttcagg

SEQ ID NO: 10012648 - DNA, 22 bp, Homo sapiens
cagaaaaggaagagctatgtaa

SEQ ID NO: 10012649 - DNA, 22 bp, Homo sapiens
cagaaaaggaagagctatgtaa

SEQ ID NO: 10012650 - DNA, 22 bp, Homo sapiens
cagaaaaggaagagctatgtaa

SEQ ID NO: 10012651 - DNA, 22 bp, Homo sapiens
cagaaaagggtgtttgttcagg

SEQ ID NO: 10012652 - DNA, 22 bp, Homo sapiens
cagaaaagggtgtttgttcagg

SEQ ID NO: 10012653 - DNA, 22 bp, Homo sapiens
cagaaaataaagtttctacgca

SEQ ID NO: 10012654 - DNA, 22 bp, Homo sapiens
ggctgccataacagagtaccac

SEQ ID NO: 10012655 - DNA, 22 bp, Homo sapiens
ggctgccataactgataccata

SEQ ID NO: 10012656 - DNA, 22 bp, Homo sapiens
ggctgccccatgggctgggctg

SEQ ID NO: 10012657 - DNA, 22 bp, Homo sapiens
ggctgccccagtgctcatggct

SEQ ID NO: 10012658 - DNA, 22 bp, Homo sapiens
ggctgccctagagctggcaagg

SEQ ID NO: 10012659 - DNA, 22 bp, Homo sapiens
ggctgccccatgggctgggctg

SEQ ID NO: 10012660 - DNA, 22 bp, Homo sapiens
cataagaaatttaacagaactt

SEQ ID NO: 10012661 - DNA, 22 bp, Homo sapiens
cataagaaataatgatgatgac

SEQ ID NO: 10012662 - DNA, 22 bp, Homo sapiens
cataactggggacacttctcta

SEQ ID NO: 10012663 - DNA, 22 bp, Homo sapiens
cataactagagtgaaatgttga

SEQ ID NO: 10012664 - DNA, 22 bp, Homo sapiens
cataatatactacattgatgaa

SEQ ID NO: 10012665 - DNA, 22 bp, Homo sapiens
cagttttatgtcgaatgtatac

SEQ ID NO: 10012666 - DNA, 22 bp, Homo sapiens
cagttttattggttgaaatctg

SEQ ID NO: 10012667 - DNA, 22 bp, Homo sapiens
aggagccagtggagttcctgcc

SEQ ID NO: 10012668 - DNA, 22 bp, Homo sapiens
cataacatctgtgaagcaggaa

SEQ ID NO: 10012669 - DNA, 22 bp, Homo sapiens
cataacatccttgctactttga

SEQ ID NO: 10012670 - DNA, 22 bp, Homo sapiens
cataacatccttgctactttga

SEQ ID NO: 10012671 - DNA, 22 bp, Homo sapiens
cataacattaagcctctatttc

SEQ ID NO: 10012672 - DNA, 22 bp, Homo sapiens
cataacatgtacatataaatgc

SEQ ID NO: 10012673 - DNA, 22 bp, Homo sapiens
aggagctgggttcctttggtgg

SEQ ID NO: 10012674 - DNA, 22 bp, Homo sapiens
aggagctgggttcctttggtgg

SEQ ID NO: 10012675 - DNA, 16 bp, Homo sapiens
aggagctgggtaggag

SEQ ID NO: 10012676 - DNA, 22 bp, Homo sapiens
aggagctggtagtctcattggg

SEQ ID NO: 10012677 - DNA, 22 bp, Homo sapiens
aggagctgtcagagtgccagag

SEQ ID NO: 10012678 - DNA, 22 bp, Homo sapiens
aggagctgtcagagtgccagag

SEQ ID NO: 10012679 - DNA, 22 bp, Homo sapiens
aggagctgtcagagtgccagag

SEQ ID NO: 10012680 - DNA, 22 bp, Homo sapiens
aggaggccgctgatgggctccc

SEQ ID NO: 10012681 - DNA, 22 bp, Homo sapiens
aggaggccgctgatgggctccc

SEQ ID NO: 10012682 - DNA, 23 bp, Homo sapiens
aggaggcctgaaactgaggctga

SEQ ID NO: 10012683 - DNA, 23 bp, Homo sapiens
aggaggcctgaaactgaggctga

SEQ ID NO: 10012684 - DNA, 22 bp, Homo sapiens
aggaggccgctgatgggctccc

SEQ ID NO: 10012685 - DNA, 22 bp, Homo sapiens
aggaggccgggattctggagat

SEQ ID NO: 10012686 - DNA, 22 bp, Homo sapiens
aggaggcctacgcacatgtcta

SEQ ID NO: 10012687 - DNA, 22 bp, Homo sapiens
aggaggcctacgcacatgtcta

SEQ ID NO: 10012688 - DNA, 22 bp, Homo sapiens
cagtccagagtaccccaagaag

SEQ ID NO: 10012689 - DNA, 22 bp, Homo sapiens
cagtccagagcccaccagagga

SEQ ID NO: 10012690 - DNA, 22 bp, Homo sapiens
cagtccagagcccaccagagga

SEQ ID NO: 10012691 - DNA, 22 bp, Homo sapiens
cagtccagccagtagggtgtgg

SEQ ID NO: 10012692 - DNA, 22 bp, Homo sapiens
cagtccagccccctgctaaaag

SEQ ID NO: 10012693 - DNA, 22 bp, Homo sapiens
cagtccaggcctggaggagcca

SEQ ID NO: 10012694 - DNA, 22 bp, Homo sapiens
cagtccagctcatcagtggcac

SEQ ID NO: 10012695 - DNA, 22 bp, Homo sapiens
cagtccaggcctggaggagcca

SEQ ID NO: 10012696 - DNA, 22 bp, Homo sapiens
cagtgtggcttagggaataggc

SEQ ID NO: 10012697 - DNA, 22 bp, Homo sapiens
cagtgtgggtttgggaggagta

SEQ ID NO: 10012698 - DNA, 22 bp, Homo sapiens
cagtgtggctgagacagaggct

SEQ ID NO: 10012699 - DNA, 22 bp, Homo sapiens
cagtgtggagggagagagcctg

SEQ ID NO: 10012700 - DNA, 20 bp, Homo sapiens
cagtccaggctgcagcatct

SEQ ID NO: 10012701 - DNA, 22 bp, Homo sapiens
aggagccaggccccatggggct

SEQ ID NO: 10012702 - DNA, 23 bp, Homo sapiens
aggagccaggtgcagcccttgtg

SEQ ID NO: 10012703 - DNA, 22 bp, Homo sapiens
aggagccagggaagctgctttc

SEQ ID NO: 10012704 - DNA, 23 bp, Homo sapiens
aggagccaggtgcagcccttgtg

SEQ ID NO: 10012705 - DNA, 22 bp, Homo sapiens
aggagccaggaaacctgctctg

SEQ ID NO: 10012706 - DNA, 21 bp, Homo sapiens
cagtgtggtgaccagggtctc

SEQ ID NO: 10012707 - DNA, 21 bp, Homo sapiens
cagtgtggtgaccagggtctc

SEQ ID NO: 10012708 - DNA, 22 bp, Homo sapiens
cagtgtggtgagattccaggtg

SEQ ID NO: 10012709 - DNA, 22 bp, Homo sapiens
cagtgtggtgagattccaggtg

SEQ ID NO: 10012710 - DNA, 22 bp, Homo sapiens
cagtgtgtggatcctcccagga

SEQ ID NO: 10012711 - DNA, 22 bp, Homo sapiens
cagtgtgtgactctgggggtac

SEQ ID NO: 10012712 - DNA, 22 bp, Homo sapiens
cagtgttgctaagttctgaact

SEQ ID NO: 10012713 - DNA, 21 bp, Homo sapiens
cagtgttgatatttaatacat

SEQ ID NO: 10012714 - DNA, 22 bp, Homo sapiens
cagtgtgtggatcctcccagga

SEQ ID NO: 10012715 - DNA, 22 bp, Homo sapiens
cagtgtttaatcattgtgaatt

SEQ ID NO: 10012716 - DNA, 22 bp, Homo sapiens
cagtgtttagatcaagaaggcc

SEQ ID NO: 10012717 - DNA, 22 bp, Homo sapiens
cagtgtttagcacagtgcttgg

SEQ ID NO: 10012718 - DNA, 22 bp, Homo sapiens
aggagccacctaggagctgttt

SEQ ID NO: 10012719 - DNA, 22 bp, Homo sapiens
catacatactgagtggactgat

SEQ ID NO: 10012720 - DNA, 22 bp, Homo sapiens
catacatactgagtggactgat

SEQ ID NO: 10012721 - DNA, 22 bp, Homo sapiens
catacagagaaggataataaag

SEQ ID NO: 10012722 - DNA, 22 bp, Homo sapiens
catacagagaaggataataaag

SEQ ID NO: 10012723 - DNA, 22 bp, Homo sapiens
catacaaatgtgtccaggctct

SEQ ID NO: 10012724 - DNA, 22 bp, Homo sapiens
catacaagcgtgcatgtgcttg

SEQ ID NO: 10012725 - DNA, 22 bp, Homo sapiens
catacaaatgtgtccaggctct

SEQ ID NO: 10012726 - DNA, 22 bp, Homo sapiens
catacaagcgttcaatagatgt

SEQ ID NO: 10012727 - DNA, 22 bp, Homo sapiens
catacaagcgttcaatagatgt

SEQ ID NO: 10012728 - DNA, 22 bp, Homo sapiens
aggaggcctgttttctcctgga

SEQ ID NO: 10012729 - DNA, 22 bp, Homo sapiens
aggaggctctcaggtcctcccc

SEQ ID NO: 10012730 - DNA, 22 bp, Homo sapiens
aggaggctgaactagggtctgg

SEQ ID NO: 10012731 - DNA, 22 bp, Homo sapiens
aggaggctgaactagggtctgg

SEQ ID NO: 10012732 - DNA, 22 bp, Homo sapiens
cataatttttttaagtcagaac

SEQ ID NO: 10012733 - DNA, 22 bp, Homo sapiens
cataatttttttaagtcagaac

SEQ ID NO: 10012734 - DNA, 22 bp, Homo sapiens
cataatttttttaagtcagaac

SEQ ID NO: 10012735 - DNA, 22 bp, Homo sapiens
catacaaatgtgtccaggctct

SEQ ID NO: 10012736 - DNA, 22 bp, Homo sapiens
catcttataggcagagttcagt

SEQ ID NO: 10012737 - DNA, 22 bp, Homo sapiens
catcttcaccagagacaagcaa

SEQ ID NO: 10012738 - DNA, 22 bp, Homo sapiens
catcttaatttctaacaggcac

SEQ ID NO: 10012739 - DNA, 22 bp, Homo sapiens
catctctgtgtccccagagctt

SEQ ID NO: 10012740 - DNA, 21 bp, Homo sapiens
catcttaattgaaagcagaga

SEQ ID NO: 10012741 - DNA, 22 bp, Homo sapiens
catctcttcattagcattattg

SEQ ID NO: 10012742 - DNA, 22 bp, Homo sapiens
catctctgagacctcagctggg

SEQ ID NO: 10012743 - DNA, 22 bp, Homo sapiens
catctctccacggcagctctcg

SEQ ID NO: 10012744 - DNA, 22 bp, Homo sapiens
catctctggttcagtctctgtg

SEQ ID NO: 10012745 - DNA, 20 bp, Homo sapiens
catctcctgcctccatgttc

SEQ ID NO: 10012746 - DNA, 22 bp, Homo sapiens
catctccaggagttctactcat

SEQ ID NO: 10012747 - DNA, 22 bp, Homo sapiens
catccaaagcaaatatcttaaa

SEQ ID NO: 10012748 - DNA, 22 bp, Homo sapiens
aggatggggtctgcagcctggt

SEQ ID NO: 10012749 - DNA, 22 bp, Homo sapiens
aggatgggtcagctagagtcca

SEQ ID NO: 10012750 - DNA, 22 bp, Homo sapiens
aggatggggtctgcagcctggt

SEQ ID NO: 10012751 - DNA, 22 bp, Homo sapiens
aggatgagagatacatggagca

SEQ ID NO: 10012752 - DNA, 22 bp, Homo sapiens
aggatgagagatacatggagca

SEQ ID NO: 10012753 - DNA, 22 bp, Homo sapiens
aggatggcttgcaggaggctgt

SEQ ID NO: 10012754 - DNA, 22 bp, Homo sapiens
aggatgggcctgggatatgctt

SEQ ID NO: 10012755 - DNA, 22 bp, Homo sapiens
aggatgggcctgggatatgctt

SEQ ID NO: 10012756 - DNA, 22 bp, Homo sapiens
catcttcattttgtccagtact

SEQ ID NO: 10012757 - DNA, 22 bp, Homo sapiens
catcttctgggacttctcagtt

SEQ ID NO: 10012758 - DNA, 22 bp, Homo sapiens
catcttctgggacttctcagtt

SEQ ID NO: 10012759 - DNA, 22 bp, Homo sapiens
catcttctgggacttctcagtt

SEQ ID NO: 10012760 - DNA, 22 bp, Homo sapiens
catcttcaggttcatggtcata

SEQ ID NO: 10012761 - DNA, 22 bp, Homo sapiens
catcttcagtgattacctaaaa

SEQ ID NO: 10012762 - DNA, 19 bp, Homo sapiens
catcttggagtactccttt

SEQ ID NO: 10012763 - DNA, 22 bp, Homo sapiens
catgagataatttttctccagt

SEQ ID NO: 10012764 - DNA, 22 bp, Homo sapiens
catgaggatccaggtgacaggc

SEQ ID NO: 10012765 - DNA, 22 bp, Homo sapiens
catgagggttggggtggagctt

SEQ ID NO: 10012766 - DNA, 22 bp, Homo sapiens
catgagataatttttctccagt

SEQ ID NO: 10012767 - DNA, 22 bp, Homo sapiens
aggatgtggctgagacttctgg

SEQ ID NO: 10012768 - DNA, 22 bp, Homo sapiens
catgagaatgaagaagacttaa

SEQ ID NO: 10012769 - DNA, 23 bp, Homo sapiens
aggatgtaggatgtatggcagag

SEQ ID NO: 10012770 - DNA, 23 bp, Homo sapiens
aggatgtaggatgtatggcagag

SEQ ID NO: 10012771 - DNA, 22 bp, Homo sapiens
ccaatgaatatatttcatatga

SEQ ID NO: 10012772 - DNA, 22 bp, Homo sapiens
catttgaaacctggaatctacc

SEQ ID NO: 10012773 - DNA, 22 bp, Homo sapiens
ccacagagagtgtcagcctttg

SEQ ID NO: 10012774 - DNA, 22 bp, Homo sapiens
ccacagagactctgcaggactg

SEQ ID NO: 10012775 - DNA, 22 bp, Homo sapiens
ccacagagagtgtcagcctttg

SEQ ID NO: 10012776 - DNA, 22 bp, Homo sapiens
ccacagagactctgcaggactg

SEQ ID NO: 10012777 - DNA, 19 bp, Homo sapiens
ccacagagactagaagaca

SEQ ID NO: 10012778 - DNA, 22 bp, Homo sapiens
ccacagagacagggtccttgct

SEQ ID NO: 10012779 - DNA, 22 bp, Homo sapiens
ccacagaatgatgacacttcag

SEQ ID NO: 10012780 - DNA, 22 bp, Homo sapiens
ccacagaattctgtctccagga

SEQ ID NO: 10012781 - DNA, 22 bp, Homo sapiens
ccacagagacagagcccagggt

SEQ ID NO: 10012782 - DNA, 22 bp, Homo sapiens
ccacagagacagggtccttgct

SEQ ID NO: 10012783 - DNA, 23 bp, Homo sapiens
ccacaggcacagaggcttgcatc

SEQ ID NO: 10012784 - DNA, 22 bp, Homo sapiens
ccacagtgcctggaattctgca

SEQ ID NO: 10012785 - DNA, 23 bp, Homo sapiens
ccacaggcacagaggcttgcatc

SEQ ID NO: 10012786 - DNA, 22 bp, Homo sapiens
ccacagtgcctggaattctgca

SEQ ID NO: 10012787 - DNA, 20 bp, Homo sapiens
ccacagtggagactggagac

SEQ ID NO: 10012788 - DNA, 22 bp, Homo sapiens
aggcaggagcaagccctacaag

SEQ ID NO: 10012789 - DNA, 22 bp, Homo sapiens
aggcaggagtgaccctgacagg

SEQ ID NO: 10012790 - DNA, 22 bp, Homo sapiens
aggcaggaggatcatggatgca

SEQ ID NO: 10012791 - DNA, 22 bp, Homo sapiens
aggcaggaaaatcgcttgaacc

SEQ ID NO: 10012792 - DNA, 19 bp, Homo sapiens
ccacagagcatgctgaggc

SEQ ID NO: 10012793 - DNA, 19 bp, Homo sapiens
ccacagagcatgctgaggc

SEQ ID NO: 10012794 - DNA, 17 bp, Homo sapiens
aggcaggagattggaga

SEQ ID NO: 10012795 - DNA, 21 bp, Homo sapiens
ccaccaggtcttctgctcggg

SEQ ID NO: 10012796 - DNA, 22 bp, Homo sapiens
ccaccattatatctcccatgcc

SEQ ID NO: 10012797 - DNA, 21 bp, Homo sapiens
ccaccaggtcttctgctcggg

SEQ ID NO: 10012798 - DNA, 22 bp, Homo sapiens
ccacagtgttttgtcacattag

SEQ ID NO: 10012799 - DNA, 22 bp, Homo sapiens
ccacagttattcatttgtgaca

SEQ ID NO: 10012800 - DNA, 22 bp, Homo sapiens
ccacagtttcttcatctataaa

SEQ ID NO: 10012801 - DNA, 22 bp, Homo sapiens
ccacagtttgccagccaggaat

SEQ ID NO: 10012802 - DNA, 22 bp, Homo sapiens
ccacagtgtggcataaactgta

SEQ ID NO: 10012803 - DNA, 22 bp, Homo sapiens
ccacagtgtggcataaactgta

SEQ ID NO: 10012804 - DNA, 22 bp, Homo sapiens
ccacagtgttctttttaaaatt

SEQ ID NO: 10012805 - DNA, 22 bp, Homo sapiens
ccacagtggttgtggcatgtgg

SEQ ID NO: 10012806 - DNA, 22 bp, Homo sapiens
ccacagtgggcacagcaggact

SEQ ID NO: 10012807 - DNA, 22 bp, Homo sapiens
ccacagtggttctcaaccaggg

SEQ ID NO: 10012808 - DNA, 22 bp, Homo sapiens
ccacgagggaaccaggtggggt

SEQ ID NO: 10012809 - DNA, 22 bp, Homo sapiens
ccacggccacccgctcatgggc

SEQ ID NO: 10012810 - DNA, 22 bp, Homo sapiens
ccacccagcagaggaggcaaga

SEQ ID NO: 10012811 - DNA, 22 bp, Homo sapiens
ccacccagaccagggatctggg

SEQ ID NO: 10012812 - DNA, 22 bp, Homo sapiens
ccacccagccagatgcaggaag

SEQ ID NO: 10012813 - DNA, 22 bp, Homo sapiens
ccacccagccagatgcaggaag

SEQ ID NO: 10012814 - DNA, 18 bp, Homo sapiens
ccacccagggggagagga

SEQ ID NO: 10012815 - DNA, 22 bp, Homo sapiens
ccacccagccagatgcaggaag

SEQ ID NO: 10012816 - DNA, 22 bp, Homo sapiens
cattggaaaatgcatgcttttt

SEQ ID NO: 10012817 - DNA, 22 bp, Homo sapiens
cattccttaacgtggggagtct

SEQ ID NO: 10012818 - DNA, 22 bp, Homo sapiens
aggcaaggtgctacagacagtg

SEQ ID NO: 10012819 - DNA, 22 bp, Homo sapiens
aggcaaggtgctcttgctctat

SEQ ID NO: 10012820 - DNA, 22 bp, Homo sapiens
aggcaagtgcattagaagagca

SEQ ID NO: 10012821 - DNA, 22 bp, Homo sapiens
aggcaaggtgctcttgctctat

SEQ ID NO: 10012822 - DNA, 22 bp, Homo sapiens
aggcaaggtgctacagacagtg

SEQ ID NO: 10012823 - DNA, 17 bp, Homo sapiens
aggcaatgactgtggtt

SEQ ID NO: 10012824 - DNA, 22 bp, Homo sapiens
cattccttaacgtggggagtct

SEQ ID NO: 10012825 - DNA, 22 bp, Homo sapiens
aggcaataggttcctcatcttt

SEQ ID NO: 10012826 - DNA, 22 bp, Homo sapiens
aggcaataagcctcaactgtct

SEQ ID NO: 10012827 - DNA, 22 bp, Homo sapiens
aggcaatacacagcatttcaca

SEQ ID NO: 10012828 - DNA, 23 bp, Homo sapiens
aggcaatacaaggcatctctgga

SEQ ID NO: 10012829 - DNA, 22 bp, Homo sapiens
aggcaagggggcgccaccttcc

SEQ ID NO: 10012830 - DNA, 23 bp, Homo sapiens
aggcaagggtgtaaaggaaatga

SEQ ID NO: 10012831 - DNA, 20 bp, Homo sapiens
aggcaaggtagatgtctgct

SEQ ID NO: 10012832 - DNA, 20 bp, Homo sapiens
aggcaaggtagatgtctgct

SEQ ID NO: 10012833 - DNA, 22 bp, Homo sapiens
aggcaagattaggaccagaaga

SEQ ID NO: 10012834 - DNA, 22 bp, Homo sapiens
aggcaactcatcatgaaagact

SEQ ID NO: 10012835 - DNA, 22 bp, Homo sapiens
aggcaactgagaggcccgtgtt

SEQ ID NO: 10012836 - DNA, 22 bp, Homo sapiens
aggcaactgtttgataatgttg

SEQ ID NO: 10012837 - DNA, 22 bp, Homo sapiens
aggcaagaaactttctgggaga

SEQ ID NO: 10012838 - DNA, 22 bp, Homo sapiens
aggcaagaacagacatgggagt

SEQ ID NO: 10012839 - DNA, 22 bp, Homo sapiens
aggcaagagtgactacgtgaaa

SEQ ID NO: 10012840 - DNA, 22 bp, Homo sapiens
aggcaagaacagacatgggagt

SEQ ID NO: 10012841 - DNA, 23 bp, Homo sapiens
aggcaagaacgggttgttcaccc

SEQ ID NO: 10012842 - DNA, 22 bp, Homo sapiens
catttctccgccgagatcactg

SEQ ID NO: 10012843 - DNA, 22 bp, Homo sapiens
catttctgattacagaatacta

SEQ ID NO: 10012844 - DNA, 22 bp, Homo sapiens
catttctgattacagaatacta

SEQ ID NO: 10012845 - DNA, 22 bp, Homo sapiens
catttctcataatattagcact

SEQ ID NO: 10012846 - DNA, 22 bp, Homo sapiens
catttcacacataaacttgggt

SEQ ID NO: 10012847 - DNA, 22 bp, Homo sapiens
catttcaattatttgctcttct

SEQ ID NO: 10012848 - DNA, 22 bp, Homo sapiens
catttcaatgccttcaacatag

SEQ ID NO: 10012849 - DNA, 22 bp, Homo sapiens
catttcaatgccttcaacatag

SEQ ID NO: 10012850 - DNA, 22 bp, Homo sapiens
catttcaattatttgctcttct

SEQ ID NO: 10012851 - DNA, 22 bp, Homo sapiens
catttcaatgccttcaacatag

SEQ ID NO: 10012852 - DNA, 22 bp, Homo sapiens
catttcaatacagtttgtaaat

SEQ ID NO: 10012853 - DNA, 22 bp, Homo sapiens
catttcaatactatctgagaat

SEQ ID NO: 10012854 - DNA, 22 bp, Homo sapiens
catttcaatactatctgagaat

SEQ ID NO: 10012855 - DNA, 22 bp, Homo sapiens
catttcaatgccttcaacatag

SEQ ID NO: 10012856 - DNA, 22 bp, Homo sapiens
catttcaaaagaattgccagaa

SEQ ID NO: 10012857 - DNA, 22 bp, Homo sapiens
catttcaaaagaattgccagaa

SEQ ID NO: 10012858 - DNA, 22 bp, Homo sapiens
catttcaaacagttacagctgc

SEQ ID NO: 10012859 - DNA, 22 bp, Homo sapiens
catttcaaacagttacagctgc

SEQ ID NO: 10012860 - DNA, 22 bp, Homo sapiens
catttcaagcattgacttctat

SEQ ID NO: 10012861 - DNA, 22 bp, Homo sapiens
catttcaagcattgacttctat

SEQ ID NO: 10012862 - DNA, 22 bp, Homo sapiens
catttcaagcattgacttctat

SEQ ID NO: 10012863 - DNA, 22 bp, Homo sapiens
catttcaaggaccaccctggga

SEQ ID NO: 10012864 - DNA, 22 bp, Homo sapiens
catttcaagtaacagattgctt

SEQ ID NO: 10012865 - DNA, 22 bp, Homo sapiens
catttcaagtaacagattgctt

SEQ ID NO: 10012866 - DNA, 22 bp, Homo sapiens
catttcaagtaacagattgctt

SEQ ID NO: 10012867 - DNA, 22 bp, Homo sapiens
catttcaagtaacagattgctt

SEQ ID NO: 10012868 - DNA, 21 bp, Homo sapiens
catttcaaagagctggaaatc

SEQ ID NO: 10012869 - DNA, 23 bp, Homo sapiens
catttcaacgaattttccttctg

SEQ ID NO: 10012870 - DNA, 23 bp, Homo sapiens
catttcaacgaattttccttctg

SEQ ID NO: 10012871 - DNA, 22 bp, Homo sapiens
catttcaagcattgacttctat

SEQ ID NO: 10012872 - DNA, 22 bp, Homo sapiens
catttactgttgaatccctagc

SEQ ID NO: 10012873 - DNA, 22 bp, Homo sapiens
cattggaatgcatttgaagaga

SEQ ID NO: 10012874 - DNA, 22 bp, Homo sapiens
cattggccttttatcctagagg

SEQ ID NO: 10012875 - DNA, 22 bp, Homo sapiens
cattggaagacatatcatgcta

SEQ ID NO: 10012876 - DNA, 20 bp, Homo sapiens
cattggacttggcttcatgg

SEQ ID NO: 10012877 - DNA, 22 bp, Homo sapiens
cattggctcctgtgggacatga

SEQ ID NO: 10012878 - DNA, 22 bp, Homo sapiens
cagctgggtttagtggggtgtg

SEQ ID NO: 10012879 - DNA, 22 bp, Homo sapiens
cagctggtactcagttcttgtc

SEQ ID NO: 10012880 - DNA, 22 bp, Homo sapiens
cagctgggtttagtggggtgtg

SEQ ID NO: 10012881 - DNA, 22 bp, Homo sapiens
cagctggtcaactgaatgaaca

SEQ ID NO: 10012882 - DNA, 22 bp, Homo sapiens
cagctgtgtctaattatggctg

SEQ ID NO: 10012883 - DNA, 22 bp, Homo sapiens
cagctgttatgaggtgtacatg

SEQ ID NO: 10012884 - DNA, 22 bp, Homo sapiens
caggagcaaggagcagtgggat

SEQ ID NO: 10012885 - DNA, 22 bp, Homo sapiens
caggagcaaggagcagtgggat

SEQ ID NO: 10012886 - DNA, 22 bp, Homo sapiens
caggagaaacataattttctgg

SEQ ID NO: 10012887 - DNA, 22 bp, Homo sapiens
caggagaaacataattttctgg

SEQ ID NO: 10012888 - DNA, 22 bp, Homo sapiens
caggactgaagggcacagggaa

SEQ ID NO: 10012889 - DNA, 22 bp, Homo sapiens
caggactggaagtctcaagaga

SEQ ID NO: 10012890 - DNA, 22 bp, Homo sapiens
caggactggaagtctcaagaga

SEQ ID NO: 10012891 - DNA, 22 bp, Homo sapiens
caggactggctcgcagtgggtg

SEQ ID NO: 10012892 - DNA, 22 bp, Homo sapiens
caggactggctcgcagtgggtg

SEQ ID NO: 10012893 - DNA, 22 bp, Homo sapiens
caggactggctcgcagtgggtg

SEQ ID NO: 10012894 - DNA, 22 bp, Homo sapiens
caggacctggaatgcttgtgaa

SEQ ID NO: 10012895 - DNA, 22 bp, Homo sapiens
caggacctaactcacctgtctc

SEQ ID NO: 10012896 - DNA, 22 bp, Homo sapiens
caggacctgaagacaggcaggt

SEQ ID NO: 10012897 - DNA, 22 bp, Homo sapiens
caggaccccatattcactgaac

SEQ ID NO: 10012898 - DNA, 22 bp, Homo sapiens
cagctgttgactggtacatgaa

SEQ ID NO: 10012899 - DNA, 22 bp, Homo sapiens
cagctgttcttgggacagacag

SEQ ID NO: 10012900 - DNA, 22 bp, Homo sapiens
cagctgttgcagcactgagaga

SEQ ID NO: 10012901 - DNA, 18 bp, Homo sapiens
caggagcaggagttgaac

SEQ ID NO: 10012902 - DNA, 18 bp, Homo sapiens
caggagcaggagttgaac

SEQ ID NO: 10012903 - DNA, 22 bp, Homo sapiens
caggagcagagggtggtcagca

SEQ ID NO: 10012904 - DNA, 22 bp, Homo sapiens
caggagcagagggtggtcagca

SEQ ID NO: 10012905 - DNA, 22 bp, Homo sapiens
caggatggagggagggctgtta

SEQ ID NO: 10012906 - DNA, 22 bp, Homo sapiens
caggagcccagagtcctcagct

SEQ ID NO: 10012907 - DNA, 22 bp, Homo sapiens
caggcacacccactggtgcaga

SEQ ID NO: 10012908 - DNA, 22 bp, Homo sapiens
caggcagcctgcggtctgcaca

SEQ ID NO: 10012909 - DNA, 20 bp, Homo sapiens
caggcacactcattcctgct

SEQ ID NO: 10012910 - DNA, 22 bp, Homo sapiens
caggcacacaggctccctgggc

SEQ ID NO: 10012911 - DNA, 22 bp, Homo sapiens
caggcacacatccgtgagagat

SEQ ID NO: 10012912 - DNA, 22 bp, Homo sapiens
caggcacacatccgtgagagat

SEQ ID NO: 10012913 - DNA, 22 bp, Homo sapiens
caggatggtcagatgcattgtc

SEQ ID NO: 10012914 - DNA, 22 bp, Homo sapiens
caggcacaattatttccctttc

SEQ ID NO: 10012915 - DNA, 22 bp, Homo sapiens
caggatggccccggggctgtgc

SEQ ID NO: 10012916 - DNA, 21 bp, Homo sapiens
agcttacattaccattgttgc

SEQ ID NO: 10012917 - DNA, 22 bp, Homo sapiens
agcttagaagtgtgctgagagg

SEQ ID NO: 10012918 - DNA, 22 bp, Homo sapiens
agcttactcttcaagaacaagc

SEQ ID NO: 10012919 - DNA, 22 bp, Homo sapiens
agcttactgggcagtaaagatt

SEQ ID NO: 10012920 - DNA, 22 bp, Homo sapiens
caggcccatctgctcccaggct

SEQ ID NO: 10012921 - DNA, 22 bp, Homo sapiens
caggcccatgagggcagccaca

SEQ ID NO: 10012922 - DNA, 22 bp, Homo sapiens
agctgtctttcattacctcatt

SEQ ID NO: 10012923 - DNA, 22 bp, Homo sapiens
agctgtctgtgaacacagcatt

SEQ ID NO: 10012924 - DNA, 22 bp, Homo sapiens
agctgtctgtctcctgaggaga

SEQ ID NO: 10012925 - DNA, 22 bp, Homo sapiens
caggcccagtgatcagggctct

SEQ ID NO: 10012926 - DNA, 22 bp, Homo sapiens
caggcccagtgatcagggctct

SEQ ID NO: 10012927 - DNA, 22 bp, Homo sapiens
caggcccagtgatcagggctct

SEQ ID NO: 10012928 - DNA, 22 bp, Homo sapiens
caggctctgctgctacagctgt

SEQ ID NO: 10012929 - DNA, 22 bp, Homo sapiens
caggctctgctgctacagctgt

SEQ ID NO: 10012930 - DNA, 22 bp, Homo sapiens
agcttctagcccatccagcagg

SEQ ID NO: 10012931 - DNA, 22 bp, Homo sapiens
agcttctagcccatccagcagg

SEQ ID NO: 10012932 - DNA, 21 bp, Homo sapiens
caggctctgctagaggagcct

SEQ ID NO: 10012933 - DNA, 22 bp, Homo sapiens
agcttcccaggagaatcaggga

SEQ ID NO: 10012934 - DNA, 22 bp, Homo sapiens
agcttcctcacctcagaggtct

SEQ ID NO: 10012935 - DNA, 22 bp, Homo sapiens
agcttcctgtcttctgcacaaa

SEQ ID NO: 10012936 - DNA, 22 bp, Homo sapiens
agctgtctacctgcagagtcct

SEQ ID NO: 10012937 - DNA, 22 bp, Homo sapiens
agctgtcagtgctgtgcctgta

SEQ ID NO: 10012938 - DNA, 22 bp, Homo sapiens
agctgtcctggctcaggctgtg

SEQ ID NO: 10012939 - DNA, 22 bp, Homo sapiens
agctgtcctggctcaggctgtg

SEQ ID NO: 10012940 - DNA, 22 bp, Homo sapiens
agctgtatttgtgaatatttaa

SEQ ID NO: 10012941 - DNA, 22 bp, Homo sapiens
caggcaggtcagtgaagaagga

SEQ ID NO: 10012942 - DNA, 22 bp, Homo sapiens
caggcagtggctcacagcaacc

SEQ ID NO: 10012943 - DNA, 22 bp, Homo sapiens
caggcaggtgcagattcctctt

SEQ ID NO: 10012944 - DNA, 22 bp, Homo sapiens
caggcaggtgcagattcctctt

SEQ ID NO: 10012945 - DNA, 22 bp, Homo sapiens
caggcagtggccatgttgggag

SEQ ID NO: 10012946 - DNA, 22 bp, Homo sapiens
caggcaggtgcagattcctctt

SEQ ID NO: 10012947 - DNA, 22 bp, Homo sapiens
caggcagtgtcccaggaagcca

SEQ ID NO: 10012948 - DNA, 22 bp, Homo sapiens
caggcagtgtgacgctagggtt

SEQ ID NO: 10012949 - DNA, 22 bp, Homo sapiens
agctggtggaagggagcccaaa

SEQ ID NO: 10012950 - DNA, 22 bp, Homo sapiens
agctggttcagtttctgggcct

SEQ ID NO: 10012951 - DNA, 22 bp, Homo sapiens
caggcaggtcagtgaagaagga

SEQ ID NO: 10012952 - DNA, 22 bp, Homo sapiens
caggcagggagctggaaaggat

SEQ ID NO: 10012953 - DNA, 22 bp, Homo sapiens
caggcagggagctggaaaggat

SEQ ID NO: 10012954 - DNA, 22 bp, Homo sapiens
caggcagctcgatgccttgttg

SEQ ID NO: 10012955 - DNA, 22 bp, Homo sapiens
caggcagggagctggaaaggat

SEQ ID NO: 10012956 - DNA, 22 bp, Homo sapiens
caggcagctcaaccttgggagc

SEQ ID NO: 10012957 - DNA, 22 bp, Homo sapiens
caggcagctcaaccttgggagc

SEQ ID NO: 10012958 - DNA, 22 bp, Homo sapiens
caggcagctagatttataacaa

SEQ ID NO: 10012959 - DNA, 22 bp, Homo sapiens
caggcagcgtcctgcttcctgt

SEQ ID NO: 10012960 - DNA, 22 bp, Homo sapiens
caggcagcgctcgtggcctggc

SEQ ID NO: 10012961 - DNA, 22 bp, Homo sapiens
caggcagcctgcggtctgcaca

SEQ ID NO: 10012962 - DNA, 22 bp, Homo sapiens
caggcagcctgcggtctgcaca

SEQ ID NO: 10012963 - DNA, 22 bp, Homo sapiens
caggcagcgctcgtggcctggc

SEQ ID NO: 10012964 - DNA, 22 bp, Homo sapiens
aggaagagcattcacatggtag

SEQ ID NO: 10012965 - DNA, 22 bp, Homo sapiens
aggaagagcccgggtgacataa

SEQ ID NO: 10012966 - DNA, 22 bp, Homo sapiens
aggaagagctggaccagaggac

SEQ ID NO: 10012967 - DNA, 22 bp, Homo sapiens
aggaagagcccgggtgacataa

SEQ ID NO: 10012968 - DNA, 22 bp, Homo sapiens
aggaagagcccgggtgacataa

SEQ ID NO: 10012969 - DNA, 22 bp, Homo sapiens
aggaagagcccgggtgacataa

SEQ ID NO: 10012970 - DNA, 22 bp, Homo sapiens
aggaagagctggaccagaggac

SEQ ID NO: 10012971 - DNA, 22 bp, Homo sapiens
aggaagagctggaccagaggac

SEQ ID NO: 10012972 - DNA, 22 bp, Homo sapiens
aggaagagctggaccagaggac

SEQ ID NO: 10012973 - DNA, 22 bp, Homo sapiens
aggaagagctggaccagaggac

SEQ ID NO: 10012974 - DNA, 22 bp, Homo sapiens
aggaagagctggaccagaggac

SEQ ID NO: 10012975 - DNA, 22 bp, Homo sapiens
aggaagagctggaccagaggac

SEQ ID NO: 10012976 - DNA, 23 bp, Homo sapiens
aggaagaggcaatttctcttaga

SEQ ID NO: 10012977 - DNA, 22 bp, Homo sapiens
aggaagagggtggcagataatc

SEQ ID NO: 10012978 - DNA, 18 bp, Homo sapiens
cagggctgtggggtcact

SEQ ID NO: 10012979 - DNA, 18 bp, Homo sapiens
cagggctgtggggtcact

SEQ ID NO: 10012980 - DNA, 22 bp, Homo sapiens
aggaagaaaactaattagatgg

SEQ ID NO: 10012981 - DNA, 22 bp, Homo sapiens
aggaagaaaactaattagatgg

SEQ ID NO: 10012982 - DNA, 22 bp, Homo sapiens
aggaaaggcctcagcagaaacc

SEQ ID NO: 10012983 - DNA, 21 bp, Homo sapiens
aggaaaggccagcacgtaggg

SEQ ID NO: 10012984 - DNA, 21 bp, Homo sapiens
aggaaaggccagcacgtaggg

SEQ ID NO: 10012985 - DNA, 22 bp, Homo sapiens
aggaaaggattggcttctctgt

SEQ ID NO: 10012986 - DNA, 22 bp, Homo sapiens
aggaaaggattggcttctctgt

SEQ ID NO: 10012987 - DNA, 22 bp, Homo sapiens
aggaaaggcctcagcagaaacc

SEQ ID NO: 10012988 - DNA, 22 bp, Homo sapiens
cagggctggctgtggcaatctc

SEQ ID NO: 10012989 - DNA, 22 bp, Homo sapiens
cagggctgggttaaaagcaggg

SEQ ID NO: 10012990 - DNA, 21 bp, Homo sapiens
aggaaaggaagtccccagggt

SEQ ID NO: 10012991 - DNA, 21 bp, Homo sapiens
aggaaaggaagtccccagggt

SEQ ID NO: 10012992 - DNA, 19 bp, Homo sapiens
aggaaaggatcaaaatagc

SEQ ID NO: 10012993 - DNA, 19 bp, Homo sapiens
aggaaaggatcaaaatagc

SEQ ID NO: 10012994 - DNA, 22 bp, Homo sapiens
agctttcttctagttgtacagt

SEQ ID NO: 10012995 - DNA, 22 bp, Homo sapiens
agctttcttctagttgtacagt

SEQ ID NO: 10012996 - DNA, 19 bp, Homo sapiens
agctttgccaaaaacttag

SEQ ID NO: 10012997 - DNA, 19 bp, Homo sapiens
agctttgccaaaaacttag

SEQ ID NO: 10012998 - DNA, 22 bp, Homo sapiens
agctttgcttcttttccatagc

SEQ ID NO: 10012999 - DNA, 22 bp, Homo sapiens
agctttggatgatctttgatac

SEQ ID NO: 10013000 - DNA, 22 bp, Homo sapiens
agctttggccctggaggttact

SEQ ID NO: 10013001 - DNA, 22 bp, Homo sapiens
agctttgggattcaggcaggaa

SEQ ID NO: 10013002 - DNA, 22 bp, Homo sapiens
agctttgggcagaagaggattc

SEQ ID NO: 10013003 - DNA, 22 bp, Homo sapiens
cagggctggctgtggcaatctc

SEQ ID NO: 10013004 - DNA, 22 bp, Homo sapiens
cagggctggctgtggcaatctc

SEQ ID NO: 10013005 - DNA, 22 bp, Homo sapiens
cagggctggctcatgaaaagtt

SEQ ID NO: 10013006 - DNA, 22 bp, Homo sapiens
caggctgaagtgcagtggtgtg

SEQ ID NO: 10013007 - DNA, 22 bp, Homo sapiens
caggctcttttggtggcaagga

SEQ ID NO: 10013008 - DNA, 22 bp, Homo sapiens
caggctcttccatcctgctgag

SEQ ID NO: 10013009 - DNA, 22 bp, Homo sapiens
caggctcttccatcctgctgag

SEQ ID NO: 10013010 - DNA, 22 bp, Homo sapiens
cagggatgtgatgagctgagcc

SEQ ID NO: 10013011 - DNA, 22 bp, Homo sapiens
cagggcaggatgctgtgattat

SEQ ID NO: 10013012 - DNA, 22 bp, Homo sapiens
cagggcagggatgttgcggcag

SEQ ID NO: 10013013 - DNA, 22 bp, Homo sapiens
cagggcaggatgctgtgattat

SEQ ID NO: 10013014 - DNA, 22 bp, Homo sapiens
cagggcagggagcttagaatga

SEQ ID NO: 10013015 - DNA, 22 bp, Homo sapiens
cagggcagggccacaccccctg

SEQ ID NO: 10013016 - DNA, 22 bp, Homo sapiens
cagggcagtaacgggaacatct

SEQ ID NO: 10013017 - DNA, 22 bp, Homo sapiens
cagtaactgatgtgatcaaacg

SEQ ID NO: 10013018 - DNA, 22 bp, Homo sapiens
cagtaagaatatgaatcaggat

SEQ ID NO: 10013019 - DNA, 20 bp, Homo sapiens
cagtatctgaagccacacaa

SEQ ID NO: 10013020 - DNA, 22 bp, Homo sapiens
cagtaataacacagaaagtttg

SEQ ID NO: 10013021 - DNA, 22 bp, Homo sapiens
cagtatcttgcttatagacaca

SEQ ID NO: 10013022 - DNA, 22 bp, Homo sapiens
cagtatgtactcttatcatgta

SEQ ID NO: 10013023 - DNA, 22 bp, Homo sapiens
cagtatgtactcttatcatgta

SEQ ID NO: 10013024 - DNA, 22 bp, Homo sapiens
cagtatgtctactggacaaagt

SEQ ID NO: 10013025 - DNA, 22 bp, Homo sapiens
cagtatgtttgggagacatgac

SEQ ID NO: 10013026 - DNA, 22 bp, Homo sapiens
cagtaaatgagaagctagtaat

SEQ ID NO: 10013027 - DNA, 22 bp, Homo sapiens
cagtaacacaaccactccgtga

SEQ ID NO: 10013028 - DNA, 22 bp, Homo sapiens
cagtaacagtgatcacctgtgg

SEQ ID NO: 10013029 - DNA, 22 bp, Homo sapiens
cagtaacatgaagagacatgga

SEQ ID NO: 10013030 - DNA, 22 bp, Homo sapiens
cagtaacagtgatcacctgtgg

SEQ ID NO: 10013031 - DNA, 22 bp, Homo sapiens
cagtaacatgaagagacatgga

SEQ ID NO: 10013032 - DNA, 22 bp, Homo sapiens
cagtaacaggctctgtggtata

SEQ ID NO: 10013033 - DNA, 22 bp, Homo sapiens
cagtaacaggctctgtggtata

SEQ ID NO: 10013034 - DNA, 22 bp, Homo sapiens
cagtaacatgaagagacatgga

SEQ ID NO: 10013035 - DNA, 22 bp, Homo sapiens
cagtaacatgtctgttaagaaa

SEQ ID NO: 10013036 - DNA, 22 bp, Homo sapiens
cagtaactaggacaaggaggaa

SEQ ID NO: 10013037 - DNA, 22 bp, Homo sapiens
cagtaacatttcaaggtagagg

SEQ ID NO: 10013038 - DNA, 22 bp, Homo sapiens
aggacagagggaccagagccca

SEQ ID NO: 10013039 - DNA, 22 bp, Homo sapiens
aggacagagggaccagagccca

SEQ ID NO: 10013040 - DNA, 22 bp, Homo sapiens
aggacagagggaccagagccca

SEQ ID NO: 10013041 - DNA, 22 bp, Homo sapiens
cagtaaacactagcattcttgg

SEQ ID NO: 10013042 - DNA, 22 bp, Homo sapiens
cagtaaacagttactaagaaga

SEQ ID NO: 10013043 - DNA, 22 bp, Homo sapiens
aggaagtggataaaatagcttt

SEQ ID NO: 10013044 - DNA, 21 bp, Homo sapiens
aggaagtggccagattgggaa

SEQ ID NO: 10013045 - DNA, 22 bp, Homo sapiens
aggaagtgctaagagaacatca

SEQ ID NO: 10013046 - DNA, 22 bp, Homo sapiens
aggaagtgaaagggaaggagtt

SEQ ID NO: 10013047 - DNA, 20 bp, Homo sapiens
aggaagtgatgttttatctg

SEQ ID NO: 10013048 - DNA, 22 bp, Homo sapiens
caggtgtctaattctcaccccc

SEQ ID NO: 10013049 - DNA, 22 bp, Homo sapiens
aggaagtgaaagggaaggagtt

SEQ ID NO: 10013050 - DNA, 22 bp, Homo sapiens
caggtgtcaaaatactaagtgg

SEQ ID NO: 10013051 - DNA, 22 bp, Homo sapiens
caggtgggccatgaaaaatgac

SEQ ID NO: 10013052 - DNA, 22 bp, Homo sapiens
cagggcttcgatggatggatgg

SEQ ID NO: 10013053 - DNA, 22 bp, Homo sapiens
aggacagacctaggactggagc

SEQ ID NO: 10013054 - DNA, 22 bp, Homo sapiens
aggaagtgggaagggtctgcca

SEQ ID NO: 10013055 - DNA, 23 bp, Homo sapiens
aggaagttaaggcagacagacag

SEQ ID NO: 10013056 - DNA, 22 bp, Homo sapiens
aggacaagacaaggaccagaga

SEQ ID NO: 10013057 - DNA, 22 bp, Homo sapiens
aggaatctgtggttttaacagg

SEQ ID NO: 10013058 - DNA, 22 bp, Homo sapiens
aggaatgaactcgagtgatctg

SEQ ID NO: 10013059 - DNA, 22 bp, Homo sapiens
aggacaagacaaggaccagaga

SEQ ID NO: 10013060 - DNA, 23 bp, Homo sapiens
cctcagggtctagcagagagaag

SEQ ID NO: 10013061 - DNA, 22 bp, Homo sapiens
cctcagggtctgaggagaccgt

SEQ ID NO: 10013062 - DNA, 22 bp, Homo sapiens
cctcaggggtcactgtgaggag

SEQ ID NO: 10013063 - DNA, 18 bp, Homo sapiens
cctcaggggacctggcag

SEQ ID NO: 10013064 - DNA, 22 bp, Homo sapiens
cctactctgagcgcctccgcat

SEQ ID NO: 10013065 - DNA, 22 bp, Homo sapiens
cctagaacacaacctatattag

SEQ ID NO: 10013066 - DNA, 22 bp, Homo sapiens
agggctgacagtggcgtggcgt

SEQ ID NO: 10013067 - DNA, 22 bp, Homo sapiens
agggctgacctaagctccactt

SEQ ID NO: 10013068 - DNA, 22 bp, Homo sapiens
cctacagttatattcttgattg

SEQ ID NO: 10013069 - DNA, 22 bp, Homo sapiens
agggctgagcccaggcatgtag

SEQ ID NO: 10013070 - DNA, 22 bp, Homo sapiens
agggctgagcccaggcatgtag

SEQ ID NO: 10013071 - DNA, 22 bp, Homo sapiens
cctcagggaggcctctgtggct

SEQ ID NO: 10013072 - DNA, 22 bp, Homo sapiens
cctcagggaggcctctgtggct

SEQ ID NO: 10013073 - DNA, 18 bp, Homo sapiens
cctcagggagatccagtg

SEQ ID NO: 10013074 - DNA, 20 bp, Homo sapiens
agggctgagaagggactagc

SEQ ID NO: 10013075 - DNA, 20 bp, Homo sapiens
agggctgagaagggactagc

SEQ ID NO: 10013076 - DNA, 22 bp, Homo sapiens
agggctgagactaaggccagat

SEQ ID NO: 10013077 - DNA, 22 bp, Homo sapiens
agggctgagactaaggccagat

SEQ ID NO: 10013078 - DNA, 22 bp, Homo sapiens
cctaattatctcccaaagatcc

SEQ ID NO: 10013079 - DNA, 22 bp, Homo sapiens
cctacacatctcacctcacagg

SEQ ID NO: 10013080 - DNA, 22 bp, Homo sapiens
cctacaggaaattgtatcaaaa

SEQ ID NO: 10013081 - DNA, 22 bp, Homo sapiens
cctacaggaaattgtatcaaaa

SEQ ID NO: 10013082 - DNA, 22 bp, Homo sapiens
agggcctgtgcttcctgagata

SEQ ID NO: 10013083 - DNA, 22 bp, Homo sapiens
agggcctgtgcttcctgagata

SEQ ID NO: 10013084 - DNA, 22 bp, Homo sapiens
agggcctgtgctgagtagacga

SEQ ID NO: 10013085 - DNA, 21 bp, Homo sapiens
agggcctgtgctctccaggtc

SEQ ID NO: 10013086 - DNA, 22 bp, Homo sapiens
ccctggccagctcatgtctgag

SEQ ID NO: 10013087 - DNA, 22 bp, Homo sapiens
agggcctggcttcactttctca

SEQ ID NO: 10013088 - DNA, 22 bp, Homo sapiens
agggcccatagatcgtcagctt

SEQ ID NO: 10013089 - DNA, 22 bp, Homo sapiens
cctctgtgtgtgcatgcatgcg

SEQ ID NO: 10013090 - DNA, 22 bp, Homo sapiens
cctctgtgtcctggtcattgaa

SEQ ID NO: 10013091 - DNA, 22 bp, Homo sapiens
cctctgtgtcctggtcattgaa

SEQ ID NO: 10013092 - DNA, 20 bp, Homo sapiens
cctctgtgtcctgtgtcata

SEQ ID NO: 10013093 - DNA, 22 bp, Homo sapiens
aggggggtggatcacctgaggt

SEQ ID NO: 10013094 - DNA, 22 bp, Homo sapiens
agggggtgaatgtctgtctaca

SEQ ID NO: 10013095 - DNA, 17 bp, Homo sapiens
agggggaacctgggagg

SEQ ID NO: 10013096 - DNA, 22 bp, Homo sapiens
agggggctccttggtgtgcaga

SEQ ID NO: 10013097 - DNA, 22 bp, Homo sapiens
agggggctcctccggtgcttcc

SEQ ID NO: 10013098 - DNA, 22 bp, Homo sapiens
agggggctgccaaggaatgtaa

SEQ ID NO: 10013099 - DNA, 22 bp, Homo sapiens
agggggctgccaaggaatgtaa

SEQ ID NO: 10013100 - DNA, 22 bp, Homo sapiens
agggggtgtctctgattgggtt

SEQ ID NO: 10013101 - DNA, 22 bp, Homo sapiens
agggggtgtctctgattgggtt

SEQ ID NO: 10013102 - DNA, 22 bp, Homo sapiens
agggggtgggaagtctagaatc

SEQ ID NO: 10013103 - DNA, 22 bp, Homo sapiens
agggggtgcatttgtgaatgaa

SEQ ID NO: 10013104 - DNA, 22 bp, Homo sapiens
agggggtgcatttgtgaatgaa

SEQ ID NO: 10013105 - DNA, 22 bp, Homo sapiens
agggggtgcccagatgaaggat

SEQ ID NO: 10013106 - DNA, 22 bp, Homo sapiens
cctgagtctgtgttttcctaag

SEQ ID NO: 10013107 - DNA, 22 bp, Homo sapiens
aggggtcagtgaccattgagga

SEQ ID NO: 10013108 - DNA, 22 bp, Homo sapiens
aggggtctatcctgagatggtc

SEQ ID NO: 10013109 - DNA, 22 bp, Homo sapiens
aggggcgaggggagccgtgcca

SEQ ID NO: 10013110 - DNA, 22 bp, Homo sapiens
aggggcctggttggcctctgtt

SEQ ID NO: 10013111 - DNA, 22 bp, Homo sapiens
aggggctctgagtgggccagga

SEQ ID NO: 10013112 - DNA, 22 bp, Homo sapiens
cctccttcctgggacagagctg

SEQ ID NO: 10013113 - DNA, 22 bp, Homo sapiens
cctccttcctgggacagagctg

SEQ ID NO: 10013114 - DNA, 22 bp, Homo sapiens
cctccttctggggccttctgct

SEQ ID NO: 10013115 - DNA, 22 bp, Homo sapiens
cctcctggtgggcgcttctggc

SEQ ID NO: 10013116 - DNA, 22 bp, Homo sapiens
cctcctggtgggcgcttctggc

SEQ ID NO: 10013117 - DNA, 22 bp, Homo sapiens
aggggaatgggtagactgttga

SEQ ID NO: 10013118 - DNA, 22 bp, Homo sapiens
cctcctggtgacaaggcaaagc

SEQ ID NO: 10013119 - DNA, 22 bp, Homo sapiens
aggggaaggccagcctgtagag

SEQ ID NO: 10013120 - DNA, 21 bp, Homo sapiens
aggggaagtagagttttgatt

SEQ ID NO: 10013121 - DNA, 22 bp, Homo sapiens
aggggaaatgccttggtggtac

SEQ ID NO: 10013122 - DNA, 22 bp, Homo sapiens
aggggaagagccctttacatgg

SEQ ID NO: 10013123 - DNA, 22 bp, Homo sapiens
aggggaaggccagcctgtagag

SEQ ID NO: 10013124 - DNA, 22 bp, Homo sapiens
aggggaagattatacttttgaa

SEQ ID NO: 10013125 - DNA, 22 bp, Homo sapiens
aggggaaggccagcctgtagag

SEQ ID NO: 10013126 - DNA, 22 bp, Homo sapiens
aggcttggctctcctatgagaa

SEQ ID NO: 10013127 - DNA, 22 bp, Homo sapiens
cccagatgcaggttcaagagta

SEQ ID NO: 10013128 - DNA, 22 bp, Homo sapiens
aggctttgcaaaaaagctcata

SEQ ID NO: 10013129 - DNA, 22 bp, Homo sapiens
aggctttgcaaaaaagctcata

SEQ ID NO: 10013130 - DNA, 22 bp, Homo sapiens
aggctttcctgtcactcatgct

SEQ ID NO: 10013131 - DNA, 20 bp, Homo sapiens
cccagaggttgcggcaggag

SEQ ID NO: 10013132 - DNA, 22 bp, Homo sapiens
cccagagttcaaaccctgcgtc

SEQ ID NO: 10013133 - DNA, 22 bp, Homo sapiens
agggaaaggctgatgctgtggg

SEQ ID NO: 10013134 - DNA, 21 bp, Homo sapiens
agggaaagaaaatgagctaat

SEQ ID NO: 10013135 - DNA, 21 bp, Homo sapiens
agggaaaaggctgagtgaggg

SEQ ID NO: 10013136 - DNA, 22 bp, Homo sapiens
cccaggaactccagagctcctc

SEQ ID NO: 10013137 - DNA, 22 bp, Homo sapiens
agggaaaggtagtgaggtcaca

SEQ ID NO: 10013138 - DNA, 22 bp, Homo sapiens
agggaaagtaagcatttcatta

SEQ ID NO: 10013139 - DNA, 22 bp, Homo sapiens
cccaggcatcccattaaggagc

SEQ ID NO: 10013140 - DNA, 22 bp, Homo sapiens
cccaggcatcccattaaggagc

SEQ ID NO: 10013141 - DNA, 22 bp, Homo sapiens
agggactatttacccatctcac

SEQ ID NO: 10013142 - DNA, 22 bp, Homo sapiens
cccaggccagaacttggttgct

SEQ ID NO: 10013143 - DNA, 22 bp, Homo sapiens
cccaggccagaacttggttgct

SEQ ID NO: 10013144 - DNA, 22 bp, Homo sapiens
cccaggccccagggcttgtcag

SEQ ID NO: 10013145 - DNA, 22 bp, Homo sapiens
agggaccttgatgggtttggga

SEQ ID NO: 10013146 - DNA, 22 bp, Homo sapiens
agggacagtctactgttcactg

SEQ ID NO: 10013147 - DNA, 22 bp, Homo sapiens
agggacagtctactgttcactg

SEQ ID NO: 10013148 - DNA, 22 bp, Homo sapiens
agggacagtctactgttcactg

SEQ ID NO: 10013149 - DNA, 22 bp, Homo sapiens
agggaatggatgatggcaggtt

SEQ ID NO: 10013150 - DNA, 22 bp, Homo sapiens
agggaccaatcaccgacaggct

SEQ ID NO: 10013151 - DNA, 22 bp, Homo sapiens
agggacagttacatcatcagac

SEQ ID NO: 10013152 - DNA, 22 bp, Homo sapiens
cccaggccccagggcttgtcag

SEQ ID NO: 10013153 - DNA, 22 bp, Homo sapiens
cccaggccccagggcttgtcag

SEQ ID NO: 10013154 - DNA, 22 bp, Homo sapiens
cccaggccctggcagagcttgt

SEQ ID NO: 10013155 - DNA, 17 bp, Homo sapiens
cccaggccgccgggagc

SEQ ID NO: 10013156 - DNA, 22 bp, Homo sapiens
cccaggcctggtctgggccagt

SEQ ID NO: 10013157 - DNA, 22 bp, Homo sapiens
cccaggcctggtctgggccagt

SEQ ID NO: 10013158 - DNA, 22 bp, Homo sapiens
cccaggcctggtctgggccagt

SEQ ID NO: 10013159 - DNA, 22 bp, Homo sapiens
agggagccttcctggctgtggt

SEQ ID NO: 10013160 - DNA, 22 bp, Homo sapiens
agggagctgggccacactgatc

SEQ ID NO: 10013161 - DNA, 22 bp, Homo sapiens
agggagctgggccacactgatc

SEQ ID NO: 10013162 - DNA, 22 bp, Homo sapiens
agggagctgagctgtgagcagc

SEQ ID NO: 10013163 - DNA, 22 bp, Homo sapiens
agggagctgtggtcagctcagt

SEQ ID NO: 10013164 - DNA, 22 bp, Homo sapiens
agggagcttctacttcaaggca

SEQ ID NO: 10013165 - DNA, 22 bp, Homo sapiens
agggcatgtgggagaggagcct

SEQ ID NO: 10013166 - DNA, 19 bp, Homo sapiens
ccccttaggggttaagcct

SEQ ID NO: 10013167 - DNA, 22 bp, Homo sapiens
cccctgtgttgttcaagggtca

SEQ ID NO: 10013168 - DNA, 20 bp, Homo sapiens
ccccttcatctacagcctga

SEQ ID NO: 10013169 - DNA, 22 bp, Homo sapiens
agggcagctgtgagccactgtg

SEQ ID NO: 10013170 - DNA, 22 bp, Homo sapiens
agggccaagtccaggacctcgg

SEQ ID NO: 10013171 - DNA, 22 bp, Homo sapiens
agggccacagtggggcctgaga

SEQ ID NO: 10013172 - DNA, 22 bp, Homo sapiens
agggccaccagagcagggcagt

SEQ ID NO: 10013173 - DNA, 22 bp, Homo sapiens
ccctgaggatagggcaggaccc

SEQ ID NO: 10013174 - DNA, 22 bp, Homo sapiens
agggccacctctctgggttccc

SEQ ID NO: 10013175 - DNA, 22 bp, Homo sapiens
ccctgaggcagtaggagctttt

SEQ ID NO: 10013176 - DNA, 22 bp, Homo sapiens
ccctgaggcctcaggttcattg

SEQ ID NO: 10013177 - DNA, 22 bp, Homo sapiens
ccctgaggggagtggtgaggtg

SEQ ID NO: 10013178 - DNA, 22 bp, Homo sapiens
ccctgaggctgaggataggtgg

SEQ ID NO: 10013179 - DNA, 22 bp, Homo sapiens
ccctgatagcccctatcatcag

SEQ ID NO: 10013180 - DNA, 22 bp, Homo sapiens
ccctgagttagtacagttgagt

SEQ ID NO: 10013181 - DNA, 22 bp, Homo sapiens
ccctgagtcatcattgcggaag

SEQ ID NO: 10013182 - DNA, 22 bp, Homo sapiens
ccctgaggggagtggtgaggtg

SEQ ID NO: 10013183 - DNA, 22 bp, Homo sapiens
agggcccaggacagcatcaggg

SEQ ID NO: 10013184 - DNA, 23 bp, Homo sapiens
agggccaggtgcggaaacagctc

SEQ ID NO: 10013185 - DNA, 23 bp, Homo sapiens
agggcccaagcctggacagcagg

SEQ ID NO: 10013186 - DNA, 22 bp, Homo sapiens
ccctgatgacacgggcatcagg

SEQ ID NO: 10013187 - DNA, 22 bp, Homo sapiens
agggcagactaggatggaagtg

SEQ ID NO: 10013188 - DNA, 22 bp, Homo sapiens
agggcagaccacgtgcaaggat

SEQ ID NO: 10013189 - DNA, 22 bp, Homo sapiens
agggcagaccacgtgcaaggat

SEQ ID NO: 10013190 - DNA, 22 bp, Homo sapiens
agggcagaccacgtgcaaggat

SEQ ID NO: 10013191 - DNA, 22 bp, Homo sapiens
agggcagaagtacagacactta

SEQ ID NO: 10013192 - DNA, 22 bp, Homo sapiens
cccctgctggcctgctggtttc

SEQ ID NO: 10013193 - DNA, 22 bp, Homo sapiens
agggatggtggaggttgcaagt

SEQ ID NO: 10013194 - DNA, 22 bp, Homo sapiens
agggcagaaaccaccttgatgg

SEQ ID NO: 10013195 - DNA, 21 bp, Homo sapiens
agggagctttaggtagaagtt

SEQ ID NO: 10013196 - DNA, 21 bp, Homo sapiens
agggagctttaggtagaagtt

SEQ ID NO: 10013197 - DNA, 22 bp, Homo sapiens
cccaggtctgtgccagctctga

SEQ ID NO: 10013198 - DNA, 22 bp, Homo sapiens
cccaggtctgtgccagctctga

SEQ ID NO: 10013199 - DNA, 22 bp, Homo sapiens
cccaggtgggttggcctctgtc

SEQ ID NO: 10013200 - DNA, 22 bp, Homo sapiens
aggctgccaaagcttctgtctc

SEQ ID NO: 10013201 - DNA, 22 bp, Homo sapiens
aggctgccagaagccttcagga

SEQ ID NO: 10013202 - DNA, 22 bp, Homo sapiens
aggctgcaggtctgggtcatgt

SEQ ID NO: 10013203 - DNA, 22 bp, Homo sapiens
aggctgcagtgcaggtaggatt

SEQ ID NO: 10013204 - DNA, 23 bp, Homo sapiens
aggctgcagaagaatagggtcat

SEQ ID NO: 10013205 - DNA, 23 bp, Homo sapiens
aggctgcagaagaatagggtcat

SEQ ID NO: 10013206 - DNA, 22 bp, Homo sapiens
aggctgagtcgggaggatcact

SEQ ID NO: 10013207 - DNA, 22 bp, Homo sapiens
aggctgcagaggtgctgccaga

SEQ ID NO: 10013208 - DNA, 22 bp, Homo sapiens
ccagtgggtaggccatggtgag

SEQ ID NO: 10013209 - DNA, 19 bp, Homo sapiens
aggctgcccagtctctgcc

SEQ ID NO: 10013210 - DNA, 22 bp, Homo sapiens
aggctgccctgccgccagtggg

SEQ ID NO: 10013211 - DNA, 19 bp, Homo sapiens
aggctgcccagtctctgcc

SEQ ID NO: 10013212 - DNA, 20 bp, Homo sapiens
aggctgccaggtctcacatc

SEQ ID NO: 10013213 - DNA, 20 bp, Homo sapiens
aggctgccaggtctcacatc

SEQ ID NO: 10013214 - DNA, 22 bp, Homo sapiens
cccacacacatttatgatagga

SEQ ID NO: 10013215 - DNA, 22 bp, Homo sapiens
cccaatttcttcctcatttgcc

SEQ ID NO: 10013216 - DNA, 22 bp, Homo sapiens
cccacacaaatcatggggagaa

SEQ ID NO: 10013217 - DNA, 18 bp, Homo sapiens
cccacacagcagtagctc

SEQ ID NO: 10013218 - DNA, 18 bp, Homo sapiens
cccacacagcagtagctc

SEQ ID NO: 10013219 - DNA, 22 bp, Homo sapiens
cccacacatttttcacttaccg

SEQ ID NO: 10013220 - DNA, 22 bp, Homo sapiens
ccattttgtctcctgaaatcta

SEQ ID NO: 10013221 - DNA, 22 bp, Homo sapiens
ccattttgtctgacttcttgct

SEQ ID NO: 10013222 - DNA, 22 bp, Homo sapiens
ccattttgtctcctgaaatcta

SEQ ID NO: 10013223 - DNA, 22 bp, Homo sapiens
ccattttattagtgacatttag

SEQ ID NO: 10013224 - DNA, 22 bp, Homo sapiens
ccattttattagtgacatttag

SEQ ID NO: 10013225 - DNA, 22 bp, Homo sapiens
ccagtgtgaccatctgttagct

SEQ ID NO: 10013226 - DNA, 22 bp, Homo sapiens
cccactcctggagctagggctc

SEQ ID NO: 10013227 - DNA, 22 bp, Homo sapiens
cccactccctgcacgcctgccg

SEQ ID NO: 10013228 - DNA, 22 bp, Homo sapiens
cccactctggctcccttctagt

SEQ ID NO: 10013229 - DNA, 22 bp, Homo sapiens
aggctgtgacagggtcatggag

SEQ ID NO: 10013230 - DNA, 22 bp, Homo sapiens
aggctgtgacagggtcatggag

SEQ ID NO: 10013231 - DNA, 22 bp, Homo sapiens
aggctgtgacagggtcatggag

SEQ ID NO: 10013232 - DNA, 22 bp, Homo sapiens
aggctgtgactacgcagggaag

SEQ ID NO: 10013233 - DNA, 22 bp, Homo sapiens
aggctgtgactacgcagggaag

SEQ ID NO: 10013234 - DNA, 22 bp, Homo sapiens
aggctgtgcacagggcacctgc

SEQ ID NO: 10013235 - DNA, 22 bp, Homo sapiens
aggctgtgcattttggagggcc

SEQ ID NO: 10013236 - DNA, 22 bp, Homo sapiens
aggctgtgcattttggagggcc

SEQ ID NO: 10013237 - DNA, 22 bp, Homo sapiens
cccacgtcgaacttgctccaga

SEQ ID NO: 10013238 - DNA, 22 bp, Homo sapiens
cccactccctgcacgcctgccg

SEQ ID NO: 10013239 - DNA, 22 bp, Homo sapiens
cccactccctacgacacgctcc

SEQ ID NO: 10013240 - DNA, 22 bp, Homo sapiens
cccagaggtgaaggaggtggga

SEQ ID NO: 10013241 - DNA, 22 bp, Homo sapiens
cccagaggtgacatcccattct

SEQ ID NO: 10013242 - DNA, 22 bp, Homo sapiens
aggctgtggtgctgaaggaggg

SEQ ID NO: 10013243 - DNA, 22 bp, Homo sapiens
aggctgtgggtgatttactgtg

SEQ ID NO: 10013244 - DNA, 22 bp, Homo sapiens
aggctgtggtgctgaaggaggg

SEQ ID NO: 10013245 - DNA, 22 bp, Homo sapiens
cccagaggtgcttcagaggtgc

SEQ ID NO: 10013246 - DNA, 22 bp, Homo sapiens
cccagaggtgcttcagaggtgc

SEQ ID NO: 10013247 - DNA, 22 bp, Homo sapiens
cccagaggttccttagggacca

SEQ ID NO: 10013248 - DNA, 20 bp, Homo sapiens
cccagaggttgcggcaggag

SEQ ID NO: 10013249 - DNA, 22 bp, Homo sapiens
aggctgtggccctggtctagca

SEQ ID NO: 10013250 - DNA, 22 bp, Homo sapiens
aggctgtgggaatggctgcttg

SEQ ID NO: 10013251 - DNA, 22 bp, Homo sapiens
aggctgtgggaatggctgcttg

SEQ ID NO: 10013252 - DNA, 22 bp, Homo sapiens
aggctgtgggacagttaggaga

SEQ ID NO: 10013253 - DNA, 22 bp, Homo sapiens
aggctgtgggagttgagagtct

SEQ ID NO: 10013254 - DNA, 22 bp, Homo sapiens
aggctgtggccctggtctagca

SEQ ID NO: 10013255 - DNA, 22 bp, Homo sapiens
aggctgtggcatcacatcagga

SEQ ID NO: 10013256 - DNA, 22 bp, Homo sapiens
aggctgtgcgaggtctcagagt

SEQ ID NO: 10013257 - DNA, 22 bp, Homo sapiens
ccaggcctttcttcttggtctg

SEQ ID NO: 10013258 - DNA, 22 bp, Homo sapiens
aggctcagatccttgtgtcctg

SEQ ID NO: 10013259 - DNA, 22 bp, Homo sapiens
ccaggccttctgaggacactct

SEQ ID NO: 10013260 - DNA, 22 bp, Homo sapiens
ccaggcctgtgttgtgtggagg

SEQ ID NO: 10013261 - DNA, 22 bp, Homo sapiens
ccaggcctgtgcaaggagggag

SEQ ID NO: 10013262 - DNA, 20 bp, Homo sapiens
ccaggcctgggcctgctcta

SEQ ID NO: 10013263 - DNA, 20 bp, Homo sapiens
ccaggcctgggcctgctcta

SEQ ID NO: 10013264 - DNA, 22 bp, Homo sapiens
aggctctgggaagcagtgagtt

SEQ ID NO: 10013265 - DNA, 22 bp, Homo sapiens
aggctctggttcatcatgatgg

SEQ ID NO: 10013266 - DNA, 22 bp, Homo sapiens
aggctctgggaagcagtgagtt

SEQ ID NO: 10013267 - DNA, 22 bp, Homo sapiens
aggctctgcttttctggatata

SEQ ID NO: 10013268 - DNA, 22 bp, Homo sapiens
aggctcagcccctgggaggaga

SEQ ID NO: 10013269 - DNA, 22 bp, Homo sapiens
aggctcagcccctgggaggaga

SEQ ID NO: 10013270 - DNA, 21 bp, Homo sapiens
aggctcagcaggtgtataaag

SEQ ID NO: 10013271 - DNA, 22 bp, Homo sapiens
aggctcagcccaaggtggagag

SEQ ID NO: 10013272 - DNA, 22 bp, Homo sapiens
ccagtaacacctcgcagactcc

SEQ ID NO: 10013273 - DNA, 22 bp, Homo sapiens
ccagtacttgctacctcaattg

SEQ ID NO: 10013274 - DNA, 22 bp, Homo sapiens
ccaggttcaaatagctgtgtga

SEQ ID NO: 10013275 - DNA, 22 bp, Homo sapiens
ccagtagttggacaaatagatt

SEQ ID NO: 10013276 - DNA, 19 bp, Homo sapiens
ccagtagagacagctgcag

SEQ ID NO: 10013277 - DNA, 19 bp, Homo sapiens
ccagtagagacagctgcag

SEQ ID NO: 10013278 - DNA, 22 bp, Homo sapiens
ccagtactttgtgcaacaaatg

SEQ ID NO: 10013279 - DNA, 22 bp, Homo sapiens
aggctgagtgctcccctagatg

SEQ ID NO: 10013280 - DNA, 20 bp, Homo sapiens
ccaggtggtgcctggagagg

SEQ ID NO: 10013281 - DNA, 20 bp, Homo sapiens
ccaggtggtgcctggagagg

SEQ ID NO: 10013282 - DNA, 18 bp, Homo sapiens
ccaggtggtgacagagat

SEQ ID NO: 10013283 - DNA, 18 bp, Homo sapiens
ccaggtggtgacagagat

SEQ ID NO: 10013284 - DNA, 20 bp, Homo sapiens
ccaggtggtgcctggagagg

SEQ ID NO: 10013285 - DNA, 22 bp, Homo sapiens
ccagggcagaaaaagagggaat

SEQ ID NO: 10013286 - DNA, 22 bp, Homo sapiens
ccagggcacttaggcccagccc

SEQ ID NO: 10013287 - DNA, 22 bp, Homo sapiens
ccagggcacttaggcccagccc

SEQ ID NO: 10013288 - DNA, 22 bp, Homo sapiens
ccaggtgcaaactcccagcagg

SEQ ID NO: 10013289 - DNA, 22 bp, Homo sapiens
ccaggtgcaaactcccagcagg

SEQ ID NO: 10013290 - DNA, 22 bp, Homo sapiens
ccagggcagccaacccagatgc

SEQ ID NO: 10013291 - DNA, 22 bp, Homo sapiens
ccagggcagaaaaagagggaat

SEQ ID NO: 10013292 - DNA, 22 bp, Homo sapiens
ccagggcagcagaattggggca

SEQ ID NO: 10013293 - DNA, 23 bp, Homo sapiens
ccagctcccaggtctgaggactg

SEQ ID NO: 10013294 - DNA, 23 bp, Homo sapiens
ccagctcccaggtctgaggactg

SEQ ID NO: 10013295 - DNA, 22 bp, Homo sapiens
ccagctcccctcagcaggtaat

SEQ ID NO: 10013296 - DNA, 22 bp, Homo sapiens
ccagctccctgaagcctggtct

SEQ ID NO: 10013297 - DNA, 22 bp, Homo sapiens
ccagctccgggagttgctgctg

SEQ ID NO: 10013298 - DNA, 22 bp, Homo sapiens
ccagctccctgaagcctggtct

SEQ ID NO: 10013299 - DNA, 22 bp, Homo sapiens
aggccctggacactcaagccgg

SEQ ID NO: 10013300 - DNA, 22 bp, Homo sapiens
aggccctgctttccagagctca

SEQ ID NO: 10013301 - DNA, 21 bp, Homo sapiens
aggccctggaggtcagagaaa

SEQ ID NO: 10013302 - DNA, 22 bp, Homo sapiens
ccagctccaggtagatgggcag

SEQ ID NO: 10013303 - DNA, 22 bp, Homo sapiens
ccaggaggggtctctgtctccc

SEQ ID NO: 10013304 - DNA, 22 bp, Homo sapiens
ccaggagggtggttactcaatc

SEQ ID NO: 10013305 - DNA, 22 bp, Homo sapiens
ccaggaggttgaggctgcagtg

SEQ ID NO: 10013306 - DNA, 22 bp, Homo sapiens
ccaggaggtggcaggacttgcc

SEQ ID NO: 10013307 - DNA, 22 bp, Homo sapiens
ccaggaggtggaggttgcggtg

SEQ ID NO: 10013308 - DNA, 22 bp, Homo sapiens
ccaggaggtggagattgcagtg

SEQ ID NO: 10013309 - DNA, 22 bp, Homo sapiens
ccaggaggtggagattgcagtg

SEQ ID NO: 10013310 - DNA, 20 bp, Homo sapiens
aggctcagatacccagggaa

SEQ ID NO: 10013311 - DNA, 22 bp, Homo sapiens
ccaggcacaggtgggcctcaga

SEQ ID NO: 10013312 - DNA, 22 bp, Homo sapiens
aggctcagagatgagtaagcac

SEQ ID NO: 10013313 - DNA, 21 bp, Homo sapiens
aggctcagagatcaaacagta

SEQ ID NO: 10013314 - DNA, 22 bp, Homo sapiens
aggctcagagagctgtgtccat

SEQ ID NO: 10013315 - DNA, 22 bp, Homo sapiens
aggcctggtgtgccggatgcag

SEQ ID NO: 10013316 - DNA, 22 bp, Homo sapiens
aggcctggtgtgccggatgcag

SEQ ID NO: 10013317 - DNA, 22 bp, Homo sapiens
aggcctgggtgttcaccagaag

SEQ ID NO: 10013318 - DNA, 22 bp, Homo sapiens
aggcctggtgaatgaagtatct

SEQ ID NO: 10013319 - DNA, 22 bp, Homo sapiens
aggcctggtgtgccggatgcag

SEQ ID NO: 10013320 - DNA, 22 bp, Homo sapiens
aggcctgggcaagaaggggcgt

SEQ ID NO: 10013321 - DNA, 22 bp, Homo sapiens
aggcctgggtctcgtgcctacc

SEQ ID NO: 10013322 - DNA, 19 bp, Homo sapiens
aggcctggggttttgcact

SEQ ID NO: 10013323 - DNA, 22 bp, Homo sapiens
ccagagtctatgagtcctcatt

SEQ ID NO: 10013324 - DNA, 22 bp, Homo sapiens
ccagcaggcagtcatatccttt

SEQ ID NO: 10013325 - DNA, 22 bp, Homo sapiens
ccagagtctatgagtcctcatt

SEQ ID NO: 10013326 - DNA, 22 bp, Homo sapiens
ccagagtccctgttctcggcct

SEQ ID NO: 10013327 - DNA, 22 bp, Homo sapiens
ccagagtcccttgcagctcagt

SEQ ID NO: 10013328 - DNA, 22 bp, Homo sapiens
ccagagtcccttgcagctcagt

SEQ ID NO: 10013329 - DNA, 22 bp, Homo sapiens
ccagccaggcattgcaaactga

SEQ ID NO: 10013330 - DNA, 22 bp, Homo sapiens
ccagccaggctggctgtggagg

SEQ ID NO: 10013331 - DNA, 22 bp, Homo sapiens
ccagccagccttgatctgagta

SEQ ID NO: 10013332 - DNA, 22 bp, Homo sapiens
ccagccagctgcccttggggcc

SEQ ID NO: 10013333 - DNA, 22 bp, Homo sapiens
ccagccagctggttggacgcct

SEQ ID NO: 10013334 - DNA, 22 bp, Homo sapiens
aggccctgctgaggcctccctc

SEQ ID NO: 10013335 - DNA, 22 bp, Homo sapiens
aggccctgcggaaatgatcatt

SEQ ID NO: 10013336 - DNA, 23 bp, Homo sapiens
aggccctgcctgtccctcttttt

SEQ ID NO: 10013337 - DNA, 23 bp, Homo sapiens
aggccctgcctgtccctcttttt

SEQ ID NO: 10013338 - DNA, 22 bp, Homo sapiens
aggccctgcccagagctcctcg

SEQ ID NO: 10013339 - DNA, 22 bp, Homo sapiens
aggccctgcccagtgccacaag

SEQ ID NO: 10013340 - DNA, 22 bp, Homo sapiens
aggccctgacctgggagatcta

SEQ ID NO: 10013341 - DNA, 23 bp, Homo sapiens
ccagccctccaccagctctaggc

SEQ ID NO: 10013342 - DNA, 22 bp, Homo sapiens
ccagccctgaaccctgctgcat

SEQ ID NO: 10013343 - DNA, 22 bp, Homo sapiens
ccagccctgaaccctgctgcat

SEQ ID NO: 10013344 - DNA, 21 bp, Homo sapiens
ccagaggttctgggcctccct

SEQ ID NO: 10013345 - DNA, 21 bp, Homo sapiens
ccagaggttctgggcctccct

SEQ ID NO: 10013346 - DNA, 22 bp, Homo sapiens
ccagaggttccaggctagggag

SEQ ID NO: 10013347 - DNA, 19 bp, Homo sapiens
ccagaggtttgctgggcct

SEQ ID NO: 10013348 - DNA, 19 bp, Homo sapiens
ccagagtcatgtctccccc

SEQ ID NO: 10013349 - DNA, 19 bp, Homo sapiens
ccagagtcatgtctccccc

SEQ ID NO: 10013350 - DNA, 22 bp, Homo sapiens
ccagagtcaggagctcatgtga

SEQ ID NO: 10013351 - DNA, 22 bp, Homo sapiens
ccagagtcaggagctcatgtga

SEQ ID NO: 10013352 - DNA, 22 bp, Homo sapiens
ccagagtcaggagctcatgtga

SEQ ID NO: 10013353 - DNA, 22 bp, Homo sapiens
ccagaggttactttgccttgga

SEQ ID NO: 10013354 - DNA, 22 bp, Homo sapiens
ccagaggtggtggtgtctagaa

SEQ ID NO: 10013355 - DNA, 22 bp, Homo sapiens
ccagaggtggtggtgtctagaa

SEQ ID NO: 10013356 - DNA, 22 bp, Homo sapiens
ccagaggttacaccctcagccc

SEQ ID NO: 10013357 - DNA, 22 bp, Homo sapiens
ccagaggttacaccctcagccc

SEQ ID NO: 10013358 - DNA, 22 bp, Homo sapiens
ccagaggtggtcatagaaagca

SEQ ID NO: 10013359 - DNA, 22 bp, Homo sapiens
ccagaggtgggagtgatctggt

SEQ ID NO: 10013360 - DNA, 22 bp, Homo sapiens
ccagaggtggtgggtgctacag

SEQ ID NO: 10013361 - DNA, 20 bp, Homo sapiens
ccagaggctgacagactttg

SEQ ID NO: 10013362 - DNA, 20 bp, Homo sapiens
ccagaggctgacagactttg

SEQ ID NO: 10013363 - DNA, 20 bp, Homo sapiens
ccagaggctgacagactttg

SEQ ID NO: 10013364 - DNA, 22 bp, Homo sapiens
ccagaggtggaagattgttttg

SEQ ID NO: 10013365 - DNA, 22 bp, Homo sapiens
ccagaggctggcaagggctcct

SEQ ID NO: 10013366 - DNA, 22 bp, Homo sapiens
ccagaggctggcaagggctcct

SEQ ID NO: 10013367 - DNA, 18 bp, Homo sapiens
ccagaggcccgggcaggc

SEQ ID NO: 10013368 - DNA, 18 bp, Homo sapiens
ccagaggcccgggcaggc

SEQ ID NO: 10013369 - DNA, 18 bp, Homo sapiens
ccagaggcccgggcaggc

SEQ ID NO: 10013370 - DNA, 21 bp, Homo sapiens
ccagaggcctctcttggccac

SEQ ID NO: 10013371 - DNA, 16 bp, Homo sapiens
ccagaggcctggcctc

SEQ ID NO: 10013372 - DNA, 22 bp, Homo sapiens
ccagaggcggaggtttgcagtg

SEQ ID NO: 10013373 - DNA, 21 bp, Homo sapiens
ccagaggcctctcttggccac

SEQ ID NO: 10013374 - DNA, 22 bp, Homo sapiens
aggcaggtcacatgcttggcga

SEQ ID NO: 10013375 - DNA, 22 bp, Homo sapiens
aggcaggtcccctggaaggcac

SEQ ID NO: 10013376 - DNA, 22 bp, Homo sapiens
aggcaggtcccctggaaggcac

SEQ ID NO: 10013377 - DNA, 22 bp, Homo sapiens
aggcaggtgagtcaaaacagac

SEQ ID NO: 10013378 - DNA, 22 bp, Homo sapiens
aggcaggtcccctggaaggcac

SEQ ID NO: 10013379 - DNA, 22 bp, Homo sapiens
aggcaggtcccctggaaggcac

SEQ ID NO: 10013380 - DNA, 21 bp, Homo sapiens
ccactcatgactccactcacc

SEQ ID NO: 10013381 - DNA, 20 bp, Homo sapiens
ccactccaggtgattctgat

SEQ ID NO: 10013382 - DNA, 17 bp, Homo sapiens
aggcaggtaagagttat

SEQ ID NO: 10013383 - DNA, 20 bp, Homo sapiens
ccagagctgatggctgcccg

SEQ ID NO: 10013384 - DNA, 19 bp, Homo sapiens
aggcaggtgcagaggtccc

SEQ ID NO: 10013385 - DNA, 19 bp, Homo sapiens
aggcaggtgcagaggtccc

SEQ ID NO: 10013386 - DNA, 22 bp, Homo sapiens
ccagaggcatgttcaaagcaat

SEQ ID NO: 10013387 - DNA, 22 bp, Homo sapiens
ccagaggatgctggtcagcctc

SEQ ID NO: 10013388 - DNA, 22 bp, Homo sapiens
ccagaggatgctggtcagcctc

SEQ ID NO: 10013389 - DNA, 22 bp, Homo sapiens
ccagaggcagacttacactcca

SEQ ID NO: 10013390 - DNA, 22 bp, Homo sapiens
ctgcctctccccagagtggccc

SEQ ID NO: 10013391 - DNA, 22 bp, Homo sapiens
ctgcctctccccagagtggccc

SEQ ID NO: 10013392 - DNA, 22 bp, Homo sapiens
ctgcctctcaggtccctgagat

SEQ ID NO: 10013393 - DNA, 22 bp, Homo sapiens
ctgcctctcaggtccctgagat

SEQ ID NO: 10013394 - DNA, 22 bp, Homo sapiens
ctgcctctcagcctgaccgcca

SEQ ID NO: 10013395 - DNA, 22 bp, Homo sapiens
ctgcctctcagcctgaccgcca

SEQ ID NO: 10013396 - DNA, 22 bp, Homo sapiens
ctgccctgtttggacagcccgg

SEQ ID NO: 10013397 - DNA, 22 bp, Homo sapiens
ctgcctctgcgtcccacagagt

SEQ ID NO: 10013398 - DNA, 22 bp, Homo sapiens
ctgcctctgcgtcccacagagt

SEQ ID NO: 10013399 - DNA, 22 bp, Homo sapiens
ctgcctctgcgtcccacagagt

SEQ ID NO: 10013400 - DNA, 22 bp, Homo sapiens
ctgcctctgcgtcccacagagt

SEQ ID NO: 10013401 - DNA, 22 bp, Homo sapiens
ataaatgattcagcaggaaata

SEQ ID NO: 10013402 - DNA, 22 bp, Homo sapiens
ataacatgagccagattgaaag

SEQ ID NO: 10013403 - DNA, 22 bp, Homo sapiens
ataacatggagtttgtcattta

SEQ ID NO: 10013404 - DNA, 22 bp, Homo sapiens
ataacatgacctgtgcttcaca

SEQ ID NO: 10013405 - DNA, 22 bp, Homo sapiens
ataacagtgacctctcagcacc

SEQ ID NO: 10013406 - DNA, 22 bp, Homo sapiens
ataacatgacctgtgcttcaca

SEQ ID NO: 10013407 - DNA, 22 bp, Homo sapiens
ataacatgacctgtgcttcaca

SEQ ID NO: 10013408 - DNA, 22 bp, Homo sapiens
ataacagatgcttcagcataaa

SEQ ID NO: 10013409 - DNA, 22 bp, Homo sapiens
ataacattttgacaactggtga

SEQ ID NO: 10013410 - DNA, 22 bp, Homo sapiens
ataacattttgacaactggtga

SEQ ID NO: 10013411 - DNA, 22 bp, Homo sapiens
ataacattttgacaactggtga

SEQ ID NO: 10013412 - DNA, 22 bp, Homo sapiens
ataactgagagcaatctttctt

SEQ ID NO: 10013413 - DNA, 22 bp, Homo sapiens
ataactctgtttttttcatgca

SEQ ID NO: 10013414 - DNA, 19 bp, Homo sapiens
ataactacattggctcagt

SEQ ID NO: 10013415 - DNA, 22 bp, Homo sapiens
ataacagatactctctgtgagg

SEQ ID NO: 10013416 - DNA, 22 bp, Homo sapiens
ataacagagttgggaagtgaaa

SEQ ID NO: 10013417 - DNA, 22 bp, Homo sapiens
ataacagagttgggaagtgaaa

SEQ ID NO: 10013418 - DNA, 22 bp, Homo sapiens
ataaattaggatctggggttcc

SEQ ID NO: 10013419 - DNA, 22 bp, Homo sapiens
ataaattaggatctggggttcc

SEQ ID NO: 10013420 - DNA, 22 bp, Homo sapiens
ataaatgtgaattagagctttg

SEQ ID NO: 10013421 - DNA, 22 bp, Homo sapiens
ataaatgtgaattagagctttg

SEQ ID NO: 10013422 - DNA, 22 bp, Homo sapiens
ataaatgtgaaatgagcagtta

SEQ ID NO: 10013423 - DNA, 22 bp, Homo sapiens
ataaatgtgaaatgagcagtta

SEQ ID NO: 10013424 - DNA, 22 bp, Homo sapiens
ataaatgtgaattagagctttg

SEQ ID NO: 10013425 - DNA, 22 bp, Homo sapiens
ataaatgtttgttgaatgaata

SEQ ID NO: 10013426 - DNA, 23 bp, Homo sapiens
ataaattactatctccctagagc

SEQ ID NO: 10013427 - DNA, 23 bp, Homo sapiens
ataaattactatctccctagagc

SEQ ID NO: 10013428 - DNA, 23 bp, Homo sapiens
ataaattactatctccctagagc

SEQ ID NO: 10013429 - DNA, 22 bp, Homo sapiens
ctgctgatcgaatcagtcaccc

SEQ ID NO: 10013430 - DNA, 22 bp, Homo sapiens
ctgctgattcttaaatgtggtt

SEQ ID NO: 10013431 - DNA, 22 bp, Homo sapiens
ctgctgaggtccttgctcagac

SEQ ID NO: 10013432 - DNA, 22 bp, Homo sapiens
ctgctgaggtccttgctcagac

SEQ ID NO: 10013433 - DNA, 22 bp, Homo sapiens
ctgctgaggtatactatgtgac

SEQ ID NO: 10013434 - DNA, 22 bp, Homo sapiens
atacaactgctctcagataagt

SEQ ID NO: 10013435 - DNA, 22 bp, Homo sapiens
atacaactgccttagaaggaaa

SEQ ID NO: 10013436 - DNA, 22 bp, Homo sapiens
atacaactgccttagaaggaaa

SEQ ID NO: 10013437 - DNA, 22 bp, Homo sapiens
atacaactgctctcagataagt

SEQ ID NO: 10013438 - DNA, 22 bp, Homo sapiens
atacaactttatctgtaatgag

SEQ ID NO: 10013439 - DNA, 22 bp, Homo sapiens
atacaactttacatgcaattcc

SEQ ID NO: 10013440 - DNA, 22 bp, Homo sapiens
atacaaagtattgatcctgagt

SEQ ID NO: 10013441 - DNA, 22 bp, Homo sapiens
atacaaagtattgatcctgagt

SEQ ID NO: 10013442 - DNA, 22 bp, Homo sapiens
atacaaatcctctgggatggta

SEQ ID NO: 10013443 - DNA, 22 bp, Homo sapiens
atacaaattataggccccatcc

SEQ ID NO: 10013444 - DNA, 22 bp, Homo sapiens
atacaaaggaacacaggcatgt

SEQ ID NO: 10013445 - DNA, 22 bp, Homo sapiens
atacaaaggaacacaggcatgt

SEQ ID NO: 10013446 - DNA, 22 bp, Homo sapiens
atacaaaggaacacaggcatgt

SEQ ID NO: 10013447 - DNA, 22 bp, Homo sapiens
atacaaatttatagatgcattt

SEQ ID NO: 10013448 - DNA, 22 bp, Homo sapiens
atacaacagaaaatgattattc

SEQ ID NO: 10013449 - DNA, 22 bp, Homo sapiens
atacaacagaaaatgattattc

SEQ ID NO: 10013450 - DNA, 22 bp, Homo sapiens
atacaacagaaaatgattattc

SEQ ID NO: 10013451 - DNA, 22 bp, Homo sapiens
atacaacagaaaatgattattc

SEQ ID NO: 10013452 - DNA, 22 bp, Homo sapiens
atacaaatttatagatgcattt

SEQ ID NO: 10013453 - DNA, 22 bp, Homo sapiens
ataacttagagtaggcaaaagt

SEQ ID NO: 10013454 - DNA, 22 bp, Homo sapiens
ataagacacgccccactcactc

SEQ ID NO: 10013455 - DNA, 22 bp, Homo sapiens
ataagacacgcaaataggtacg

SEQ ID NO: 10013456 - DNA, 17 bp, Homo sapiens
ataagacagaagacaat

SEQ ID NO: 10013457 - DNA, 22 bp, Homo sapiens
ataagaaacattattctttcca

SEQ ID NO: 10013458 - DNA, 22 bp, Homo sapiens
ataagaaacattattctttcca

SEQ ID NO: 10013459 - DNA, 22 bp, Homo sapiens
ataagcatgattaccgggagca

SEQ ID NO: 10013460 - DNA, 21 bp, Homo sapiens
ataagcatgctgattacattt

SEQ ID NO: 10013461 - DNA, 17 bp, Homo sapiens
ataagacagaagacaat

SEQ ID NO: 10013462 - DNA, 22 bp, Homo sapiens
ataagaggaattacagaagagg

SEQ ID NO: 10013463 - DNA, 22 bp, Homo sapiens
ataagagtcttgttttcttatt

SEQ ID NO: 10013464 - DNA, 22 bp, Homo sapiens
ataagaggaattacagaagagg

SEQ ID NO: 10013465 - DNA, 22 bp, Homo sapiens
ataagatataaatccacagagt

SEQ ID NO: 10013466 - DNA, 22 bp, Homo sapiens
ataagatgagatcagctttctg

SEQ ID NO: 10013467 - DNA, 20 bp, Homo sapiens
ataatttaccctgcaccact

SEQ ID NO: 10013468 - DNA, 17 bp, Homo sapiens
atacaaagccataaacc

SEQ ID NO: 10013469 - DNA, 22 bp, Homo sapiens
ataatttactaagctctacctt

SEQ ID NO: 10013470 - DNA, 22 bp, Homo sapiens
atacaaagctaaatatggtttc

SEQ ID NO: 10013471 - DNA, 17 bp, Homo sapiens
atacaaagccataaacc

SEQ ID NO: 10013472 - DNA, 22 bp, Homo sapiens
atacaaagctaaatatggtttc

SEQ ID NO: 10013473 - DNA, 22 bp, Homo sapiens
atacaaagctaaatatggtttc

SEQ ID NO: 10013474 - DNA, 22 bp, Homo sapiens
ctgcagagagtgccgggcagcc

SEQ ID NO: 10013475 - DNA, 22 bp, Homo sapiens
ctgcagagagtgccgggcagcc

SEQ ID NO: 10013476 - DNA, 22 bp, Homo sapiens
ctgcagagatgaagaaggtggc

SEQ ID NO: 10013477 - DNA, 23 bp, Homo sapiens
ctgcagagaactgagggacagcc

SEQ ID NO: 10013478 - DNA, 23 bp, Homo sapiens
ctgcagagaactgagggacagcc

SEQ ID NO: 10013479 - DNA, 22 bp, Homo sapiens
ctgcagagaattgtggggcttc

SEQ ID NO: 10013480 - DNA, 22 bp, Homo sapiens
ctgcagagaattgtggggcttc

SEQ ID NO: 10013481 - DNA, 23 bp, Homo sapiens
ctgcagagaactgagggacagcc

SEQ ID NO: 10013482 - DNA, 22 bp, Homo sapiens
ctgcagggtgacgttgcccacc

SEQ ID NO: 10013483 - DNA, 20 bp, Homo sapiens
ctgcagggtgagtgggcgat

SEQ ID NO: 10013484 - DNA, 20 bp, Homo sapiens
ctgcagggtgagtgggcgat

SEQ ID NO: 10013485 - DNA, 22 bp, Homo sapiens
ctgcaggggtgtcctgtattgg

SEQ ID NO: 10013486 - DNA, 20 bp, Homo sapiens
ctgcagggtgagtgggcgat

SEQ ID NO: 10013487 - DNA, 20 bp, Homo sapiens
ctgcagggttagaggctcca

SEQ ID NO: 10013488 - DNA, 20 bp, Homo sapiens
ctgcagggtgagtgggcgat

SEQ ID NO: 10013489 - DNA, 22 bp, Homo sapiens
ctgcaggggctggagttggctt

SEQ ID NO: 10013490 - DNA, 22 bp, Homo sapiens
ctgcaggggtgtcctgtattgg

SEQ ID NO: 10013491 - DNA, 22 bp, Homo sapiens
ctgcagggagaggggacagcct

SEQ ID NO: 10013492 - DNA, 22 bp, Homo sapiens
ctgcagagatgaagaaggtggc

SEQ ID NO: 10013493 - DNA, 22 bp, Homo sapiens
ctgcagagcaagtaacatcctc

SEQ ID NO: 10013494 - DNA, 22 bp, Homo sapiens
ctgcagagatgaagaaggtggc

SEQ ID NO: 10013495 - DNA, 21 bp, Homo sapiens
ctgcatctcatagaacatgtc

SEQ ID NO: 10013496 - DNA, 22 bp, Homo sapiens
ctgcatctctgtgccagagggc

SEQ ID NO: 10013497 - DNA, 21 bp, Homo sapiens
ctgcatctgagtcattatgcc

SEQ ID NO: 10013498 - DNA, 22 bp, Homo sapiens
ctgcatctgcataatcaacttc

SEQ ID NO: 10013499 - DNA, 20 bp, Homo sapiens
ctgcatctgtgacttgcaaa

SEQ ID NO: 10013500 - DNA, 22 bp, Homo sapiens
ctgcatctgttagattatcacc

SEQ ID NO: 10013501 - DNA, 22 bp, Homo sapiens
ctgcatcttagtcaaaatctgt

SEQ ID NO: 10013502 - DNA, 22 bp, Homo sapiens
ctgcatgagctgtcagtggagg

SEQ ID NO: 10013503 - DNA, 22 bp, Homo sapiens
ctgcatgttttcttaattgtga

SEQ ID NO: 10013504 - DNA, 22 bp, Homo sapiens
ctgcatgtgttatatttggttc

SEQ ID NO: 10013505 - DNA, 22 bp, Homo sapiens
ctgcatgtcactctgctgtccc

SEQ ID NO: 10013506 - DNA, 22 bp, Homo sapiens
ctgcatgtgtttctgctgggtt

SEQ ID NO: 10013507 - DNA, 22 bp, Homo sapiens
ctgcatgtgtttctgctgggtt

SEQ ID NO: 10013508 - DNA, 22 bp, Homo sapiens
ctgcatgtttacatttttgaga

SEQ ID NO: 10013509 - DNA, 22 bp, Homo sapiens
ctgcatccatgttgctgcaaag

SEQ ID NO: 10013510 - DNA, 21 bp, Homo sapiens
ctgcatctcatagaacatgtc

SEQ ID NO: 10013511 - DNA, 22 bp, Homo sapiens
ctgcagggttttaacaatggac

SEQ ID NO: 10013512 - DNA, 22 bp, Homo sapiens
ctgcagggtttcgccagttgtg

SEQ ID NO: 10013513 - DNA, 20 bp, Homo sapiens
ctgcagggttagaggctcca

SEQ ID NO: 10013514 - DNA, 22 bp, Homo sapiens
ctgcagggttcggagagttccc

SEQ ID NO: 10013515 - DNA, 22 bp, Homo sapiens
ctgcaaggtccacctgctacat

SEQ ID NO: 10013516 - DNA, 22 bp, Homo sapiens
ctgcaatctccatgcttgattt

SEQ ID NO: 10013517 - DNA, 22 bp, Homo sapiens
ctgcaagggatcttcaggtagc

SEQ ID NO: 10013518 - DNA, 23 bp, Homo sapiens
ctgcaaggtacaagatgctggat

SEQ ID NO: 10013519 - DNA, 23 bp, Homo sapiens
ctgcaaggtacaagatgctggat

SEQ ID NO: 10013520 - DNA, 22 bp, Homo sapiens
ctgcaaggtcatgactctctgg

SEQ ID NO: 10013521 - DNA, 22 bp, Homo sapiens
ctgcaagctacccctagcatca

SEQ ID NO: 10013522 - DNA, 22 bp, Homo sapiens
ctgcaaggctggggtgagctgg

SEQ ID NO: 10013523 - DNA, 20 bp, Homo sapiens
ctgcaagcaggttattccag

SEQ ID NO: 10013524 - DNA, 22 bp, Homo sapiens
ctgcaagcaaatcaactctttg

SEQ ID NO: 10013525 - DNA, 22 bp, Homo sapiens
ctgatcccattggcagtccagt

SEQ ID NO: 10013526 - DNA, 22 bp, Homo sapiens
agttatgtcctcagcaaatcaa

SEQ ID NO: 10013527 - DNA, 22 bp, Homo sapiens
agttattactctttaacatatt

SEQ ID NO: 10013528 - DNA, 22 bp, Homo sapiens
agttattactctttaacatatt

SEQ ID NO: 10013529 - DNA, 22 bp, Homo sapiens
agttatattccatagattcaga

SEQ ID NO: 10013530 - DNA, 22 bp, Homo sapiens
agttatattccatagattcaga

SEQ ID NO: 10013531 - DNA, 22 bp, Homo sapiens
ctgaggagcaaccccgtgccct

SEQ ID NO: 10013532 - DNA, 22 bp, Homo sapiens
agttatatgtgaaaacacgtat

SEQ ID NO: 10013533 - DNA, 22 bp, Homo sapiens
agttatatgtgaaaacacgtat

SEQ ID NO: 10013534 - DNA, 22 bp, Homo sapiens
agttatattccatagattcaga

SEQ ID NO: 10013535 - DNA, 22 bp, Homo sapiens
ctgaggagctgaaggccctcca

SEQ ID NO: 10013536 - DNA, 22 bp, Homo sapiens
agttatataactatctagatgc

SEQ ID NO: 10013537 - DNA, 22 bp, Homo sapiens
ctgaggagccccctctcagcat

SEQ ID NO: 10013538 - DNA, 22 bp, Homo sapiens
ctgaggagccccctctcagcat

SEQ ID NO: 10013539 - DNA, 22 bp, Homo sapiens
atacatgtgtgtgcatacatgt

SEQ ID NO: 10013540 - DNA, 22 bp, Homo sapiens
atacatagttctgtgaaaagta

SEQ ID NO: 10013541 - DNA, 22 bp, Homo sapiens
atacataggagaataacttcag

SEQ ID NO: 10013542 - DNA, 21 bp, Homo sapiens
atacattctattaagcattta

SEQ ID NO: 10013543 - DNA, 17 bp, Homo sapiens
atacattgttaaagtat

SEQ ID NO: 10013544 - DNA, 21 bp, Homo sapiens
atacattctattaagcattta

SEQ ID NO: 10013545 - DNA, 21 bp, Homo sapiens
atacattctattaagcattta

SEQ ID NO: 10013546 - DNA, 22 bp, Homo sapiens
atacccaggcttatgttggtca

SEQ ID NO: 10013547 - DNA, 22 bp, Homo sapiens
atacccagtccaatctcttagc

SEQ ID NO: 10013548 - DNA, 22 bp, Homo sapiens
atacccagccccagctgcagga

SEQ ID NO: 10013549 - DNA, 22 bp, Homo sapiens
atacccagagtgggtagagtta

SEQ ID NO: 10013550 - DNA, 22 bp, Homo sapiens
atacccagccccagctgcagga

SEQ ID NO: 10013551 - DNA, 22 bp, Homo sapiens
atacccagctctttcgttttgg

SEQ ID NO: 10013552 - DNA, 22 bp, Homo sapiens
ataccacaacatggctcagagg

SEQ ID NO: 10013553 - DNA, 22 bp, Homo sapiens
ataccacaacatggctcagagg

SEQ ID NO: 10013554 - DNA, 22 bp, Homo sapiens
ataccacaacatggctcagagg

SEQ ID NO: 10013555 - DNA, 22 bp, Homo sapiens
atacgtaagttgaacatcagaa

SEQ ID NO: 10013556 - DNA, 22 bp, Homo sapiens
atacctgtgtatccacaagcgt

SEQ ID NO: 10013557 - DNA, 23 bp, Homo sapiens
atacatacagtcttactgacttt

SEQ ID NO: 10013558 - DNA, 22 bp, Homo sapiens
atacatacatgtacacataaat

SEQ ID NO: 10013559 - DNA, 22 bp, Homo sapiens
atacatacgtacatacgtatgt

SEQ ID NO: 10013560 - DNA, 22 bp, Homo sapiens
atacatacatgtatgcacatac

SEQ ID NO: 10013561 - DNA, 22 bp, Homo sapiens
atacatacgtacatacgtatgt

SEQ ID NO: 10013562 - DNA, 22 bp, Homo sapiens
atacatagcagagtcaattaat

SEQ ID NO: 10013563 - DNA, 22 bp, Homo sapiens
atacagttagaaaaaaagcctt

SEQ ID NO: 10013564 - DNA, 22 bp, Homo sapiens
atacagtgccccttttcacatg

SEQ ID NO: 10013565 - DNA, 22 bp, Homo sapiens
atacagtagggaccatgtctga

SEQ ID NO: 10013566 - DNA, 20 bp, Homo sapiens
atacagtaggtgctcaatat

SEQ ID NO: 10013567 - DNA, 22 bp, Homo sapiens
atacagtataactaataaaccc

SEQ ID NO: 10013568 - DNA, 22 bp, Homo sapiens
atacagtattacctgttcagga

SEQ ID NO: 10013569 - DNA, 22 bp, Homo sapiens
atacagtatgtaggcttttcag

SEQ ID NO: 10013570 - DNA, 22 bp, Homo sapiens
atacagtataactaataaaccc

SEQ ID NO: 10013571 - DNA, 22 bp, Homo sapiens
atacagtataactaataaaccc

SEQ ID NO: 10013572 - DNA, 22 bp, Homo sapiens
ctggaatgctggtaaaatagca

SEQ ID NO: 10013573 - DNA, 22 bp, Homo sapiens
ctggaatggcaatgggaagtcc

SEQ ID NO: 10013574 - DNA, 22 bp, Homo sapiens
ctggaatgcggagagttggaga

SEQ ID NO: 10013575 - DNA, 22 bp, Homo sapiens
ctggaatgggccatttgaggcc

SEQ ID NO: 10013576 - DNA, 22 bp, Homo sapiens
ctggaatgggagtcagacagag

SEQ ID NO: 10013577 - DNA, 22 bp, Homo sapiens
ctggaatgggaatcaggaaaga

SEQ ID NO: 10013578 - DNA, 22 bp, Homo sapiens
ctggaatgtatgggaacccaaa

SEQ ID NO: 10013579 - DNA, 22 bp, Homo sapiens
ctggaatgtatgggaacccaaa

SEQ ID NO: 10013580 - DNA, 22 bp, Homo sapiens
ctggaatgtagagacagcttag

SEQ ID NO: 10013581 - DNA, 22 bp, Homo sapiens
ctggaatgggtttcaggcactg

SEQ ID NO: 10013582 - DNA, 22 bp, Homo sapiens
ctggaatgggtttcaggcactg

SEQ ID NO: 10013583 - DNA, 20 bp, Homo sapiens
ctggaatgggtgtgggttag

SEQ ID NO: 10013584 - DNA, 22 bp, Homo sapiens
ctggaatctttggagaatgtgg

SEQ ID NO: 10013585 - DNA, 22 bp, Homo sapiens
ctggaatgaagctatgtacatt

SEQ ID NO: 10013586 - DNA, 19 bp, Homo sapiens
ctggaatgagaacatgccc

SEQ ID NO: 10013587 - DNA, 22 bp, Homo sapiens
ctggaatgagagcccggggatc

SEQ ID NO: 10013588 - DNA, 19 bp, Homo sapiens
ctggaatgagaacatgccc

SEQ ID NO: 10013589 - DNA, 22 bp, Homo sapiens
ctggaatgagcagggcttatgg

SEQ ID NO: 10013590 - DNA, 22 bp, Homo sapiens
ctggaatgattgaaaaggaatg

SEQ ID NO: 10013591 - DNA, 22 bp, Homo sapiens
ctggaatgcctccctgtcagag

SEQ ID NO: 10013592 - DNA, 19 bp, Homo sapiens
ctggaatgatagagacctc

SEQ ID NO: 10013593 - DNA, 19 bp, Homo sapiens
ctggaatgatagagacctc

SEQ ID NO: 10013594 - DNA, 22 bp, Homo sapiens
ctggaagactcaatggcctgcc

SEQ ID NO: 10013595 - DNA, 22 bp, Homo sapiens
ctggaagtggggttggcttgaa

SEQ ID NO: 10013596 - DNA, 22 bp, Homo sapiens
ctggaagtttccttcctggtca

SEQ ID NO: 10013597 - DNA, 22 bp, Homo sapiens
ctggaagtttccttcctggtca

SEQ ID NO: 10013598 - DNA, 22 bp, Homo sapiens
atacagtaattgcataggcttc

SEQ ID NO: 10013599 - DNA, 22 bp, Homo sapiens
atacagtaagtgtccctgaaac

SEQ ID NO: 10013600 - DNA, 22 bp, Homo sapiens
atacagtaattgccctgcaatg

SEQ ID NO: 10013601 - DNA, 22 bp, Homo sapiens
atacagtaatttgtaactcatc

SEQ ID NO: 10013602 - DNA, 22 bp, Homo sapiens
atacagtagacaatctcatgaa

SEQ ID NO: 10013603 - DNA, 22 bp, Homo sapiens
atacagtagacaatctcatgaa

SEQ ID NO: 10013604 - DNA, 22 bp, Homo sapiens
atacagtagggaccatgtctga

SEQ ID NO: 10013605 - DNA, 22 bp, Homo sapiens
ctggagagaatgtggaatgatt

SEQ ID NO: 10013606 - DNA, 22 bp, Homo sapiens
ctggagagaatgttcattgcag

SEQ ID NO: 10013607 - DNA, 19 bp, Homo sapiens
atacagtaaggtgtttgcc

SEQ ID NO: 10013608 - DNA, 22 bp, Homo sapiens
atacagtaaccacattctatag

SEQ ID NO: 10013609 - DNA, 22 bp, Homo sapiens
ctggagagaaatgacaaagcta

SEQ ID NO: 10013610 - DNA, 22 bp, Homo sapiens
ctggagagaatgtggaatgatt

SEQ ID NO: 10013611 - DNA, 22 bp, Homo sapiens
ctggagacctctcctgagagtg

SEQ ID NO: 10013612 - DNA, 22 bp, Homo sapiens
ctggagaagaggtagtatgtag

SEQ ID NO: 10013613 - DNA, 22 bp, Homo sapiens
ctggaatgtatgtatcttaaga

SEQ ID NO: 10013614 - DNA, 22 bp, Homo sapiens
ctggaatgtctgctcaatgttt

SEQ ID NO: 10013615 - DNA, 22 bp, Homo sapiens
ctggagaagtactgagacattt

SEQ ID NO: 10013616 - DNA, 22 bp, Homo sapiens
atagatgttttagtaatactgt

SEQ ID NO: 10013617 - DNA, 22 bp, Homo sapiens
atagatgttttctcctaattgg

SEQ ID NO: 10013618 - DNA, 22 bp, Homo sapiens
atagattagccctatagtttta

SEQ ID NO: 10013619 - DNA, 22 bp, Homo sapiens
atagattatttgctcattactt

SEQ ID NO: 10013620 - DNA, 22 bp, Homo sapiens
atagatttgaatttaagacttg

SEQ ID NO: 10013621 - DNA, 22 bp, Homo sapiens
atactcaaggttaatgattgaa

SEQ ID NO: 10013622 - DNA, 22 bp, Homo sapiens
atactatattaccttctcaact

SEQ ID NO: 10013623 - DNA, 22 bp, Homo sapiens
atactatattaccttctcaact

SEQ ID NO: 10013624 - DNA, 22 bp, Homo sapiens
atactacaatcataattgtaca

SEQ ID NO: 10013625 - DNA, 22 bp, Homo sapiens
atactacaatcataattgtaca

SEQ ID NO: 10013626 - DNA, 22 bp, Homo sapiens
atactacaatcataattgtaca

SEQ ID NO: 10013627 - DNA, 22 bp, Homo sapiens
atactacaaggtatgtgctaaa

SEQ ID NO: 10013628 - DNA, 22 bp, Homo sapiens
atactacaaggtatgtgctaaa

SEQ ID NO: 10013629 - DNA, 22 bp, Homo sapiens
atactacacattgactatattt

SEQ ID NO: 10013630 - DNA, 22 bp, Homo sapiens
atactacatactatgtaaacat

SEQ ID NO: 10013631 - DNA, 22 bp, Homo sapiens
atactacattattagagcctgg

SEQ ID NO: 10013632 - DNA, 22 bp, Homo sapiens
atactacatttgaaaattgcag

SEQ ID NO: 10013633 - DNA, 22 bp, Homo sapiens
atactacatcacagccaagaag

SEQ ID NO: 10013634 - DNA, 22 bp, Homo sapiens
atactacatcacagccaagaag

SEQ ID NO: 10013635 - DNA, 22 bp, Homo sapiens
atactacatactatgtaaacat

SEQ ID NO: 10013636 - DNA, 22 bp, Homo sapiens
atactacatactatgtaaacat

SEQ ID NO: 10013637 - DNA, 22 bp, Homo sapiens
atactacatactatgtaaacat

SEQ ID NO: 10013638 - DNA, 22 bp, Homo sapiens
atactacatactatgtaaacat

SEQ ID NO: 10013639 - DNA, 22 bp, Homo sapiens
ctggcccccacacctgtcaggg

SEQ ID NO: 10013640 - DNA, 22 bp, Homo sapiens
ctggccccatctggagtctgag

SEQ ID NO: 10013641 - DNA, 22 bp, Homo sapiens
ctggcccattgccttctctctc

SEQ ID NO: 10013642 - DNA, 22 bp, Homo sapiens
ctggcccattgccttctctctc

SEQ ID NO: 10013643 - DNA, 22 bp, Homo sapiens
ctggcccattgccttctctctc

SEQ ID NO: 10013644 - DNA, 20 bp, Homo sapiens
ctggcccatctaccgctctg

SEQ ID NO: 10013645 - DNA, 20 bp, Homo sapiens
ctggcccatctaccgctctg

SEQ ID NO: 10013646 - DNA, 22 bp, Homo sapiens
ctggcccatggtgagctctggg

SEQ ID NO: 10013647 - DNA, 22 bp, Homo sapiens
atagcaaaggacaatagtcagt

SEQ ID NO: 10013648 - DNA, 22 bp, Homo sapiens
ctggcccagttctgcgttttgc

SEQ ID NO: 10013649 - DNA, 22 bp, Homo sapiens
ctggcccagttctgcgttttgc

SEQ ID NO: 10013650 - DNA, 22 bp, Homo sapiens
atagcaaagcctggcacaatga

SEQ ID NO: 10013651 - DNA, 22 bp, Homo sapiens
atagcaaaggacaatagtcagt

SEQ ID NO: 10013652 - DNA, 22 bp, Homo sapiens
atagcaaagatgtcaattcccc

SEQ ID NO: 10013653 - DNA, 22 bp, Homo sapiens
atagcaaaaggcaccagagtga

SEQ ID NO: 10013654 - DNA, 22 bp, Homo sapiens
ctggctccatcactgggtgatg

SEQ ID NO: 10013655 - DNA, 22 bp, Homo sapiens
ctggctccatcctaggcaaatg

SEQ ID NO: 10013656 - DNA, 22 bp, Homo sapiens
atagcagtaacactgacatttt

SEQ ID NO: 10013657 - DNA, 19 bp, Homo sapiens
atagcagctatacccagat

SEQ ID NO: 10013658 - DNA, 19 bp, Homo sapiens
atagcagctatacccagat

SEQ ID NO: 10013659 - DNA, 22 bp, Homo sapiens
ctggctggccatgtagagatga

SEQ ID NO: 10013660 - DNA, 22 bp, Homo sapiens
atagcaatttgcccaattacct

SEQ ID NO: 10013661 - DNA, 22 bp, Homo sapiens
atagcacatcactccagtgagt

SEQ ID NO: 10013662 - DNA, 22 bp, Homo sapiens
atagcaccatgactaaacaatt

SEQ ID NO: 10013663 - DNA, 22 bp, Homo sapiens
atagcacctgtgatgggatgag

SEQ ID NO: 10013664 - DNA, 22 bp, Homo sapiens
atagcagcatcagtttatctcc

SEQ ID NO: 10013665 - DNA, 22 bp, Homo sapiens
atagcagcatttcttccaagga

SEQ ID NO: 10013666 - DNA, 22 bp, Homo sapiens
atagcagcatttcttccaagga

SEQ ID NO: 10013667 - DNA, 22 bp, Homo sapiens
atagcagcatcagtttatctcc

SEQ ID NO: 10013668 - DNA, 22 bp, Homo sapiens
atagcaaattctttaggtgctt

SEQ ID NO: 10013669 - DNA, 22 bp, Homo sapiens
atagcaagcgttcccaagccac

SEQ ID NO: 10013670 - DNA, 22 bp, Homo sapiens
atagcaaatattttaatgagca

SEQ ID NO: 10013671 - DNA, 22 bp, Homo sapiens
atagcaaatattttaatgagca

SEQ ID NO: 10013672 - DNA, 22 bp, Homo sapiens
atagcaatcagtgtatttgaaa

SEQ ID NO: 10013673 - DNA, 22 bp, Homo sapiens
atagcaatgatcaagacagaca

SEQ ID NO: 10013674 - DNA, 22 bp, Homo sapiens
atagcaatggcaacaactaagc

SEQ ID NO: 10013675 - DNA, 22 bp, Homo sapiens
atattcttcttgttcagactat

SEQ ID NO: 10013676 - DNA, 22 bp, Homo sapiens
ctgggctgagcctgggctgtgt

SEQ ID NO: 10013677 - DNA, 22 bp, Homo sapiens
ctgggctgagcctgggctgtgt

SEQ ID NO: 10013678 - DNA, 19 bp, Homo sapiens
ctgggctgaggtctgcctt

SEQ ID NO: 10013679 - DNA, 22 bp, Homo sapiens
ctgggctgaaagtgttccttga

SEQ ID NO: 10013680 - DNA, 22 bp, Homo sapiens
ctgggctctgcggtgtcgctct

SEQ ID NO: 10013681 - DNA, 22 bp, Homo sapiens
atattataagttatttcaagtt

SEQ ID NO: 10013682 - DNA, 22 bp, Homo sapiens
atattatagacagagtcttctg

SEQ ID NO: 10013683 - DNA, 22 bp, Homo sapiens
atattataagttatttcaagtt

SEQ ID NO: 10013684 - DNA, 22 bp, Homo sapiens
atattataagttatttcaagtt

SEQ ID NO: 10013685 - DNA, 22 bp, Homo sapiens
atattagtgtaggtagctaata

SEQ ID NO: 10013686 - DNA, 22 bp, Homo sapiens
atattagtttggagactacaat

SEQ ID NO: 10013687 - DNA, 22 bp, Homo sapiens
atattagtttggagactacaat

SEQ ID NO: 10013688 - DNA, 22 bp, Homo sapiens
atattacataaacatgagtgaa

SEQ ID NO: 10013689 - DNA, 22 bp, Homo sapiens
atattacataaacatgagtgaa

SEQ ID NO: 10013690 - DNA, 22 bp, Homo sapiens
atattactctgatttagtaaat

SEQ ID NO: 10013691 - DNA, 22 bp, Homo sapiens
atattactctgatttagtaaat

SEQ ID NO: 10013692 - DNA, 22 bp, Homo sapiens
atattacttcctggtataaaat

SEQ ID NO: 10013693 - DNA, 22 bp, Homo sapiens
atattacttcctggtataaaat

SEQ ID NO: 10013694 - DNA, 22 bp, Homo sapiens
atatgcaagcacatagaatact

SEQ ID NO: 10013695 - DNA, 22 bp, Homo sapiens
ctgggctcagcaggccaaggcc

SEQ ID NO: 10013696 - DNA, 22 bp, Homo sapiens
ctgggctcagatgagaggaagg

SEQ ID NO: 10013697 - DNA, 22 bp, Homo sapiens
ctgggctcacctgtggctggca

SEQ ID NO: 10013698 - DNA, 20 bp, Homo sapiens
ctgggctcaagtgatcctcc

SEQ ID NO: 10013699 - DNA, 20 bp, Homo sapiens
ctgggctcaagtgagcctcc

SEQ ID NO: 10013700 - DNA, 20 bp, Homo sapiens
ctgggctcaagtgagcctcc

SEQ ID NO: 10013701 - DNA, 22 bp, Homo sapiens
ctgggctcaagtgatccaccca

SEQ ID NO: 10013702 - DNA, 21 bp, Homo sapiens
ctgggctcaagcaatcctttc

SEQ ID NO: 10013703 - DNA, 22 bp, Homo sapiens
ctgggcctggtagggcttgaaa

SEQ ID NO: 10013704 - DNA, 22 bp, Homo sapiens
ctgggcctggggctgttgagag

SEQ ID NO: 10013705 - DNA, 22 bp, Homo sapiens
ctgggcctggtagggcttgaaa

SEQ ID NO: 10013706 - DNA, 22 bp, Homo sapiens
ctggctgtttcaggcagtgtcc

SEQ ID NO: 10013707 - DNA, 22 bp, Homo sapiens
ctggctgtttcaggcagtgtcc

SEQ ID NO: 10013708 - DNA, 22 bp, Homo sapiens
ctggctgtgtgcccccggcacc

SEQ ID NO: 10013709 - DNA, 22 bp, Homo sapiens
ctggctgtgtcttggaggagct

SEQ ID NO: 10013710 - DNA, 22 bp, Homo sapiens
ctggctgtgtcttggaggagct

SEQ ID NO: 10013711 - DNA, 22 bp, Homo sapiens
ctggctgttttcaatgttgatg

SEQ ID NO: 10013712 - DNA, 22 bp, Homo sapiens
ctggcttcctcaggagcagtgg

SEQ ID NO: 10013713 - DNA, 22 bp, Homo sapiens
ctggctgtgtccacagagtaag

SEQ ID NO: 10013714 - DNA, 22 bp, Homo sapiens
ctggctgtggtcacaggtaact

SEQ ID NO: 10013715 - DNA, 22 bp, Homo sapiens
ctggctgggagcgagctgctca

SEQ ID NO: 10013716 - DNA, 22 bp, Homo sapiens
ctggctggccggagcgaggcgg

SEQ ID NO: 10013717 - DNA, 22 bp, Homo sapiens
ctggctggccggaggcatccct

SEQ ID NO: 10013718 - DNA, 22 bp, Homo sapiens
atattcttgtgattataaagta

SEQ ID NO: 10013719 - DNA, 22 bp, Homo sapiens
atattcttgtgattataaagta

SEQ ID NO: 10013720 - DNA, 22 bp, Homo sapiens
atattgtactagggttacatgt

SEQ ID NO: 10013721 - DNA, 22 bp, Homo sapiens
atatttaaacagggtaccaata

SEQ ID NO: 10013722 - DNA, 22 bp, Homo sapiens
atatttaaacagggtaccaata

SEQ ID NO: 10013723 - DNA, 22 bp, Homo sapiens
atatttaaacagggtaccaata

SEQ ID NO: 10013724 - DNA, 21 bp, Homo sapiens
atattgtaggtaaagtgcagg

SEQ ID NO: 10013725 - DNA, 22 bp, Homo sapiens
atcaaaatggaagaatttggct

SEQ ID NO: 10013726 - DNA, 22 bp, Homo sapiens
atcaaagaatgtgactgaaata

SEQ ID NO: 10013727 - DNA, 22 bp, Homo sapiens
atcaaagaatgtgactgaaata

SEQ ID NO: 10013728 - DNA, 22 bp, Homo sapiens
atcaaagaatgtgactgaaata

SEQ ID NO: 10013729 - DNA, 22 bp, Homo sapiens
atcaaaatgctccagtgatggt

SEQ ID NO: 10013730 - DNA, 22 bp, Homo sapiens
atcaaaatggaagaatttggct

SEQ ID NO: 10013731 - DNA, 22 bp, Homo sapiens
atcaaaatggaagaatttggct

SEQ ID NO: 10013732 - DNA, 22 bp, Homo sapiens
atcaaaatgctccagtgatggt

SEQ ID NO: 10013733 - DNA, 22 bp, Homo sapiens
atatttaaacagggtaccaata

SEQ ID NO: 10013734 - DNA, 22 bp, Homo sapiens
atatttaactggtcccaatata

SEQ ID NO: 10013735 - DNA, 22 bp, Homo sapiens
atatttaactggtcccaatata

SEQ ID NO: 10013736 - DNA, 22 bp, Homo sapiens
atatttactgctgtggtgaagg

SEQ ID NO: 10013737 - DNA, 22 bp, Homo sapiens
atatttaactggtcccaatata

SEQ ID NO: 10013738 - DNA, 22 bp, Homo sapiens
atatttaactggtcccaatata

SEQ ID NO: 10013739 - DNA, 22 bp, Homo sapiens
atattttggcaaatgtctagat

SEQ ID NO: 10013740 - DNA, 22 bp, Homo sapiens
atcaaagtaggcatatgttttt

SEQ ID NO: 10013741 - DNA, 22 bp, Homo sapiens
atcaaaggtatctatgctgtct

SEQ ID NO: 10013742 - DNA, 23 bp, Homo sapiens
atcaaaggatgtagagaagaagc

SEQ ID NO: 10013743 - DNA, 22 bp, Homo sapiens
atcaaagagtgagatttttact

SEQ ID NO: 10013744 - DNA, 22 bp, Homo sapiens
atcaaagtggttttctgtgctt

SEQ ID NO: 10013745 - DNA, 22 bp, Homo sapiens
atcaaagttcgtaactgataac

SEQ ID NO: 10013746 - DNA, 23 bp, Homo sapiens
atcaaagtggaaatcaattatct

SEQ ID NO: 10013747 - DNA, 23 bp, Homo sapiens
atcaaagtggaaatcaattatct

SEQ ID NO: 10013748 - DNA, 22 bp, Homo sapiens
atcaaagtgatttgtaaacagg

SEQ ID NO: 10013749 - DNA, 22 bp, Homo sapiens
atcaaagtatctcaatatggta

SEQ ID NO: 10013750 - DNA, 22 bp, Homo sapiens
atcagaaactcttagagcaggg

SEQ ID NO: 10013751 - DNA, 22 bp, Homo sapiens
atcagaaactcttagagcaggg

SEQ ID NO: 10013752 - DNA, 22 bp, Homo sapiens
atcagaaaggtgggcaagcaga

SEQ ID NO: 10013753 - DNA, 22 bp, Homo sapiens
atcagaaatagtcatgttactt

SEQ ID NO: 10013754 - DNA, 22 bp, Homo sapiens
atcagaaatctaggattcagaa

SEQ ID NO: 10013755 - DNA, 22 bp, Homo sapiens
atcagaaactcttagagcaggg

SEQ ID NO: 10013756 - DNA, 22 bp, Homo sapiens
atcagaaaaatgagaagagctg

SEQ ID NO: 10013757 - DNA, 22 bp, Homo sapiens
atcagaaaaacataatgttatt

SEQ ID NO: 10013758 - DNA, 22 bp, Homo sapiens
atcagaagaaatggatgtgact

SEQ ID NO: 10013759 - DNA, 22 bp, Homo sapiens
atcagaaattgctaccagtgga

SEQ ID NO: 10013760 - DNA, 22 bp, Homo sapiens
atcacattctttcaaagcagtc

SEQ ID NO: 10013761 - DNA, 22 bp, Homo sapiens
atcacattgccagtgattaccc

SEQ ID NO: 10013762 - DNA, 22 bp, Homo sapiens
atcaacatactgctcaggcatt

SEQ ID NO: 10013763 - DNA, 22 bp, Homo sapiens
atcaacatgaatttctctgaag

SEQ ID NO: 10013764 - DNA, 22 bp, Homo sapiens
atcaacatgaatttctctgaag

SEQ ID NO: 10013765 - DNA, 22 bp, Homo sapiens
atcaacttaaagaaaagatact

SEQ ID NO: 10013766 - DNA, 22 bp, Homo sapiens
atcaacattccaatgtggtaga

SEQ ID NO: 10013767 - DNA, 22 bp, Homo sapiens
atcaacatgtcataaagtgaaa

SEQ ID NO: 10013768 - DNA, 22 bp, Homo sapiens
atcaacatgtcataaagtgaaa

SEQ ID NO: 10013769 - DNA, 22 bp, Homo sapiens
atcaaatacaaagggcataagg

SEQ ID NO: 10013770 - DNA, 22 bp, Homo sapiens
atcaaatacaaagggcataagg

SEQ ID NO: 10013771 - DNA, 22 bp, Homo sapiens
atcaaagttcgtaactgataac

SEQ ID NO: 10013772 - DNA, 22 bp, Homo sapiens
atcaaagtttcccagaagttgt

SEQ ID NO: 10013773 - DNA, 22 bp, Homo sapiens
atcaaatcattgcattaatgtt

SEQ ID NO: 10013774 - DNA, 22 bp, Homo sapiens
atcaaatcattgcattaatgtt

SEQ ID NO: 10013775 - DNA, 22 bp, Homo sapiens
atcaaatataataattttcgct

SEQ ID NO: 10013776 - DNA, 22 bp, Homo sapiens
atcaaatataataattttcgct

SEQ ID NO: 10013777 - DNA, 22 bp, Homo sapiens
atcaaatataataattttcgct

SEQ ID NO: 10013778 - DNA, 22 bp, Homo sapiens
atcaaattatgtgctacaagaa

SEQ ID NO: 10013779 - DNA, 22 bp, Homo sapiens
atcaacagagcaaagcctgaac

SEQ ID NO: 10013780 - DNA, 22 bp, Homo sapiens
atcaacaggtatggatgagatt

SEQ ID NO: 10013781 - DNA, 22 bp, Homo sapiens
atcaacagtgaagagatcaaga

SEQ ID NO: 10013782 - DNA, 22 bp, Homo sapiens
atccagggataaaagtaaggtt

SEQ ID NO: 10013783 - DNA, 22 bp, Homo sapiens
ctgtgtgcagggcacaatggaa

SEQ ID NO: 10013784 - DNA, 22 bp, Homo sapiens
ctgtgtgcaacttgcagttttg

SEQ ID NO: 10013785 - DNA, 22 bp, Homo sapiens
ctgtgtgcctagagggtggccg

SEQ ID NO: 10013786 - DNA, 22 bp, Homo sapiens
ctgtgtgcatagttgtgctcaa

SEQ ID NO: 10013787 - DNA, 22 bp, Homo sapiens
ctgtgtgcagggcacaatggaa

SEQ ID NO: 10013788 - DNA, 22 bp, Homo sapiens
ctgtgtgcaggtgctgggtacc

SEQ ID NO: 10013789 - DNA, 22 bp, Homo sapiens
ctgtgtgcaggtgctgggtacc

SEQ ID NO: 10013790 - DNA, 22 bp, Homo sapiens
atccagggataaaagtaaggtt

SEQ ID NO: 10013791 - DNA, 22 bp, Homo sapiens
atccagggtgtggagagagctc

SEQ ID NO: 10013792 - DNA, 22 bp, Homo sapiens
atccagggtgtggagagagctc

SEQ ID NO: 10013793 - DNA, 18 bp, Homo sapiens
atcctgggccagtctttc

SEQ ID NO: 10013794 - DNA, 18 bp, Homo sapiens
atcctgggccagtctttc

SEQ ID NO: 10013795 - DNA, 22 bp, Homo sapiens
atcctgggcaagtcaatgtccc

SEQ ID NO: 10013796 - DNA, 22 bp, Homo sapiens
atcctgggcaaagtatgctgtc

SEQ ID NO: 10013797 - DNA, 22 bp, Homo sapiens
atcctgggcagtgtgtcactct

SEQ ID NO: 10013798 - DNA, 22 bp, Homo sapiens
atcctgggcagtgtgtcactct

SEQ ID NO: 10013799 - DNA, 22 bp, Homo sapiens
atcctgggcaagtcaatgtccc

SEQ ID NO: 10013800 - DNA, 22 bp, Homo sapiens
atcctgtctatgagtagataat

SEQ ID NO: 10013801 - DNA, 22 bp, Homo sapiens
atcctgtagtctcacagcccca

SEQ ID NO: 10013802 - DNA, 22 bp, Homo sapiens
atcctgtctttgttttaaatat

SEQ ID NO: 10013803 - DNA, 22 bp, Homo sapiens
atcctgtctctacccatcggct

SEQ ID NO: 10013804 - DNA, 19 bp, Homo sapiens
atcctgggtcctccagctg

SEQ ID NO: 10013805 - DNA, 19 bp, Homo sapiens
atcctgggtcctccagctg

SEQ ID NO: 10013806 - DNA, 22 bp, Homo sapiens
atcctgggctgcaccctcagcc

SEQ ID NO: 10013807 - DNA, 22 bp, Homo sapiens
ctgtgtgtcctcggacgagttt

SEQ ID NO: 10013808 - DNA, 22 bp, Homo sapiens
ctgtgtgtcatttgtcaatcct

SEQ ID NO: 10013809 - DNA, 22 bp, Homo sapiens
ctgtgtgtcatttgtcaatcct

SEQ ID NO: 10013810 - DNA, 22 bp, Homo sapiens
ctgtgtgtcatttgtcaatcct

SEQ ID NO: 10013811 - DNA, 22 bp, Homo sapiens
ctgtgtgtcatttgtcaatcct

SEQ ID NO: 10013812 - DNA, 22 bp, Homo sapiens
ctgtgtgtcctcggacgagttt

SEQ ID NO: 10013813 - DNA, 22 bp, Homo sapiens
ctgtgtgtcctcggacgagttt

SEQ ID NO: 10013814 - DNA, 22 bp, Homo sapiens
ctgtgtggcctcaagccagcct

SEQ ID NO: 10013815 - DNA, 22 bp, Homo sapiens
ctgtgtggactggttgaggccc

SEQ ID NO: 10013816 - DNA, 22 bp, Homo sapiens
ctgtgtgctgttagggagctgc

SEQ ID NO: 10013817 - DNA, 22 bp, Homo sapiens
ctgtgtgctgttagggagctgc

SEQ ID NO: 10013818 - DNA, 22 bp, Homo sapiens
ctgtgtgctgaaatgcagtgag

SEQ ID NO: 10013819 - DNA, 22 bp, Homo sapiens
ctgtgtgctgaaatgcagtgag

SEQ ID NO: 10013820 - DNA, 22 bp, Homo sapiens
ctgtgtgcctcctgtgatcagg

SEQ ID NO: 10013821 - DNA, 22 bp, Homo sapiens
ctgtgtgctcggatggactcgt

SEQ ID NO: 10013822 - DNA, 22 bp, Homo sapiens
ctgtgggaaaggatgagattgc

SEQ ID NO: 10013823 - DNA, 22 bp, Homo sapiens
ctgtgggaaaggatgagattgc

SEQ ID NO: 10013824 - DNA, 22 bp, Homo sapiens
ctgtgggagaagctagcacagg

SEQ ID NO: 10013825 - DNA, 22 bp, Homo sapiens
ctgtgggagaagttgctggagt

SEQ ID NO: 10013826 - DNA, 22 bp, Homo sapiens
ctgtgggagaggtgcctggatt

SEQ ID NO: 10013827 - DNA, 21 bp, Homo sapiens
ctgtgggaccaagcactggga

SEQ ID NO: 10013828 - DNA, 22 bp, Homo sapiens
ctgtgggactctgaggaaaagc

SEQ ID NO: 10013829 - DNA, 18 bp, Homo sapiens
ctgtgggaagagtttggg

SEQ ID NO: 10013830 - DNA, 18 bp, Homo sapiens
ctgtgggaaggctttcta

SEQ ID NO: 10013831 - DNA, 22 bp, Homo sapiens
atcagagcaatggataaaatca

SEQ ID NO: 10013832 - DNA, 22 bp, Homo sapiens
atcagaatgcagccagcagtta

SEQ ID NO: 10013833 - DNA, 22 bp, Homo sapiens
atcagaatggagcccacatggt

SEQ ID NO: 10013834 - DNA, 22 bp, Homo sapiens
ctgtggcctttgttggaggtcc

SEQ ID NO: 10013835 - DNA, 22 bp, Homo sapiens
atccttaaaggaattctgattt

SEQ ID NO: 10013836 - DNA, 22 bp, Homo sapiens
atcctgttttagataagcttat

SEQ ID NO: 10013837 - DNA, 22 bp, Homo sapiens
atccttaagaaagttttctata

SEQ ID NO: 10013838 - DNA, 20 bp, Homo sapiens
atccttaaagagaatttcta

SEQ ID NO: 10013839 - DNA, 22 bp, Homo sapiens
atcctgtttggttgtctgcctt

SEQ ID NO: 10013840 - DNA, 20 bp, Homo sapiens
cttagaagggacatcctggg

SEQ ID NO: 10013841 - DNA, 22 bp, Homo sapiens
cttagaaggaacagtttagtgc

SEQ ID NO: 10013842 - DNA, 22 bp, Homo sapiens
cttagaagaatgcctaggacag

SEQ ID NO: 10013843 - DNA, 18 bp, Homo sapiens
cttagaacatcattcctt

SEQ ID NO: 10013844 - DNA, 22 bp, Homo sapiens
cttagaacattctgcctgggaa

SEQ ID NO: 10013845 - DNA, 18 bp, Homo sapiens
cttagaacatcattcctt

SEQ ID NO: 10013846 - DNA, 22 bp, Homo sapiens
cttagaacattctgcctgggaa

SEQ ID NO: 10013847 - DNA, 22 bp, Homo sapiens
cttagaaattgttactcattca

SEQ ID NO: 10013848 - DNA, 22 bp, Homo sapiens
cttagaaattgttactcattca

SEQ ID NO: 10013849 - DNA, 22 bp, Homo sapiens
cttagaaattgttactcattca

SEQ ID NO: 10013850 - DNA, 20 bp, Homo sapiens
cttagaaatttttaccctgg

SEQ ID NO: 10013851 - DNA, 22 bp, Homo sapiens
cttagaacagtgtctgccagag

SEQ ID NO: 10013852 - DNA, 22 bp, Homo sapiens
cttagaacagtgtctgccagag

SEQ ID NO: 10013853 - DNA, 22 bp, Homo sapiens
cttagaacatacttagtgtgat

SEQ ID NO: 10013854 - DNA, 22 bp, Homo sapiens
cttagaacatacttagtgtgat

SEQ ID NO: 10013855 - DNA, 22 bp, Homo sapiens
cttagaattttgcctactacaa

SEQ ID NO: 10013856 - DNA, 22 bp, Homo sapiens
cttagacatggcagctccaagt

SEQ ID NO: 10013857 - DNA, 22 bp, Homo sapiens
cttagaattttgcctactacaa

SEQ ID NO: 10013858 - DNA, 22 bp, Homo sapiens
cttagaagtgggctataattag

SEQ ID NO: 10013859 - DNA, 22 bp, Homo sapiens
cttagaataaaagggggctata

SEQ ID NO: 10013860 - DNA, 22 bp, Homo sapiens
cttagaatgggacccaatgggt

SEQ ID NO: 10013861 - DNA, 22 bp, Homo sapiens
cttagaattttaatccagaaag

SEQ ID NO: 10013862 - DNA, 22 bp, Homo sapiens
cttagaatgtctactcttacca

SEQ ID NO: 10013863 - DNA, 22 bp, Homo sapiens
cttagagatgggttttacttag

SEQ ID NO: 10013864 - DNA, 22 bp, Homo sapiens
cttagagatgggttttacttag

SEQ ID NO: 10013865 - DNA, 22 bp, Homo sapiens
cttagagatgggttttacttag

SEQ ID NO: 10013866 - DNA, 22 bp, Homo sapiens
cttagagcttaggctagccatt

SEQ ID NO: 10013867 - DNA, 22 bp, Homo sapiens
cttagatgaagtcacagaaccc

SEQ ID NO: 10013868 - DNA, 22 bp, Homo sapiens
cttcattaactattggaatgca

SEQ ID NO: 10013869 - DNA, 22 bp, Homo sapiens
cttccagtagtatcattctcat

SEQ ID NO: 10013870 - DNA, 23 bp, Homo sapiens
cttccagtactgcacactcaagg

SEQ ID NO: 10013871 - DNA, 22 bp, Homo sapiens
cttcctagcttcagagtctgtt

SEQ ID NO: 10013872 - DNA, 22 bp, Homo sapiens
cttcctagcttcagagtctgtt

SEQ ID NO: 10013873 - DNA, 22 bp, Homo sapiens
cttcctcccggcccatgctctg

SEQ ID NO: 10013874 - DNA, 22 bp, Homo sapiens
cttcctcatgtgcaatgcaagc

SEQ ID NO: 10013875 - DNA, 22 bp, Homo sapiens
atctgagactgagtttggattt

SEQ ID NO: 10013876 - DNA, 19 bp, Homo sapiens
atctgagattataaacaga

SEQ ID NO: 10013877 - DNA, 19 bp, Homo sapiens
atctgagattataaacaga

SEQ ID NO: 10013878 - DNA, 21 bp, Homo sapiens
atctgatgtataaatacctct

SEQ ID NO: 10013879 - DNA, 20 bp, Homo sapiens
cttcttggagatggtgtttt

SEQ ID NO: 10013880 - DNA, 22 bp, Homo sapiens
cttcttggctgcaagtctctgt

SEQ ID NO: 10013881 - DNA, 22 bp, Homo sapiens
cttcttattaatccttctctgt

SEQ ID NO: 10013882 - DNA, 22 bp, Homo sapiens
atctgcatcagactttgcatga

SEQ ID NO: 10013883 - DNA, 22 bp, Homo sapiens
atctgcaggatgttaggatgat

SEQ ID NO: 10013884 - DNA, 19 bp, Homo sapiens
atctgaagtaggtgcagct

SEQ ID NO: 10013885 - DNA, 22 bp, Homo sapiens
atctgaagggaagtggaaggca

SEQ ID NO: 10013886 - DNA, 22 bp, Homo sapiens
atctgaagggaagtggaaggca

SEQ ID NO: 10013887 - DNA, 22 bp, Homo sapiens
atctgaataaatttcttttagt

SEQ ID NO: 10013888 - DNA, 22 bp, Homo sapiens
atctgaagtccttataatctga

SEQ ID NO: 10013889 - DNA, 22 bp, Homo sapiens
atctgaagtggagaaaaatata

SEQ ID NO: 10013890 - DNA, 21 bp, Homo sapiens
atctgaagtttgagaggaaag

SEQ ID NO: 10013891 - DNA, 22 bp, Homo sapiens
atctgaaatagtcttatctgag

SEQ ID NO: 10013892 - DNA, 21 bp, Homo sapiens
atctgaaaggttagtgttgag

SEQ ID NO: 10013893 - DNA, 21 bp, Homo sapiens
atctgaaatgtcaaagcagat

SEQ ID NO: 10013894 - DNA, 21 bp, Homo sapiens
atctgaaatgtcaaagcagat

SEQ ID NO: 10013895 - DNA, 22 bp, Homo sapiens
atctgaagaatgaatggaatta

SEQ ID NO: 10013896 - DNA, 22 bp, Homo sapiens
atctgaagaatgaatggaatta

SEQ ID NO: 10013897 - DNA, 22 bp, Homo sapiens
atctgaaatagtcttatctgag

SEQ ID NO: 10013898 - DNA, 22 bp, Homo sapiens
atctgaaagctaggagttctca

SEQ ID NO: 10013899 - DNA, 22 bp, Homo sapiens
atctctgcatccctcaaggttg

SEQ ID NO: 10013900 - DNA, 22 bp, Homo sapiens
atctctgcgtccccagcatcga

SEQ ID NO: 10013901 - DNA, 22 bp, Homo sapiens
atctgaaaaatctcctttgtca

SEQ ID NO: 10013902 - DNA, 22 bp, Homo sapiens
atctgaaaagctttaatgagct

SEQ ID NO: 10013903 - DNA, 23 bp, Homo sapiens
atctgaaaaggcattttcttccc

SEQ ID NO: 10013904 - DNA, 22 bp, Homo sapiens
atctgaaactctgacattgtct

SEQ ID NO: 10013905 - DNA, 22 bp, Homo sapiens
atctgaaactctgacattgtct

SEQ ID NO: 10013906 - DNA, 22 bp, Homo sapiens
atctgaaactctgacattgtct

SEQ ID NO: 10013907 - DNA, 22 bp, Homo sapiens
atctctgatttacagcatctct

SEQ ID NO: 10013908 - DNA, 22 bp, Homo sapiens
cttcctctagcctagtaatgcc

SEQ ID NO: 10013909 - DNA, 17 bp, Homo sapiens
ctctgcagtgcatggct

SEQ ID NO: 10013910 - DNA, 22 bp, Homo sapiens
ctctgcagtgtaacagcgcttg

SEQ ID NO: 10013911 - DNA, 23 bp, Homo sapiens
ctctgcaggagagtgggcagggc

SEQ ID NO: 10013912 - DNA, 21 bp, Homo sapiens
ctctgcagccctgcttccagg

SEQ ID NO: 10013913 - DNA, 22 bp, Homo sapiens
ctctcagggacccagccagcct

SEQ ID NO: 10013914 - DNA, 22 bp, Homo sapiens
ctctcagggcaggtggcctttc

SEQ ID NO: 10013915 - DNA, 22 bp, Homo sapiens
ctctcaggtagagcccaagaat

SEQ ID NO: 10013916 - DNA, 15 bp, Homo sapiens
ctctcaggcaggcag

SEQ ID NO: 10013917 - DNA, 22 bp, Homo sapiens
ctctgagcagaggccgtggcta

SEQ ID NO: 10013918 - DNA, 22 bp, Homo sapiens
ctctgagcagaggccgtggcta

SEQ ID NO: 10013919 - DNA, 22 bp, Homo sapiens
ctctgagcagaggccgtggcta

SEQ ID NO: 10013920 - DNA, 21 bp, Homo sapiens
ctctgcagccctgcttccagg

SEQ ID NO: 10013921 - DNA, 22 bp, Homo sapiens
ctctgagcccgctgcagcccca

SEQ ID NO: 10013922 - DNA, 22 bp, Homo sapiens
ctctccaagttatcaagatgaa

SEQ ID NO: 10013923 - DNA, 22 bp, Homo sapiens
ctctcagtgccacacagccatt

SEQ ID NO: 10013924 - DNA, 22 bp, Homo sapiens
ctctgcctgccactgttcaggc

SEQ ID NO: 10013925 - DNA, 22 bp, Homo sapiens
ctctgcattttaacagatgatt

SEQ ID NO: 10013926 - DNA, 22 bp, Homo sapiens
ctctgcagtgtaacagcgcttg

SEQ ID NO: 10013927 - DNA, 22 bp, Homo sapiens
ctctgcatgccacatgagtgac

SEQ ID NO: 10013928 - DNA, 22 bp, Homo sapiens
ctctgcatcagcttcattctgt

SEQ ID NO: 10013929 - DNA, 22 bp, Homo sapiens
ctctgcatcaggcattatggat

SEQ ID NO: 10013930 - DNA, 22 bp, Homo sapiens
ctctgcctgtctcatcctgcaa

SEQ ID NO: 10013931 - DNA, 22 bp, Homo sapiens
ctctgcctgtctcatcctgcaa

SEQ ID NO: 10013932 - DNA, 22 bp, Homo sapiens
ctctgctgatctcagctgggct

SEQ ID NO: 10013933 - DNA, 22 bp, Homo sapiens
ctctggattgctgtgagatgct

SEQ ID NO: 10013934 - DNA, 22 bp, Homo sapiens
ctctgctcaccagccatgtgat

SEQ ID NO: 10013935 - DNA, 22 bp, Homo sapiens
ctctgctcaccagccatgtgat

SEQ ID NO: 10013936 - DNA, 22 bp, Homo sapiens
ctctggctttgctcatgcatcc

SEQ ID NO: 10013937 - DNA, 22 bp, Homo sapiens
ctctgggaagggctgagcactg

SEQ ID NO: 10013938 - DNA, 22 bp, Homo sapiens
ctctggcttgttaatgcatatt

SEQ ID NO: 10013939 - DNA, 22 bp, Homo sapiens
ctctgggactagaaccccaggg

SEQ ID NO: 10013940 - DNA, 22 bp, Homo sapiens
ctctgggaccatggcaagtgcg

SEQ ID NO: 10013941 - DNA, 22 bp, Homo sapiens
ctctgggagaggacacttggag

SEQ ID NO: 10013942 - DNA, 22 bp, Homo sapiens
ctctgggaccacgtgactctgc

SEQ ID NO: 10013943 - DNA, 22 bp, Homo sapiens
ctctgggacatcccttggccta

SEQ ID NO: 10013944 - DNA, 22 bp, Homo sapiens
ctctgggacatcccttggccta

SEQ ID NO: 10013945 - DNA, 22 bp, Homo sapiens
ctctgggcttgttgacctgcac

SEQ ID NO: 10013946 - DNA, 22 bp, Homo sapiens
ctctgggcttcaagtcagattt

SEQ ID NO: 10013947 - DNA, 22 bp, Homo sapiens
ctctgggcttacctgcttcctg

SEQ ID NO: 10013948 - DNA, 22 bp, Homo sapiens
ctgaaataaagttgctaaaatt

SEQ ID NO: 10013949 - DNA, 23 bp, Homo sapiens
ctgaaataccagaaaatcagtgt

SEQ ID NO: 10013950 - DNA, 22 bp, Homo sapiens
ctgaaagggagaacaccaagag

SEQ ID NO: 10013951 - DNA, 22 bp, Homo sapiens
ctctttggttaatcacacagat

SEQ ID NO: 10013952 - DNA, 22 bp, Homo sapiens
ctgaaaggcagtgggtagtgtg

SEQ ID NO: 10013953 - DNA, 22 bp, Homo sapiens
ctgaaagggttacatagtaagt

SEQ ID NO: 10013954 - DNA, 22 bp, Homo sapiens
ctgaaaggtataaataagactt

SEQ ID NO: 10013955 - DNA, 22 bp, Homo sapiens
ctgaaatagtttcatagaactt

SEQ ID NO: 10013956 - DNA, 22 bp, Homo sapiens
ctgaaatagtttcatagaactt

SEQ ID NO: 10013957 - DNA, 17 bp, Homo sapiens
ctgaaatattatgataa

SEQ ID NO: 10013958 - DNA, 22 bp, Homo sapiens
ctctgggcttgttgacctgcac

SEQ ID NO: 10013959 - DNA, 17 bp, Homo sapiens
ctctggggacagttcta

SEQ ID NO: 10013960 - DNA, 22 bp, Homo sapiens
ctctggggtggaggaggctgac

SEQ ID NO: 10013961 - DNA, 22 bp, Homo sapiens
ctctttggtgcaccttgcagtc

SEQ ID NO: 10013962 - DNA, 22 bp, Homo sapiens
agttagaaagtaaatcatttga

SEQ ID NO: 10013963 - DNA, 22 bp, Homo sapiens
agttagaaagtaaatcatttga

SEQ ID NO: 10013964 - DNA, 22 bp, Homo sapiens
agttagaagtgtgtcatctgtg

SEQ ID NO: 10013965 - DNA, 22 bp, Homo sapiens
agttagaatagtcagattgtag

SEQ ID NO: 10013966 - DNA, 22 bp, Homo sapiens
agttagaatagtcagattgtag

SEQ ID NO: 10013967 - DNA, 22 bp, Homo sapiens
agttaagagtgtgaaaatgtta

SEQ ID NO: 10013968 - DNA, 22 bp, Homo sapiens
agttagaaagtaaatcatttga

SEQ ID NO: 10013969 - DNA, 22 bp, Homo sapiens
agttaactcattttataatgcc

SEQ ID NO: 10013970 - DNA, 22 bp, Homo sapiens
ctgagaaaccaggtgctctgat

SEQ ID NO: 10013971 - DNA, 22 bp, Homo sapiens
ctgagaaacatatttccatcta

SEQ ID NO: 10013972 - DNA, 22 bp, Homo sapiens
ctgagaaacatatttccatcta

SEQ ID NO: 10013973 - DNA, 22 bp, Homo sapiens
agttatataactatctagatgc

SEQ ID NO: 10013974 - DNA, 22 bp, Homo sapiens
agttatagccatattctaagat

SEQ ID NO: 10013975 - DNA, 22 bp, Homo sapiens
agttatagaaccaggtcctcac

SEQ ID NO: 10013976 - DNA, 22 bp, Homo sapiens
agttataggtggttttgagaat

SEQ ID NO: 10013977 - DNA, 20 bp, Homo sapiens
agttatagtatctagccatg

SEQ ID NO: 10013978 - DNA, 20 bp, Homo sapiens
agttatagtatctagccatg

SEQ ID NO: 10013979 - DNA, 22 bp, Homo sapiens
agttataatctgctactgatat

SEQ ID NO: 10013980 - DNA, 20 bp, Homo sapiens
agttagtgagtaattgagct

SEQ ID NO: 10013981 - DNA, 22 bp, Homo sapiens
agttagaatggatgttgagagc

SEQ ID NO: 10013982 - DNA, 22 bp, Homo sapiens
agttagaatataattatgttaa

SEQ ID NO: 10013983 - DNA, 22 bp, Homo sapiens
agttagtatacaaagtaacagc

SEQ ID NO: 10013984 - DNA, 22 bp, Homo sapiens
ctgaggagaggtggcctgtgtt

SEQ ID NO: 10013985 - DNA, 22 bp, Homo sapiens
ctgaggagaggtggcctgtgtt

SEQ ID NO: 10013986 - DNA, 22 bp, Homo sapiens
ctgaggagaggtggcctgtgtt

SEQ ID NO: 10013987 - DNA, 22 bp, Homo sapiens
ctgaggagaggtggcctgtgtt

SEQ ID NO: 10013988 - DNA, 22 bp, Homo sapiens
ctgaggagaccatcaactaatt

SEQ ID NO: 10013989 - DNA, 22 bp, Homo sapiens
ctgaggagaccatcaactaatt

SEQ ID NO: 10013990 - DNA, 22 bp, Homo sapiens
ctgaggagacagaagccaaata

SEQ ID NO: 10013991 - DNA, 22 bp, Homo sapiens
ctgagctgggactcagtagcaa

SEQ ID NO: 10013992 - DNA, 22 bp, Homo sapiens
ctgagcagcagggagactggtg

SEQ ID NO: 10013993 - DNA, 22 bp, Homo sapiens
ctgagcagcagggagactggtg

SEQ ID NO: 10013994 - DNA, 22 bp, Homo sapiens
ctgaggagaacaatgagatcaa

SEQ ID NO: 10013995 - DNA, 17 bp, Homo sapiens
ctgaggagaacagaaag

SEQ ID NO: 10013996 - DNA, 22 bp, Homo sapiens
ctgagcagaggtcaagatactt

SEQ ID NO: 10013997 - DNA, 22 bp, Homo sapiens
ctgagcagatgaccagccccag

SEQ ID NO: 10013998 - DNA, 22 bp, Homo sapiens
ctgagcagatgttgcccagaag

SEQ ID NO: 10013999 - DNA, 22 bp, Homo sapiens
ctgagcagcaacccagagcctc

SEQ ID NO: 10014000 - DNA, 22 bp, Homo sapiens
ctgagcagcaacccagagcctc

SEQ ID NO: 10014001 - DNA, 22 bp, Homo sapiens
ctgagcagcaacccagagcctc

SEQ ID NO: 10014002 - DNA, 22 bp, Homo sapiens
ctgagcagcaccttcaagaaac

SEQ ID NO: 10014003 - DNA, 22 bp, Homo sapiens
ctgaaatggttgcctggagaat

SEQ ID NO: 10014004 - DNA, 22 bp, Homo sapiens
ctgaaatgttaaatacttggct

SEQ ID NO: 10014005 - DNA, 22 bp, Homo sapiens
agtgtctgcctgggaggagcat

SEQ ID NO: 10014006 - DNA, 22 bp, Homo sapiens
agtgtctgcctgggaggagcat

SEQ ID NO: 10014007 - DNA, 22 bp, Homo sapiens
agtgtctgcgggcagaggagcg

SEQ ID NO: 10014008 - DNA, 22 bp, Homo sapiens
agtgtctgctcagacagctaca

SEQ ID NO: 10014009 - DNA, 22 bp, Homo sapiens
agtgtctgctcagacagctaca

SEQ ID NO: 10014010 - DNA, 22 bp, Homo sapiens
agtgtctgcttatcagttcttg

SEQ ID NO: 10014011 - DNA, 22 bp, Homo sapiens
agtgtctgcggcggggaggcgg

SEQ ID NO: 10014012 - DNA, 22 bp, Homo sapiens
agtgtctgcgggcagaggagcg

SEQ ID NO: 10014013 - DNA, 22 bp, Homo sapiens
agtgtctgctaggttcatcaac

SEQ ID NO: 10014014 - DNA, 22 bp, Homo sapiens
agtgtctgcgggcagaggagcg

SEQ ID NO: 10014015 - DNA, 22 bp, Homo sapiens
agtgtctgctttgagtcaggtg

SEQ ID NO: 10014016 - DNA, 22 bp, Homo sapiens
agtgtctgctttgagtcaggtg

SEQ ID NO: 10014017 - DNA, 22 bp, Homo sapiens
agtgtctgcttatcagttcttg

SEQ ID NO: 10014018 - DNA, 22 bp, Homo sapiens
agtgtctgctttgagtcaggtg

SEQ ID NO: 10014019 - DNA, 20 bp, Homo sapiens
agtgtctggattttgtaacc

SEQ ID NO: 10014020 - DNA, 20 bp, Homo sapiens
agtgtctgggcctcaggccc

SEQ ID NO: 10014021 - DNA, 18 bp, Homo sapiens
agtgtctggatatttggg

SEQ ID NO: 10014022 - DNA, 22 bp, Homo sapiens
agtgtctggaggcattcttggt

SEQ ID NO: 10014023 - DNA, 22 bp, Homo sapiens
ctgaagctttacttcaaataca

SEQ ID NO: 10014024 - DNA, 22 bp, Homo sapiens
ctgaagctttacttcaaataca

SEQ ID NO: 10014025 - DNA, 22 bp, Homo sapiens
ctgaagcttgataaactataaa

SEQ ID NO: 10014026 - DNA, 22 bp, Homo sapiens
ctgacacccagcagaactggga

SEQ ID NO: 10014027 - DNA, 22 bp, Homo sapiens
ctgacacactgagcatttgata

SEQ ID NO: 10014028 - DNA, 22 bp, Homo sapiens
ctgacttttccaaataatactt

SEQ ID NO: 10014029 - DNA, 22 bp, Homo sapiens
ctgagaaaagacatttctagat

SEQ ID NO: 10014030 - DNA, 22 bp, Homo sapiens
ctgagaaaatttcaggaagtgt

SEQ ID NO: 10014031 - DNA, 22 bp, Homo sapiens
ctgagaaaagtatgagctctgg

SEQ ID NO: 10014032 - DNA, 22 bp, Homo sapiens
ctgagaaaagctttcttataca

SEQ ID NO: 10014033 - DNA, 20 bp, Homo sapiens
ctgacagaaaatatttcatc

SEQ ID NO: 10014034 - DNA, 22 bp, Homo sapiens
ctgacagaatcattaagaccat

SEQ ID NO: 10014035 - DNA, 22 bp, Homo sapiens
ctccaggctggatccaagtcaa

SEQ ID NO: 10014036 - DNA, 22 bp, Homo sapiens
ctccaggaaagcctgaggcccg

SEQ ID NO: 10014037 - DNA, 22 bp, Homo sapiens
ctccaggaaaatagggaatgag

SEQ ID NO: 10014038 - DNA, 22 bp, Homo sapiens
ctccagctttagctctccaggg

SEQ ID NO: 10014039 - DNA, 22 bp, Homo sapiens
ctccagctttagctctccaggg

SEQ ID NO: 10014040 - DNA, 22 bp, Homo sapiens
ctccagctgctggtctgagact

SEQ ID NO: 10014041 - DNA, 22 bp, Homo sapiens
ctccagcttccctcagctgtgg

SEQ ID NO: 10014042 - DNA, 22 bp, Homo sapiens
ctccagctcttaactgcggaag

SEQ ID NO: 10014043 - DNA, 22 bp, Homo sapiens
agtcttcatttgtgttcaagac

SEQ ID NO: 10014044 - DNA, 22 bp, Homo sapiens
agtcttctcatttcacatgctt

SEQ ID NO: 10014045 - DNA, 21 bp, Homo sapiens
agtcttctccagaggctgggg

SEQ ID NO: 10014046 - DNA, 22 bp, Homo sapiens
ctccagagagtccagctctggg

SEQ ID NO: 10014047 - DNA, 22 bp, Homo sapiens
agtcttatggttaaatagatgc

SEQ ID NO: 10014048 - DNA, 22 bp, Homo sapiens
agtcttaggctccattagtaga

SEQ ID NO: 10014049 - DNA, 22 bp, Homo sapiens
agtcttagtatggttttaggtt

SEQ ID NO: 10014050 - DNA, 22 bp, Homo sapiens
agtcttatggccatctctgatt

SEQ ID NO: 10014051 - DNA, 22 bp, Homo sapiens
agtcttagaactacagtgccta

SEQ ID NO: 10014052 - DNA, 21 bp, Homo sapiens
agtcttaggcacagctgtgtc

SEQ ID NO: 10014053 - DNA, 22 bp, Homo sapiens
agtcttagattttattttggtc

SEQ ID NO: 10014054 - DNA, 22 bp, Homo sapiens
agtcttagagtctgtgtcatga

SEQ ID NO: 10014055 - DNA, 22 bp, Homo sapiens
agtcttcagagaaattaactct

SEQ ID NO: 10014056 - DNA, 22 bp, Homo sapiens
agtcttatgtttgtgaagaact

SEQ ID NO: 10014057 - DNA, 22 bp, Homo sapiens
agtcttcacatcagtctaaaga

SEQ ID NO: 10014058 - DNA, 22 bp, Homo sapiens
agtcttcactcttcactactat

SEQ ID NO: 10014059 - DNA, 19 bp, Homo sapiens
agtcttcatctgccaggcc

SEQ ID NO: 10014060 - DNA, 23 bp, Homo sapiens
agtcttcattgtatttccagacc

SEQ ID NO: 10014061 - DNA, 22 bp, Homo sapiens
agtcttcatttagttgatccag

SEQ ID NO: 10014062 - DNA, 22 bp, Homo sapiens
agtcttcagcagggttaaaccc

SEQ ID NO: 10014063 - DNA, 22 bp, Homo sapiens
agtcttcagcagggttaaaccc

SEQ ID NO: 10014064 - DNA, 22 bp, Homo sapiens
agtcttcagcagccttctcagg

SEQ ID NO: 10014065 - DNA, 22 bp, Homo sapiens
agtcttcagcagccttctcagg

SEQ ID NO: 10014066 - DNA, 22 bp, Homo sapiens
agtcttcagcagccttctcagg

SEQ ID NO: 10014067 - DNA, 22 bp, Homo sapiens
agtcctggcatataggtcctca

SEQ ID NO: 10014068 - DNA, 22 bp, Homo sapiens
agtcctggcatataggtcctca

SEQ ID NO: 10014069 - DNA, 22 bp, Homo sapiens
agtcctagccctggatccatca

SEQ ID NO: 10014070 - DNA, 22 bp, Homo sapiens
agtcccctctaacccaacttta

SEQ ID NO: 10014071 - DNA, 22 bp, Homo sapiens
agtcccttctcaaagtgtgcgg

SEQ ID NO: 10014072 - DNA, 22 bp, Homo sapiens
agtccctgtactttccactgcc

SEQ ID NO: 10014073 - DNA, 22 bp, Homo sapiens
agtccgtggccagactcaagag

SEQ ID NO: 10014074 - DNA, 20 bp, Homo sapiens
agtccctttggtcaggtatt

SEQ ID NO: 10014075 - DNA, 22 bp, Homo sapiens
agtccgcctgctgccgtggcag

SEQ ID NO: 10014076 - DNA, 22 bp, Homo sapiens
ctcattgcccagatccccacag

SEQ ID NO: 10014077 - DNA, 22 bp, Homo sapiens
ctcattgcaacctccgcctccc

SEQ ID NO: 10014078 - DNA, 22 bp, Homo sapiens
ctcattcattcccgcagccacc

SEQ ID NO: 10014079 - DNA, 22 bp, Homo sapiens
ctcattgcaacctccgcctccc

SEQ ID NO: 10014080 - DNA, 22 bp, Homo sapiens
ctcattgcaacctccgcctccc

SEQ ID NO: 10014081 - DNA, 22 bp, Homo sapiens
ctcatgtaagagagcattagtt

SEQ ID NO: 10014082 - DNA, 22 bp, Homo sapiens
ctcatggagggagtgctcttcc

SEQ ID NO: 10014083 - DNA, 22 bp, Homo sapiens
ctcatggcagagtcacctgtcc

SEQ ID NO: 10014084 - DNA, 22 bp, Homo sapiens
ctcattaaaggaaatcacctgc

SEQ ID NO: 10014085 - DNA, 20 bp, Homo sapiens
ctcatgtggcaccaggcact

SEQ ID NO: 10014086 - DNA, 18 bp, Homo sapiens
ctcatgtgtggtcccagc

SEQ ID NO: 10014087 - DNA, 22 bp, Homo sapiens
ctcatctgtctgggctggtttt

SEQ ID NO: 10014088 - DNA, 18 bp, Homo sapiens
ctcagtgtttgctgaaaa

SEQ ID NO: 10014089 - DNA, 22 bp, Homo sapiens
agtcctgggtccagcaggtcct

SEQ ID NO: 10014090 - DNA, 22 bp, Homo sapiens
ctcctggctttcccagaccagg

SEQ ID NO: 10014091 - DNA, 22 bp, Homo sapiens
ctcctgggaaaggctggacaca

SEQ ID NO: 10014092 - DNA, 22 bp, Homo sapiens
ctcctgggaaaggctggacaca

SEQ ID NO: 10014093 - DNA, 22 bp, Homo sapiens
ctcctgggaaaggctggacaca

SEQ ID NO: 10014094 - DNA, 22 bp, Homo sapiens
ctcctgggaatttagttgtgag

SEQ ID NO: 10014095 - DNA, 20 bp, Homo sapiens
ctcctgggactgctggttat

SEQ ID NO: 10014096 - DNA, 20 bp, Homo sapiens
ctcctgggactgctggttat

SEQ ID NO: 10014097 - DNA, 22 bp, Homo sapiens
ctcctgggaatttagttgtgag

SEQ ID NO: 10014098 - DNA, 22 bp, Homo sapiens
ctcctgggtcattgccagcaaa

SEQ ID NO: 10014099 - DNA, 22 bp, Homo sapiens
ctcctgggggacagcggcaggg

SEQ ID NO: 10014100 - DNA, 22 bp, Homo sapiens
ctcctgggggacagcggcaggg

SEQ ID NO: 10014101 - DNA, 22 bp, Homo sapiens
ctcctggggccatggaaggaac

SEQ ID NO: 10014102 - DNA, 22 bp, Homo sapiens
ctcctggggccatggaaggaac

SEQ ID NO: 10014103 - DNA, 22 bp, Homo sapiens
ctcctggggcacttagaagcaa

SEQ ID NO: 10014104 - DNA, 22 bp, Homo sapiens
ctcctggggcacttagaagcaa

SEQ ID NO: 10014105 - DNA, 22 bp, Homo sapiens
ctcctgggcttcgaaggctccc

SEQ ID NO: 10014106 - DNA, 22 bp, Homo sapiens
agtggcagagtgcactcaggca

SEQ ID NO: 10014107 - DNA, 22 bp, Homo sapiens
agtggcagagtgcactcaggca

SEQ ID NO: 10014108 - DNA, 22 bp, Homo sapiens
ctcctgggtcattgccagcaaa

SEQ ID NO: 10014109 - DNA, 22 bp, Homo sapiens
ctcctgggtcattgccagcaaa

SEQ ID NO: 10014110 - DNA, 22 bp, Homo sapiens
agtggcagaagccaagtctgca

SEQ ID NO: 10014111 - DNA, 22 bp, Homo sapiens
agtggcagaggttgactgcagt

SEQ ID NO: 10014112 - DNA, 22 bp, Homo sapiens
agtggcagatctctggtctgga

SEQ ID NO: 10014113 - DNA, 19 bp, Homo sapiens
agtggcagatctggaagta

SEQ ID NO: 10014114 - DNA, 19 bp, Homo sapiens
agtggcagatctggaagta

SEQ ID NO: 10014115 - DNA, 22 bp, Homo sapiens
ctctcagacacccatttggaaa

SEQ ID NO: 10014116 - DNA, 22 bp, Homo sapiens
ctctcagatggagtgtgaatgg

SEQ ID NO: 10014117 - DNA, 22 bp, Homo sapiens
ctctcagcaggaaagcatgcaa

SEQ ID NO: 10014118 - DNA, 22 bp, Homo sapiens
ctcctcacacccactgcaacca

SEQ ID NO: 10014119 - DNA, 22 bp, Homo sapiens
ctcctaggtgctcactggggtc

SEQ ID NO: 10014120 - DNA, 22 bp, Homo sapiens
ctcctaggtgctcactggggtc

SEQ ID NO: 10014121 - DNA, 22 bp, Homo sapiens
ctcctaggtaacagggtggttt

SEQ ID NO: 10014122 - DNA, 22 bp, Homo sapiens
ctcctagatgtcttcagagaaa

SEQ ID NO: 10014123 - DNA, 18 bp, Homo sapiens
ctcctggctgatggtgag

SEQ ID NO: 10014124 - DNA, 19 bp, Homo sapiens
ctcctggctctgtcatttt

SEQ ID NO: 10014125 - DNA, 22 bp, Homo sapiens
ctcctcagaagagggtaacaca

SEQ ID NO: 10014126 - DNA, 22 bp, Homo sapiens
ctcctgccaccgcggtgtcctg

SEQ ID NO: 10014127 - DNA, 22 bp, Homo sapiens
ctccctccctacgtgagctcac

SEQ ID NO: 10014128 - DNA, 22 bp, Homo sapiens
ctccctccaaataagactcggg

SEQ ID NO: 10014129 - DNA, 22 bp, Homo sapiens
ctccctccctacgtgagctcac

SEQ ID NO: 10014130 - DNA, 22 bp, Homo sapiens
ctccagggaaaggggcgtccgc

SEQ ID NO: 10014131 - DNA, 20 bp, Homo sapiens
ctccagggaacagactggag

SEQ ID NO: 10014132 - DNA, 23 bp, Homo sapiens
aggtaggttattgctgctacctg

SEQ ID NO: 10014133 - DNA, 22 bp, Homo sapiens
cctggatagctactggccaggc

SEQ ID NO: 10014134 - DNA, 22 bp, Homo sapiens
cctggatgatccatgtcatgga

SEQ ID NO: 10014135 - DNA, 22 bp, Homo sapiens
cctggctctgccacttactgcc

SEQ ID NO: 10014136 - DNA, 22 bp, Homo sapiens
cctggctctgcagccactccag

SEQ ID NO: 10014137 - DNA, 22 bp, Homo sapiens
cctggctctgcagccactccag

SEQ ID NO: 10014138 - DNA, 19 bp, Homo sapiens
aggtccctgtcacctctca

SEQ ID NO: 10014139 - DNA, 21 bp, Homo sapiens
aggtcccaggtttgggcagca

SEQ ID NO: 10014140 - DNA, 22 bp, Homo sapiens
aggtcccagtgttagggtgaca

SEQ ID NO: 10014141 - DNA, 22 bp, Homo sapiens
aggtcccaggcatagctggtct

SEQ ID NO: 10014142 - DNA, 21 bp, Homo sapiens
aggtcccaggtttgggcagca

SEQ ID NO: 10014143 - DNA, 22 bp, Homo sapiens
aggtccagttttctgacaaggg

SEQ ID NO: 10014144 - DNA, 22 bp, Homo sapiens
aggtccagttttctgacaaggg

SEQ ID NO: 10014145 - DNA, 22 bp, Homo sapiens
cctgccagcccgcgttcatgcc

SEQ ID NO: 10014146 - DNA, 23 bp, Homo sapiens
cctgcagctgctggggctccacc

SEQ ID NO: 10014147 - DNA, 23 bp, Homo sapiens
cctgcagctgccacgccctgctc

SEQ ID NO: 10014148 - DNA, 22 bp, Homo sapiens
cctgcagagccacgtgccagcg

SEQ ID NO: 10014149 - DNA, 18 bp, Homo sapiens
cctgcagcccaggaggcc

SEQ ID NO: 10014150 - DNA, 22 bp, Homo sapiens
aggtacagggtgaaagtttatg

SEQ ID NO: 10014151 - DNA, 22 bp, Homo sapiens
aggtacaggaggttggggctac

SEQ ID NO: 10014152 - DNA, 22 bp, Homo sapiens
cctgccagcgcttatctctcgg

SEQ ID NO: 10014153 - DNA, 22 bp, Homo sapiens
cctgccagcgcttatctctcgg

SEQ ID NO: 10014154 - DNA, 23 bp, Homo sapiens
aggtaggttattgctgctacctg

SEQ ID NO: 10014155 - DNA, 23 bp, Homo sapiens
aggtaggttattgctgctacctg

SEQ ID NO: 10014156 - DNA, 22 bp, Homo sapiens
aggtagggttaatggagatata

SEQ ID NO: 10014157 - DNA, 22 bp, Homo sapiens
aggtagggttaatggagatata

SEQ ID NO: 10014158 - DNA, 22 bp, Homo sapiens
aggtagggctaggctgcgtctg

SEQ ID NO: 10014159 - DNA, 22 bp, Homo sapiens
aggtagggaagaaggcatgaaa

SEQ ID NO: 10014160 - DNA, 22 bp, Homo sapiens
aggtagggaagaaggcatgaaa

SEQ ID NO: 10014161 - DNA, 22 bp, Homo sapiens
cctgggcataaatcactccaag

SEQ ID NO: 10014162 - DNA, 22 bp, Homo sapiens
cctggctctgtcctcgcgcaaa

SEQ ID NO: 10014163 - DNA, 22 bp, Homo sapiens
cctggctctggttccctcagct

SEQ ID NO: 10014164 - DNA, 22 bp, Homo sapiens
cctggctctgcgtgcagctccg

SEQ ID NO: 10014165 - DNA, 22 bp, Homo sapiens
cctgggctcaggcttgggcagc

SEQ ID NO: 10014166 - DNA, 22 bp, Homo sapiens
cctgggctccactccaagagca

SEQ ID NO: 10014167 - DNA, 22 bp, Homo sapiens
cctgggctccactccaagagca

SEQ ID NO: 10014168 - DNA, 22 bp, Homo sapiens
cctgggctcaggcttgggcagc

SEQ ID NO: 10014169 - DNA, 22 bp, Homo sapiens
cctgggctcaggcttgggcagc

SEQ ID NO: 10014170 - DNA, 22 bp, Homo sapiens
cctgggctcaggcttgggcagc

SEQ ID NO: 10014171 - DNA, 22 bp, Homo sapiens
cctgggctcacagccaaggctc

SEQ ID NO: 10014172 - DNA, 22 bp, Homo sapiens
cctgggcttctgtctagatgtt

SEQ ID NO: 10014173 - DNA, 22 bp, Homo sapiens
cctgggcttctgtctagatgtt

SEQ ID NO: 10014174 - DNA, 22 bp, Homo sapiens
cctgggcttctgtctagatgtt

SEQ ID NO: 10014175 - DNA, 20 bp, Homo sapiens
cctgggctccaggagccccg

SEQ ID NO: 10014176 - DNA, 22 bp, Homo sapiens
cctgggcttgcatctgtgctgg

SEQ ID NO: 10014177 - DNA, 22 bp, Homo sapiens
cctgtcagctgatggctatgta

SEQ ID NO: 10014178 - DNA, 22 bp, Homo sapiens
cctgtcagggtttgcctcagaa

SEQ ID NO: 10014179 - DNA, 22 bp, Homo sapiens
cctgggctttgagggcaggatg

SEQ ID NO: 10014180 - DNA, 22 bp, Homo sapiens
cctgtcagttgctgtcagggat

SEQ ID NO: 10014181 - DNA, 22 bp, Homo sapiens
cctgtcagttgctgtcagggat

SEQ ID NO: 10014182 - DNA, 22 bp, Homo sapiens
cctgggctttcaaaaccagcct

SEQ ID NO: 10014183 - DNA, 22 bp, Homo sapiens
cctgggctttcaaaaccagcct

SEQ ID NO: 10014184 - DNA, 22 bp, Homo sapiens
aggtggggaggagtgtctcttt

SEQ ID NO: 10014185 - DNA, 22 bp, Homo sapiens
aggtggggaggagtgtctcttt

SEQ ID NO: 10014186 - DNA, 22 bp, Homo sapiens
aggtgggcacacctcccttctc

SEQ ID NO: 10014187 - DNA, 22 bp, Homo sapiens
cctgtgcattgcagggtgttca

SEQ ID NO: 10014188 - DNA, 21 bp, Homo sapiens
cctgtgccaaagtgtgttagg

SEQ ID NO: 10014189 - DNA, 22 bp, Homo sapiens
cctgtgccaaaaggctgcttat

SEQ ID NO: 10014190 - DNA, 22 bp, Homo sapiens
aggtggggcccaccaatttgca

SEQ ID NO: 10014191 - DNA, 22 bp, Homo sapiens
aggtggggccaaatgctacagt

SEQ ID NO: 10014192 - DNA, 22 bp, Homo sapiens
aggtggggagtatatgtaattg

SEQ ID NO: 10014193 - DNA, 22 bp, Homo sapiens
cctgtctatcaagacatcttca

SEQ ID NO: 10014194 - DNA, 22 bp, Homo sapiens
cctgtctccctggcatggctca

SEQ ID NO: 10014195 - DNA, 22 bp, Homo sapiens
cctgtctccctggcatggctca

SEQ ID NO: 10014196 - DNA, 20 bp, Homo sapiens
cctgtctcctcttacctggc

SEQ ID NO: 10014197 - DNA, 22 bp, Homo sapiens
cctgtctccctggcatggctca

SEQ ID NO: 10014198 - DNA, 22 bp, Homo sapiens
cctgtctccctggcatggctca

SEQ ID NO: 10014199 - DNA, 22 bp, Homo sapiens
cctgtccagggactgagggaga

SEQ ID NO: 10014200 - DNA, 22 bp, Homo sapiens
cctgtcatactaacgtagtggg

SEQ ID NO: 10014201 - DNA, 20 bp, Homo sapiens
cctgtctcctcttacctggc

SEQ ID NO: 10014202 - DNA, 22 bp, Homo sapiens
cctgtgaccactctggttctgc

SEQ ID NO: 10014203 - DNA, 22 bp, Homo sapiens
cctgtgcaatgttgaggtttca

SEQ ID NO: 10014204 - DNA, 22 bp, Homo sapiens
cctgtgatggtgttacactgtt

SEQ ID NO: 10014205 - DNA, 22 bp, Homo sapiens
ctacccagagtgaatctcttaa

SEQ ID NO: 10014206 - DNA, 22 bp, Homo sapiens
ctagaaatattttacagtcaag

SEQ ID NO: 10014207 - DNA, 22 bp, Homo sapiens
ctagaaatattttacagtcaag

SEQ ID NO: 10014208 - DNA, 22 bp, Homo sapiens
ctacccagcacctaggctgcct

SEQ ID NO: 10014209 - DNA, 22 bp, Homo sapiens
ctacccagatccaggatggcta

SEQ ID NO: 10014210 - DNA, 22 bp, Homo sapiens
ctagaaatctctgtttacatca

SEQ ID NO: 10014211 - DNA, 22 bp, Homo sapiens
ctagaaatctctgtttacatca

SEQ ID NO: 10014212 - DNA, 22 bp, Homo sapiens
ctagaaatctctgtttacatca

SEQ ID NO: 10014213 - DNA, 22 bp, Homo sapiens
ctagaaatgctcaagagaaagt

SEQ ID NO: 10014214 - DNA, 22 bp, Homo sapiens
ctagaaatgtagattcttagtg

SEQ ID NO: 10014215 - DNA, 22 bp, Homo sapiens
ctagaaatgtagattcttagtg

SEQ ID NO: 10014216 - DNA, 22 bp, Homo sapiens
ctagaaattctgattcagtagg

SEQ ID NO: 10014217 - DNA, 22 bp, Homo sapiens
ctagaaattctgattcagtagg

SEQ ID NO: 10014218 - DNA, 22 bp, Homo sapiens
ctagaaattctgattcagtagg

SEQ ID NO: 10014219 - DNA, 22 bp, Homo sapiens
ctagaacaaattaggaggcata

SEQ ID NO: 10014220 - DNA, 22 bp, Homo sapiens
ctacatttggagagtataggaa

SEQ ID NO: 10014221 - DNA, 22 bp, Homo sapiens
ctacagaatggagggtcagaga

SEQ ID NO: 10014222 - DNA, 22 bp, Homo sapiens
ctacagaattcaacaaatggtt

SEQ ID NO: 10014223 - DNA, 22 bp, Homo sapiens
ctacatttgttctatagctttt

SEQ ID NO: 10014224 - DNA, 22 bp, Homo sapiens
ctaaggaaaggaaatacagtaa

SEQ ID NO: 10014225 - DNA, 22 bp, Homo sapiens
ctaaggaaaaggatatatatgt

SEQ ID NO: 10014226 - DNA, 22 bp, Homo sapiens
ctaaggaaatatgtcacttgct

SEQ ID NO: 10014227 - DNA, 22 bp, Homo sapiens
ctaaggaagtgacagtgggatt

SEQ ID NO: 10014228 - DNA, 22 bp, Homo sapiens
ctacagaatctacctcaagcca

SEQ ID NO: 10014229 - DNA, 21 bp, Homo sapiens
ctacagaatcgagcattctgg

SEQ ID NO: 10014230 - DNA, 22 bp, Homo sapiens
agtatttagagacacaagatgg

SEQ ID NO: 10014231 - DNA, 22 bp, Homo sapiens
agtatttagagacacaagatgg

SEQ ID NO: 10014232 - DNA, 23 bp, Homo sapiens
agtattcaaaaggcaagctatat

SEQ ID NO: 10014233 - DNA, 22 bp, Homo sapiens
agtattctggaattctatgtga

SEQ ID NO: 10014234 - DNA, 22 bp, Homo sapiens
agtatttagagacacaagatgg

SEQ ID NO: 10014235 - DNA, 22 bp, Homo sapiens
agtccataggcagttcataaca

SEQ ID NO: 10014236 - DNA, 22 bp, Homo sapiens
agtccatacattgagaataaca

SEQ ID NO: 10014237 - DNA, 22 bp, Homo sapiens
agtccagggagcccaggctttg

SEQ ID NO: 10014238 - DNA, 22 bp, Homo sapiens
ctagaatcccaaatggactggg

SEQ ID NO: 10014239 - DNA, 22 bp, Homo sapiens
ctagaatatcatatgaagagac

SEQ ID NO: 10014240 - DNA, 22 bp, Homo sapiens
ctagaatctccaagtttactca

SEQ ID NO: 10014241 - DNA, 22 bp, Homo sapiens
ctagaatctatgtcaggaactc

SEQ ID NO: 10014242 - DNA, 22 bp, Homo sapiens
ctagaatctgggatttctgact

SEQ ID NO: 10014243 - DNA, 22 bp, Homo sapiens
agtccacagagtctctcctgaa

SEQ ID NO: 10014244 - DNA, 22 bp, Homo sapiens
ctagaagcaactagatctgttt

SEQ ID NO: 10014245 - DNA, 22 bp, Homo sapiens
ctagaaggaagcccagcacttc

SEQ ID NO: 10014246 - DNA, 22 bp, Homo sapiens
ctagaagttggggctagggata

SEQ ID NO: 10014247 - DNA, 22 bp, Homo sapiens
ctagaatactcgtattattccc

SEQ ID NO: 10014248 - DNA, 22 bp, Homo sapiens
ctagaacctaggagtactaaag

SEQ ID NO: 10014249 - DNA, 22 bp, Homo sapiens
ctagaacagtcaaagtgagctc

SEQ ID NO: 10014250 - DNA, 20 bp, Homo sapiens
ctagaactgagaaatttaaa

SEQ ID NO: 10014251 - DNA, 22 bp, Homo sapiens
ctagaagcaactagatctgttt

SEQ ID NO: 10014252 - DNA, 22 bp, Homo sapiens
ctagaactacatcttttaatag

SEQ ID NO: 10014253 - DNA, 22 bp, Homo sapiens
agtcccagctactcaagaggct

SEQ ID NO: 10014254 - DNA, 22 bp, Homo sapiens
ctagtcactcagcactgacaaa

SEQ ID NO: 10014255 - DNA, 20 bp, Homo sapiens
ctagtctcacatccctggca

SEQ ID NO: 10014256 - DNA, 22 bp, Homo sapiens
ctagtcacgtctttcagttacc

SEQ ID NO: 10014257 - DNA, 22 bp, Homo sapiens
ctagtaaagtactcaaatagcc

SEQ ID NO: 10014258 - DNA, 22 bp, Homo sapiens
ctaggtggtggtgggttgacat

SEQ ID NO: 10014259 - DNA, 22 bp, Homo sapiens
ctaggtttaactttcacagaaa

SEQ ID NO: 10014260 - DNA, 22 bp, Homo sapiens
agtccatggttgtagttctctc

SEQ ID NO: 10014261 - DNA, 22 bp, Homo sapiens
agtccatggttctgactcatct

SEQ ID NO: 10014262 - DNA, 22 bp, Homo sapiens
agtccatggttctgactcatct

SEQ ID NO: 10014263 - DNA, 22 bp, Homo sapiens
agtccatggttctgactcatct

SEQ ID NO: 10014264 - DNA, 22 bp, Homo sapiens
agtccatgctgtctacagaatc

SEQ ID NO: 10014265 - DNA, 19 bp, Homo sapiens
ctagggcttggcagcaggc

SEQ ID NO: 10014266 - DNA, 22 bp, Homo sapiens
agtccatggttgtagttctctc

SEQ ID NO: 10014267 - DNA, 18 bp, Homo sapiens
agtccatgcatggctata

SEQ ID NO: 10014268 - DNA, 18 bp, Homo sapiens
agtccatgcatggctata

SEQ ID NO: 10014269 - DNA, 19 bp, Homo sapiens
agtccatgaatggaggatg

SEQ ID NO: 10014270 - DNA, 22 bp, Homo sapiens
agtccatgatgaaaccagatcc

SEQ ID NO: 10014271 - DNA, 22 bp, Homo sapiens
ctaggggcatgaaatagagaat

SEQ ID NO: 10014272 - DNA, 22 bp, Homo sapiens
ctagggtcaggggcctgcgtcg

SEQ ID NO: 10014273 - DNA, 22 bp, Homo sapiens
ctagggtcaggggcctgcgtcg

SEQ ID NO: 10014274 - DNA, 22 bp, Homo sapiens
ctagggtctgttttccaggtgt

SEQ ID NO: 10014275 - DNA, 22 bp, Homo sapiens
ctagggtggatttgtgcagagt

SEQ ID NO: 10014276 - DNA, 22 bp, Homo sapiens
ctaggtgatccactgctctctt

SEQ ID NO: 10014277 - DNA, 21 bp, Homo sapiens
aggtttctgtgagcagagcag

SEQ ID NO: 10014278 - DNA, 22 bp, Homo sapiens
aggtttgggagtagaaatcaga

SEQ ID NO: 10014279 - DNA, 22 bp, Homo sapiens
aggtttgggttcattgctggct

SEQ ID NO: 10014280 - DNA, 22 bp, Homo sapiens
aggtttggtttgacaagactga

SEQ ID NO: 10014281 - DNA, 22 bp, Homo sapiens
agtaaaaagttcagaatggttg

SEQ ID NO: 10014282 - DNA, 22 bp, Homo sapiens
cggctcagctagcttggcccca

SEQ ID NO: 10014283 - DNA, 22 bp, Homo sapiens
agtaaaaagttcagaatggttg

SEQ ID NO: 10014284 - DNA, 22 bp, Homo sapiens
cgcagggccgcgagcgggacca

SEQ ID NO: 10014285 - DNA, 22 bp, Homo sapiens
aggtttctgcagcatagtggca

SEQ ID NO: 10014286 - DNA, 22 bp, Homo sapiens
cgcaggctttagaatctgctac

SEQ ID NO: 10014287 - DNA, 22 bp, Homo sapiens
cgcaggctttagaatctgctac

SEQ ID NO: 10014288 - DNA, 19 bp, Homo sapiens
cgcaggcttcgggtcgctc

SEQ ID NO: 10014289 - DNA, 22 bp, Homo sapiens
cgaggccatgcatgctgaggac

SEQ ID NO: 10014290 - DNA, 22 bp, Homo sapiens
cgaggccagctctaagccctac

SEQ ID NO: 10014291 - DNA, 22 bp, Homo sapiens
cctgttcttgtctcattggcta

SEQ ID NO: 10014292 - DNA, 22 bp, Homo sapiens
cctgttgtggaaaaagcctgat

SEQ ID NO: 10014293 - DNA, 22 bp, Homo sapiens
cgcaggcaagagagtacagtta

SEQ ID NO: 10014294 - DNA, 19 bp, Homo sapiens
cgcaggagccgaggtgacc

SEQ ID NO: 10014295 - DNA, 22 bp, Homo sapiens
cgcagctgtccatgtgtggggg

SEQ ID NO: 10014296 - DNA, 22 bp, Homo sapiens
cgcaggaagacaagggtggaaa

SEQ ID NO: 10014297 - DNA, 22 bp, Homo sapiens
cctgtgttctaatccatctcag

SEQ ID NO: 10014298 - DNA, 22 bp, Homo sapiens
cctgtgtttagatatgatgctg

SEQ ID NO: 10014299 - DNA, 18 bp, Homo sapiens
cctgtgtgtgttgcaggc

SEQ ID NO: 10014300 - DNA, 22 bp, Homo sapiens
cctgttcaagttgcagggctgg

SEQ ID NO: 10014301 - DNA, 18 bp, Homo sapiens
cctgttacacactggggt

SEQ ID NO: 10014302 - DNA, 22 bp, Homo sapiens
cctgttctgttaattaaacttt

SEQ ID NO: 10014303 - DNA, 22 bp, Homo sapiens
cctgttctgtggctctcaaagg

SEQ ID NO: 10014304 - DNA, 19 bp, Homo sapiens
cctgttcttggctgaggct

SEQ ID NO: 10014305 - DNA, 22 bp, Homo sapiens
cctgttctaatcttggggcaga

SEQ ID NO: 10014306 - DNA, 22 bp, Homo sapiens
cctgttctaatcttggggcaga

SEQ ID NO: 10014307 - DNA, 22 bp, Homo sapiens
cctgttctgtagtgagtttgag

SEQ ID NO: 10014308 - DNA, 21 bp, Homo sapiens
ctaagcaaggagcaggggtag

SEQ ID NO: 10014309 - DNA, 22 bp, Homo sapiens
ctaagactctgcaaatcagctt

SEQ ID NO: 10014310 - DNA, 22 bp, Homo sapiens
ctaagcaagaatgagtgcaaca

SEQ ID NO: 10014311 - DNA, 20 bp, Homo sapiens
ctaagaggtccttccacatc

SEQ ID NO: 10014312 - DNA, 18 bp, Homo sapiens
ctaagaggtcgtttctca

SEQ ID NO: 10014313 - DNA, 22 bp, Homo sapiens
ctaagaggaagtactctgttat

SEQ ID NO: 10014314 - DNA, 20 bp, Homo sapiens
ctaagaggaggactaggttt

SEQ ID NO: 10014315 - DNA, 22 bp, Homo sapiens
ctaagacatgccctgcatgata

SEQ ID NO: 10014316 - DNA, 22 bp, Homo sapiens
ctaagaaggaggaaaagtgcca

SEQ ID NO: 10014317 - DNA, 22 bp, Homo sapiens
ctaagaaggaggaaaagtgcca

SEQ ID NO: 10014318 - DNA, 22 bp, Homo sapiens
ctaaacttcttggcaattttat

SEQ ID NO: 10014319 - DNA, 22 bp, Homo sapiens
ctaaacttcatatgttgcttta

SEQ ID NO: 10014320 - DNA, 22 bp, Homo sapiens
agtacaatttaatgaagatagc

SEQ ID NO: 10014321 - DNA, 22 bp, Homo sapiens
agtacacaagacacatttaaaa

SEQ ID NO: 10014322 - DNA, 22 bp, Homo sapiens
agtacacacagtagaatagagt

SEQ ID NO: 10014323 - DNA, 22 bp, Homo sapiens
agtacagcaccatgagcacagg

SEQ ID NO: 10014324 - DNA, 22 bp, Homo sapiens
agtacagtcaggaagctgctgt

SEQ ID NO: 10014325 - DNA, 22 bp, Homo sapiens
agtacagacctgtctcttcctg

SEQ ID NO: 10014326 - DNA, 19 bp, Homo sapiens
agtacagaaaagagccctg

SEQ ID NO: 10014327 - DNA, 17 bp, Homo sapiens
cgggcatggagggcagg

SEQ ID NO: 10014328 - DNA, 17 bp, Homo sapiens
cgggcatggagggcagg

SEQ ID NO: 10014329 - DNA, 22 bp, Homo sapiens
cgggcagcggcgtggccatggt

SEQ ID NO: 10014330 - DNA, 23 bp, Homo sapiens
agtacaataagtataattctttc

SEQ ID NO: 10014331 - DNA, 22 bp, Homo sapiens
agtacaagtattagagttattc

SEQ ID NO: 10014332 - DNA, 22 bp, Homo sapiens
agtacaagtagaatgctacaag

SEQ ID NO: 10014333 - DNA, 22 bp, Homo sapiens
agtacaagtgatgtggtaaaaa

SEQ ID NO: 10014334 - DNA, 22 bp, Homo sapiens
agtacaatgtctgacacagtag

SEQ ID NO: 10014335 - DNA, 22 bp, Homo sapiens
agtacaaattatagcgcttgga

SEQ ID NO: 10014336 - DNA, 22 bp, Homo sapiens
cctcttctcaactccagccaga

SEQ ID NO: 10014337 - DNA, 19 bp, Homo sapiens
tgggagtggggaaggtcct

SEQ ID NO: 10014338 - DNA, 18 bp, Homo sapiens
tgggagtgggagtggata

SEQ ID NO: 10014339 - DNA, 18 bp, Homo sapiens
tgggagtgggagtggata

SEQ ID NO: 10014340 - DNA, 22 bp, Homo sapiens
tgggagtggggcatagaaggta

SEQ ID NO: 10014341 - DNA, 19 bp, Homo sapiens
tgggagtggggaaggtcct

SEQ ID NO: 10014342 - DNA, 22 bp, Homo sapiens
tgggagtggggcatagaaggta

SEQ ID NO: 10014343 - DNA, 22 bp, Homo sapiens
cctcttctaccatttacatttt

SEQ ID NO: 10014344 - DNA, 22 bp, Homo sapiens
cctgagagagaagcgacctggt

SEQ ID NO: 10014345 - DNA, 21 bp, Homo sapiens
cctgagatctggagtggcttt

SEQ ID NO: 10014346 - DNA, 22 bp, Homo sapiens
cctgagaccaagttgcagccat

SEQ ID NO: 10014347 - DNA, 22 bp, Homo sapiens
tgggagttgggtgggagacttc

SEQ ID NO: 10014348 - DNA, 22 bp, Homo sapiens
tgggagtgttcttggcttgctt

SEQ ID NO: 10014349 - DNA, 22 bp, Homo sapiens
tgggagttagttatactgtgac

SEQ ID NO: 10014350 - DNA, 22 bp, Homo sapiens
tgggagttgagacattttgccc

SEQ ID NO: 10014351 - DNA, 22 bp, Homo sapiens
cctgagcacacatcagaatcac

SEQ ID NO: 10014352 - DNA, 22 bp, Homo sapiens
cctgagcaaaggcccagaggga

SEQ ID NO: 10014353 - DNA, 22 bp, Homo sapiens
cctgagcagggctctgcagggc

SEQ ID NO: 10014354 - DNA, 22 bp, Homo sapiens
cctgagcattagacatccatca

SEQ ID NO: 10014355 - DNA, 22 bp, Homo sapiens
cctgagccaagagtcagaatct

SEQ ID NO: 10014356 - DNA, 22 bp, Homo sapiens
cctgagcctcttgcacgctcag

SEQ ID NO: 10014357 - DNA, 22 bp, Homo sapiens
cctgagccgagcgctctttctc

SEQ ID NO: 10014358 - DNA, 22 bp, Homo sapiens
cctgagccgagcgctctttctc

SEQ ID NO: 10014359 - DNA, 22 bp, Homo sapiens
tgggcccaagagagtctccaac

SEQ ID NO: 10014360 - DNA, 22 bp, Homo sapiens
tgggccatttttggaagactgg

SEQ ID NO: 10014361 - DNA, 22 bp, Homo sapiens
cctgagcctgcagccgagcaga

SEQ ID NO: 10014362 - DNA, 22 bp, Homo sapiens
tgggccagtttctcattgaaat

SEQ ID NO: 10014363 - DNA, 22 bp, Homo sapiens
cctgagcctgagtggtgcaggg

SEQ ID NO: 10014364 - DNA, 22 bp, Homo sapiens
cctgagcctgagtggtgcaggg

SEQ ID NO: 10014365 - DNA, 22 bp, Homo sapiens
cctgagcctgagtggtgcaggg

SEQ ID NO: 10014366 - DNA, 18 bp, Homo sapiens
tgggctgcctggcctctg

SEQ ID NO: 10014367 - DNA, 22 bp, Homo sapiens
tgggctgcggataggcctcgga

SEQ ID NO: 10014368 - DNA, 22 bp, Homo sapiens
tgggccctggtggccatgcctc

SEQ ID NO: 10014369 - DNA, 22 bp, Homo sapiens
tgggctcctcgtcactcgctgt

SEQ ID NO: 10014370 - DNA, 22 bp, Homo sapiens
tgggctgctgcggtgctcttgg

SEQ ID NO: 10014371 - DNA, 22 bp, Homo sapiens
tgggctgctgtctgcacatgct

SEQ ID NO: 10014372 - DNA, 22 bp, Homo sapiens
tgggctgctgtctgcacatgct

SEQ ID NO: 10014373 - DNA, 22 bp, Homo sapiens
tgggccctgacttcaagcatcc

SEQ ID NO: 10014374 - DNA, 22 bp, Homo sapiens
tgggccctgacttcaagcatcc

SEQ ID NO: 10014375 - DNA, 22 bp, Homo sapiens
cctgagctgcggggcagtgctc

SEQ ID NO: 10014376 - DNA, 22 bp, Homo sapiens
cctgagctgactctcctttcag

SEQ ID NO: 10014377 - DNA, 22 bp, Homo sapiens
cctgagctggaagagcttgtgc

SEQ ID NO: 10014378 - DNA, 22 bp, Homo sapiens
tggggaggaagtcagatttcag

SEQ ID NO: 10014379 - DNA, 22 bp, Homo sapiens
cctgagctcaagaaggtgacca

SEQ ID NO: 10014380 - DNA, 22 bp, Homo sapiens
cctgagctcaagaaggtgacca

SEQ ID NO: 10014381 - DNA, 22 bp, Homo sapiens
cctgagctagggaaggaagacc

SEQ ID NO: 10014382 - DNA, 22 bp, Homo sapiens
cctgagctcaaagggtgcctgg

SEQ ID NO: 10014383 - DNA, 22 bp, Homo sapiens
cctgagctccagtagcagccag

SEQ ID NO: 10014384 - DNA, 22 bp, Homo sapiens
cctgagctgaactaagcagttt

SEQ ID NO: 10014385 - DNA, 22 bp, Homo sapiens
cctgagctctgcactttttaga

SEQ ID NO: 10014386 - DNA, 22 bp, Homo sapiens
cctgagctccagtagcagccag

SEQ ID NO: 10014387 - DNA, 22 bp, Homo sapiens
cctgagcctggctcatgcactc

SEQ ID NO: 10014388 - DNA, 22 bp, Homo sapiens
cctgagcctggctcatgcactc

SEQ ID NO: 10014389 - DNA, 21 bp, Homo sapiens
cctgagcctgtttatccagaa

SEQ ID NO: 10014390 - DNA, 22 bp, Homo sapiens
tgggctggcccaccacacctcg

SEQ ID NO: 10014391 - DNA, 22 bp, Homo sapiens
tgggctggcccaccacacctcg

SEQ ID NO: 10014392 - DNA, 22 bp, Homo sapiens
cctgagcctggctcatgcactc

SEQ ID NO: 10014393 - DNA, 22 bp, Homo sapiens
tgggctgcttcctcagctgaga

SEQ ID NO: 10014394 - DNA, 22 bp, Homo sapiens
tgggctgcttctcaaatgtctc

SEQ ID NO: 10014395 - DNA, 22 bp, Homo sapiens
cctctgctctggtccatgtgct

SEQ ID NO: 10014396 - DNA, 19 bp, Homo sapiens
cctctgctccagtttcctt

SEQ ID NO: 10014397 - DNA, 21 bp, Homo sapiens
cctctgctcgggcatgcgttt

SEQ ID NO: 10014398 - DNA, 20 bp, Homo sapiens
cctctgcctttctagtctga

SEQ ID NO: 10014399 - DNA, 18 bp, Homo sapiens
cctctgcctttgtagagc

SEQ ID NO: 10014400 - DNA, 22 bp, Homo sapiens
cctctgcctgcacatcatcctg

SEQ ID NO: 10014401 - DNA, 22 bp, Homo sapiens
cctctgcctttagtgaaagttg

SEQ ID NO: 10014402 - DNA, 18 bp, Homo sapiens
cctctgccatagccagca

SEQ ID NO: 10014403 - DNA, 20 bp, Homo sapiens
cctctgccccggggctgcta

SEQ ID NO: 10014404 - DNA, 22 bp, Homo sapiens
cctctgagtcctccctggttgc

SEQ ID NO: 10014405 - DNA, 22 bp, Homo sapiens
cctctgcccttttcctgtatca

SEQ ID NO: 10014406 - DNA, 22 bp, Homo sapiens
tggcttccagagctgctccacc

SEQ ID NO: 10014407 - DNA, 22 bp, Homo sapiens
tgggaagctactcatgcaggca

SEQ ID NO: 10014408 - DNA, 22 bp, Homo sapiens
tgggaagctgcattttaacaag

SEQ ID NO: 10014409 - DNA, 22 bp, Homo sapiens
tgggaaggataccttggaacat

SEQ ID NO: 10014410 - DNA, 22 bp, Homo sapiens
tgggaaggacgtgtcagtggca

SEQ ID NO: 10014411 - DNA, 22 bp, Homo sapiens
tgggaaggacgtgtcagtggca

SEQ ID NO: 10014412 - DNA, 19 bp, Homo sapiens
cctctgtgggagtcagtga

SEQ ID NO: 10014413 - DNA, 22 bp, Homo sapiens
cctctgtggccttggaccagct

SEQ ID NO: 10014414 - DNA, 19 bp, Homo sapiens
tggctctgtcgaaggcaca

SEQ ID NO: 10014415 - DNA, 22 bp, Homo sapiens
tggctgagaagttctggtggga

SEQ ID NO: 10014416 - DNA, 22 bp, Homo sapiens
tggctgagaatgggatgatgcc

SEQ ID NO: 10014417 - DNA, 22 bp, Homo sapiens
tggctgagaccatcagggtgta

SEQ ID NO: 10014418 - DNA, 22 bp, Homo sapiens
tggctctgtcactgtgagctat

SEQ ID NO: 10014419 - DNA, 17 bp, Homo sapiens
tggctctgtcctcagct

SEQ ID NO: 10014420 - DNA, 17 bp, Homo sapiens
tggctctgtcctcagct

SEQ ID NO: 10014421 - DNA, 22 bp, Homo sapiens
tggctgctagccagagcttcag

SEQ ID NO: 10014422 - DNA, 16 bp, Homo sapiens
tggctgagagagggtt

SEQ ID NO: 10014423 - DNA, 16 bp, Homo sapiens
tggctgagagagggtt

SEQ ID NO: 10014424 - DNA, 22 bp, Homo sapiens
tggctgagagaagacggggaag

SEQ ID NO: 10014425 - DNA, 22 bp, Homo sapiens
tggctgagaccatcagggtgta

SEQ ID NO: 10014426 - DNA, 22 bp, Homo sapiens
tggctgagaccttcccaaattc

SEQ ID NO: 10014427 - DNA, 22 bp, Homo sapiens
tggctggctgtccagctgggca

SEQ ID NO: 10014428 - DNA, 22 bp, Homo sapiens
tggcttcaggagcacctggctt

SEQ ID NO: 10014429 - DNA, 22 bp, Homo sapiens
tggctggctgtccagctgggca

SEQ ID NO: 10014430 - DNA, 22 bp, Homo sapiens
tggcttcatctgcagcactgcc

SEQ ID NO: 10014431 - DNA, 22 bp, Homo sapiens
tggcttcatctgcagcactgcc

SEQ ID NO: 10014432 - DNA, 20 bp, Homo sapiens
tggcttcataatggtttctg

SEQ ID NO: 10014433 - DNA, 22 bp, Homo sapiens
tggcttcagtttcccagtctgg

SEQ ID NO: 10014434 - DNA, 22 bp, Homo sapiens
tggcttcatcactcgggctgcc

SEQ ID NO: 10014435 - DNA, 17 bp, Homo sapiens
tggcttcaggctgagca

SEQ ID NO: 10014436 - DNA, 22 bp, Homo sapiens
tggcttcaggcagaatttagac

SEQ ID NO: 10014437 - DNA, 22 bp, Homo sapiens
tggcttcagttcctgtgttgtt

SEQ ID NO: 10014438 - DNA, 22 bp, Homo sapiens
tggcttcagggttgtcttcagc

SEQ ID NO: 10014439 - DNA, 22 bp, Homo sapiens
tggcttcagtctcatcttggaa

SEQ ID NO: 10014440 - DNA, 22 bp, Homo sapiens
tggcttcatggcaagtcttagt

SEQ ID NO: 10014441 - DNA, 22 bp, Homo sapiens
tggcttcatgtagtttgagttg

SEQ ID NO: 10014442 - DNA, 22 bp, Homo sapiens
tggcttcatggctgtgcaatct

SEQ ID NO: 10014443 - DNA, 22 bp, Homo sapiens
tggcttcattattgtttttcct

SEQ ID NO: 10014444 - DNA, 22 bp, Homo sapiens
tggcttcattcagcatgacagt

SEQ ID NO: 10014445 - DNA, 22 bp, Homo sapiens
tggcttcattctcctgtgaata

SEQ ID NO: 10014446 - DNA, 21 bp, Homo sapiens
tggcttcatttgcaacccact

SEQ ID NO: 10014447 - DNA, 22 bp, Homo sapiens
tggcttcattctgtagttaaaa

SEQ ID NO: 10014448 - DNA, 22 bp, Homo sapiens
ccctgcaggggacctgcagcct

SEQ ID NO: 10014449 - DNA, 21 bp, Homo sapiens
ccctgcaggccagggctgagc

SEQ ID NO: 10014450 - DNA, 22 bp, Homo sapiens
ccctgcagcttttgcatagtca

SEQ ID NO: 10014451 - DNA, 22 bp, Homo sapiens
ccctgcagccttgcatgccttc

SEQ ID NO: 10014452 - DNA, 22 bp, Homo sapiens
tggagcagggcatcactgtgcg

SEQ ID NO: 10014453 - DNA, 22 bp, Homo sapiens
tggagcagggcatcactgtgcg

SEQ ID NO: 10014454 - DNA, 22 bp, Homo sapiens
tggagcaggccggaagtggctt

SEQ ID NO: 10014455 - DNA, 18 bp, Homo sapiens
tggagcaggtaggcatga

SEQ ID NO: 10014456 - DNA, 18 bp, Homo sapiens
tggagcaggtaggcatga

SEQ ID NO: 10014457 - DNA, 22 bp, Homo sapiens
cccttcccttctgggagatcca

SEQ ID NO: 10014458 - DNA, 22 bp, Homo sapiens
cccttcctcaaggagctgtgtt

SEQ ID NO: 10014459 - DNA, 22 bp, Homo sapiens
ccctgtgggaactcctgagttg

SEQ ID NO: 10014460 - DNA, 19 bp, Homo sapiens
tggcagaggacaaggactt

SEQ ID NO: 10014461 - DNA, 19 bp, Homo sapiens
tggcagaggacaaggactt

SEQ ID NO: 10014462 - DNA, 22 bp, Homo sapiens
tggcagaggaaaaagtcactgg

SEQ ID NO: 10014463 - DNA, 22 bp, Homo sapiens
cccttctctttcactcactatt

SEQ ID NO: 10014464 - DNA, 22 bp, Homo sapiens
cccttctctttcactcactatt

SEQ ID NO: 10014465 - DNA, 21 bp, Homo sapiens
cccttcttactcaagctcatt

SEQ ID NO: 10014466 - DNA, 22 bp, Homo sapiens
cccttctagtccattcttcaca

SEQ ID NO: 10014467 - DNA, 22 bp, Homo sapiens
cctcagaagctcaaggacattg

SEQ ID NO: 10014468 - DNA, 22 bp, Homo sapiens
cctcagaaggacaagagacaaa

SEQ ID NO: 10014469 - DNA, 22 bp, Homo sapiens
tggcagggttggccaccttacc

SEQ ID NO: 10014470 - DNA, 22 bp, Homo sapiens
cctcagaggcagatggtaagaa

SEQ ID NO: 10014471 - DNA, 18 bp, Homo sapiens
cctcagaggcaaattgtt

SEQ ID NO: 10014472 - DNA, 22 bp, Homo sapiens
cctcagaggtgaacatcagtgc

SEQ ID NO: 10014473 - DNA, 22 bp, Homo sapiens
cctaggcaagagttggtgtgga

SEQ ID NO: 10014474 - DNA, 22 bp, Homo sapiens
cctaggcaagagttggtgtgga

SEQ ID NO: 10014475 - DNA, 22 bp, Homo sapiens
cctaggagaggtaatgaagttc

SEQ ID NO: 10014476 - DNA, 22 bp, Homo sapiens
cctaggagaggtaatgaagttc

SEQ ID NO: 10014477 - DNA, 22 bp, Homo sapiens
tggcagggttggccaccttacc

SEQ ID NO: 10014478 - DNA, 21 bp, Homo sapiens
cctagcctcttacccagcttt

SEQ ID NO: 10014479 - DNA, 22 bp, Homo sapiens
cctagcagggagaggatacctg

SEQ ID NO: 10014480 - DNA, 22 bp, Homo sapiens
cctagcagggaagcagtgagga

SEQ ID NO: 10014481 - DNA, 22 bp, Homo sapiens
cctagcagaagctgcaatgcct

SEQ ID NO: 10014482 - DNA, 19 bp, Homo sapiens
cctagagggaaggcaggac

SEQ ID NO: 10014483 - DNA, 22 bp, Homo sapiens
cctagagtgattgagagcatca

SEQ ID NO: 10014484 - DNA, 22 bp, Homo sapiens
cctagagctctgctttatctaa

SEQ ID NO: 10014485 - DNA, 22 bp, Homo sapiens
cctagaggctgcaaggagaggc

SEQ ID NO: 10014486 - DNA, 22 bp, Homo sapiens
cctagactagaggcagggagcc

SEQ ID NO: 10014487 - DNA, 22 bp, Homo sapiens
cctagactagaggcagggagcc

SEQ ID NO: 10014488 - DNA, 22 bp, Homo sapiens
cctagactagaggcagggagcc

SEQ ID NO: 10014489 - DNA, 22 bp, Homo sapiens
cctagagctctgctttatctaa

SEQ ID NO: 10014490 - DNA, 22 bp, Homo sapiens
tggcagaggctctgtgatgttg

SEQ ID NO: 10014491 - DNA, 22 bp, Homo sapiens
tggcagaggctctgtgatgttg

SEQ ID NO: 10014492 - DNA, 19 bp, Homo sapiens
tggcagaggcagtttgtac

SEQ ID NO: 10014493 - DNA, 19 bp, Homo sapiens
tggcagaggcagtttgtac

SEQ ID NO: 10014494 - DNA, 22 bp, Homo sapiens
tggcagaggaggctcagattga

SEQ ID NO: 10014495 - DNA, 22 bp, Homo sapiens
tggcagaggaggctcagattga

SEQ ID NO: 10014496 - DNA, 22 bp, Homo sapiens
tggcagaggagaattaagatta

SEQ ID NO: 10014497 - DNA, 22 bp, Homo sapiens
tggcagaggagaattaagatta

SEQ ID NO: 10014498 - DNA, 22 bp, Homo sapiens
cctcagagttatttgaagtgaa

SEQ ID NO: 10014499 - DNA, 22 bp, Homo sapiens
tggcccagagcactgctgggca

SEQ ID NO: 10014500 - DNA, 22 bp, Homo sapiens
cctcagagtttaagatgtcaga

SEQ ID NO: 10014501 - DNA, 19 bp, Homo sapiens
tggcccagatggtcctggg

SEQ ID NO: 10014502 - DNA, 20 bp, Homo sapiens
tggcccagcacgacgaggac

SEQ ID NO: 10014503 - DNA, 22 bp, Homo sapiens
tggcccagcactccaagtaggg

SEQ ID NO: 10014504 - DNA, 22 bp, Homo sapiens
tggcccagcagttctgccccag

SEQ ID NO: 10014505 - DNA, 19 bp, Homo sapiens
tggcccagatggtcctggg

SEQ ID NO: 10014506 - DNA, 19 bp, Homo sapiens
tggcccagatggtcctggg

SEQ ID NO: 10014507 - DNA, 22 bp, Homo sapiens
tggcccagatctctgaccttga

SEQ ID NO: 10014508 - DNA, 22 bp, Homo sapiens
tggcccagatctctgaccttga

SEQ ID NO: 10014509 - DNA, 22 bp, Homo sapiens
tggcccagatctctgaccttga

SEQ ID NO: 10014510 - DNA, 22 bp, Homo sapiens
cctcagggaatgggaggctggg

SEQ ID NO: 10014511 - DNA, 22 bp, Homo sapiens
cctcaggcttcgtcttccaccc

SEQ ID NO: 10014512 - DNA, 22 bp, Homo sapiens
cctcaggcttacgggcaatgga

SEQ ID NO: 10014513 - DNA, 22 bp, Homo sapiens
cctcaggctagctactgtccct

SEQ ID NO: 10014514 - DNA, 22 bp, Homo sapiens
cctcaggcctgccagagcccca

SEQ ID NO: 10014515 - DNA, 22 bp, Homo sapiens
cctcaggctgggctgcccctgg

SEQ ID NO: 10014516 - DNA, 22 bp, Homo sapiens
cctcaggctgctcacacttgtc

SEQ ID NO: 10014517 - DNA, 23 bp, Homo sapiens
cctcatgaaggtctgcttcctgg

SEQ ID NO: 10014518 - DNA, 22 bp, Homo sapiens
cctcatgatttttagcccattg

SEQ ID NO: 10014519 - DNA, 22 bp, Homo sapiens
cctccaaccataggtccagggg

SEQ ID NO: 10014520 - DNA, 22 bp, Homo sapiens
tggcctggctgccctgtctgga

SEQ ID NO: 10014521 - DNA, 22 bp, Homo sapiens
tggcctggctcacagtgagatt

SEQ ID NO: 10014522 - DNA, 22 bp, Homo sapiens
tggcctggggacctgtgagacc

SEQ ID NO: 10014523 - DNA, 22 bp, Homo sapiens
tggcctggggaagaccatgggc

SEQ ID NO: 10014524 - DNA, 22 bp, Homo sapiens
tggcctgggcctgccggtgcaa

SEQ ID NO: 10014525 - DNA, 22 bp, Homo sapiens
tggcctggctgccctgtctgga

SEQ ID NO: 10014526 - DNA, 22 bp, Homo sapiens
tggcctgggcatgaagcatcgt

SEQ ID NO: 10014527 - DNA, 22 bp, Homo sapiens
tggcctgggccggcagatatac

SEQ ID NO: 10014528 - DNA, 21 bp, Homo sapiens
tggctctgggtaggagagtgc

SEQ ID NO: 10014529 - DNA, 21 bp, Homo sapiens
tggctctgggtaggagagtgc

SEQ ID NO: 10014530 - DNA, 22 bp, Homo sapiens
tggctctggtgcgggctcctgc

SEQ ID NO: 10014531 - DNA, 22 bp, Homo sapiens
tgctgtgtaaaaggtgattgaa

SEQ ID NO: 10014532 - DNA, 22 bp, Homo sapiens
tgctgtgtctttctgtgaaaag

SEQ ID NO: 10014533 - DNA, 22 bp, Homo sapiens
tgctgtggttcccagagtggat

SEQ ID NO: 10014534 - DNA, 22 bp, Homo sapiens
tgctgtgctggcggcagaggcc

SEQ ID NO: 10014535 - DNA, 22 bp, Homo sapiens
tgctgtggattcagagatgaaa

SEQ ID NO: 10014536 - DNA, 22 bp, Homo sapiens
tgctgtggattcagagatgaaa

SEQ ID NO: 10014537 - DNA, 22 bp, Homo sapiens
tgctgtgctccattgtcttcac

SEQ ID NO: 10014538 - DNA, 22 bp, Homo sapiens
tgctgtgctctttaaggtgctg

SEQ ID NO: 10014539 - DNA, 22 bp, Homo sapiens
tgctgtgtggatgtgaagaatc

SEQ ID NO: 10014540 - DNA, 22 bp, Homo sapiens
tggaatggaaacaaactgagga

SEQ ID NO: 10014541 - DNA, 22 bp, Homo sapiens
tggaagggagctggaatttgga

SEQ ID NO: 10014542 - DNA, 22 bp, Homo sapiens
tggaagggagctggaatttgga

SEQ ID NO: 10014543 - DNA, 22 bp, Homo sapiens
tggaatggaaacaaactgagga

SEQ ID NO: 10014544 - DNA, 22 bp, Homo sapiens
tggaatggaaacaaactgagga

SEQ ID NO: 10014545 - DNA, 22 bp, Homo sapiens
tggaatgtaaacctcaggtggg

SEQ ID NO: 10014546 - DNA, 22 bp, Homo sapiens
tggaatgtagcaagtgttgtca

SEQ ID NO: 10014547 - DNA, 20 bp, Homo sapiens
tggaatgtagtcggtgagag

SEQ ID NO: 10014548 - DNA, 22 bp, Homo sapiens
tggaatgtaatcagaatatgaa

SEQ ID NO: 10014549 - DNA, 22 bp, Homo sapiens
tggaatgtaatcatgtggtggt

SEQ ID NO: 10014550 - DNA, 21 bp, Homo sapiens
tggaatgtacctccctctctt

SEQ ID NO: 10014551 - DNA, 22 bp, Homo sapiens
tggaatgtaaactctgtgaggg

SEQ ID NO: 10014552 - DNA, 22 bp, Homo sapiens
tggaatgtaaagcgtgtgataa

SEQ ID NO: 10014553 - DNA, 22 bp, Homo sapiens
tggaatgtaaagggtatgggat

SEQ ID NO: 10014554 - DNA, 22 bp, Homo sapiens
tggaatgtcataccataaaaga

SEQ ID NO: 10014555 - DNA, 22 bp, Homo sapiens
tggaatgtcttgatatagaggt

SEQ ID NO: 10014556 - DNA, 22 bp, Homo sapiens
tggaatgtgaacatacaaggta

SEQ ID NO: 10014557 - DNA, 22 bp, Homo sapiens
tggaatgtgctactgttgattt

SEQ ID NO: 10014558 - DNA, 22 bp, Homo sapiens
tggaatgtggtatcagtagaaa

SEQ ID NO: 10014559 - DNA, 22 bp, Homo sapiens
tggaatgtggataagggtgtct

SEQ ID NO: 10014560 - DNA, 22 bp, Homo sapiens
tggaatgtggtatcagtagaaa

SEQ ID NO: 10014561 - DNA, 22 bp, Homo sapiens
tggaatgtgctagggctgtggc

SEQ ID NO: 10014562 - DNA, 22 bp, Homo sapiens
tggaatgtgagaataccgtttt

SEQ ID NO: 10014563 - DNA, 22 bp, Homo sapiens
tggaatgtcagctacaagaggg

SEQ ID NO: 10014564 - DNA, 23 bp, Homo sapiens
tggaatgtctgattctgctctag

SEQ ID NO: 10014565 - DNA, 22 bp, Homo sapiens
tggaatgtagtgtccatggaat

SEQ ID NO: 10014566 - DNA, 22 bp, Homo sapiens
tggaatgtatagatgttatgta

SEQ ID NO: 10014567 - DNA, 22 bp, Homo sapiens
tggaatgtcaaaagtctgctat

SEQ ID NO: 10014568 - DNA, 22 bp, Homo sapiens
tggaatgtattaagtattgagt

SEQ ID NO: 10014569 - DNA, 22 bp, Homo sapiens
tggaatgtcaagaagcagtaag

SEQ ID NO: 10014570 - DNA, 22 bp, Homo sapiens
tggaatgtgttctattttacag

SEQ ID NO: 10014571 - DNA, 22 bp, Homo sapiens
tggaatgttaaacctcaatgat

SEQ ID NO: 10014572 - DNA, 22 bp, Homo sapiens
ccctcgctctaggcagccctgt

SEQ ID NO: 10014573 - DNA, 22 bp, Homo sapiens
ccctccttaccaccacagctcc

SEQ ID NO: 10014574 - DNA, 20 bp, Homo sapiens
ccctgagacaaaggaggggc

SEQ ID NO: 10014575 - DNA, 20 bp, Homo sapiens
ccctgagacgactgagctcc

SEQ ID NO: 10014576 - DNA, 20 bp, Homo sapiens
ccctgagaccagagagcagc

SEQ ID NO: 10014577 - DNA, 22 bp, Homo sapiens
ccctgagagcagggtctttctc

SEQ ID NO: 10014578 - DNA, 22 bp, Homo sapiens
ccctgagaggttgagtgtctgc

SEQ ID NO: 10014579 - DNA, 22 bp, Homo sapiens
ccctgagaagatcattgccacg

SEQ ID NO: 10014580 - DNA, 22 bp, Homo sapiens
ccctgacttgatctttgacttg

SEQ ID NO: 10014581 - DNA, 22 bp, Homo sapiens
ccctgaccctatcagagggcca

SEQ ID NO: 10014582 - DNA, 22 bp, Homo sapiens
ccctctcctggctgcatggagc

SEQ ID NO: 10014583 - DNA, 18 bp, Homo sapiens
ccctctcctgctagtggg

SEQ ID NO: 10014584 - DNA, 18 bp, Homo sapiens
ccctgagatgatgctgtg

SEQ ID NO: 10014585 - DNA, 22 bp, Homo sapiens
ccctgagagtgagtgccacctt

SEQ ID NO: 10014586 - DNA, 22 bp, Homo sapiens
ccctgagcagtctgcagagagc

SEQ ID NO: 10014587 - DNA, 22 bp, Homo sapiens
ccctgagatgcctcaccctagt

SEQ ID NO: 10014588 - DNA, 22 bp, Homo sapiens
ccctgagcattcatgtgagctt

SEQ ID NO: 10014589 - DNA, 22 bp, Homo sapiens
ccctgagccacacagagcaggt

SEQ ID NO: 10014590 - DNA, 22 bp, Homo sapiens
ccctgagccgctgctccaacct

SEQ ID NO: 10014591 - DNA, 22 bp, Homo sapiens
ccctgagcgtgaggaggaagta

SEQ ID NO: 10014592 - DNA, 22 bp, Homo sapiens
ccctgagcgtgaggaggaagta

SEQ ID NO: 10014593 - DNA, 22 bp, Homo sapiens
ccctgagccgcctgccgtgtcc

SEQ ID NO: 10014594 - DNA, 23 bp, Homo sapiens
ccctgagctggtccaggctcaac

SEQ ID NO: 10014595 - DNA, 22 bp, Homo sapiens
ccctgaggaaagggtggagggc

SEQ ID NO: 10014596 - DNA, 22 bp, Homo sapiens
ccctgaggaaagggtggagggc

SEQ ID NO: 10014597 - DNA, 22 bp, Homo sapiens
ccctgaggaccaggaaggaggg

SEQ ID NO: 10014598 - DNA, 22 bp, Homo sapiens
tggagcagaaatggcctcttgt

SEQ ID NO: 10014599 - DNA, 22 bp, Homo sapiens
tggagcaggacggggagtggta

SEQ ID NO: 10014600 - DNA, 22 bp, Homo sapiens
tggagcaggactgctgccctca

SEQ ID NO: 10014601 - DNA, 22 bp, Homo sapiens
tggagcaggcatctttctctct

SEQ ID NO: 10014602 - DNA, 22 bp, Homo sapiens
cccatttttgtgtgagtaatga

SEQ ID NO: 10014603 - DNA, 22 bp, Homo sapiens
cccattttgcttatgctgctgt

SEQ ID NO: 10014604 - DNA, 22 bp, Homo sapiens
cccattttgcttatgctgctgt

SEQ ID NO: 10014605 - DNA, 22 bp, Homo sapiens
cccattttggaacgagtagcca

SEQ ID NO: 10014606 - DNA, 22 bp, Homo sapiens
cccatttttgtgtgagtaatga

SEQ ID NO: 10014607 - DNA, 22 bp, Homo sapiens
cccatttttgtgtgagtaatga

SEQ ID NO: 10014608 - DNA, 22 bp, Homo sapiens
ccccaaaacttagtgacttaaa

SEQ ID NO: 10014609 - DNA, 22 bp, Homo sapiens
ccccaaaacttggtgacttcca

SEQ ID NO: 10014610 - DNA, 22 bp, Homo sapiens
ccccaaagctgagttcccgcct

SEQ ID NO: 10014611 - DNA, 22 bp, Homo sapiens
ccccaaagcctcagcctgcctg

SEQ ID NO: 10014612 - DNA, 18 bp, Homo sapiens
ccccaaaagtcaccctgg

SEQ ID NO: 10014613 - DNA, 22 bp, Homo sapiens
ccccaaaattcttaagttgaat

SEQ ID NO: 10014614 - DNA, 19 bp, Homo sapiens
ccccaaagtttagatgttg

SEQ ID NO: 10014615 - DNA, 22 bp, Homo sapiens
ccccaaagtgttggataattga

SEQ ID NO: 10014616 - DNA, 22 bp, Homo sapiens
cccattgtggttgttgaggata

SEQ ID NO: 10014617 - DNA, 22 bp, Homo sapiens
cccattttagcaaggggtggcg

SEQ ID NO: 10014618 - DNA, 23 bp, Homo sapiens
cccattttcatgttaactcctgg

SEQ ID NO: 10014619 - DNA, 23 bp, Homo sapiens
cccattttcatgttaactcctgg

SEQ ID NO: 10014620 - DNA, 22 bp, Homo sapiens
cccatttcttgagttcagctct

SEQ ID NO: 10014621 - DNA, 22 bp, Homo sapiens
cccatttgtccaaagtataaaa

SEQ ID NO: 10014622 - DNA, 22 bp, Homo sapiens
cccatttgtatagagccttata

SEQ ID NO: 10014623 - DNA, 22 bp, Homo sapiens
cccattcatcctcgcttccttc

SEQ ID NO: 10014624 - DNA, 22 bp, Homo sapiens
cccagtttcaactttccagtgg

SEQ ID NO: 10014625 - DNA, 22 bp, Homo sapiens
cccaggtctatgccagctctga

SEQ ID NO: 10014626 - DNA, 22 bp, Homo sapiens
cccaggtctatgccagctctga

SEQ ID NO: 10014627 - DNA, 22 bp, Homo sapiens
cccaggtcgtcagcagtgtggt

SEQ ID NO: 10014628 - DNA, 21 bp, Homo sapiens
cccaggtcgtggtcttcccag

SEQ ID NO: 10014629 - DNA, 22 bp, Homo sapiens
cccaggtcccgccccagctcta

SEQ ID NO: 10014630 - DNA, 22 bp, Homo sapiens
cccaggtcccggggccagctgc

SEQ ID NO: 10014631 - DNA, 22 bp, Homo sapiens
cccaggtccccacctgtctgct

SEQ ID NO: 10014632 - DNA, 22 bp, Homo sapiens
cccaggtccccacctgtctgct

SEQ ID NO: 10014633 - DNA, 23 bp, Homo sapiens
cccaggtcaaaattcacaggcct

SEQ ID NO: 10014634 - DNA, 20 bp, Homo sapiens
ccccacactattgagcactt

SEQ ID NO: 10014635 - DNA, 22 bp, Homo sapiens
ccccacagccgccagcagggag

SEQ ID NO: 10014636 - DNA, 22 bp, Homo sapiens
ccccacactctttacattcata

SEQ ID NO: 10014637 - DNA, 22 bp, Homo sapiens
ccccacaactcatgttgaaact

SEQ ID NO: 10014638 - DNA, 22 bp, Homo sapiens
ccccacaggtgtctgaggcagg

SEQ ID NO: 10014639 - DNA, 22 bp, Homo sapiens
ccccacagtccgtgaggagcca

SEQ ID NO: 10014640 - DNA, 22 bp, Homo sapiens
ccccacagtccgtgaggagcca

SEQ ID NO: 10014641 - DNA, 22 bp, Homo sapiens
ccccacagtccgtgaggagcca

SEQ ID NO: 10014642 - DNA, 22 bp, Homo sapiens
ccccaccctcgctccatttcgg

SEQ ID NO: 10014643 - DNA, 22 bp, Homo sapiens
ccccaccctcgctccatttcgg

SEQ ID NO: 10014644 - DNA, 22 bp, Homo sapiens
tgctggagcccaggcggccttt

SEQ ID NO: 10014645 - DNA, 23 bp, Homo sapiens
cccctctggtggctcagctcctg

SEQ ID NO: 10014646 - DNA, 22 bp, Homo sapiens
ccccttccaggaagcagaatcg

SEQ ID NO: 10014647 - DNA, 22 bp, Homo sapiens
tgctggctttttggtccttgct

SEQ ID NO: 10014648 - DNA, 22 bp, Homo sapiens
tgctggctttttgtgtcaaaga

SEQ ID NO: 10014649 - DNA, 22 bp, Homo sapiens
tgctggctttttgtgtcaaaga

SEQ ID NO: 10014650 - DNA, 22 bp, Homo sapiens
tgctgggatatagcttctaggg

SEQ ID NO: 10014651 - DNA, 22 bp, Homo sapiens
tgctgggatatagcttctaggg

SEQ ID NO: 10014652 - DNA, 22 bp, Homo sapiens
tgctgggatatagcttctaggg

SEQ ID NO: 10014653 - DNA, 22 bp, Homo sapiens
ccccttctggtcttcaatggtg

SEQ ID NO: 10014654 - DNA, 22 bp, Homo sapiens
ccccttctgtgtcctgtcagcc

SEQ ID NO: 10014655 - DNA, 19 bp, Homo sapiens
ccccttgtgtaactagcct

SEQ ID NO: 10014656 - DNA, 22 bp, Homo sapiens
tgctggctttgcgagatgcatt

SEQ ID NO: 10014657 - DNA, 22 bp, Homo sapiens
tgctggctttctgtccctggca

SEQ ID NO: 10014658 - DNA, 22 bp, Homo sapiens
tgctggcttttccttcaggcag

SEQ ID NO: 10014659 - DNA, 23 bp, Homo sapiens
tgctggcttttatctggtcccta

SEQ ID NO: 10014660 - DNA, 23 bp, Homo sapiens
tgctggctaagaatctgcatttt

SEQ ID NO: 10014661 - DNA, 23 bp, Homo sapiens
tgctggctaagaatctgcatttt

SEQ ID NO: 10014662 - DNA, 22 bp, Homo sapiens
tgctggctacattattgctgtc

SEQ ID NO: 10014663 - DNA, 22 bp, Homo sapiens
tgctggctaatggaaaccagat

SEQ ID NO: 10014664 - DNA, 22 bp, Homo sapiens
tgctggctttaaggttaaagtg

SEQ ID NO: 10014665 - DNA, 22 bp, Homo sapiens
tgctggctttagtgattggggt

SEQ ID NO: 10014666 - DNA, 22 bp, Homo sapiens
tgctggctttagtgattggggt

SEQ ID NO: 10014667 - DNA, 23 bp, Homo sapiens
cccaggctacaaattatgctctg

SEQ ID NO: 10014668 - DNA, 23 bp, Homo sapiens
cccaggctacaaattatgctctg

SEQ ID NO: 10014669 - DNA, 22 bp, Homo sapiens
tgcccagctgtcaaagtagata

SEQ ID NO: 10014670 - DNA, 22 bp, Homo sapiens
tgcccagctattcctttcttag

SEQ ID NO: 10014671 - DNA, 22 bp, Homo sapiens
tgcccagcgcccacattctgtc

SEQ ID NO: 10014672 - DNA, 22 bp, Homo sapiens
tgcccagcgcccacattctgtc

SEQ ID NO: 10014673 - DNA, 22 bp, Homo sapiens
tgcccagcccctatccctggga

SEQ ID NO: 10014674 - DNA, 22 bp, Homo sapiens
tgcccagcctaaacttggcaag

SEQ ID NO: 10014675 - DNA, 22 bp, Homo sapiens
tgccagttgggaaaacagacat

SEQ ID NO: 10014676 - DNA, 22 bp, Homo sapiens
tgccagtgtggaactaggaaga

SEQ ID NO: 10014677 - DNA, 22 bp, Homo sapiens
tgccagtgggtgtgcagagact

SEQ ID NO: 10014678 - DNA, 22 bp, Homo sapiens
tgccatagcaatggtaagctga

SEQ ID NO: 10014679 - DNA, 22 bp, Homo sapiens
tgccatattattgagcatatta

SEQ ID NO: 10014680 - DNA, 22 bp, Homo sapiens
tgccatattgcaaagtgtctgc

SEQ ID NO: 10014681 - DNA, 22 bp, Homo sapiens
tgcccagccaatttgttatgtt

SEQ ID NO: 10014682 - DNA, 22 bp, Homo sapiens
tgccatattgatgtgctgtacc

SEQ ID NO: 10014683 - DNA, 22 bp, Homo sapiens
tgcccagccagtttatggtaat

SEQ ID NO: 10014684 - DNA, 22 bp, Homo sapiens
cccaggctcccaggtgggacaa

SEQ ID NO: 10014685 - DNA, 22 bp, Homo sapiens
cccaggctcccaggtgggacaa

SEQ ID NO: 10014686 - DNA, 22 bp, Homo sapiens
cccaggctagtatgatatcagt

SEQ ID NO: 10014687 - DNA, 22 bp, Homo sapiens
cccaggctagtatgatatcagt

SEQ ID NO: 10014688 - DNA, 22 bp, Homo sapiens
cccaggctcagactggcttgtt

SEQ ID NO: 10014689 - DNA, 22 bp, Homo sapiens
cccaggctcactgtccgcttcc

SEQ ID NO: 10014690 - DNA, 22 bp, Homo sapiens
tgccagcttcttacggctgcct

SEQ ID NO: 10014691 - DNA, 22 bp, Homo sapiens
tgccagcttgtggtcagaggct

SEQ ID NO: 10014692 - DNA, 22 bp, Homo sapiens
tgccagctgacagcagagacaa

SEQ ID NO: 10014693 - DNA, 21 bp, Homo sapiens
tgccagctgctgcatctgtct

SEQ ID NO: 10014694 - DNA, 22 bp, Homo sapiens
tgccagctgcttgtcccccaca

SEQ ID NO: 10014695 - DNA, 22 bp, Homo sapiens
tgccagctgttcccacccaaaa

SEQ ID NO: 10014696 - DNA, 22 bp, Homo sapiens
tgcacagagcaggcaccagcgg

SEQ ID NO: 10014697 - DNA, 22 bp, Homo sapiens
tgcacagatagtgatagatagc

SEQ ID NO: 10014698 - DNA, 22 bp, Homo sapiens
tgcacagagagatgagacacgt

SEQ ID NO: 10014699 - DNA, 22 bp, Homo sapiens
tgccacagaggtgaagcccact

SEQ ID NO: 10014700 - DNA, 22 bp, Homo sapiens
tgcacagatctggtggcaagga

SEQ ID NO: 10014701 - DNA, 22 bp, Homo sapiens
tgccagctcctgcagctcctgt

SEQ ID NO: 10014702 - DNA, 22 bp, Homo sapiens
tgccagctccgaggagctgcag

SEQ ID NO: 10014703 - DNA, 22 bp, Homo sapiens
tgccagctcccttttctcctcc

SEQ ID NO: 10014704 - DNA, 22 bp, Homo sapiens
tgccagctcccttttctcctcc

SEQ ID NO: 10014705 - DNA, 22 bp, Homo sapiens
cccaggagacatatagaaggac

SEQ ID NO: 10014706 - DNA, 22 bp, Homo sapiens
cccaggagacctgtgaaaggac

SEQ ID NO: 10014707 - DNA, 22 bp, Homo sapiens
tgccagtgcttgtgtctgagca

SEQ ID NO: 10014708 - DNA, 22 bp, Homo sapiens
tgccagtctcaccctgggtcct

SEQ ID NO: 10014709 - DNA, 22 bp, Homo sapiens
tgccaggctaagtggaggactt

SEQ ID NO: 10014710 - DNA, 22 bp, Homo sapiens
cccaggagagaggccagttggc

SEQ ID NO: 10014711 - DNA, 22 bp, Homo sapiens
cccaggagagggaaccaaatgt

SEQ ID NO: 10014712 - DNA, 22 bp, Homo sapiens
tgcctgtgtgaccacgggcaag

SEQ ID NO: 10014713 - DNA, 22 bp, Homo sapiens
tgcctgtgtggggtctgccgcc

SEQ ID NO: 10014714 - DNA, 17 bp, Homo sapiens
cccagggaccactgctt

SEQ ID NO: 10014715 - DNA, 22 bp, Homo sapiens
tgccttcctggagctgaaggct

SEQ ID NO: 10014716 - DNA, 22 bp, Homo sapiens
tgccttcctaatggtggggttt

SEQ ID NO: 10014717 - DNA, 22 bp, Homo sapiens
tgccttcctaatggtggggttt

SEQ ID NO: 10014718 - DNA, 22 bp, Homo sapiens
tgccttcaccaggccttcagcc

SEQ ID NO: 10014719 - DNA, 22 bp, Homo sapiens
tgcctgttgcccacctgataaa

SEQ ID NO: 10014720 - DNA, 22 bp, Homo sapiens
tgccttcaccaggccttcagcc

SEQ ID NO: 10014721 - DNA, 22 bp, Homo sapiens
tgccttcaagacccatcctcca

SEQ ID NO: 10014722 - DNA, 22 bp, Homo sapiens
tgccttagggtacctggtgctt

SEQ ID NO: 10014723 - DNA, 23 bp, Homo sapiens
tgccttagttagcacatttctaa

SEQ ID NO: 10014724 - DNA, 20 bp, Homo sapiens
tgccttagagataaaggctt

SEQ ID NO: 10014725 - DNA, 22 bp, Homo sapiens
tgccttagaggatagtgaagcc

SEQ ID NO: 10014726 - DNA, 22 bp, Homo sapiens
tgccttagagcactcaagagtg

SEQ ID NO: 10014727 - DNA, 22 bp, Homo sapiens
cccagggtggatgcaagcagca

SEQ ID NO: 10014728 - DNA, 22 bp, Homo sapiens
cccaggggttcaaggctgcagt

SEQ ID NO: 10014729 - DNA, 22 bp, Homo sapiens
cccaggggttctagaccagctt

SEQ ID NO: 10014730 - DNA, 22 bp, Homo sapiens
cccaggggttcaaggctgcagt

SEQ ID NO: 10014731 - DNA, 20 bp, Homo sapiens
cccaggggttgtggtgagga

SEQ ID NO: 10014732 - DNA, 22 bp, Homo sapiens
cccaggggttctgagcagcagc

SEQ ID NO: 10014733 - DNA, 22 bp, Homo sapiens
cccaggctggagtgcaatggtg

SEQ ID NO: 10014734 - DNA, 22 bp, Homo sapiens
cccaggctggagtgcaatggtg

SEQ ID NO: 10014735 - DNA, 22 bp, Homo sapiens
cccaggctggagtgcagtggcg

SEQ ID NO: 10014736 - DNA, 22 bp, Homo sapiens
cccaggctggagtgcagtggcg

SEQ ID NO: 10014737 - DNA, 22 bp, Homo sapiens
cccaggctggagtgcaatggca

SEQ ID NO: 10014738 - DNA, 22 bp, Homo sapiens
cccaggctggagtgcaatggca

SEQ ID NO: 10014739 - DNA, 22 bp, Homo sapiens
cccaggctggaattccaggcct

SEQ ID NO: 10014740 - DNA, 22 bp, Homo sapiens
cccaggctggaattccaggcct

SEQ ID NO: 10014741 - DNA, 22 bp, Homo sapiens
cccaggctgagttagaggtgtc

SEQ ID NO: 10014742 - DNA, 22 bp, Homo sapiens
cccaggctggaattccaggcct

SEQ ID NO: 10014743 - DNA, 22 bp, Homo sapiens
cccaggctgagttagaggtgtc

SEQ ID NO: 10014744 - DNA, 22 bp, Homo sapiens
tgccctggttacactggagtcc

SEQ ID NO: 10014745 - DNA, 22 bp, Homo sapiens
cccaggctggcctccgcagtgc

SEQ ID NO: 10014746 - DNA, 22 bp, Homo sapiens
cccaggctggatttcggtggca

SEQ ID NO: 10014747 - DNA, 22 bp, Homo sapiens
cccaggctggatttcggtggca

SEQ ID NO: 10014748 - DNA, 22 bp, Homo sapiens
cccaggctggggctcctccagc

SEQ ID NO: 10014749 - DNA, 21 bp, Homo sapiens
tctggcaggaagacggatggg

SEQ ID NO: 10014750 - DNA, 22 bp, Homo sapiens
tctggcagcgaagcgtgtactt

SEQ ID NO: 10014751 - DNA, 22 bp, Homo sapiens
tctggccctgctgctgtgagca

SEQ ID NO: 10014752 - DNA, 22 bp, Homo sapiens
tctggcaggccttgtcaatctg

SEQ ID NO: 10014753 - DNA, 22 bp, Homo sapiens
tctggccctgctgctgtgagca

SEQ ID NO: 10014754 - DNA, 22 bp, Homo sapiens
tctggcctactggagtccatga

SEQ ID NO: 10014755 - DNA, 22 bp, Homo sapiens
tctggcctcttgggatgctccc

SEQ ID NO: 10014756 - DNA, 22 bp, Homo sapiens
tctggctcagggctctgaggga

SEQ ID NO: 10014757 - DNA, 22 bp, Homo sapiens
ccaggaaggatcgtttgggagt

SEQ ID NO: 10014758 - DNA, 22 bp, Homo sapiens
ccaggacagggagacgggagcc

SEQ ID NO: 10014759 - DNA, 19 bp, Homo sapiens
ccaggacctttccagggtc

SEQ ID NO: 10014760 - DNA, 20 bp, Homo sapiens
ccaggactgctggggactct

SEQ ID NO: 10014761 - DNA, 22 bp, Homo sapiens
ccaggactttaagtccagcact

SEQ ID NO: 10014762 - DNA, 22 bp, Homo sapiens
ccaggacttcgaggctacagtg

SEQ ID NO: 10014763 - DNA, 22 bp, Homo sapiens
ccaggacttcgaggctacagtg

SEQ ID NO: 10014764 - DNA, 22 bp, Homo sapiens
tctggtcccttttcctgcagtc

SEQ ID NO: 10014765 - DNA, 22 bp, Homo sapiens
tctggtccccattccaggtggg

SEQ ID NO: 10014766 - DNA, 20 bp, Homo sapiens
tctggtgccccttcctgaga

SEQ ID NO: 10014767 - DNA, 21 bp, Homo sapiens
tctggtctgctgtggacctgg

SEQ ID NO: 10014768 - DNA, 22 bp, Homo sapiens
tctggtgtcagtattctttgaa

SEQ ID NO: 10014769 - DNA, 19 bp, Homo sapiens
tctggttcatttctgctgt

SEQ ID NO: 10014770 - DNA, 19 bp, Homo sapiens
tctgggagagtgaatctga

SEQ ID NO: 10014771 - DNA, 22 bp, Homo sapiens
tctgggagatccaagcagaact

SEQ ID NO: 10014772 - DNA, 22 bp, Homo sapiens
ccaggactcagtggggaaaggg

SEQ ID NO: 10014773 - DNA, 22 bp, Homo sapiens
ccaggactcagtggggaaaggg

SEQ ID NO: 10014774 - DNA, 22 bp, Homo sapiens
tctgggagcacacgcagtgatc

SEQ ID NO: 10014775 - DNA, 22 bp, Homo sapiens
tctgggagatccaagcagaact

SEQ ID NO: 10014776 - DNA, 22 bp, Homo sapiens
tctgggagccatgccttggagt

SEQ ID NO: 10014777 - DNA, 22 bp, Homo sapiens
tctgggagcagctcagcagatt

SEQ ID NO: 10014778 - DNA, 22 bp, Homo sapiens
tctgggagcagctcagcagatt

SEQ ID NO: 10014779 - DNA, 22 bp, Homo sapiens
tctgggagctggctttgcctca

SEQ ID NO: 10014780 - DNA, 22 bp, Homo sapiens
tctgggagcctgaaagtgaatg

SEQ ID NO: 10014781 - DNA, 22 bp, Homo sapiens
tctgcttctcctacttcatggg

SEQ ID NO: 10014782 - DNA, 22 bp, Homo sapiens
tctgcttctcctacttcatggg

SEQ ID NO: 10014783 - DNA, 22 bp, Homo sapiens
tctgctgtttactgtgtgatat

SEQ ID NO: 10014784 - DNA, 23 bp, Homo sapiens
tctgcttctgtattttttcccat

SEQ ID NO: 10014785 - DNA, 22 bp, Homo sapiens
tctggaaagatcattaaatcca

SEQ ID NO: 10014786 - DNA, 22 bp, Homo sapiens
tctgctttttcattgactgaaa

SEQ ID NO: 10014787 - DNA, 22 bp, Homo sapiens
tctggaaaagcgataaaccatt

SEQ ID NO: 10014788 - DNA, 22 bp, Homo sapiens
tctgctttgaccttcttgatgc

SEQ ID NO: 10014789 - DNA, 22 bp, Homo sapiens
tctgctttgctgcctcctgatc

SEQ ID NO: 10014790 - DNA, 22 bp, Homo sapiens
tctgctttcttgcgcagatgtg

SEQ ID NO: 10014791 - DNA, 22 bp, Homo sapiens
ccagctctcagcgggagactca

SEQ ID NO: 10014792 - DNA, 18 bp, Homo sapiens
tctggaacaacttcatgt

SEQ ID NO: 10014793 - DNA, 22 bp, Homo sapiens
tctggaaatttcagttttagag

SEQ ID NO: 10014794 - DNA, 22 bp, Homo sapiens
tctggaaatttcagttttagag

SEQ ID NO: 10014795 - DNA, 22 bp, Homo sapiens
ccagagagaaatggatttgagt

SEQ ID NO: 10014796 - DNA, 22 bp, Homo sapiens
ccagagagagaggtcaatggca

SEQ ID NO: 10014797 - DNA, 22 bp, Homo sapiens
ccagagagagaggtcaatggca

SEQ ID NO: 10014798 - DNA, 22 bp, Homo sapiens
tctcagaagtgatcaggatgtt

SEQ ID NO: 10014799 - DNA, 22 bp, Homo sapiens
tctcagaagggtggtgctggag

SEQ ID NO: 10014800 - DNA, 22 bp, Homo sapiens
ccagagagaaaatggagggcca

SEQ ID NO: 10014801 - DNA, 22 bp, Homo sapiens
ccagagagaaaatggagggcca

SEQ ID NO: 10014802 - DNA, 19 bp, Homo sapiens
tctcagaattggcaatcat

SEQ ID NO: 10014803 - DNA, 19 bp, Homo sapiens
tctcagaattaagagtgct

SEQ ID NO: 10014804 - DNA, 22 bp, Homo sapiens
tctgctattttctatctgtgtg

SEQ ID NO: 10014805 - DNA, 22 bp, Homo sapiens
tctgctattttctatctgtgtg

SEQ ID NO: 10014806 - DNA, 22 bp, Homo sapiens
ccagctctctgtcctccccaca

SEQ ID NO: 10014807 - DNA, 22 bp, Homo sapiens
ccagctctctttgaagcataaa

SEQ ID NO: 10014808 - DNA, 22 bp, Homo sapiens
ccagctctgcagggcctggggt

SEQ ID NO: 10014809 - DNA, 22 bp, Homo sapiens
ccagctctgccaagcgtcagct

SEQ ID NO: 10014810 - DNA, 22 bp, Homo sapiens
ccagctctgattttgacctcca

SEQ ID NO: 10014811 - DNA, 22 bp, Homo sapiens
ccagctgcaggtgttccagatg

SEQ ID NO: 10014812 - DNA, 22 bp, Homo sapiens
ccagctgcaggtgttccagatg

SEQ ID NO: 10014813 - DNA, 22 bp, Homo sapiens
ccagctgcccaagaggcatcct

SEQ ID NO: 10014814 - DNA, 22 bp, Homo sapiens
ccagctgcaggggagcagtgga

SEQ ID NO: 10014815 - DNA, 22 bp, Homo sapiens
ccagctgcaggggagcagtgga

SEQ ID NO: 10014816 - DNA, 22 bp, Homo sapiens
ccagctgctgtgcagggaggct

SEQ ID NO: 10014817 - DNA, 22 bp, Homo sapiens
ccagctgctgtgaggaccacag

SEQ ID NO: 10014818 - DNA, 22 bp, Homo sapiens
ccagctgcgggcatcgagagtt

SEQ ID NO: 10014819 - DNA, 22 bp, Homo sapiens
tcttcacattttaagaagttct

SEQ ID NO: 10014820 - DNA, 22 bp, Homo sapiens
tcttcacattcacgtaacatag

SEQ ID NO: 10014821 - DNA, 22 bp, Homo sapiens
ccaggcaagagaggctctggca

SEQ ID NO: 10014822 - DNA, 20 bp, Homo sapiens
ccaggcaactatcctgtctc

SEQ ID NO: 10014823 - DNA, 22 bp, Homo sapiens
ccaggcaacggagcccactgcc

SEQ ID NO: 10014824 - DNA, 22 bp, Homo sapiens
ccaggcaaggacatgaaactga

SEQ ID NO: 10014825 - DNA, 15 bp, Homo sapiens
ccaggcaagcaggaa

SEQ ID NO: 10014826 - DNA, 22 bp, Homo sapiens
ccaggcaagctctgctgtgccc

SEQ ID NO: 10014827 - DNA, 22 bp, Homo sapiens
ccaggcaaggtctcctagagag

SEQ ID NO: 10014828 - DNA, 22 bp, Homo sapiens
tcttagaatgtcaactgatgtt

SEQ ID NO: 10014829 - DNA, 22 bp, Homo sapiens
ccaggcaaagcccatgcaagag

SEQ ID NO: 10014830 - DNA, 22 bp, Homo sapiens
ccaggcaaatccctctggcaga

SEQ ID NO: 10014831 - DNA, 22 bp, Homo sapiens
ccaggcaaaacagatttgtatg

SEQ ID NO: 10014832 - DNA, 22 bp, Homo sapiens
ccaggagttggaggctgcagtg

SEQ ID NO: 10014833 - DNA, 22 bp, Homo sapiens
ccaggagttggaggttgcagtg

SEQ ID NO: 10014834 - DNA, 22 bp, Homo sapiens
ccaggagtttgaggctgcagtg

SEQ ID NO: 10014835 - DNA, 22 bp, Homo sapiens
ccaggagtggctggtgaccttc

SEQ ID NO: 10014836 - DNA, 22 bp, Homo sapiens
ccaggaggttgaggctgcagtg

SEQ ID NO: 10014837 - DNA, 22 bp, Homo sapiens
ccaggaggttgaggctgcagtg

SEQ ID NO: 10014838 - DNA, 22 bp, Homo sapiens
ccaggaggttgaggctgcagtg

SEQ ID NO: 10014839 - DNA, 22 bp, Homo sapiens
ccaggagggaccgcggcatccc

SEQ ID NO: 10014840 - DNA, 22 bp, Homo sapiens
tcttcagaagatcacatcagtg

SEQ ID NO: 10014841 - DNA, 22 bp, Homo sapiens
tcttcactgatgtctctcaaat

SEQ ID NO: 10014842 - DNA, 22 bp, Homo sapiens
tcttcagaaaattatcacttgt

SEQ ID NO: 10014843 - DNA, 22 bp, Homo sapiens
tcttcagacccttagctgtgat

SEQ ID NO: 10014844 - DNA, 22 bp, Homo sapiens
tcttcagactccaaatgtttta

SEQ ID NO: 10014845 - DNA, 22 bp, Homo sapiens
tcttcagactccaaatgtttta

SEQ ID NO: 10014846 - DNA, 22 bp, Homo sapiens
tcttcagactccaaatgtttta

SEQ ID NO: 10014847 - DNA, 22 bp, Homo sapiens
tcttcagactgttgttcttttg

SEQ ID NO: 10014848 - DNA, 22 bp, Homo sapiens
tcttcagagcatttctgaggta

SEQ ID NO: 10014849 - DNA, 22 bp, Homo sapiens
tcttcagaggagctgaatatat

SEQ ID NO: 10014850 - DNA, 22 bp, Homo sapiens
tcttcagagatgtaacatatgg

SEQ ID NO: 10014851 - DNA, 22 bp, Homo sapiens
tcttcagagactctgagcccct

SEQ ID NO: 10014852 - DNA, 22 bp, Homo sapiens
tcttcagagactctgagcccct

SEQ ID NO: 10014853 - DNA, 22 bp, Homo sapiens
tcttcagataaagggagagtat

SEQ ID NO: 10014854 - DNA, 22 bp, Homo sapiens
ccaggccagcaggcacacctgc

SEQ ID NO: 10014855 - DNA, 22 bp, Homo sapiens
ccaggccagcaggcacacctgc

SEQ ID NO: 10014856 - DNA, 22 bp, Homo sapiens
ccaggccagcctggagcatggc

SEQ ID NO: 10014857 - DNA, 22 bp, Homo sapiens
tcttcccccgtgctccagtgca

SEQ ID NO: 10014858 - DNA, 22 bp, Homo sapiens
ccaggcaggctagaatgtaaat

SEQ ID NO: 10014859 - DNA, 22 bp, Homo sapiens
tcttcctatgccaacattctgt

SEQ ID NO: 10014860 - DNA, 22 bp, Homo sapiens
ccaggctggagtgcaatggcgt

SEQ ID NO: 10014861 - DNA, 22 bp, Homo sapiens
ccaggctggagtgcaatggcgt

SEQ ID NO: 10014862 - DNA, 22 bp, Homo sapiens
ccaggctggagtgcaatggcat

SEQ ID NO: 10014863 - DNA, 22 bp, Homo sapiens
ccaggctggagtgcaatggcat

SEQ ID NO: 10014864 - DNA, 22 bp, Homo sapiens
tctttggcatttaggagcagga

SEQ ID NO: 10014865 - DNA, 22 bp, Homo sapiens
tctttggccttaggagcccttg

SEQ ID NO: 10014866 - DNA, 22 bp, Homo sapiens
tctttggccttaggagcccttg

SEQ ID NO: 10014867 - DNA, 22 bp, Homo sapiens
tctttggcatttaggagcagga

SEQ ID NO: 10014868 - DNA, 19 bp, Homo sapiens
tctttggctaaattgggtg

SEQ ID NO: 10014869 - DNA, 22 bp, Homo sapiens
tctttggctatgatttactgtt

SEQ ID NO: 10014870 - DNA, 22 bp, Homo sapiens
tctttggctgcctgaagcccaa

SEQ ID NO: 10014871 - DNA, 19 bp, Homo sapiens
tctttggcttctggatcag

SEQ ID NO: 10014872 - DNA, 22 bp, Homo sapiens
tctttggcttgtctcctcagtt

SEQ ID NO: 10014873 - DNA, 22 bp, Homo sapiens
tctttggctttgccacacccaa

SEQ ID NO: 10014874 - DNA, 22 bp, Homo sapiens
tctttggtattcacttgtgaag

SEQ ID NO: 10014875 - DNA, 22 bp, Homo sapiens
tctttgggctaggagtttggat

SEQ ID NO: 10014876 - DNA, 22 bp, Homo sapiens
tctttggcttgtctcctcagtt

SEQ ID NO: 10014877 - DNA, 22 bp, Homo sapiens
tctttggctttgccacacccaa

SEQ ID NO: 10014878 - DNA, 22 bp, Homo sapiens
tctttgggagaaggggtcccag

SEQ ID NO: 10014879 - DNA, 22 bp, Homo sapiens
ccaggctctgttccccgaggag

SEQ ID NO: 10014880 - DNA, 22 bp, Homo sapiens
ccaggctctgttccccgaggag

SEQ ID NO: 10014881 - DNA, 22 bp, Homo sapiens
ccaggctctgtgtgggctagag

SEQ ID NO: 10014882 - DNA, 22 bp, Homo sapiens
ccaggctctgtgtgggctagag

SEQ ID NO: 10014883 - DNA, 22 bp, Homo sapiens
ccaggctctgtgtgggctagag

SEQ ID NO: 10014884 - DNA, 22 bp, Homo sapiens
ccaggctctgtgtgggctagag

SEQ ID NO: 10014885 - DNA, 22 bp, Homo sapiens
ccaggctctgtgtgggctagag

SEQ ID NO: 10014886 - DNA, 22 bp, Homo sapiens
ccaggctgaatatgttccaggg

SEQ ID NO: 10014887 - DNA, 23 bp, Homo sapiens
ccaggctctttcacctgctattc

SEQ ID NO: 10014888 - DNA, 23 bp, Homo sapiens
ccaggctctttcacctgctattc

SEQ ID NO: 10014889 - DNA, 22 bp, Homo sapiens
ccaggctctgtctggtcagaag

SEQ ID NO: 10014890 - DNA, 22 bp, Homo sapiens
ccaggctctgtctggtcagaag

SEQ ID NO: 10014891 - DNA, 22 bp, Homo sapiens
ccaggctctgtctggtcagaag

SEQ ID NO: 10014892 - DNA, 22 bp, Homo sapiens
ccaggctctgcgctggacatgg

SEQ ID NO: 10014893 - DNA, 22 bp, Homo sapiens
ccaggcctggccaggggatgcc

SEQ ID NO: 10014894 - DNA, 21 bp, Homo sapiens
ccaggctcctgaggctggtca

SEQ ID NO: 10014895 - DNA, 21 bp, Homo sapiens
ccaggctcctgaggctggtca

SEQ ID NO: 10014896 - DNA, 22 bp, Homo sapiens
ccaggcctggaccatgccaggg

SEQ ID NO: 10014897 - DNA, 22 bp, Homo sapiens
ccaggcctggacgggtggcctg

SEQ ID NO: 10014898 - DNA, 22 bp, Homo sapiens
ccaggccattcccagagttgct

SEQ ID NO: 10014899 - DNA, 22 bp, Homo sapiens
ccaggccagtgtttggtccagg

SEQ ID NO: 10014900 - DNA, 19 bp, Homo sapiens
ccaggccatcccagttccc

SEQ ID NO: 10014901 - DNA, 22 bp, Homo sapiens
ccaggcccaccttggccactta

SEQ ID NO: 10014902 - DNA, 22 bp, Homo sapiens
ccaggcccagggtactgaccaa

SEQ ID NO: 10014903 - DNA, 22 bp, Homo sapiens
tctttcaatccattcatatgtc

SEQ ID NO: 10014904 - DNA, 22 bp, Homo sapiens
ccaggccccagggctggctttc

SEQ ID NO: 10014905 - DNA, 22 bp, Homo sapiens
ccaggcctgcatctgctgcgca

SEQ ID NO: 10014906 - DNA, 22 bp, Homo sapiens
tctttctttatcacctgatatg

SEQ ID NO: 10014907 - DNA, 22 bp, Homo sapiens
tctttcttggtataaagcaggg

SEQ ID NO: 10014908 - DNA, 22 bp, Homo sapiens
tctttcttggtataaagcaggg

SEQ ID NO: 10014909 - DNA, 22 bp, Homo sapiens
tctttcttggtataaagcaggg

SEQ ID NO: 10014910 - DNA, 22 bp, Homo sapiens
tctttcttctttcatagtgtga

SEQ ID NO: 10014911 - DNA, 22 bp, Homo sapiens
tctttcttcagccctgtaagat

SEQ ID NO: 10014912 - DNA, 22 bp, Homo sapiens
ccatgcatgcctgaaattgctg

SEQ ID NO: 10014913 - DNA, 22 bp, Homo sapiens
ccatcctgcattgctattcaga

SEQ ID NO: 10014914 - DNA, 22 bp, Homo sapiens
ccatgcccttgtcatctccagg

SEQ ID NO: 10014915 - DNA, 22 bp, Homo sapiens
ccatgctgaccctgtgcaggca

SEQ ID NO: 10014916 - DNA, 22 bp, Homo sapiens
ccatgctgaccctgtgcaggca

SEQ ID NO: 10014917 - DNA, 22 bp, Homo sapiens
ccatgctgaccctgtgcaggca

SEQ ID NO: 10014918 - DNA, 22 bp, Homo sapiens
ccatgctggagtccctagctgt

SEQ ID NO: 10014919 - DNA, 22 bp, Homo sapiens
tgaggtcacagctggggatgga

SEQ ID NO: 10014920 - DNA, 22 bp, Homo sapiens
tgaggtatgtgatgtcttttag

SEQ ID NO: 10014921 - DNA, 22 bp, Homo sapiens
tgaggtattttttaaagcacaa

SEQ ID NO: 10014922 - DNA, 22 bp, Homo sapiens
tgaggtatggtaaggtaaaatc

SEQ ID NO: 10014923 - DNA, 22 bp, Homo sapiens
tgaggtatgctgaactctgttt

SEQ ID NO: 10014924 - DNA, 22 bp, Homo sapiens
tgaggtatgagtgtgccaggtg

SEQ ID NO: 10014925 - DNA, 22 bp, Homo sapiens
tgaggtatgatttacatgcagt

SEQ ID NO: 10014926 - DNA, 22 bp, Homo sapiens
tgaggtatgctgaactctgttt

SEQ ID NO: 10014927 - DNA, 22 bp, Homo sapiens
tgaggtatccagtgaagcagcc

SEQ ID NO: 10014928 - DNA, 22 bp, Homo sapiens
tgaggtatgaggttctatgatc

SEQ ID NO: 10014929 - DNA, 22 bp, Homo sapiens
ccatgtggtgggaaggagaatg

SEQ ID NO: 10014930 - DNA, 22 bp, Homo sapiens
tgaggtaggtaccattatcact

SEQ ID NO: 10014931 - DNA, 22 bp, Homo sapiens
tgaggtaggcttgagatgggag

SEQ ID NO: 10014932 - DNA, 20 bp, Homo sapiens
tgaggtatcaattcaaggca

SEQ ID NO: 10014933 - DNA, 22 bp, Homo sapiens
tgaggtatacgttggttcagtc

SEQ ID NO: 10014934 - DNA, 20 bp, Homo sapiens
ccagtccctgagcaccaggg

SEQ ID NO: 10014935 - DNA, 22 bp, Homo sapiens
tgaggcagcaattgtattgtat

SEQ ID NO: 10014936 - DNA, 22 bp, Homo sapiens
tgaggcagcattcttcaagaca

SEQ ID NO: 10014937 - DNA, 23 bp, Homo sapiens
tgaggctgattgatttttgctca

SEQ ID NO: 10014938 - DNA, 23 bp, Homo sapiens
tgaggctgattgatttttgctca

SEQ ID NO: 10014939 - DNA, 22 bp, Homo sapiens
tgagggcaaagtggtgctgagg

SEQ ID NO: 10014940 - DNA, 22 bp, Homo sapiens
tgagggcaaagtggtgctgagg

SEQ ID NO: 10014941 - DNA, 22 bp, Homo sapiens
tgagggcaaagtggtgctgagg

SEQ ID NO: 10014942 - DNA, 22 bp, Homo sapiens
tgagggcagagcactggggagc

SEQ ID NO: 10014943 - DNA, 22 bp, Homo sapiens
tgagggcagagcactggggagc

SEQ ID NO: 10014944 - DNA, 22 bp, Homo sapiens
tgagggcagagcactggggagc

SEQ ID NO: 10014945 - DNA, 22 bp, Homo sapiens
tgagggcagagcactggggagc

SEQ ID NO: 10014946 - DNA, 22 bp, Homo sapiens
tgagggctaaattgtggcaggt

SEQ ID NO: 10014947 - DNA, 22 bp, Homo sapiens
tgagggctaaattgtggcaggt

SEQ ID NO: 10014948 - DNA, 22 bp, Homo sapiens
tgaggggaactgatgcccattg

SEQ ID NO: 10014949 - DNA, 22 bp, Homo sapiens
ccagtgtttacagttgaacaaa

SEQ ID NO: 10014950 - DNA, 22 bp, Homo sapiens
tgattttattgaaacttcactt

SEQ ID NO: 10014951 - DNA, 22 bp, Homo sapiens
tgattttattggtgaggaaatt

SEQ ID NO: 10014952 - DNA, 22 bp, Homo sapiens
tgattttattgaaacttcactt

SEQ ID NO: 10014953 - DNA, 22 bp, Homo sapiens
tgattttacttagcatgatgtt

SEQ ID NO: 10014954 - DNA, 23 bp, Homo sapiens
tgattttaaaaagtaagttatca

SEQ ID NO: 10014955 - DNA, 23 bp, Homo sapiens
tgattttaaaaagtaagttatca

SEQ ID NO: 10014956 - DNA, 22 bp, Homo sapiens
tgatttgtttagtgccaagttt

SEQ ID NO: 10014957 - DNA, 22 bp, Homo sapiens
tgatttgttacacaggtgtgtg

SEQ ID NO: 10014958 - DNA, 22 bp, Homo sapiens
tgatttgtttagtgccaagttt

SEQ ID NO: 10014959 - DNA, 22 bp, Homo sapiens
tgatttgaaacctttggcaaga

SEQ ID NO: 10014960 - DNA, 22 bp, Homo sapiens
tgatttgattcttcttggagta

SEQ ID NO: 10014961 - DNA, 22 bp, Homo sapiens
tgatttctcatattgttcaaaa

SEQ ID NO: 10014962 - DNA, 22 bp, Homo sapiens
tgatttcctgtgcgcccttagg

SEQ ID NO: 10014963 - DNA, 22 bp, Homo sapiens
tgattcaagccaccacatactg

SEQ ID NO: 10014964 - DNA, 22 bp, Homo sapiens
tgattcaagccaccacatactg

SEQ ID NO: 10014965 - DNA, 20 bp, Homo sapiens
tgatttctcttctattcctt

SEQ ID NO: 10014966 - DNA, 22 bp, Homo sapiens
tgatttctcttggcaatatgtt

SEQ ID NO: 10014967 - DNA, 22 bp, Homo sapiens
tgatttcttccttgtcattaga

SEQ ID NO: 10014968 - DNA, 22 bp, Homo sapiens
ccattaaaatggaatgtagtga

SEQ ID NO: 10014969 - DNA, 22 bp, Homo sapiens
ccattaaaattgtgacatagga

SEQ ID NO: 10014970 - DNA, 22 bp, Homo sapiens
ccattaaacttgtggacccagt

SEQ ID NO: 10014971 - DNA, 22 bp, Homo sapiens
ccattaaaatggaatgtagtga

SEQ ID NO: 10014972 - DNA, 22 bp, Homo sapiens
ccattatccacgggcttcctga

SEQ ID NO: 10014973 - DNA, 22 bp, Homo sapiens
ccattatccattttgagtctta

SEQ ID NO: 10014974 - DNA, 23 bp, Homo sapiens
ccattcatctcagtcattgcttt

SEQ ID NO: 10014975 - DNA, 22 bp, Homo sapiens
ccattaaagcaccactgtaata

SEQ ID NO: 10014976 - DNA, 22 bp, Homo sapiens
ccattactgaaataaagagaat

SEQ ID NO: 10014977 - DNA, 22 bp, Homo sapiens
ccattagaagatgtaatagaga

SEQ ID NO: 10014978 - DNA, 22 bp, Homo sapiens
ccattacttagaaaggaactga

SEQ ID NO: 10014979 - DNA, 22 bp, Homo sapiens
ccattgaattagaaggggaagg

SEQ ID NO: 10014980 - DNA, 22 bp, Homo sapiens
ccattgaatcctcagctgctag

SEQ ID NO: 10014981 - DNA, 22 bp, Homo sapiens
ccattgaaggcacttgagcaga

SEQ ID NO: 10014982 - DNA, 22 bp, Homo sapiens
ccattggagagttttaagaagg

SEQ ID NO: 10014983 - DNA, 19 bp, Homo sapiens
ccattgtaaagaaaaatgt

SEQ ID NO: 10014984 - DNA, 22 bp, Homo sapiens
ccattgaacccctctaggccac

SEQ ID NO: 10014985 - DNA, 22 bp, Homo sapiens
ccattctgagtcttatgtcttt

SEQ ID NO: 10014986 - DNA, 22 bp, Homo sapiens
ccattccatgtgctacacataa

SEQ ID NO: 10014987 - DNA, 22 bp, Homo sapiens
tgcaaaggcatctgggaaggtt

SEQ ID NO: 10014988 - DNA, 22 bp, Homo sapiens
tgcaaagtgctagcccacacca

SEQ ID NO: 10014989 - DNA, 22 bp, Homo sapiens
tgcaaagtcgcaaaattcttct

SEQ ID NO: 10014990 - DNA, 22 bp, Homo sapiens
tgcaaagttgaggaaggcatgg

SEQ ID NO: 10014991 - DNA, 22 bp, Homo sapiens
tgcaaagttgcatcaaaaccca

SEQ ID NO: 10014992 - DNA, 22 bp, Homo sapiens
tgcaaatagcctgatgaaagaa

SEQ ID NO: 10014993 - DNA, 22 bp, Homo sapiens
cccactgtgttgcagtctagtg

SEQ ID NO: 10014994 - DNA, 22 bp, Homo sapiens
cccagacataacagcagagagg

SEQ ID NO: 10014995 - DNA, 22 bp, Homo sapiens
cccagaaggtcgaggctgcagt

SEQ ID NO: 10014996 - DNA, 20 bp, Homo sapiens
cccagaagcttaacagagca

SEQ ID NO: 10014997 - DNA, 22 bp, Homo sapiens
cccagaaggcttgccaggaagc

SEQ ID NO: 10014998 - DNA, 22 bp, Homo sapiens
tgcacacattaaggatacacag

SEQ ID NO: 10014999 - DNA, 22 bp, Homo sapiens
tgcacacatgtttacaagcatc

SEQ ID NO: 10015000 - DNA, 22 bp, Homo sapiens
tgcacacattaaggatacacag

SEQ ID NO: 10015001 - DNA, 22 bp, Homo sapiens
tgcacacatgtttacaagcatc

SEQ ID NO: 10015002 - DNA, 22 bp, Homo sapiens
tgcacacatgtatgtatatgtg

SEQ ID NO: 10015003 - DNA, 22 bp, Homo sapiens
tgcacacatgtatgtatatgtg

SEQ ID NO: 10015004 - DNA, 22 bp, Homo sapiens
tgcacacatgtttacaagcatc

SEQ ID NO: 10015005 - DNA, 22 bp, Homo sapiens
cccagactcatccctgggagct

SEQ ID NO: 10015006 - DNA, 22 bp, Homo sapiens
ccaggctggagtgcagtagtgt

SEQ ID NO: 10015007 - DNA, 22 bp, Homo sapiens
ccaggctggagtgcaatggtgc

SEQ ID NO: 10015008 - DNA, 22 bp, Homo sapiens
ccaggctggagtgcagtggcac

SEQ ID NO: 10015009 - DNA, 22 bp, Homo sapiens
ccaggctggagtgcagtggcac

SEQ ID NO: 10015010 - DNA, 22 bp, Homo sapiens
ccaggctggagtgcagtggcac

SEQ ID NO: 10015011 - DNA, 22 bp, Homo sapiens
ccaggctggagtgtagtcgcat

SEQ ID NO: 10015012 - DNA, 22 bp, Homo sapiens
ccaggctggagtgtagtcgcat

SEQ ID NO: 10015013 - DNA, 22 bp, Homo sapiens
ccaggctggattttgcagttca

SEQ ID NO: 10015014 - DNA, 22 bp, Homo sapiens
ccaggctggattttgcagttca

SEQ ID NO: 10015015 - DNA, 20 bp, Homo sapiens
ccaggctggcaaatgggggc

SEQ ID NO: 10015016 - DNA, 23 bp, Homo sapiens
tgacaacagctctcagccatgtc

SEQ ID NO: 10015017 - DNA, 22 bp, Homo sapiens
tgacaacagccatcacttttag

SEQ ID NO: 10015018 - DNA, 21 bp, Homo sapiens
tgacaacagaactgggcaagc

SEQ ID NO: 10015019 - DNA, 22 bp, Homo sapiens
tgacaacattgagttatgtgca

SEQ ID NO: 10015020 - DNA, 20 bp, Homo sapiens
tgacaacatgccttttgctt

SEQ ID NO: 10015021 - DNA, 22 bp, Homo sapiens
tgacaacatcatttttgtgtgg

SEQ ID NO: 10015022 - DNA, 23 bp, Homo sapiens
tgacaacagctctcagccatgtc

SEQ ID NO: 10015023 - DNA, 22 bp, Homo sapiens
tgacaagaagacctggtaatga

SEQ ID NO: 10015024 - DNA, 22 bp, Homo sapiens
tgacaagaatttgggactgtta

SEQ ID NO: 10015025 - DNA, 22 bp, Homo sapiens
tgaatgcaagaaggaacatgaa

SEQ ID NO: 10015026 - DNA, 20 bp, Homo sapiens
tgacaacaaaatggtaattt

SEQ ID NO: 10015027 - DNA, 20 bp, Homo sapiens
tgacaacaaaatggtaattt

SEQ ID NO: 10015028 - DNA, 22 bp, Homo sapiens
tgacaacaaggatcctgcctgg

SEQ ID NO: 10015029 - DNA, 22 bp, Homo sapiens
tgaatgatgtataatattgaga

SEQ ID NO: 10015030 - DNA, 22 bp, Homo sapiens
tgaagttgttaaggttgccatt

SEQ ID NO: 10015031 - DNA, 22 bp, Homo sapiens
tgaatgatctagttttgtagac

SEQ ID NO: 10015032 - DNA, 20 bp, Homo sapiens
tgacatagctcttggggtgc

SEQ ID NO: 10015033 - DNA, 22 bp, Homo sapiens
tgacatcagaatggcatagaaa

SEQ ID NO: 10015034 - DNA, 22 bp, Homo sapiens
tgacatcattagtaacatagct

SEQ ID NO: 10015035 - DNA, 22 bp, Homo sapiens
tgacatcattagtaacatagct

SEQ ID NO: 10015036 - DNA, 22 bp, Homo sapiens
tgagaaaagtacatggagaagc

SEQ ID NO: 10015037 - DNA, 22 bp, Homo sapiens
tgagaaaagtacatggagaagc

SEQ ID NO: 10015038 - DNA, 22 bp, Homo sapiens
tgagaaaaggttgagatgataa

SEQ ID NO: 10015039 - DNA, 22 bp, Homo sapiens
tgagaaaaggttgagatgataa

SEQ ID NO: 10015040 - DNA, 22 bp, Homo sapiens
tgacagtttattttgcagaatg

SEQ ID NO: 10015041 - DNA, 22 bp, Homo sapiens
tgacagtttattttgcagaatg

SEQ ID NO: 10015042 - DNA, 22 bp, Homo sapiens
tgacagtttagtgtaatagtta

SEQ ID NO: 10015043 - DNA, 22 bp, Homo sapiens
tgacagttcaggtcagatttat

SEQ ID NO: 10015044 - DNA, 22 bp, Homo sapiens
tgacagtgcgggtacatcatag

SEQ ID NO: 10015045 - DNA, 22 bp, Homo sapiens
tgacagtgtttgcacttcaggt

SEQ ID NO: 10015046 - DNA, 22 bp, Homo sapiens
tgacagtgtttgcacttcaggt

SEQ ID NO: 10015047 - DNA, 22 bp, Homo sapiens
ccagggctttatctgcctttga

SEQ ID NO: 10015048 - DNA, 22 bp, Homo sapiens
ccaggggaaacagggagcactc

SEQ ID NO: 10015049 - DNA, 22 bp, Homo sapiens
ccaggggaaacagggagcactc

SEQ ID NO: 10015050 - DNA, 22 bp, Homo sapiens
ccagggcttcccacgtgccctg

SEQ ID NO: 10015051 - DNA, 22 bp, Homo sapiens
ccagggcttcagttagtggtga

SEQ ID NO: 10015052 - DNA, 22 bp, Homo sapiens
ccagggcttcagttagtggtga

SEQ ID NO: 10015053 - DNA, 22 bp, Homo sapiens
ccagggcttcccacgtgccctg

SEQ ID NO: 10015054 - DNA, 22 bp, Homo sapiens
tgacaagctttacagaattgaa

SEQ ID NO: 10015055 - DNA, 23 bp, Homo sapiens
tgacaagtctcagccaatgcaga

SEQ ID NO: 10015056 - DNA, 22 bp, Homo sapiens
ccagggctgctgtgggactcca

SEQ ID NO: 10015057 - DNA, 19 bp, Homo sapiens
tgagaaggcagtggggagc

SEQ ID NO: 10015058 - DNA, 22 bp, Homo sapiens
tgagaaggcctgtgtgacaggg

SEQ ID NO: 10015059 - DNA, 22 bp, Homo sapiens
tgagaaggtgaaagtgtggaga

SEQ ID NO: 10015060 - DNA, 22 bp, Homo sapiens
tgagaataacagcctgtgttcc

SEQ ID NO: 10015061 - DNA, 22 bp, Homo sapiens
tgagaatactgcattgttagga

SEQ ID NO: 10015062 - DNA, 22 bp, Homo sapiens
tgagaatagcagactggtaact

SEQ ID NO: 10015063 - DNA, 22 bp, Homo sapiens
tgagaatcatccagaggcttct

SEQ ID NO: 10015064 - DNA, 22 bp, Homo sapiens
tgagaatatttgaagatgttag

SEQ ID NO: 10015065 - DNA, 22 bp, Homo sapiens
tgagaatcagctgcacagaggt

SEQ ID NO: 10015066 - DNA, 22 bp, Homo sapiens
ccaggggctctcagggtgtgtg

SEQ ID NO: 10015067 - DNA, 22 bp, Homo sapiens
ccaggggctctcagggtgtgtg

SEQ ID NO: 10015068 - DNA, 22 bp, Homo sapiens
ccaggtggaaggtctgtgctct

SEQ ID NO: 10015069 - DNA, 19 bp, Homo sapiens
ccaggtggaactgaggtag

SEQ ID NO: 10015070 - DNA, 22 bp, Homo sapiens
ccaggtgctcttgccagggctg

SEQ ID NO: 10015071 - DNA, 19 bp, Homo sapiens
ccaggtggaactgaggtag

SEQ ID NO: 10015072 - DNA, 22 bp, Homo sapiens
ccaggtgctcttgccagggctg

SEQ ID NO: 10015073 - DNA, 22 bp, Homo sapiens
ccaggggctggtgctgagctgg

SEQ ID NO: 10015074 - DNA, 22 bp, Homo sapiens
ccaggtgctagcaatcactgtc

SEQ ID NO: 10015075 - DNA, 22 bp, Homo sapiens
ccaggtctcgggtctgctcgtg

SEQ ID NO: 10015076 - DNA, 21 bp, Homo sapiens
ccagggtccagctgccatggt

SEQ ID NO: 10015077 - DNA, 17 bp, Homo sapiens
ccaggtctccttgcttt

SEQ ID NO: 10015078 - DNA, 22 bp, Homo sapiens
ccagggtcacaaataactgcag

SEQ ID NO: 10015079 - DNA, 22 bp, Homo sapiens
tgagacagttctgcagctgggt

SEQ ID NO: 10015080 - DNA, 22 bp, Homo sapiens
tgagacagttctgcagctgggt

SEQ ID NO: 10015081 - DNA, 22 bp, Homo sapiens
tgagacagttggtgaaatctaa

SEQ ID NO: 10015082 - DNA, 22 bp, Homo sapiens
tgagacagttctgcagctgggt

SEQ ID NO: 10015083 - DNA, 22 bp, Homo sapiens
tgagacagtttttctatttcca

SEQ ID NO: 10015084 - DNA, 22 bp, Homo sapiens
tgagacctgtaatgagaaattg

SEQ ID NO: 10015085 - DNA, 22 bp, Homo sapiens
tgagacctgtagcttcacagag

SEQ ID NO: 10015086 - DNA, 22 bp, Homo sapiens
tgagacctgtagcttcacagag

SEQ ID NO: 10015087 - DNA, 22 bp, Homo sapiens
tgagacgaagtcttgctctgtt

SEQ ID NO: 10015088 - DNA, 22 bp, Homo sapiens
tgagaccttaaaaggtatgtca

SEQ ID NO: 10015089 - DNA, 22 bp, Homo sapiens
tgagacctctgggttctgagct

SEQ ID NO: 10015090 - DNA, 22 bp, Homo sapiens
tgagacgaagtcttgctctgtt

SEQ ID NO: 10015091 - DNA, 17 bp, Homo sapiens
ccaggtgggaggtgggg

SEQ ID NO: 10015092 - DNA, 22 bp, Homo sapiens
ccaggtgtagcactgctcacag

SEQ ID NO: 10015093 - DNA, 22 bp, Homo sapiens
ccaggtgtcatgcgtgtgaccc

SEQ ID NO: 10015094 - DNA, 22 bp, Homo sapiens
ccaggtgtaggacaccaaggga

SEQ ID NO: 10015095 - DNA, 22 bp, Homo sapiens
ccaggtgtctgtggccagccct

SEQ ID NO: 10015096 - DNA, 22 bp, Homo sapiens
ccaggtgtgctctgcagtggat

SEQ ID NO: 10015097 - DNA, 22 bp, Homo sapiens
ccaggtgtgccagcagggactg

SEQ ID NO: 10015098 - DNA, 22 bp, Homo sapiens
ccaggtgtgatttggcagtgtc

SEQ ID NO: 10015099 - DNA, 22 bp, Homo sapiens
ccaggtgtggggaggactcaca

SEQ ID NO: 10015100 - DNA, 23 bp, Homo sapiens
tgaggacctctcaggggccaggc

SEQ ID NO: 10015101 - DNA, 22 bp, Homo sapiens
tgaggcagcaattgtattgtat

SEQ ID NO: 10015102 - DNA, 22 bp, Homo sapiens
tgaggcagcaattgattattca

SEQ ID NO: 10015103 - DNA, 22 bp, Homo sapiens
tgaggcagagtaagatacatga

SEQ ID NO: 10015104 - DNA, 22 bp, Homo sapiens
tgaggcagatatttattgggtt

SEQ ID NO: 10015105 - DNA, 22 bp, Homo sapiens
tgaggcagaaattcctgttttc

SEQ ID NO: 10015106 - DNA, 22 bp, Homo sapiens
cagggccatgaggcacagggtc

SEQ ID NO: 10015107 - DNA, 22 bp, Homo sapiens
cagggccagttctcgcagcagt

SEQ ID NO: 10015108 - DNA, 22 bp, Homo sapiens
cagggccagttctcgcagcagt

SEQ ID NO: 10015109 - DNA, 22 bp, Homo sapiens
cagggccagttctcgcagcagt

SEQ ID NO: 10015110 - DNA, 22 bp, Homo sapiens
cagggccatatcttgtgcacca

SEQ ID NO: 10015111 - DNA, 22 bp, Homo sapiens
cagggccatgaggcacagggtc

SEQ ID NO: 10015112 - DNA, 22 bp, Homo sapiens
cagggccagggctatggtgaag

SEQ ID NO: 10015113 - DNA, 22 bp, Homo sapiens
cagggccagggctatggtgaag

SEQ ID NO: 10015114 - DNA, 22 bp, Homo sapiens
cagggccaggctgatggcctgg

SEQ ID NO: 10015115 - DNA, 22 bp, Homo sapiens
tagatttctcattcatagattg

SEQ ID NO: 10015116 - DNA, 22 bp, Homo sapiens
tagatttctaacagtgtgcttg

SEQ ID NO: 10015117 - DNA, 22 bp, Homo sapiens
tagatttgaatgatgtaaagag

SEQ ID NO: 10015118 - DNA, 22 bp, Homo sapiens
cagggagatcttggctcctggt

SEQ ID NO: 10015119 - DNA, 22 bp, Homo sapiens
cagggagatcttggctcctggt

SEQ ID NO: 10015120 - DNA, 22 bp, Homo sapiens
tagattgttcttaactttataa

SEQ ID NO: 10015121 - DNA, 22 bp, Homo sapiens
tagatttaagaccctgaatttg

SEQ ID NO: 10015122 - DNA, 22 bp, Homo sapiens
tagattctttgctagatcattg

SEQ ID NO: 10015123 - DNA, 22 bp, Homo sapiens
tagattctttgctagatcattg

SEQ ID NO: 10015124 - DNA, 22 bp, Homo sapiens
tagatttcaggagacaaaatgg

SEQ ID NO: 10015125 - DNA, 22 bp, Homo sapiens
tagatttcaggagacaaaatgg

SEQ ID NO: 10015126 - DNA, 22 bp, Homo sapiens
tagatttcgctgcatctcaatc

SEQ ID NO: 10015127 - DNA, 22 bp, Homo sapiens
tagcttatcccacagtgcccag

SEQ ID NO: 10015128 - DNA, 22 bp, Homo sapiens
tagcttatcccacagtgcccag

SEQ ID NO: 10015129 - DNA, 22 bp, Homo sapiens
tagcttctatacaacttcagca

SEQ ID NO: 10015130 - DNA, 22 bp, Homo sapiens
tagcttctaatacttaccaatt

SEQ ID NO: 10015131 - DNA, 22 bp, Homo sapiens
tagcttctaatacttaccaatt

SEQ ID NO: 10015132 - DNA, 22 bp, Homo sapiens
tagctttaaaaatcatcaaagc

SEQ ID NO: 10015133 - DNA, 22 bp, Homo sapiens
tagcttctggagtgtttgaaaa

SEQ ID NO: 10015134 - DNA, 22 bp, Homo sapiens
tagcttctcttttcaacatctt

SEQ ID NO: 10015135 - DNA, 22 bp, Homo sapiens
tagcttctgggagtgtttacta

SEQ ID NO: 10015136 - DNA, 21 bp, Homo sapiens
tagcttcttgaggcttggccg

SEQ ID NO: 10015137 - DNA, 22 bp, Homo sapiens
taggcaggtgtgcactgcccac

SEQ ID NO: 10015138 - DNA, 22 bp, Homo sapiens
taggcagggattagggttgatt

SEQ ID NO: 10015139 - DNA, 22 bp, Homo sapiens
taggcagggattagggttgatt

SEQ ID NO: 10015140 - DNA, 22 bp, Homo sapiens
taggcagtgctctgtgcttcag

SEQ ID NO: 10015141 - DNA, 22 bp, Homo sapiens
taggcaggtgtgcactgcccac

SEQ ID NO: 10015142 - DNA, 22 bp, Homo sapiens
taggccaacgtggaagggtcca

SEQ ID NO: 10015143 - DNA, 22 bp, Homo sapiens
taggccaaatgacttgatgttt

SEQ ID NO: 10015144 - DNA, 22 bp, Homo sapiens
taggccaagttgatcagacatc

SEQ ID NO: 10015145 - DNA, 22 bp, Homo sapiens
taggccacagagaggagatttc

SEQ ID NO: 10015146 - DNA, 22 bp, Homo sapiens
taggccacaaataagatcctgt

SEQ ID NO: 10015147 - DNA, 22 bp, Homo sapiens
taggccacagatgagacataag

SEQ ID NO: 10015148 - DNA, 22 bp, Homo sapiens
taggccaccagggttccattta

SEQ ID NO: 10015149 - DNA, 21 bp, Homo sapiens
taggccacatgggttggagat

SEQ ID NO: 10015150 - DNA, 22 bp, Homo sapiens
taggccacggaaagcaggttgc

SEQ ID NO: 10015151 - DNA, 22 bp, Homo sapiens
taggccacgaaggagatgatag

SEQ ID NO: 10015152 - DNA, 22 bp, Homo sapiens
taggccactctcctttgtctca

SEQ ID NO: 10015153 - DNA, 22 bp, Homo sapiens
taggccagaggagcagctttgg

SEQ ID NO: 10015154 - DNA, 22 bp, Homo sapiens
cagggcccaagacacaatgagg

SEQ ID NO: 10015155 - DNA, 22 bp, Homo sapiens
cagggccattggcgtggctgtc

SEQ ID NO: 10015156 - DNA, 22 bp, Homo sapiens
cagggcccagtccctgctgtca

SEQ ID NO: 10015157 - DNA, 22 bp, Homo sapiens
cagggcccagtccctgctgtca

SEQ ID NO: 10015158 - DNA, 22 bp, Homo sapiens
cagggcctcatcctcagagatt

SEQ ID NO: 10015159 - DNA, 22 bp, Homo sapiens
cagggctccatgcagggactcc

SEQ ID NO: 10015160 - DNA, 20 bp, Homo sapiens
cagggcctatgattgagctt

SEQ ID NO: 10015161 - DNA, 22 bp, Homo sapiens
cagggcctcatcctcagagatt

SEQ ID NO: 10015162 - DNA, 22 bp, Homo sapiens
cagggcctcatcctcagagatt

SEQ ID NO: 10015163 - DNA, 23 bp, Homo sapiens
cagggccctgctcaatttctcca

SEQ ID NO: 10015164 - DNA, 20 bp, Homo sapiens
cagggcctatgattgagctt

SEQ ID NO: 10015165 - DNA, 20 bp, Homo sapiens
cagggcctaagagctgaaaa

SEQ ID NO: 10015166 - DNA, 22 bp, Homo sapiens
cagggccccagggatgtctgct

SEQ ID NO: 10015167 - DNA, 22 bp, Homo sapiens
cagggcccatggctcaggtagg

SEQ ID NO: 10015168 - DNA, 22 bp, Homo sapiens
caggggtggctgcagcagaggt

SEQ ID NO: 10015169 - DNA, 22 bp, Homo sapiens
caggggtggctgcagcagaggt

SEQ ID NO: 10015170 - DNA, 22 bp, Homo sapiens
cagggggtggtccaggctgcgc

SEQ ID NO: 10015171 - DNA, 22 bp, Homo sapiens
caggggtattcaaggtagttta

SEQ ID NO: 10015172 - DNA, 22 bp, Homo sapiens
cagggtagggcaagggaacctg

SEQ ID NO: 10015173 - DNA, 22 bp, Homo sapiens
cagggtagggcaagggaacctg

SEQ ID NO: 10015174 - DNA, 22 bp, Homo sapiens
cagggtagacagtaggtgtctg

SEQ ID NO: 10015175 - DNA, 22 bp, Homo sapiens
cagggtagacagtaggtgtctg

SEQ ID NO: 10015176 - DNA, 22 bp, Homo sapiens
caggggtgtttttggccaggag

SEQ ID NO: 10015177 - DNA, 22 bp, Homo sapiens
cagggtccggctgcctggctgt

SEQ ID NO: 10015178 - DNA, 22 bp, Homo sapiens
cagggtagtaatttaatacaag

SEQ ID NO: 10015179 - DNA, 22 bp, Homo sapiens
cagggtcaagagactccagcag

SEQ ID NO: 10015180 - DNA, 22 bp, Homo sapiens
cagggtcatggcacctgcacgg

SEQ ID NO: 10015181 - DNA, 22 bp, Homo sapiens
cagggtcatggcacctgcacgg

SEQ ID NO: 10015182 - DNA, 17 bp, Homo sapiens
cagggctgtctgcctag

SEQ ID NO: 10015183 - DNA, 22 bp, Homo sapiens
cagggctgtgcccatcttcccc

SEQ ID NO: 10015184 - DNA, 22 bp, Homo sapiens
caggggcctgtcctggcttctg

SEQ ID NO: 10015185 - DNA, 22 bp, Homo sapiens
cagggctgtggaaaactggtgc

SEQ ID NO: 10015186 - DNA, 22 bp, Homo sapiens
caggggggcaggagtcattgat

SEQ ID NO: 10015187 - DNA, 22 bp, Homo sapiens
cagggggctgtggctgtccagt

SEQ ID NO: 10015188 - DNA, 22 bp, Homo sapiens
cagggggcagcgtagaaaatga

SEQ ID NO: 10015189 - DNA, 22 bp, Homo sapiens
cagggggctcaaaggagagtgc

SEQ ID NO: 10015190 - DNA, 22 bp, Homo sapiens
cagggggctcaaaggagagtgc

SEQ ID NO: 10015191 - DNA, 22 bp, Homo sapiens
caggggcgggtaaaaggcctcc

SEQ ID NO: 10015192 - DNA, 22 bp, Homo sapiens
caggggcttttcctctataagg

SEQ ID NO: 10015193 - DNA, 22 bp, Homo sapiens
caggggcttaagtgacagaagg

SEQ ID NO: 10015194 - DNA, 22 bp, Homo sapiens
taggctttgtgttttgggaaca

SEQ ID NO: 10015195 - DNA, 22 bp, Homo sapiens
taggcttcacttccagttattc

SEQ ID NO: 10015196 - DNA, 22 bp, Homo sapiens
taggcttcccgctcacatgccc

SEQ ID NO: 10015197 - DNA, 23 bp, Homo sapiens
taggcttctgctgtccccgacgc

SEQ ID NO: 10015198 - DNA, 22 bp, Homo sapiens
taggcttccgagtcttggtatc

SEQ ID NO: 10015199 - DNA, 22 bp, Homo sapiens
taggcttgttacaaaacagtca

SEQ ID NO: 10015200 - DNA, 22 bp, Homo sapiens
taggcttgcaattaggatggaa

SEQ ID NO: 10015201 - DNA, 22 bp, Homo sapiens
cagggctggatttcatttctag

SEQ ID NO: 10015202 - DNA, 22 bp, Homo sapiens
cagggctgggttaaaagcaggg

SEQ ID NO: 10015203 - DNA, 23 bp, Homo sapiens
cagggctggtagggaagagcgtg

SEQ ID NO: 10015204 - DNA, 22 bp, Homo sapiens
cagggctgtctccaaaggcccc

SEQ ID NO: 10015205 - DNA, 22 bp, Homo sapiens
cagggctggtttgtcgaagaaa

SEQ ID NO: 10015206 - DNA, 22 bp, Homo sapiens
cagggctgggttaaaagcaggg

SEQ ID NO: 10015207 - DNA, 22 bp, Homo sapiens
cagggctcttccggagcaggga

SEQ ID NO: 10015208 - DNA, 22 bp, Homo sapiens
cagggctgaaatcaaggtgtag

SEQ ID NO: 10015209 - DNA, 20 bp, Homo sapiens
cagggctctgggcctggcct

SEQ ID NO: 10015210 - DNA, 22 bp, Homo sapiens
taggctgggcctgccttccagg

SEQ ID NO: 10015211 - DNA, 22 bp, Homo sapiens
taggctgggctgagctggacgg

SEQ ID NO: 10015212 - DNA, 22 bp, Homo sapiens
taggctgggcctgccttccagg

SEQ ID NO: 10015213 - DNA, 22 bp, Homo sapiens
taggctgggcctgccttccagg

SEQ ID NO: 10015214 - DNA, 22 bp, Homo sapiens
cagggctgaagaaattcaaaag

SEQ ID NO: 10015215 - DNA, 22 bp, Homo sapiens
cagggctgaagaaattcaaaag

SEQ ID NO: 10015216 - DNA, 22 bp, Homo sapiens
cagggctgagaatttagagaca

SEQ ID NO: 10015217 - DNA, 18 bp, Homo sapiens
taggctgggggctgtagt

SEQ ID NO: 10015218 - DNA, 22 bp, Homo sapiens
taggctgggctgagctggacgg

SEQ ID NO: 10015219 - DNA, 22 bp, Homo sapiens
taggctgggctgagctggacgg

SEQ ID NO: 10015220 - DNA, 22 bp, Homo sapiens
taggctgggggtaggaattgag

SEQ ID NO: 10015221 - DNA, 18 bp, Homo sapiens
taggctgggggctgtagt

SEQ ID NO: 10015222 - DNA, 18 bp, Homo sapiens
taggctgggggctgtagt

SEQ ID NO: 10015223 - DNA, 22 bp, Homo sapiens
taggctgggggtaggaattgag

SEQ ID NO: 10015224 - DNA, 22 bp, Homo sapiens
tcaacaaatacttaaagcagag

SEQ ID NO: 10015225 - DNA, 22 bp, Homo sapiens
tcaaaacactattacctttaat

SEQ ID NO: 10015226 - DNA, 22 bp, Homo sapiens
tcaacaaatacttaaagcagag

SEQ ID NO: 10015227 - DNA, 22 bp, Homo sapiens
tcaacaaatacttaaagcagag

SEQ ID NO: 10015228 - DNA, 22 bp, Homo sapiens
tcaagcaagtgtttggtgtaaa

SEQ ID NO: 10015229 - DNA, 22 bp, Homo sapiens
tcaagcaacagaactgtgagac

SEQ ID NO: 10015230 - DNA, 22 bp, Homo sapiens
tcaagcaaatgtccttttgttc

SEQ ID NO: 10015231 - DNA, 22 bp, Homo sapiens
tcaagcaactgaattctaaaag

SEQ ID NO: 10015232 - DNA, 22 bp, Homo sapiens
tcaagcaaagtttagctggtta

SEQ ID NO: 10015233 - DNA, 22 bp, Homo sapiens
tcaagcaaagatacaaatggaa

SEQ ID NO: 10015234 - DNA, 22 bp, Homo sapiens
tcaagcaaactctgagaaataa

SEQ ID NO: 10015235 - DNA, 22 bp, Homo sapiens
tcaagccactggcagaagatta

SEQ ID NO: 10015236 - DNA, 22 bp, Homo sapiens
tcaagccactggcagaagatta

SEQ ID NO: 10015237 - DNA, 23 bp, Homo sapiens
tcaagcaataattggtaatagtg

SEQ ID NO: 10015238 - DNA, 22 bp, Homo sapiens
tcaagcaagttgcatattgcta

SEQ ID NO: 10015239 - DNA, 22 bp, Homo sapiens
tcaagcagagtcaaaagtacca

SEQ ID NO: 10015240 - DNA, 22 bp, Homo sapiens
tcaagcaattctcctgcctcag

SEQ ID NO: 10015241 - DNA, 22 bp, Homo sapiens
tcaagcaatctctgtgtccctg

SEQ ID NO: 10015242 - DNA, 23 bp, Homo sapiens
tcaagcaattctcctgcctcggc

SEQ ID NO: 10015243 - DNA, 19 bp, Homo sapiens
tcaagcagtctgatttagg

SEQ ID NO: 10015244 - DNA, 22 bp, Homo sapiens
tcaagcagcagatcaagagcta

SEQ ID NO: 10015245 - DNA, 22 bp, Homo sapiens
tcaagcagcttttacagaagag

SEQ ID NO: 10015246 - DNA, 19 bp, Homo sapiens
tcaaaacacaaatggttga

SEQ ID NO: 10015247 - DNA, 19 bp, Homo sapiens
tcaaaacacaaatggttga

SEQ ID NO: 10015248 - DNA, 19 bp, Homo sapiens
tcaaaacacaaatggttga

SEQ ID NO: 10015249 - DNA, 19 bp, Homo sapiens
tcaaaacacaaatggttga

SEQ ID NO: 10015250 - DNA, 19 bp, Homo sapiens
tcaaaacacaaatggttga

SEQ ID NO: 10015251 - DNA, 19 bp, Homo sapiens
tcaaaacacaaatggttga

SEQ ID NO: 10015252 - DNA, 22 bp, Homo sapiens
tcaaaacactattacctttaat

SEQ ID NO: 10015253 - DNA, 22 bp, Homo sapiens
tcaaaacactattacctttaat

SEQ ID NO: 10015254 - DNA, 22 bp, Homo sapiens
tcaaaacaatcattggatgtgc

SEQ ID NO: 10015255 - DNA, 22 bp, Homo sapiens
tcaaaacaatcattggatgtgc

SEQ ID NO: 10015256 - DNA, 22 bp, Homo sapiens
tcaaaacaacactcaggtgtaa

SEQ ID NO: 10015257 - DNA, 22 bp, Homo sapiens
tcaaaacaatcattggatgtgc

SEQ ID NO: 10015258 - DNA, 22 bp, Homo sapiens
tcaaaacaacactcaggtgtaa

SEQ ID NO: 10015259 - DNA, 22 bp, Homo sapiens
tcaaaacaacactcaggtgtaa

SEQ ID NO: 10015260 - DNA, 22 bp, Homo sapiens
tattttcaccatgtatccctgt

SEQ ID NO: 10015261 - DNA, 22 bp, Homo sapiens
tattttatctgccagagtggag

SEQ ID NO: 10015262 - DNA, 22 bp, Homo sapiens
tcaaaaatgttttatattggta

SEQ ID NO: 10015263 - DNA, 22 bp, Homo sapiens
tattttacatgacaggtgttta

SEQ ID NO: 10015264 - DNA, 22 bp, Homo sapiens
tattttactttaaagcgagaga

SEQ ID NO: 10015265 - DNA, 22 bp, Homo sapiens
cagtcaggggtgggatcaaggc

SEQ ID NO: 10015266 - DNA, 22 bp, Homo sapiens
cagtcagggacaccagctagga

SEQ ID NO: 10015267 - DNA, 22 bp, Homo sapiens
cagtcaggctgcgcttctctga

SEQ ID NO: 10015268 - DNA, 22 bp, Homo sapiens
cagtcacttacaaaaatataat

SEQ ID NO: 10015269 - DNA, 22 bp, Homo sapiens
cagtcaggaatgcctccttcct

SEQ ID NO: 10015270 - DNA, 22 bp, Homo sapiens
cagtcaggctgcgcttctctga

SEQ ID NO: 10015271 - DNA, 22 bp, Homo sapiens
cagtcaggctgcgcttctctga

SEQ ID NO: 10015272 - DNA, 22 bp, Homo sapiens
cagtcaggaatgcctccttcct

SEQ ID NO: 10015273 - DNA, 22 bp, Homo sapiens
cagtcaggaatgcctccttcct

SEQ ID NO: 10015274 - DNA, 22 bp, Homo sapiens
tatttgaagattcttctgatgt

SEQ ID NO: 10015275 - DNA, 22 bp, Homo sapiens
tattttaaagactgccagccta

SEQ ID NO: 10015276 - DNA, 22 bp, Homo sapiens
tatttgaagattcttctgatgt

SEQ ID NO: 10015277 - DNA, 20 bp, Homo sapiens
tatttgaaatggccaagtgt

SEQ ID NO: 10015278 - DNA, 22 bp, Homo sapiens
tatttgaaagtgtacaaaaact

SEQ ID NO: 10015279 - DNA, 22 bp, Homo sapiens
tattttaaagactgccagccta

SEQ ID NO: 10015280 - DNA, 22 bp, Homo sapiens
tattttaaagtgaagggtcttg

SEQ ID NO: 10015281 - DNA, 22 bp, Homo sapiens
tattttaaagtgaagggtcttg

SEQ ID NO: 10015282 - DNA, 22 bp, Homo sapiens
cagtcacattgccctgcattta

SEQ ID NO: 10015283 - DNA, 22 bp, Homo sapiens
cagtcaccaccaggtggcagta

SEQ ID NO: 10015284 - DNA, 22 bp, Homo sapiens
cagtcaccttgaggactcagac

SEQ ID NO: 10015285 - DNA, 22 bp, Homo sapiens
cagtcactggaatagctgagga

SEQ ID NO: 10015286 - DNA, 22 bp, Homo sapiens
cagtcacagtgacaggatgtgg

SEQ ID NO: 10015287 - DNA, 22 bp, Homo sapiens
cagtcacagtgacaggatgtgg

SEQ ID NO: 10015288 - DNA, 22 bp, Homo sapiens
cagtcacacaagtggacttggg

SEQ ID NO: 10015289 - DNA, 22 bp, Homo sapiens
cagtcacaagcgtacctaattt

SEQ ID NO: 10015290 - DNA, 17 bp, Homo sapiens
cagtcacaggtcttttc

SEQ ID NO: 10015291 - DNA, 22 bp, Homo sapiens
cagtcaaacttataggcacatt

SEQ ID NO: 10015292 - DNA, 22 bp, Homo sapiens
caggtgggtgtatgaatgcaaa

SEQ ID NO: 10015293 - DNA, 22 bp, Homo sapiens
caggtgggtgtatgaatgcaaa

SEQ ID NO: 10015294 - DNA, 22 bp, Homo sapiens
tattatccaaagagctgggagc

SEQ ID NO: 10015295 - DNA, 22 bp, Homo sapiens
tattataatttagggcttggat

SEQ ID NO: 10015296 - DNA, 22 bp, Homo sapiens
tattagtagcttgaaattggtg

SEQ ID NO: 10015297 - DNA, 22 bp, Homo sapiens
tattagtgaaagaattagtttg

SEQ ID NO: 10015298 - DNA, 22 bp, Homo sapiens
tattataaaattactggcaggg

SEQ ID NO: 10015299 - DNA, 22 bp, Homo sapiens
tattatcattggtaatatggtc

SEQ ID NO: 10015300 - DNA, 22 bp, Homo sapiens
tattatcatgttaattagtggg

SEQ ID NO: 10015301 - DNA, 22 bp, Homo sapiens
tattatcagagctatttggaat

SEQ ID NO: 10015302 - DNA, 22 bp, Homo sapiens
tattattaaatggcagaatttt

SEQ ID NO: 10015303 - DNA, 22 bp, Homo sapiens
tattatgtagagtaagggttaa

SEQ ID NO: 10015304 - DNA, 18 bp, Homo sapiens
caggtgggtctcctgccc

SEQ ID NO: 10015305 - DNA, 18 bp, Homo sapiens
caggtgggtctcctgccc

SEQ ID NO: 10015306 - DNA, 22 bp, Homo sapiens
caggtggcatgactgcctacaa

SEQ ID NO: 10015307 - DNA, 22 bp, Homo sapiens
caggtggcattgtcccgccagc

SEQ ID NO: 10015308 - DNA, 22 bp, Homo sapiens
caggtggatctctaaggactga

SEQ ID NO: 10015309 - DNA, 22 bp, Homo sapiens
caggtggcagaggtctctggaa

SEQ ID NO: 10015310 - DNA, 23 bp, Homo sapiens
caggtggctccacgaggggtggg

SEQ ID NO: 10015311 - DNA, 23 bp, Homo sapiens
caggtggctccacgaggggtggg

SEQ ID NO: 10015312 - DNA, 22 bp, Homo sapiens
caggtggctaacggcctcatag

SEQ ID NO: 10015313 - DNA, 19 bp, Homo sapiens
caggtggcgctctacaggg

SEQ ID NO: 10015314 - DNA, 22 bp, Homo sapiens
tattaaatatatctgttagttg

SEQ ID NO: 10015315 - DNA, 22 bp, Homo sapiens
tattaaatgttatttgggttgt

SEQ ID NO: 10015316 - DNA, 22 bp, Homo sapiens
tattaaatgttatttgggttgt

SEQ ID NO: 10015317 - DNA, 22 bp, Homo sapiens
tattaaatgttatttgggttgt

SEQ ID NO: 10015318 - DNA, 22 bp, Homo sapiens
tattaaatgttatttgggttgt

SEQ ID NO: 10015319 - DNA, 22 bp, Homo sapiens
tattagtaatacctgtctcata

SEQ ID NO: 10015320 - DNA, 22 bp, Homo sapiens
caggtaggtatggtgcagtctt

SEQ ID NO: 10015321 - DNA, 22 bp, Homo sapiens
caggtattaataaatggagagt

SEQ ID NO: 10015322 - DNA, 22 bp, Homo sapiens
caggtataacgtgcatgttgta

SEQ ID NO: 10015323 - DNA, 22 bp, Homo sapiens
caggtatatgtgcatccataga

SEQ ID NO: 10015324 - DNA, 22 bp, Homo sapiens
caggtcaaaggttagttatgtt

SEQ ID NO: 10015325 - DNA, 20 bp, Homo sapiens
caggtattacttcctttatg

SEQ ID NO: 10015326 - DNA, 20 bp, Homo sapiens
caggtattacatctgcacct

SEQ ID NO: 10015327 - DNA, 22 bp, Homo sapiens
caggtattttcaaggcttgtgt

SEQ ID NO: 10015328 - DNA, 17 bp, Homo sapiens
caggtatttaggcattg

SEQ ID NO: 10015329 - DNA, 23 bp, Homo sapiens
caggtattgatttttcttctagg

SEQ ID NO: 10015330 - DNA, 22 bp, Homo sapiens
caggtattcatagaattcagag

SEQ ID NO: 10015331 - DNA, 22 bp, Homo sapiens
caggtaggatggaagggctcaa

SEQ ID NO: 10015332 - DNA, 17 bp, Homo sapiens
caggtacattgctactg

SEQ ID NO: 10015333 - DNA, 22 bp, Homo sapiens
caggtacattcgtagacccatt

SEQ ID NO: 10015334 - DNA, 22 bp, Homo sapiens
caggtacacaggacaaagtact

SEQ ID NO: 10015335 - DNA, 22 bp, Homo sapiens
caggtacaaagctactgcctga

SEQ ID NO: 10015336 - DNA, 22 bp, Homo sapiens
cagggtttctgttgagaagtcc

SEQ ID NO: 10015337 - DNA, 22 bp, Homo sapiens
caggtgctgtcctgcacatgtc

SEQ ID NO: 10015338 - DNA, 22 bp, Homo sapiens
caggtgcctcaggatgagacaa

SEQ ID NO: 10015339 - DNA, 22 bp, Homo sapiens
caggtgccgggaatgcagcaat

SEQ ID NO: 10015340 - DNA, 22 bp, Homo sapiens
caggtgccgggaatgcagcaat

SEQ ID NO: 10015341 - DNA, 22 bp, Homo sapiens
caggtgcccagctcctgctgtg

SEQ ID NO: 10015342 - DNA, 22 bp, Homo sapiens
caggtgcccagctcctgctgtg

SEQ ID NO: 10015343 - DNA, 22 bp, Homo sapiens
caggtgaatcacttgagtccag

SEQ ID NO: 10015344 - DNA, 22 bp, Homo sapiens
caggtccacagcccatcactgc

SEQ ID NO: 10015345 - DNA, 22 bp, Homo sapiens
caggtccaagagatcctcctac

SEQ ID NO: 10015346 - DNA, 22 bp, Homo sapiens
caggtccaattgcgctaaaatc

SEQ ID NO: 10015347 - DNA, 22 bp, Homo sapiens
caggtccaattgcgctaaaatc

SEQ ID NO: 10015348 - DNA, 22 bp, Homo sapiens
caggtccacagcccatcactgc

SEQ ID NO: 10015349 - DNA, 22 bp, Homo sapiens
caggtccacagcccatcactgc

SEQ ID NO: 10015350 - DNA, 22 bp, Homo sapiens
caggtcagcacttggaggtgca

SEQ ID NO: 10015351 - DNA, 22 bp, Homo sapiens
caggtcagagtccccctgtcct

SEQ ID NO: 10015352 - DNA, 22 bp, Homo sapiens
caggtcagcacttggaggtgca

SEQ ID NO: 10015353 - DNA, 22 bp, Homo sapiens
caggtccaactatttatctgtg

SEQ ID NO: 10015354 - DNA, 22 bp, Homo sapiens
caggtcagctggtgccccaggt

SEQ ID NO: 10015355 - DNA, 22 bp, Homo sapiens
taataattagttattgatcgtg

SEQ ID NO: 10015356 - DNA, 21 bp, Homo sapiens
taataattccactacagagta

SEQ ID NO: 10015357 - DNA, 21 bp, Homo sapiens
taataattccactacagagta

SEQ ID NO: 10015358 - DNA, 22 bp, Homo sapiens
taataattaacagtgatgggtc

SEQ ID NO: 10015359 - DNA, 22 bp, Homo sapiens
taataattagttattgatcgtg

SEQ ID NO: 10015360 - DNA, 22 bp, Homo sapiens
taataattaacagtgatgggtc

SEQ ID NO: 10015361 - DNA, 22 bp, Homo sapiens
caggcagcagaggagtgtggga

SEQ ID NO: 10015362 - DNA, 22 bp, Homo sapiens
caggcagatttgctgccctcca

SEQ ID NO: 10015363 - DNA, 22 bp, Homo sapiens
caggcagatttgctgccctcca

SEQ ID NO: 10015364 - DNA, 22 bp, Homo sapiens
caggcagatgctgacaagagtt

SEQ ID NO: 10015365 - DNA, 22 bp, Homo sapiens
caggcagatttgctgccctcca

SEQ ID NO: 10015366 - DNA, 22 bp, Homo sapiens
taataattggcaatgttgagca

SEQ ID NO: 10015367 - DNA, 22 bp, Homo sapiens
taataattggctaaccctggga

SEQ ID NO: 10015368 - DNA, 22 bp, Homo sapiens
taataattggctaaccctggga

SEQ ID NO: 10015369 - DNA, 22 bp, Homo sapiens
taataattttaaagaaggctag

SEQ ID NO: 10015370 - DNA, 21 bp, Homo sapiens
taataattccactacagagta

SEQ ID NO: 10015371 - DNA, 22 bp, Homo sapiens
taataattggcaatgttgagca

SEQ ID NO: 10015372 - DNA, 22 bp, Homo sapiens
taataattggcaatgttgagca

SEQ ID NO: 10015373 - DNA, 22 bp, Homo sapiens
taataattggcaatgttgagca

SEQ ID NO: 10015374 - DNA, 22 bp, Homo sapiens
taatacaaggcaggaagcagta

SEQ ID NO: 10015375 - DNA, 22 bp, Homo sapiens
taataattttaaagaaggctag

SEQ ID NO: 10015376 - DNA, 22 bp, Homo sapiens
caggcaccccaggtgagcactg

SEQ ID NO: 10015377 - DNA, 22 bp, Homo sapiens
caggcagagttagagcaactgg

SEQ ID NO: 10015378 - DNA, 22 bp, Homo sapiens
caggcagagttagtgatttagg

SEQ ID NO: 10015379 - DNA, 22 bp, Homo sapiens
caggcagatatgttcgctttaa

SEQ ID NO: 10015380 - DNA, 22 bp, Homo sapiens
caggcagatgctgacaagagtt

SEQ ID NO: 10015381 - DNA, 22 bp, Homo sapiens
cagctcaagtttcccaggtcag

SEQ ID NO: 10015382 - DNA, 22 bp, Homo sapiens
cagctattttgcctatcatggt

SEQ ID NO: 10015383 - DNA, 22 bp, Homo sapiens
cagctcaatagcctaccttaat

SEQ ID NO: 10015384 - DNA, 22 bp, Homo sapiens
cagctcacttgtttcatcttct

SEQ ID NO: 10015385 - DNA, 20 bp, Homo sapiens
gtgcttcagaagccattgct

SEQ ID NO: 10015386 - DNA, 22 bp, Homo sapiens
gtgcttaatacatgtcaataac

SEQ ID NO: 10015387 - DNA, 22 bp, Homo sapiens
gtgcttaaggcagtctgtcaaa

SEQ ID NO: 10015388 - DNA, 22 bp, Homo sapiens
gtgcttctccgttctgcagcac

SEQ ID NO: 10015389 - DNA, 22 bp, Homo sapiens
gtgcttctctgctctacccggc

SEQ ID NO: 10015390 - DNA, 22 bp, Homo sapiens
gtgcttctcttcacacccaact

SEQ ID NO: 10015391 - DNA, 22 bp, Homo sapiens
taagtccacaggagttgtgttc

SEQ ID NO: 10015392 - DNA, 22 bp, Homo sapiens
taagtccaagggtatgagttgg

SEQ ID NO: 10015393 - DNA, 18 bp, Homo sapiens
taagtcatttgaaatgcc

SEQ ID NO: 10015394 - DNA, 22 bp, Homo sapiens
taagtccacctcattcttcagc

SEQ ID NO: 10015395 - DNA, 22 bp, Homo sapiens
taagtccacctcattcttcagc

SEQ ID NO: 10015396 - DNA, 22 bp, Homo sapiens
taagtcctagatgattcacaga

SEQ ID NO: 10015397 - DNA, 22 bp, Homo sapiens
taagtgaaataagtcagataca

SEQ ID NO: 10015398 - DNA, 22 bp, Homo sapiens
taagtattggcctatagctaga

SEQ ID NO: 10015399 - DNA, 22 bp, Homo sapiens
taaggcagcctcagggtagggt

SEQ ID NO: 10015400 - DNA, 22 bp, Homo sapiens
taagtagtcagacataccccat

SEQ ID NO: 10015401 - DNA, 19 bp, Homo sapiens
taagtagtcaaatagtaac

SEQ ID NO: 10015402 - DNA, 19 bp, Homo sapiens
taagtagtcaaatagtaac

SEQ ID NO: 10015403 - DNA, 22 bp, Homo sapiens
taagtattggcctatagctaga

SEQ ID NO: 10015404 - DNA, 22 bp, Homo sapiens
taagtagtcctgatttaacctt

SEQ ID NO: 10015405 - DNA, 22 bp, Homo sapiens
taagtagtttgtagccccatag

SEQ ID NO: 10015406 - DNA, 22 bp, Homo sapiens
taagtagttccatccaaacagc

SEQ ID NO: 10015407 - DNA, 22 bp, Homo sapiens
taagtatgttagaaaatcaagt

SEQ ID NO: 10015408 - DNA, 22 bp, Homo sapiens
caggccaggtgctctagaatca

SEQ ID NO: 10015409 - DNA, 19 bp, Homo sapiens
caggccagtgtcagggggc

SEQ ID NO: 10015410 - DNA, 22 bp, Homo sapiens
caggccagtgggaaatagggat

SEQ ID NO: 10015411 - DNA, 22 bp, Homo sapiens
caggccagtgggaaatagggat

SEQ ID NO: 10015412 - DNA, 22 bp, Homo sapiens
caggcccactgcttgtctagtc

SEQ ID NO: 10015413 - DNA, 22 bp, Homo sapiens
caggcccacgaggcacacagag

SEQ ID NO: 10015414 - DNA, 22 bp, Homo sapiens
caggccagtgtgcttcccaggc

SEQ ID NO: 10015415 - DNA, 22 bp, Homo sapiens
caggccattaccgctgagaccc

SEQ ID NO: 10015416 - DNA, 22 bp, Homo sapiens
caggccagtgtgcttcccaggc

SEQ ID NO: 10015417 - DNA, 19 bp, Homo sapiens
caggccagtgtcagggggc

SEQ ID NO: 10015418 - DNA, 22 bp, Homo sapiens
caggccagtgtgcttcccaggc

SEQ ID NO: 10015419 - DNA, 22 bp, Homo sapiens
tacaaaaaattgatactgacga

SEQ ID NO: 10015420 - DNA, 22 bp, Homo sapiens
tacaaaacagtgctctggtcct

SEQ ID NO: 10015421 - DNA, 22 bp, Homo sapiens
tacaaaaaattgatactgacga

SEQ ID NO: 10015422 - DNA, 22 bp, Homo sapiens
tacaaaacagtgctctggtcct

SEQ ID NO: 10015423 - DNA, 22 bp, Homo sapiens
tacaaaacagtgctctggtcct

SEQ ID NO: 10015424 - DNA, 22 bp, Homo sapiens
tacaaaacagtgctctggtcct

SEQ ID NO: 10015425 - DNA, 22 bp, Homo sapiens
tacaaaaggaagagggatctta

SEQ ID NO: 10015426 - DNA, 22 bp, Homo sapiens
tacaaaaggaagagggatctta

SEQ ID NO: 10015427 - DNA, 22 bp, Homo sapiens
tacaaaagtaattacggttttt

SEQ ID NO: 10015428 - DNA, 22 bp, Homo sapiens
tacaaaaggaagagggatctta

SEQ ID NO: 10015429 - DNA, 22 bp, Homo sapiens
caggccagggttgagaagagaa

SEQ ID NO: 10015430 - DNA, 22 bp, Homo sapiens
caggccagagcgcgtggttggg

SEQ ID NO: 10015431 - DNA, 22 bp, Homo sapiens
tacaaaagtaattacggttttt

SEQ ID NO: 10015432 - DNA, 22 bp, Homo sapiens
tacaaaagtaattacggttttt

SEQ ID NO: 10015433 - DNA, 22 bp, Homo sapiens
tacaaaagtaattacggttttt

SEQ ID NO: 10015434 - DNA, 20 bp, Homo sapiens
tacaaacctccacactggtg

SEQ ID NO: 10015435 - DNA, 22 bp, Homo sapiens
caggcatgggccatgggaagtg

SEQ ID NO: 10015436 - DNA, 22 bp, Homo sapiens
caggcatgggccatgggaagtg

SEQ ID NO: 10015437 - DNA, 22 bp, Homo sapiens
caggcatgggccatgggaagtg

SEQ ID NO: 10015438 - DNA, 22 bp, Homo sapiens
tacaaaaaattgatactgacga

SEQ ID NO: 10015439 - DNA, 21 bp, Homo sapiens
caggccaaaaggttcaacatt

SEQ ID NO: 10015440 - DNA, 22 bp, Homo sapiens
tacaaaaaattgatactgacga

SEQ ID NO: 10015441 - DNA, 22 bp, Homo sapiens
taatgtgttgaatatttgtaca

SEQ ID NO: 10015442 - DNA, 22 bp, Homo sapiens
taatgtgatattcctgtccttt

SEQ ID NO: 10015443 - DNA, 22 bp, Homo sapiens
taatgtgtgtcatcagtagagt

SEQ ID NO: 10015444 - DNA, 22 bp, Homo sapiens
taatgtcagcatagtttatttt

SEQ ID NO: 10015445 - DNA, 22 bp, Homo sapiens
taatgtcttagtaccttaattt

SEQ ID NO: 10015446 - DNA, 22 bp, Homo sapiens
taatgtctatgggccagataat

SEQ ID NO: 10015447 - DNA, 22 bp, Homo sapiens
caggcatgagccaggcccctcc

SEQ ID NO: 10015448 - DNA, 22 bp, Homo sapiens
caggcatgcttctgtctgggca

SEQ ID NO: 10015449 - DNA, 22 bp, Homo sapiens
caggcatgcttctgtctgggca

SEQ ID NO: 10015450 - DNA, 22 bp, Homo sapiens
caggcatgatgggaagtgcctg

SEQ ID NO: 10015451 - DNA, 22 bp, Homo sapiens
caggcatggaaaagcccagagg

SEQ ID NO: 10015452 - DNA, 22 bp, Homo sapiens
caggcatggaaaagcccagagg

SEQ ID NO: 10015453 - DNA, 22 bp, Homo sapiens
caggcatggagaggcagagact

SEQ ID NO: 10015454 - DNA, 22 bp, Homo sapiens
caggcatggagaggcagagact

SEQ ID NO: 10015455 - DNA, 22 bp, Homo sapiens
caggcatggagaggcagagact

SEQ ID NO: 10015456 - DNA, 22 bp, Homo sapiens
taatatctggcattcaaacatg

SEQ ID NO: 10015457 - DNA, 22 bp, Homo sapiens
taatatctggcattcaaacatg

SEQ ID NO: 10015458 - DNA, 22 bp, Homo sapiens
taatacagacaacttgccaaat

SEQ ID NO: 10015459 - DNA, 22 bp, Homo sapiens
taatcacaattcagatgtctta

SEQ ID NO: 10015460 - DNA, 22 bp, Homo sapiens
taatcacaattcagatgtctta

SEQ ID NO: 10015461 - DNA, 22 bp, Homo sapiens
taatatttctaccctgctgcct

SEQ ID NO: 10015462 - DNA, 22 bp, Homo sapiens
taatcacatcagggtaaatggg

SEQ ID NO: 10015463 - DNA, 22 bp, Homo sapiens
taatcacagaaacagactgttt

SEQ ID NO: 10015464 - DNA, 20 bp, Homo sapiens
taatgtcaaagtcacaaggt

SEQ ID NO: 10015465 - DNA, 22 bp, Homo sapiens
taatgtataacaaatactcatc

SEQ ID NO: 10015466 - DNA, 22 bp, Homo sapiens
taatgtaaacacagagacagaa

SEQ ID NO: 10015467 - DNA, 22 bp, Homo sapiens
taatgtaaagaagatgtaggaa

SEQ ID NO: 10015468 - DNA, 22 bp, Homo sapiens
taatgtaaacacagagacagaa

SEQ ID NO: 10015469 - DNA, 22 bp, Homo sapiens
taatgtacctccagatgttgta

SEQ ID NO: 10015470 - DNA, 22 bp, Homo sapiens
taatgtataacaaatactcatc

SEQ ID NO: 10015471 - DNA, 22 bp, Homo sapiens
taatcatatgggtaatccaatg

SEQ ID NO: 10015472 - DNA, 22 bp, Homo sapiens
taatcatatgggtaatccaatg

SEQ ID NO: 10015473 - DNA, 19 bp, Homo sapiens
taatccaaggctgctctta

SEQ ID NO: 10015474 - DNA, 22 bp, Homo sapiens
taatccaatggcacaatgtatg

SEQ ID NO: 10015475 - DNA, 22 bp, Homo sapiens
taatccaaaactgaatctgtgg

SEQ ID NO: 10015476 - DNA, 22 bp, Homo sapiens
taatcactgggcgtttggtact

SEQ ID NO: 10015477 - DNA, 22 bp, Homo sapiens
tagaaacaagggagaggattct

SEQ ID NO: 10015478 - DNA, 22 bp, Homo sapiens
caggctgtctgaatggaggccc

SEQ ID NO: 10015479 - DNA, 22 bp, Homo sapiens
cagggaagagccgatgctgcag

SEQ ID NO: 10015480 - DNA, 22 bp, Homo sapiens
cagggaagagccgatgctgcag

SEQ ID NO: 10015481 - DNA, 22 bp, Homo sapiens
caggctttactttctctctgaa

SEQ ID NO: 10015482 - DNA, 22 bp, Homo sapiens
cagggacagagactgcaccttg

SEQ ID NO: 10015483 - DNA, 22 bp, Homo sapiens
cagggaaggctgcaaatgttaa

SEQ ID NO: 10015484 - DNA, 22 bp, Homo sapiens
cagggacaatggcagagcctga

SEQ ID NO: 10015485 - DNA, 22 bp, Homo sapiens
tagatacaggcaagattatgaa

SEQ ID NO: 10015486 - DNA, 22 bp, Homo sapiens
tagattcttagtttcatagaat

SEQ ID NO: 10015487 - DNA, 22 bp, Homo sapiens
tagattctactgtcacttagtt

SEQ ID NO: 10015488 - DNA, 22 bp, Homo sapiens
tagattctcccatcatgagatg

SEQ ID NO: 10015489 - DNA, 22 bp, Homo sapiens
tagattctcccatcatgagatg

SEQ ID NO: 10015490 - DNA, 22 bp, Homo sapiens
tagattctgtaaataatcaagg

SEQ ID NO: 10015491 - DNA, 22 bp, Homo sapiens
tagattctggagagacagcagt

SEQ ID NO: 10015492 - DNA, 22 bp, Homo sapiens
caggctgggaacgccacccgct

SEQ ID NO: 10015493 - DNA, 22 bp, Homo sapiens
caggctggcaatgcgtcaagca

SEQ ID NO: 10015494 - DNA, 22 bp, Homo sapiens
caggctgggactgacccctgct

SEQ ID NO: 10015495 - DNA, 22 bp, Homo sapiens
caggctgggaacgccacccgct

SEQ ID NO: 10015496 - DNA, 22 bp, Homo sapiens
tagaaaagctctaaggcctctc

SEQ ID NO: 10015497 - DNA, 22 bp, Homo sapiens
tagaaaagccccagctggaggg

SEQ ID NO: 10015498 - DNA, 22 bp, Homo sapiens
tagaaaagctctaaggcctctc

SEQ ID NO: 10015499 - DNA, 22 bp, Homo sapiens
tagaaaagctctaaggcctctc

SEQ ID NO: 10015500 - DNA, 22 bp, Homo sapiens
caggctgggactgacccctgct

SEQ ID NO: 10015501 - DNA, 22 bp, Homo sapiens
caggctgggcagcctccccggc

SEQ ID NO: 10015502 - DNA, 22 bp, Homo sapiens
tagaaaagccccagctggaggg

SEQ ID NO: 10015503 - DNA, 22 bp, Homo sapiens
caggctgggactgacccctgct

SEQ ID NO: 10015504 - DNA, 22 bp, Homo sapiens
caggctgggaacgccacccgct

SEQ ID NO: 10015505 - DNA, 22 bp, Homo sapiens
caggctgggactgacccctgct

SEQ ID NO: 10015506 - DNA, 22 bp, Homo sapiens
tagaaacaaagacctgggtgct

SEQ ID NO: 10015507 - DNA, 22 bp, Homo sapiens
tagaaaatgttccactgccatt

SEQ ID NO: 10015508 - DNA, 22 bp, Homo sapiens
tagaaacaaaatctgatgactc

SEQ ID NO: 10015509 - DNA, 22 bp, Homo sapiens
tagaaaatgttccactgccatt

SEQ ID NO: 10015510 - DNA, 22 bp, Homo sapiens
tagaaaatggccaagcaggact

SEQ ID NO: 10015511 - DNA, 22 bp, Homo sapiens
tagaaaatggccaagcaggact

SEQ ID NO: 10015512 - DNA, 22 bp, Homo sapiens
tagaaaatccagtgtggggaga

SEQ ID NO: 10015513 - DNA, 22 bp, Homo sapiens
tagaaaagtatgggactgacat

SEQ ID NO: 10015514 - DNA, 22 bp, Homo sapiens
tagaaaatagggcctgtggagc

SEQ ID NO: 10015515 - DNA, 22 bp, Homo sapiens
tagaaaagtatgggactgacat

SEQ ID NO: 10015516 - DNA, 22 bp, Homo sapiens
tagaaaatagggcctgtggagc

SEQ ID NO: 10015517 - DNA, 22 bp, Homo sapiens
caggctgccaaggctggggagg

SEQ ID NO: 10015518 - DNA, 22 bp, Homo sapiens
caggctgccgtgaagcaggcct

SEQ ID NO: 10015519 - DNA, 22 bp, Homo sapiens
caggctgccgtgaagcaggcct

SEQ ID NO: 10015520 - DNA, 22 bp, Homo sapiens
caggctgccgaggctgcagaat

SEQ ID NO: 10015521 - DNA, 22 bp, Homo sapiens
caggctggagttcagtggtgtg

SEQ ID NO: 10015522 - DNA, 22 bp, Homo sapiens
caggctgccgtgaagcaggcct

SEQ ID NO: 10015523 - DNA, 22 bp, Homo sapiens
caggctggcaatgcgtcaagca

SEQ ID NO: 10015524 - DNA, 22 bp, Homo sapiens
caggctggagttcagtggtgtg

SEQ ID NO: 10015525 - DNA, 22 bp, Homo sapiens
caggctggagttcagtggtgtg

SEQ ID NO: 10015526 - DNA, 22 bp, Homo sapiens
caggctggagttcagtggtgtg

SEQ ID NO: 10015527 - DNA, 20 bp, Homo sapiens
caggcctctgggggccctgg

SEQ ID NO: 10015528 - DNA, 22 bp, Homo sapiens
caggcctctccttagtctggca

SEQ ID NO: 10015529 - DNA, 20 bp, Homo sapiens
caggcctctgggggccctgg

SEQ ID NO: 10015530 - DNA, 20 bp, Homo sapiens
caggcctctgggggccctgg

SEQ ID NO: 10015531 - DNA, 22 bp, Homo sapiens
caggcctctatggtcagctgag

SEQ ID NO: 10015532 - DNA, 22 bp, Homo sapiens
caggcctctatggtcagctgag

SEQ ID NO: 10015533 - DNA, 22 bp, Homo sapiens
caggcctctatggtcagctgag

SEQ ID NO: 10015534 - DNA, 22 bp, Homo sapiens
caggcctcgaggagacagctac

SEQ ID NO: 10015535 - DNA, 22 bp, Homo sapiens
caggcctcgaggagacagctac

SEQ ID NO: 10015536 - DNA, 22 bp, Homo sapiens
tacattgattcaggatataggc

SEQ ID NO: 10015537 - DNA, 22 bp, Homo sapiens
tacatgtttactccaagtcagg

SEQ ID NO: 10015538 - DNA, 22 bp, Homo sapiens
tacattgctttctaatacatct

SEQ ID NO: 10015539 - DNA, 22 bp, Homo sapiens
caggcctgagtgtggaagtctt

SEQ ID NO: 10015540 - DNA, 22 bp, Homo sapiens
tacatgttcaaatttgtctttc

SEQ ID NO: 10015541 - DNA, 19 bp, Homo sapiens
caggcctcttaccctctct

SEQ ID NO: 10015542 - DNA, 22 bp, Homo sapiens
caggcctcttccatgcagcagc

SEQ ID NO: 10015543 - DNA, 22 bp, Homo sapiens
caggcctcttccatgcagcagc

SEQ ID NO: 10015544 - DNA, 18 bp, Homo sapiens
caggcctcttgatcttcc

SEQ ID NO: 10015545 - DNA, 22 bp, Homo sapiens
caggcctgagacatctgagata

SEQ ID NO: 10015546 - DNA, 22 bp, Homo sapiens
caggcctgagacatctgagata

SEQ ID NO: 10015547 - DNA, 22 bp, Homo sapiens
caggcctgaccctgagcttcac

SEQ ID NO: 10015548 - DNA, 22 bp, Homo sapiens
tacatttataaggcttctctgt

SEQ ID NO: 10015549 - DNA, 22 bp, Homo sapiens
tacattgtgatgtttcaataca

SEQ ID NO: 10015550 - DNA, 22 bp, Homo sapiens
tacattgtgttaaaacagaaga

SEQ ID NO: 10015551 - DNA, 22 bp, Homo sapiens
tacattgtgataggaagtcacc

SEQ ID NO: 10015552 - DNA, 22 bp, Homo sapiens
caggccttttttcctgcagtgt

SEQ ID NO: 10015553 - DNA, 22 bp, Homo sapiens
caggccttttttcctgcagtgt

SEQ ID NO: 10015554 - DNA, 22 bp, Homo sapiens
caggctaaagctttgagcatgt

SEQ ID NO: 10015555 - DNA, 22 bp, Homo sapiens
caggcgggacgtgggaggatca

SEQ ID NO: 10015556 - DNA, 22 bp, Homo sapiens
tacatttcctgtcagagatata

SEQ ID NO: 10015557 - DNA, 22 bp, Homo sapiens
caggcctttcttggggcttaga

SEQ ID NO: 10015558 - DNA, 22 bp, Homo sapiens
caggcctttctggggaagtgag

SEQ ID NO: 10015559 - DNA, 22 bp, Homo sapiens
tactttaaaaactgataattca

SEQ ID NO: 10015560 - DNA, 22 bp, Homo sapiens
tactttaatatatgtgaagttc

SEQ ID NO: 10015561 - DNA, 22 bp, Homo sapiens
tacttgttttgtgttcctaaac

SEQ ID NO: 10015562 - DNA, 22 bp, Homo sapiens
tacttgttatcccttactcttg

SEQ ID NO: 10015563 - DNA, 22 bp, Homo sapiens
tacttgttatcatcttttcctt

SEQ ID NO: 10015564 - DNA, 22 bp, Homo sapiens
tacttgttctttcaagagatag

SEQ ID NO: 10015565 - DNA, 22 bp, Homo sapiens
tacttgttaggaatttctacta

SEQ ID NO: 10015566 - DNA, 22 bp, Homo sapiens
tacttgttatcatcttttcctt

SEQ ID NO: 10015567 - DNA, 22 bp, Homo sapiens
caggctagattggggccagtag

SEQ ID NO: 10015568 - DNA, 22 bp, Homo sapiens
catctgttctatccacgttgct

SEQ ID NO: 10015569 - DNA, 22 bp, Homo sapiens
catctgtgtatctgtgcttaga

SEQ ID NO: 10015570 - DNA, 22 bp, Homo sapiens
catctgtttcctaatctgtagc

SEQ ID NO: 10015571 - DNA, 22 bp, Homo sapiens
catgaaatttgaagtacagcaa

SEQ ID NO: 10015572 - DNA, 22 bp, Homo sapiens
catgaaattgctcctttggtgc

SEQ ID NO: 10015573 - DNA, 22 bp, Homo sapiens
catgaaaataacattgttgtga

SEQ ID NO: 10015574 - DNA, 22 bp, Homo sapiens
catgaagcatgttttgtcatga

SEQ ID NO: 10015575 - DNA, 22 bp, Homo sapiens
catgaagccctcatcagtctga

SEQ ID NO: 10015576 - DNA, 22 bp, Homo sapiens
catgaagcatgttttgtcatga

SEQ ID NO: 10015577 - DNA, 22 bp, Homo sapiens
catgaagatcctgtatgttttt

SEQ ID NO: 10015578 - DNA, 22 bp, Homo sapiens
catgaaccaaaccaaagtgtcc

SEQ ID NO: 10015579 - DNA, 22 bp, Homo sapiens
catgaacattcagaaatacagc

SEQ ID NO: 10015580 - DNA, 22 bp, Homo sapiens
catgaacattcagaaatacagc

SEQ ID NO: 10015581 - DNA, 22 bp, Homo sapiens
catgaacaccaggcatgaacaa

SEQ ID NO: 10015582 - DNA, 22 bp, Homo sapiens
catgaacaatttgctcactgat

SEQ ID NO: 10015583 - DNA, 19 bp, Homo sapiens
catctggatgattctcctg

SEQ ID NO: 10015584 - DNA, 22 bp, Homo sapiens
catctgtagctccatgacaatt

SEQ ID NO: 10015585 - DNA, 19 bp, Homo sapiens
catctgtaaggacagaaac

SEQ ID NO: 10015586 - DNA, 22 bp, Homo sapiens
catctgctgttccttggactca

SEQ ID NO: 10015587 - DNA, 22 bp, Homo sapiens
catctgctgtaattaacaagcc

SEQ ID NO: 10015588 - DNA, 22 bp, Homo sapiens
catctgctctgtctgccatgtt

SEQ ID NO: 10015589 - DNA, 22 bp, Homo sapiens
catctgcctaagtggccctgtt

SEQ ID NO: 10015590 - DNA, 22 bp, Homo sapiens
catctgaatttgccttagtttc

SEQ ID NO: 10015591 - DNA, 22 bp, Homo sapiens
catctgaaatctgcctacaagc

SEQ ID NO: 10015592 - DNA, 22 bp, Homo sapiens
catctgaaatctgcctacaagc

SEQ ID NO: 10015593 - DNA, 22 bp, Homo sapiens
catctgaagtgaattgcttttt

SEQ ID NO: 10015594 - DNA, 22 bp, Homo sapiens
catctgaagtgaattgcttttt

SEQ ID NO: 10015595 - DNA, 22 bp, Homo sapiens
catctgaatttgccttagtttc

SEQ ID NO: 10015596 - DNA, 22 bp, Homo sapiens
tcagtgccaattctgccatggg

SEQ ID NO: 10015597 - DNA, 22 bp, Homo sapiens
tcagtgccaattctgccatggg

SEQ ID NO: 10015598 - DNA, 22 bp, Homo sapiens
tcagtgccatgggcagacaggc

SEQ ID NO: 10015599 - DNA, 22 bp, Homo sapiens
tcagtccctaaggatatgggct

SEQ ID NO: 10015600 - DNA, 21 bp, Homo sapiens
tcagtccctgggtgtgtccca

SEQ ID NO: 10015601 - DNA, 22 bp, Homo sapiens
tcagtcccttaaaggtggcagc

SEQ ID NO: 10015602 - DNA, 22 bp, Homo sapiens
tcagtcccttctccaggtcagc

SEQ ID NO: 10015603 - DNA, 22 bp, Homo sapiens
tcagtgcattcatgggtggctg

SEQ ID NO: 10015604 - DNA, 22 bp, Homo sapiens
tcagtccataggtgggcctgag

SEQ ID NO: 10015605 - DNA, 23 bp, Homo sapiens
tcagtcccaacagcttctcctgg

SEQ ID NO: 10015606 - DNA, 22 bp, Homo sapiens
tcagtcccaaggtcctgaggtg

SEQ ID NO: 10015607 - DNA, 22 bp, Homo sapiens
tcagtccccagatgtgtgctgt

SEQ ID NO: 10015608 - DNA, 22 bp, Homo sapiens
tcagtccaggattgggagtgac

SEQ ID NO: 10015609 - DNA, 22 bp, Homo sapiens
tcagtccaggggctgtgatgtc

SEQ ID NO: 10015610 - DNA, 22 bp, Homo sapiens
tcagtccaggggctgtgatgtc

SEQ ID NO: 10015611 - DNA, 22 bp, Homo sapiens
tcagtccataggtgggcctgag

SEQ ID NO: 10015612 - DNA, 22 bp, Homo sapiens
tcagtgctgccatggcagggcc

SEQ ID NO: 10015613 - DNA, 22 bp, Homo sapiens
tcagtgctgagtagcgtgcacc

SEQ ID NO: 10015614 - DNA, 22 bp, Homo sapiens
tcagtgctctgaggtccagggt

SEQ ID NO: 10015615 - DNA, 19 bp, Homo sapiens
tcagtgctcctatgtcctt

SEQ ID NO: 10015616 - DNA, 22 bp, Homo sapiens
catctcactgaggggtttacaa

SEQ ID NO: 10015617 - DNA, 22 bp, Homo sapiens
catctcacagcaaactgctgaa

SEQ ID NO: 10015618 - DNA, 22 bp, Homo sapiens
catctcagtgtacagggagtct

SEQ ID NO: 10015619 - DNA, 20 bp, Homo sapiens
tcagtgctcaggcaccaggt

SEQ ID NO: 10015620 - DNA, 22 bp, Homo sapiens
tcagtgctaaaagagctggtgt

SEQ ID NO: 10015621 - DNA, 22 bp, Homo sapiens
tcagtgcctactttgatcaatt

SEQ ID NO: 10015622 - DNA, 22 bp, Homo sapiens
tcagtgcctactttgatcaatt

SEQ ID NO: 10015623 - DNA, 22 bp, Homo sapiens
tcagtgctcaggggagccgagg

SEQ ID NO: 10015624 - DNA, 22 bp, Homo sapiens
tcagtgctcctaaagtgaatgc

SEQ ID NO: 10015625 - DNA, 22 bp, Homo sapiens
tcagtgctcctaaagtgaatgc

SEQ ID NO: 10015626 - DNA, 22 bp, Homo sapiens
tcagtgctcctaaagtgaatgc

SEQ ID NO: 10015627 - DNA, 22 bp, Homo sapiens
tcagtgctcctaaagtgaatgc

SEQ ID NO: 10015628 - DNA, 22 bp, Homo sapiens
tcagggattaaggtcaaaggtg

SEQ ID NO: 10015629 - DNA, 22 bp, Homo sapiens
tcagtccaatgattgtaggaca

SEQ ID NO: 10015630 - DNA, 22 bp, Homo sapiens
tcagtcacttttgcctgctaca

SEQ ID NO: 10015631 - DNA, 22 bp, Homo sapiens
tcagggagatttggggactcaa

SEQ ID NO: 10015632 - DNA, 22 bp, Homo sapiens
tcagggagatttggggactcaa

SEQ ID NO: 10015633 - DNA, 22 bp, Homo sapiens
tcagggagcctggacttcaagg

SEQ ID NO: 10015634 - DNA, 22 bp, Homo sapiens
tcagggagggacctgaggctgg

SEQ ID NO: 10015635 - DNA, 22 bp, Homo sapiens
tcagggagggacctgaggctgg

SEQ ID NO: 10015636 - DNA, 22 bp, Homo sapiens
tcagggagggacctgaggctgg

SEQ ID NO: 10015637 - DNA, 22 bp, Homo sapiens
tcagggaggtgtctgccagaga

SEQ ID NO: 10015638 - DNA, 22 bp, Homo sapiens
tcagggaggtgtctgccagaga

SEQ ID NO: 10015639 - DNA, 22 bp, Homo sapiens
tcagggaggtgtctgccagaga

SEQ ID NO: 10015640 - DNA, 22 bp, Homo sapiens
tcagggagtgttggcaggatca

SEQ ID NO: 10015641 - DNA, 22 bp, Homo sapiens
tcagggagtgttggcaggatca

SEQ ID NO: 10015642 - DNA, 22 bp, Homo sapiens
tcagggagtagtttgtgctatg

SEQ ID NO: 10015643 - DNA, 22 bp, Homo sapiens
catgcagtctggagccttctgt

SEQ ID NO: 10015644 - DNA, 22 bp, Homo sapiens
catgcagtgactcagacacagg

SEQ ID NO: 10015645 - DNA, 22 bp, Homo sapiens
catgcagggacttgtgctccat

SEQ ID NO: 10015646 - DNA, 22 bp, Homo sapiens
catgcagggagcagaggagaca

SEQ ID NO: 10015647 - DNA, 22 bp, Homo sapiens
catgcaggcgcaacttctacaa

SEQ ID NO: 10015648 - DNA, 22 bp, Homo sapiens
catgcagggactagagaacagg

SEQ ID NO: 10015649 - DNA, 22 bp, Homo sapiens
catgcagggagtgctcctatta

SEQ ID NO: 10015650 - DNA, 22 bp, Homo sapiens
catgcatatgtcaaaaaagcta

SEQ ID NO: 10015651 - DNA, 22 bp, Homo sapiens
catgcatcagaatcacctagag

SEQ ID NO: 10015652 - DNA, 22 bp, Homo sapiens
catgcatattactagcacagca

SEQ ID NO: 10015653 - DNA, 22 bp, Homo sapiens
catgcatctggtcttggaaata

SEQ ID NO: 10015654 - DNA, 22 bp, Homo sapiens
catgcatcgatgaatgcgtggg

SEQ ID NO: 10015655 - DNA, 22 bp, Homo sapiens
catgacacctaccatattaagt

SEQ ID NO: 10015656 - DNA, 22 bp, Homo sapiens
catgacacccaggcatagcacc

SEQ ID NO: 10015657 - DNA, 22 bp, Homo sapiens
catgaaggaattaaggtaagga

SEQ ID NO: 10015658 - DNA, 22 bp, Homo sapiens
catgaagtcaggatttccatga

SEQ ID NO: 10015659 - DNA, 22 bp, Homo sapiens
catgaatatacatcctgatggc

SEQ ID NO: 10015660 - DNA, 22 bp, Homo sapiens
catgaatatttagtatttactt

SEQ ID NO: 10015661 - DNA, 22 bp, Homo sapiens
catgcacacacagttctaatta

SEQ ID NO: 10015662 - DNA, 22 bp, Homo sapiens
catgcacacacgtgcatgtacg

SEQ ID NO: 10015663 - DNA, 22 bp, Homo sapiens
catgacattttaaaaagaacat

SEQ ID NO: 10015664 - DNA, 20 bp, Homo sapiens
catgacactgttcctctgcc

SEQ ID NO: 10015665 - DNA, 22 bp, Homo sapiens
catgacatcctgaagctgcaca

SEQ ID NO: 10015666 - DNA, 22 bp, Homo sapiens
catggcagctttgggaggagga

SEQ ID NO: 10015667 - DNA, 23 bp, Homo sapiens
catggcagcaagagctcatggcc

SEQ ID NO: 10015668 - DNA, 22 bp, Homo sapiens
catggcagctcctccagtgtga

SEQ ID NO: 10015669 - DNA, 22 bp, Homo sapiens
catggcagcctgccctgcttgc

SEQ ID NO: 10015670 - DNA, 22 bp, Homo sapiens
catggcagagcctgcaggtggg

SEQ ID NO: 10015671 - DNA, 22 bp, Homo sapiens
catggcaggtgcagattctgtg

SEQ ID NO: 10015672 - DNA, 22 bp, Homo sapiens
catggcagggctgtgggcaggt

SEQ ID NO: 10015673 - DNA, 22 bp, Homo sapiens
catggcagtgattcagcctttg

SEQ ID NO: 10015674 - DNA, 22 bp, Homo sapiens
catggcaggaggctgctggcag

SEQ ID NO: 10015675 - DNA, 22 bp, Homo sapiens
catggcaggaaggacatgcact

SEQ ID NO: 10015676 - DNA, 20 bp, Homo sapiens
tccagctgggaacagctgat

SEQ ID NO: 10015677 - DNA, 22 bp, Homo sapiens
tccaggagaaggccatccagcg

SEQ ID NO: 10015678 - DNA, 23 bp, Homo sapiens
tccaggagaattccagggcccgg

SEQ ID NO: 10015679 - DNA, 22 bp, Homo sapiens
tccaggagaaggccatccagcg

SEQ ID NO: 10015680 - DNA, 22 bp, Homo sapiens
catggccacatctagctgcaag

SEQ ID NO: 10015681 - DNA, 22 bp, Homo sapiens
tcagagagttttcactagggtg

SEQ ID NO: 10015682 - DNA, 22 bp, Homo sapiens
tcagagagttttcactagggtg

SEQ ID NO: 10015683 - DNA, 22 bp, Homo sapiens
tcagagatctggagtacaactg

SEQ ID NO: 10015684 - DNA, 22 bp, Homo sapiens
tcagagatggagttagcagtga

SEQ ID NO: 10015685 - DNA, 22 bp, Homo sapiens
tcagagattcacgtcagtccca

SEQ ID NO: 10015686 - DNA, 22 bp, Homo sapiens
tcagagatgcagtgccacctac

SEQ ID NO: 10015687 - DNA, 22 bp, Homo sapiens
tcagagatcttcaggatgggac

SEQ ID NO: 10015688 - DNA, 22 bp, Homo sapiens
tcagagattcacgtcagtccca

SEQ ID NO: 10015689 - DNA, 21 bp, Homo sapiens
tcagagagtcacagtgaactg

SEQ ID NO: 10015690 - DNA, 22 bp, Homo sapiens
tcagagagtcctggtcatttgc

SEQ ID NO: 10015691 - DNA, 22 bp, Homo sapiens
cagttgaaaagattttattctg

SEQ ID NO: 10015692 - DNA, 20 bp, Homo sapiens
cagttgaaataatttgtttg

SEQ ID NO: 10015693 - DNA, 17 bp, Homo sapiens
cagttgaaatgtttgga

SEQ ID NO: 10015694 - DNA, 22 bp, Homo sapiens
cagttgaatggtcagacaaggc

SEQ ID NO: 10015695 - DNA, 22 bp, Homo sapiens
cagttgatcactataggcttca

SEQ ID NO: 10015696 - DNA, 22 bp, Homo sapiens
cagttactgtatgtcaaagact

SEQ ID NO: 10015697 - DNA, 22 bp, Homo sapiens
tcaatgaaagagcatgcatttt

SEQ ID NO: 10015698 - DNA, 22 bp, Homo sapiens
cagttctggtttgcagatatat

SEQ ID NO: 10015699 - DNA, 22 bp, Homo sapiens
cagttctggagtttcattcttt

SEQ ID NO: 10015700 - DNA, 22 bp, Homo sapiens
tcaatcaatgtgtcagttccca

SEQ ID NO: 10015701 - DNA, 22 bp, Homo sapiens
tcaatcaatggtttccaaattt

SEQ ID NO: 10015702 - DNA, 22 bp, Homo sapiens
tcaatatttttatgagcataga

SEQ ID NO: 10015703 - DNA, 22 bp, Homo sapiens
tcaatcaaagcactgggctttg

SEQ ID NO: 10015704 - DNA, 22 bp, Homo sapiens
tcaatcaaagccagatgtcctt

SEQ ID NO: 10015705 - DNA, 22 bp, Homo sapiens
tcaatattcttctttagtagga

SEQ ID NO: 10015706 - DNA, 22 bp, Homo sapiens
tcaatatattccatgttttctc

SEQ ID NO: 10015707 - DNA, 22 bp, Homo sapiens
tcaatatattccatgttttctc

SEQ ID NO: 10015708 - DNA, 22 bp, Homo sapiens
tcaatagcatagcaattaatgt

SEQ ID NO: 10015709 - DNA, 22 bp, Homo sapiens
cagtttgtcttgattcagaaca

SEQ ID NO: 10015710 - DNA, 22 bp, Homo sapiens
cagtttgtcttgattcagaaca

SEQ ID NO: 10015711 - DNA, 23 bp, Homo sapiens
tcagatgaggaatgcatactaat

SEQ ID NO: 10015712 - DNA, 22 bp, Homo sapiens
cagttttccatgactcagagag

SEQ ID NO: 10015713 - DNA, 22 bp, Homo sapiens
cagtttgtgctaggcactattt

SEQ ID NO: 10015714 - DNA, 22 bp, Homo sapiens
cagtttgtgctaggcactattt

SEQ ID NO: 10015715 - DNA, 22 bp, Homo sapiens
cagttttctaaagtctctttaa

SEQ ID NO: 10015716 - DNA, 22 bp, Homo sapiens
cagttttggtcctttctaggta

SEQ ID NO: 10015717 - DNA, 23 bp, Homo sapiens
cataaaatattagtatggtagca

SEQ ID NO: 10015718 - DNA, 22 bp, Homo sapiens
cataaaagccacctatttaaag

SEQ ID NO: 10015719 - DNA, 22 bp, Homo sapiens
tcagaggagccaaagttctgag

SEQ ID NO: 10015720 - DNA, 18 bp, Homo sapiens
tcagaggagatacctaaa

SEQ ID NO: 10015721 - DNA, 22 bp, Homo sapiens
tcagaggagatggttaccaggg

SEQ ID NO: 10015722 - DNA, 22 bp, Homo sapiens
tcagaggagcaaaagaggggat

SEQ ID NO: 10015723 - DNA, 22 bp, Homo sapiens
tcagaggatcatgtccctactc

SEQ ID NO: 10015724 - DNA, 23 bp, Homo sapiens
tcagaggatcatcaaacgttttc

SEQ ID NO: 10015725 - DNA, 22 bp, Homo sapiens
tcagaggatagaaatacttatt

SEQ ID NO: 10015726 - DNA, 22 bp, Homo sapiens
tcagaggaggcatttaaacaga

SEQ ID NO: 10015727 - DNA, 22 bp, Homo sapiens
tcagaggagggactcagaccca

SEQ ID NO: 10015728 - DNA, 22 bp, Homo sapiens
tcagatatgaattcatatctct

SEQ ID NO: 10015729 - DNA, 22 bp, Homo sapiens
tcagatatagtcatttaaataa

SEQ ID NO: 10015730 - DNA, 21 bp, Homo sapiens
tcagataccagactcaagggg

SEQ ID NO: 10015731 - DNA, 22 bp, Homo sapiens
tcagatactgtggcttatgggc

SEQ ID NO: 10015732 - DNA, 22 bp, Homo sapiens
tcagataccattgaatttgttg

SEQ ID NO: 10015733 - DNA, 22 bp, Homo sapiens
tcagatactagctctcagcctc

SEQ ID NO: 10015734 - DNA, 22 bp, Homo sapiens
tcagagtttgaaataattttta

SEQ ID NO: 10015735 - DNA, 22 bp, Homo sapiens
tcagagttggcagtaaaacaca

SEQ ID NO: 10015736 - DNA, 22 bp, Homo sapiens
tcagaggatgctgttctttaat

SEQ ID NO: 10015737 - DNA, 22 bp, Homo sapiens
cataattttccatggtttgcta

SEQ ID NO: 10015738 - DNA, 22 bp, Homo sapiens
tcaggccaggagatcagattga

SEQ ID NO: 10015739 - DNA, 22 bp, Homo sapiens
tcaggcccagagtcacggatcc

SEQ ID NO: 10015740 - DNA, 22 bp, Homo sapiens
cataatttctgtatcagcacca

SEQ ID NO: 10015741 - DNA, 22 bp, Homo sapiens
cataatttctaccagggccata

SEQ ID NO: 10015742 - DNA, 22 bp, Homo sapiens
cataatttgatatgcttgatgg

SEQ ID NO: 10015743 - DNA, 22 bp, Homo sapiens
cataattttccatggtttgcta

SEQ ID NO: 10015744 - DNA, 22 bp, Homo sapiens
cataattactgatatgctgatt

SEQ ID NO: 10015745 - DNA, 22 bp, Homo sapiens
cataatgtgtgtcatacagact

SEQ ID NO: 10015746 - DNA, 22 bp, Homo sapiens
cataatgttgtaacacatagag

SEQ ID NO: 10015747 - DNA, 22 bp, Homo sapiens
cataatttcccaagagattgaa

SEQ ID NO: 10015748 - DNA, 22 bp, Homo sapiens
cataatttcactgtcgtatggc

SEQ ID NO: 10015749 - DNA, 22 bp, Homo sapiens
cataattataaacgcaagttca

SEQ ID NO: 10015750 - DNA, 22 bp, Homo sapiens
cataacagtggcttcagcaagt

SEQ ID NO: 10015751 - DNA, 22 bp, Homo sapiens
cataatatctccgattacttgc

SEQ ID NO: 10015752 - DNA, 22 bp, Homo sapiens
cataatatctccgattacttgc

SEQ ID NO: 10015753 - DNA, 17 bp, Homo sapiens
tcagcagtaatggtggg

SEQ ID NO: 10015754 - DNA, 22 bp, Homo sapiens
tcagcagtcctccaggatcaag

SEQ ID NO: 10015755 - DNA, 22 bp, Homo sapiens
cataatcagatgtgtacataag

SEQ ID NO: 10015756 - DNA, 22 bp, Homo sapiens
cataatcagatgtgtacataag

SEQ ID NO: 10015757 - DNA, 22 bp, Homo sapiens
cataatatctccgattacttgc

SEQ ID NO: 10015758 - DNA, 22 bp, Homo sapiens
cataatcccaggcttgcattca

SEQ ID NO: 10015759 - DNA, 22 bp, Homo sapiens
cataatcctggtgtagccctct

SEQ ID NO: 10015760 - DNA, 22 bp, Homo sapiens
cataatccttgattcaaataat

SEQ ID NO: 10015761 - DNA, 22 bp, Homo sapiens
cataatgtatgcattttccagc

SEQ ID NO: 10015762 - DNA, 22 bp, Homo sapiens
cataatgtgtgtcatacagact

SEQ ID NO: 10015763 - DNA, 22 bp, Homo sapiens
cataatgtctgacacagtaaga

SEQ ID NO: 10015764 - DNA, 22 bp, Homo sapiens
cataatgtctgacacagtaaga

SEQ ID NO: 10015765 - DNA, 22 bp, Homo sapiens
cataatgtctgacacagtaaga

SEQ ID NO: 10015766 - DNA, 22 bp, Homo sapiens
tcagcaggtctgaggcggggcc

SEQ ID NO: 10015767 - DNA, 22 bp, Homo sapiens
catagaaactgagacaaggatt

SEQ ID NO: 10015768 - DNA, 22 bp, Homo sapiens
catagaaactgagacaaggatt

SEQ ID NO: 10015769 - DNA, 22 bp, Homo sapiens
catagaaatcaggtgagaatct

SEQ ID NO: 10015770 - DNA, 22 bp, Homo sapiens
catagaaagtattatggaattt

SEQ ID NO: 10015771 - DNA, 22 bp, Homo sapiens
tcaggcctccaggttaccattt

SEQ ID NO: 10015772 - DNA, 22 bp, Homo sapiens
tcaggccccttgtcagctctgt

SEQ ID NO: 10015773 - DNA, 22 bp, Homo sapiens
tcaggccccatcccagacttat

SEQ ID NO: 10015774 - DNA, 22 bp, Homo sapiens
tcaggccctttgctgctgcccc

SEQ ID NO: 10015775 - DNA, 22 bp, Homo sapiens
tcaggcccttctcccaggactc

SEQ ID NO: 10015776 - DNA, 17 bp, Homo sapiens
tcaggctgtgcctggta

SEQ ID NO: 10015777 - DNA, 22 bp, Homo sapiens
tcaggctgtgggcactggccat

SEQ ID NO: 10015778 - DNA, 22 bp, Homo sapiens
tcagggagaggtgagagcctgt

SEQ ID NO: 10015779 - DNA, 22 bp, Homo sapiens
tcagggagaggtgagagcctgt

SEQ ID NO: 10015780 - DNA, 22 bp, Homo sapiens
tcagggagagtgacccatccac

SEQ ID NO: 10015781 - DNA, 22 bp, Homo sapiens
tcaggctgtgtctttaaacaat

SEQ ID NO: 10015782 - DNA, 22 bp, Homo sapiens
tcaggctgcctatcagactgtg

SEQ ID NO: 10015783 - DNA, 22 bp, Homo sapiens
tcaggctgcctatcagactgtg

SEQ ID NO: 10015784 - DNA, 22 bp, Homo sapiens
tcaggctgcctatcagactgtg

SEQ ID NO: 10015785 - DNA, 22 bp, Homo sapiens
catagaacagctcctagcacat

SEQ ID NO: 10015786 - DNA, 22 bp, Homo sapiens
catagaatcatagcacatttga

SEQ ID NO: 10015787 - DNA, 22 bp, Homo sapiens
catagaatatgtgtgattgtta

SEQ ID NO: 10015788 - DNA, 22 bp, Homo sapiens
ccaaggcccctgtggtctagcc

SEQ ID NO: 10015789 - DNA, 22 bp, Homo sapiens
ccaaggctcctcagctggtctt

SEQ ID NO: 10015790 - DNA, 22 bp, Homo sapiens
ccaaggctcctcagctggtctt

SEQ ID NO: 10015791 - DNA, 22 bp, Homo sapiens
tcctggcacccttgggttggag

SEQ ID NO: 10015792 - DNA, 22 bp, Homo sapiens
ccaaggcttcccagagatgctc

SEQ ID NO: 10015793 - DNA, 22 bp, Homo sapiens
tcctacagatactaaggagatc

SEQ ID NO: 10015794 - DNA, 22 bp, Homo sapiens
tcctagaactccaggacagtcc

SEQ ID NO: 10015795 - DNA, 22 bp, Homo sapiens
tcctagaacagcccacctggaa

SEQ ID NO: 10015796 - DNA, 22 bp, Homo sapiens
ccaagaggttgaggctgcagtg

SEQ ID NO: 10015797 - DNA, 22 bp, Homo sapiens
ccaagaggttgtgaggcaggca

SEQ ID NO: 10015798 - DNA, 22 bp, Homo sapiens
ccaaggcaacgttggtgtcagg

SEQ ID NO: 10015799 - DNA, 22 bp, Homo sapiens
ccaaggcatatggctgaaacca

SEQ ID NO: 10015800 - DNA, 22 bp, Homo sapiens
ccaaggcagaagatggctcttg

SEQ ID NO: 10015801 - DNA, 22 bp, Homo sapiens
ccaaggcagaagatggctcttg

SEQ ID NO: 10015802 - DNA, 22 bp, Homo sapiens
ccacactgaacctcagtgtctt

SEQ ID NO: 10015803 - DNA, 22 bp, Homo sapiens
ccacagaaaataaagcacgatt

SEQ ID NO: 10015804 - DNA, 22 bp, Homo sapiens
ccacacagtcagtttccaagaa

SEQ ID NO: 10015805 - DNA, 22 bp, Homo sapiens
ccacactccccgcaggcgtagg

SEQ ID NO: 10015806 - DNA, 22 bp, Homo sapiens
tcctggctccagcagctcttcc

SEQ ID NO: 10015807 - DNA, 22 bp, Homo sapiens
tcctgggactctttatcagaga

SEQ ID NO: 10015808 - DNA, 22 bp, Homo sapiens
ccacagaaagttgtctagagta

SEQ ID NO: 10015809 - DNA, 22 bp, Homo sapiens
ccacagaaagttgtctagagta

SEQ ID NO: 10015810 - DNA, 22 bp, Homo sapiens
tcctgggagacccagctgtgga

SEQ ID NO: 10015811 - DNA, 22 bp, Homo sapiens
tcctgggagagtgggactgtat

SEQ ID NO: 10015812 - DNA, 22 bp, Homo sapiens
tcctgggagagtgggactgtat

SEQ ID NO: 10015813 - DNA, 22 bp, Homo sapiens
tcctgggagacccagctgtgga

SEQ ID NO: 10015814 - DNA, 22 bp, Homo sapiens
tcctgggagagtttgattcatt

SEQ ID NO: 10015815 - DNA, 22 bp, Homo sapiens
tcctgggagcatgaagagggat

SEQ ID NO: 10015816 - DNA, 22 bp, Homo sapiens
tcctgggagcatgaagagggat

SEQ ID NO: 10015817 - DNA, 22 bp, Homo sapiens
tcctgggagcatgaagagggat

SEQ ID NO: 10015818 - DNA, 22 bp, Homo sapiens
tcctgggagcccttgctccacc

SEQ ID NO: 10015819 - DNA, 22 bp, Homo sapiens
tcctgggagcccttgctccacc

SEQ ID NO: 10015820 - DNA, 22 bp, Homo sapiens
tcctgggcttagtggctaggtc

SEQ ID NO: 10015821 - DNA, 22 bp, Homo sapiens
tcctgggcttaagtgatcctcc

SEQ ID NO: 10015822 - DNA, 22 bp, Homo sapiens
ccactgctagagatgcatcccc

SEQ ID NO: 10015823 - DNA, 22 bp, Homo sapiens
ccactgtaagtttgaaaataac

SEQ ID NO: 10015824 - DNA, 22 bp, Homo sapiens
ccactgtcttttccaggctgaa

SEQ ID NO: 10015825 - DNA, 22 bp, Homo sapiens
ccactgtcttttccaggctgaa

SEQ ID NO: 10015826 - DNA, 22 bp, Homo sapiens
ccactgtctgcaggcctcagca

SEQ ID NO: 10015827 - DNA, 22 bp, Homo sapiens
ccactgtcagaggggctgtgcc

SEQ ID NO: 10015828 - DNA, 22 bp, Homo sapiens
tctaagccaggactgagagacg

SEQ ID NO: 10015829 - DNA, 22 bp, Homo sapiens
tctaagaatactcatatcttct

SEQ ID NO: 10015830 - DNA, 21 bp, Homo sapiens
tctaagaacatgattctccct

SEQ ID NO: 10015831 - DNA, 22 bp, Homo sapiens
tctaagaatactcatatcttct

SEQ ID NO: 10015832 - DNA, 22 bp, Homo sapiens
ccacttaagagaacagctatag

SEQ ID NO: 10015833 - DNA, 22 bp, Homo sapiens
ccacttcatcccagctcagata

SEQ ID NO: 10015834 - DNA, 22 bp, Homo sapiens
ccagagaaccatctgcttgagg

SEQ ID NO: 10015835 - DNA, 22 bp, Homo sapiens
tctaaggagccaggactattag

SEQ ID NO: 10015836 - DNA, 22 bp, Homo sapiens
tctaagtaaaatttgtcatttc

SEQ ID NO: 10015837 - DNA, 21 bp, Homo sapiens
tctaagccttgcagatgggtt

SEQ ID NO: 10015838 - DNA, 22 bp, Homo sapiens
tctaaggacattggctttggag

SEQ ID NO: 10015839 - DNA, 22 bp, Homo sapiens
tctaaggacagttattactggg

SEQ ID NO: 10015840 - DNA, 22 bp, Homo sapiens
tctaaggacaaggtcttggaga

SEQ ID NO: 10015841 - DNA, 22 bp, Homo sapiens
tctaatcctatggtggggaggg

SEQ ID NO: 10015842 - DNA, 22 bp, Homo sapiens
tctaataaataaatgctctagg

SEQ ID NO: 10015843 - DNA, 22 bp, Homo sapiens
tcctgggctttgtttctctcct

SEQ ID NO: 10015844 - DNA, 19 bp, Homo sapiens
tcctggggaggggcatggc

SEQ ID NO: 10015845 - DNA, 19 bp, Homo sapiens
tcctggggaggggcatggc

SEQ ID NO: 10015846 - DNA, 22 bp, Homo sapiens
tcctgggcttagtggctaggtc

SEQ ID NO: 10015847 - DNA, 22 bp, Homo sapiens
tcctgggcttagtggctaggtc

SEQ ID NO: 10015848 - DNA, 22 bp, Homo sapiens
tcctgggcttcacagactctgt

SEQ ID NO: 10015849 - DNA, 22 bp, Homo sapiens
tcctgggcttcacagactctgt

SEQ ID NO: 10015850 - DNA, 22 bp, Homo sapiens
tcctgggcttgctcctccagct

SEQ ID NO: 10015851 - DNA, 22 bp, Homo sapiens
tcctgggcttgctcctccagct

SEQ ID NO: 10015852 - DNA, 22 bp, Homo sapiens
tccttgggtcagtgagtgaggt

SEQ ID NO: 10015853 - DNA, 22 bp, Homo sapiens
tccttgggtcagtgagtgaggt

SEQ ID NO: 10015854 - DNA, 22 bp, Homo sapiens
tccttggtgctggagctcagac

SEQ ID NO: 10015855 - DNA, 22 bp, Homo sapiens
tccttggtgcaaatgatttaat

SEQ ID NO: 10015856 - DNA, 19 bp, Homo sapiens
tccttgtgactgtgtgaaa

SEQ ID NO: 10015857 - DNA, 22 bp, Homo sapiens
tcctttatgtgagttgtttccc

SEQ ID NO: 10015858 - DNA, 22 bp, Homo sapiens
tccttcctgcaggccaagtcct

SEQ ID NO: 10015859 - DNA, 21 bp, Homo sapiens
tccttcccccttggcctggga

SEQ ID NO: 10015860 - DNA, 19 bp, Homo sapiens
tccttccccccagcacaga

SEQ ID NO: 10015861 - DNA, 23 bp, Homo sapiens
tccttgggcctgcccagagtggt

SEQ ID NO: 10015862 - DNA, 22 bp, Homo sapiens
cattacatttcaaaatgtttcc

SEQ ID NO: 10015863 - DNA, 22 bp, Homo sapiens
cattagaaggttttaaaggaat

SEQ ID NO: 10015864 - DNA, 22 bp, Homo sapiens
cattagaattaggttgtttacc

SEQ ID NO: 10015865 - DNA, 22 bp, Homo sapiens
cattagaagaacagttatatta

SEQ ID NO: 10015866 - DNA, 22 bp, Homo sapiens
cattagaaggttttaaaggaat

SEQ ID NO: 10015867 - DNA, 22 bp, Homo sapiens
cattagaacctataaaaagcat

SEQ ID NO: 10015868 - DNA, 22 bp, Homo sapiens
cattagaacctataaaaagcat

SEQ ID NO: 10015869 - DNA, 22 bp, Homo sapiens
cattagaacctataaaaagcat

SEQ ID NO: 10015870 - DNA, 22 bp, Homo sapiens
cattagaactaagatgtccagg

SEQ ID NO: 10015871 - DNA, 22 bp, Homo sapiens
cattctctacactcctgccctg

SEQ ID NO: 10015872 - DNA, 22 bp, Homo sapiens
cattctcaatagtagatgagta

SEQ ID NO: 10015873 - DNA, 22 bp, Homo sapiens
cattctcaatagtagatgagta

SEQ ID NO: 10015874 - DNA, 22 bp, Homo sapiens
cattctatcttggactggatct

SEQ ID NO: 10015875 - DNA, 22 bp, Homo sapiens
cattagcattacttcaaagagt

SEQ ID NO: 10015876 - DNA, 22 bp, Homo sapiens
cattagcattcagtgacttgta

SEQ ID NO: 10015877 - DNA, 22 bp, Homo sapiens
cattctcttgacaggacagccc

SEQ ID NO: 10015878 - DNA, 22 bp, Homo sapiens
cattctctgatcttcacatacc

SEQ ID NO: 10015879 - DNA, 22 bp, Homo sapiens
cattcttatatttactcattca

SEQ ID NO: 10015880 - DNA, 22 bp, Homo sapiens
cattcttacacaatattttaat

SEQ ID NO: 10015881 - DNA, 22 bp, Homo sapiens
tcccacccatcctgcatctctt

SEQ ID NO: 10015882 - DNA, 22 bp, Homo sapiens
tcccacatgtgaatcctcaggt

SEQ ID NO: 10015883 - DNA, 22 bp, Homo sapiens
tcccaccaggtgaccatttcat

SEQ ID NO: 10015884 - DNA, 22 bp, Homo sapiens
tcccaccccctccaaggaggaa

SEQ ID NO: 10015885 - DNA, 22 bp, Homo sapiens
tccatttagctggcaaacaatg

SEQ ID NO: 10015886 - DNA, 22 bp, Homo sapiens
tccatcaccacagaggacagag

SEQ ID NO: 10015887 - DNA, 22 bp, Homo sapiens
tccattttagaagaaaatccac

SEQ ID NO: 10015888 - DNA, 22 bp, Homo sapiens
tccatttgaaatgaaagtgata

SEQ ID NO: 10015889 - DNA, 22 bp, Homo sapiens
tccattttagaagaaaatccac

SEQ ID NO: 10015890 - DNA, 22 bp, Homo sapiens
catgggcagttggcagggctca

SEQ ID NO: 10015891 - DNA, 22 bp, Homo sapiens
catgggcagttggcagggctca

SEQ ID NO: 10015892 - DNA, 22 bp, Homo sapiens
catgggcccgtgagaggcaggg

SEQ ID NO: 10015893 - DNA, 22 bp, Homo sapiens
catgggccatggtgaagccagg

SEQ ID NO: 10015894 - DNA, 22 bp, Homo sapiens
tccattttagagatgaagaaac

SEQ ID NO: 10015895 - DNA, 22 bp, Homo sapiens
tccattttagagatgaagaaac

SEQ ID NO: 10015896 - DNA, 22 bp, Homo sapiens
tccattttagagatgaagaaac

SEQ ID NO: 10015897 - DNA, 22 bp, Homo sapiens
tccattttagagatgaagaaac

SEQ ID NO: 10015898 - DNA, 22 bp, Homo sapiens
tccattttagagatgaagaaac

SEQ ID NO: 10015899 - DNA, 22 bp, Homo sapiens
tccattttctaagtatcactta

SEQ ID NO: 10015900 - DNA, 22 bp, Homo sapiens
tccattttcatctcatgtataa

SEQ ID NO: 10015901 - DNA, 22 bp, Homo sapiens
tccattttcatctcatgtataa

SEQ ID NO: 10015902 - DNA, 22 bp, Homo sapiens
tccattttcatctcatgtataa

SEQ ID NO: 10015903 - DNA, 22 bp, Homo sapiens
tccatttttcatgactcctcaa

SEQ ID NO: 10015904 - DNA, 22 bp, Homo sapiens
tccattttgtaggtatgctaca

SEQ ID NO: 10015905 - DNA, 22 bp, Homo sapiens
tccattttgtaggtatgctaca

SEQ ID NO: 10015906 - DNA, 22 bp, Homo sapiens
tccatttttcatgactcctcaa

SEQ ID NO: 10015907 - DNA, 22 bp, Homo sapiens
tccattttgtaggtatgctaca

SEQ ID NO: 10015908 - DNA, 22 bp, Homo sapiens
tccattttcttgctctaggtaa

SEQ ID NO: 10015909 - DNA, 22 bp, Homo sapiens
tccattttctaagtatcactta

SEQ ID NO: 10015910 - DNA, 22 bp, Homo sapiens
tccattttctcttccggaggtg

SEQ ID NO: 10015911 - DNA, 22 bp, Homo sapiens
catgggcaccttaaaatgaggc

SEQ ID NO: 10015912 - DNA, 21 bp, Homo sapiens
tccaggagcacgggactagga

SEQ ID NO: 10015913 - DNA, 22 bp, Homo sapiens
catgggaggcctgctgctggtg

SEQ ID NO: 10015914 - DNA, 17 bp, Homo sapiens
tccaggagaggcaatgg

SEQ ID NO: 10015915 - DNA, 22 bp, Homo sapiens
tccaggagaccagatgtaggcc

SEQ ID NO: 10015916 - DNA, 22 bp, Homo sapiens
tccaggagacacaaggtacata

SEQ ID NO: 10015917 - DNA, 22 bp, Homo sapiens
tccaggagacacccttgtgtgt

SEQ ID NO: 10015918 - DNA, 22 bp, Homo sapiens
tccaggagaggtagagggttcc

SEQ ID NO: 10015919 - DNA, 22 bp, Homo sapiens
tccaggagaggcctgaccaggt

SEQ ID NO: 10015920 - DNA, 22 bp, Homo sapiens
tccaggagaggcctgaccaggt

SEQ ID NO: 10015921 - DNA, 22 bp, Homo sapiens
tccaggagaggtgtggggactg

SEQ ID NO: 10015922 - DNA, 22 bp, Homo sapiens
tccaggagatacactgcaccag

SEQ ID NO: 10015923 - DNA, 22 bp, Homo sapiens
tccaggagattcattaggtcat

SEQ ID NO: 10015924 - DNA, 22 bp, Homo sapiens
tccctggggtatcgctgaggca

SEQ ID NO: 10015925 - DNA, 22 bp, Homo sapiens
tccctggaacagagagacaacg

SEQ ID NO: 10015926 - DNA, 22 bp, Homo sapiens
tccctgctttcttgtgagggga

SEQ ID NO: 10015927 - DNA, 23 bp, Homo sapiens
tcctaactcaattcaggggtgtc

SEQ ID NO: 10015928 - DNA, 22 bp, Homo sapiens
tcctaactaatttgtagcaaaa

SEQ ID NO: 10015929 - DNA, 20 bp, Homo sapiens
tcctaactataaagtggctc

SEQ ID NO: 10015930 - DNA, 16 bp, Homo sapiens
tcctaactggcagttc

SEQ ID NO: 10015931 - DNA, 18 bp, Homo sapiens
tcctaacttagatactcc

SEQ ID NO: 10015932 - DNA, 22 bp, Homo sapiens
tcctaactgccctgggcaaggt

SEQ ID NO: 10015933 - DNA, 22 bp, Homo sapiens
tcctaactccactagccttggg

SEQ ID NO: 10015934 - DNA, 23 bp, Homo sapiens
tcctaactgattctgcagtctct

SEQ ID NO: 10015935 - DNA, 22 bp, Homo sapiens
tccctgggttacctttcaaggt

SEQ ID NO: 10015936 - DNA, 22 bp, Homo sapiens
catttattcatgatctgtagct

SEQ ID NO: 10015937 - DNA, 22 bp, Homo sapiens
catttattgagtggccacagtg

SEQ ID NO: 10015938 - DNA, 22 bp, Homo sapiens
cattgtcacccaaagctcatag

SEQ ID NO: 10015939 - DNA, 22 bp, Homo sapiens
cattgtcacccaaagctcatag

SEQ ID NO: 10015940 - DNA, 22 bp, Homo sapiens
cattgtcattctatgctattca

SEQ ID NO: 10015941 - DNA, 22 bp, Homo sapiens
cattgtacagttattttaaaat

SEQ ID NO: 10015942 - DNA, 22 bp, Homo sapiens
cattgtattgaggatacttaag

SEQ ID NO: 10015943 - DNA, 22 bp, Homo sapiens
tcccactcccaggcaggcctct

SEQ ID NO: 10015944 - DNA, 22 bp, Homo sapiens
cattgcactccagcctgggcaa

SEQ ID NO: 10015945 - DNA, 22 bp, Homo sapiens
cattgcactccagcctgggcca

SEQ ID NO: 10015946 - DNA, 22 bp, Homo sapiens
cattgcactcctgcctgggcaa

SEQ ID NO: 10015947 - DNA, 22 bp, Homo sapiens
catttaaaggttgtgggtaaaa

SEQ ID NO: 10015948 - DNA, 22 bp, Homo sapiens
catttaaaggttgtgggtaaaa

SEQ ID NO: 10015949 - DNA, 22 bp, Homo sapiens
catttaaaggttgtgggtaaaa

SEQ ID NO: 10015950 - DNA, 22 bp, Homo sapiens
catttaaaggttgtgggtaaaa

SEQ ID NO: 10015951 - DNA, 22 bp, Homo sapiens
cattgttttgagaacaacctga

SEQ ID NO: 10015952 - DNA, 22 bp, Homo sapiens
cattgttaattggtatcttaca

SEQ ID NO: 10015953 - DNA, 22 bp, Homo sapiens
cattgttcaacactgacttgca

SEQ ID NO: 10015954 - DNA, 22 bp, Homo sapiens
catttacacttctaaccacaag

SEQ ID NO: 10015955 - DNA, 20 bp, Homo sapiens
tccctcctgcagatagagaa

SEQ ID NO: 10015956 - DNA, 22 bp, Homo sapiens
tccctcagaaattctctctgaa

SEQ ID NO: 10015957 - DNA, 20 bp, Homo sapiens
tccctcctgcagatagagaa

SEQ ID NO: 10015958 - DNA, 22 bp, Homo sapiens
catttaatagatgctgtttcag

SEQ ID NO: 10015959 - DNA, 22 bp, Homo sapiens
catttaagagaaatatttagtt

SEQ ID NO: 10015960 - DNA, 22 bp, Homo sapiens
catttaatagatgctgtttcag

SEQ ID NO: 10015961 - DNA, 22 bp, Homo sapiens
catttacaatgtacaggttgtg

SEQ ID NO: 10015962 - DNA, 20 bp, Homo sapiens
tgtgtatgtgcacatgcgaa

SEQ ID NO: 10015963 - DNA, 22 bp, Homo sapiens
tgtgtatgtaagcatgtgcata

SEQ ID NO: 10015964 - DNA, 23 bp, Homo sapiens
tgtgtatgtatctatgcataggt

SEQ ID NO: 10015965 - DNA, 22 bp, Homo sapiens
tgtgtatattaggacacattct

SEQ ID NO: 10015966 - DNA, 22 bp, Homo sapiens
tgtgtatgcatacacacataga

SEQ ID NO: 10015967 - DNA, 22 bp, Homo sapiens
tgtgtatattaggacacattct

SEQ ID NO: 10015968 - DNA, 22 bp, Homo sapiens
tgtgtatatgtaaatatagttg

SEQ ID NO: 10015969 - DNA, 22 bp, Homo sapiens
tgtgtctgaactagttgctctc

SEQ ID NO: 10015970 - DNA, 22 bp, Homo sapiens
tgtgtctgaacatgctttgtaa

SEQ ID NO: 10015971 - DNA, 19 bp, Homo sapiens
tgtgtctctgtgtagcctg

SEQ ID NO: 10015972 - DNA, 23 bp, Homo sapiens
tgtgtctgaggatatatgtgcat

SEQ ID NO: 10015973 - DNA, 22 bp, Homo sapiens
tgtgtctgcccttagtacatct

SEQ ID NO: 10015974 - DNA, 22 bp, Homo sapiens
tgtgtctgcactgagtcctcac

SEQ ID NO: 10015975 - DNA, 22 bp, Homo sapiens
tgtgtataactcttaattcatt

SEQ ID NO: 10015976 - DNA, 22 bp, Homo sapiens
tgtgtataattagaccatttac

SEQ ID NO: 10015977 - DNA, 22 bp, Homo sapiens
tgtgtatacgagtatgaatatg

SEQ ID NO: 10015978 - DNA, 22 bp, Homo sapiens
tgtgtatacaacttataggagc

SEQ ID NO: 10015979 - DNA, 22 bp, Homo sapiens
tgtgtatacatacatacacacg

SEQ ID NO: 10015980 - DNA, 22 bp, Homo sapiens
tgtgtatagaaagtaggaaagg

SEQ ID NO: 10015981 - DNA, 22 bp, Homo sapiens
tgtgtatagatgcatgcatata

SEQ ID NO: 10015982 - DNA, 22 bp, Homo sapiens
tgtgtatatatgtgcacatgta

SEQ ID NO: 10015983 - DNA, 22 bp, Homo sapiens
tgtgtataggttgtgctaatag

SEQ ID NO: 10015984 - DNA, 22 bp, Homo sapiens
tgtgggtcttccaaagaagggc

SEQ ID NO: 10015985 - DNA, 22 bp, Homo sapiens
tgtgggtgatgaatttgttctt

SEQ ID NO: 10015986 - DNA, 22 bp, Homo sapiens
cctgggcaacatagtgagacct

SEQ ID NO: 10015987 - DNA, 22 bp, Homo sapiens
cctgggcaatatagtgaggccc

SEQ ID NO: 10015988 - DNA, 20 bp, Homo sapiens
tgtgtataaatatatgtttc

SEQ ID NO: 10015989 - DNA, 20 bp, Homo sapiens
tgtgtataaatatatgtttc

SEQ ID NO: 10015990 - DNA, 22 bp, Homo sapiens
tgtgtagctttcttctgtgggg

SEQ ID NO: 10015991 - DNA, 22 bp, Homo sapiens
cctgggcaacatagggagaccc

SEQ ID NO: 10015992 - DNA, 22 bp, Homo sapiens
cctgggcaacatagtgagaccc

SEQ ID NO: 10015993 - DNA, 22 bp, Homo sapiens
cctgggcaacatagtgagaccc

SEQ ID NO: 10015994 - DNA, 22 bp, Homo sapiens
cctgggcaacatagtgagacct

SEQ ID NO: 10015995 - DNA, 22 bp, Homo sapiens
cctgggcaacatagggagaccc

SEQ ID NO: 10015996 - DNA, 22 bp, Homo sapiens
cctgggcaaatgccagagacaa

SEQ ID NO: 10015997 - DNA, 22 bp, Homo sapiens
cctgggcaaatgccagagacaa

SEQ ID NO: 10015998 - DNA, 22 bp, Homo sapiens
tggggcagccacatagacaaca

SEQ ID NO: 10015999 - DNA, 22 bp, Homo sapiens
tggggcagctccatctattcca

SEQ ID NO: 10016000 - DNA, 22 bp, Homo sapiens
tggggcagtggcttttcaccct

SEQ ID NO: 10016001 - DNA, 22 bp, Homo sapiens
tggggcagggatgggaaactat

SEQ ID NO: 10016002 - DNA, 22 bp, Homo sapiens
tggggcagggatgggaaactat

SEQ ID NO: 10016003 - DNA, 23 bp, Homo sapiens
tggggccaagtgaggaagggtct

SEQ ID NO: 10016004 - DNA, 22 bp, Homo sapiens
tggggctgtccttagtctgaga

SEQ ID NO: 10016005 - DNA, 22 bp, Homo sapiens
tggggctgtccttagtctgaga

SEQ ID NO: 10016006 - DNA, 22 bp, Homo sapiens
tggggctgtgagactacaggat

SEQ ID NO: 10016007 - DNA, 22 bp, Homo sapiens
tggggctgtgagactacaggat

SEQ ID NO: 10016008 - DNA, 22 bp, Homo sapiens
tggggctgtgagactacaggat

SEQ ID NO: 10016009 - DNA, 22 bp, Homo sapiens
tggggctgtggattctcacgaa

SEQ ID NO: 10016010 - DNA, 22 bp, Homo sapiens
cctgggagtggcactcacagca

SEQ ID NO: 10016011 - DNA, 22 bp, Homo sapiens
cctgggagtggcactcacagca

SEQ ID NO: 10016012 - DNA, 22 bp, Homo sapiens
cctgggagtggcactcacagca

SEQ ID NO: 10016013 - DNA, 19 bp, Homo sapiens
cctgggagtcagctgaagg

SEQ ID NO: 10016014 - DNA, 19 bp, Homo sapiens
cctgggagtcagctgaagg

SEQ ID NO: 10016015 - DNA, 22 bp, Homo sapiens
cctgggagtgcacaggtttcgt

SEQ ID NO: 10016016 - DNA, 22 bp, Homo sapiens
cctgggagtgtgccatctctgt

SEQ ID NO: 10016017 - DNA, 19 bp, Homo sapiens
cctgggagtcagctgaagg

SEQ ID NO: 10016018 - DNA, 21 bp, Homo sapiens
tgggggagaattggttgcttt

SEQ ID NO: 10016019 - DNA, 22 bp, Homo sapiens
cctgggaggctgaggctgcagt

SEQ ID NO: 10016020 - DNA, 22 bp, Homo sapiens
tgggggaactgttgcgcgcggg

SEQ ID NO: 10016021 - DNA, 22 bp, Homo sapiens
tgggggacaccagtctctctct

SEQ ID NO: 10016022 - DNA, 22 bp, Homo sapiens
tgggggaagagcttgttaaagt

SEQ ID NO: 10016023 - DNA, 22 bp, Homo sapiens
tgggggactgcactggcgtcag

SEQ ID NO: 10016024 - DNA, 22 bp, Homo sapiens
tgggggactgcactggcgtcag

SEQ ID NO: 10016025 - DNA, 22 bp, Homo sapiens
cctgggctggagtacagcagtg

SEQ ID NO: 10016026 - DNA, 22 bp, Homo sapiens
cctgggctggagtacagcagtg

SEQ ID NO: 10016027 - DNA, 22 bp, Homo sapiens
cctgggctgcatgatggcattt

SEQ ID NO: 10016028 - DNA, 22 bp, Homo sapiens
cctgggctgctcatggggatga

SEQ ID NO: 10016029 - DNA, 22 bp, Homo sapiens
cctgggctgctcatggggatga

SEQ ID NO: 10016030 - DNA, 16 bp, Homo sapiens
cctgggctctgttgga

SEQ ID NO: 10016031 - DNA, 22 bp, Homo sapiens
cctgggctgcatgatggcattt

SEQ ID NO: 10016032 - DNA, 22 bp, Homo sapiens
tgtgtctggataggtaatggat

SEQ ID NO: 10016033 - DNA, 22 bp, Homo sapiens
tgtgtctgcccttagtacatct

SEQ ID NO: 10016034 - DNA, 22 bp, Homo sapiens
tgtgtctggaccggggaggagc

SEQ ID NO: 10016035 - DNA, 22 bp, Homo sapiens
cctgggctcaagtgatcctcct

SEQ ID NO: 10016036 - DNA, 22 bp, Homo sapiens
cctgggctctatcctgacccag

SEQ ID NO: 10016037 - DNA, 22 bp, Homo sapiens
cctgggctctatcctgacccag

SEQ ID NO: 10016038 - DNA, 22 bp, Homo sapiens
cctgggctctgaggagggagtc

SEQ ID NO: 10016039 - DNA, 22 bp, Homo sapiens
cctgggctctgaggagggagtc

SEQ ID NO: 10016040 - DNA, 22 bp, Homo sapiens
cctgggctgttgcatcatcctt

SEQ ID NO: 10016041 - DNA, 22 bp, Homo sapiens
cctgggctgttgcatcatcctt

SEQ ID NO: 10016042 - DNA, 22 bp, Homo sapiens
tgttacaaggaagaatgtaggt

SEQ ID NO: 10016043 - DNA, 22 bp, Homo sapiens
tgttacaagtcttgaggtactt

SEQ ID NO: 10016044 - DNA, 22 bp, Homo sapiens
tgttacaaactgttgtttctat

SEQ ID NO: 10016045 - DNA, 17 bp, Homo sapiens
tgttaattccaatgata

SEQ ID NO: 10016046 - DNA, 22 bp, Homo sapiens
tgttaatggctgaagacatcct

SEQ ID NO: 10016047 - DNA, 17 bp, Homo sapiens
tgttaattccaatgata

SEQ ID NO: 10016048 - DNA, 22 bp, Homo sapiens
tgttaagttgccagtgtatgac

SEQ ID NO: 10016049 - DNA, 22 bp, Homo sapiens
tgttaagttgccagtgtatgac

SEQ ID NO: 10016050 - DNA, 22 bp, Homo sapiens
tgttaatatactaaaatccact

SEQ ID NO: 10016051 - DNA, 22 bp, Homo sapiens
tgttaatcaatcaacagtatta

SEQ ID NO: 10016052 - DNA, 22 bp, Homo sapiens
tgttaatatactaaaatccact

SEQ ID NO: 10016053 - DNA, 22 bp, Homo sapiens
tgttaatatactaaaatccact

SEQ ID NO: 10016054 - DNA, 22 bp, Homo sapiens
cctgggtgtcatgggcagctgg

SEQ ID NO: 10016055 - DNA, 22 bp, Homo sapiens
cctggtgcttaccagagctttt

SEQ ID NO: 10016056 - DNA, 22 bp, Homo sapiens
cctggtggcttctgggtggacg

SEQ ID NO: 10016057 - DNA, 22 bp, Homo sapiens
cctggtggagaggggcggagcg

SEQ ID NO: 10016058 - DNA, 22 bp, Homo sapiens
tgtttacttaaatgttttcata

SEQ ID NO: 10016059 - DNA, 22 bp, Homo sapiens
cctggtgttgtgaagtagccgt

SEQ ID NO: 10016060 - DNA, 22 bp, Homo sapiens
tgttccagaggcagagatagga

SEQ ID NO: 10016061 - DNA, 22 bp, Homo sapiens
tgttccagggcgcgaaggtggt

SEQ ID NO: 10016062 - DNA, 20 bp, Homo sapiens
tgttccaggaggccagggct

SEQ ID NO: 10016063 - DNA, 22 bp, Homo sapiens
tgttccagatttagccaaccga

SEQ ID NO: 10016064 - DNA, 22 bp, Homo sapiens
tgttcattcgctattgtctatg

SEQ ID NO: 10016065 - DNA, 22 bp, Homo sapiens
tgttcattccggggagggctaa

SEQ ID NO: 10016066 - DNA, 22 bp, Homo sapiens
tgttcattcaacatgtcatcta

SEQ ID NO: 10016067 - DNA, 22 bp, Homo sapiens
tgttcattattcttcatctgcc

SEQ ID NO: 10016068 - DNA, 22 bp, Homo sapiens
tgttcattctgtatatgctgta

SEQ ID NO: 10016069 - DNA, 22 bp, Homo sapiens
tgttcattctgtgacctggttc

SEQ ID NO: 10016070 - DNA, 22 bp, Homo sapiens
tgttcattgccccctgtgtaaa

SEQ ID NO: 10016071 - DNA, 22 bp, Homo sapiens
tgttcatttgcaacaaccaaat

SEQ ID NO: 10016072 - DNA, 22 bp, Homo sapiens
tgttcatttggcccttttgtat

SEQ ID NO: 10016073 - DNA, 22 bp, Homo sapiens
tgttcattttgaagtacttcaa

SEQ ID NO: 10016074 - DNA, 22 bp, Homo sapiens
tgttcattttgaagtacttcaa

SEQ ID NO: 10016075 - DNA, 22 bp, Homo sapiens
tgttacagtactacaattctgc

SEQ ID NO: 10016076 - DNA, 22 bp, Homo sapiens
tgttacaagtcttgaggtactt

SEQ ID NO: 10016077 - DNA, 22 bp, Homo sapiens
tgttacaatattatcaactgag

SEQ ID NO: 10016078 - DNA, 22 bp, Homo sapiens
tgttcagttaacacagacacca

SEQ ID NO: 10016079 - DNA, 19 bp, Homo sapiens
tgttcagatatgtcagctt

SEQ ID NO: 10016080 - DNA, 22 bp, Homo sapiens
tgttcattaaactactgtgtgg

SEQ ID NO: 10016081 - DNA, 22 bp, Homo sapiens
tgttcattacccatcccaggtc

SEQ ID NO: 10016082 - DNA, 22 bp, Homo sapiens
tgttcattagtggaagtaagtt

SEQ ID NO: 10016083 - DNA, 22 bp, Homo sapiens
tgttcattactgctgtttgcca

SEQ ID NO: 10016084 - DNA, 22 bp, Homo sapiens
tgttcatattcctgtccgctga

SEQ ID NO: 10016085 - DNA, 22 bp, Homo sapiens
ccttcatgatggaaagggttca

SEQ ID NO: 10016086 - DNA, 22 bp, Homo sapiens
ccttcatgtcattggacacctt

SEQ ID NO: 10016087 - DNA, 22 bp, Homo sapiens
ccttccccaggtgctcactgtc

SEQ ID NO: 10016088 - DNA, 22 bp, Homo sapiens
ccttccccagtgattctctcag

SEQ ID NO: 10016089 - DNA, 22 bp, Homo sapiens
ccttcccatgcagcctgtctga

SEQ ID NO: 10016090 - DNA, 20 bp, Homo sapiens
ccttccccacccgctgaggt

SEQ ID NO: 10016091 - DNA, 22 bp, Homo sapiens
ccttccccaggtgctcactgtc

SEQ ID NO: 10016092 - DNA, 20 bp, Homo sapiens
ccttccccacccgctgaggt

SEQ ID NO: 10016093 - DNA, 22 bp, Homo sapiens
ccttccccaggtgctcactgtc

SEQ ID NO: 10016094 - DNA, 19 bp, Homo sapiens
ccttccccttcagcctctg

SEQ ID NO: 10016095 - DNA, 19 bp, Homo sapiens
ccttccccttcagcctctg

SEQ ID NO: 10016096 - DNA, 17 bp, Homo sapiens
ccttcctcatctccttc

SEQ ID NO: 10016097 - DNA, 19 bp, Homo sapiens
ccttcctccccagggccat

SEQ ID NO: 10016098 - DNA, 22 bp, Homo sapiens
cctgtgtcctaatccatcaggc

SEQ ID NO: 10016099 - DNA, 22 bp, Homo sapiens
cctgtgtcctaatccatcaggc

SEQ ID NO: 10016100 - DNA, 22 bp, Homo sapiens
cctgtgtccttggcagatatcc

SEQ ID NO: 10016101 - DNA, 23 bp, Homo sapiens
cctgtgtctgttgctgaataatg

SEQ ID NO: 10016102 - DNA, 22 bp, Homo sapiens
cctgtgtcttccccactggtgt

SEQ ID NO: 10016103 - DNA, 22 bp, Homo sapiens
cctgtgtgcacacgaggccatg

SEQ ID NO: 10016104 - DNA, 22 bp, Homo sapiens
cctgtgtgcacacgaggccatg

SEQ ID NO: 10016105 - DNA, 22 bp, Homo sapiens
cctgtgtgcacacgaggccatg

SEQ ID NO: 10016106 - DNA, 22 bp, Homo sapiens
cctgtgtggaaaccgcatgacg

SEQ ID NO: 10016107 - DNA, 22 bp, Homo sapiens
cctgtgtgctgatgacgacaga

SEQ ID NO: 10016108 - DNA, 23 bp, Homo sapiens
cctgtgtgcccttaattcacagc

SEQ ID NO: 10016109 - DNA, 20 bp, Homo sapiens
cctgtgtggccagctgaggc

SEQ ID NO: 10016110 - DNA, 22 bp, Homo sapiens
cctgtgtggccaggctggagtc

SEQ ID NO: 10016111 - DNA, 20 bp, Homo sapiens
cctgtgtggccagctgaggc

SEQ ID NO: 10016112 - DNA, 19 bp, Homo sapiens
cctgtgtggggtagagatc

SEQ ID NO: 10016113 - DNA, 22 bp, Homo sapiens
cctgtgtggccaggctggagtc

SEQ ID NO: 10016114 - DNA, 22 bp, Homo sapiens
cctgtgtggccgcactgctccc

SEQ ID NO: 10016115 - DNA, 21 bp, Homo sapiens
cctgtgtgtctgactgggcta

SEQ ID NO: 10016116 - DNA, 22 bp, Homo sapiens
cctgtgtgtaggccaggggagt

SEQ ID NO: 10016117 - DNA, 22 bp, Homo sapiens
cctgtgtgtaggccaggggagt

SEQ ID NO: 10016118 - DNA, 20 bp, Homo sapiens
cctgtgtggtttgcactaca

SEQ ID NO: 10016119 - DNA, 22 bp, Homo sapiens
cctgtgtggtagccagcggtgc

SEQ ID NO: 10016120 - DNA, 22 bp, Homo sapiens
ttagaaaaaacgtcttctagtg

SEQ ID NO: 10016121 - DNA, 22 bp, Homo sapiens
ttacttttgcaccaaactaata

SEQ ID NO: 10016122 - DNA, 22 bp, Homo sapiens
ttacttttgcaccaaactaata

SEQ ID NO: 10016123 - DNA, 21 bp, Homo sapiens
ttactaaacaaaacatgcagg

SEQ ID NO: 10016124 - DNA, 21 bp, Homo sapiens
ttactaaacaaaacatgcagg

SEQ ID NO: 10016125 - DNA, 22 bp, Homo sapiens
ccttctagcaaatcaacataaa

SEQ ID NO: 10016126 - DNA, 22 bp, Homo sapiens
ccttctagcctgcgccagggca

SEQ ID NO: 10016127 - DNA, 22 bp, Homo sapiens
ccttctcagccccagctcccgc

SEQ ID NO: 10016128 - DNA, 22 bp, Homo sapiens
ccttcctttgcaggtcaggtca

SEQ ID NO: 10016129 - DNA, 22 bp, Homo sapiens
ccttcctttcagggctatgcct

SEQ ID NO: 10016130 - DNA, 22 bp, Homo sapiens
ccttccttgtctacaaaagctc

SEQ ID NO: 10016131 - DNA, 22 bp, Homo sapiens
ccttccttgtctacaaaagctc

SEQ ID NO: 10016132 - DNA, 22 bp, Homo sapiens
ccttccttgagaagcaattcct

SEQ ID NO: 10016133 - DNA, 22 bp, Homo sapiens
ttagacaagggctccttaaaag

SEQ ID NO: 10016134 - DNA, 22 bp, Homo sapiens
ttagaatttctgctcactttga

SEQ ID NO: 10016135 - DNA, 22 bp, Homo sapiens
cctttacatctgacttctttca

SEQ ID NO: 10016136 - DNA, 20 bp, Homo sapiens
cctttagaaactcatatgta

SEQ ID NO: 10016137 - DNA, 22 bp, Homo sapiens
cctttacagtatggttgtatca

SEQ ID NO: 10016138 - DNA, 22 bp, Homo sapiens
ttagaatcagaagagaggtatt

SEQ ID NO: 10016139 - DNA, 22 bp, Homo sapiens
ttagaatcagaagagaggtatt

SEQ ID NO: 10016140 - DNA, 22 bp, Homo sapiens
ttagaagttcaggtctgtaatc

SEQ ID NO: 10016141 - DNA, 22 bp, Homo sapiens
ttagaagtgggcctatagtcct

SEQ ID NO: 10016142 - DNA, 22 bp, Homo sapiens
ttagaagtggtaagtagaaaga

SEQ ID NO: 10016143 - DNA, 22 bp, Homo sapiens
ttagaatctaacattcttatct

SEQ ID NO: 10016144 - DNA, 22 bp, Homo sapiens
ttagaatctttagagtctcact

SEQ ID NO: 10016145 - DNA, 22 bp, Homo sapiens
ttagaatcttgtatcagaagtt

SEQ ID NO: 10016146 - DNA, 22 bp, Homo sapiens
ttagaatccatggttgcagtgg

SEQ ID NO: 10016147 - DNA, 22 bp, Homo sapiens
ttagaatcaggtgttataatca

SEQ ID NO: 10016148 - DNA, 22 bp, Homo sapiens
ttagaaaaaggctgtggtctta

SEQ ID NO: 10016149 - DNA, 22 bp, Homo sapiens
ttagaaaaaggctgtggtctta

SEQ ID NO: 10016150 - DNA, 22 bp, Homo sapiens
ttagaaaaaggctgtggtctta

SEQ ID NO: 10016151 - DNA, 22 bp, Homo sapiens
ttagaaaaatgttcagtagttt

SEQ ID NO: 10016152 - DNA, 22 bp, Homo sapiens
ttagaaaaatgttcagtagttt

SEQ ID NO: 10016153 - DNA, 22 bp, Homo sapiens
ttagaaaatggaggtgggaggg

SEQ ID NO: 10016154 - DNA, 22 bp, Homo sapiens
ttagaagtacatttagaacata

SEQ ID NO: 10016155 - DNA, 22 bp, Homo sapiens
ttagaagtcatctagtctaaaa

SEQ ID NO: 10016156 - DNA, 18 bp, Homo sapiens
cctgtctggggtccccac

SEQ ID NO: 10016157 - DNA, 22 bp, Homo sapiens
cctgtctgtcctctcatgagcc

SEQ ID NO: 10016158 - DNA, 22 bp, Homo sapiens
cctgtctggccaccagggcgat

SEQ ID NO: 10016159 - DNA, 20 bp, Homo sapiens
cctgtctggagacaaagaga

SEQ ID NO: 10016160 - DNA, 22 bp, Homo sapiens
cctgtctgggcttgagtattta

SEQ ID NO: 10016161 - DNA, 23 bp, Homo sapiens
cctgtctgtgctgggtggacaca

SEQ ID NO: 10016162 - DNA, 22 bp, Homo sapiens
cctgtgccatcctgagcatccc

SEQ ID NO: 10016163 - DNA, 21 bp, Homo sapiens
cctgtgccagtctatgtgttc

SEQ ID NO: 10016164 - DNA, 22 bp, Homo sapiens
cctgtctgaaggcagggggatg

SEQ ID NO: 10016165 - DNA, 22 bp, Homo sapiens
cctgtctgcatgagtgagcata

SEQ ID NO: 10016166 - DNA, 22 bp, Homo sapiens
cctgtctggaacatggcctgtt

SEQ ID NO: 10016167 - DNA, 22 bp, Homo sapiens
cctgtctgcggaggagtggaag

SEQ ID NO: 10016168 - DNA, 22 bp, Homo sapiens
cctgtcagatgaagtaattgtg

SEQ ID NO: 10016169 - DNA, 22 bp, Homo sapiens
cctgtcactctgagccgctccg

SEQ ID NO: 10016170 - DNA, 22 bp, Homo sapiens
cctgtcactgttgcagccagct

SEQ ID NO: 10016171 - DNA, 22 bp, Homo sapiens
tgtttataaattttcttgccat

SEQ ID NO: 10016172 - DNA, 22 bp, Homo sapiens
cctgtctctgttaccacatttg

SEQ ID NO: 10016173 - DNA, 22 bp, Homo sapiens
cctgtctctttcaatctgagag

SEQ ID NO: 10016174 - DNA, 22 bp, Homo sapiens
tgtttagaggaactggaatcag

SEQ ID NO: 10016175 - DNA, 22 bp, Homo sapiens
tgtttagaggaactggaatcag

SEQ ID NO: 10016176 - DNA, 22 bp, Homo sapiens
tgtttagcataaagattttcca

SEQ ID NO: 10016177 - DNA, 22 bp, Homo sapiens
tgtttagaatcattcaaaagtt

SEQ ID NO: 10016178 - DNA, 22 bp, Homo sapiens
tgtttacttgaggtggaaacaa

SEQ ID NO: 10016179 - DNA, 21 bp, Homo sapiens
cctgtgctccacacagggtcc

SEQ ID NO: 10016180 - DNA, 21 bp, Homo sapiens
cctgtgctatcagcttgggtt

SEQ ID NO: 10016181 - DNA, 22 bp, Homo sapiens
cctgtgccctacacctttccag

SEQ ID NO: 10016182 - DNA, 22 bp, Homo sapiens
cctgtgccatcctgagcatccc

SEQ ID NO: 10016183 - DNA, 22 bp, Homo sapiens
cctgtgccctctgcatagcagc

SEQ ID NO: 10016184 - DNA, 22 bp, Homo sapiens
cctgtgccctgccaggctggtg

SEQ ID NO: 10016185 - DNA, 22 bp, Homo sapiens
cctgtgcctgcctgtgagttct

SEQ ID NO: 10016186 - DNA, 22 bp, Homo sapiens
ttaaaggcatggttagacatgg

SEQ ID NO: 10016187 - DNA, 22 bp, Homo sapiens
ttaaagcttgattcgaagctta

SEQ ID NO: 10016188 - DNA, 22 bp, Homo sapiens
ttaaaggaattgagtttcttgt

SEQ ID NO: 10016189 - DNA, 22 bp, Homo sapiens
ttaaagcttgattcgaagctta

SEQ ID NO: 10016190 - DNA, 22 bp, Homo sapiens
ttaaagctgtagagttacttgc

SEQ ID NO: 10016191 - DNA, 22 bp, Homo sapiens
ttaaagctgtagagttacttgc

SEQ ID NO: 10016192 - DNA, 22 bp, Homo sapiens
ttaaagctgagccctcagaagc

SEQ ID NO: 10016193 - DNA, 22 bp, Homo sapiens
ttaaagctgctgaatcctattt

SEQ ID NO: 10016194 - DNA, 22 bp, Homo sapiens
cctgtgctgggtgtgagggaca

SEQ ID NO: 10016195 - DNA, 22 bp, Homo sapiens
cctgtgctggacagggctgggc

SEQ ID NO: 10016196 - DNA, 22 bp, Homo sapiens
cctgtgctgggtgtgagggaca

SEQ ID NO: 10016197 - DNA, 22 bp, Homo sapiens
ttaaagctaggtggaacaaatt

SEQ ID NO: 10016198 - DNA, 21 bp, Homo sapiens
cctgtggtctggagggagcac

SEQ ID NO: 10016199 - DNA, 22 bp, Homo sapiens
cctgtgtcaccggaacggagga

SEQ ID NO: 10016200 - DNA, 22 bp, Homo sapiens
cctgtgtcagcccctgcctcca

SEQ ID NO: 10016201 - DNA, 22 bp, Homo sapiens
cctgtgtcagcccctgcctcca

SEQ ID NO: 10016202 - DNA, 22 bp, Homo sapiens
cctgtgtccagttccaggttgt

SEQ ID NO: 10016203 - DNA, 22 bp, Homo sapiens
ttaaagtatggtttaagggctt

SEQ ID NO: 10016204 - DNA, 22 bp, Homo sapiens
ttaaagtatagaggacaaaaac

SEQ ID NO: 10016205 - DNA, 22 bp, Homo sapiens
ttaaagtaatctgtgtgaattt

SEQ ID NO: 10016206 - DNA, 22 bp, Homo sapiens
ttaaaggctgatcttaatatta

SEQ ID NO: 10016207 - DNA, 22 bp, Homo sapiens
ctacccaggctggagtgcagta

SEQ ID NO: 10016208 - DNA, 22 bp, Homo sapiens
ttcctgggctgcagagagcacc

SEQ ID NO: 10016209 - DNA, 22 bp, Homo sapiens
ctaccctgtatttagagatgca

SEQ ID NO: 10016210 - DNA, 22 bp, Homo sapiens
ctacccaggcttagagggctgg

SEQ ID NO: 10016211 - DNA, 16 bp, Homo sapiens
ctacccagtgagaagg

SEQ ID NO: 10016212 - DNA, 22 bp, Homo sapiens
ctacccaggctggagtgcagta

SEQ ID NO: 10016213 - DNA, 22 bp, Homo sapiens
ctacccaggctggagtgcagta

SEQ ID NO: 10016214 - DNA, 22 bp, Homo sapiens
ctacccttaagtttctgtgggg

SEQ ID NO: 10016215 - DNA, 22 bp, Homo sapiens
ctacccttaagtttctgtgggg

SEQ ID NO: 10016216 - DNA, 22 bp, Homo sapiens
ctaccttactttaaccctgcaa

SEQ ID NO: 10016217 - DNA, 22 bp, Homo sapiens
ctactctcccatgattctctgt

SEQ ID NO: 10016218 - DNA, 22 bp, Homo sapiens
ctaccttcaagttcctccctct

SEQ ID NO: 10016219 - DNA, 22 bp, Homo sapiens
ctaccttatcagagtggtaagg

SEQ ID NO: 10016220 - DNA, 22 bp, Homo sapiens
ctaccttcaagttcctccctct

SEQ ID NO: 10016221 - DNA, 22 bp, Homo sapiens
ctactgagtccttcagctgcca

SEQ ID NO: 10016222 - DNA, 22 bp, Homo sapiens
ctactcttttgagtcttcagat

SEQ ID NO: 10016223 - DNA, 22 bp, Homo sapiens
ttctctggagggctgcccggcc

SEQ ID NO: 10016224 - DNA, 22 bp, Homo sapiens
ttctctaaacatattggatctg

SEQ ID NO: 10016225 - DNA, 22 bp, Homo sapiens
ctagaaacattacatgtgttaa

SEQ ID NO: 10016226 - DNA, 22 bp, Homo sapiens
ctagaaacgcctttagcacaac

SEQ ID NO: 10016227 - DNA, 22 bp, Homo sapiens
ctagaaactccatctcactaca

SEQ ID NO: 10016228 - DNA, 22 bp, Homo sapiens
ctacttctgtgatgaaactaca

SEQ ID NO: 10016229 - DNA, 21 bp, Homo sapiens
ctacttaagtaggggattagg

SEQ ID NO: 10016230 - DNA, 22 bp, Homo sapiens
ttccaggactgggtgtttgaag

SEQ ID NO: 10016231 - DNA, 22 bp, Homo sapiens
ttccaggagacttccagaaata

SEQ ID NO: 10016232 - DNA, 22 bp, Homo sapiens
ttccaggagccacacaggggcg

SEQ ID NO: 10016233 - DNA, 22 bp, Homo sapiens
ttccaggacaagatgtttcagg

SEQ ID NO: 10016234 - DNA, 22 bp, Homo sapiens
ctacagagaactcagctgccct

SEQ ID NO: 10016235 - DNA, 22 bp, Homo sapiens
ctacagagaattgtgtgatttt

SEQ ID NO: 10016236 - DNA, 22 bp, Homo sapiens
ctacagaggacacaaagatctt

SEQ ID NO: 10016237 - DNA, 22 bp, Homo sapiens
ctacagaggacacaaagatctt

SEQ ID NO: 10016238 - DNA, 22 bp, Homo sapiens
ctacagagtatctaaagaggta

SEQ ID NO: 10016239 - DNA, 21 bp, Homo sapiens
ctacagaggagagggaaaggc

SEQ ID NO: 10016240 - DNA, 22 bp, Homo sapiens
ttccaggatggcaataatgaat

SEQ ID NO: 10016241 - DNA, 22 bp, Homo sapiens
ctacaacatagtcttctacaga

SEQ ID NO: 10016242 - DNA, 22 bp, Homo sapiens
ctacaacaccaggcacggagtg

SEQ ID NO: 10016243 - DNA, 22 bp, Homo sapiens
ctacaacatagtcttctacaga

SEQ ID NO: 10016244 - DNA, 22 bp, Homo sapiens
ctacaacatagtcttctacaga

SEQ ID NO: 10016245 - DNA, 22 bp, Homo sapiens
ttccaggatgctgctgcttttt

SEQ ID NO: 10016246 - DNA, 22 bp, Homo sapiens
ttccaggaggaggtactagagg

SEQ ID NO: 10016247 - DNA, 22 bp, Homo sapiens
ttccaggaggcactgacagagg

SEQ ID NO: 10016248 - DNA, 22 bp, Homo sapiens
ttccaggaggcattcttagttt

SEQ ID NO: 10016249 - DNA, 22 bp, Homo sapiens
ctacagagtatctaaagaggta

SEQ ID NO: 10016250 - DNA, 21 bp, Homo sapiens
ctacagaggagagggaaaggc

SEQ ID NO: 10016251 - DNA, 22 bp, Homo sapiens
ctacagcagagaccagccacat

SEQ ID NO: 10016252 - DNA, 22 bp, Homo sapiens
ctacagcagagctacactaact

SEQ ID NO: 10016253 - DNA, 22 bp, Homo sapiens
ctacagctgtgtgtttatgtgc

SEQ ID NO: 10016254 - DNA, 22 bp, Homo sapiens
ctacagtagagaggatgtagaa

SEQ ID NO: 10016255 - DNA, 22 bp, Homo sapiens
ctacagtactggatgctcagcc

SEQ ID NO: 10016256 - DNA, 22 bp, Homo sapiens
ctacagtagagtaggcctctga

SEQ ID NO: 10016257 - DNA, 22 bp, Homo sapiens
ctacaggctcagggagccctct

SEQ ID NO: 10016258 - DNA, 22 bp, Homo sapiens
ctacaggctcagggagccctct

SEQ ID NO: 10016259 - DNA, 20 bp, Homo sapiens
ttcctggctctaggaccttg

SEQ ID NO: 10016260 - DNA, 22 bp, Homo sapiens
ctacagtatgaaacctttactc

SEQ ID NO: 10016261 - DNA, 22 bp, Homo sapiens
ctacagtagaggttgtcaggga

SEQ ID NO: 10016262 - DNA, 22 bp, Homo sapiens
ttcctggctcacagcagtgggg

SEQ ID NO: 10016263 - DNA, 22 bp, Homo sapiens
ttcctgggactggagcagccca

SEQ ID NO: 10016264 - DNA, 22 bp, Homo sapiens
ttcctgggagctagccacatct

SEQ ID NO: 10016265 - DNA, 22 bp, Homo sapiens
ttcctggctgtcatgccctagt

SEQ ID NO: 10016266 - DNA, 22 bp, Homo sapiens
ttcctgggccttaaatcttttg

SEQ ID NO: 10016267 - DNA, 22 bp, Homo sapiens
ttcctgggctgcagagagcacc

SEQ ID NO: 10016268 - DNA, 22 bp, Homo sapiens
ttcctgggactggagcagccca

SEQ ID NO: 10016269 - DNA, 22 bp, Homo sapiens
ttcctgggaggctgtgtacttg

SEQ ID NO: 10016270 - DNA, 22 bp, Homo sapiens
ttcctgggattattgtcaagca

SEQ ID NO: 10016271 - DNA, 22 bp, Homo sapiens
ttcctgggaggctgtgtacttg

SEQ ID NO: 10016272 - DNA, 22 bp, Homo sapiens
ctattaaatactcttcaaattg

SEQ ID NO: 10016273 - DNA, 22 bp, Homo sapiens
ctattaaacactactgtgcact

SEQ ID NO: 10016274 - DNA, 22 bp, Homo sapiens
ctattaaacactactgtgcact

SEQ ID NO: 10016275 - DNA, 22 bp, Homo sapiens
ctatgtttatctgtatttctgt

SEQ ID NO: 10016276 - DNA, 22 bp, Homo sapiens
ctatgttctcggcactatggat

SEQ ID NO: 10016277 - DNA, 22 bp, Homo sapiens
ctattacaatctgctactatga

SEQ ID NO: 10016278 - DNA, 22 bp, Homo sapiens
ctattacaatctgctactatga

SEQ ID NO: 10016279 - DNA, 22 bp, Homo sapiens
ctattacaatctgctactatga

SEQ ID NO: 10016280 - DNA, 22 bp, Homo sapiens
ctattaaatactcttcaaattg

SEQ ID NO: 10016281 - DNA, 22 bp, Homo sapiens
ctatggtgatagaaatcagaat

SEQ ID NO: 10016282 - DNA, 22 bp, Homo sapiens
ctatgcagaatttagtgactta

SEQ ID NO: 10016283 - DNA, 22 bp, Homo sapiens
ctatatatatcatcttccagtt

SEQ ID NO: 10016284 - DNA, 22 bp, Homo sapiens
ctagcagcattcttctagttag

SEQ ID NO: 10016285 - DNA, 22 bp, Homo sapiens
ctagcagcattcttctagttag

SEQ ID NO: 10016286 - DNA, 22 bp, Homo sapiens
ctagcagctctgatatttacaa

SEQ ID NO: 10016287 - DNA, 21 bp, Homo sapiens
ctagcacgattccaagtaata

SEQ ID NO: 10016288 - DNA, 22 bp, Homo sapiens
ctagcagcatcacaggaagact

SEQ ID NO: 10016289 - DNA, 22 bp, Homo sapiens
ctagcagcatcacaggaagact

SEQ ID NO: 10016290 - DNA, 22 bp, Homo sapiens
ctagcagcatcacaggaagact

SEQ ID NO: 10016291 - DNA, 22 bp, Homo sapiens
ctagcagctctgatatttacaa

SEQ ID NO: 10016292 - DNA, 22 bp, Homo sapiens
ctagcagcattcttctagttag

SEQ ID NO: 10016293 - DNA, 22 bp, Homo sapiens
ctagcaggctaatgtaagcttg

SEQ ID NO: 10016294 - DNA, 22 bp, Homo sapiens
ctagccagatttaaagagagac

SEQ ID NO: 10016295 - DNA, 22 bp, Homo sapiens
ctagccagatttaaagagagac

SEQ ID NO: 10016296 - DNA, 22 bp, Homo sapiens
ctatatacttttcacagatgtt

SEQ ID NO: 10016297 - DNA, 22 bp, Homo sapiens
ctatatacttttcacagatgtt

SEQ ID NO: 10016298 - DNA, 22 bp, Homo sapiens
ctagcagtgtactcaacaaggg

SEQ ID NO: 10016299 - DNA, 22 bp, Homo sapiens
ctagcatcagatgagaagctgt

SEQ ID NO: 10016300 - DNA, 22 bp, Homo sapiens
ctagcatcagatgagaagctgt

SEQ ID NO: 10016301 - DNA, 22 bp, Homo sapiens
ctagccagatgattcccaaata

SEQ ID NO: 10016302 - DNA, 22 bp, Homo sapiens
ctagccagactcaagggccacc

SEQ ID NO: 10016303 - DNA, 22 bp, Homo sapiens
ctagattcatatatttttggag

SEQ ID NO: 10016304 - DNA, 23 bp, Homo sapiens
ctagatgcaagctccatgaggga

SEQ ID NO: 10016305 - DNA, 22 bp, Homo sapiens
ctagcaagcctaccacgaaact

SEQ ID NO: 10016306 - DNA, 22 bp, Homo sapiens
ctagcacagtatggtatcagat

SEQ ID NO: 10016307 - DNA, 22 bp, Homo sapiens
ctcacaggagaaagtcatggtc

SEQ ID NO: 10016308 - DNA, 22 bp, Homo sapiens
ctcacaggagaaagtcatggtc

SEQ ID NO: 10016309 - DNA, 22 bp, Homo sapiens
ctcacaggcatctcatcaggct

SEQ ID NO: 10016310 - DNA, 21 bp, Homo sapiens
ctcacaggatgcagtgttact

SEQ ID NO: 10016311 - DNA, 22 bp, Homo sapiens
ctcacaggcatctcatcaggct

SEQ ID NO: 10016312 - DNA, 22 bp, Homo sapiens
ctcacagggttctatcgaagag

SEQ ID NO: 10016313 - DNA, 22 bp, Homo sapiens
ctcacaggcggtaattcaggga

SEQ ID NO: 10016314 - DNA, 22 bp, Homo sapiens
ctcacaggtaccagcaccctcc

SEQ ID NO: 10016315 - DNA, 22 bp, Homo sapiens
ctcacaggtaccagcaccctcc

SEQ ID NO: 10016316 - DNA, 22 bp, Homo sapiens
ctcacaggtcatgtggtggctt

SEQ ID NO: 10016317 - DNA, 22 bp, Homo sapiens
ctcacaggttagttgtgtggat

SEQ ID NO: 10016318 - DNA, 22 bp, Homo sapiens
ctcacaggtagaataacaacat

SEQ ID NO: 10016319 - DNA, 22 bp, Homo sapiens
ctcacaggtcatgtggtggctt

SEQ ID NO: 10016320 - DNA, 22 bp, Homo sapiens
ctcaatacccagggactctaga

SEQ ID NO: 10016321 - DNA, 22 bp, Homo sapiens
ctcaatatgccagaggggaaag

SEQ ID NO: 10016322 - DNA, 22 bp, Homo sapiens
ctcacacacgaagcccttggcc

SEQ ID NO: 10016323 - DNA, 22 bp, Homo sapiens
ctcacagatacggctattcctg

SEQ ID NO: 10016324 - DNA, 22 bp, Homo sapiens
ctcaaggacttattcatgcctg

SEQ ID NO: 10016325 - DNA, 22 bp, Homo sapiens
ctcaaggaaagtctggagaaga

SEQ ID NO: 10016326 - DNA, 22 bp, Homo sapiens
ctcaaggaaagtctggagaaga

SEQ ID NO: 10016327 - DNA, 22 bp, Homo sapiens
ctcaatatgccagaggggaaag

SEQ ID NO: 10016328 - DNA, 22 bp, Homo sapiens
ctcaagtttcatatttgtctag

SEQ ID NO: 10016329 - DNA, 22 bp, Homo sapiens
ctcaagttggcatgaacaaatt

SEQ ID NO: 10016330 - DNA, 22 bp, Homo sapiens
ctattattagcaaaaggtggat

SEQ ID NO: 10016331 - DNA, 22 bp, Homo sapiens
ctatttttctgtaccctaattt

SEQ ID NO: 10016332 - DNA, 22 bp, Homo sapiens
ctcaaaatccataaaatcaggt

SEQ ID NO: 10016333 - DNA, 22 bp, Homo sapiens
ctattagaaagcatcttctata

SEQ ID NO: 10016334 - DNA, 22 bp, Homo sapiens
ctattagacacaattagtgatt

SEQ ID NO: 10016335 - DNA, 22 bp, Homo sapiens
ctattagacacaattagtgatt

SEQ ID NO: 10016336 - DNA, 22 bp, Homo sapiens
ctattagaaagcatcttctata

SEQ ID NO: 10016337 - DNA, 22 bp, Homo sapiens
ttcagaggtgggctgagaggat

SEQ ID NO: 10016338 - DNA, 22 bp, Homo sapiens
ttcagaggttagagcagtggga

SEQ ID NO: 10016339 - DNA, 22 bp, Homo sapiens
ttcagaggtagagaggatcttg

SEQ ID NO: 10016340 - DNA, 20 bp, Homo sapiens
ttcagaggtgaagttgtggt

SEQ ID NO: 10016341 - DNA, 22 bp, Homo sapiens
ttcagaggctgtatgactagat

SEQ ID NO: 10016342 - DNA, 22 bp, Homo sapiens
ttcaggcccaacgcacagcttc

SEQ ID NO: 10016343 - DNA, 22 bp, Homo sapiens
ttcaggatcatttgttttatct

SEQ ID NO: 10016344 - DNA, 22 bp, Homo sapiens
ttcaggattatactctcttccc

SEQ ID NO: 10016345 - DNA, 22 bp, Homo sapiens
ttcaggagtgtcaggagtgcct

SEQ ID NO: 10016346 - DNA, 22 bp, Homo sapiens
ttcagggcagacagaagagatg

SEQ ID NO: 10016347 - DNA, 22 bp, Homo sapiens
cggtcaggtgcagcgttggcac

SEQ ID NO: 10016348 - DNA, 22 bp, Homo sapiens
ttcagggagagcgggacgggtg

SEQ ID NO: 10016349 - DNA, 22 bp, Homo sapiens
ttcagggagagcgggacgggtg

SEQ ID NO: 10016350 - DNA, 22 bp, Homo sapiens
ttcagggacttagtgtcagttt

SEQ ID NO: 10016351 - DNA, 22 bp, Homo sapiens
ttcagggactttgatgtatcag

SEQ ID NO: 10016352 - DNA, 22 bp, Homo sapiens
ttcaggcctctaaagggaaagc

SEQ ID NO: 10016353 - DNA, 22 bp, Homo sapiens
ttcaggcctaatttctagcccc

SEQ ID NO: 10016354 - DNA, 22 bp, Homo sapiens
ttcaggcccagcacagcgcgtg

SEQ ID NO: 10016355 - DNA, 22 bp, Homo sapiens
ttcaggcccaacgcacagcttc

SEQ ID NO: 10016356 - DNA, 22 bp, Homo sapiens
ctaaagatctacagaggctttt

SEQ ID NO: 10016357 - DNA, 22 bp, Homo sapiens
ctaaagtccttatcaagtgtaa

SEQ ID NO: 10016358 - DNA, 22 bp, Homo sapiens
ctaaagtgccaggaatacaggt

SEQ ID NO: 10016359 - DNA, 22 bp, Homo sapiens
ctaaataatccctctggtctta

SEQ ID NO: 10016360 - DNA, 22 bp, Homo sapiens
ctaaataatccctctggtctta

SEQ ID NO: 10016361 - DNA, 22 bp, Homo sapiens
ctaaataatccctctggtctta

SEQ ID NO: 10016362 - DNA, 17 bp, Homo sapiens
ctaaatacttgcgtttc

SEQ ID NO: 10016363 - DNA, 17 bp, Homo sapiens
ctaaatacttgcgtttc

SEQ ID NO: 10016364 - DNA, 17 bp, Homo sapiens
ctaaatacttgcgtttc

SEQ ID NO: 10016365 - DNA, 22 bp, Homo sapiens
ttcatgaatggaatcaatgctc

SEQ ID NO: 10016366 - DNA, 22 bp, Homo sapiens
ttcatgaatgttccatgtgagt

SEQ ID NO: 10016367 - DNA, 22 bp, Homo sapiens
ttcatgaatgttccatgtgagt

SEQ ID NO: 10016368 - DNA, 22 bp, Homo sapiens
ctaaaaatccacactaggtgaa

SEQ ID NO: 10016369 - DNA, 22 bp, Homo sapiens
ctaaaattacctaccagtttag

SEQ ID NO: 10016370 - DNA, 22 bp, Homo sapiens
ttcatgaagggtgaatatagtc

SEQ ID NO: 10016371 - DNA, 22 bp, Homo sapiens
ttcatgaataccccttctgtaa

SEQ ID NO: 10016372 - DNA, 22 bp, Homo sapiens
ttcatgaagggtgaatatagtc

SEQ ID NO: 10016373 - DNA, 22 bp, Homo sapiens
ttcatgaatatattgaattagc

SEQ ID NO: 10016374 - DNA, 22 bp, Homo sapiens
ttcatgaaagtgtatcttgtgg

SEQ ID NO: 10016375 - DNA, 22 bp, Homo sapiens
ttcatgaacgaacatatgtata

SEQ ID NO: 10016376 - DNA, 22 bp, Homo sapiens
ttcatgaacgaacatatgtata

SEQ ID NO: 10016377 - DNA, 22 bp, Homo sapiens
ttcatgaacgaacatatgtata

SEQ ID NO: 10016378 - DNA, 22 bp, Homo sapiens
ttcatgaaaaggtctatttctt

SEQ ID NO: 10016379 - DNA, 22 bp, Homo sapiens
ttcatgaaacttaactgttggg

SEQ ID NO: 10016380 - DNA, 22 bp, Homo sapiens
ttcatgaaacttaactgttggg

SEQ ID NO: 10016381 - DNA, 22 bp, Homo sapiens
ttcatctggaatttatgttata

SEQ ID NO: 10016382 - DNA, 22 bp, Homo sapiens
ttcatccatatgcagagagctt

SEQ ID NO: 10016383 - DNA, 21 bp, Homo sapiens
ttcatcattggtaaaaagtgg

SEQ ID NO: 10016384 - DNA, 22 bp, Homo sapiens
cgtatttagaaggctgctgaaa

SEQ ID NO: 10016385 - DNA, 22 bp, Homo sapiens
cgtatacatgaagacattgctg

SEQ ID NO: 10016386 - DNA, 22 bp, Homo sapiens
cgtatcaaagcaaaacatattt

SEQ ID NO: 10016387 - DNA, 22 bp, Homo sapiens
cgtatacatgaagacattgctg

SEQ ID NO: 10016388 - DNA, 22 bp, Homo sapiens
cgtcacttcttagtctattttc

SEQ ID NO: 10016389 - DNA, 22 bp, Homo sapiens
cgtcactggcgtgaagtgagga

SEQ ID NO: 10016390 - DNA, 22 bp, Homo sapiens
cggtctcccgtgtgtgtgcgct

SEQ ID NO: 10016391 - DNA, 19 bp, Homo sapiens
cggtccatccgattttaca

SEQ ID NO: 10016392 - DNA, 22 bp, Homo sapiens
cctttctctggcagcaggacag

SEQ ID NO: 10016393 - DNA, 22 bp, Homo sapiens
cctttctctggcagcaggacag

SEQ ID NO: 10016394 - DNA, 22 bp, Homo sapiens
cctttctcttggataccgattg

SEQ ID NO: 10016395 - DNA, 17 bp, Homo sapiens
cctttctctttcatctc

SEQ ID NO: 10016396 - DNA, 17 bp, Homo sapiens
cctttctctttcatctc

SEQ ID NO: 10016397 - DNA, 22 bp, Homo sapiens
cctttctctttgctgatcatgt

SEQ ID NO: 10016398 - DNA, 22 bp, Homo sapiens
ttaggaaggccttgaatgccag

SEQ ID NO: 10016399 - DNA, 22 bp, Homo sapiens
ttaggaaggacttggattctgg

SEQ ID NO: 10016400 - DNA, 20 bp, Homo sapiens
ttaggaagtcacaatttcag

SEQ ID NO: 10016401 - DNA, 22 bp, Homo sapiens
ttaggaagttatagtggaaatg

SEQ ID NO: 10016402 - DNA, 22 bp, Homo sapiens
ttaggaagtgtgtccagaagcg

SEQ ID NO: 10016403 - DNA, 20 bp, Homo sapiens
ttaggaagtcacaatttcag

SEQ ID NO: 10016404 - DNA, 22 bp, Homo sapiens
ttaggaatatagactaagtaga

SEQ ID NO: 10016405 - DNA, 22 bp, Homo sapiens
ttaggaatattttctgagtagt

SEQ ID NO: 10016406 - DNA, 18 bp, Homo sapiens
ttaggaagtttctccgtc

SEQ ID NO: 10016407 - DNA, 22 bp, Homo sapiens
ttaggaagtttcagaaaatgca

SEQ ID NO: 10016408 - DNA, 22 bp, Homo sapiens
ttaggaatatagactaagtaga

SEQ ID NO: 10016409 - DNA, 22 bp, Homo sapiens
ttaggaatttatcacagactgg

SEQ ID NO: 10016410 - DNA, 22 bp, Homo sapiens
ttaggaatcacctgcagatctt

SEQ ID NO: 10016411 - DNA, 22 bp, Homo sapiens
ttaggaatgagatttctagtga

SEQ ID NO: 10016412 - DNA, 22 bp, Homo sapiens
cctttctctatcgacccatcgc

SEQ ID NO: 10016413 - DNA, 16 bp, Homo sapiens
cctttctctgccttcc

SEQ ID NO: 10016414 - DNA, 22 bp, Homo sapiens
cctttcctgcctcaggaagtag

SEQ ID NO: 10016415 - DNA, 22 bp, Homo sapiens
cctttctcattttaagcattag

SEQ ID NO: 10016416 - DNA, 22 bp, Homo sapiens
cctttcccgctttgagggcaag

SEQ ID NO: 10016417 - DNA, 22 bp, Homo sapiens
cctttccccgcgggaggtgcca

SEQ ID NO: 10016418 - DNA, 22 bp, Homo sapiens
ttaggcctttgattggggtgct

SEQ ID NO: 10016419 - DNA, 22 bp, Homo sapiens
cgcagctgcacggggctgagcc

SEQ ID NO: 10016420 - DNA, 22 bp, Homo sapiens
cgcagctgccttgtcagccgtt

SEQ ID NO: 10016421 - DNA, 22 bp, Homo sapiens
ttaggcaaagatattacgtagt

SEQ ID NO: 10016422 - DNA, 22 bp, Homo sapiens
ttaggcaaagctggaatccagg

SEQ ID NO: 10016423 - DNA, 22 bp, Homo sapiens
ttaggatttgaaaaggggcaga

SEQ ID NO: 10016424 - DNA, 22 bp, Homo sapiens
ttaggcaatttgatttttcaag

SEQ ID NO: 10016425 - DNA, 22 bp, Homo sapiens
ttaggcaatatcattggagttg

SEQ ID NO: 10016426 - DNA, 22 bp, Homo sapiens
ttaggcaattttgtcattgtgt

SEQ ID NO: 10016427 - DNA, 22 bp, Homo sapiens
ttaggcaaataaaatgtttcca

SEQ ID NO: 10016428 - DNA, 22 bp, Homo sapiens
ttaggcaatgaattattccaag

SEQ ID NO: 10016429 - DNA, 22 bp, Homo sapiens
ttaggcaatgctctcaaatttg

SEQ ID NO: 10016430 - DNA, 22 bp, Homo sapiens
cgcagtgagtctgtaaaaggct

SEQ ID NO: 10016431 - DNA, 22 bp, Homo sapiens
cgcagctggatatcatgtgcct

SEQ ID NO: 10016432 - DNA, 22 bp, Homo sapiens
cgcagctgctgctctgaaacag

SEQ ID NO: 10016433 - DNA, 23 bp, Homo sapiens
cgcccagcctcagtgacctgggc

SEQ ID NO: 10016434 - DNA, 22 bp, Homo sapiens
cgccaggcttggtagctcatgc

SEQ ID NO: 10016435 - DNA, 22 bp, Homo sapiens
cgccaggcttggtagctcatgc

SEQ ID NO: 10016436 - DNA, 22 bp, Homo sapiens
ttcacacacagcttcctattgt

SEQ ID NO: 10016437 - DNA, 22 bp, Homo sapiens
ttcacaatttcccttcatcagg

SEQ ID NO: 10016438 - DNA, 22 bp, Homo sapiens
ttcacaatttcccttcatcagg

SEQ ID NO: 10016439 - DNA, 22 bp, Homo sapiens
ttcacacagcaactgtatgaat

SEQ ID NO: 10016440 - DNA, 22 bp, Homo sapiens
ttcacacagcaactgtatgaat

SEQ ID NO: 10016441 - DNA, 22 bp, Homo sapiens
ttcacacagcaactgtatgaat

SEQ ID NO: 10016442 - DNA, 22 bp, Homo sapiens
ttcacacagaatctgaggagct

SEQ ID NO: 10016443 - DNA, 22 bp, Homo sapiens
ttcacacagaatctgaggagct

SEQ ID NO: 10016444 - DNA, 21 bp, Homo sapiens
ttcaatactatttcaatagtc

SEQ ID NO: 10016445 - DNA, 22 bp, Homo sapiens
ttcaatacaaagaaaggaattt

SEQ ID NO: 10016446 - DNA, 22 bp, Homo sapiens
ttcaatacaccataggaatagt

SEQ ID NO: 10016447 - DNA, 22 bp, Homo sapiens
ttcaatatcattgtttagtctc

SEQ ID NO: 10016448 - DNA, 22 bp, Homo sapiens
ttcaagttttatattgaagcaa

SEQ ID NO: 10016449 - DNA, 22 bp, Homo sapiens
ttcaagttttcagaatagccac

SEQ ID NO: 10016450 - DNA, 22 bp, Homo sapiens
ttcaagttttatattgaagcaa

SEQ ID NO: 10016451 - DNA, 22 bp, Homo sapiens
ttcaagttttgacttagtcctt

SEQ ID NO: 10016452 - DNA, 22 bp, Homo sapiens
ttcaagtttgtatttctgtatt

SEQ ID NO: 10016453 - DNA, 22 bp, Homo sapiens
ttcaagttttatatccatggct

SEQ ID NO: 10016454 - DNA, 22 bp, Homo sapiens
ttcaagtttgtatttctgtatt

SEQ ID NO: 10016455 - DNA, 22 bp, Homo sapiens
ttcaagtttactttgaagttta

SEQ ID NO: 10016456 - DNA, 22 bp, Homo sapiens
ttcaagtttactttgaagttta

SEQ ID NO: 10016457 - DNA, 22 bp, Homo sapiens
ttcaagttctagtgttcacttc

SEQ ID NO: 10016458 - DNA, 22 bp, Homo sapiens
ttcaagttctgtggagagctgt

SEQ ID NO: 10016459 - DNA, 20 bp, Homo sapiens
ttcaagttgggtctctggct

SEQ ID NO: 10016460 - DNA, 20 bp, Homo sapiens
ttcaagttgggtctctggct

SEQ ID NO: 10016461 - DNA, 22 bp, Homo sapiens
ttcaagttagagatatatttag

SEQ ID NO: 10016462 - DNA, 22 bp, Homo sapiens
ttcaagttcatgtgtagtcagt

SEQ ID NO: 10016463 - DNA, 22 bp, Homo sapiens
ttcaagttaatgattctggttt

SEQ ID NO: 10016464 - DNA, 22 bp, Homo sapiens
ttcaagttaatgattctggttt

SEQ ID NO: 10016465 - DNA, 22 bp, Homo sapiens
cgcccagggcaggaggccgctc

SEQ ID NO: 10016466 - DNA, 20 bp, Homo sapiens
cgcccagtgcggttctgacc

SEQ ID NO: 10016467 - DNA, 22 bp, Homo sapiens
cgcccagggcaggaggccgctc

SEQ ID NO: 10016468 - DNA, 22 bp, Homo sapiens
cgcccagctgaaatctccaggc

SEQ ID NO: 10016469 - DNA, 22 bp, Homo sapiens
ttcaagtgaggctgtctttaga

SEQ ID NO: 10016470 - DNA, 22 bp, Homo sapiens
ttcaagttaactctccttgtac

SEQ ID NO: 10016471 - DNA, 22 bp, Homo sapiens
ttcaagttaactctccttgtac

SEQ ID NO: 10016472 - DNA, 22 bp, Homo sapiens
ttcaaattaccacatttgctta

SEQ ID NO: 10016473 - DNA, 22 bp, Homo sapiens
ttcaaatttggtatgcaagcca

SEQ ID NO: 10016474 - DNA, 22 bp, Homo sapiens
ttcaaatttggtatgcaagcca

SEQ ID NO: 10016475 - DNA, 22 bp, Homo sapiens
ttcaagtctgaagaggactaat

SEQ ID NO: 10016476 - DNA, 22 bp, Homo sapiens
cgccccagtctgtaggtgcccc

SEQ ID NO: 10016477 - DNA, 20 bp, Homo sapiens
ctctttgcaatgcagaagac

SEQ ID NO: 10016478 - DNA, 22 bp, Homo sapiens
ctctttggagaagcacgtatta

SEQ ID NO: 10016479 - DNA, 18 bp, Homo sapiens
ctctttctttggcacaaa

SEQ ID NO: 10016480 - DNA, 22 bp, Homo sapiens
ctctttgaaatccatcactgct

SEQ ID NO: 10016481 - DNA, 22 bp, Homo sapiens
ctgaatatcatttatcattggc

SEQ ID NO: 10016482 - DNA, 22 bp, Homo sapiens
ctgaatatcatttacatttgga

SEQ ID NO: 10016483 - DNA, 22 bp, Homo sapiens
ctctttggatgtttatgataag

SEQ ID NO: 10016484 - DNA, 19 bp, Homo sapiens
ctctttggagatccttgga

SEQ ID NO: 10016485 - DNA, 22 bp, Homo sapiens
ctctttggatagaattacaaag

SEQ ID NO: 10016486 - DNA, 17 bp, Homo sapiens
ctctttataaagagtta

SEQ ID NO: 10016487 - DNA, 17 bp, Homo sapiens
ctctttataaagagtta

SEQ ID NO: 10016488 - DNA, 22 bp, Homo sapiens
ctctttcctcgatgggctcctg

SEQ ID NO: 10016489 - DNA, 22 bp, Homo sapiens
ctgaccctagcatctctgtgca

SEQ ID NO: 10016490 - DNA, 18 bp, Homo sapiens
ctgaccctggctctgggt

SEQ ID NO: 10016491 - DNA, 22 bp, Homo sapiens
ctgaccctggaggcatttctct

SEQ ID NO: 10016492 - DNA, 22 bp, Homo sapiens
ctgacccttaatgagcaagtaa

SEQ ID NO: 10016493 - DNA, 22 bp, Homo sapiens
ctgaccctggtcaagttgcctc

SEQ ID NO: 10016494 - DNA, 22 bp, Homo sapiens
ctgacagtaactaatgtggaga

SEQ ID NO: 10016495 - DNA, 22 bp, Homo sapiens
ctgacaggttggtagctttgga

SEQ ID NO: 10016496 - DNA, 22 bp, Homo sapiens
ctgacagggtagacagagggca

SEQ ID NO: 10016497 - DNA, 22 bp, Homo sapiens
ctgacagtgtacactgacagct

SEQ ID NO: 10016498 - DNA, 22 bp, Homo sapiens
ctgacagtttttgctgtattgt

SEQ ID NO: 10016499 - DNA, 22 bp, Homo sapiens
ctgacagtctcattgatttgct

SEQ ID NO: 10016500 - DNA, 22 bp, Homo sapiens
ctgacagtcttgccaagtttct

SEQ ID NO: 10016501 - DNA, 22 bp, Homo sapiens
ctgacagatacttatgacataa

SEQ ID NO: 10016502 - DNA, 22 bp, Homo sapiens
ctgaatcatggtcattagttta

SEQ ID NO: 10016503 - DNA, 22 bp, Homo sapiens
ctgacagatacttatgacataa

SEQ ID NO: 10016504 - DNA, 22 bp, Homo sapiens
ctgacagatctggatctgaact

SEQ ID NO: 10016505 - DNA, 22 bp, Homo sapiens
ctgacagatgctgctggcagta

SEQ ID NO: 10016506 - DNA, 22 bp, Homo sapiens
ctgacagattagatgtgcatat

SEQ ID NO: 10016507 - DNA, 22 bp, Homo sapiens
ctgacagggtagacagagggca

SEQ ID NO: 10016508 - DNA, 22 bp, Homo sapiens
ctgaggcagagggcagaccaga

SEQ ID NO: 10016509 - DNA, 22 bp, Homo sapiens
ctgaggcagagggcagaccaga

SEQ ID NO: 10016510 - DNA, 22 bp, Homo sapiens
ctgagccctgcctcttgtcact

SEQ ID NO: 10016511 - DNA, 22 bp, Homo sapiens
ctgactctcctcaagcataaat

SEQ ID NO: 10016512 - DNA, 22 bp, Homo sapiens
ctgagccaaccacagcaggagc

SEQ ID NO: 10016513 - DNA, 22 bp, Homo sapiens
ctgactgtaattctgttcttaa

SEQ ID NO: 10016514 - DNA, 22 bp, Homo sapiens
ctgagccaaccacagcaggagc

SEQ ID NO: 10016515 - DNA, 23 bp, Homo sapiens
ctgactcatcccaccacctcctc

SEQ ID NO: 10016516 - DNA, 22 bp, Homo sapiens
ctgactcagcagctgatgatcc

SEQ ID NO: 10016517 - DNA, 23 bp, Homo sapiens
ctgacctgacccataagcaagga

SEQ ID NO: 10016518 - DNA, 22 bp, Homo sapiens
ctgaccctttagggtatgttta

SEQ ID NO: 10016519 - DNA, 22 bp, Homo sapiens
ctgacctgagtggtacaaggca

SEQ ID NO: 10016520 - DNA, 22 bp, Homo sapiens
ctgacctgcggggaggagggcc

SEQ ID NO: 10016521 - DNA, 22 bp, Homo sapiens
ctgagccagggccacacatgga

SEQ ID NO: 10016522 - DNA, 20 bp, Homo sapiens
ctgagccaactctcttcttg

SEQ ID NO: 10016523 - DNA, 20 bp, Homo sapiens
ctgagccaactctcttcttg

SEQ ID NO: 10016524 - DNA, 22 bp, Homo sapiens
ctgagccataagggaggctggg

SEQ ID NO: 10016525 - DNA, 22 bp, Homo sapiens
ctgagccataagggaggctggg

SEQ ID NO: 10016526 - DNA, 22 bp, Homo sapiens
ctgagccagtagtcagggacaa

SEQ ID NO: 10016527 - DNA, 22 bp, Homo sapiens
ctgagccatccataccagctta

SEQ ID NO: 10016528 - DNA, 22 bp, Homo sapiens
ctgagccatgagcctgcgccca

SEQ ID NO: 10016529 - DNA, 22 bp, Homo sapiens
ctgagccatccataccagctta

SEQ ID NO: 10016530 - DNA, 22 bp, Homo sapiens
ctgagccataagggaggctggg

SEQ ID NO: 10016531 - DNA, 22 bp, Homo sapiens
ctgagccatgagcctgcgccca

SEQ ID NO: 10016532 - DNA, 22 bp, Homo sapiens
ctgagccatgagcctgcgccca

SEQ ID NO: 10016533 - DNA, 22 bp, Homo sapiens
ctgagccatgggtctaagcact

SEQ ID NO: 10016534 - DNA, 22 bp, Homo sapiens
ctgaggccagagtgggcctctt

SEQ ID NO: 10016535 - DNA, 18 bp, Homo sapiens
ctgaggccaactacactg

SEQ ID NO: 10016536 - DNA, 22 bp, Homo sapiens
ctgaggccagaacccgaccctg

SEQ ID NO: 10016537 - DNA, 22 bp, Homo sapiens
ctgaggccagaacccgaccctg

SEQ ID NO: 10016538 - DNA, 22 bp, Homo sapiens
ctgaggccagctgcagagctct

SEQ ID NO: 10016539 - DNA, 22 bp, Homo sapiens
ctgaggccagctgcagagctct

SEQ ID NO: 10016540 - DNA, 22 bp, Homo sapiens
ctgaggccagagtgggcctctt

SEQ ID NO: 10016541 - DNA, 22 bp, Homo sapiens
ctgaggccagctgcagagctct

SEQ ID NO: 10016542 - DNA, 18 bp, Homo sapiens
ctgaggccaactacactg

SEQ ID NO: 10016543 - DNA, 22 bp, Homo sapiens
ctgaggcatgttacaggacata

SEQ ID NO: 10016544 - DNA, 22 bp, Homo sapiens
ctgaggcatgttacaggacata

SEQ ID NO: 10016545 - DNA, 22 bp, Homo sapiens
ctgaggcccctctcttgagctt

SEQ ID NO: 10016546 - DNA, 22 bp, Homo sapiens
ctgaggcccctctcttgagctt

SEQ ID NO: 10016547 - DNA, 19 bp, Homo sapiens
ctgaggcccatgtaccatg

SEQ ID NO: 10016548 - DNA, 19 bp, Homo sapiens
ctgaggcccatgtaccatg

SEQ ID NO: 10016549 - DNA, 19 bp, Homo sapiens
ctgaggcccatgtaccatg

SEQ ID NO: 10016550 - DNA, 22 bp, Homo sapiens
ctgaggccggagcactgaagag

SEQ ID NO: 10016551 - DNA, 22 bp, Homo sapiens
ctgaggccggagcactgaagag

SEQ ID NO: 10016552 - DNA, 22 bp, Homo sapiens
ctgaggcccctcttgtgagcat

SEQ ID NO: 10016553 - DNA, 22 bp, Homo sapiens
ctgaggcccctcttgtgagcat

SEQ ID NO: 10016554 - DNA, 17 bp, Homo sapiens
ctgaggcccagggccca

SEQ ID NO: 10016555 - DNA, 17 bp, Homo sapiens
ctgaggcccagggccca

SEQ ID NO: 10016556 - DNA, 17 bp, Homo sapiens
ctgaggcccagggccca

SEQ ID NO: 10016557 - DNA, 18 bp, Homo sapiens
ctgaggcccagagagggc

SEQ ID NO: 10016558 - DNA, 22 bp, Homo sapiens
ctgaggccagctgcagagctct

SEQ ID NO: 10016559 - DNA, 18 bp, Homo sapiens
ctgaggcccagagagggc

SEQ ID NO: 10016560 - DNA, 22 bp, Homo sapiens
ctgcacagcctgtctgggggcc

SEQ ID NO: 10016561 - DNA, 22 bp, Homo sapiens
ctgcacagctggccagggagag

SEQ ID NO: 10016562 - DNA, 22 bp, Homo sapiens
ctgcacagctgggcaagatata

SEQ ID NO: 10016563 - DNA, 22 bp, Homo sapiens
ctgcacagggatatggggagct

SEQ ID NO: 10016564 - DNA, 22 bp, Homo sapiens
ctgcacaggggatgagggcagt

SEQ ID NO: 10016565 - DNA, 22 bp, Homo sapiens
ctgcacagagcagggcagacac

SEQ ID NO: 10016566 - DNA, 22 bp, Homo sapiens
ctgcacacatatggcttctctc

SEQ ID NO: 10016567 - DNA, 22 bp, Homo sapiens
ctgcacacatcgcactgcccgt

SEQ ID NO: 10016568 - DNA, 22 bp, Homo sapiens
ctgaggccggagcactgaagag

SEQ ID NO: 10016569 - DNA, 22 bp, Homo sapiens
ctgcaggcccccttcctggagt

SEQ ID NO: 10016570 - DNA, 22 bp, Homo sapiens
ctgcagggaggttccttgttct

SEQ ID NO: 10016571 - DNA, 22 bp, Homo sapiens
ctgcagggagcagatggcgtgt

SEQ ID NO: 10016572 - DNA, 22 bp, Homo sapiens
ctgcagggagaggggacagcct

SEQ ID NO: 10016573 - DNA, 22 bp, Homo sapiens
ctgcagggagcagatggcgtgt

SEQ ID NO: 10016574 - DNA, 22 bp, Homo sapiens
ctgcaggcatctaactgtgggc

SEQ ID NO: 10016575 - DNA, 22 bp, Homo sapiens
ctgcaggcatttattcatgcaa

SEQ ID NO: 10016576 - DNA, 18 bp, Homo sapiens
ctgcactgtgggtagctc

SEQ ID NO: 10016577 - DNA, 21 bp, Homo sapiens
ctgcactgtgatttaaaatgt

SEQ ID NO: 10016578 - DNA, 19 bp, Homo sapiens
ctgcactgagaaaaggagg

SEQ ID NO: 10016579 - DNA, 20 bp, Homo sapiens
ctgcactgaacatgtctgag

SEQ ID NO: 10016580 - DNA, 22 bp, Homo sapiens
ctgcagggattgcttctgtata

SEQ ID NO: 10016581 - DNA, 22 bp, Homo sapiens
ctgcagggcagggcctcctggc

SEQ ID NO: 10016582 - DNA, 22 bp, Homo sapiens
ctgcagggcagggcctcctggc

SEQ ID NO: 10016583 - DNA, 22 bp, Homo sapiens
ctgcagggcagaagggcataga

SEQ ID NO: 10016584 - DNA, 19 bp, Homo sapiens
ctgcagggatgtgcagagt

SEQ ID NO: 10016585 - DNA, 19 bp, Homo sapiens
ctgcagggatgtgcagagt

SEQ ID NO: 10016586 - DNA, 19 bp, Homo sapiens
ctgcagggatgtgcagagt

SEQ ID NO: 10016587 - DNA, 22 bp, Homo sapiens
ctgcagggatgtgaggcccgtt

SEQ ID NO: 10016588 - DNA, 22 bp, Homo sapiens
ctgcagggatgtgaggcccgtt

SEQ ID NO: 10016589 - DNA, 22 bp, Homo sapiens
ctgcagggcccaaggtcaacgg

SEQ ID NO: 10016590 - DNA, 22 bp, Homo sapiens
ctgcagggccatgggttctata

SEQ ID NO: 10016591 - DNA, 22 bp, Homo sapiens
ctgcagggcccaaggtcaacgg

SEQ ID NO: 10016592 - DNA, 22 bp, Homo sapiens
ctgcagggcccaaggtcaacgg

SEQ ID NO: 10016593 - DNA, 22 bp, Homo sapiens
ctgcagggccatgggttctata

SEQ ID NO: 10016594 - DNA, 22 bp, Homo sapiens
ctgcagggcattgtaactcttt

SEQ ID NO: 10016595 - DNA, 22 bp, Homo sapiens
ctgcaggggcagtccacttcct

SEQ ID NO: 10016596 - DNA, 22 bp, Homo sapiens
ctgcaggggcctcgagcacagg

SEQ ID NO: 10016597 - DNA, 22 bp, Homo sapiens
ctgcaggggaccaaagtctgac

SEQ ID NO: 10016598 - DNA, 22 bp, Homo sapiens
ctgcaggggaccaaagtctgac

SEQ ID NO: 10016599 - DNA, 22 bp, Homo sapiens
ctgcagggcccgcctgagccct

SEQ ID NO: 10016600 - DNA, 22 bp, Homo sapiens
ctgcagggcttaccttgctctg

SEQ ID NO: 10016601 - DNA, 22 bp, Homo sapiens
ctctgctttctcaaaccctgtg

SEQ ID NO: 10016602 - DNA, 22 bp, Homo sapiens
tttgctctgctgttgccaggtg

SEQ ID NO: 10016603 - DNA, 22 bp, Homo sapiens
tttgctctgacagtgccagaga

SEQ ID NO: 10016604 - DNA, 22 bp, Homo sapiens
tttgctcacttgtgtattttca

SEQ ID NO: 10016605 - DNA, 22 bp, Homo sapiens
tttgctcagttctctgtatttt

SEQ ID NO: 10016606 - DNA, 22 bp, Homo sapiens
ctctgcttttatgtgccggcgc

SEQ ID NO: 10016607 - DNA, 20 bp, Homo sapiens
tttgcgaggccaaggcgggc

SEQ ID NO: 10016608 - DNA, 22 bp, Homo sapiens
tttgctaaaaggccattgattt

SEQ ID NO: 10016609 - DNA, 22 bp, Homo sapiens
tttgctaaaagtgatgaagaca

SEQ ID NO: 10016610 - DNA, 22 bp, Homo sapiens
tttgctaaaatgtattgggatt

SEQ ID NO: 10016611 - DNA, 22 bp, Homo sapiens
tttgctaatgcctctgaaatca

SEQ ID NO: 10016612 - DNA, 22 bp, Homo sapiens
tttgctaaataagtgattaagt

SEQ ID NO: 10016613 - DNA, 22 bp, Homo sapiens
tttgctatttttctgtgcagct

SEQ ID NO: 10016614 - DNA, 22 bp, Homo sapiens
tttgctattgtgaatagtgcca

SEQ ID NO: 10016615 - DNA, 22 bp, Homo sapiens
tttgctataaaagggtcacacg

SEQ ID NO: 10016616 - DNA, 22 bp, Homo sapiens
tttgcctgattctaagagctca

SEQ ID NO: 10016617 - DNA, 22 bp, Homo sapiens
tttgcctctcagagtctacaca

SEQ ID NO: 10016618 - DNA, 22 bp, Homo sapiens
tttgcctgggaattctagtgta

SEQ ID NO: 10016619 - DNA, 21 bp, Homo sapiens
tttgccttcacgaagcatcct

SEQ ID NO: 10016620 - DNA, 22 bp, Homo sapiens
tttgggcaattcagtgggacct

SEQ ID NO: 10016621 - DNA, 22 bp, Homo sapiens
tttgggcaattcagtgggacct

SEQ ID NO: 10016622 - DNA, 22 bp, Homo sapiens
ctctggaagatgacctgggtaa

SEQ ID NO: 10016623 - DNA, 22 bp, Homo sapiens
tttggaattggaaagtgctgtg

SEQ ID NO: 10016624 - DNA, 22 bp, Homo sapiens
tttggaattggcattctattct

SEQ ID NO: 10016625 - DNA, 21 bp, Homo sapiens
ctctgcccagggcctcctgcc

SEQ ID NO: 10016626 - DNA, 19 bp, Homo sapiens
ctctgcctccctcctgggt

SEQ ID NO: 10016627 - DNA, 19 bp, Homo sapiens
ctctgcctccctcctgggt

SEQ ID NO: 10016628 - DNA, 22 bp, Homo sapiens
ctctgcctcagtgatttcttta

SEQ ID NO: 10016629 - DNA, 22 bp, Homo sapiens
tttcctttatgacatcaccact

SEQ ID NO: 10016630 - DNA, 22 bp, Homo sapiens
tttccttgttattatttgtcct

SEQ ID NO: 10016631 - DNA, 18 bp, Homo sapiens
tttccttgtatgaacata

SEQ ID NO: 10016632 - DNA, 22 bp, Homo sapiens
ctctgccaccatgcttcctgac

SEQ ID NO: 10016633 - DNA, 22 bp, Homo sapiens
ctctgccaccatgcttcctgac

SEQ ID NO: 10016634 - DNA, 22 bp, Homo sapiens
ctctgccaagatgacaggtaag

SEQ ID NO: 10016635 - DNA, 22 bp, Homo sapiens
ctctgccactcgaagtcaagga

SEQ ID NO: 10016636 - DNA, 22 bp, Homo sapiens
ctctgccagccaaaatttatga

SEQ ID NO: 10016637 - DNA, 22 bp, Homo sapiens
ctctgccaggcagaacggcttt

SEQ ID NO: 10016638 - DNA, 22 bp, Homo sapiens
ctctgccagccaaagtcatcac

SEQ ID NO: 10016639 - DNA, 22 bp, Homo sapiens
ctctgccatcagtttttctttg

SEQ ID NO: 10016640 - DNA, 22 bp, Homo sapiens
ctctgccagtttctggcctcag

SEQ ID NO: 10016641 - DNA, 22 bp, Homo sapiens
ctctgccagtttctggcctcag

SEQ ID NO: 10016642 - DNA, 22 bp, Homo sapiens
ctctgccatctcactgggtcct

SEQ ID NO: 10016643 - DNA, 22 bp, Homo sapiens
ctctgccatcttggagctcaag

SEQ ID NO: 10016644 - DNA, 19 bp, Homo sapiens
ctctgccatttgctgcctg

SEQ ID NO: 10016645 - DNA, 22 bp, Homo sapiens
ctctgccatttatcagaactgt

SEQ ID NO: 10016646 - DNA, 22 bp, Homo sapiens
ctctgccatcttggagctcaag

SEQ ID NO: 10016647 - DNA, 21 bp, Homo sapiens
ctctgcccagggcctcctgcc

SEQ ID NO: 10016648 - DNA, 22 bp, Homo sapiens
ttttagattgggaaatgtaaag

SEQ ID NO: 10016649 - DNA, 20 bp, Homo sapiens
ttttagcagaaagaaagctc

SEQ ID NO: 10016650 - DNA, 22 bp, Homo sapiens
ttttagaatcaggttgtctggg

SEQ ID NO: 10016651 - DNA, 22 bp, Homo sapiens
ttttagattgggaaatgtaaag

SEQ ID NO: 10016652 - DNA, 22 bp, Homo sapiens
ttttagatagtttaactgcact

SEQ ID NO: 10016653 - DNA, 22 bp, Homo sapiens
ttttagattataagtctaattc

SEQ ID NO: 10016654 - DNA, 22 bp, Homo sapiens
ttttaagatgctagtatttcag

SEQ ID NO: 10016655 - DNA, 22 bp, Homo sapiens
ttttaagttaatataattgagg

SEQ ID NO: 10016656 - DNA, 22 bp, Homo sapiens
ttttaagttggattgctaagta

SEQ ID NO: 10016657 - DNA, 22 bp, Homo sapiens
ttttaagtttattccagtacat

SEQ ID NO: 10016658 - DNA, 22 bp, Homo sapiens
ttttaatactgctattgtagga

SEQ ID NO: 10016659 - DNA, 22 bp, Homo sapiens
tttgtacactgtctactatgaa

SEQ ID NO: 10016660 - DNA, 22 bp, Homo sapiens
tttgtacactgtctactatgaa

SEQ ID NO: 10016661 - DNA, 22 bp, Homo sapiens
tttgtacactgtctactatgaa

SEQ ID NO: 10016662 - DNA, 22 bp, Homo sapiens
tttgtacactgtctactatgaa

SEQ ID NO: 10016663 - DNA, 22 bp, Homo sapiens
tttgtacacctacctaatacag

SEQ ID NO: 10016664 - DNA, 22 bp, Homo sapiens
tttgtacacaggatgttataat

SEQ ID NO: 10016665 - DNA, 22 bp, Homo sapiens
tttgtacatatataaaatctgt

SEQ ID NO: 10016666 - DNA, 22 bp, Homo sapiens
tttgtacatatataaaatctgt

SEQ ID NO: 10016667 - DNA, 22 bp, Homo sapiens
tttgttctattttagagatgaa

SEQ ID NO: 10016668 - DNA, 22 bp, Homo sapiens
tttgttctgaaaactcaagtcc

SEQ ID NO: 10016669 - DNA, 22 bp, Homo sapiens
tttgttctattttagagatgaa

SEQ ID NO: 10016670 - DNA, 22 bp, Homo sapiens
tttgttctgaaaactcaagtcc

SEQ ID NO: 10016671 - DNA, 22 bp, Homo sapiens
tttgttctgaaaatcttccctt

SEQ ID NO: 10016672 - DNA, 22 bp, Homo sapiens
ctcttcaggaatatgtcagtca

SEQ ID NO: 10016673 - DNA, 22 bp, Homo sapiens
ctcttcagatatacagtactct

SEQ ID NO: 10016674 - DNA, 22 bp, Homo sapiens
ctcttcaaatgatttccttagg

SEQ ID NO: 10016675 - DNA, 22 bp, Homo sapiens
ctcttcagttggtcactattct

SEQ ID NO: 10016676 - DNA, 22 bp, Homo sapiens
ctcttcagttgttgcatattct

SEQ ID NO: 10016677 - DNA, 22 bp, Homo sapiens
ctcttccatattactcagggta

SEQ ID NO: 10016678 - DNA, 22 bp, Homo sapiens
ctcttccatttctacttcacag

SEQ ID NO: 10016679 - DNA, 22 bp, Homo sapiens
ctcttccacctccttcaggaga

SEQ ID NO: 10016680 - DNA, 22 bp, Homo sapiens
ctcttcatgtgtttaattttta

SEQ ID NO: 10016681 - DNA, 20 bp, Homo sapiens
ctcttcaaatattttattct

SEQ ID NO: 10016682 - DNA, 20 bp, Homo sapiens
ctcttcaaatattttattct

SEQ ID NO: 10016683 - DNA, 22 bp, Homo sapiens
ctcttattcctacagtaacagg

SEQ ID NO: 10016684 - DNA, 22 bp, Homo sapiens
ctcttattcctacagtaacagg

SEQ ID NO: 10016685 - DNA, 22 bp, Homo sapiens
ctcttatagacactcttctata

SEQ ID NO: 10016686 - DNA, 23 bp, Homo sapiens
ttttagtgactcctttatctgcc

SEQ ID NO: 10016687 - DNA, 22 bp, Homo sapiens
ctctgtttctcagcctatttcc

SEQ ID NO: 10016688 - DNA, 18 bp, Homo sapiens
ctctgtgttggtgtgaag

SEQ ID NO: 10016689 - DNA, 22 bp, Homo sapiens
ttttcaccatagacactggtcc

SEQ ID NO: 10016690 - DNA, 22 bp, Homo sapiens
ttttcacattgtcccagcacta

SEQ ID NO: 10016691 - DNA, 22 bp, Homo sapiens
ctcttccatttctacttcacag

SEQ ID NO: 10016692 - DNA, 22 bp, Homo sapiens
ttttcagaaagatgagaaatta

SEQ ID NO: 10016693 - DNA, 22 bp, Homo sapiens
ttttcagaggcctaagaggttt

SEQ ID NO: 10016694 - DNA, 22 bp, Homo sapiens
ttttcagtaatgtctacataat

SEQ ID NO: 10016695 - DNA, 22 bp, Homo sapiens
ttttcagtaatgtctacataat

SEQ ID NO: 10016696 - DNA, 22 bp, Homo sapiens
ttttcagtaatgtctacataat

SEQ ID NO: 10016697 - DNA, 22 bp, Homo sapiens
ttttcagtgggcaatgatgtga

SEQ ID NO: 10016698 - DNA, 22 bp, Homo sapiens
ttttcagtggcttgcatatgtt

SEQ ID NO: 10016699 - DNA, 22 bp, Homo sapiens
ttttcagttatagaatggtaga

SEQ ID NO: 10016700 - DNA, 22 bp, Homo sapiens
ttttcagttactgtttatgtga

SEQ ID NO: 10016701 - DNA, 22 bp, Homo sapiens
ttttcagttactgtttatgtga

SEQ ID NO: 10016702 - DNA, 22 bp, Homo sapiens
ttttcagtggtatctttgtaaa

SEQ ID NO: 10016703 - DNA, 22 bp, Homo sapiens
ctcttcttgcctgatgaggcag

SEQ ID NO: 10016704 - DNA, 22 bp, Homo sapiens
ctcttcttggaatgctgactgt

SEQ ID NO: 10016705 - DNA, 22 bp, Homo sapiens
ctcttcttgctagactgagtgc

SEQ ID NO: 10016706 - DNA, 22 bp, Homo sapiens
ctcttcttgctagactgagtgc

SEQ ID NO: 10016707 - DNA, 22 bp, Homo sapiens
ctctttaagctcctaacagcca

SEQ ID NO: 10016708 - DNA, 22 bp, Homo sapiens
ctctttaagctcctaacagcca

SEQ ID NO: 10016709 - DNA, 22 bp, Homo sapiens
ctctctgctgtatccttaggct

SEQ ID NO: 10016710 - DNA, 22 bp, Homo sapiens
ctctctggaagggggagctgat

SEQ ID NO: 10016711 - DNA, 22 bp, Homo sapiens
ctctctggaagggggagctgat

SEQ ID NO: 10016712 - DNA, 22 bp, Homo sapiens
ctctctgagtgagggacaagct

SEQ ID NO: 10016713 - DNA, 18 bp, Homo sapiens
tttccttgtatgaacata

SEQ ID NO: 10016714 - DNA, 22 bp, Homo sapiens
tttccttgcctcctgtccttct

SEQ ID NO: 10016715 - DNA, 17 bp, Homo sapiens
ctctccttcctctgagg

SEQ ID NO: 10016716 - DNA, 23 bp, Homo sapiens
ctctctctaccatgtgaggacac

SEQ ID NO: 10016717 - DNA, 22 bp, Homo sapiens
ctctctctatgcgttgttccta

SEQ ID NO: 10016718 - DNA, 20 bp, Homo sapiens
ctctctctccattcccaggg

SEQ ID NO: 10016719 - DNA, 20 bp, Homo sapiens
ctctctctccattcccaggg

SEQ ID NO: 10016720 - DNA, 22 bp, Homo sapiens
ctctctctatgcgttgttccta

SEQ ID NO: 10016721 - DNA, 22 bp, Homo sapiens
ctctctctttagaagcgtctgg

SEQ ID NO: 10016722 - DNA, 22 bp, Homo sapiens
ctctctctttagaagcgtctgg

SEQ ID NO: 10016723 - DNA, 22 bp, Homo sapiens
ctctctctttagaagcgtctgg

SEQ ID NO: 10016724 - DNA, 22 bp, Homo sapiens
ctctctcttgtgttgctgcaga

SEQ ID NO: 10016725 - DNA, 22 bp, Homo sapiens
ctctctcttgtgttgctgcaga

SEQ ID NO: 10016726 - DNA, 22 bp, Homo sapiens
ctctctcttgtgttgctgcaga

SEQ ID NO: 10016727 - DNA, 22 bp, Homo sapiens
ctctctcttgtgttgctgcaga

SEQ ID NO: 10016728 - DNA, 22 bp, Homo sapiens
ctctctcttgtgttgctgcaga

SEQ ID NO: 10016729 - DNA, 22 bp, Homo sapiens
ctctcctggtgtggaggacagg

SEQ ID NO: 10016730 - DNA, 22 bp, Homo sapiens
ctctccagtcatattctcagtc

SEQ ID NO: 10016731 - DNA, 22 bp, Homo sapiens
ctctccagtcatattctcagtc

SEQ ID NO: 10016732 - DNA, 22 bp, Homo sapiens
ctctccaggggtagatgccttc

SEQ ID NO: 10016733 - DNA, 22 bp, Homo sapiens
ctctccagggcatgagttccac

SEQ ID NO: 10016734 - DNA, 22 bp, Homo sapiens
ctctccagggaagcagtgtact

SEQ ID NO: 10016735 - DNA, 22 bp, Homo sapiens
ctctccaggctgggacaggacc

SEQ ID NO: 10016736 - DNA, 22 bp, Homo sapiens
tttcacagtcaatttggagtca

SEQ ID NO: 10016737 - DNA, 20 bp, Homo sapiens
tttcacagtccctgtttcct

SEQ ID NO: 10016738 - DNA, 22 bp, Homo sapiens
tttcacagtgctctgtaagtat

SEQ ID NO: 10016739 - DNA, 22 bp, Homo sapiens
tttcacagtgctctgtaagtat

SEQ ID NO: 10016740 - DNA, 22 bp, Homo sapiens
tttcacataaatggagtaaaga

SEQ ID NO: 10016741 - DNA, 22 bp, Homo sapiens
tttcctacccttccaggcagag

SEQ ID NO: 10016742 - DNA, 22 bp, Homo sapiens
tttcctaaggtagtgataattt

SEQ ID NO: 10016743 - DNA, 22 bp, Homo sapiens
tttcctaaggctcattttaaaa

SEQ ID NO: 10016744 - DNA, 22 bp, Homo sapiens
tttcctaagggatgcggctcaa

SEQ ID NO: 10016745 - DNA, 22 bp, Homo sapiens
tttcctaaggtagtgataattt

SEQ ID NO: 10016746 - DNA, 20 bp, Homo sapiens
tttcctaagtggtttgctga

SEQ ID NO: 10016747 - DNA, 20 bp, Homo sapiens
tttcctaagtggtttgctga

SEQ ID NO: 10016748 - DNA, 22 bp, Homo sapiens
tttcctaatcccaatgacattt

SEQ ID NO: 10016749 - DNA, 22 bp, Homo sapiens
tttcctaacacaatgcatgaga

SEQ ID NO: 10016750 - DNA, 22 bp, Homo sapiens
tttcctaaggctcattttaaaa

SEQ ID NO: 10016751 - DNA, 22 bp, Homo sapiens
tttcctaactcatcggatgtac

SEQ ID NO: 10016752 - DNA, 22 bp, Homo sapiens
tttcctaagatagatacttcag

SEQ ID NO: 10016753 - DNA, 22 bp, Homo sapiens
tttcctaactcatcggatgtac

SEQ ID NO: 10016754 - DNA, 22 bp, Homo sapiens
tttcaaatggagtcgtgaaatg

SEQ ID NO: 10016755 - DNA, 22 bp, Homo sapiens
tttcaaatggagtcgtgaaatg

SEQ ID NO: 10016756 - DNA, 22 bp, Homo sapiens
tttcaaatggatccctcagcct

SEQ ID NO: 10016757 - DNA, 19 bp, Homo sapiens
tttcaatggcttagagaaa

SEQ ID NO: 10016758 - DNA, 22 bp, Homo sapiens
tttcaatgtaacatttccaggc

SEQ ID NO: 10016759 - DNA, 22 bp, Homo sapiens
tttcaatgtaacatttccaggc

SEQ ID NO: 10016760 - DNA, 22 bp, Homo sapiens
tttcaattccaccaaagcgccc

SEQ ID NO: 10016761 - DNA, 22 bp, Homo sapiens
tttcaattgactttggaagaaa

SEQ ID NO: 10016762 - DNA, 22 bp, Homo sapiens
tttcaatttccaggctagaatt

SEQ ID NO: 10016763 - DNA, 21 bp, Homo sapiens
tttcaatttgccttgagtcat

SEQ ID NO: 10016764 - DNA, 22 bp, Homo sapiens
tttcacaacacaatctcgttaa

SEQ ID NO: 10016765 - DNA, 22 bp, Homo sapiens
tttcacaaagcatagcacttta

SEQ ID NO: 10016766 - DNA, 22 bp, Homo sapiens
tttcacaaagcatagcacttta

SEQ ID NO: 10016767 - DNA, 22 bp, Homo sapiens
tttcacaaatgtctttaacttg

SEQ ID NO: 10016768 - DNA, 22 bp, Homo sapiens
tttcacaaatgtctttaacttg

SEQ ID NO: 10016769 - DNA, 22 bp, Homo sapiens
tttcacaaatgtctttaacttg

SEQ ID NO: 10016770 - DNA, 22 bp, Homo sapiens
tttcacaaactgaggagacaat

SEQ ID NO: 10016771 - DNA, 22 bp, Homo sapiens
tttcacaaactgaggagacaat

SEQ ID NO: 10016772 - DNA, 19 bp, Homo sapiens
tttcacaaagagagcgtga

SEQ ID NO: 10016773 - DNA, 21 bp, Homo sapiens
tttcacaaaagtatgtgacaa

SEQ ID NO: 10016774 - DNA, 21 bp, Homo sapiens
tttcacaaaagtatgtgacaa

SEQ ID NO: 10016775 - DNA, 22 bp, Homo sapiens
tttcacaaactgaggagacaat

SEQ ID NO: 10016776 - DNA, 22 bp, Homo sapiens
ctcctccagtgggtccctcagg

SEQ ID NO: 10016777 - DNA, 22 bp, Homo sapiens
ctcctccagtcctccaaggaca

SEQ ID NO: 10016778 - DNA, 22 bp, Homo sapiens
ctcctccagcttccagtggctc

SEQ ID NO: 10016779 - DNA, 22 bp, Homo sapiens
ctcctccagcttccagtggctc

SEQ ID NO: 10016780 - DNA, 22 bp, Homo sapiens
ctcctccagtgggtccctcagg

SEQ ID NO: 10016781 - DNA, 22 bp, Homo sapiens
ctcctccagtgggtccctcagg

SEQ ID NO: 10016782 - DNA, 18 bp, Homo sapiens
ctcctccacagcccctgc

SEQ ID NO: 10016783 - DNA, 18 bp, Homo sapiens
ctcctccacagcccctgc

SEQ ID NO: 10016784 - DNA, 22 bp, Homo sapiens
ctcctccagacttactgaatcc

SEQ ID NO: 10016785 - DNA, 22 bp, Homo sapiens
ctcctccacccgctggggccca

SEQ ID NO: 10016786 - DNA, 22 bp, Homo sapiens
ctcctccagctctccctggggg

SEQ ID NO: 10016787 - DNA, 22 bp, Homo sapiens
tttattgttgggtcttaagctg

SEQ ID NO: 10016788 - DNA, 22 bp, Homo sapiens
tttattctaacttgctgctcta

SEQ ID NO: 10016789 - DNA, 22 bp, Homo sapiens
tttattgtttagaagggggctg

SEQ ID NO: 10016790 - DNA, 22 bp, Homo sapiens
ctcctggcactcagtgtggaag

SEQ ID NO: 10016791 - DNA, 22 bp, Homo sapiens
tttatttaccttatgtcctcca

SEQ ID NO: 10016792 - DNA, 22 bp, Homo sapiens
tttatttaccttatgtcctcca

SEQ ID NO: 10016793 - DNA, 22 bp, Homo sapiens
tttatttaccttatgtcctcca

SEQ ID NO: 10016794 - DNA, 22 bp, Homo sapiens
tttatttaaagtcgtgtgttaa

SEQ ID NO: 10016795 - DNA, 22 bp, Homo sapiens
tttatttaaagtcgtgtgttaa

SEQ ID NO: 10016796 - DNA, 17 bp, Homo sapiens
ctcctggcagcctcagg

SEQ ID NO: 10016797 - DNA, 22 bp, Homo sapiens
ctcctccacagagtccttgcca

SEQ ID NO: 10016798 - DNA, 18 bp, Homo sapiens
ctcctccacagcccctgc

SEQ ID NO: 10016799 - DNA, 22 bp, Homo sapiens
ctcctccacagacctactgaat

SEQ ID NO: 10016800 - DNA, 22 bp, Homo sapiens
tttagtgcctgggccagttcca

SEQ ID NO: 10016801 - DNA, 22 bp, Homo sapiens
tttagtcatttggatttgatct

SEQ ID NO: 10016802 - DNA, 23 bp, Homo sapiens
tttagtcagttgacagccatata

SEQ ID NO: 10016803 - DNA, 22 bp, Homo sapiens
tttagtactcaggggagaagtt

SEQ ID NO: 10016804 - DNA, 22 bp, Homo sapiens
tttagtaccatcatttgcctct

SEQ ID NO: 10016805 - DNA, 22 bp, Homo sapiens
tttagtaagttcactgcaaagc

SEQ ID NO: 10016806 - DNA, 22 bp, Homo sapiens
tttagtaagttcactgcaaagc

SEQ ID NO: 10016807 - DNA, 22 bp, Homo sapiens
tttaggccagatttatttgaca

SEQ ID NO: 10016808 - DNA, 22 bp, Homo sapiens
tttaggttttttcacgtggcta

SEQ ID NO: 10016809 - DNA, 22 bp, Homo sapiens
tttaggttaatcaacaaacatt

SEQ ID NO: 10016810 - DNA, 20 bp, Homo sapiens
ctcccctctacagagggctg

SEQ ID NO: 10016811 - DNA, 22 bp, Homo sapiens
ctcccgtgatcctggaggagag

SEQ ID NO: 10016812 - DNA, 22 bp, Homo sapiens
tttagacatggcttgctcactt

SEQ ID NO: 10016813 - DNA, 22 bp, Homo sapiens
ctccccatggcaacagttatgg

SEQ ID NO: 10016814 - DNA, 22 bp, Homo sapiens
ctcccccttagctcttgtcttt

SEQ ID NO: 10016815 - DNA, 22 bp, Homo sapiens
ctcccccttagctcttgtcttt

SEQ ID NO: 10016816 - DNA, 22 bp, Homo sapiens
tttaatcaggcaaagcataata

SEQ ID NO: 10016817 - DNA, 23 bp, Homo sapiens
ctccccagtgtcctcatgcatct

SEQ ID NO: 10016818 - DNA, 22 bp, Homo sapiens
ttgaaatagatgcgtcagagat

SEQ ID NO: 10016819 - DNA, 22 bp, Homo sapiens
ttgaaatactgcattgttcagt

SEQ ID NO: 10016820 - DNA, 22 bp, Homo sapiens
ttgaaatactgcattgttcagt

SEQ ID NO: 10016821 - DNA, 22 bp, Homo sapiens
ttgaaagttatctagattctga

SEQ ID NO: 10016822 - DNA, 22 bp, Homo sapiens
ctccaaatacaatattgttgtt

SEQ ID NO: 10016823 - DNA, 22 bp, Homo sapiens
ctcatttactactcatgtgacc

SEQ ID NO: 10016824 - DNA, 22 bp, Homo sapiens
ctcatttactcatctgcaaaac

SEQ ID NO: 10016825 - DNA, 22 bp, Homo sapiens
ttcttttacattaagatttcag

SEQ ID NO: 10016826 - DNA, 22 bp, Homo sapiens
ttcttttagtcattcagggaag

SEQ ID NO: 10016827 - DNA, 22 bp, Homo sapiens
ttcttttcaagaggggcaagga

SEQ ID NO: 10016828 - DNA, 22 bp, Homo sapiens
ttcttttagaatttcctaaggt

SEQ ID NO: 10016829 - DNA, 22 bp, Homo sapiens
ctcacaggttagttgtgtggat

SEQ ID NO: 10016830 - DNA, 22 bp, Homo sapiens
ttctttcttagcaatctatggt

SEQ ID NO: 10016831 - DNA, 22 bp, Homo sapiens
ttcttttaatttctgtctgcag

SEQ ID NO: 10016832 - DNA, 22 bp, Homo sapiens
ttcttttaattgtgggggagtg

SEQ ID NO: 10016833 - DNA, 22 bp, Homo sapiens
ttcttttaatttctgtctgcag

SEQ ID NO: 10016834 - DNA, 18 bp, Homo sapiens
ttcttttcatgtgatctc

SEQ ID NO: 10016835 - DNA, 22 bp, Homo sapiens
ttcttttcccaatattttgctg

SEQ ID NO: 10016836 - DNA, 22 bp, Homo sapiens
ttcttttcccaatattttgctg

SEQ ID NO: 10016837 - DNA, 22 bp, Homo sapiens
ttcttttcccaatattttgctg

SEQ ID NO: 10016838 - DNA, 22 bp, Homo sapiens
ttcttttcccaatattttgctg

SEQ ID NO: 10016839 - DNA, 22 bp, Homo sapiens
ttcttttcctacacagcgattt

SEQ ID NO: 10016840 - DNA, 22 bp, Homo sapiens
ttcttttcctacacagcgattt

SEQ ID NO: 10016841 - DNA, 22 bp, Homo sapiens
ttcttttcctgtggctcatcca

SEQ ID NO: 10016842 - DNA, 22 bp, Homo sapiens
ttgaaagggttaaagtggtaaa

SEQ ID NO: 10016843 - DNA, 23 bp, Homo sapiens
ttgaaaggtagctggcagctaga

SEQ ID NO: 10016844 - DNA, 23 bp, Homo sapiens
ttgaaaggtagctggcagctaga

SEQ ID NO: 10016845 - DNA, 22 bp, Homo sapiens
ttgaaaggtgctgtgtgctgat

SEQ ID NO: 10016846 - DNA, 22 bp, Homo sapiens
ttgaaaggtgaacatgatgcac

SEQ ID NO: 10016847 - DNA, 22 bp, Homo sapiens
ttgaaaggtgacattgttagag

SEQ ID NO: 10016848 - DNA, 20 bp, Homo sapiens
ctccaaggcttgcaggaggc

SEQ ID NO: 10016849 - DNA, 22 bp, Homo sapiens
ctccaaggattctggacccttg

SEQ ID NO: 10016850 - DNA, 22 bp, Homo sapiens
ctccacagcccctccagtggca

SEQ ID NO: 10016851 - DNA, 22 bp, Homo sapiens
ctccacagcccctccagtggca

SEQ ID NO: 10016852 - DNA, 22 bp, Homo sapiens
ctccacagctcaggctcagagt

SEQ ID NO: 10016853 - DNA, 19 bp, Homo sapiens
ctccacagggattgtgatt

SEQ ID NO: 10016854 - DNA, 22 bp, Homo sapiens
ctccacagagatgctgattgta

SEQ ID NO: 10016855 - DNA, 22 bp, Homo sapiens
ctccacagcccctccagtggca

SEQ ID NO: 10016856 - DNA, 22 bp, Homo sapiens
ttgtacaaatgcatattcctgg

SEQ ID NO: 10016857 - DNA, 22 bp, Homo sapiens
ttgtacaacacatattctacag

SEQ ID NO: 10016858 - DNA, 22 bp, Homo sapiens
ttgtacaaatgcatattcctgg

SEQ ID NO: 10016859 - DNA, 22 bp, Homo sapiens
ttggtcagctaataaggacagg

SEQ ID NO: 10016860 - DNA, 22 bp, Homo sapiens
ctccacagttgctgcttttaat

SEQ ID NO: 10016861 - DNA, 22 bp, Homo sapiens
ttggtcagatgtgtctcctcct

SEQ ID NO: 10016862 - DNA, 22 bp, Homo sapiens
ttgtacaaagatttcacagctc

SEQ ID NO: 10016863 - DNA, 22 bp, Homo sapiens
ttgtacaaagatttcacagctc

SEQ ID NO: 10016864 - DNA, 22 bp, Homo sapiens
ttgtacaaaggatttggaagag

SEQ ID NO: 10016865 - DNA, 22 bp, Homo sapiens
ttgtacaaataggaacctctga

SEQ ID NO: 10016866 - DNA, 22 bp, Homo sapiens
ttgtaatttgcaaatgtattgt

SEQ ID NO: 10016867 - DNA, 22 bp, Homo sapiens
ttgtacaaagatttcacagctc

SEQ ID NO: 10016868 - DNA, 20 bp, Homo sapiens
ctccagcccctgccctggtc

SEQ ID NO: 10016869 - DNA, 22 bp, Homo sapiens
ctccagccagagtgcctctgtt

SEQ ID NO: 10016870 - DNA, 22 bp, Homo sapiens
ctccagccagagtgcctctgtt

SEQ ID NO: 10016871 - DNA, 22 bp, Homo sapiens
ttgtctgtccaggcaccccaag

SEQ ID NO: 10016872 - DNA, 22 bp, Homo sapiens
ttgtctgtccaggcaccccaag

SEQ ID NO: 10016873 - DNA, 22 bp, Homo sapiens
ttgtctgtcccagcttgtgcat

SEQ ID NO: 10016874 - DNA, 23 bp, Homo sapiens
ttgtctgtgcttttccagttgct

SEQ ID NO: 10016875 - DNA, 23 bp, Homo sapiens
ttgtctgtgcttttccagttgct

SEQ ID NO: 10016876 - DNA, 22 bp, Homo sapiens
ttgtctgtgaaatggaaatagt

SEQ ID NO: 10016877 - DNA, 22 bp, Homo sapiens
ttgtctgtgaaatggaaatagt

SEQ ID NO: 10016878 - DNA, 22 bp, Homo sapiens
ttgtctgtcccagcttgtgcat

SEQ ID NO: 10016879 - DNA, 19 bp, Homo sapiens
ttgtcttagctgcataaga

SEQ ID NO: 10016880 - DNA, 22 bp, Homo sapiens
ttgtctttcccagcttctagag

SEQ ID NO: 10016881 - DNA, 22 bp, Homo sapiens
ttgtcttattttatcataagca

SEQ ID NO: 10016882 - DNA, 22 bp, Homo sapiens
ttgtgaaaagccgcaagtatag

SEQ ID NO: 10016883 - DNA, 22 bp, Homo sapiens
ttgtgaaaagccgcaagtatag

SEQ ID NO: 10016884 - DNA, 22 bp, Homo sapiens
ttgtgaaacattcatggatttg

SEQ ID NO: 10016885 - DNA, 18 bp, Homo sapiens
ttgtgaaatattggagtc

SEQ ID NO: 10016886 - DNA, 21 bp, Homo sapiens
ttgtgaaagtccaggaacaac

SEQ ID NO: 10016887 - DNA, 21 bp, Homo sapiens
ttgtgaaagtccaggaacaac

SEQ ID NO: 10016888 - DNA, 22 bp, Homo sapiens
ttgtgaaatcgtgtttggaagc

SEQ ID NO: 10016889 - DNA, 22 bp, Homo sapiens
ttgtggggaggatttgatgaga

SEQ ID NO: 10016890 - DNA, 22 bp, Homo sapiens
ttgtggggcaacagcaggtgaa

SEQ ID NO: 10016891 - DNA, 22 bp, Homo sapiens
ttgtgtaacttgagcaaacaca

SEQ ID NO: 10016892 - DNA, 22 bp, Homo sapiens
ctccagtgcgcaggacagcccc

SEQ ID NO: 10016893 - DNA, 22 bp, Homo sapiens
ctccagtgcgcaggacagcccc

SEQ ID NO: 10016894 - DNA, 22 bp, Homo sapiens
ctcccaaggggtaagggagctg

SEQ ID NO: 10016895 - DNA, 22 bp, Homo sapiens
ctcccagaaaattctcagacaa

SEQ ID NO: 10016896 - DNA, 22 bp, Homo sapiens
ctcccactcctggctcaccaca

SEQ ID NO: 10016897 - DNA, 22 bp, Homo sapiens
ctcccagccttcgccagtctga

SEQ ID NO: 10016898 - DNA, 22 bp, Homo sapiens
ctcccagattcctgctgtggga

SEQ ID NO: 10016899 - DNA, 22 bp, Homo sapiens
ctcccagagagcaggtgggccg

SEQ ID NO: 10016900 - DNA, 22 bp, Homo sapiens
ctcccagagaccaagctgagaa

SEQ ID NO: 10016901 - DNA, 22 bp, Homo sapiens
ctcccaggccatgctctagcca

SEQ ID NO: 10016902 - DNA, 22 bp, Homo sapiens
tttaatacagaacttgtcaggg

SEQ ID NO: 10016903 - DNA, 22 bp, Homo sapiens
tttaacagatgctatgtctacc

SEQ ID NO: 10016904 - DNA, 22 bp, Homo sapiens
ctcccaggactggctctaactg

SEQ ID NO: 10016905 - DNA, 22 bp, Homo sapiens
tttaatattctgcattctcctt

SEQ ID NO: 10016906 - DNA, 22 bp, Homo sapiens
tttaatattctgcattctcctt

SEQ ID NO: 10016907 - DNA, 22 bp, Homo sapiens
tttaatatctcacacttccatg

SEQ ID NO: 10016908 - DNA, 22 bp, Homo sapiens
tttaatatctcacacttccatg

SEQ ID NO: 10016909 - DNA, 22 bp, Homo sapiens
tttaatactatggggatgaaca

SEQ ID NO: 10016910 - DNA, 22 bp, Homo sapiens
tttaatagggcccaatgagact

SEQ ID NO: 10016911 - DNA, 22 bp, Homo sapiens
ctggctgcttgtagactcgact

SEQ ID NO: 10016912 - DNA, 22 bp, Homo sapiens
ctggctgcgtctgctctgacag

SEQ ID NO: 10016913 - DNA, 20 bp, Homo sapiens
ctggctggaaacttagcctt

SEQ ID NO: 10016914 - DNA, 22 bp, Homo sapiens
ctggctggaagttagagaactt

SEQ ID NO: 10016915 - DNA, 22 bp, Homo sapiens
ctggctgtgaaatggcagtgtc

SEQ ID NO: 10016916 - DNA, 22 bp, Homo sapiens
ctggctcttgcgactcagcttg

SEQ ID NO: 10016917 - DNA, 22 bp, Homo sapiens
ctggctcttgcgactcagcttg

SEQ ID NO: 10016918 - DNA, 22 bp, Homo sapiens
ctggctcttgcgactcagcttg

SEQ ID NO: 10016919 - DNA, 22 bp, Homo sapiens
ctggctccaaggaagaggtttt

SEQ ID NO: 10016920 - DNA, 22 bp, Homo sapiens
ctggctcttgcgactcagcttg

SEQ ID NO: 10016921 - DNA, 22 bp, Homo sapiens
ctggctcagttcttggttttca

SEQ ID NO: 10016922 - DNA, 22 bp, Homo sapiens
ctggccctcagactcatgggca

SEQ ID NO: 10016923 - DNA, 22 bp, Homo sapiens
ctggccctcggagtccagctgc

SEQ ID NO: 10016924 - DNA, 22 bp, Homo sapiens
ctggccctcgtcagtttcactg

SEQ ID NO: 10016925 - DNA, 22 bp, Homo sapiens
ctggccctcggagtccagctgc

SEQ ID NO: 10016926 - DNA, 22 bp, Homo sapiens
ctggccctggagggctgtgcga

SEQ ID NO: 10016927 - DNA, 22 bp, Homo sapiens
ctggccctggagggctgtgcga

SEQ ID NO: 10016928 - DNA, 22 bp, Homo sapiens
ctggccctggagggctgtgcga

SEQ ID NO: 10016929 - DNA, 22 bp, Homo sapiens
ctggccctgcctaatgtacttg

SEQ ID NO: 10016930 - DNA, 22 bp, Homo sapiens
ctggccctgcctaatgtacttg

SEQ ID NO: 10016931 - DNA, 22 bp, Homo sapiens
ctggccctgccagagatcaaca

SEQ ID NO: 10016932 - DNA, 22 bp, Homo sapiens
ctggcccagtctcagagtgtca

SEQ ID NO: 10016933 - DNA, 22 bp, Homo sapiens
ctggccctattccaggccttcc

SEQ ID NO: 10016934 - DNA, 22 bp, Homo sapiens
ctggccaggccccttgcagggc

SEQ ID NO: 10016935 - DNA, 22 bp, Homo sapiens
ctggcccaggtggtcgttgagg

SEQ ID NO: 10016936 - DNA, 22 bp, Homo sapiens
ctggcccagtctcagagtgtca

SEQ ID NO: 10016937 - DNA, 22 bp, Homo sapiens
ctggcccagtctcagagtgtca

SEQ ID NO: 10016938 - DNA, 19 bp, Homo sapiens
ctggccaggccaggggccc

SEQ ID NO: 10016939 - DNA, 22 bp, Homo sapiens
ctggccaggcatcccctgatcc

SEQ ID NO: 10016940 - DNA, 23 bp, Homo sapiens
ctggccctggctctgtgatcatg

SEQ ID NO: 10016941 - DNA, 23 bp, Homo sapiens
ctggccctggctctgtgatcatg

SEQ ID NO: 10016942 - DNA, 22 bp, Homo sapiens
ctggcctggtctggcctctcca

SEQ ID NO: 10016943 - DNA, 22 bp, Homo sapiens
ctggcctggtctggcctctcca

SEQ ID NO: 10016944 - DNA, 22 bp, Homo sapiens
ctggccctgtaggatgtgagtt

SEQ ID NO: 10016945 - DNA, 22 bp, Homo sapiens
ctggccctgtaggatgtgagtt

SEQ ID NO: 10016946 - DNA, 22 bp, Homo sapiens
ctggcctgtgggctgtctccgg

SEQ ID NO: 10016947 - DNA, 22 bp, Homo sapiens
ctggctcactagccctgccctg

SEQ ID NO: 10016948 - DNA, 22 bp, Homo sapiens
ctggctcactagccctgccctg

SEQ ID NO: 10016949 - DNA, 22 bp, Homo sapiens
ctggccagcatggctgaagtac

SEQ ID NO: 10016950 - DNA, 22 bp, Homo sapiens
ctggccagcatttttgctttag

SEQ ID NO: 10016951 - DNA, 22 bp, Homo sapiens
ctggccagcatttttgctttag

SEQ ID NO: 10016952 - DNA, 22 bp, Homo sapiens
ctggccagatgttacgtccaat

SEQ ID NO: 10016953 - DNA, 22 bp, Homo sapiens
ctggccagagttggagggtgtg

SEQ ID NO: 10016954 - DNA, 22 bp, Homo sapiens
ctggccagagttggagggtgtg

SEQ ID NO: 10016955 - DNA, 22 bp, Homo sapiens
ctggccagagttggagggtgtg

SEQ ID NO: 10016956 - DNA, 22 bp, Homo sapiens
ctggccagctgacagcagggct

SEQ ID NO: 10016957 - DNA, 22 bp, Homo sapiens
ctggccagctgacagcagggct

SEQ ID NO: 10016958 - DNA, 22 bp, Homo sapiens
ctggccaggaggtaaccagatg

SEQ ID NO: 10016959 - DNA, 22 bp, Homo sapiens
ctggccaggcatcccctgatcc

SEQ ID NO: 10016960 - DNA, 22 bp, Homo sapiens
ctggccagcctcccaggtaccc

SEQ ID NO: 10016961 - DNA, 22 bp, Homo sapiens
ctggccagcctgtcgatgccct

SEQ ID NO: 10016962 - DNA, 22 bp, Homo sapiens
ctggcaggctctctggtcggtt

SEQ ID NO: 10016963 - DNA, 22 bp, Homo sapiens
ctggcaggctctctggtcggtt

SEQ ID NO: 10016964 - DNA, 22 bp, Homo sapiens
ctggcaggctctctggtcggtt

SEQ ID NO: 10016965 - DNA, 22 bp, Homo sapiens
ctggcagggcaggggtttgtgc

SEQ ID NO: 10016966 - DNA, 22 bp, Homo sapiens
ctggcaggcggaggttgcagtg

SEQ ID NO: 10016967 - DNA, 22 bp, Homo sapiens
ctggcaggcagacttctgcaag

SEQ ID NO: 10016968 - DNA, 22 bp, Homo sapiens
ctggcaggagcattcacagagg

SEQ ID NO: 10016969 - DNA, 20 bp, Homo sapiens
ctggcaggagcgagtctacc

SEQ ID NO: 10016970 - DNA, 22 bp, Homo sapiens
ctggcaggagctgtggccgtag

SEQ ID NO: 10016971 - DNA, 22 bp, Homo sapiens
ctggcaggagctgtggccgtag

SEQ ID NO: 10016972 - DNA, 22 bp, Homo sapiens
ctggcaggcaaattggtgggag

SEQ ID NO: 10016973 - DNA, 22 bp, Homo sapiens
ctggcaggcaaattggtgggag

SEQ ID NO: 10016974 - DNA, 22 bp, Homo sapiens
ctggcaggcactcatgaaataa

SEQ ID NO: 10016975 - DNA, 22 bp, Homo sapiens
ctggcaggatctaaccagggaa

SEQ ID NO: 10016976 - DNA, 22 bp, Homo sapiens
ctggcaggaagaggaaaggtca

SEQ ID NO: 10016977 - DNA, 22 bp, Homo sapiens
ctggcaggaagttagatggtaa

SEQ ID NO: 10016978 - DNA, 22 bp, Homo sapiens
ctggcagcccaacctagagtct

SEQ ID NO: 10016979 - DNA, 22 bp, Homo sapiens
ctggcagcttcctttgcatctg

SEQ ID NO: 10016980 - DNA, 22 bp, Homo sapiens
ctggcagcttcaggacactcgg

SEQ ID NO: 10016981 - DNA, 22 bp, Homo sapiens
ctgccagcactgcctcctgagg

SEQ ID NO: 10016982 - DNA, 22 bp, Homo sapiens
ctgccagctcaaagcgcagcta

SEQ ID NO: 10016983 - DNA, 22 bp, Homo sapiens
ctggcagcatttttttcagaag

SEQ ID NO: 10016984 - DNA, 22 bp, Homo sapiens
ctggcagccaagtgggatactc

SEQ ID NO: 10016985 - DNA, 22 bp, Homo sapiens
ctgccactagctttcacatctt

SEQ ID NO: 10016986 - DNA, 22 bp, Homo sapiens
ctgccacttactaggcatggtg

SEQ ID NO: 10016987 - DNA, 22 bp, Homo sapiens
ctgccactttcacccagtgctc

SEQ ID NO: 10016988 - DNA, 22 bp, Homo sapiens
ctgccagatcattggattcaca

SEQ ID NO: 10016989 - DNA, 22 bp, Homo sapiens
ctgccagacacgttatgctcat

SEQ ID NO: 10016990 - DNA, 22 bp, Homo sapiens
ctgccagagatctgggcagagt

SEQ ID NO: 10016991 - DNA, 22 bp, Homo sapiens
ctgccagaagagaacaccagtt

SEQ ID NO: 10016992 - DNA, 22 bp, Homo sapiens
ctgccactttggagtgctcaga

SEQ ID NO: 10016993 - DNA, 22 bp, Homo sapiens
ctgcatcagtggatatgatggt

SEQ ID NO: 10016994 - DNA, 22 bp, Homo sapiens
ctgcatcataaaatttagagtt

SEQ ID NO: 10016995 - DNA, 22 bp, Homo sapiens
ctgcatcagtggatatgatggt

SEQ ID NO: 10016996 - DNA, 22 bp, Homo sapiens
ctgcatcaggccaattaagaat

SEQ ID NO: 10016997 - DNA, 20 bp, Homo sapiens
ctgcatcagcggccgcgtct

SEQ ID NO: 10016998 - DNA, 22 bp, Homo sapiens
ctgcatcattttcagacaatgg

SEQ ID NO: 10016999 - DNA, 22 bp, Homo sapiens
ctgcatcattggtgattcagga

SEQ ID NO: 10017000 - DNA, 20 bp, Homo sapiens
ctgcatcatggttaagaaca

SEQ ID NO: 10017001 - DNA, 22 bp, Homo sapiens
ctgcatcattttcagacaatgg

SEQ ID NO: 10017002 - DNA, 22 bp, Homo sapiens
ctgccaaggctggggaggacaa

SEQ ID NO: 10017003 - DNA, 22 bp, Homo sapiens
ctggctgtgctgactgagaggg

SEQ ID NO: 10017004 - DNA, 22 bp, Homo sapiens
ctgggagctgaggctgacgctg

SEQ ID NO: 10017005 - DNA, 22 bp, Homo sapiens
ctgggaggattcattgaggtga

SEQ ID NO: 10017006 - DNA, 22 bp, Homo sapiens
ctgggaggattcattgaggtga

SEQ ID NO: 10017007 - DNA, 22 bp, Homo sapiens
ctgggaggattcattgaggtga

SEQ ID NO: 10017008 - DNA, 22 bp, Homo sapiens
ctgggaggcaccgcgtcgtgct

SEQ ID NO: 10017009 - DNA, 22 bp, Homo sapiens
ctgggaggcaccgcgtcgtgct

SEQ ID NO: 10017010 - DNA, 22 bp, Homo sapiens
ctgggaagaaattgtgggaggc

SEQ ID NO: 10017011 - DNA, 22 bp, Homo sapiens
ctgggaggcagtctctctagaa

SEQ ID NO: 10017012 - DNA, 22 bp, Homo sapiens
ctgggaggcagaggttgtagtg

SEQ ID NO: 10017013 - DNA, 22 bp, Homo sapiens
ctgggaggcagaggttgtagtg

SEQ ID NO: 10017014 - DNA, 22 bp, Homo sapiens
ctgggaggcagaggttgcagtg

SEQ ID NO: 10017015 - DNA, 22 bp, Homo sapiens
ctgggaggcagaggttgcagtg

SEQ ID NO: 10017016 - DNA, 22 bp, Homo sapiens
ctgggaggcagaggttgcagtg

SEQ ID NO: 10017017 - DNA, 22 bp, Homo sapiens
ctgggaggcagaggttgcagtg

SEQ ID NO: 10017018 - DNA, 22 bp, Homo sapiens
ctgggaggcactattcaggagg

SEQ ID NO: 10017019 - DNA, 22 bp, Homo sapiens
ctgggaggcagaggttgcagtg

SEQ ID NO: 10017020 - DNA, 22 bp, Homo sapiens
ctgggaggcagaggttgcagtg

SEQ ID NO: 10017021 - DNA, 22 bp, Homo sapiens
ctgggaggcggagcttgcagtg

SEQ ID NO: 10017022 - DNA, 22 bp, Homo sapiens
ctgggcaggagaggtggttgga

SEQ ID NO: 10017023 - DNA, 22 bp, Homo sapiens
ctgggaggcggagcttgcagtg

SEQ ID NO: 10017024 - DNA, 22 bp, Homo sapiens
ctgggaggcagtctctctagaa

SEQ ID NO: 10017025 - DNA, 22 bp, Homo sapiens
ctgggaggcagtctctctagaa

SEQ ID NO: 10017026 - DNA, 22 bp, Homo sapiens
ctgggaggcagtctctctagaa

SEQ ID NO: 10017027 - DNA, 22 bp, Homo sapiens
ctgggaggcagtctctctagaa

SEQ ID NO: 10017028 - DNA, 22 bp, Homo sapiens
ctgggaggcccacgttgggaag

SEQ ID NO: 10017029 - DNA, 22 bp, Homo sapiens
ctgggaggcccacgttgggaag

SEQ ID NO: 10017030 - DNA, 22 bp, Homo sapiens
ctgggaggcccacgttgggaag

SEQ ID NO: 10017031 - DNA, 22 bp, Homo sapiens
ctgggcagttttacatcattgc

SEQ ID NO: 10017032 - DNA, 22 bp, Homo sapiens
ctgggcaggagggctctatgga

SEQ ID NO: 10017033 - DNA, 22 bp, Homo sapiens
ctgggcagtttattcagttctg

SEQ ID NO: 10017034 - DNA, 22 bp, Homo sapiens
ctgggcagtttattcagttctg

SEQ ID NO: 10017035 - DNA, 22 bp, Homo sapiens
ctgggcatttttctctgttaca

SEQ ID NO: 10017036 - DNA, 22 bp, Homo sapiens
ctgggccacaagcctgtgtgat

SEQ ID NO: 10017037 - DNA, 22 bp, Homo sapiens
ctgggccacatcagatgaagac

SEQ ID NO: 10017038 - DNA, 22 bp, Homo sapiens
ctgggccacttcctcaggggaa

SEQ ID NO: 10017039 - DNA, 22 bp, Homo sapiens
ctgggccactccagatgcccac

SEQ ID NO: 10017040 - DNA, 22 bp, Homo sapiens
ctgggccacatcagatgaagac

SEQ ID NO: 10017041 - DNA, 22 bp, Homo sapiens
ctggggcccatcgagggctgag

SEQ ID NO: 10017042 - DNA, 22 bp, Homo sapiens
ctggggccagtgaggaggcttt

SEQ ID NO: 10017043 - DNA, 22 bp, Homo sapiens
ctggggccagtgaggaggcttt

SEQ ID NO: 10017044 - DNA, 22 bp, Homo sapiens
ctggggcccatcgagggctgag

SEQ ID NO: 10017045 - DNA, 22 bp, Homo sapiens
ctggggcccatcgagggctgag

SEQ ID NO: 10017046 - DNA, 22 bp, Homo sapiens
ctggggccacaacggcgcacgc

SEQ ID NO: 10017047 - DNA, 22 bp, Homo sapiens
ctggggcattgggagaggcctg

SEQ ID NO: 10017048 - DNA, 22 bp, Homo sapiens
ctggggctcactttggtcaggc

SEQ ID NO: 10017049 - DNA, 22 bp, Homo sapiens
ctggggctcactccagccctgg

SEQ ID NO: 10017050 - DNA, 22 bp, Homo sapiens
ctggggctcactccagccctgg

SEQ ID NO: 10017051 - DNA, 22 bp, Homo sapiens
ctggggcccgagccttgggcca

SEQ ID NO: 10017052 - DNA, 22 bp, Homo sapiens
ctggggctcactttggtcaggc

SEQ ID NO: 10017053 - DNA, 22 bp, Homo sapiens
ctggggctcactttggtcaggc

SEQ ID NO: 10017054 - DNA, 22 bp, Homo sapiens
ctggggctctctggaatgcttg

SEQ ID NO: 10017055 - DNA, 22 bp, Homo sapiens
ctggggctgcggacgggagccc

SEQ ID NO: 10017056 - DNA, 22 bp, Homo sapiens
ctggggctgcggacgggagccc

SEQ ID NO: 10017057 - DNA, 22 bp, Homo sapiens
ctggggctgcagcgatcttcat

SEQ ID NO: 10017058 - DNA, 22 bp, Homo sapiens
ctggggctgcggacgggagccc

SEQ ID NO: 10017059 - DNA, 22 bp, Homo sapiens
ctggggctgcagcgatcttcat

SEQ ID NO: 10017060 - DNA, 22 bp, Homo sapiens
ctggggctgcggtggaggagcc

SEQ ID NO: 10017061 - DNA, 22 bp, Homo sapiens
ctggggctgcggtggaggagcc

SEQ ID NO: 10017062 - DNA, 22 bp, Homo sapiens
ctggggtgtgctcagagcaggg

SEQ ID NO: 10017063 - DNA, 22 bp, Homo sapiens
ctgggtctggccacaggaagta

SEQ ID NO: 10017064 - DNA, 22 bp, Homo sapiens
ctgggtctggccacaggaagta

SEQ ID NO: 10017065 - DNA, 22 bp, Homo sapiens
ctgggtctggctactgcttcct

SEQ ID NO: 10017066 - DNA, 20 bp, Homo sapiens
ctgggtctccttctgcttaa

SEQ ID NO: 10017067 - DNA, 22 bp, Homo sapiens
ctggggtgtgctcagagcaggg

SEQ ID NO: 10017068 - DNA, 22 bp, Homo sapiens
ctgggtctccggcagcctcggg

SEQ ID NO: 10017069 - DNA, 20 bp, Homo sapiens
ctggggagctgctcccacga

SEQ ID NO: 10017070 - DNA, 20 bp, Homo sapiens
ctggggaggaggatgtgttc

SEQ ID NO: 10017071 - DNA, 20 bp, Homo sapiens
ctggggaggaggatgtgttc

SEQ ID NO: 10017072 - DNA, 20 bp, Homo sapiens
ctggggaggaggatgtgttc

SEQ ID NO: 10017073 - DNA, 22 bp, Homo sapiens
ctgggctgcttgctgaaggggt

SEQ ID NO: 10017074 - DNA, 20 bp, Homo sapiens
ctggggagctgctcccacga

SEQ ID NO: 10017075 - DNA, 23 bp, Homo sapiens
ctgggctgcttgagtccctggct

SEQ ID NO: 10017076 - DNA, 20 bp, Homo sapiens
ctgggctgcccagctatggg

SEQ ID NO: 10017077 - DNA, 20 bp, Homo sapiens
ctgggctgcccagctatggg

SEQ ID NO: 10017078 - DNA, 20 bp, Homo sapiens
ctgggctgcccagctatggg

SEQ ID NO: 10017079 - DNA, 22 bp, Homo sapiens
ctgggctgcggtggtaggttgt

SEQ ID NO: 10017080 - DNA, 22 bp, Homo sapiens
ctgggccagatccagcctcaca

SEQ ID NO: 10017081 - DNA, 22 bp, Homo sapiens
ctgggctctagaaaggaaagaa

SEQ ID NO: 10017082 - DNA, 19 bp, Homo sapiens
ctgggccagagctgtcctc

SEQ ID NO: 10017083 - DNA, 19 bp, Homo sapiens
ctgggccagagctgtcctc

SEQ ID NO: 10017084 - DNA, 22 bp, Homo sapiens
ctgggccagaccttgtggtctt

SEQ ID NO: 10017085 - DNA, 22 bp, Homo sapiens
ctgggctgcaggagtggggcaa

SEQ ID NO: 10017086 - DNA, 22 bp, Homo sapiens
ctgggctgcaggagtggggcaa

SEQ ID NO: 10017087 - DNA, 22 bp, Homo sapiens
ctgggctgcagcgggagcgacg

SEQ ID NO: 10017088 - DNA, 22 bp, Homo sapiens
ctgggctgcagcgggagcgacg

SEQ ID NO: 10017089 - DNA, 22 bp, Homo sapiens
ctgggctgcagttcctggtcct

SEQ ID NO: 10017090 - DNA, 22 bp, Homo sapiens
ctgggctgcatcaaagaggcat

SEQ ID NO: 10017091 - DNA, 22 bp, Homo sapiens
ctgggctgcatcaaagaggcat

SEQ ID NO: 10017092 - DNA, 20 bp, Homo sapiens
cttgcaggagtgggtagagt

SEQ ID NO: 10017093 - DNA, 23 bp, Homo sapiens
cttgcaggaagcagatggcacac

SEQ ID NO: 10017094 - DNA, 22 bp, Homo sapiens
cttgcaggcagggcctcctgga

SEQ ID NO: 10017095 - DNA, 22 bp, Homo sapiens
cttgcaggcccagccttacaag

SEQ ID NO: 10017096 - DNA, 22 bp, Homo sapiens
cttgcaggcccagccttacaag

SEQ ID NO: 10017097 - DNA, 22 bp, Homo sapiens
cttgcaggattttgctgctgta

SEQ ID NO: 10017098 - DNA, 22 bp, Homo sapiens
cttgcagggctgatgggaagtg

SEQ ID NO: 10017099 - DNA, 22 bp, Homo sapiens
cttcctgcaggacagccatctg

SEQ ID NO: 10017100 - DNA, 19 bp, Homo sapiens
cttcctggaggagagcctc

SEQ ID NO: 10017101 - DNA, 22 bp, Homo sapiens
cttcctggatgaagcccagcat

SEQ ID NO: 10017102 - DNA, 22 bp, Homo sapiens
cttcctggatgagcaggctgat

SEQ ID NO: 10017103 - DNA, 22 bp, Homo sapiens
cttcctgggcaatgttctgctt

SEQ ID NO: 10017104 - DNA, 22 bp, Homo sapiens
cttcctgggacacctaactcta

SEQ ID NO: 10017105 - DNA, 22 bp, Homo sapiens
cttcctggcatgggtctcatga

SEQ ID NO: 10017106 - DNA, 22 bp, Homo sapiens
cttcctgggtctggagactgga

SEQ ID NO: 10017107 - DNA, 22 bp, Homo sapiens
cttgacaactggcagatatata

SEQ ID NO: 10017108 - DNA, 22 bp, Homo sapiens
cttgacagtcccaggaaaatag

SEQ ID NO: 10017109 - DNA, 22 bp, Homo sapiens
ctttatgtccaccagactgcaa

SEQ ID NO: 10017110 - DNA, 22 bp, Homo sapiens
ctttatgagccttgtgaaggag

SEQ ID NO: 10017111 - DNA, 22 bp, Homo sapiens
ctttatggaatcaaagactgga

SEQ ID NO: 10017112 - DNA, 22 bp, Homo sapiens
ctttatgtactgtgtatttgaa

SEQ ID NO: 10017113 - DNA, 22 bp, Homo sapiens
cttgtcttgcacacggttgcca

SEQ ID NO: 10017114 - DNA, 22 bp, Homo sapiens
cttgtcttgcacacggttgcca

SEQ ID NO: 10017115 - DNA, 16 bp, Homo sapiens
cttgtctgttgctcat

SEQ ID NO: 10017116 - DNA, 22 bp, Homo sapiens
cttgtctgtgtcggataaaact

SEQ ID NO: 10017117 - DNA, 22 bp, Homo sapiens
cttgtcagccaattgtggattt

SEQ ID NO: 10017118 - DNA, 22 bp, Homo sapiens
cttgtcagtgtactttcttttg

SEQ ID NO: 10017119 - DNA, 22 bp, Homo sapiens
cttgtctgggcagcttgggagt

SEQ ID NO: 10017120 - DNA, 22 bp, Homo sapiens
cttgtcctttacttgagactca

SEQ ID NO: 10017121 - DNA, 21 bp, Homo sapiens
cttgtctgcagtgtttatagc

SEQ ID NO: 10017122 - DNA, 22 bp, Homo sapiens
cttgtctgctataaaaatccag

SEQ ID NO: 10017123 - DNA, 22 bp, Homo sapiens
cttgtcctttacttgagactca

SEQ ID NO: 10017124 - DNA, 22 bp, Homo sapiens
cttgtctgataatggggccaac

SEQ ID NO: 10017125 - DNA, 22 bp, Homo sapiens
cttgtcagcactttgccgaaaa

SEQ ID NO: 10017126 - DNA, 22 bp, Homo sapiens
cttgtattcttccacttaagat

SEQ ID NO: 10017127 - DNA, 22 bp, Homo sapiens
cttgtattctgcctaaccttca

SEQ ID NO: 10017128 - DNA, 22 bp, Homo sapiens
cttgtatagggaaagataaatc

SEQ ID NO: 10017129 - DNA, 22 bp, Homo sapiens
cttgtatacagtgtacacattg

SEQ ID NO: 10017130 - DNA, 22 bp, Homo sapiens
cttgtattcccctatctctaaa

SEQ ID NO: 10017131 - DNA, 20 bp, Homo sapiens
cttgccagttccctggcaga

SEQ ID NO: 10017132 - DNA, 22 bp, Homo sapiens
cttgccagtgttgcagaagctc

SEQ ID NO: 10017133 - DNA, 22 bp, Homo sapiens
cttgcatgcatttgaagatcat

SEQ ID NO: 10017134 - DNA, 22 bp, Homo sapiens
cttgccaatggtacaaacgatt

SEQ ID NO: 10017135 - DNA, 22 bp, Homo sapiens
cttgccagcacttggccagctg

SEQ ID NO: 10017136 - DNA, 22 bp, Homo sapiens
cttgtagaattgaaatggtctc

SEQ ID NO: 10017137 - DNA, 18 bp, Homo sapiens
cttcctcttctggagaaa

SEQ ID NO: 10017138 - DNA, 18 bp, Homo sapiens
cttcctcttctggagaaa

SEQ ID NO: 10017139 - DNA, 22 bp, Homo sapiens
cttcctctgtgtcctgggcttg

SEQ ID NO: 10017140 - DNA, 16 bp, Homo sapiens
cttcctcttcactggc

SEQ ID NO: 10017141 - DNA, 22 bp, Homo sapiens
cttcctctgcggcgccgggcgc

SEQ ID NO: 10017142 - DNA, 22 bp, Homo sapiens
cttcctctgtgtcctgggcttc

SEQ ID NO: 10017143 - DNA, 22 bp, Homo sapiens
cttccctttttatgtcttcagc

SEQ ID NO: 10017144 - DNA, 19 bp, Homo sapiens
cttcagtgttcacctggcc

SEQ ID NO: 10017145 - DNA, 22 bp, Homo sapiens
cttcagtgttcccatctgtaaa

SEQ ID NO: 10017146 - DNA, 23 bp, Homo sapiens
cttcagtgtgggactgcagcgtg

SEQ ID NO: 10017147 - DNA, 22 bp, Homo sapiens
cttcagtgtcctctctagtaga

SEQ ID NO: 10017148 - DNA, 23 bp, Homo sapiens
cttcagtgtgggactgcagcgtg

SEQ ID NO: 10017149 - DNA, 22 bp, Homo sapiens
cttcagtggtcatttgtgataa

SEQ ID NO: 10017150 - DNA, 18 bp, Homo sapiens
cttcagtggctgctctgc

SEQ ID NO: 10017151 - DNA, 22 bp, Homo sapiens
cttcctctgcctcccgtgctca

SEQ ID NO: 10017152 - DNA, 22 bp, Homo sapiens
cttcctctgaggcttctgagtc

SEQ ID NO: 10017153 - DNA, 22 bp, Homo sapiens
cttcctctgcctcccgtgctca

SEQ ID NO: 10017154 - DNA, 22 bp, Homo sapiens
cttcctaaaagcttcaagagaa

SEQ ID NO: 10017155 - DNA, 22 bp, Homo sapiens
cttccctttttatgtcttcagc

SEQ ID NO: 10017156 - DNA, 22 bp, Homo sapiens
cttcagtcgccttggcaggggc

SEQ ID NO: 10017157 - DNA, 19 bp, Homo sapiens
cttcagggaggggccaggc

SEQ ID NO: 10017158 - DNA, 22 bp, Homo sapiens
cttcagggtgacgcaggctgca

SEQ ID NO: 10017159 - DNA, 22 bp, Homo sapiens
cttcagggaggagcatgggttc

SEQ ID NO: 10017160 - DNA, 22 bp, Homo sapiens
cttcagtgcatgtttataatca

SEQ ID NO: 10017161 - DNA, 22 bp, Homo sapiens
cttcagtgattgcagaaagcct

SEQ ID NO: 10017162 - DNA, 22 bp, Homo sapiens
cttcagtgatataggcttctcc

SEQ ID NO: 10017163 - DNA, 22 bp, Homo sapiens
cttcagtgaatgttgagtaagg

SEQ ID NO: 10017164 - DNA, 22 bp, Homo sapiens
cttcagtgacagccacccaggc

SEQ ID NO: 10017165 - DNA, 22 bp, Homo sapiens
cttcagtgacattccttccctc

SEQ ID NO: 10017166 - DNA, 18 bp, Homo sapiens
cttcagtgacagtctggc

SEQ ID NO: 10017167 - DNA, 22 bp, Homo sapiens
cttcaggagtagttacctagca

SEQ ID NO: 10017168 - DNA, 22 bp, Homo sapiens
cttcagctgcagttatgtttag

SEQ ID NO: 10017169 - DNA, 22 bp, Homo sapiens
cttcagctgcagttatgtttag

SEQ ID NO: 10017170 - DNA, 22 bp, Homo sapiens
cttcagcctcgttactcctgcg

SEQ ID NO: 10017171 - DNA, 22 bp, Homo sapiens
cttatattttaggaacagacaa

SEQ ID NO: 10017172 - DNA, 22 bp, Homo sapiens
cttatcaaactggagcaggctt

SEQ ID NO: 10017173 - DNA, 22 bp, Homo sapiens
ctgttgttcatcatctgtcatt

SEQ ID NO: 10017174 - DNA, 22 bp, Homo sapiens
cttattctactccacaagctct

SEQ ID NO: 10017175 - DNA, 22 bp, Homo sapiens
cttatttaatgagggttagaat

SEQ ID NO: 10017176 - DNA, 22 bp, Homo sapiens
cttcagaaccagccagaagagg

SEQ ID NO: 10017177 - DNA, 22 bp, Homo sapiens
cttcagaactataaaaagtact

SEQ ID NO: 10017178 - DNA, 22 bp, Homo sapiens
cttcagaagaaaagcagtgtgt

SEQ ID NO: 10017179 - DNA, 22 bp, Homo sapiens
cttcaaacactagaaacacagg

SEQ ID NO: 10017180 - DNA, 22 bp, Homo sapiens
cttcaaacccagattaaatgca

SEQ ID NO: 10017181 - DNA, 22 bp, Homo sapiens
cttcaaacccagattaaatgca

SEQ ID NO: 10017182 - DNA, 22 bp, Homo sapiens
cttcaaacactagaaacacagg

SEQ ID NO: 10017183 - DNA, 22 bp, Homo sapiens
cttcaaacactagaaacacagg

SEQ ID NO: 10017184 - DNA, 22 bp, Homo sapiens
cttattttgctgatgacccagg

SEQ ID NO: 10017185 - DNA, 22 bp, Homo sapiens
cttattttaagtcagtttgggt

SEQ ID NO: 10017186 - DNA, 22 bp, Homo sapiens
cttatttctccatccagagtca

SEQ ID NO: 10017187 - DNA, 19 bp, Homo sapiens
cttatttctggttttgggt

SEQ ID NO: 10017188 - DNA, 22 bp, Homo sapiens
cttatttctccatccagagtca

SEQ ID NO: 10017189 - DNA, 22 bp, Homo sapiens
cttatttcctgacatggaaaga

SEQ ID NO: 10017190 - DNA, 22 bp, Homo sapiens
cttatttcagccctgggcaccc

SEQ ID NO: 10017191 - DNA, 22 bp, Homo sapiens
cttatttactgatccacagatg

SEQ ID NO: 10017192 - DNA, 22 bp, Homo sapiens
cttatttactgatccacagatg

SEQ ID NO: 10017193 - DNA, 22 bp, Homo sapiens
cttatttatgtctgtctctaat

SEQ ID NO: 10017194 - DNA, 22 bp, Homo sapiens
ctgtcctgcccaccctgcaggg

SEQ ID NO: 10017195 - DNA, 21 bp, Homo sapiens
ctgtcctggtctagaggcaca

SEQ ID NO: 10017196 - DNA, 22 bp, Homo sapiens
ctgtcctggtgctggggatccc

SEQ ID NO: 10017197 - DNA, 22 bp, Homo sapiens
ctgtcctgtactttgaggccct

SEQ ID NO: 10017198 - DNA, 22 bp, Homo sapiens
ctgtcctgtagctccatcagtc

SEQ ID NO: 10017199 - DNA, 22 bp, Homo sapiens
ctgtcctgtagctccatcagtc

SEQ ID NO: 10017200 - DNA, 22 bp, Homo sapiens
ctgtcctgtagctccatcagtc

SEQ ID NO: 10017201 - DNA, 22 bp, Homo sapiens
ctgtcctgcccaccctgcaggg

SEQ ID NO: 10017202 - DNA, 22 bp, Homo sapiens
ctgtcctgcccaccctgcaggg

SEQ ID NO: 10017203 - DNA, 22 bp, Homo sapiens
ctgtcctgcagttgggggcagg

SEQ ID NO: 10017204 - DNA, 22 bp, Homo sapiens
ctgtcctgccagtcctggactc

SEQ ID NO: 10017205 - DNA, 22 bp, Homo sapiens
ctgtcctgccagtcctggactc

SEQ ID NO: 10017206 - DNA, 22 bp, Homo sapiens
ctgtcctgagataaagatgagg

SEQ ID NO: 10017207 - DNA, 22 bp, Homo sapiens
ctgtcctgagttcttggaggtc

SEQ ID NO: 10017208 - DNA, 22 bp, Homo sapiens
ctgtcctgaggcaggtggcctg

SEQ ID NO: 10017209 - DNA, 20 bp, Homo sapiens
ctgtcctgatcttttcagaa

SEQ ID NO: 10017210 - DNA, 22 bp, Homo sapiens
ctgtcctgatggtgccactggt

SEQ ID NO: 10017211 - DNA, 22 bp, Homo sapiens
ctgtcctgatggtgccactggt

SEQ ID NO: 10017212 - DNA, 22 bp, Homo sapiens
ctgtcctgatggtgccactggt

SEQ ID NO: 10017213 - DNA, 22 bp, Homo sapiens
ctgggtgagttgatgaaggaga

SEQ ID NO: 10017214 - DNA, 22 bp, Homo sapiens
ctgggtgagttgatgaaggaga

SEQ ID NO: 10017215 - DNA, 22 bp, Homo sapiens
ctgggtgacagagtgagatggt

SEQ ID NO: 10017216 - DNA, 22 bp, Homo sapiens
ctgggtctttttcttccattga

SEQ ID NO: 10017217 - DNA, 22 bp, Homo sapiens
ctgggtgaatttgaaggaaagg

SEQ ID NO: 10017218 - DNA, 22 bp, Homo sapiens
ctgtcctgaagttttcatgaga

SEQ ID NO: 10017219 - DNA, 22 bp, Homo sapiens
ctgtcctgaaagggagattggg

SEQ ID NO: 10017220 - DNA, 22 bp, Homo sapiens
ctgtcctctgtcctcagcagga

SEQ ID NO: 10017221 - DNA, 22 bp, Homo sapiens
ctgggtgccagcatggctgagt

SEQ ID NO: 10017222 - DNA, 22 bp, Homo sapiens
ctgggtgctgtgggctcagagg

SEQ ID NO: 10017223 - DNA, 22 bp, Homo sapiens
ctgggtgctgtgggctcagagg

SEQ ID NO: 10017224 - DNA, 22 bp, Homo sapiens
ctgtgcattgttgagtgtttag

SEQ ID NO: 10017225 - DNA, 22 bp, Homo sapiens
ctgtgcatggccatcagtgccc

SEQ ID NO: 10017226 - DNA, 22 bp, Homo sapiens
ctgtgcatgtgttctctggtaa

SEQ ID NO: 10017227 - DNA, 22 bp, Homo sapiens
ctgtgcattgttgagtgtttag

SEQ ID NO: 10017228 - DNA, 22 bp, Homo sapiens
ctgtgcagtggggctctgggtt

SEQ ID NO: 10017229 - DNA, 22 bp, Homo sapiens
ctgtgcagtgtggggtaggcct

SEQ ID NO: 10017230 - DNA, 22 bp, Homo sapiens
ctgtgccagagggtgaccaagg

SEQ ID NO: 10017231 - DNA, 22 bp, Homo sapiens
ctgtgccactgccccaggcctc

SEQ ID NO: 10017232 - DNA, 22 bp, Homo sapiens
ctgtgagggtcacagccatgcc

SEQ ID NO: 10017233 - DNA, 22 bp, Homo sapiens
ctgtgagggtcacagccatgcc

SEQ ID NO: 10017234 - DNA, 22 bp, Homo sapiens
ctgtgcagtaggtcagggctgg

SEQ ID NO: 10017235 - DNA, 22 bp, Homo sapiens
ctgtgcagtaggtcagggctgg

SEQ ID NO: 10017236 - DNA, 22 bp, Homo sapiens
ctgtgcagtggcagcgtgtggg

SEQ ID NO: 10017237 - DNA, 22 bp, Homo sapiens
ctgtgcagtggcagcgtgtggg

SEQ ID NO: 10017238 - DNA, 22 bp, Homo sapiens
ctgtgagggccagagtcagggc

SEQ ID NO: 10017239 - DNA, 22 bp, Homo sapiens
ctgtgagggccagagtcagggc

SEQ ID NO: 10017240 - DNA, 22 bp, Homo sapiens
ctgtgagggccagagtcagggc

SEQ ID NO: 10017241 - DNA, 22 bp, Homo sapiens
ctgtgagggccagagtcagggc

SEQ ID NO: 10017242 - DNA, 22 bp, Homo sapiens
ctgtcctgtgcattgtcagatg

SEQ ID NO: 10017243 - DNA, 22 bp, Homo sapiens
ctgtcctgtagctccatcagtc

SEQ ID NO: 10017244 - DNA, 22 bp, Homo sapiens
ctgtggccagatggtgccagtt

SEQ ID NO: 10017245 - DNA, 22 bp, Homo sapiens
ctgtggccccaccctcttggcc

SEQ ID NO: 10017246 - DNA, 19 bp, Homo sapiens
ctgtgccctatgacttgta

SEQ ID NO: 10017247 - DNA, 22 bp, Homo sapiens
ctgtgcccaggctggagtgcag

SEQ ID NO: 10017248 - DNA, 22 bp, Homo sapiens
ctgtgcccggcccagggccctg

SEQ ID NO: 10017249 - DNA, 22 bp, Homo sapiens
ctgtgcccagctccctgactgc

SEQ ID NO: 10017250 - DNA, 22 bp, Homo sapiens
ctgtgcccacctggctctgagg

SEQ ID NO: 10017251 - DNA, 22 bp, Homo sapiens
ctgtgccaggcccagctgactt

SEQ ID NO: 10017252 - DNA, 22 bp, Homo sapiens
ctgtggtgggccctgggcttca

SEQ ID NO: 10017253 - DNA, 22 bp, Homo sapiens
ctgtgtctaatcaggtcagtca

SEQ ID NO: 10017254 - DNA, 22 bp, Homo sapiens
ctgtgtctaatcttatacatca

SEQ ID NO: 10017255 - DNA, 22 bp, Homo sapiens
ctgtgtccttttagttgctgtg

SEQ ID NO: 10017256 - DNA, 22 bp, Homo sapiens
ctgtgtctaatcaggtcagtca

SEQ ID NO: 10017257 - DNA, 23 bp, Homo sapiens
ctgtgtctatgcagccatatcca

SEQ ID NO: 10017258 - DNA, 22 bp, Homo sapiens
ctgtgtctaatcaggtcagtca

SEQ ID NO: 10017259 - DNA, 22 bp, Homo sapiens
ctgtgtctcatccgcctctggc

SEQ ID NO: 10017260 - DNA, 22 bp, Homo sapiens
ctgtgtcctcccgctgcaccca

SEQ ID NO: 10017261 - DNA, 22 bp, Homo sapiens
ctgtgtcctgcgtcaagccaat

SEQ ID NO: 10017262 - DNA, 22 bp, Homo sapiens
ctgtgtcctcccgctgcaccca

SEQ ID NO: 10017263 - DNA, 20 bp, Homo sapiens
ctgtggctcatgcatctgcc

SEQ ID NO: 10017264 - DNA, 22 bp, Homo sapiens
ctgtggctccatagaagttgca

SEQ ID NO: 10017265 - DNA, 22 bp, Homo sapiens
ctgtggctgcagccttggtcct

SEQ ID NO: 10017266 - DNA, 22 bp, Homo sapiens
ctgtggctgcgccatcgaaaac

SEQ ID NO: 10017267 - DNA, 22 bp, Homo sapiens
ctgtggctgcgccatcgaaaac

SEQ ID NO: 10017268 - DNA, 22 bp, Homo sapiens
ctgttattttataattcaagaa

SEQ ID NO: 10017269 - DNA, 22 bp, Homo sapiens
ctgttattttcctctgaactct

SEQ ID NO: 10017270 - DNA, 22 bp, Homo sapiens
ctgttcacagaatcctcccctg

SEQ ID NO: 10017271 - DNA, 22 bp, Homo sapiens
ctgttcatgttgaggcataggg

SEQ ID NO: 10017272 - DNA, 22 bp, Homo sapiens
ctgttctgaactgcctgcatgc

SEQ ID NO: 10017273 - DNA, 22 bp, Homo sapiens
ctgttctgaactgcctgcatgc

SEQ ID NO: 10017274 - DNA, 22 bp, Homo sapiens
ctgttctctggcggtggctgtt

SEQ ID NO: 10017275 - DNA, 22 bp, Homo sapiens
ctgttctatcattaaaagctat

SEQ ID NO: 10017276 - DNA, 22 bp, Homo sapiens
ctgttgattagaatttcacatc

SEQ ID NO: 10017277 - DNA, 18 bp, Homo sapiens
ctgttgagatgtggctga

SEQ ID NO: 10017278 - DNA, 22 bp, Homo sapiens
ctgttgatctcagttagctaga

SEQ ID NO: 10017279 - DNA, 22 bp, Homo sapiens
ctgttctgtaagctgctgttgt

SEQ ID NO: 10017280 - DNA, 17 bp, Homo sapiens
ctgttaattcatttccc

SEQ ID NO: 10017281 - DNA, 17 bp, Homo sapiens
ctgttaattcatttccc

SEQ ID NO: 10017282 - DNA, 22 bp, Homo sapiens
ctgttacatagcttttcttaac

SEQ ID NO: 10017283 - DNA, 22 bp, Homo sapiens
ctgtgtcttcctctgcccaggc

SEQ ID NO: 10017284 - DNA, 22 bp, Homo sapiens
ctgttaatctgcttgcatgatg

SEQ ID NO: 10017285 - DNA, 22 bp, Homo sapiens
ctgtgtcttcaatgtactggga

SEQ ID NO: 10017286 - DNA, 22 bp, Homo sapiens
ctgtgtcttcacatttgtgtgc

SEQ ID NO: 10017287 - DNA, 22 bp, Homo sapiens
ctgtgtcttcctctgcccaggc

SEQ ID NO: 10017288 - DNA, 22 bp, Homo sapiens
ctgtgtcttctgcttacagtct

SEQ ID NO: 10017289 - DNA, 22 bp, Homo sapiens
ctgtgtcttcacatttgtgtgc

SEQ ID NO: 10017290 - DNA, 22 bp, Homo sapiens
ctgtgtctgtggaatagcgaat

SEQ ID NO: 10017291 - DNA, 22 bp, Homo sapiens
ctgtgtcttcaatgtactggga

SEQ ID NO: 10017292 - DNA, 22 bp, Homo sapiens
ctgtgtcttcaatgtactggga

SEQ ID NO: 10017293 - DNA, 22 bp, Homo sapiens
ctgtgtctctccttacaagact

SEQ ID NO: 10017294 - DNA, 22 bp, Homo sapiens
ctgtgtctgaataactctgtgt

SEQ ID NO: 10017295 - DNA, 22 bp, Homo sapiens
ctgtgtctctccttacaagact

SEQ ID NO: 10017296 - DNA, 22 bp, Homo sapiens
ctgtgtctctccttacaagact

SEQ ID NO: 10017297 - DNA, 22 bp, Homo sapiens
ctgtgtctgcctgggatccatt

SEQ ID NO: 10017298 - DNA, 22 bp, Homo sapiens
ctgtgtctgaataactctgtgt

SEQ ID NO: 10017299 - DNA, 22 bp, Homo sapiens
ctgtgtctcatccgcctctggc

SEQ ID NO: 10017300 - DNA, 22 bp, Homo sapiens
ctgtgtctccttggtgggatat

SEQ ID NO: 10017301 - DNA, 22 bp, Homo sapiens
ctgtgtctcccaaggagggtca

SEQ ID NO: 10017302 - DNA, 22 bp, Homo sapiens
ctgtgtctccttggtgggatat

SEQ ID NO: 10017303 - DNA, 22 bp, Homo sapiens
ctgtgtctcgttaaagcattgg

SEQ ID NO: 10017304 - DNA, 22 bp, Homo sapiens
ctgtgtctctacctccccatcc

SEQ ID NO: 10017305 - DNA, 22 bp, Homo sapiens
gagccagactgcctgaagctca

SEQ ID NO: 10017306 - DNA, 22 bp, Homo sapiens
gagccagagatccaggatggct

SEQ ID NO: 10017307 - DNA, 22 bp, Homo sapiens
gagccagaaaagctgcctgact

SEQ ID NO: 10017308 - DNA, 22 bp, Homo sapiens
gagccagaaaagctgcctgact

SEQ ID NO: 10017309 - DNA, 22 bp, Homo sapiens
gagccagccgcaagagctgtga

SEQ ID NO: 10017310 - DNA, 22 bp, Homo sapiens
gagccagagctacaagtgtctg

SEQ ID NO: 10017311 - DNA, 22 bp, Homo sapiens
gagccagattttatgcaagaca

SEQ ID NO: 10017312 - DNA, 22 bp, Homo sapiens
gagccagagctacaagtgtctg

SEQ ID NO: 10017313 - DNA, 22 bp, Homo sapiens
gagccaggggtcagctccgagg

SEQ ID NO: 10017314 - DNA, 22 bp, Homo sapiens
gagccagggctgtgagctgagc

SEQ ID NO: 10017315 - DNA, 22 bp, Homo sapiens
gagccaggttggaggctgcagt

SEQ ID NO: 10017316 - DNA, 22 bp, Homo sapiens
gagccaggttggaggctgcagt

SEQ ID NO: 10017317 - DNA, 22 bp, Homo sapiens
gagccagggtttgaaactagac

SEQ ID NO: 10017318 - DNA, 22 bp, Homo sapiens
gagcagctgttctgacttgtct

SEQ ID NO: 10017319 - DNA, 22 bp, Homo sapiens
gagcagctgtggggttgaccat

SEQ ID NO: 10017320 - DNA, 22 bp, Homo sapiens
gagcagctgtggggttgaccat

SEQ ID NO: 10017321 - DNA, 22 bp, Homo sapiens
gagcagctgttctgacttgtct

SEQ ID NO: 10017322 - DNA, 22 bp, Homo sapiens
gagcagctgtccccaaagcttc

SEQ ID NO: 10017323 - DNA, 22 bp, Homo sapiens
gagcagctgtccccaaagcttc

SEQ ID NO: 10017324 - DNA, 22 bp, Homo sapiens
gagcagctggtaggtgaaccca

SEQ ID NO: 10017325 - DNA, 22 bp, Homo sapiens
gagcagctgtccccaaagcttc

SEQ ID NO: 10017326 - DNA, 22 bp, Homo sapiens
gagcagctggctgtattggttt

SEQ ID NO: 10017327 - DNA, 22 bp, Homo sapiens
gagcagctggtaggtgaaccca

SEQ ID NO: 10017328 - DNA, 22 bp, Homo sapiens
gagcagctggacaggcctccct

SEQ ID NO: 10017329 - DNA, 22 bp, Homo sapiens
gagcagctggacaggcctccct

SEQ ID NO: 10017330 - DNA, 22 bp, Homo sapiens
gagcagctggaggccttgttgg

SEQ ID NO: 10017331 - DNA, 22 bp, Homo sapiens
gagcagctggaggccttgttgg

SEQ ID NO: 10017332 - DNA, 22 bp, Homo sapiens
gagcagctggctgtattggttt

SEQ ID NO: 10017333 - DNA, 22 bp, Homo sapiens
gagcagctgcagtgcagaccct

SEQ ID NO: 10017334 - DNA, 22 bp, Homo sapiens
gagcagctgcagtgcagaccct

SEQ ID NO: 10017335 - DNA, 22 bp, Homo sapiens
gagcagctgcagtgcagaccct

SEQ ID NO: 10017336 - DNA, 19 bp, Homo sapiens
gagcagctgcacccattga

SEQ ID NO: 10017337 - DNA, 22 bp, Homo sapiens
gagcagcctgaggagcgtgggc

SEQ ID NO: 10017338 - DNA, 22 bp, Homo sapiens
gagccaagatcgcaccactgca

SEQ ID NO: 10017339 - DNA, 22 bp, Homo sapiens
gagcatttttgtctgcatttta

SEQ ID NO: 10017340 - DNA, 20 bp, Homo sapiens
gagcagctgtttgcattgca

SEQ ID NO: 10017341 - DNA, 22 bp, Homo sapiens
gagcagcttatgtcaagccaga

SEQ ID NO: 10017342 - DNA, 22 bp, Homo sapiens
gagccacagcaacctcaaagga

SEQ ID NO: 10017343 - DNA, 22 bp, Homo sapiens
gagccaagggcgtgctggagag

SEQ ID NO: 10017344 - DNA, 22 bp, Homo sapiens
gagccaatctttgggctcttgg

SEQ ID NO: 10017345 - DNA, 22 bp, Homo sapiens
gagccacagtggattgattcca

SEQ ID NO: 10017346 - DNA, 22 bp, Homo sapiens
gagccacagtggtggcccacgt

SEQ ID NO: 10017347 - DNA, 22 bp, Homo sapiens
gagccaccttcaactcaggaat

SEQ ID NO: 10017348 - DNA, 22 bp, Homo sapiens
gagatggaatctgtgtggaggg

SEQ ID NO: 10017349 - DNA, 20 bp, Homo sapiens
gagatggacagatgaagggg

SEQ ID NO: 10017350 - DNA, 22 bp, Homo sapiens
gagatggaaaactgctggtagt

SEQ ID NO: 10017351 - DNA, 22 bp, Homo sapiens
gagatggagtctttttctgtca

SEQ ID NO: 10017352 - DNA, 22 bp, Homo sapiens
gagatgtacaatgtgtattaat

SEQ ID NO: 10017353 - DNA, 22 bp, Homo sapiens
gagatggagtctttttctgtca

SEQ ID NO: 10017354 - DNA, 20 bp, Homo sapiens
gagattaactgagaatctag

SEQ ID NO: 10017355 - DNA, 22 bp, Homo sapiens
gagatgtgatcctttgctgtgt

SEQ ID NO: 10017356 - DNA, 22 bp, Homo sapiens
gagattgtttagctaccatggc

SEQ ID NO: 10017357 - DNA, 22 bp, Homo sapiens
gagatttaattggattaactta

SEQ ID NO: 10017358 - DNA, 22 bp, Homo sapiens
gagatttaattggattaactta

SEQ ID NO: 10017359 - DNA, 22 bp, Homo sapiens
gagattctgtgaaacggacatt

SEQ ID NO: 10017360 - DNA, 22 bp, Homo sapiens
gagcagcagctgggccaggttc

SEQ ID NO: 10017361 - DNA, 22 bp, Homo sapiens
gagcagcagctgggccaggttc

SEQ ID NO: 10017362 - DNA, 18 bp, Homo sapiens
gagcagcaggatcaagaa

SEQ ID NO: 10017363 - DNA, 22 bp, Homo sapiens
gagcagcagctgggccaggttc

SEQ ID NO: 10017364 - DNA, 22 bp, Homo sapiens
gagcagcaggccaggttgcagg

SEQ ID NO: 10017365 - DNA, 22 bp, Homo sapiens
gagcagcaggccaggttgcagg

SEQ ID NO: 10017366 - DNA, 22 bp, Homo sapiens
gagcagcaggccaggttgcagg

SEQ ID NO: 10017367 - DNA, 18 bp, Homo sapiens
gagcagcaggatcaagaa

SEQ ID NO: 10017368 - DNA, 18 bp, Homo sapiens
gagcagcaggatcaagaa

SEQ ID NO: 10017369 - DNA, 18 bp, Homo sapiens
gagcagcaggatcaagaa

SEQ ID NO: 10017370 - DNA, 22 bp, Homo sapiens
gagcagcaggtggctgtgatgg

SEQ ID NO: 10017371 - DNA, 22 bp, Homo sapiens
gagcagcaggtggggctggctt

SEQ ID NO: 10017372 - DNA, 22 bp, Homo sapiens
gagcagcaggtggggctggctt

SEQ ID NO: 10017373 - DNA, 22 bp, Homo sapiens
gagcagcagttgttacaatgat

SEQ ID NO: 10017374 - DNA, 22 bp, Homo sapiens
gagcagcagttgttacaatgat

SEQ ID NO: 10017375 - DNA, 22 bp, Homo sapiens
gagcagcagttgttacaatgat

SEQ ID NO: 10017376 - DNA, 22 bp, Homo sapiens
gagcagcatctccggcttaaag

SEQ ID NO: 10017377 - DNA, 21 bp, Homo sapiens
gagatttagaaggatcaattt

SEQ ID NO: 10017378 - DNA, 18 bp, Homo sapiens
gagcagaggctcaactgg

SEQ ID NO: 10017379 - DNA, 18 bp, Homo sapiens
gagcagaggctcaactgg

SEQ ID NO: 10017380 - DNA, 22 bp, Homo sapiens
gagcagatgtgtgccaggatgc

SEQ ID NO: 10017381 - DNA, 22 bp, Homo sapiens
gagcagagtctatttccacact

SEQ ID NO: 10017382 - DNA, 22 bp, Homo sapiens
gagcagcaaagggagggtaaat

SEQ ID NO: 10017383 - DNA, 22 bp, Homo sapiens
gagcagcaaagggagggtaaat

SEQ ID NO: 10017384 - DNA, 22 bp, Homo sapiens
gagcagcaagcactcaaaggct

SEQ ID NO: 10017385 - DNA, 22 bp, Homo sapiens
gagcagcaaagggagggtaaat

SEQ ID NO: 10017386 - DNA, 22 bp, Homo sapiens
gagcagcactgagttagcagct

SEQ ID NO: 10017387 - DNA, 22 bp, Homo sapiens
gagcagcaagcactcaaaggct

SEQ ID NO: 10017388 - DNA, 22 bp, Homo sapiens
gagcagcaagcactcaaaggct

SEQ ID NO: 10017389 - DNA, 22 bp, Homo sapiens
gagcagcactgagttagcagct

SEQ ID NO: 10017390 - DNA, 22 bp, Homo sapiens
gagcagcactgagttagcagct

SEQ ID NO: 10017391 - DNA, 22 bp, Homo sapiens
gagcagcagattgtctccatgg

SEQ ID NO: 10017392 - DNA, 22 bp, Homo sapiens
gagcagcacttgaggcatgtca

SEQ ID NO: 10017393 - DNA, 22 bp, Homo sapiens
gagaaggatgtggctcatagct

SEQ ID NO: 10017394 - DNA, 22 bp, Homo sapiens
gagaaggatgtggctcatagct

SEQ ID NO: 10017395 - DNA, 22 bp, Homo sapiens
gagaaggctgatccttggagtt

SEQ ID NO: 10017396 - DNA, 22 bp, Homo sapiens
gagaaggctggtcttaagtcga

SEQ ID NO: 10017397 - DNA, 22 bp, Homo sapiens
gagaagggcttgggagtcaaca

SEQ ID NO: 10017398 - DNA, 22 bp, Homo sapiens
gagaagggcttgggagtcaaca

SEQ ID NO: 10017399 - DNA, 22 bp, Homo sapiens
gagaagggatatgccactctcg

SEQ ID NO: 10017400 - DNA, 22 bp, Homo sapiens
gagaagggatatgccactctcg

SEQ ID NO: 10017401 - DNA, 22 bp, Homo sapiens
gagaagggatatggcttcttga

SEQ ID NO: 10017402 - DNA, 22 bp, Homo sapiens
gagaattagggcgtaattcaga

SEQ ID NO: 10017403 - DNA, 22 bp, Homo sapiens
gagaattagggcgtaattcaga

SEQ ID NO: 10017404 - DNA, 22 bp, Homo sapiens
gagaattactgtttttataaca

SEQ ID NO: 10017405 - DNA, 22 bp, Homo sapiens
gagaattactgtttttataaca

SEQ ID NO: 10017406 - DNA, 22 bp, Homo sapiens
gagacaaaagttggagtgcaag

SEQ ID NO: 10017407 - DNA, 22 bp, Homo sapiens
gagaatttcccagtctgtgctg

SEQ ID NO: 10017408 - DNA, 22 bp, Homo sapiens
gagaagggggctcgagtgtcct

SEQ ID NO: 10017409 - DNA, 22 bp, Homo sapiens
gagaatctccagatgaagtcct

SEQ ID NO: 10017410 - DNA, 22 bp, Homo sapiens
gagaagggggctcgagtgtcct

SEQ ID NO: 10017411 - DNA, 22 bp, Homo sapiens
gagaatctcaggcacccagaag

SEQ ID NO: 10017412 - DNA, 22 bp, Homo sapiens
gagaatctgggttttggctatc

SEQ ID NO: 10017413 - DNA, 19 bp, Homo sapiens
gagaatctctttgatgttt

SEQ ID NO: 10017414 - DNA, 22 bp, Homo sapiens
gagaatctctttgacaagcaga

SEQ ID NO: 10017415 - DNA, 22 bp, Homo sapiens
gagaatgatgatttccaatttc

SEQ ID NO: 10017416 - DNA, 21 bp, Homo sapiens
gagaatctgttttcttgtctt

SEQ ID NO: 10017417 - DNA, 22 bp, Homo sapiens
gagaatctttccccacagaagg

SEQ ID NO: 10017418 - DNA, 22 bp, Homo sapiens
gagaaggaggcgaagcgtgtgc

SEQ ID NO: 10017419 - DNA, 22 bp, Homo sapiens
gagaaggaggcgaagcgtgtgc

SEQ ID NO: 10017420 - DNA, 22 bp, Homo sapiens
gagaaggactacggaaaacaga

SEQ ID NO: 10017421 - DNA, 22 bp, Homo sapiens
gagaaggactacggaaaacaga

SEQ ID NO: 10017422 - DNA, 22 bp, Homo sapiens
gagaaggactacggaaaacaga

SEQ ID NO: 10017423 - DNA, 22 bp, Homo sapiens
gacctgaaatgggggcctgtcc

SEQ ID NO: 10017424 - DNA, 22 bp, Homo sapiens
gagaaggactacacatctggcc

SEQ ID NO: 10017425 - DNA, 22 bp, Homo sapiens
gacctgaaagtgtgggcgacct

SEQ ID NO: 10017426 - DNA, 22 bp, Homo sapiens
gacctgaaagagattaaatgac

SEQ ID NO: 10017427 - DNA, 22 bp, Homo sapiens
gacctgaaagagattaaatgac

SEQ ID NO: 10017428 - DNA, 22 bp, Homo sapiens
gacctcgtgatccgccctcctt

SEQ ID NO: 10017429 - DNA, 22 bp, Homo sapiens
gacctcatgatccacctgcctt

SEQ ID NO: 10017430 - DNA, 22 bp, Homo sapiens
gagaggccctgtggtcccagct

SEQ ID NO: 10017431 - DNA, 22 bp, Homo sapiens
gagaggccctgaagcccacaga

SEQ ID NO: 10017432 - DNA, 22 bp, Homo sapiens
gagaggctcagggacttgctga

SEQ ID NO: 10017433 - DNA, 19 bp, Homo sapiens
gagaggcctgtgcttgaag

SEQ ID NO: 10017434 - DNA, 22 bp, Homo sapiens
gagaggctatgaggttctgtgt

SEQ ID NO: 10017435 - DNA, 22 bp, Homo sapiens
gagaggcatggaacagattctt

SEQ ID NO: 10017436 - DNA, 22 bp, Homo sapiens
gagaggcatggaacagattctt

SEQ ID NO: 10017437 - DNA, 22 bp, Homo sapiens
gagaggcatggaacagattctt

SEQ ID NO: 10017438 - DNA, 22 bp, Homo sapiens
gagaggcaggcgctgcaatggt

SEQ ID NO: 10017439 - DNA, 22 bp, Homo sapiens
gagacaaaagttggagtgcaag

SEQ ID NO: 10017440 - DNA, 22 bp, Homo sapiens
gagacacaaacacatttagagg

SEQ ID NO: 10017441 - DNA, 22 bp, Homo sapiens
gagaggccatggggtgggatgc

SEQ ID NO: 10017442 - DNA, 22 bp, Homo sapiens
gagatcttcaaggttttagata

SEQ ID NO: 10017443 - DNA, 22 bp, Homo sapiens
gagagggatactgagttttggt

SEQ ID NO: 10017444 - DNA, 22 bp, Homo sapiens
gagatgagtgggggatctctca

SEQ ID NO: 10017445 - DNA, 22 bp, Homo sapiens
gagatgaatgtaaacaaaggca

SEQ ID NO: 10017446 - DNA, 22 bp, Homo sapiens
gagagggagccagccaggaacc

SEQ ID NO: 10017447 - DNA, 22 bp, Homo sapiens
gagagggagccagccaggaacc

SEQ ID NO: 10017448 - DNA, 22 bp, Homo sapiens
gagaggcttgtgtgaagaacaa

SEQ ID NO: 10017449 - DNA, 22 bp, Homo sapiens
gagaggctgggttggagatcga

SEQ ID NO: 10017450 - DNA, 22 bp, Homo sapiens
gagaggctgggttggagatcga

SEQ ID NO: 10017451 - DNA, 22 bp, Homo sapiens
gagaggctggtaaagtctgaac

SEQ ID NO: 10017452 - DNA, 22 bp, Homo sapiens
gagaggctgtgtgccattgttg

SEQ ID NO: 10017453 - DNA, 22 bp, Homo sapiens
gagaggcttaagggctgtgaag

SEQ ID NO: 10017454 - DNA, 22 bp, Homo sapiens
gagaggctgtgtgccattgttg

SEQ ID NO: 10017455 - DNA, 22 bp, Homo sapiens
gagcttaaatggctaaatataa

SEQ ID NO: 10017456 - DNA, 23 bp, Homo sapiens
gagcttagtctactcagacatcc

SEQ ID NO: 10017457 - DNA, 22 bp, Homo sapiens
gagcttccagagacatcagagt

SEQ ID NO: 10017458 - DNA, 22 bp, Homo sapiens
gagcttccatccttactgtgtg

SEQ ID NO: 10017459 - DNA, 22 bp, Homo sapiens
gagcttccatccttactgtgtg

SEQ ID NO: 10017460 - DNA, 22 bp, Homo sapiens
gagcttccatccttactgtgtg

SEQ ID NO: 10017461 - DNA, 22 bp, Homo sapiens
gagcttccatggacgccatctg

SEQ ID NO: 10017462 - DNA, 22 bp, Homo sapiens
gagcttcctttttctgcatgac

SEQ ID NO: 10017463 - DNA, 22 bp, Homo sapiens
gagcttctcaacagttatctct

SEQ ID NO: 10017464 - DNA, 22 bp, Homo sapiens
gagcttcctgcaggtcactgtg

SEQ ID NO: 10017465 - DNA, 22 bp, Homo sapiens
gagcttcctgatgccgaccagt

SEQ ID NO: 10017466 - DNA, 22 bp, Homo sapiens
gagcttccctctgcagtccctg

SEQ ID NO: 10017467 - DNA, 22 bp, Homo sapiens
gagcttccctctgcagtccctg

SEQ ID NO: 10017468 - DNA, 22 bp, Homo sapiens
gagcttggaagcagatcctcac

SEQ ID NO: 10017469 - DNA, 22 bp, Homo sapiens
gagcttggatgtcttttgttca

SEQ ID NO: 10017470 - DNA, 22 bp, Homo sapiens
gagcttggcagtgtcactaggg

SEQ ID NO: 10017471 - DNA, 22 bp, Homo sapiens
gagcttggcagtgtcactaggg

SEQ ID NO: 10017472 - DNA, 22 bp, Homo sapiens
gagcttttataccttctctcag

SEQ ID NO: 10017473 - DNA, 22 bp, Homo sapiens
gagcttttgtgggggccaaggt

SEQ ID NO: 10017474 - DNA, 22 bp, Homo sapiens
gagcttttcccgtctttctcgt

SEQ ID NO: 10017475 - DNA, 22 bp, Homo sapiens
gagcttttcttccagttaatga

SEQ ID NO: 10017476 - DNA, 22 bp, Homo sapiens
gagctgagaagcagcgcttgat

SEQ ID NO: 10017477 - DNA, 22 bp, Homo sapiens
gagctgagacacactttggcaa

SEQ ID NO: 10017478 - DNA, 19 bp, Homo sapiens
gagctgagagtagcactgg

SEQ ID NO: 10017479 - DNA, 22 bp, Homo sapiens
gagctgagacacactttggcaa

SEQ ID NO: 10017480 - DNA, 19 bp, Homo sapiens
gagctgagagtagcactgg

SEQ ID NO: 10017481 - DNA, 22 bp, Homo sapiens
gagctgtgttgtctagtaccga

SEQ ID NO: 10017482 - DNA, 22 bp, Homo sapiens
gagctgtgttcatgaggagaaa

SEQ ID NO: 10017483 - DNA, 22 bp, Homo sapiens
gagctgtgttcatgaggagaaa

SEQ ID NO: 10017484 - DNA, 18 bp, Homo sapiens
gagctgagaagaggatgc

SEQ ID NO: 10017485 - DNA, 21 bp, Homo sapiens
gagctgaatatgttctagggg

SEQ ID NO: 10017486 - DNA, 22 bp, Homo sapiens
gagctgaagtttccatttgtac

SEQ ID NO: 10017487 - DNA, 22 bp, Homo sapiens
gagctgaaatatgaagccaatt

SEQ ID NO: 10017488 - DNA, 22 bp, Homo sapiens
gagcccttttcctagatactgt

SEQ ID NO: 10017489 - DNA, 22 bp, Homo sapiens
gagcctcgtggcggccactgcg

SEQ ID NO: 10017490 - DNA, 22 bp, Homo sapiens
gagcctgatgaaacaggcagac

SEQ ID NO: 10017491 - DNA, 22 bp, Homo sapiens
gagcctgcccagccctgtccac

SEQ ID NO: 10017492 - DNA, 22 bp, Homo sapiens
gagcctggagctggaacgaagc

SEQ ID NO: 10017493 - DNA, 22 bp, Homo sapiens
gagcctggacatctcaggccca

SEQ ID NO: 10017494 - DNA, 22 bp, Homo sapiens
gagcggaggcttggaggccagc

SEQ ID NO: 10017495 - DNA, 22 bp, Homo sapiens
gagcctggagctggaacgaagc

SEQ ID NO: 10017496 - DNA, 22 bp, Homo sapiens
gagcctggattgaagtgggtgg

SEQ ID NO: 10017497 - DNA, 22 bp, Homo sapiens
gagctctgtgtagcctgagggt

SEQ ID NO: 10017498 - DNA, 22 bp, Homo sapiens
gagctctgtgtggcttgggtgg

SEQ ID NO: 10017499 - DNA, 22 bp, Homo sapiens
gagctctgttctcgtcctgctg

SEQ ID NO: 10017500 - DNA, 22 bp, Homo sapiens
gagctagagtttgtagggtaga

SEQ ID NO: 10017501 - DNA, 22 bp, Homo sapiens
gagctagtagaacaagtgagga

SEQ ID NO: 10017502 - DNA, 22 bp, Homo sapiens
gagctaggctagggggagtcgc

SEQ ID NO: 10017503 - DNA, 22 bp, Homo sapiens
gagctaggatatcatgagggta

SEQ ID NO: 10017504 - DNA, 22 bp, Homo sapiens
gagcgggaggaacggctcgggc

SEQ ID NO: 10017505 - DNA, 22 bp, Homo sapiens
gagctaagctatgttatgcagc

SEQ ID NO: 10017506 - DNA, 22 bp, Homo sapiens
gaggaaaataacaactaagggc

SEQ ID NO: 10017507 - DNA, 22 bp, Homo sapiens
gaggaaaataacaactaagggc

SEQ ID NO: 10017508 - DNA, 22 bp, Homo sapiens
gaggaaaagagacaggttattg

SEQ ID NO: 10017509 - DNA, 23 bp, Homo sapiens
gagcttttgtagtagtcactgtg

SEQ ID NO: 10017510 - DNA, 22 bp, Homo sapiens
gaggaaaataacaactaagggc

SEQ ID NO: 10017511 - DNA, 22 bp, Homo sapiens
gaggaaaataacaactaagggc

SEQ ID NO: 10017512 - DNA, 22 bp, Homo sapiens
gaggaaaatattcagggaggtt

SEQ ID NO: 10017513 - DNA, 22 bp, Homo sapiens
gaggaaaatattcagggaggtt

SEQ ID NO: 10017514 - DNA, 22 bp, Homo sapiens
gaggaaaatattcagggaggtt

SEQ ID NO: 10017515 - DNA, 22 bp, Homo sapiens
gaggaaaatattcagggaggtt

SEQ ID NO: 10017516 - DNA, 22 bp, Homo sapiens
gaggagcttgtgagaagatgtc

SEQ ID NO: 10017517 - DNA, 22 bp, Homo sapiens
gaggagcttgtgagaagatgtc

SEQ ID NO: 10017518 - DNA, 22 bp, Homo sapiens
gaggagctgtctttgtgatctt

SEQ ID NO: 10017519 - DNA, 22 bp, Homo sapiens
gaggaggaggaagtggaaccca

SEQ ID NO: 10017520 - DNA, 19 bp, Homo sapiens
gaggaggaaaactagtgta

SEQ ID NO: 10017521 - DNA, 22 bp, Homo sapiens
gaggaggaaaccctgttcctct

SEQ ID NO: 10017522 - DNA, 22 bp, Homo sapiens
gaggaggaaaggagttgaaatg

SEQ ID NO: 10017523 - DNA, 22 bp, Homo sapiens
gaggaggaagttctctgtaggc

SEQ ID NO: 10017524 - DNA, 22 bp, Homo sapiens
gaggaggccagtggaaggaagc

SEQ ID NO: 10017525 - DNA, 22 bp, Homo sapiens
gaggaggctaagtgggctctgg

SEQ ID NO: 10017526 - DNA, 22 bp, Homo sapiens
gaggcaagagaagccagctttc

SEQ ID NO: 10017527 - DNA, 22 bp, Homo sapiens
gaggcaaggccgcacgtctcag

SEQ ID NO: 10017528 - DNA, 22 bp, Homo sapiens
gaggaggctaagtgggctctgg

SEQ ID NO: 10017529 - DNA, 22 bp, Homo sapiens
gaggaggctatcagcaatcagg

SEQ ID NO: 10017530 - DNA, 22 bp, Homo sapiens
gaggaggctatcagcaatcagg

SEQ ID NO: 10017531 - DNA, 22 bp, Homo sapiens
gaggccagatgtcatgtcttat

SEQ ID NO: 10017532 - DNA, 22 bp, Homo sapiens
gaggcagaggaaggtggtctct

SEQ ID NO: 10017533 - DNA, 22 bp, Homo sapiens
gaggccagatgtcatgtcttat

SEQ ID NO: 10017534 - DNA, 22 bp, Homo sapiens
gaggccagcccctcttgaaggc

SEQ ID NO: 10017535 - DNA, 22 bp, Homo sapiens
gaggccagcgcgcagcactttt

SEQ ID NO: 10017536 - DNA, 22 bp, Homo sapiens
gaggccagcgcgcagcactttt

SEQ ID NO: 10017537 - DNA, 22 bp, Homo sapiens
gaggccagctagtccaggaagt

SEQ ID NO: 10017538 - DNA, 22 bp, Homo sapiens
gaggccagctagtccaggaagt

SEQ ID NO: 10017539 - DNA, 22 bp, Homo sapiens
gaggccagctacccaagggtca

SEQ ID NO: 10017540 - DNA, 22 bp, Homo sapiens
gaggccagcgcgcagcactttt

SEQ ID NO: 10017541 - DNA, 22 bp, Homo sapiens
gaggccagctacccaagggtca

SEQ ID NO: 10017542 - DNA, 22 bp, Homo sapiens
gaggccaggacatgaaagctga

SEQ ID NO: 10017543 - DNA, 22 bp, Homo sapiens
gaggccaggacatgaaagctga

SEQ ID NO: 10017544 - DNA, 22 bp, Homo sapiens
gaggccaggaagcccaagatca

SEQ ID NO: 10017545 - DNA, 22 bp, Homo sapiens
gaggccaggaagcccaagatca

SEQ ID NO: 10017546 - DNA, 22 bp, Homo sapiens
gaggcacatcacttggtgcatt

SEQ ID NO: 10017547 - DNA, 22 bp, Homo sapiens
gaggcacatcacttggtgcatt

SEQ ID NO: 10017548 - DNA, 22 bp, Homo sapiens
gaggcagaagttgcagtgagca

SEQ ID NO: 10017549 - DNA, 22 bp, Homo sapiens
gaggcagaagttgcagtgagca

SEQ ID NO: 10017550 - DNA, 22 bp, Homo sapiens
gaggcagagaccttcaggacct

SEQ ID NO: 10017551 - DNA, 22 bp, Homo sapiens
gaggcagagactccaccttcag

SEQ ID NO: 10017552 - DNA, 22 bp, Homo sapiens
gaaatatttctcttgagcccct

SEQ ID NO: 10017553 - DNA, 22 bp, Homo sapiens
gaaatatttctcttgagcccct

SEQ ID NO: 10017554 - DNA, 22 bp, Homo sapiens
gaaatcaaacccttttctgata

SEQ ID NO: 10017555 - DNA, 22 bp, Homo sapiens
gaaatcacttttttcatagttg

SEQ ID NO: 10017556 - DNA, 22 bp, Homo sapiens
gaaatcaatttcttggttgata

SEQ ID NO: 10017557 - DNA, 22 bp, Homo sapiens
gaaatcaatttcttggttgata

SEQ ID NO: 10017558 - DNA, 22 bp, Homo sapiens
gaaatcaaggctacattcaggt

SEQ ID NO: 10017559 - DNA, 22 bp, Homo sapiens
ctttcatttgataagaatgcca

SEQ ID NO: 10017560 - DNA, 22 bp, Homo sapiens
ctttccaactctagtgaaattt

SEQ ID NO: 10017561 - DNA, 22 bp, Homo sapiens
ctttcattcttagatattagtg

SEQ ID NO: 10017562 - DNA, 23 bp, Homo sapiens
ctttcattgtggtttcacagagc

SEQ ID NO: 10017563 - DNA, 23 bp, Homo sapiens
ctttcattgtggtttcacagagc

SEQ ID NO: 10017564 - DNA, 22 bp, Homo sapiens
ctttcatgaacagacaaggaac

SEQ ID NO: 10017565 - DNA, 22 bp, Homo sapiens
ctttcatagttaaaatagtttg

SEQ ID NO: 10017566 - DNA, 22 bp, Homo sapiens
ctttcatagttaaaatagtttg

SEQ ID NO: 10017567 - DNA, 22 bp, Homo sapiens
ctttcataattcagcacattga

SEQ ID NO: 10017568 - DNA, 22 bp, Homo sapiens
ctttcataattcagcacattga

SEQ ID NO: 10017569 - DNA, 22 bp, Homo sapiens
ctttcataaggggttttataat

SEQ ID NO: 10017570 - DNA, 22 bp, Homo sapiens
ctttcatgcagttgacaaggtg

SEQ ID NO: 10017571 - DNA, 18 bp, Homo sapiens
ctttatgtgcagagcttt

SEQ ID NO: 10017572 - DNA, 22 bp, Homo sapiens
ctttatgtccttgaagagttgt

SEQ ID NO: 10017573 - DNA, 22 bp, Homo sapiens
ctttatgtgctgggcattaagg

SEQ ID NO: 10017574 - DNA, 22 bp, Homo sapiens
ctttcacagtcatatgatgaat

SEQ ID NO: 10017575 - DNA, 22 bp, Homo sapiens
ctttcacagccttcgttctgaa

SEQ ID NO: 10017576 - DNA, 22 bp, Homo sapiens
ctttcacagctgtgcttatgat

SEQ ID NO: 10017577 - DNA, 22 bp, Homo sapiens
ctttcaggttctataggaagcc

SEQ ID NO: 10017578 - DNA, 22 bp, Homo sapiens
ctttcagaggttactcaggaaa

SEQ ID NO: 10017579 - DNA, 18 bp, Homo sapiens
ctttcagtaatttcagcc

SEQ ID NO: 10017580 - DNA, 22 bp, Homo sapiens
ctttcagttaatgactccatag

SEQ ID NO: 10017581 - DNA, 22 bp, Homo sapiens
ctttcagttacagttacacaca

SEQ ID NO: 10017582 - DNA, 22 bp, Homo sapiens
ctttcagtctttacaaggttgc

SEQ ID NO: 10017583 - DNA, 22 bp, Homo sapiens
ctttcagtcagttaactcagaa

SEQ ID NO: 10017584 - DNA, 22 bp, Homo sapiens
ctttcagttagtacctagtggc

SEQ ID NO: 10017585 - DNA, 22 bp, Homo sapiens
ctttcagttacagttacacaca

SEQ ID NO: 10017586 - DNA, 22 bp, Homo sapiens
ctttcataaggggttttataat

SEQ ID NO: 10017587 - DNA, 22 bp, Homo sapiens
ctttcataaaggaaatgatgag

SEQ ID NO: 10017588 - DNA, 22 bp, Homo sapiens
ctttcataaaggaaatgatgag

SEQ ID NO: 10017589 - DNA, 22 bp, Homo sapiens
gaacatttggatttgtaaattt

SEQ ID NO: 10017590 - DNA, 22 bp, Homo sapiens
gaacatttggatttgtaaattt

SEQ ID NO: 10017591 - DNA, 22 bp, Homo sapiens
gaacatttggatttgtaaattt

SEQ ID NO: 10017592 - DNA, 17 bp, Homo sapiens
gaacagtgtaagacact

SEQ ID NO: 10017593 - DNA, 22 bp, Homo sapiens
gaacagtgccagcacacaataa

SEQ ID NO: 10017594 - DNA, 22 bp, Homo sapiens
gaacagtatcagtagtgccagt

SEQ ID NO: 10017595 - DNA, 22 bp, Homo sapiens
gaacagtatcagtagtgccagt

SEQ ID NO: 10017596 - DNA, 22 bp, Homo sapiens
gaacagtatcagtagtgccagt

SEQ ID NO: 10017597 - DNA, 22 bp, Homo sapiens
gaacagtatttccaggaatccc

SEQ ID NO: 10017598 - DNA, 22 bp, Homo sapiens
gaacagtatttccaggaatccc

SEQ ID NO: 10017599 - DNA, 22 bp, Homo sapiens
gaacagtaactgtctgctgtgt

SEQ ID NO: 10017600 - DNA, 22 bp, Homo sapiens
gaacagtaaatttatgcagcac

SEQ ID NO: 10017601 - DNA, 22 bp, Homo sapiens
gaacagtaaatttatgcagcac

SEQ ID NO: 10017602 - DNA, 22 bp, Homo sapiens
gaacagtaactgtctgctgtgt

SEQ ID NO: 10017603 - DNA, 22 bp, Homo sapiens
gaacagtacagttgagtagttg

SEQ ID NO: 10017604 - DNA, 22 bp, Homo sapiens
gaacagtactaagagctttaca

SEQ ID NO: 10017605 - DNA, 22 bp, Homo sapiens
gaacagtactaagagctttaca

SEQ ID NO: 10017606 - DNA, 22 bp, Homo sapiens
gaacagtagatgagatgctaga

SEQ ID NO: 10017607 - DNA, 22 bp, Homo sapiens
gaacagtagatgagatgctaga

SEQ ID NO: 10017608 - DNA, 22 bp, Homo sapiens
gaacagggttgggtgagagagg

SEQ ID NO: 10017609 - DNA, 22 bp, Homo sapiens
gaacagggtttgagaggcttag

SEQ ID NO: 10017610 - DNA, 22 bp, Homo sapiens
gaacagggtttgagaggcttag

SEQ ID NO: 10017611 - DNA, 22 bp, Homo sapiens
gaacagggttgggtgagagagg

SEQ ID NO: 10017612 - DNA, 22 bp, Homo sapiens
gaacagggagtacggcacattt

SEQ ID NO: 10017613 - DNA, 22 bp, Homo sapiens
gaacagctataatcatctgtcc

SEQ ID NO: 10017614 - DNA, 22 bp, Homo sapiens
gaacagctataatcatctgtcc

SEQ ID NO: 10017615 - DNA, 22 bp, Homo sapiens
gaaatcattagcaaagatatgt

SEQ ID NO: 10017616 - DNA, 22 bp, Homo sapiens
gaaatctacgattagtgaaaat

SEQ ID NO: 10017617 - DNA, 22 bp, Homo sapiens
gaaatctacgattagtgaaaat

SEQ ID NO: 10017618 - DNA, 22 bp, Homo sapiens
gaaatgattttagtttatcatg

SEQ ID NO: 10017619 - DNA, 20 bp, Homo sapiens
gaaatgtacacattaccaca

SEQ ID NO: 10017620 - DNA, 22 bp, Homo sapiens
gaaatgtaattctcttgaagat

SEQ ID NO: 10017621 - DNA, 22 bp, Homo sapiens
gaaatgtaattctcttgaagat

SEQ ID NO: 10017622 - DNA, 20 bp, Homo sapiens
gaaatgtacacattaccaca

SEQ ID NO: 10017623 - DNA, 22 bp, Homo sapiens
gaaatgtactttaaagccatcc

SEQ ID NO: 10017624 - DNA, 17 bp, Homo sapiens
gaacagcagaggggaca

SEQ ID NO: 10017625 - DNA, 22 bp, Homo sapiens
gaacagcagctcgttctcgatg

SEQ ID NO: 10017626 - DNA, 22 bp, Homo sapiens
gaaatgcatggatcttggcaga

SEQ ID NO: 10017627 - DNA, 22 bp, Homo sapiens
gaaatgctacacttgttaatga

SEQ ID NO: 10017628 - DNA, 22 bp, Homo sapiens
gaaatgtaattctcttgaagat

SEQ ID NO: 10017629 - DNA, 22 bp, Homo sapiens
gaagattgaaggctgggaatta

SEQ ID NO: 10017630 - DNA, 22 bp, Homo sapiens
gaagatttctgatgagttactt

SEQ ID NO: 10017631 - DNA, 22 bp, Homo sapiens
gaagatttctgatgagttactt

SEQ ID NO: 10017632 - DNA, 22 bp, Homo sapiens
gaagatttcagttaagtatcta

SEQ ID NO: 10017633 - DNA, 22 bp, Homo sapiens
gaagatttcagttaagtatcta

SEQ ID NO: 10017634 - DNA, 22 bp, Homo sapiens
gaagatttctttatgaaagatg

SEQ ID NO: 10017635 - DNA, 22 bp, Homo sapiens
gaagatttctttatgaaagatg

SEQ ID NO: 10017636 - DNA, 22 bp, Homo sapiens
gaagatttcagttaagtatcta

SEQ ID NO: 10017637 - DNA, 22 bp, Homo sapiens
gaagatttctttatgaaagatg

SEQ ID NO: 10017638 - DNA, 22 bp, Homo sapiens
gaagatttaagcacaatagtct

SEQ ID NO: 10017639 - DNA, 22 bp, Homo sapiens
gaagatttataaggaccttatt

SEQ ID NO: 10017640 - DNA, 22 bp, Homo sapiens
gaagatttataggagcctatta

SEQ ID NO: 10017641 - DNA, 22 bp, Homo sapiens
gaagatctgcagcctcaggcga

SEQ ID NO: 10017642 - DNA, 22 bp, Homo sapiens
gaagatgggaatgatgagtggg

SEQ ID NO: 10017643 - DNA, 22 bp, Homo sapiens
gaagatgggaatgatgagtggg

SEQ ID NO: 10017644 - DNA, 22 bp, Homo sapiens
gaagatcagagtaagcttttta

SEQ ID NO: 10017645 - DNA, 22 bp, Homo sapiens
gaagaggctttcctagggcaag

SEQ ID NO: 10017646 - DNA, 22 bp, Homo sapiens
gaagaggtagcattggcaggtg

SEQ ID NO: 10017647 - DNA, 22 bp, Homo sapiens
gaagagtggttatccctgctgt

SEQ ID NO: 10017648 - DNA, 22 bp, Homo sapiens
gaagagtatatttagtgaaatc

SEQ ID NO: 10017649 - DNA, 22 bp, Homo sapiens
gaagatttttcttaatgctccg

SEQ ID NO: 10017650 - DNA, 22 bp, Homo sapiens
gaagattttctcctttaaatga

SEQ ID NO: 10017651 - DNA, 22 bp, Homo sapiens
gaagatttgaaacacatagaca

SEQ ID NO: 10017652 - DNA, 22 bp, Homo sapiens
gaagatttgaaacacatagaca

SEQ ID NO: 10017653 - DNA, 22 bp, Homo sapiens
gaagatttgcccatgcactttt

SEQ ID NO: 10017654 - DNA, 22 bp, Homo sapiens
gaagatttgttgtaatttttag

SEQ ID NO: 10017655 - DNA, 22 bp, Homo sapiens
gaagatttggattccatgtcac

SEQ ID NO: 10017656 - DNA, 22 bp, Homo sapiens
gaagccagccttgtctgcctct

SEQ ID NO: 10017657 - DNA, 22 bp, Homo sapiens
gaagccaggggcctgacaggca

SEQ ID NO: 10017658 - DNA, 22 bp, Homo sapiens
gaagccagcagtggagaaagga

SEQ ID NO: 10017659 - DNA, 22 bp, Homo sapiens
gaagcccatttgtacagcacat

SEQ ID NO: 10017660 - DNA, 22 bp, Homo sapiens
gaagccccaaaccctcgccatc

SEQ ID NO: 10017661 - DNA, 22 bp, Homo sapiens
gaagccctatcctctcctggga

SEQ ID NO: 10017662 - DNA, 22 bp, Homo sapiens
gaagccagtactgtgctctgca

SEQ ID NO: 10017663 - DNA, 22 bp, Homo sapiens
gaagccagtgtttgaagaattt

SEQ ID NO: 10017664 - DNA, 22 bp, Homo sapiens
gaagcccagcaaactgtgatca

SEQ ID NO: 10017665 - DNA, 22 bp, Homo sapiens
gaagagctatgtccagggagca

SEQ ID NO: 10017666 - DNA, 22 bp, Homo sapiens
gaagagctccaaaaacagtgag

SEQ ID NO: 10017667 - DNA, 22 bp, Homo sapiens
gaagagctgacagtgtcatcct

SEQ ID NO: 10017668 - DNA, 22 bp, Homo sapiens
gaagagctgcacactggggact

SEQ ID NO: 10017669 - DNA, 22 bp, Homo sapiens
gaagagctgctcagaacatgat

SEQ ID NO: 10017670 - DNA, 22 bp, Homo sapiens
gaagagctgcagtttcctgggc

SEQ ID NO: 10017671 - DNA, 22 bp, Homo sapiens
gaagagaagcatcaataggtaa

SEQ ID NO: 10017672 - DNA, 22 bp, Homo sapiens
gaagagaagcatcaataggtaa

SEQ ID NO: 10017673 - DNA, 22 bp, Homo sapiens
gaagactttaagccgagattag

SEQ ID NO: 10017674 - DNA, 22 bp, Homo sapiens
gaagagaaaggcaaggagtttt

SEQ ID NO: 10017675 - DNA, 22 bp, Homo sapiens
gaagagctgtcagaaaagctaa

SEQ ID NO: 10017676 - DNA, 22 bp, Homo sapiens
gaagaggactgtggcatcctag

SEQ ID NO: 10017677 - DNA, 22 bp, Homo sapiens
gaagaggatgacaggagccggt

SEQ ID NO: 10017678 - DNA, 22 bp, Homo sapiens
gaagaggcaattgaataagcta

SEQ ID NO: 10017679 - DNA, 22 bp, Homo sapiens
gaagaggctttcctagggcaag

SEQ ID NO: 10017680 - DNA, 22 bp, Homo sapiens
gaagaggatgacaggagccggt

SEQ ID NO: 10017681 - DNA, 22 bp, Homo sapiens
gaagacattttatgcatactct

SEQ ID NO: 10017682 - DNA, 22 bp, Homo sapiens
gaagacactctgcagagttatc

SEQ ID NO: 10017683 - DNA, 22 bp, Homo sapiens
gaagacatgtggattctagttt

SEQ ID NO: 10017684 - DNA, 22 bp, Homo sapiens
gaagacatcatggagaggatag

SEQ ID NO: 10017685 - DNA, 22 bp, Homo sapiens
gaagacagaaacctgtttggct

SEQ ID NO: 10017686 - DNA, 22 bp, Homo sapiens
gaagacaattctgggtggagga

SEQ ID NO: 10017687 - DNA, 21 bp, Homo sapiens
gaacccagcagcagtgctctg

SEQ ID NO: 10017688 - DNA, 22 bp, Homo sapiens
gaaccacaagattcaaaggggt

SEQ ID NO: 10017689 - DNA, 21 bp, Homo sapiens
gaacatttgggttgtttctac

SEQ ID NO: 10017690 - DNA, 20 bp, Homo sapiens
gaacatttggccatactgag

SEQ ID NO: 10017691 - DNA, 21 bp, Homo sapiens
gaacatttgggttgtttctac

SEQ ID NO: 10017692 - DNA, 22 bp, Homo sapiens
gacaaggcaaccagggaggctt

SEQ ID NO: 10017693 - DNA, 22 bp, Homo sapiens
gacaaggcagaaagcttaaagg

SEQ ID NO: 10017694 - DNA, 22 bp, Homo sapiens
gacaaggcgcccagcctgccaa

SEQ ID NO: 10017695 - DNA, 22 bp, Homo sapiens
gacacagaattcccctccaagt

SEQ ID NO: 10017696 - DNA, 22 bp, Homo sapiens
gacacagaatgggtgctcagta

SEQ ID NO: 10017697 - DNA, 22 bp, Homo sapiens
gacacagaatgggtgctcagta

SEQ ID NO: 10017698 - DNA, 22 bp, Homo sapiens
gacaagttgtggagaagagggt

SEQ ID NO: 10017699 - DNA, 22 bp, Homo sapiens
gacaataaaatgatcttacagt

SEQ ID NO: 10017700 - DNA, 22 bp, Homo sapiens
gacaagttacacctgtgcttga

SEQ ID NO: 10017701 - DNA, 22 bp, Homo sapiens
gacaataaaatgatcttacagt

SEQ ID NO: 10017702 - DNA, 22 bp, Homo sapiens
gacacagaaggtcacatgttca

SEQ ID NO: 10017703 - DNA, 22 bp, Homo sapiens
gacacagaaggtcacatgttca

SEQ ID NO: 10017704 - DNA, 22 bp, Homo sapiens
gacaggctaggttgctgtcctc

SEQ ID NO: 10017705 - DNA, 17 bp, Homo sapiens
gacaggctcagtgacga

SEQ ID NO: 10017706 - DNA, 22 bp, Homo sapiens
gacacagagataggcctgtgtt

SEQ ID NO: 10017707 - DNA, 22 bp, Homo sapiens
gacaggccaggggctgaggtgg

SEQ ID NO: 10017708 - DNA, 22 bp, Homo sapiens
gacacagagacttgcagttgta

SEQ ID NO: 10017709 - DNA, 22 bp, Homo sapiens
gacacagagacttgcagttgta

SEQ ID NO: 10017710 - DNA, 22 bp, Homo sapiens
gacacagaatttactcccgata

SEQ ID NO: 10017711 - DNA, 22 bp, Homo sapiens
gacacagacagttagaggtaat

SEQ ID NO: 10017712 - DNA, 22 bp, Homo sapiens
gacaggctttctcaggatgagc

SEQ ID NO: 10017713 - DNA, 22 bp, Homo sapiens
gacaggcttcctaagtgccaga

SEQ ID NO: 10017714 - DNA, 22 bp, Homo sapiens
gacaggcttcctaagtgccaga

SEQ ID NO: 10017715 - DNA, 22 bp, Homo sapiens
gacaggcttccactatgttgcc

SEQ ID NO: 10017716 - DNA, 22 bp, Homo sapiens
gacaggcttcatgatggcagga

SEQ ID NO: 10017717 - DNA, 22 bp, Homo sapiens
gacagggaaacattgaagtgtc

SEQ ID NO: 10017718 - DNA, 22 bp, Homo sapiens
gacaggcttagggagggtgctc

SEQ ID NO: 10017719 - DNA, 22 bp, Homo sapiens
gacaggctggcaatgccctgct

SEQ ID NO: 10017720 - DNA, 22 bp, Homo sapiens
gacaggcttagggagggtgctc

SEQ ID NO: 10017721 - DNA, 22 bp, Homo sapiens
gacagggctgtgggaggagcag

SEQ ID NO: 10017722 - DNA, 22 bp, Homo sapiens
gacaggggctttgcatgcttta

SEQ ID NO: 10017723 - DNA, 21 bp, Homo sapiens
gacaggggccatgggtttcta

SEQ ID NO: 10017724 - DNA, 22 bp, Homo sapiens
gaccctgtttctacaaataatt

SEQ ID NO: 10017725 - DNA, 22 bp, Homo sapiens
gacccttggctgcagcatcaca

SEQ ID NO: 10017726 - DNA, 22 bp, Homo sapiens
gacccttagaatgtgatcttat

SEQ ID NO: 10017727 - DNA, 22 bp, Homo sapiens
gaccctttcacagctgctgggg

SEQ ID NO: 10017728 - DNA, 22 bp, Homo sapiens
gaccctttcagaccctttagta

SEQ ID NO: 10017729 - DNA, 22 bp, Homo sapiens
gaccctttgacttgtgacatta

SEQ ID NO: 10017730 - DNA, 22 bp, Homo sapiens
gacccttttcagactcaggtac

SEQ ID NO: 10017731 - DNA, 22 bp, Homo sapiens
gaccctttctgagtgagcagtt

SEQ ID NO: 10017732 - DNA, 22 bp, Homo sapiens
gaccctttctgcatgcttatct

SEQ ID NO: 10017733 - DNA, 22 bp, Homo sapiens
gaccctttggaggtagtcacca

SEQ ID NO: 10017734 - DNA, 22 bp, Homo sapiens
gacctagattaacattctgtga

SEQ ID NO: 10017735 - DNA, 22 bp, Homo sapiens
gaccctggtgggcactggcacc

SEQ ID NO: 10017736 - DNA, 22 bp, Homo sapiens
gaccctgtttctacaaataatt

SEQ ID NO: 10017737 - DNA, 22 bp, Homo sapiens
gaccctgtggctctgtggcaga

SEQ ID NO: 10017738 - DNA, 22 bp, Homo sapiens
gaccctgtttctacaaataatt

SEQ ID NO: 10017739 - DNA, 22 bp, Homo sapiens
gaccctggtgggcactggcacc

SEQ ID NO: 10017740 - DNA, 22 bp, Homo sapiens
gaccctggctggagctggcctg

SEQ ID NO: 10017741 - DNA, 22 bp, Homo sapiens
gacccagtcacacttgtgcttt

SEQ ID NO: 10017742 - DNA, 22 bp, Homo sapiens
gacccagtgactcgtctctgtg

SEQ ID NO: 10017743 - DNA, 22 bp, Homo sapiens
gacccagtgggggcctgatctg

SEQ ID NO: 10017744 - DNA, 22 bp, Homo sapiens
gacccagtgactcgtctctgtg

SEQ ID NO: 10017745 - DNA, 22 bp, Homo sapiens
gacccagggtttctgcacaggg

SEQ ID NO: 10017746 - DNA, 22 bp, Homo sapiens
gacagtcacttccaggagagga

SEQ ID NO: 10017747 - DNA, 22 bp, Homo sapiens
gaccctggctagggcttaacct

SEQ ID NO: 10017748 - DNA, 22 bp, Homo sapiens
gaccctggcaggtagcctcaca

SEQ ID NO: 10017749 - DNA, 22 bp, Homo sapiens
gacagtaagtcagagacttggt

SEQ ID NO: 10017750 - DNA, 22 bp, Homo sapiens
gacagtaaggtggcttcttctt

SEQ ID NO: 10017751 - DNA, 22 bp, Homo sapiens
gacagtacaggtagaagtcact

SEQ ID NO: 10017752 - DNA, 22 bp, Homo sapiens
gacagtaactgagagatgtaat

SEQ ID NO: 10017753 - DNA, 22 bp, Homo sapiens
gacagtaactgagagatgtaat

SEQ ID NO: 10017754 - DNA, 22 bp, Homo sapiens
gacagtaagaccttaccagcct

SEQ ID NO: 10017755 - DNA, 22 bp, Homo sapiens
gacagtaagagtgtctgggttc

SEQ ID NO: 10017756 - DNA, 22 bp, Homo sapiens
gacaggttgaagtatcaaaggt

SEQ ID NO: 10017757 - DNA, 22 bp, Homo sapiens
gacagtaaatgcagtctagcac

SEQ ID NO: 10017758 - DNA, 18 bp, Homo sapiens
gacagtaaacttccccat

SEQ ID NO: 10017759 - DNA, 22 bp, Homo sapiens
gacagtaactacagttctgtgg

SEQ ID NO: 10017760 - DNA, 22 bp, Homo sapiens
gacaggtaaagatggtggcagg

SEQ ID NO: 10017761 - DNA, 23 bp, Homo sapiens
gacaggtaagggttgggagaatc

SEQ ID NO: 10017762 - DNA, 22 bp, Homo sapiens
gacaggtaccggtcagactacg

SEQ ID NO: 10017763 - DNA, 22 bp, Homo sapiens
gacagggtccaaaggcagggga

SEQ ID NO: 10017764 - DNA, 22 bp, Homo sapiens
gaatatattattcagcttttca

SEQ ID NO: 10017765 - DNA, 22 bp, Homo sapiens
gaatatattattcagcttttca

SEQ ID NO: 10017766 - DNA, 23 bp, Homo sapiens
gaatagttttagaaattggagaa

SEQ ID NO: 10017767 - DNA, 21 bp, Homo sapiens
gaatagttctgtggcagcagt

SEQ ID NO: 10017768 - DNA, 23 bp, Homo sapiens
gaatagttttagaaattggagaa

SEQ ID NO: 10017769 - DNA, 22 bp, Homo sapiens
gaatatattggtgaaaatagtt

SEQ ID NO: 10017770 - DNA, 22 bp, Homo sapiens
gaatatattggtgaaaatagtt

SEQ ID NO: 10017771 - DNA, 22 bp, Homo sapiens
gaatatattggtgaaaatagtt

SEQ ID NO: 10017772 - DNA, 22 bp, Homo sapiens
gaatagttctatggctgcaggg

SEQ ID NO: 10017773 - DNA, 22 bp, Homo sapiens
gaatagcttagattccttagtg

SEQ ID NO: 10017774 - DNA, 22 bp, Homo sapiens
gaatagcttccttttttccaaa

SEQ ID NO: 10017775 - DNA, 22 bp, Homo sapiens
gaatagctgtaggctagtgtct

SEQ ID NO: 10017776 - DNA, 22 bp, Homo sapiens
gaatagatcctcatttattgat

SEQ ID NO: 10017777 - DNA, 22 bp, Homo sapiens
gaatagataagtgactatttgg

SEQ ID NO: 10017778 - DNA, 22 bp, Homo sapiens
gaatacattggaaatcagaata

SEQ ID NO: 10017779 - DNA, 22 bp, Homo sapiens
gaatacattggaaatcagaata

SEQ ID NO: 10017780 - DNA, 22 bp, Homo sapiens
gaatacatgatacatgaactgc

SEQ ID NO: 10017781 - DNA, 22 bp, Homo sapiens
gaatacatggcagggagtcatc

SEQ ID NO: 10017782 - DNA, 22 bp, Homo sapiens
gacaagcaggctcctgaagaaa

SEQ ID NO: 10017783 - DNA, 22 bp, Homo sapiens
gacaagctcttgtttcatggtt

SEQ ID NO: 10017784 - DNA, 22 bp, Homo sapiens
gacaagactggtttatttaagg

SEQ ID NO: 10017785 - DNA, 22 bp, Homo sapiens
gacaagactatgtagaaagtat

SEQ ID NO: 10017786 - DNA, 17 bp, Homo sapiens
gacaagacagaattcat

SEQ ID NO: 10017787 - DNA, 22 bp, Homo sapiens
gacaagacacctctctccatcc

SEQ ID NO: 10017788 - DNA, 22 bp, Homo sapiens
gacaagacattggtaaagatat

SEQ ID NO: 10017789 - DNA, 22 bp, Homo sapiens
gacaagacatgtgatgacatca

SEQ ID NO: 10017790 - DNA, 22 bp, Homo sapiens
gacaagacatgtgatgacatca

SEQ ID NO: 10017791 - DNA, 22 bp, Homo sapiens
gacaagacagcttgcagacaac

SEQ ID NO: 10017792 - DNA, 22 bp, Homo sapiens
gaatatgtttgacatttagttg

SEQ ID NO: 10017793 - DNA, 22 bp, Homo sapiens
gaatatgtgttcctggacaaga

SEQ ID NO: 10017794 - DNA, 22 bp, Homo sapiens
gaatatcttgtacatctaagta

SEQ ID NO: 10017795 - DNA, 22 bp, Homo sapiens
gaatatcttgtacatctaagta

SEQ ID NO: 10017796 - DNA, 22 bp, Homo sapiens
gaatatgtttgacatttagttg

SEQ ID NO: 10017797 - DNA, 22 bp, Homo sapiens
gaatattagtatcagttatacc

SEQ ID NO: 10017798 - DNA, 22 bp, Homo sapiens
gaatatatttctcttaccttta

SEQ ID NO: 10017799 - DNA, 22 bp, Homo sapiens
gaatatatttctcttaccttta

SEQ ID NO: 10017800 - DNA, 22 bp, Homo sapiens
gaatatatttctcttaccttta

SEQ ID NO: 10017801 - DNA, 18 bp, Homo sapiens
gaatatctagcacatagt

SEQ ID NO: 10017802 - DNA, 22 bp, Homo sapiens
gaatatctgggagtgggaagct

SEQ ID NO: 10017803 - DNA, 22 bp, Homo sapiens
gaagttctcttgggggcctgag

SEQ ID NO: 10017804 - DNA, 22 bp, Homo sapiens
gaagttctgaaataaaatcctg

SEQ ID NO: 10017805 - DNA, 22 bp, Homo sapiens
gaagttctgggagtggcgccct

SEQ ID NO: 10017806 - DNA, 22 bp, Homo sapiens
gaagttctgggatttccacagt

SEQ ID NO: 10017807 - DNA, 22 bp, Homo sapiens
gaagttctgaccatatggccaa

SEQ ID NO: 10017808 - DNA, 22 bp, Homo sapiens
gaagttctggctcagagaggaa

SEQ ID NO: 10017809 - DNA, 22 bp, Homo sapiens
gaagtttagaagtgacaggttt

SEQ ID NO: 10017810 - DNA, 22 bp, Homo sapiens
gaagtttacctctgccttgctt

SEQ ID NO: 10017811 - DNA, 22 bp, Homo sapiens
gaagtttagaagtgacaggttt

SEQ ID NO: 10017812 - DNA, 22 bp, Homo sapiens
gaagtttacctctgccttgctt

SEQ ID NO: 10017813 - DNA, 22 bp, Homo sapiens
gaagttctttgctccccagtac

SEQ ID NO: 10017814 - DNA, 22 bp, Homo sapiens
gaagttgtaagcctgggaaggt

SEQ ID NO: 10017815 - DNA, 23 bp, Homo sapiens
gaagttctttcttctcatgctgt

SEQ ID NO: 10017816 - DNA, 22 bp, Homo sapiens
gaagttctttatagcagtgtga

SEQ ID NO: 10017817 - DNA, 22 bp, Homo sapiens
gaagttcttatgaaaacttgag

SEQ ID NO: 10017818 - DNA, 22 bp, Homo sapiens
gaagttcttagtctcatttgca

SEQ ID NO: 10017819 - DNA, 22 bp, Homo sapiens
gaagttcttagtctcatttgca

SEQ ID NO: 10017820 - DNA, 22 bp, Homo sapiens
gaagttctgggatttccacagt

SEQ ID NO: 10017821 - DNA, 22 bp, Homo sapiens
gaagttctggtgtatgtgataa

SEQ ID NO: 10017822 - DNA, 23 bp, Homo sapiens
gaagttctgttcagccagacaag

SEQ ID NO: 10017823 - DNA, 22 bp, Homo sapiens
gaagctttgagagcagaagccc

SEQ ID NO: 10017824 - DNA, 22 bp, Homo sapiens
gaagcttggataactgtatggg

SEQ ID NO: 10017825 - DNA, 22 bp, Homo sapiens
gaagcttcgaaagagtgatttc

SEQ ID NO: 10017826 - DNA, 22 bp, Homo sapiens
gaagcttcgtggctcttcaaat

SEQ ID NO: 10017827 - DNA, 22 bp, Homo sapiens
gaagctgtgttgatggcatgga

SEQ ID NO: 10017828 - DNA, 22 bp, Homo sapiens
gaagctgtgctgggggatctgt

SEQ ID NO: 10017829 - DNA, 22 bp, Homo sapiens
gaaggaaaaatactctgtaagg

SEQ ID NO: 10017830 - DNA, 22 bp, Homo sapiens
gaagctttgtcttgtctcctgg

SEQ ID NO: 10017831 - DNA, 22 bp, Homo sapiens
gaagctttgtcttgtctcctgg

SEQ ID NO: 10017832 - DNA, 22 bp, Homo sapiens
gaaggaaaaatactctgtaagg

SEQ ID NO: 10017833 - DNA, 22 bp, Homo sapiens
gaaggaaaacagatctgcctga

SEQ ID NO: 10017834 - DNA, 22 bp, Homo sapiens
gaaggaaaacagatctgcctga

SEQ ID NO: 10017835 - DNA, 22 bp, Homo sapiens
gaatacaagcctgccacctgga

SEQ ID NO: 10017836 - DNA, 22 bp, Homo sapiens
gaatacaagccaggcacaaggc

SEQ ID NO: 10017837 - DNA, 22 bp, Homo sapiens
gaatacaagccaggcacaaggc

SEQ ID NO: 10017838 - DNA, 22 bp, Homo sapiens
gaagtttatggtgcttgtaagg

SEQ ID NO: 10017839 - DNA, 22 bp, Homo sapiens
gaagtttaggttcttatgttta

SEQ ID NO: 10017840 - DNA, 22 bp, Homo sapiens
gaagtttatggtgcttgtaagg

SEQ ID NO: 10017841 - DNA, 22 bp, Homo sapiens
gaagtttatttcaatctattca

SEQ ID NO: 10017842 - DNA, 22 bp, Homo sapiens
gaagtttatttcaatctattca

SEQ ID NO: 10017843 - DNA, 22 bp, Homo sapiens
gaagtttattttacacatccat

SEQ ID NO: 10017844 - DNA, 22 bp, Homo sapiens
gaagtttattttacacatccat

SEQ ID NO: 10017845 - DNA, 22 bp, Homo sapiens
gaagtttagagtttggagtcct

SEQ ID NO: 10017846 - DNA, 22 bp, Homo sapiens
gaagtttagagtttggagtcct

SEQ ID NO: 10017847 - DNA, 22 bp, Homo sapiens
gaagtttaggttcttatgttta

SEQ ID NO: 10017848 - DNA, 22 bp, Homo sapiens
gaagtttagagtgttgtaattt

SEQ ID NO: 10017849 - DNA, 22 bp, Homo sapiens
gaagtttagagtgttgtaattt

SEQ ID NO: 10017850 - DNA, 22 bp, Homo sapiens
gaagtttagagtgttgtaattt

SEQ ID NO: 10017851 - DNA, 22 bp, Homo sapiens
gaagttttagtcaaaatgtaga

SEQ ID NO: 10017852 - DNA, 22 bp, Homo sapiens
gaagtttgatttttctcctaga

SEQ ID NO: 10017853 - DNA, 22 bp, Homo sapiens
gaagttttagtcaaaatgtaga

SEQ ID NO: 10017854 - DNA, 22 bp, Homo sapiens
gtccctagtggaaagacatgat

SEQ ID NO: 10017855 - DNA, 22 bp, Homo sapiens
gtccctgcatcaccacgggact

SEQ ID NO: 10017856 - DNA, 22 bp, Homo sapiens
gtccctctgtgtccctgcagtc

SEQ ID NO: 10017857 - DNA, 22 bp, Homo sapiens
gtccccagctgtgacgagagcc

SEQ ID NO: 10017858 - DNA, 22 bp, Homo sapiens
gtccccttaaacatgctctctt

SEQ ID NO: 10017859 - DNA, 22 bp, Homo sapiens
gtcccctggcccccagcgtcgg

SEQ ID NO: 10017860 - DNA, 22 bp, Homo sapiens
gtcctgggaaggaagccaggga

SEQ ID NO: 10017861 - DNA, 22 bp, Homo sapiens
gtcctgggaaggaagccaggga

SEQ ID NO: 10017862 - DNA, 22 bp, Homo sapiens
gtcctgggaaggaagccaggga

SEQ ID NO: 10017863 - DNA, 20 bp, Homo sapiens
gtcctgggagccacagcaca

SEQ ID NO: 10017864 - DNA, 20 bp, Homo sapiens
gtcctgggagccacagcaca

SEQ ID NO: 10017865 - DNA, 22 bp, Homo sapiens
gtccctgccctcctgggactca

SEQ ID NO: 10017866 - DNA, 22 bp, Homo sapiens
gtcctgggaactggacagctaa

SEQ ID NO: 10017867 - DNA, 22 bp, Homo sapiens
gtcctgggcccaggggctgcct

SEQ ID NO: 10017868 - DNA, 22 bp, Homo sapiens
gtcctgggcccaggggctgcct

SEQ ID NO: 10017869 - DNA, 17 bp, Homo sapiens
gtcctgggaggagagag

SEQ ID NO: 10017870 - DNA, 17 bp, Homo sapiens
gtcctgggaggagagag

SEQ ID NO: 10017871 - DNA, 17 bp, Homo sapiens
gtcctgggaggagagag

SEQ ID NO: 10017872 - DNA, 22 bp, Homo sapiens
gtatttccattagtgtgtgcac

SEQ ID NO: 10017873 - DNA, 22 bp, Homo sapiens
gtcattttatgggaacagattt

SEQ ID NO: 10017874 - DNA, 22 bp, Homo sapiens
gtcattttgctgcatatttaga

SEQ ID NO: 10017875 - DNA, 22 bp, Homo sapiens
gtcattttctagaattatttga

SEQ ID NO: 10017876 - DNA, 22 bp, Homo sapiens
gtcatttttgactttgaagtga

SEQ ID NO: 10017877 - DNA, 22 bp, Homo sapiens
gtcatttttcactgcatataga

SEQ ID NO: 10017878 - DNA, 22 bp, Homo sapiens
gtccaaggatgcaggatgctgt

SEQ ID NO: 10017879 - DNA, 22 bp, Homo sapiens
gtccaagagtcaagaagggggc

SEQ ID NO: 10017880 - DNA, 22 bp, Homo sapiens
gtccaagagatgtaacgaagaa

SEQ ID NO: 10017881 - DNA, 22 bp, Homo sapiens
gtccaagagaactgaaatagga

SEQ ID NO: 10017882 - DNA, 22 bp, Homo sapiens
gtccaagagtcaagaagggggc

SEQ ID NO: 10017883 - DNA, 22 bp, Homo sapiens
gtcatttttttcgtaatagtgg

SEQ ID NO: 10017884 - DNA, 22 bp, Homo sapiens
gtccaaatttttcacatgtaga

SEQ ID NO: 10017885 - DNA, 22 bp, Homo sapiens
gtccaaattccacagatttctc

SEQ ID NO: 10017886 - DNA, 18 bp, Homo sapiens
gtccacagccctcacagc

SEQ ID NO: 10017887 - DNA, 22 bp, Homo sapiens
gtccaccatagggagggcgtgg

SEQ ID NO: 10017888 - DNA, 22 bp, Homo sapiens
gtccacataggaacccagcttc

SEQ ID NO: 10017889 - DNA, 22 bp, Homo sapiens
gtccacagggatggccacacat

SEQ ID NO: 10017890 - DNA, 22 bp, Homo sapiens
ggtttgacagcttggggctgtc

SEQ ID NO: 10017891 - DNA, 22 bp, Homo sapiens
ggttttaaccattcacaagtga

SEQ ID NO: 10017892 - DNA, 22 bp, Homo sapiens
ggtttccacttgctgaagaaag

SEQ ID NO: 10017893 - DNA, 22 bp, Homo sapiens
ggtttccattattttatgggtg

SEQ ID NO: 10017894 - DNA, 22 bp, Homo sapiens
ggtttccaaagatagagtagta

SEQ ID NO: 10017895 - DNA, 22 bp, Homo sapiens
gtaaaaaggccaagcccttgtg

SEQ ID NO: 10017896 - DNA, 22 bp, Homo sapiens
gtaaaacatgttttaactagga

SEQ ID NO: 10017897 - DNA, 22 bp, Homo sapiens
gtaaaacatgttttaactagga

SEQ ID NO: 10017898 - DNA, 22 bp, Homo sapiens
ggttttatagcagtactatcag

SEQ ID NO: 10017899 - DNA, 22 bp, Homo sapiens
ggttttatcctacccacacagc

SEQ ID NO: 10017900 - DNA, 22 bp, Homo sapiens
ggttttattaccccttaaacac

SEQ ID NO: 10017901 - DNA, 22 bp, Homo sapiens
ggttttattaactttaacatca

SEQ ID NO: 10017902 - DNA, 22 bp, Homo sapiens
gtacatttatttttgcagcata

SEQ ID NO: 10017903 - DNA, 22 bp, Homo sapiens
gtaaaacatgttttaactagga

SEQ ID NO: 10017904 - DNA, 22 bp, Homo sapiens
gtaaaactgcagaacttggagg

SEQ ID NO: 10017905 - DNA, 22 bp, Homo sapiens
gtacatttcagtttccttaaga

SEQ ID NO: 10017906 - DNA, 22 bp, Homo sapiens
gtacatttcatttaaatgatgt

SEQ ID NO: 10017907 - DNA, 22 bp, Homo sapiens
gtacatttctcccaacactaaa

SEQ ID NO: 10017908 - DNA, 22 bp, Homo sapiens
gtacatttctcccaacactaaa

SEQ ID NO: 10017909 - DNA, 22 bp, Homo sapiens
gtacattttactttgtttgaat

SEQ ID NO: 10017910 - DNA, 22 bp, Homo sapiens
gtaccaaatctgtattaggaaa

SEQ ID NO: 10017911 - DNA, 22 bp, Homo sapiens
gtacccagtgattccttcttca

SEQ ID NO: 10017912 - DNA, 22 bp, Homo sapiens
gtacccaggcacgccttgctga

SEQ ID NO: 10017913 - DNA, 22 bp, Homo sapiens
gtacccagaggcatgatcccag

SEQ ID NO: 10017914 - DNA, 17 bp, Homo sapiens
gtattctttgccttcca

SEQ ID NO: 10017915 - DNA, 22 bp, Homo sapiens
gtattgtagctacaatagacgt

SEQ ID NO: 10017916 - DNA, 22 bp, Homo sapiens
gtatttaattccattaagttag

SEQ ID NO: 10017917 - DNA, 22 bp, Homo sapiens
gtattgtatatttgcaaataca

SEQ ID NO: 10017918 - DNA, 22 bp, Homo sapiens
gtattgtattgggatgagctct

SEQ ID NO: 10017919 - DNA, 22 bp, Homo sapiens
gtatttataggggaatgagagt

SEQ ID NO: 10017920 - DNA, 22 bp, Homo sapiens
gtatttaattctgtgcttctag

SEQ ID NO: 10017921 - DNA, 22 bp, Homo sapiens
gtatttataggggaatgagagt

SEQ ID NO: 10017922 - DNA, 20 bp, Homo sapiens
gtattctgtattctgctcag

SEQ ID NO: 10017923 - DNA, 22 bp, Homo sapiens
gtattccttcagaagacgttta

SEQ ID NO: 10017924 - DNA, 22 bp, Homo sapiens
gtattctgggccgattacaaaa

SEQ ID NO: 10017925 - DNA, 22 bp, Homo sapiens
gtattcctaagtcatgacaaat

SEQ ID NO: 10017926 - DNA, 22 bp, Homo sapiens
gtattccattagtgttaatatc

SEQ ID NO: 10017927 - DNA, 22 bp, Homo sapiens
gtattcatttatttactcatcc

SEQ ID NO: 10017928 - DNA, 22 bp, Homo sapiens
gtattcatattaaacatatcaa

SEQ ID NO: 10017929 - DNA, 22 bp, Homo sapiens
gtattcaagcgagcagatgtct

SEQ ID NO: 10017930 - DNA, 22 bp, Homo sapiens
gtattcaaggattttgttctac

SEQ ID NO: 10017931 - DNA, 22 bp, Homo sapiens
gtattattgtcatgaaataata

SEQ ID NO: 10017932 - DNA, 22 bp, Homo sapiens
gtattattgtcatgaaataata

SEQ ID NO: 10017933 - DNA, 22 bp, Homo sapiens
gtattattgtcatgaaataata

SEQ ID NO: 10017934 - DNA, 22 bp, Homo sapiens
gtagacaaatttcttctctcaa

SEQ ID NO: 10017935 - DNA, 22 bp, Homo sapiens
gtattagaagaaattataggta

SEQ ID NO: 10017936 - DNA, 22 bp, Homo sapiens
gtattagactgagaaatggagt

SEQ ID NO: 10017937 - DNA, 22 bp, Homo sapiens
gtagaatatatggttagtattg

SEQ ID NO: 10017938 - DNA, 22 bp, Homo sapiens
gtagaatatatggttagtattg

SEQ ID NO: 10017939 - DNA, 22 bp, Homo sapiens
gtagaatcccagtggctatatt

SEQ ID NO: 10017940 - DNA, 22 bp, Homo sapiens
gtagaattacctctctatgtcc

SEQ ID NO: 10017941 - DNA, 22 bp, Homo sapiens
gtagaattttaataatggagat

SEQ ID NO: 10017942 - DNA, 22 bp, Homo sapiens
gtagaactaggacttcaggtat

SEQ ID NO: 10017943 - DNA, 20 bp, Homo sapiens
gtagaaccatgtgtgctggg

SEQ ID NO: 10017944 - DNA, 22 bp, Homo sapiens
gtagaaccttctttactagagt

SEQ ID NO: 10017945 - DNA, 22 bp, Homo sapiens
gtagaaattccatttactttga

SEQ ID NO: 10017946 - DNA, 22 bp, Homo sapiens
gtagaaatggtgtgtttcttct

SEQ ID NO: 10017947 - DNA, 22 bp, Homo sapiens
gtacgtgcatgcacgtgtgcct

SEQ ID NO: 10017948 - DNA, 22 bp, Homo sapiens
gtgaaaataaggctggttcttg

SEQ ID NO: 10017949 - DNA, 22 bp, Homo sapiens
gtgaaacaccctccaatgcaca

SEQ ID NO: 10017950 - DNA, 22 bp, Homo sapiens
gtgaaacttcacattttgatag

SEQ ID NO: 10017951 - DNA, 22 bp, Homo sapiens
gtgaaacaccctccaatgcaca

SEQ ID NO: 10017952 - DNA, 22 bp, Homo sapiens
gtgaaatatttaacgtccaggt

SEQ ID NO: 10017953 - DNA, 22 bp, Homo sapiens
gtgaaagtaagaaagtaggact

SEQ ID NO: 10017954 - DNA, 22 bp, Homo sapiens
gtgaaatattttgtttatgtca

SEQ ID NO: 10017955 - DNA, 22 bp, Homo sapiens
gtgaaatattttgtttatgtca

SEQ ID NO: 10017956 - DNA, 22 bp, Homo sapiens
gtgaaattgtatttggcattga

SEQ ID NO: 10017957 - DNA, 19 bp, Homo sapiens
gtgaacaaggagaatggga

SEQ ID NO: 10017958 - DNA, 22 bp, Homo sapiens
gtgaaccaagaagtcaaagcga

SEQ ID NO: 10017959 - DNA, 18 bp, Homo sapiens
gtgaagctttattgaatg

SEQ ID NO: 10017960 - DNA, 22 bp, Homo sapiens
gtgaaggagttatcagtggtta

SEQ ID NO: 10017961 - DNA, 22 bp, Homo sapiens
gtgaccataatagattatgagt

SEQ ID NO: 10017962 - DNA, 23 bp, Homo sapiens
gtgacccaaggaccttccagaat

SEQ ID NO: 10017963 - DNA, 22 bp, Homo sapiens
gtgaccatcatctcagctagtt

SEQ ID NO: 10017964 - DNA, 22 bp, Homo sapiens
gtgaccatttgacatatccttg

SEQ ID NO: 10017965 - DNA, 22 bp, Homo sapiens
gtgaagaccagggaacgctggc

SEQ ID NO: 10017966 - DNA, 22 bp, Homo sapiens
gtgaactgctgagttttatcat

SEQ ID NO: 10017967 - DNA, 22 bp, Homo sapiens
gtgaagacttggagaagttaag

SEQ ID NO: 10017968 - DNA, 21 bp, Homo sapiens
gtgaagactttgcctttaaga

SEQ ID NO: 10017969 - DNA, 22 bp, Homo sapiens
gtgaagcagggaaggaaaggat

SEQ ID NO: 10017970 - DNA, 22 bp, Homo sapiens
gtcctgggggcagctgtgtcca

SEQ ID NO: 10017971 - DNA, 22 bp, Homo sapiens
gtcctgggggcagctgtgtcca

SEQ ID NO: 10017972 - DNA, 22 bp, Homo sapiens
gtcctgggggcagctgtgtcca

SEQ ID NO: 10017973 - DNA, 22 bp, Homo sapiens
gtctgccctcacgccagctggg

SEQ ID NO: 10017974 - DNA, 22 bp, Homo sapiens
gtcctgggcctgctgaggctga

SEQ ID NO: 10017975 - DNA, 22 bp, Homo sapiens
gtcctgggcctgctgaggctga

SEQ ID NO: 10017976 - DNA, 22 bp, Homo sapiens
gtcctggggaatacagaagccg

SEQ ID NO: 10017977 - DNA, 22 bp, Homo sapiens
gtcctggggaatacagaagccg

SEQ ID NO: 10017978 - DNA, 22 bp, Homo sapiens
gtcctggggatacagaagtgaa

SEQ ID NO: 10017979 - DNA, 22 bp, Homo sapiens
gtcctggggatacagaagtgaa

SEQ ID NO: 10017980 - DNA, 22 bp, Homo sapiens
gtcctggggattatagagtgtt

SEQ ID NO: 10017981 - DNA, 22 bp, Homo sapiens
gtcctggggattatagagtgtt

SEQ ID NO: 10017982 - DNA, 22 bp, Homo sapiens
gtctgctggcacgtcacagata

SEQ ID NO: 10017983 - DNA, 22 bp, Homo sapiens
gtctgctggtgcctggcctgcg

SEQ ID NO: 10017984 - DNA, 22 bp, Homo sapiens
gtctgctggtgcctggcctgcg

SEQ ID NO: 10017985 - DNA, 22 bp, Homo sapiens
gtctgctgtgccttggggaaaa

SEQ ID NO: 10017986 - DNA, 22 bp, Homo sapiens
gtctgctcatgctaccgcgggc

SEQ ID NO: 10017987 - DNA, 22 bp, Homo sapiens
gtctgctcatgctaccgcgggc

SEQ ID NO: 10017988 - DNA, 22 bp, Homo sapiens
gtctgctcatgctaccgcgggc

SEQ ID NO: 10017989 - DNA, 22 bp, Homo sapiens
gtctgcctgtctggatgacaga

SEQ ID NO: 10017990 - DNA, 22 bp, Homo sapiens
gtctgctcatgctaccgcgggc

SEQ ID NO: 10017991 - DNA, 22 bp, Homo sapiens
gtctgctgcagagcatggcttt

SEQ ID NO: 10017992 - DNA, 22 bp, Homo sapiens
gtctgctgacagagcatggacc

SEQ ID NO: 10017993 - DNA, 22 bp, Homo sapiens
gtctgcctctattgcctacctg

SEQ ID NO: 10017994 - DNA, 22 bp, Homo sapiens
gtctgcctgggacgctgggagt

SEQ ID NO: 10017995 - DNA, 22 bp, Homo sapiens
gtgagacacccaagagtcagat

SEQ ID NO: 10017996 - DNA, 22 bp, Homo sapiens
gtgagacatcttgggaagtgat

SEQ ID NO: 10017997 - DNA, 23 bp, Homo sapiens
gtgagcagcccactaggaatgcc

SEQ ID NO: 10017998 - DNA, 23 bp, Homo sapiens
gtgagcagcccactaggaatgcc

SEQ ID NO: 10017999 - DNA, 22 bp, Homo sapiens
gtgagcagcctcacctgagggt

SEQ ID NO: 10018000 - DNA, 22 bp, Homo sapiens
gtgagcagcctcacctgagggt

SEQ ID NO: 10018001 - DNA, 22 bp, Homo sapiens
gtgagcagctcagggtggtctc

SEQ ID NO: 10018002 - DNA, 22 bp, Homo sapiens
gtgagcagctcagggtggtctc

SEQ ID NO: 10018003 - DNA, 22 bp, Homo sapiens
gtgagcaggataggggctccct

SEQ ID NO: 10018004 - DNA, 22 bp, Homo sapiens
gtgacgtgaggggctcctgttg

SEQ ID NO: 10018005 - DNA, 22 bp, Homo sapiens
gtgactgttgtttgctacgtgc

SEQ ID NO: 10018006 - DNA, 22 bp, Homo sapiens
gtgagaatgagattggaatgta

SEQ ID NO: 10018007 - DNA, 22 bp, Homo sapiens
gtgagaataccagcagtgagaa

SEQ ID NO: 10018008 - DNA, 22 bp, Homo sapiens
gtgagaagataagtattgcaaa

SEQ ID NO: 10018009 - DNA, 22 bp, Homo sapiens
gtgagacaagatttgtaggcag

SEQ ID NO: 10018010 - DNA, 22 bp, Homo sapiens
gtgagaaatgacaaatgtgtcg

SEQ ID NO: 10018011 - DNA, 22 bp, Homo sapiens
gtgcagagaaggagcagtagtt

SEQ ID NO: 10018012 - DNA, 22 bp, Homo sapiens
gtgcagagaggaccttggggag

SEQ ID NO: 10018013 - DNA, 22 bp, Homo sapiens
gtgcagagaggtggagggactt

SEQ ID NO: 10018014 - DNA, 22 bp, Homo sapiens
gtgcagaatcagtacagaacga

SEQ ID NO: 10018015 - DNA, 22 bp, Homo sapiens
gtgcactttgggagtctcagtg

SEQ ID NO: 10018016 - DNA, 22 bp, Homo sapiens
gtgcagaagtaacaattaaaga

SEQ ID NO: 10018017 - DNA, 22 bp, Homo sapiens
gtgcacttgatctagacagatt

SEQ ID NO: 10018018 - DNA, 22 bp, Homo sapiens
gtgagcaggatttcatggtgta

SEQ ID NO: 10018019 - DNA, 22 bp, Homo sapiens
gtgagcaggatttcatggtgta

SEQ ID NO: 10018020 - DNA, 22 bp, Homo sapiens
gtgcacatcgtgcaggtttgtt

SEQ ID NO: 10018021 - DNA, 21 bp, Homo sapiens
gtgcacagtcctgcacacagg

SEQ ID NO: 10018022 - DNA, 22 bp, Homo sapiens
gtgcacatcgtgcaggtttgtt

SEQ ID NO: 10018023 - DNA, 22 bp, Homo sapiens
gtgcacatcgtgcaggtttgtt

SEQ ID NO: 10018024 - DNA, 22 bp, Homo sapiens
gtgctagggacaaagcagtgaa

SEQ ID NO: 10018025 - DNA, 22 bp, Homo sapiens
gtgctaggattacaggcatggg

SEQ ID NO: 10018026 - DNA, 22 bp, Homo sapiens
gtgcatatatgcacatatgtgt

SEQ ID NO: 10018027 - DNA, 22 bp, Homo sapiens
gtgcatatggttacagcaccgc

SEQ ID NO: 10018028 - DNA, 22 bp, Homo sapiens
gtgcatatatgtgcagcatcaa

SEQ ID NO: 10018029 - DNA, 22 bp, Homo sapiens
gtgcatatatatgggagggagc

SEQ ID NO: 10018030 - DNA, 19 bp, Homo sapiens
gtgcattccaaagcaccat

SEQ ID NO: 10018031 - DNA, 22 bp, Homo sapiens
gtgcatatgtacctgtgatcat

SEQ ID NO: 10018032 - DNA, 22 bp, Homo sapiens
gtgcagggtcctaattgttaag

SEQ ID NO: 10018033 - DNA, 22 bp, Homo sapiens
gtgcagggtagcgacggcagga

SEQ ID NO: 10018034 - DNA, 22 bp, Homo sapiens
gtgcagtggcagatcctagctc

SEQ ID NO: 10018035 - DNA, 22 bp, Homo sapiens
gtgcagtgagcagtgcagcacc

SEQ ID NO: 10018036 - DNA, 22 bp, Homo sapiens
gtgcagtgaccctggagagctg

SEQ ID NO: 10018037 - DNA, 22 bp, Homo sapiens
gtgcagtgaaaaaagaatgtcc

SEQ ID NO: 10018038 - DNA, 22 bp, Homo sapiens
gtgcagtgaccctggagagctg

SEQ ID NO: 10018039 - DNA, 22 bp, Homo sapiens
gtgcagaggacgtggcggcctc

SEQ ID NO: 10018040 - DNA, 22 bp, Homo sapiens
gtgcagaggacgtggcggcctc

SEQ ID NO: 10018041 - DNA, 21 bp, Homo sapiens
gtgcagaggaatgtagggggc

SEQ ID NO: 10018042 - DNA, 20 bp, Homo sapiens
gtgcagaggcagcctgtggg

SEQ ID NO: 10018043 - DNA, 20 bp, Homo sapiens
gtgcagaggcagcctgtggg

SEQ ID NO: 10018044 - DNA, 22 bp, Homo sapiens
gtgcagatcctgattgcagttc

SEQ ID NO: 10018045 - DNA, 22 bp, Homo sapiens
ggtccttgcttcggtccagtac

SEQ ID NO: 10018046 - DNA, 20 bp, Homo sapiens
ggtcctgtactctcattgaa

SEQ ID NO: 10018047 - DNA, 22 bp, Homo sapiens
ggtcagaggtcccagaagaagc

SEQ ID NO: 10018048 - DNA, 22 bp, Homo sapiens
ggtcagcaatttggactgggct

SEQ ID NO: 10018049 - DNA, 22 bp, Homo sapiens
ggtcagaggtcacaagctggca

SEQ ID NO: 10018050 - DNA, 22 bp, Homo sapiens
ggtcagcagtgcagggcagagc

SEQ ID NO: 10018051 - DNA, 22 bp, Homo sapiens
ggtcagcagtgcagggcagagc

SEQ ID NO: 10018052 - DNA, 19 bp, Homo sapiens
ggtcagcagtttagggtct

SEQ ID NO: 10018053 - DNA, 22 bp, Homo sapiens
ggtcagcagtgcagggcagagc

SEQ ID NO: 10018054 - DNA, 22 bp, Homo sapiens
ggtcgctgtgtaggttcagcta

SEQ ID NO: 10018055 - DNA, 22 bp, Homo sapiens
ggtcgctgtgtaggttcagcta

SEQ ID NO: 10018056 - DNA, 22 bp, Homo sapiens
ggtcgagtcacttgttgccttt

SEQ ID NO: 10018057 - DNA, 22 bp, Homo sapiens
ggtcctttgccatctctccacc

SEQ ID NO: 10018058 - DNA, 22 bp, Homo sapiens
ggtcctttgaaaggggtgtgtc

SEQ ID NO: 10018059 - DNA, 20 bp, Homo sapiens
ggtccttgtcacaaggagag

SEQ ID NO: 10018060 - DNA, 22 bp, Homo sapiens
ggtctagatcaagaacagaact

SEQ ID NO: 10018061 - DNA, 22 bp, Homo sapiens
ggtctagatgaaattaaatgtt

SEQ ID NO: 10018062 - DNA, 22 bp, Homo sapiens
ggtctagagtggggcctggaaa

SEQ ID NO: 10018063 - DNA, 22 bp, Homo sapiens
ggtctcaggagactggagagca

SEQ ID NO: 10018064 - DNA, 22 bp, Homo sapiens
ggtctcagtgaaggagtgtgct

SEQ ID NO: 10018065 - DNA, 22 bp, Homo sapiens
ggtctctgacttagagatggat

SEQ ID NO: 10018066 - DNA, 22 bp, Homo sapiens
ggtctccttgggaaagcaggaa

SEQ ID NO: 10018067 - DNA, 22 bp, Homo sapiens
ggtctcctgaggctgccacacc

SEQ ID NO: 10018068 - DNA, 22 bp, Homo sapiens
ggtctcccttgctggttggctg

SEQ ID NO: 10018069 - DNA, 22 bp, Homo sapiens
ggtaggggaagacaagtgaaaa

SEQ ID NO: 10018070 - DNA, 22 bp, Homo sapiens
ggtaggggaagacaagtgaaaa

SEQ ID NO: 10018071 - DNA, 22 bp, Homo sapiens
gggtggcatagggtgatggctt

SEQ ID NO: 10018072 - DNA, 22 bp, Homo sapiens
gggtggcatagggtgatggctt

SEQ ID NO: 10018073 - DNA, 22 bp, Homo sapiens
gggtggcaggattggcaggagt

SEQ ID NO: 10018074 - DNA, 22 bp, Homo sapiens
gggtggcaggattggcaggagt

SEQ ID NO: 10018075 - DNA, 22 bp, Homo sapiens
gggtggcacaggtgcagagggt

SEQ ID NO: 10018076 - DNA, 22 bp, Homo sapiens
gggtggcacaggtgcagagggt

SEQ ID NO: 10018077 - DNA, 20 bp, Homo sapiens
gggtggagttgcggtctgtg

SEQ ID NO: 10018078 - DNA, 22 bp, Homo sapiens
gggtggcaggattggcaggagt

SEQ ID NO: 10018079 - DNA, 22 bp, Homo sapiens
gggtggcaggattggcaggagt

SEQ ID NO: 10018080 - DNA, 22 bp, Homo sapiens
gggtggcacaggtgcagagggt

SEQ ID NO: 10018081 - DNA, 22 bp, Homo sapiens
gggtggcacaggtgcagagggt

SEQ ID NO: 10018082 - DNA, 22 bp, Homo sapiens
gggtggcacaggtgcagagggt

SEQ ID NO: 10018083 - DNA, 22 bp, Homo sapiens
gggtggcagctgttgccaaggt

SEQ ID NO: 10018084 - DNA, 22 bp, Homo sapiens
ggtcacccatgatcacatcacc

SEQ ID NO: 10018085 - DNA, 22 bp, Homo sapiens
ggtagtcatggatagctatgag

SEQ ID NO: 10018086 - DNA, 22 bp, Homo sapiens
ggtagtacatggaagagtacac

SEQ ID NO: 10018087 - DNA, 22 bp, Homo sapiens
ggtagtcagtgttagtttgatt

SEQ ID NO: 10018088 - DNA, 22 bp, Homo sapiens
ggtcacttctttcatcgaaact

SEQ ID NO: 10018089 - DNA, 22 bp, Homo sapiens
ggtcacttcagataactggtgt

SEQ ID NO: 10018090 - DNA, 22 bp, Homo sapiens
ggtcagagctggagagataggg

SEQ ID NO: 10018091 - DNA, 22 bp, Homo sapiens
ggtcagagccgttagcattcag

SEQ ID NO: 10018092 - DNA, 22 bp, Homo sapiens
ggtcagagctggagagataggg

SEQ ID NO: 10018093 - DNA, 22 bp, Homo sapiens
ggtcagagccgttagcattcag

SEQ ID NO: 10018094 - DNA, 22 bp, Homo sapiens
ggtcagagccatggagcaactg

SEQ ID NO: 10018095 - DNA, 22 bp, Homo sapiens
ggtcagaggaggaataggacat

SEQ ID NO: 10018096 - DNA, 22 bp, Homo sapiens
ggtcagaggggattccttggga

SEQ ID NO: 10018097 - DNA, 22 bp, Homo sapiens
ggtcagaggggattccttggga

SEQ ID NO: 10018098 - DNA, 22 bp, Homo sapiens
ggtcagagggtgggctgcctgt

SEQ ID NO: 10018099 - DNA, 22 bp, Homo sapiens
ggtcagagggtgggctgcctgt

SEQ ID NO: 10018100 - DNA, 22 bp, Homo sapiens
ggtcagagatgaggtctaaagt

SEQ ID NO: 10018101 - DNA, 19 bp, Homo sapiens
ggtcagagagatccaggct

SEQ ID NO: 10018102 - DNA, 19 bp, Homo sapiens
ggtcagagagatccaggct

SEQ ID NO: 10018103 - DNA, 22 bp, Homo sapiens
ggtcagagaaaagtagggtgtt

SEQ ID NO: 10018104 - DNA, 22 bp, Homo sapiens
ggtcagagaaaagtagggtgtt

SEQ ID NO: 10018105 - DNA, 22 bp, Homo sapiens
ggtcagagaaaagtagggtgtt

SEQ ID NO: 10018106 - DNA, 22 bp, Homo sapiens
ggtgtgggggcaagtttgagat

SEQ ID NO: 10018107 - DNA, 22 bp, Homo sapiens
ggtgtggggaggttctgcttct

SEQ ID NO: 10018108 - DNA, 22 bp, Homo sapiens
ggtgtgggtccttgtgcttgct

SEQ ID NO: 10018109 - DNA, 22 bp, Homo sapiens
ggtgtgggggcagctctgatat

SEQ ID NO: 10018110 - DNA, 22 bp, Homo sapiens
ggtgtgggggcagctctgatat

SEQ ID NO: 10018111 - DNA, 22 bp, Homo sapiens
ggtgtgggccctgatgtcagca

SEQ ID NO: 10018112 - DNA, 22 bp, Homo sapiens
ggtgtgggccctgatgtcagca

SEQ ID NO: 10018113 - DNA, 22 bp, Homo sapiens
ggtgtgggagagattctttcct

SEQ ID NO: 10018114 - DNA, 22 bp, Homo sapiens
ggtgtgggaactacaggttttt

SEQ ID NO: 10018115 - DNA, 22 bp, Homo sapiens
ggtgtgtggttttgatacagtc

SEQ ID NO: 10018116 - DNA, 22 bp, Homo sapiens
ggtgtgtgtggattagcatgcc

SEQ ID NO: 10018117 - DNA, 22 bp, Homo sapiens
ggtgtgtgtggattagcatgcc

SEQ ID NO: 10018118 - DNA, 22 bp, Homo sapiens
ggtgtgtggtcctctcacttag

SEQ ID NO: 10018119 - DNA, 22 bp, Homo sapiens
ggtgtgtggttttgatacagtc

SEQ ID NO: 10018120 - DNA, 22 bp, Homo sapiens
ggtgtgtgaggagtcacttagt

SEQ ID NO: 10018121 - DNA, 22 bp, Homo sapiens
ggtgtgtgaggagtcacttagt

SEQ ID NO: 10018122 - DNA, 22 bp, Homo sapiens
ggtgtgtgaggagtcacttagt

SEQ ID NO: 10018123 - DNA, 22 bp, Homo sapiens
ggtgtgggtccttgtgcttgct

SEQ ID NO: 10018124 - DNA, 22 bp, Homo sapiens
ggtgtgtctgccaggaactgca

SEQ ID NO: 10018125 - DNA, 19 bp, Homo sapiens
ggtgtgtgctggggcctgt

SEQ ID NO: 10018126 - DNA, 19 bp, Homo sapiens
ggtgtgtgctggggcctgt

SEQ ID NO: 10018127 - DNA, 19 bp, Homo sapiens
ggtgtgtgctggggcctgt

SEQ ID NO: 10018128 - DNA, 22 bp, Homo sapiens
ggtttaatgggtgaaggcatga

SEQ ID NO: 10018129 - DNA, 22 bp, Homo sapiens
ggtgttcttagtggcactggca

SEQ ID NO: 10018130 - DNA, 22 bp, Homo sapiens
ggtgttggaacatggtgagatt

SEQ ID NO: 10018131 - DNA, 22 bp, Homo sapiens
ggtgttgcagttgaagactggt

SEQ ID NO: 10018132 - DNA, 22 bp, Homo sapiens
ggtttattaatgtgaactgtat

SEQ ID NO: 10018133 - DNA, 22 bp, Homo sapiens
ggtttattgttaataagtttga

SEQ ID NO: 10018134 - DNA, 22 bp, Homo sapiens
ggtttattgaaggccaccccac

SEQ ID NO: 10018135 - DNA, 18 bp, Homo sapiens
ggtggcggggatggaggt

SEQ ID NO: 10018136 - DNA, 22 bp, Homo sapiens
ggtggctcagggctccaagcat

SEQ ID NO: 10018137 - DNA, 22 bp, Homo sapiens
ggtggcctccagggcataggtg

SEQ ID NO: 10018138 - DNA, 22 bp, Homo sapiens
ggtggcctcggtggtgcacagg

SEQ ID NO: 10018139 - DNA, 22 bp, Homo sapiens
ggtggccctaaccgcagcctcc

SEQ ID NO: 10018140 - DNA, 22 bp, Homo sapiens
ggtctggatgctgaggttccca

SEQ ID NO: 10018141 - DNA, 22 bp, Homo sapiens
ggtctggagcttggctaaggga

SEQ ID NO: 10018142 - DNA, 22 bp, Homo sapiens
gggcatggtgctggtgttcatg

SEQ ID NO: 10018143 - DNA, 22 bp, Homo sapiens
gggcatggtgatgtgcacctgt

SEQ ID NO: 10018144 - DNA, 22 bp, Homo sapiens
gggcatggtgatgtgcacctgt

SEQ ID NO: 10018145 - DNA, 22 bp, Homo sapiens
gggcatggggcggacctggttc

SEQ ID NO: 10018146 - DNA, 22 bp, Homo sapiens
gggcatggtgagggatatgaag

SEQ ID NO: 10018147 - DNA, 22 bp, Homo sapiens
gggcatggccaggtgaggggtc

SEQ ID NO: 10018148 - DNA, 18 bp, Homo sapiens
gggcatggatgcagcatc

SEQ ID NO: 10018149 - DNA, 22 bp, Homo sapiens
gggcatgtaggaatccatggag

SEQ ID NO: 10018150 - DNA, 22 bp, Homo sapiens
gggccaaggggagctggaaggg

SEQ ID NO: 10018151 - DNA, 22 bp, Homo sapiens
gggccaaggggagctggaaggg

SEQ ID NO: 10018152 - DNA, 22 bp, Homo sapiens
gggccaagggtgcgtggcagga

SEQ ID NO: 10018153 - DNA, 22 bp, Homo sapiens
gggccaagggtgcgtggcagga

SEQ ID NO: 10018154 - DNA, 22 bp, Homo sapiens
gggccacacagaacctcctggt

SEQ ID NO: 10018155 - DNA, 22 bp, Homo sapiens
gggccacacagaacctcctggt

SEQ ID NO: 10018156 - DNA, 22 bp, Homo sapiens
gggctgagagctggaatctgag

SEQ ID NO: 10018157 - DNA, 22 bp, Homo sapiens
gggctgagagctggaatctgag

SEQ ID NO: 10018158 - DNA, 22 bp, Homo sapiens
gggctgagagtgactgttctgt

SEQ ID NO: 10018159 - DNA, 22 bp, Homo sapiens
gggctgagagctggaatctgag

SEQ ID NO: 10018160 - DNA, 22 bp, Homo sapiens
gggctgagagctggaatctgag

SEQ ID NO: 10018161 - DNA, 22 bp, Homo sapiens
gggctgagattggtgccctgtc

SEQ ID NO: 10018162 - DNA, 22 bp, Homo sapiens
gggctgagcacatactgacagc

SEQ ID NO: 10018163 - DNA, 22 bp, Homo sapiens
gggctgagctgttctgagttta

SEQ ID NO: 10018164 - DNA, 22 bp, Homo sapiens
gggctgagctgttctgagttta

SEQ ID NO: 10018165 - DNA, 22 bp, Homo sapiens
gggctgagctaagctgggttga

SEQ ID NO: 10018166 - DNA, 22 bp, Homo sapiens
gggctgaggaacatattttgtt

SEQ ID NO: 10018167 - DNA, 22 bp, Homo sapiens
gggctgaggctaccactggtct

SEQ ID NO: 10018168 - DNA, 22 bp, Homo sapiens
gggctgaggctaccactggtct

SEQ ID NO: 10018169 - DNA, 22 bp, Homo sapiens
gggctgaggaacatattttgtt

SEQ ID NO: 10018170 - DNA, 22 bp, Homo sapiens
gggctgagcacatactgacagc

SEQ ID NO: 10018171 - DNA, 22 bp, Homo sapiens
gggctgagccacagcttttgtt

SEQ ID NO: 10018172 - DNA, 22 bp, Homo sapiens
gggctgagcacatactgacagc

SEQ ID NO: 10018173 - DNA, 22 bp, Homo sapiens
gggctgagccacagcttttgtt

SEQ ID NO: 10018174 - DNA, 22 bp, Homo sapiens
gggctgagccatttgaaccttg

SEQ ID NO: 10018175 - DNA, 22 bp, Homo sapiens
gggctgagccatttgaaccttg

SEQ ID NO: 10018176 - DNA, 22 bp, Homo sapiens
gggctgagctaagctgggttga

SEQ ID NO: 10018177 - DNA, 22 bp, Homo sapiens
gggctgccaagcctgcctgcct

SEQ ID NO: 10018178 - DNA, 22 bp, Homo sapiens
gggctgcacgtattctgctcac

SEQ ID NO: 10018179 - DNA, 22 bp, Homo sapiens
gggctgcaatgcttcagttgtt

SEQ ID NO: 10018180 - DNA, 22 bp, Homo sapiens
gggctgcgtgtggaggatgtaa

SEQ ID NO: 10018181 - DNA, 22 bp, Homo sapiens
gggctgccttttaattcttccc

SEQ ID NO: 10018182 - DNA, 22 bp, Homo sapiens
gggctgcgtgtggaggatgtaa

SEQ ID NO: 10018183 - DNA, 23 bp, Homo sapiens
gggctgctccaggccaaggctgg

SEQ ID NO: 10018184 - DNA, 22 bp, Homo sapiens
gggctgccaagcctgcctgcct

SEQ ID NO: 10018185 - DNA, 22 bp, Homo sapiens
gggctgcctgagcatctcctcc

SEQ ID NO: 10018186 - DNA, 22 bp, Homo sapiens
gggctgcctttcttctgggagc

SEQ ID NO: 10018187 - DNA, 22 bp, Homo sapiens
gggctgcctttcttctgggagc

SEQ ID NO: 10018188 - DNA, 22 bp, Homo sapiens
gggctgcctttcttctgggagc

SEQ ID NO: 10018189 - DNA, 22 bp, Homo sapiens
gggctgaggctaccactggtct

SEQ ID NO: 10018190 - DNA, 22 bp, Homo sapiens
gggctgagggccaattcctact

SEQ ID NO: 10018191 - DNA, 22 bp, Homo sapiens
gggctgagggccaattcctact

SEQ ID NO: 10018192 - DNA, 22 bp, Homo sapiens
gggctgagtgtcccaggccgaa

SEQ ID NO: 10018193 - DNA, 22 bp, Homo sapiens
gggctgagttcctgcctcactc

SEQ ID NO: 10018194 - DNA, 22 bp, Homo sapiens
gggctgagttcctgcctcactc

SEQ ID NO: 10018195 - DNA, 22 bp, Homo sapiens
gggctgagtgtcccaggccgaa

SEQ ID NO: 10018196 - DNA, 22 bp, Homo sapiens
gggctgagtgtcccaggccgaa

SEQ ID NO: 10018197 - DNA, 22 bp, Homo sapiens
gggcttgaggtgaaggtaggga

SEQ ID NO: 10018198 - DNA, 22 bp, Homo sapiens
gggcttcttgccatggggacgg

SEQ ID NO: 10018199 - DNA, 22 bp, Homo sapiens
gggctgctgtagagaacatgtt

SEQ ID NO: 10018200 - DNA, 22 bp, Homo sapiens
gggctgctgcccaggaggcacc

SEQ ID NO: 10018201 - DNA, 22 bp, Homo sapiens
gggcttggagtaggctgatgaa

SEQ ID NO: 10018202 - DNA, 22 bp, Homo sapiens
gggcttggcacatgggctcagc

SEQ ID NO: 10018203 - DNA, 22 bp, Homo sapiens
gggcttggcacatgggctcagc

SEQ ID NO: 10018204 - DNA, 22 bp, Homo sapiens
gggcttggccccagaagagcta

SEQ ID NO: 10018205 - DNA, 22 bp, Homo sapiens
gggcttggctcataagtggatg

SEQ ID NO: 10018206 - DNA, 19 bp, Homo sapiens
gggcttggggctgaagcct

SEQ ID NO: 10018207 - DNA, 22 bp, Homo sapiens
gggcttgggtattgtgagaggt

SEQ ID NO: 10018208 - DNA, 22 bp, Homo sapiens
ggggctgatggaactcaggcct

SEQ ID NO: 10018209 - DNA, 22 bp, Homo sapiens
ggggctgagtcagtgggaagag

SEQ ID NO: 10018210 - DNA, 22 bp, Homo sapiens
ggggctgctcccacccctgagg

SEQ ID NO: 10018211 - DNA, 20 bp, Homo sapiens
ggggctgcatgcagagaaga

SEQ ID NO: 10018212 - DNA, 22 bp, Homo sapiens
ggggctggctcactaagagact

SEQ ID NO: 10018213 - DNA, 22 bp, Homo sapiens
ggggctgctggtatttccagtt

SEQ ID NO: 10018214 - DNA, 22 bp, Homo sapiens
ggggctggctcactaagagact

SEQ ID NO: 10018215 - DNA, 22 bp, Homo sapiens
ggggctcagttcggacagcctg

SEQ ID NO: 10018216 - DNA, 22 bp, Homo sapiens
ggggctccagtcttcacatttt

SEQ ID NO: 10018217 - DNA, 22 bp, Homo sapiens
ggggctgaacctggaggtggtc

SEQ ID NO: 10018218 - DNA, 22 bp, Homo sapiens
ggggctgaacctggaggtggtc

SEQ ID NO: 10018219 - DNA, 22 bp, Homo sapiens
ggggctgacgggcatgtggctt

SEQ ID NO: 10018220 - DNA, 22 bp, Homo sapiens
ggggctgacgggcatgtggctt

SEQ ID NO: 10018221 - DNA, 22 bp, Homo sapiens
ggggctgacgggcatgtggctt

SEQ ID NO: 10018222 - DNA, 22 bp, Homo sapiens
ggggctaactttctgagggtag

SEQ ID NO: 10018223 - DNA, 22 bp, Homo sapiens
ggggccgaccgcggttcaggcc

SEQ ID NO: 10018224 - DNA, 22 bp, Homo sapiens
ggggccgaccgcggttcaggcc

SEQ ID NO: 10018225 - DNA, 22 bp, Homo sapiens
ggggaagatggccctccatgtg

SEQ ID NO: 10018226 - DNA, 22 bp, Homo sapiens
ggggccgaccgcggttcaggcc

SEQ ID NO: 10018227 - DNA, 22 bp, Homo sapiens
ggggaaggaaagttattagcag

SEQ ID NO: 10018228 - DNA, 22 bp, Homo sapiens
ggggaagatggccctccatgtg

SEQ ID NO: 10018229 - DNA, 22 bp, Homo sapiens
ggggaagacctggcactacagc

SEQ ID NO: 10018230 - DNA, 22 bp, Homo sapiens
ggggaagaatggcagaaaacat

SEQ ID NO: 10018231 - DNA, 22 bp, Homo sapiens
ggggaagagcattgcacggtgt

SEQ ID NO: 10018232 - DNA, 22 bp, Homo sapiens
ggggaagagcattgcacggtgt

SEQ ID NO: 10018233 - DNA, 22 bp, Homo sapiens
ggggaagagcattgcacggtgt

SEQ ID NO: 10018234 - DNA, 22 bp, Homo sapiens
ggggaagaatggcagaaaacat

SEQ ID NO: 10018235 - DNA, 22 bp, Homo sapiens
ggggaagaatgctctctagaga

SEQ ID NO: 10018236 - DNA, 22 bp, Homo sapiens
gggcttgggtattgtgagaggt

SEQ ID NO: 10018237 - DNA, 22 bp, Homo sapiens
gggcttggtggagagaatgctg

SEQ ID NO: 10018238 - DNA, 22 bp, Homo sapiens
gggtggagtagaaagatgaatt

SEQ ID NO: 10018239 - DNA, 22 bp, Homo sapiens
gggtggaggtgggttttgagat

SEQ ID NO: 10018240 - DNA, 22 bp, Homo sapiens
gggtggagtagaaagatgaatt

SEQ ID NO: 10018241 - DNA, 22 bp, Homo sapiens
gggtggagtgtgaaatctggct

SEQ ID NO: 10018242 - DNA, 22 bp, Homo sapiens
gggtggagcttggacaccagta

SEQ ID NO: 10018243 - DNA, 22 bp, Homo sapiens
gggtggagcttggacaccagta

SEQ ID NO: 10018244 - DNA, 22 bp, Homo sapiens
gggtggaggagaacaggcccca

SEQ ID NO: 10018245 - DNA, 22 bp, Homo sapiens
gggtagggtgacttaggctggc

SEQ ID NO: 10018246 - DNA, 22 bp, Homo sapiens
gggtagggtgacttaggctggc

SEQ ID NO: 10018247 - DNA, 22 bp, Homo sapiens
gggtaggaaatccagaggtggc

SEQ ID NO: 10018248 - DNA, 22 bp, Homo sapiens
gggtaggagaggtgtctgtgtg

SEQ ID NO: 10018249 - DNA, 22 bp, Homo sapiens
gggtaggcaaagcaatgacgtt

SEQ ID NO: 10018250 - DNA, 22 bp, Homo sapiens
gggtaggatggtagaagggacc

SEQ ID NO: 10018251 - DNA, 22 bp, Homo sapiens
gggtaggatggtagaagggacc

SEQ ID NO: 10018252 - DNA, 22 bp, Homo sapiens
ggggtgggcgtgcagggacacc

SEQ ID NO: 10018253 - DNA, 22 bp, Homo sapiens
ggggtgggcgtgcagggacacc

SEQ ID NO: 10018254 - DNA, 22 bp, Homo sapiens
ggggtgggcgtgcagggacacc

SEQ ID NO: 10018255 - DNA, 22 bp, Homo sapiens
ggggtgggcgtgcagggacacc

SEQ ID NO: 10018256 - DNA, 22 bp, Homo sapiens
ggggtgggcgtgcagggacacc

SEQ ID NO: 10018257 - DNA, 22 bp, Homo sapiens
ggggtggggttactcattgtgc

SEQ ID NO: 10018258 - DNA, 22 bp, Homo sapiens
ggggtgggcgtgcagggacacc

SEQ ID NO: 10018259 - DNA, 22 bp, Homo sapiens
ggggtggggttactcattgtgc

SEQ ID NO: 10018260 - DNA, 22 bp, Homo sapiens
ggggtgtgagtagagctgggga

SEQ ID NO: 10018261 - DNA, 22 bp, Homo sapiens
ggggtgtggacggctgtgccag

SEQ ID NO: 10018262 - DNA, 22 bp, Homo sapiens
ggggtgtgtctgacaatggtat

SEQ ID NO: 10018263 - DNA, 22 bp, Homo sapiens
ggggtgtgagtagagctgggga

SEQ ID NO: 10018264 - DNA, 22 bp, Homo sapiens
gggtaggaaatccagaggtggc

SEQ ID NO: 10018265 - DNA, 22 bp, Homo sapiens
ggctccaggagatgctgggcag

SEQ ID NO: 10018266 - DNA, 22 bp, Homo sapiens
ggctccaggagatgctgggcag

SEQ ID NO: 10018267 - DNA, 18 bp, Homo sapiens
ggctccaggacctaccca

SEQ ID NO: 10018268 - DNA, 22 bp, Homo sapiens
ggctccagatgtctcctggcaa

SEQ ID NO: 10018269 - DNA, 22 bp, Homo sapiens
ggctccaggagggccttggcca

SEQ ID NO: 10018270 - DNA, 22 bp, Homo sapiens
ggctccaggagggccttggcca

SEQ ID NO: 10018271 - DNA, 22 bp, Homo sapiens
ggctctgctcacagcccgcagc

SEQ ID NO: 10018272 - DNA, 22 bp, Homo sapiens
ggctccaggagggccttggcca

SEQ ID NO: 10018273 - DNA, 22 bp, Homo sapiens
ggctctggaatgtgtagtcagg

SEQ ID NO: 10018274 - DNA, 22 bp, Homo sapiens
ggctctggaatgtgtagtcagg

SEQ ID NO: 10018275 - DNA, 22 bp, Homo sapiens
ggctccagaaacttcagtccat

SEQ ID NO: 10018276 - DNA, 22 bp, Homo sapiens
ggctccaccctgcttccagaag

SEQ ID NO: 10018277 - DNA, 22 bp, Homo sapiens
ggctccaccctgcttccagaag

SEQ ID NO: 10018278 - DNA, 22 bp, Homo sapiens
ggctccagatgtcccctggcaa

SEQ ID NO: 10018279 - DNA, 22 bp, Homo sapiens
ggctccagatgtctcctggcaa

SEQ ID NO: 10018280 - DNA, 22 bp, Homo sapiens
ggctccagatgtcccctggcaa

SEQ ID NO: 10018281 - DNA, 22 bp, Homo sapiens
ggcggcctgtgggtcggcctca

SEQ ID NO: 10018282 - DNA, 22 bp, Homo sapiens
ggctctggctactccaccctgt

SEQ ID NO: 10018283 - DNA, 22 bp, Homo sapiens
ggctctgggcatagaaggaagc

SEQ ID NO: 10018284 - DNA, 22 bp, Homo sapiens
ggctctggcgtccaatggagcg

SEQ ID NO: 10018285 - DNA, 22 bp, Homo sapiens
ggctctggcgtccaatggagcg

SEQ ID NO: 10018286 - DNA, 19 bp, Homo sapiens
ggctctggcggctgtagcc

SEQ ID NO: 10018287 - DNA, 22 bp, Homo sapiens
ggctctggcggctctttcaata

SEQ ID NO: 10018288 - DNA, 19 bp, Homo sapiens
ggctctggcggctgtagcc

SEQ ID NO: 10018289 - DNA, 22 bp, Homo sapiens
ggctctggcgagctttagtaca

SEQ ID NO: 10018290 - DNA, 22 bp, Homo sapiens
ggctctggcaaggggaggctac

SEQ ID NO: 10018291 - DNA, 22 bp, Homo sapiens
ggctctggcggctctttcaata

SEQ ID NO: 10018292 - DNA, 22 bp, Homo sapiens
ggctctggagcacagacgtctg

SEQ ID NO: 10018293 - DNA, 22 bp, Homo sapiens
ggctctggagacatgtggagag

SEQ ID NO: 10018294 - DNA, 22 bp, Homo sapiens
ggctctggagatgtccgacctg

SEQ ID NO: 10018295 - DNA, 22 bp, Homo sapiens
ggctctggagatgtccgacctg

SEQ ID NO: 10018296 - DNA, 22 bp, Homo sapiens
ggctctggagcacagacgtctg

SEQ ID NO: 10018297 - DNA, 22 bp, Homo sapiens
ggctgaagtgtagtggctcact

SEQ ID NO: 10018298 - DNA, 22 bp, Homo sapiens
ggctgaagtgtagtggctcact

SEQ ID NO: 10018299 - DNA, 22 bp, Homo sapiens
ggctgaagttctttttgttcag

SEQ ID NO: 10018300 - DNA, 22 bp, Homo sapiens
ggctgaagtgtagtggctcact

SEQ ID NO: 10018301 - DNA, 22 bp, Homo sapiens
ggctgagaagacagtggggtgg

SEQ ID NO: 10018302 - DNA, 22 bp, Homo sapiens
ggctgagaaggagtgggtgagg

SEQ ID NO: 10018303 - DNA, 22 bp, Homo sapiens
ggctgagactagagtgaggcat

SEQ ID NO: 10018304 - DNA, 22 bp, Homo sapiens
ggctgagactagagtgaggcat

SEQ ID NO: 10018305 - DNA, 23 bp, Homo sapiens
ggctgagaagtcccatgataggt

SEQ ID NO: 10018306 - DNA, 22 bp, Homo sapiens
ggctgagacaacctgggaccca

SEQ ID NO: 10018307 - DNA, 22 bp, Homo sapiens
ggctgaagaactgggagtctca

SEQ ID NO: 10018308 - DNA, 22 bp, Homo sapiens
ggctgaaggatgaaagctgcag

SEQ ID NO: 10018309 - DNA, 22 bp, Homo sapiens
ggctcttgggagctcagagttg

SEQ ID NO: 10018310 - DNA, 22 bp, Homo sapiens
ggctctgggccagagttggctt

SEQ ID NO: 10018311 - DNA, 22 bp, Homo sapiens
ggcttctgtcctctggatctgt

SEQ ID NO: 10018312 - DNA, 22 bp, Homo sapiens
ggcttctggtgggagcatgact

SEQ ID NO: 10018313 - DNA, 22 bp, Homo sapiens
ggcttctgctcagcctgcacgc

SEQ ID NO: 10018314 - DNA, 22 bp, Homo sapiens
ggcttctgagtgctctgctgtt

SEQ ID NO: 10018315 - DNA, 22 bp, Homo sapiens
ggcttctgaaatctctgtgcgt

SEQ ID NO: 10018316 - DNA, 22 bp, Homo sapiens
ggcttctctgtctagtttctac

SEQ ID NO: 10018317 - DNA, 22 bp, Homo sapiens
ggctgggctgctgggtcagagc

SEQ ID NO: 10018318 - DNA, 22 bp, Homo sapiens
ggctgggctgctgggtcagagc

SEQ ID NO: 10018319 - DNA, 22 bp, Homo sapiens
ggctgggctgctgggtcagagc

SEQ ID NO: 10018320 - DNA, 22 bp, Homo sapiens
ggctgggcatccatccatgaga

SEQ ID NO: 10018321 - DNA, 22 bp, Homo sapiens
ggctgggcatccatccatgaga

SEQ ID NO: 10018322 - DNA, 22 bp, Homo sapiens
ggctgggccagggcctgtggac

SEQ ID NO: 10018323 - DNA, 22 bp, Homo sapiens
ggctgggcaggtctgcacaggg

SEQ ID NO: 10018324 - DNA, 22 bp, Homo sapiens
ggctgggctccgggagcatgcg

SEQ ID NO: 10018325 - DNA, 22 bp, Homo sapiens
ggctgggctccgggagcatgcg

SEQ ID NO: 10018326 - DNA, 22 bp, Homo sapiens
ggctgggctccgggagcatgcg

SEQ ID NO: 10018327 - DNA, 22 bp, Homo sapiens
ggctgctgagttggccaggaga

SEQ ID NO: 10018328 - DNA, 22 bp, Homo sapiens
ggctgagcaattttgatgacat

SEQ ID NO: 10018329 - DNA, 22 bp, Homo sapiens
ggctgagcaattttgatgacat

SEQ ID NO: 10018330 - DNA, 22 bp, Homo sapiens
ggctgggaggccgtgctgacct

SEQ ID NO: 10018331 - DNA, 22 bp, Homo sapiens
ggctgggaggccgtgctgacct

SEQ ID NO: 10018332 - DNA, 22 bp, Homo sapiens
ggctgggaggccgtgctgacct

SEQ ID NO: 10018333 - DNA, 22 bp, Homo sapiens
ggctgggaggccgtgctgacct

SEQ ID NO: 10018334 - DNA, 22 bp, Homo sapiens
ggctgggcaaacaagactcttc

SEQ ID NO: 10018335 - DNA, 22 bp, Homo sapiens
ggctggcttggtgagctgtcac

SEQ ID NO: 10018336 - DNA, 22 bp, Homo sapiens
ggctggcttgcggagtcacaga

SEQ ID NO: 10018337 - DNA, 22 bp, Homo sapiens
ggctggcttggtgagctgtcac

SEQ ID NO: 10018338 - DNA, 22 bp, Homo sapiens
ggctgctgggaatatgccagct

SEQ ID NO: 10018339 - DNA, 22 bp, Homo sapiens
gggaggacggtccagggcaaag

SEQ ID NO: 10018340 - DNA, 22 bp, Homo sapiens
gggaggagcttggagattcact

SEQ ID NO: 10018341 - DNA, 22 bp, Homo sapiens
gggatggggagctggaaagggg

SEQ ID NO: 10018342 - DNA, 22 bp, Homo sapiens
gggatggggagctggaaagggg

SEQ ID NO: 10018343 - DNA, 22 bp, Homo sapiens
gggatggggagctggaaagggg

SEQ ID NO: 10018344 - DNA, 22 bp, Homo sapiens
gggatggggagctggaaagggg

SEQ ID NO: 10018345 - DNA, 22 bp, Homo sapiens
gggaggaaggcttgggtgagta

SEQ ID NO: 10018346 - DNA, 22 bp, Homo sapiens
gggaggaaggcttgggtgagta

SEQ ID NO: 10018347 - DNA, 22 bp, Homo sapiens
gggaggaaatgtgcagcgaatt

SEQ ID NO: 10018348 - DNA, 22 bp, Homo sapiens
gggaggaaatgtgcagcgaatt

SEQ ID NO: 10018349 - DNA, 23 bp, Homo sapiens
gggagctgtggtgaaaagaggtg

SEQ ID NO: 10018350 - DNA, 23 bp, Homo sapiens
gggagctgtggtgaaaagaggtg

SEQ ID NO: 10018351 - DNA, 19 bp, Homo sapiens
gggagctgtctgcccgtgg

SEQ ID NO: 10018352 - DNA, 22 bp, Homo sapiens
gggaggaaatgtgcagcgaatt

SEQ ID NO: 10018353 - DNA, 22 bp, Homo sapiens
gggagcttctggaaggcaggaa

SEQ ID NO: 10018354 - DNA, 22 bp, Homo sapiens
gggatggggtcgggaccctgct

SEQ ID NO: 10018355 - DNA, 22 bp, Homo sapiens
gggatggggtcgggaccctgct

SEQ ID NO: 10018356 - DNA, 22 bp, Homo sapiens
gggatttcaccatgttggttgg

SEQ ID NO: 10018357 - DNA, 22 bp, Homo sapiens
gggcaaaggcagaaagcggtgt

SEQ ID NO: 10018358 - DNA, 22 bp, Homo sapiens
gggatttgtgggatggccagtg

SEQ ID NO: 10018359 - DNA, 19 bp, Homo sapiens
gggcacagcctccccccag

SEQ ID NO: 10018360 - DNA, 22 bp, Homo sapiens
gggcaagcacagcgagcgtgcg

SEQ ID NO: 10018361 - DNA, 22 bp, Homo sapiens
gggcaaagtggtggaggcagtt

SEQ ID NO: 10018362 - DNA, 22 bp, Homo sapiens
gggcaactgaaaaattgtattc

SEQ ID NO: 10018363 - DNA, 19 bp, Homo sapiens
gggcatggatgagcttacc

SEQ ID NO: 10018364 - DNA, 18 bp, Homo sapiens
gggcatggatgcagcatc

SEQ ID NO: 10018365 - DNA, 22 bp, Homo sapiens
gggcaggctgagcatgtcacct

SEQ ID NO: 10018366 - DNA, 22 bp, Homo sapiens
gggcaggctgagcatgtcacct

SEQ ID NO: 10018367 - DNA, 22 bp, Homo sapiens
gggcaggctgagcatgtcacct

SEQ ID NO: 10018368 - DNA, 22 bp, Homo sapiens
gggcatgcctgcgcagtgcatg

SEQ ID NO: 10018369 - DNA, 22 bp, Homo sapiens
gggcaggagaaggtggatgtcc

SEQ ID NO: 10018370 - DNA, 22 bp, Homo sapiens
gggcaggagagaacagtcatgg

SEQ ID NO: 10018371 - DNA, 22 bp, Homo sapiens
gggcaggagaaggtggatgtcc

SEQ ID NO: 10018372 - DNA, 22 bp, Homo sapiens
gggcaggaggctaattctgcat

SEQ ID NO: 10018373 - DNA, 22 bp, Homo sapiens
gggcaggagagggccacctgga

SEQ ID NO: 10018374 - DNA, 22 bp, Homo sapiens
gggcaggagagaacagtcatgg

SEQ ID NO: 10018375 - DNA, 22 bp, Homo sapiens
gggcaggagagaacagtcatgg

SEQ ID NO: 10018376 - DNA, 22 bp, Homo sapiens
gggcagctctggctgtgggaag

SEQ ID NO: 10018377 - DNA, 22 bp, Homo sapiens
gggcagctctgcccatcagagg

SEQ ID NO: 10018378 - DNA, 22 bp, Homo sapiens
gggcagctgcccctctctgggc

SEQ ID NO: 10018379 - DNA, 22 bp, Homo sapiens
gggcagctgccagaggccatgg

SEQ ID NO: 10018380 - DNA, 22 bp, Homo sapiens
gggagacacgctgcaggcataa

SEQ ID NO: 10018381 - DNA, 22 bp, Homo sapiens
gggagacacgctgcaggcataa

SEQ ID NO: 10018382 - DNA, 22 bp, Homo sapiens
gggagactagtgctatgttttc

SEQ ID NO: 10018383 - DNA, 22 bp, Homo sapiens
gggagacccccaatgccaggtc

SEQ ID NO: 10018384 - DNA, 22 bp, Homo sapiens
gggagacagttcagatagtttc

SEQ ID NO: 10018385 - DNA, 20 bp, Homo sapiens
gggagacagggccagtgtcc

SEQ ID NO: 10018386 - DNA, 22 bp, Homo sapiens
gggagagaagggcatgtacact

SEQ ID NO: 10018387 - DNA, 22 bp, Homo sapiens
gggagagaattattgccagacc

SEQ ID NO: 10018388 - DNA, 19 bp, Homo sapiens
gggagagccaggctcaccc

SEQ ID NO: 10018389 - DNA, 22 bp, Homo sapiens
gggagaggttacccgagcaact

SEQ ID NO: 10018390 - DNA, 22 bp, Homo sapiens
gggagagatgctgattgccaat

SEQ ID NO: 10018391 - DNA, 22 bp, Homo sapiens
gggagagagagctcatgttgaa

SEQ ID NO: 10018392 - DNA, 22 bp, Homo sapiens
gggagaggttacccgagcaact

SEQ ID NO: 10018393 - DNA, 22 bp, Homo sapiens
gggagaggttacccgagcaact

SEQ ID NO: 10018394 - DNA, 22 bp, Homo sapiens
gggagaggttacccgagcaact

SEQ ID NO: 10018395 - DNA, 22 bp, Homo sapiens
gggagatgaatcagaagtgatc

SEQ ID NO: 10018396 - DNA, 17 bp, Homo sapiens
gggagatgaagggatat

SEQ ID NO: 10018397 - DNA, 22 bp, Homo sapiens
gggagatgaatcagaagtgatc

SEQ ID NO: 10018398 - DNA, 18 bp, Homo sapiens
gggagctgggaagctggt

SEQ ID NO: 10018399 - DNA, 22 bp, Homo sapiens
gggagctgtagtccagataccg

SEQ ID NO: 10018400 - DNA, 22 bp, Homo sapiens
gggagctgtaagggacaggtag

SEQ ID NO: 10018401 - DNA, 22 bp, Homo sapiens
gggagctgtcatcagtgttgtc

SEQ ID NO: 10018402 - DNA, 20 bp, Homo sapiens
ggcttggctgcctggggagg

SEQ ID NO: 10018403 - DNA, 22 bp, Homo sapiens
ggcttgggagcaggcatgtgac

SEQ ID NO: 10018404 - DNA, 22 bp, Homo sapiens
ggcttgggagcaggcatgtgac

SEQ ID NO: 10018405 - DNA, 22 bp, Homo sapiens
ggcttgtccttctggttgtctt

SEQ ID NO: 10018406 - DNA, 22 bp, Homo sapiens
ggcttgtccttgggctgtgcat

SEQ ID NO: 10018407 - DNA, 22 bp, Homo sapiens
ggcttgggagcaggcatgtgac

SEQ ID NO: 10018408 - DNA, 22 bp, Homo sapiens
ggcttgttgaaacacagattgt

SEQ ID NO: 10018409 - DNA, 22 bp, Homo sapiens
ggctttagtgtaggtttctgtt

SEQ ID NO: 10018410 - DNA, 22 bp, Homo sapiens
ggctttagggcaggcagtgtta

SEQ ID NO: 10018411 - DNA, 23 bp, Homo sapiens
gggagaatatgaggatgatggtg

SEQ ID NO: 10018412 - DNA, 22 bp, Homo sapiens
gggagaagtggaaatctcatta

SEQ ID NO: 10018413 - DNA, 22 bp, Homo sapiens
gggacatctttctagtcagggt

SEQ ID NO: 10018414 - DNA, 22 bp, Homo sapiens
gggacatgaggccatagtgatt

SEQ ID NO: 10018415 - DNA, 22 bp, Homo sapiens
gggacaggctgagacttgagct

SEQ ID NO: 10018416 - DNA, 22 bp, Homo sapiens
ggccatgcctgtgggtgcaggc

SEQ ID NO: 10018417 - DNA, 23 bp, Homo sapiens
ggccatggagacttagaatgggc

SEQ ID NO: 10018418 - DNA, 23 bp, Homo sapiens
ggccatggagacttagaatgggc

SEQ ID NO: 10018419 - DNA, 22 bp, Homo sapiens
ggccatggaccccgagctgacc

SEQ ID NO: 10018420 - DNA, 22 bp, Homo sapiens
ggccatggaccccgagctgacc

SEQ ID NO: 10018421 - DNA, 22 bp, Homo sapiens
ggcctcagaccggagctggcca

SEQ ID NO: 10018422 - DNA, 22 bp, Homo sapiens
ggccatggcgggagccggcgtc

SEQ ID NO: 10018423 - DNA, 18 bp, Homo sapiens
ggcctcagcctggccgga

SEQ ID NO: 10018424 - DNA, 21 bp, Homo sapiens
ggcctcagccacctggctctg

SEQ ID NO: 10018425 - DNA, 22 bp, Homo sapiens
ggcctcagaggaggtgtgagtc

SEQ ID NO: 10018426 - DNA, 18 bp, Homo sapiens
ggcctcagcctggccgga

SEQ ID NO: 10018427 - DNA, 23 bp, Homo sapiens
ggcctcagcgcacagaaactgct

SEQ ID NO: 10018428 - DNA, 22 bp, Homo sapiens
ggcctctggttcgtggtgacct

SEQ ID NO: 10018429 - DNA, 22 bp, Homo sapiens
ggcctctggttcacagggagga

SEQ ID NO: 10018430 - DNA, 22 bp, Homo sapiens
ggcctctggttcacagggagga

SEQ ID NO: 10018431 - DNA, 21 bp, Homo sapiens
ggcctctgtcatcctgggaag

SEQ ID NO: 10018432 - DNA, 21 bp, Homo sapiens
ggcctctgtcatcctgggaag

SEQ ID NO: 10018433 - DNA, 22 bp, Homo sapiens
ggcctctgttctgcattcctcc

SEQ ID NO: 10018434 - DNA, 22 bp, Homo sapiens
ggcctcagtgggccgctgcagg

SEQ ID NO: 10018435 - DNA, 20 bp, Homo sapiens
ggcctcagtgtccttgtttg

SEQ ID NO: 10018436 - DNA, 22 bp, Homo sapiens
ggcctcagggttgggcccatta

SEQ ID NO: 10018437 - DNA, 22 bp, Homo sapiens
ggcgaggccgggacaggctgga

SEQ ID NO: 10018438 - DNA, 22 bp, Homo sapiens
ggcgagcagcgctgtgtcaggt

SEQ ID NO: 10018439 - DNA, 22 bp, Homo sapiens
ggcgagcagagcactgccagga

SEQ ID NO: 10018440 - DNA, 22 bp, Homo sapiens
ggccttggtgccatggccagtt

SEQ ID NO: 10018441 - DNA, 22 bp, Homo sapiens
ggccttggtgctctgtgttgca

SEQ ID NO: 10018442 - DNA, 20 bp, Homo sapiens
ggccttgggtttcgcctgtt

SEQ ID NO: 10018443 - DNA, 17 bp, Homo sapiens
ggccttggggcctcagt

SEQ ID NO: 10018444 - DNA, 17 bp, Homo sapiens
ggccttgggctgctctt

SEQ ID NO: 10018445 - DNA, 22 bp, Homo sapiens
ggccttgggctggctgcagtat

SEQ ID NO: 10018446 - DNA, 22 bp, Homo sapiens
ggccttggggaggatggtgtcc

SEQ ID NO: 10018447 - DNA, 22 bp, Homo sapiens
ggcctgacaagtgggaagaggc

SEQ ID NO: 10018448 - DNA, 22 bp, Homo sapiens
ggcctgaatgcctgagtgtggg

SEQ ID NO: 10018449 - DNA, 22 bp, Homo sapiens
ggcctgaaataaagtagcagaa

SEQ ID NO: 10018450 - DNA, 22 bp, Homo sapiens
ggcctgaaatagctctgaggtt

SEQ ID NO: 10018451 - DNA, 22 bp, Homo sapiens
ggcctgaggcgtcccagctgtg

SEQ ID NO: 10018452 - DNA, 22 bp, Homo sapiens
ggcctgaggcgtcccagctgtg

SEQ ID NO: 10018453 - DNA, 22 bp, Homo sapiens
ggcctgagtcacatcaggagag

SEQ ID NO: 10018454 - DNA, 22 bp, Homo sapiens
ggcctgagtcccacctggctgt

SEQ ID NO: 10018455 - DNA, 18 bp, Homo sapiens
ggcctgcagtgaagcaag

SEQ ID NO: 10018456 - DNA, 22 bp, Homo sapiens
ggccttgggatgtggctgcagc

SEQ ID NO: 10018457 - DNA, 22 bp, Homo sapiens
ggccttgggcagacacgtcaca

SEQ ID NO: 10018458 - DNA, 22 bp, Homo sapiens
ggccagtcccctaatccagggc

SEQ ID NO: 10018459 - DNA, 22 bp, Homo sapiens
ggccagtctgggccacggtcgg

SEQ ID NO: 10018460 - DNA, 22 bp, Homo sapiens
ggccatgcaggtcagaggtggg

SEQ ID NO: 10018461 - DNA, 22 bp, Homo sapiens
ggccatgcaggtcagaggtggg

SEQ ID NO: 10018462 - DNA, 22 bp, Homo sapiens
ggccagggcctggggactgtcc

SEQ ID NO: 10018463 - DNA, 19 bp, Homo sapiens
ggccaggctgactgtggtc

SEQ ID NO: 10018464 - DNA, 22 bp, Homo sapiens
ggccagggcctggggactgtcc

SEQ ID NO: 10018465 - DNA, 22 bp, Homo sapiens
ggccaggtggctgtcctggcgt

SEQ ID NO: 10018466 - DNA, 22 bp, Homo sapiens
ggccagggggcttcagactcca

SEQ ID NO: 10018467 - DNA, 18 bp, Homo sapiens
ggcatgtgagtgctgagg

SEQ ID NO: 10018468 - DNA, 18 bp, Homo sapiens
ggcatgtgagtgctgagg

SEQ ID NO: 10018469 - DNA, 22 bp, Homo sapiens
ggccaaggctcttgagggctga

SEQ ID NO: 10018470 - DNA, 22 bp, Homo sapiens
ggccaaggtggagaaggcactg

SEQ ID NO: 10018471 - DNA, 22 bp, Homo sapiens
ggccaaggatggtggctctggt

SEQ ID NO: 10018472 - DNA, 22 bp, Homo sapiens
ggccaaggatggtggctctggt

SEQ ID NO: 10018473 - DNA, 22 bp, Homo sapiens
ggccaaggtgttctgatatgcc

SEQ ID NO: 10018474 - DNA, 22 bp, Homo sapiens
ggccaaggtggagaaggcactg

SEQ ID NO: 10018475 - DNA, 22 bp, Homo sapiens
ggccaaggtgttctgatatgcc

SEQ ID NO: 10018476 - DNA, 22 bp, Homo sapiens
ggccaattccaggagccggcgg

SEQ ID NO: 10018477 - DNA, 21 bp, Homo sapiens
ggccacaagcggaggagccgc

SEQ ID NO: 10018478 - DNA, 22 bp, Homo sapiens
ggccacagaacagctacaggac

SEQ ID NO: 10018479 - DNA, 19 bp, Homo sapiens
ggccaggctgactgtggtc

SEQ ID NO: 10018480 - DNA, 19 bp, Homo sapiens
ggccaggctgactgtggtc

SEQ ID NO: 10018481 - DNA, 19 bp, Homo sapiens
ggccaggctgactgtggtc

SEQ ID NO: 10018482 - DNA, 19 bp, Homo sapiens
ggccaggctgactgtggtc

SEQ ID NO: 10018483 - DNA, 22 bp, Homo sapiens
ggcagtgaatgaaacagaggct

SEQ ID NO: 10018484 - DNA, 22 bp, Homo sapiens
ggcagtgaatgaaacagaggct

SEQ ID NO: 10018485 - DNA, 22 bp, Homo sapiens
ggcatggacgtctctgaggcca

SEQ ID NO: 10018486 - DNA, 22 bp, Homo sapiens
ggcagtgaatgaaacagaggct

SEQ ID NO: 10018487 - DNA, 22 bp, Homo sapiens
ggcagtgaatctgagagcctgg

SEQ ID NO: 10018488 - DNA, 22 bp, Homo sapiens
ggcagtctttcccttgagctct

SEQ ID NO: 10018489 - DNA, 22 bp, Homo sapiens
ggcagtgaacagaaatgcagaa

SEQ ID NO: 10018490 - DNA, 22 bp, Homo sapiens
ggcagtgaacagaaatgcagaa

SEQ ID NO: 10018491 - DNA, 22 bp, Homo sapiens
ggcagtgaacagaaatgcagaa

SEQ ID NO: 10018492 - DNA, 22 bp, Homo sapiens
ggcagtgaaaaagtatgtttcc

SEQ ID NO: 10018493 - DNA, 22 bp, Homo sapiens
ggcatgggccgaggtgcctcct

SEQ ID NO: 10018494 - DNA, 22 bp, Homo sapiens
ggcatggggtgtatgtggcacg

SEQ ID NO: 10018495 - DNA, 22 bp, Homo sapiens
ggcatggggtgtatgtggcacg

SEQ ID NO: 10018496 - DNA, 22 bp, Homo sapiens
ggcatggcctgtaagacggaga

SEQ ID NO: 10018497 - DNA, 21 bp, Homo sapiens
ggcatggcacctctgggcagg

SEQ ID NO: 10018498 - DNA, 22 bp, Homo sapiens
ggcagtcagtgtggttcataaa

SEQ ID NO: 10018499 - DNA, 22 bp, Homo sapiens
ggcagtcacttttgcttgtgcc

SEQ ID NO: 10018500 - DNA, 22 bp, Homo sapiens
ggcaggtgggaaccctccccac

SEQ ID NO: 10018501 - DNA, 22 bp, Homo sapiens
ggcaggtggaagttggcagagc

SEQ ID NO: 10018502 - DNA, 22 bp, Homo sapiens
ggcaggtggattttctactcta

SEQ ID NO: 10018503 - DNA, 22 bp, Homo sapiens
ggcaggcagaggctgagacagg

SEQ ID NO: 10018504 - DNA, 22 bp, Homo sapiens
ggcaggtggaagttggcagagc

SEQ ID NO: 10018505 - DNA, 22 bp, Homo sapiens
ggcaggcagaggctgagacagg

SEQ ID NO: 10018506 - DNA, 22 bp, Homo sapiens
ggcagaggtagctggaaccagg

SEQ ID NO: 10018507 - DNA, 22 bp, Homo sapiens
ggcagaggtagctggaaccagg

SEQ ID NO: 10018508 - DNA, 22 bp, Homo sapiens
ggcagaggtagctggaaccagg

SEQ ID NO: 10018509 - DNA, 20 bp, Homo sapiens
ggcagagggcctgggagaag

SEQ ID NO: 10018510 - DNA, 20 bp, Homo sapiens
ggcagagggcctgggagaag

SEQ ID NO: 10018511 - DNA, 20 bp, Homo sapiens
ggcagagggcctgggagaag

SEQ ID NO: 10018512 - DNA, 20 bp, Homo sapiens
ggcagagggcctgggagaag

SEQ ID NO: 10018513 - DNA, 20 bp, Homo sapiens
ggcagagggcctgggagaag

SEQ ID NO: 10018514 - DNA, 22 bp, Homo sapiens
ggcaggagggcggacaatgacc

SEQ ID NO: 10018515 - DNA, 22 bp, Homo sapiens
ggcaggagggcggacaatgacc

SEQ ID NO: 10018516 - DNA, 22 bp, Homo sapiens
ggcagaggtagctggaaccagg

SEQ ID NO: 10018517 - DNA, 22 bp, Homo sapiens
ggcaggaggaagagttagcacc

SEQ ID NO: 10018518 - DNA, 22 bp, Homo sapiens
ggcagaggtagctggaaccagg

SEQ ID NO: 10018519 - DNA, 22 bp, Homo sapiens
ggcaggagggcggacaatgacc

SEQ ID NO: 10018520 - DNA, 22 bp, Homo sapiens
ggcaggaggtgagtggcgggtg

SEQ ID NO: 10018521 - DNA, 18 bp, Homo sapiens
ggcaggatttcaactttc

SEQ ID NO: 10018522 - DNA, 22 bp, Homo sapiens
ggcaggcaacggaccactagtc

SEQ ID NO: 10018523 - DNA, 22 bp, Homo sapiens
ggcaggcaagtctgctctgtga

SEQ ID NO: 10018524 - DNA, 22 bp, Homo sapiens
ggcaggcaatgaggatgggaag

SEQ ID NO: 10018525 - DNA, 22 bp, Homo sapiens
ggcaggcaccagctcagcaata

SEQ ID NO: 10018526 - DNA, 22 bp, Homo sapiens
ggcaggcacatttgggggccgt

SEQ ID NO: 10018527 - DNA, 22 bp, Homo sapiens
ggcaggcaccagctcagcaata

SEQ ID NO: 10018528 - DNA, 22 bp, Homo sapiens
ggcaggcagaggctgagacagg

SEQ ID NO: 10018529 - DNA, 22 bp, Homo sapiens
ggcacaggaatctgtgaagtgc

SEQ ID NO: 10018530 - DNA, 22 bp, Homo sapiens
ggcacagctgatgcagacacac

SEQ ID NO: 10018531 - DNA, 22 bp, Homo sapiens
ggcacagctcaggtcccagctc

SEQ ID NO: 10018532 - DNA, 17 bp, Homo sapiens
ggcaccagacggagagt

SEQ ID NO: 10018533 - DNA, 22 bp, Homo sapiens
ggcacagctacttgctcactct

SEQ ID NO: 10018534 - DNA, 22 bp, Homo sapiens
ggcacagctcaggtcccagctc

SEQ ID NO: 10018535 - DNA, 22 bp, Homo sapiens
ggcacagcgactaccatcgaaa

SEQ ID NO: 10018536 - DNA, 22 bp, Homo sapiens
ggcacagcgactaccatcgaaa

SEQ ID NO: 10018537 - DNA, 22 bp, Homo sapiens
ggcacagccctctctgtggaca

SEQ ID NO: 10018538 - DNA, 22 bp, Homo sapiens
ggcacagccctctctgtggaca

SEQ ID NO: 10018539 - DNA, 22 bp, Homo sapiens
ggcacagcaggagctatgtgaa

SEQ ID NO: 10018540 - DNA, 22 bp, Homo sapiens
ggcagaggagctggaaacatgg

SEQ ID NO: 10018541 - DNA, 22 bp, Homo sapiens
ggcagaggagctggaaacatgg

SEQ ID NO: 10018542 - DNA, 22 bp, Homo sapiens
ggcagaggagctggaaacatgg

SEQ ID NO: 10018543 - DNA, 22 bp, Homo sapiens
ggcagaggagctggaaacatgg

SEQ ID NO: 10018544 - DNA, 22 bp, Homo sapiens
ggcagaggaggggtgaatttgc

SEQ ID NO: 10018545 - DNA, 22 bp, Homo sapiens
ggcagaggaagctggaagtggg

SEQ ID NO: 10018546 - DNA, 22 bp, Homo sapiens
ggcagaggaagctggaagtggg

SEQ ID NO: 10018547 - DNA, 22 bp, Homo sapiens
ggcagaggaagctggaagtggg

SEQ ID NO: 10018548 - DNA, 22 bp, Homo sapiens
ggcagaggaagctggaagtggg

SEQ ID NO: 10018549 - DNA, 22 bp, Homo sapiens
ggcagaggaaggatgaattcac

SEQ ID NO: 10018550 - DNA, 22 bp, Homo sapiens
ggcagaggaaggatgaattcac

SEQ ID NO: 10018551 - DNA, 22 bp, Homo sapiens
ggcagaggaaggatgaattcac

SEQ ID NO: 10018552 - DNA, 23 bp, Homo sapiens
ggcaccaggccatggagcgggag

SEQ ID NO: 10018553 - DNA, 20 bp, Homo sapiens
ggcaccaggctaggattgga

SEQ ID NO: 10018554 - DNA, 22 bp, Homo sapiens
ggcaccaggctgggcataggcc

SEQ ID NO: 10018555 - DNA, 22 bp, Homo sapiens
ggagtgagtggccttgtcactg

SEQ ID NO: 10018556 - DNA, 22 bp, Homo sapiens
ggagtgagtggccttgtcactg

SEQ ID NO: 10018557 - DNA, 22 bp, Homo sapiens
ggcaaacaccaggcgagggagc

SEQ ID NO: 10018558 - DNA, 22 bp, Homo sapiens
ggcaaaaatcacccctggttca

SEQ ID NO: 10018559 - DNA, 22 bp, Homo sapiens
ggattttagagtacctaagtgt

SEQ ID NO: 10018560 - DNA, 22 bp, Homo sapiens
ggcaaaaacagcaatgactttt

SEQ ID NO: 10018561 - DNA, 22 bp, Homo sapiens
ggcaaaaagttcccatcagtgt

SEQ ID NO: 10018562 - DNA, 22 bp, Homo sapiens
ggcaaaaaccgcaataacttct

SEQ ID NO: 10018563 - DNA, 22 bp, Homo sapiens
ggcaaaaaccacaattactttt

SEQ ID NO: 10018564 - DNA, 22 bp, Homo sapiens
ggcaaaaaccataattactttt

SEQ ID NO: 10018565 - DNA, 22 bp, Homo sapiens
ggcaagagttgaagctccagga

SEQ ID NO: 10018566 - DNA, 22 bp, Homo sapiens
ggcaagagggcagatggagtgc

SEQ ID NO: 10018567 - DNA, 22 bp, Homo sapiens
ggcaagagtgaggagtgtctct

SEQ ID NO: 10018568 - DNA, 22 bp, Homo sapiens
ggcaacatgatgtcaaccagga

SEQ ID NO: 10018569 - DNA, 22 bp, Homo sapiens
ggcaacattctccagatccttt

SEQ ID NO: 10018570 - DNA, 22 bp, Homo sapiens
ggcaacctgagcttgtggagaa

SEQ ID NO: 10018571 - DNA, 21 bp, Homo sapiens
ggcaagaaacacaatcaagta

SEQ ID NO: 10018572 - DNA, 22 bp, Homo sapiens
ggcaagaaggcttcaggtagct

SEQ ID NO: 10018573 - DNA, 22 bp, Homo sapiens
ggcaagaaggcttcaggtagct

SEQ ID NO: 10018574 - DNA, 22 bp, Homo sapiens
ggcaagaacctcaattaccttt

SEQ ID NO: 10018575 - DNA, 22 bp, Homo sapiens
ggcaagaaccacaattactttt

SEQ ID NO: 10018576 - DNA, 21 bp, Homo sapiens
ggcaagaaacacaatcaagta

SEQ ID NO: 10018577 - DNA, 18 bp, Homo sapiens
ggcaaatgcaattcaaag

SEQ ID NO: 10018578 - DNA, 22 bp, Homo sapiens
ggagtgagcaaatagagatttg

SEQ ID NO: 10018579 - DNA, 22 bp, Homo sapiens
ggagtcagcctgtcagagtgta

SEQ ID NO: 10018580 - DNA, 22 bp, Homo sapiens
ggagtcagcctgtcagagtgta

SEQ ID NO: 10018581 - DNA, 22 bp, Homo sapiens
ggagtcaggagcaggctgggct

SEQ ID NO: 10018582 - DNA, 22 bp, Homo sapiens
ggagtcacctgggaggactggg

SEQ ID NO: 10018583 - DNA, 22 bp, Homo sapiens
ggagtcaccaagtaggagtctt

SEQ ID NO: 10018584 - DNA, 22 bp, Homo sapiens
ggagtcaccaagtaggagtctt

SEQ ID NO: 10018585 - DNA, 22 bp, Homo sapiens
ggagtcagaatggcagggtggt

SEQ ID NO: 10018586 - DNA, 22 bp, Homo sapiens
ggagtcagaatggcagggtggt

SEQ ID NO: 10018587 - DNA, 22 bp, Homo sapiens
ggagccagagcactggggagcc

SEQ ID NO: 10018588 - DNA, 22 bp, Homo sapiens
ggagccagagcactggggagcc

SEQ ID NO: 10018589 - DNA, 22 bp, Homo sapiens
ggagccagaggctgctgctgtg

SEQ ID NO: 10018590 - DNA, 22 bp, Homo sapiens
ggagtcacacagagaagataag

SEQ ID NO: 10018591 - DNA, 22 bp, Homo sapiens
ggagtcaaggaaggctctgtga

SEQ ID NO: 10018592 - DNA, 22 bp, Homo sapiens
ggagtaggccccgggagagagt

SEQ ID NO: 10018593 - DNA, 19 bp, Homo sapiens
ggagccagctgtggaaggc

SEQ ID NO: 10018594 - DNA, 19 bp, Homo sapiens
ggagccagctgtggaaggc

SEQ ID NO: 10018595 - DNA, 23 bp, Homo sapiens
ggagccagcctgtggggagcggg

SEQ ID NO: 10018596 - DNA, 22 bp, Homo sapiens
gccctggccttcatctcagaca

SEQ ID NO: 10018597 - DNA, 22 bp, Homo sapiens
gccctgggattgggtggaggct

SEQ ID NO: 10018598 - DNA, 22 bp, Homo sapiens
gccctggatggcaggagccatc

SEQ ID NO: 10018599 - DNA, 22 bp, Homo sapiens
gccctggatgctcatggcatca

SEQ ID NO: 10018600 - DNA, 22 bp, Homo sapiens
gccctggatgtacaggcatgtt

SEQ ID NO: 10018601 - DNA, 22 bp, Homo sapiens
gccctgtgccagtcacgctgtg

SEQ ID NO: 10018602 - DNA, 22 bp, Homo sapiens
gccctgtgccagtcacgctgtg

SEQ ID NO: 10018603 - DNA, 22 bp, Homo sapiens
gccctgtgcgactctagaggtt

SEQ ID NO: 10018604 - DNA, 22 bp, Homo sapiens
gccctgtgcgactctagaggtt

SEQ ID NO: 10018605 - DNA, 22 bp, Homo sapiens
gccctgtgcgactctagaggtt

SEQ ID NO: 10018606 - DNA, 22 bp, Homo sapiens
gccctgtgcttggatggcagat

SEQ ID NO: 10018607 - DNA, 22 bp, Homo sapiens
gccctgtgcttggatggcagat

SEQ ID NO: 10018608 - DNA, 22 bp, Homo sapiens
gccctgtggacagtgagaagtg

SEQ ID NO: 10018609 - DNA, 22 bp, Homo sapiens
gccctgtggacagtgagaagtg

SEQ ID NO: 10018610 - DNA, 22 bp, Homo sapiens
gccctgtggattaatgagcagg

SEQ ID NO: 10018611 - DNA, 22 bp, Homo sapiens
gccctgtggacccaggaactct

SEQ ID NO: 10018612 - DNA, 22 bp, Homo sapiens
gccctgtggattaatgagcagg

SEQ ID NO: 10018613 - DNA, 22 bp, Homo sapiens
gccccagccaaggtgacacgaa

SEQ ID NO: 10018614 - DNA, 22 bp, Homo sapiens
gccccagccaaggtgacacgaa

SEQ ID NO: 10018615 - DNA, 22 bp, Homo sapiens
gccccagccaaggtgacacgaa

SEQ ID NO: 10018616 - DNA, 22 bp, Homo sapiens
gccccagatggaggaagctggg

SEQ ID NO: 10018617 - DNA, 22 bp, Homo sapiens
gccccagaaagttcaaggcaca

SEQ ID NO: 10018618 - DNA, 22 bp, Homo sapiens
gccccagcctcccgagtagctg

SEQ ID NO: 10018619 - DNA, 22 bp, Homo sapiens
gccctggagctagactaggaca

SEQ ID NO: 10018620 - DNA, 17 bp, Homo sapiens
gccctggagccaggcta

SEQ ID NO: 10018621 - DNA, 22 bp, Homo sapiens
gccctggagagggatatggcat

SEQ ID NO: 10018622 - DNA, 22 bp, Homo sapiens
gccctggagagggatatggcat

SEQ ID NO: 10018623 - DNA, 22 bp, Homo sapiens
gccccagctctgccacaactag

SEQ ID NO: 10018624 - DNA, 22 bp, Homo sapiens
gccccagctctgccacaactag

SEQ ID NO: 10018625 - DNA, 22 bp, Homo sapiens
gcctcctgacttacactgagct

SEQ ID NO: 10018626 - DNA, 22 bp, Homo sapiens
gcctcctcttgagggtcaggga

SEQ ID NO: 10018627 - DNA, 22 bp, Homo sapiens
gcctcctcttgagggtcaggga

SEQ ID NO: 10018628 - DNA, 22 bp, Homo sapiens
gcctcctcacaatgtacccacg

SEQ ID NO: 10018629 - DNA, 23 bp, Homo sapiens
gcctcctagcagtaaacatgtta

SEQ ID NO: 10018630 - DNA, 22 bp, Homo sapiens
gcctcctattaaaatttacctt

SEQ ID NO: 10018631 - DNA, 22 bp, Homo sapiens
gcctccggagttgcagtgtctt

SEQ ID NO: 10018632 - DNA, 22 bp, Homo sapiens
gcctcccttggtgtctcccggg

SEQ ID NO: 10018633 - DNA, 22 bp, Homo sapiens
gccctgtgtgtttgcactgatt

SEQ ID NO: 10018634 - DNA, 22 bp, Homo sapiens
gccctgtgtgatcacatgaaca

SEQ ID NO: 10018635 - DNA, 22 bp, Homo sapiens
gccctgtgtatcccctgtgctt

SEQ ID NO: 10018636 - DNA, 22 bp, Homo sapiens
gccctgtggttccaggaagcaa

SEQ ID NO: 10018637 - DNA, 22 bp, Homo sapiens
gccctgtggttccaggaagcaa

SEQ ID NO: 10018638 - DNA, 22 bp, Homo sapiens
gcctccggagttgcagtgtctt

SEQ ID NO: 10018639 - DNA, 22 bp, Homo sapiens
gcctccggagttgcagtgtctt

SEQ ID NO: 10018640 - DNA, 22 bp, Homo sapiens
gcctccggagtcacagtgtctt

SEQ ID NO: 10018641 - DNA, 22 bp, Homo sapiens
gcctccggagtcacagtgtctt

SEQ ID NO: 10018642 - DNA, 22 bp, Homo sapiens
gcctccggagtcacagtgtctt

SEQ ID NO: 10018643 - DNA, 22 bp, Homo sapiens
gcctcctgagaagccacaggct

SEQ ID NO: 10018644 - DNA, 22 bp, Homo sapiens
gcctctgggctctgcccctggc

SEQ ID NO: 10018645 - DNA, 22 bp, Homo sapiens
gcctctgggctctgcccctggc

SEQ ID NO: 10018646 - DNA, 22 bp, Homo sapiens
gcccagctttttgaggcaggca

SEQ ID NO: 10018647 - DNA, 22 bp, Homo sapiens
gcccagctgtctggcagggatg

SEQ ID NO: 10018648 - DNA, 22 bp, Homo sapiens
gcccagctggcttccagcacat

SEQ ID NO: 10018649 - DNA, 22 bp, Homo sapiens
gcccagctggcttccagcacat

SEQ ID NO: 10018650 - DNA, 22 bp, Homo sapiens
gcccaggaagttgaggctgccg

SEQ ID NO: 10018651 - DNA, 22 bp, Homo sapiens
gcccatggcagaactgtgagca

SEQ ID NO: 10018652 - DNA, 22 bp, Homo sapiens
gcccatggcttccctaggcaca

SEQ ID NO: 10018653 - DNA, 22 bp, Homo sapiens
gccccacagcctgcggtctcag

SEQ ID NO: 10018654 - DNA, 22 bp, Homo sapiens
gcccatgtctgacagggtgggg

SEQ ID NO: 10018655 - DNA, 22 bp, Homo sapiens
gcccatggtccaggaagacaga

SEQ ID NO: 10018656 - DNA, 22 bp, Homo sapiens
gcccagccctgaggtcacagct

SEQ ID NO: 10018657 - DNA, 22 bp, Homo sapiens
gcccagcctccaagctccaagg

SEQ ID NO: 10018658 - DNA, 22 bp, Homo sapiens
gcccagctcctctgcagaccct

SEQ ID NO: 10018659 - DNA, 22 bp, Homo sapiens
gcccagctgcaccctggtgggt

SEQ ID NO: 10018660 - DNA, 22 bp, Homo sapiens
gcccagcagatctcagtgtctc

SEQ ID NO: 10018661 - DNA, 22 bp, Homo sapiens
gcccagcacctctctcagggtt

SEQ ID NO: 10018662 - DNA, 22 bp, Homo sapiens
gcccagcacattgctgaggacc

SEQ ID NO: 10018663 - DNA, 22 bp, Homo sapiens
gcccagcacctctctcagggtt

SEQ ID NO: 10018664 - DNA, 22 bp, Homo sapiens
gcccagcacctctctcagggtt

SEQ ID NO: 10018665 - DNA, 22 bp, Homo sapiens
gcccagcaaggaccaagggccg

SEQ ID NO: 10018666 - DNA, 22 bp, Homo sapiens
gccaggtcacagggataaatgg

SEQ ID NO: 10018667 - DNA, 22 bp, Homo sapiens
gccaggtcacctcactcatcca

SEQ ID NO: 10018668 - DNA, 22 bp, Homo sapiens
gcccagcacagctggaagagtc

SEQ ID NO: 10018669 - DNA, 21 bp, Homo sapiens
gcccagcaaggtgagaaggcc

SEQ ID NO: 10018670 - DNA, 22 bp, Homo sapiens
gcccagcacattgctgaggacc

SEQ ID NO: 10018671 - DNA, 22 bp, Homo sapiens
gccagggggtcagcaggcactt

SEQ ID NO: 10018672 - DNA, 22 bp, Homo sapiens
gccagggtgtgcagggacagga

SEQ ID NO: 10018673 - DNA, 22 bp, Homo sapiens
gccagggttcgaatccgtatgg

SEQ ID NO: 10018674 - DNA, 22 bp, Homo sapiens
gcagtggctaggagtctggcgt

SEQ ID NO: 10018675 - DNA, 22 bp, Homo sapiens
gcagtggctaggagtctggcgt

SEQ ID NO: 10018676 - DNA, 22 bp, Homo sapiens
gcagtggctaagctcgcatgca

SEQ ID NO: 10018677 - DNA, 22 bp, Homo sapiens
gcagtggcccagcttgcaggct

SEQ ID NO: 10018678 - DNA, 22 bp, Homo sapiens
gcagtggctaagctcgcatgca

SEQ ID NO: 10018679 - DNA, 22 bp, Homo sapiens
gcagtggccacatggaggagga

SEQ ID NO: 10018680 - DNA, 22 bp, Homo sapiens
gcatgcacggggcatatgggac

SEQ ID NO: 10018681 - DNA, 22 bp, Homo sapiens
gcagtgggagcttaggcagtgc

SEQ ID NO: 10018682 - DNA, 22 bp, Homo sapiens
gcatgcaatgtatcagtgatag

SEQ ID NO: 10018683 - DNA, 22 bp, Homo sapiens
gcatgcaattatggtattagat

SEQ ID NO: 10018684 - DNA, 22 bp, Homo sapiens
gcatgcaggataggttgagctc

SEQ ID NO: 10018685 - DNA, 22 bp, Homo sapiens
gcatgcagggagggtctggctg

SEQ ID NO: 10018686 - DNA, 22 bp, Homo sapiens
gcatgcagacagtctgagacca

SEQ ID NO: 10018687 - DNA, 22 bp, Homo sapiens
gcatgcagagaatacctgtgat

SEQ ID NO: 10018688 - DNA, 22 bp, Homo sapiens
gcatgcagagtccctctgcatt

SEQ ID NO: 10018689 - DNA, 19 bp, Homo sapiens
gcatgcagagtaagaaggt

SEQ ID NO: 10018690 - DNA, 22 bp, Homo sapiens
gcagtgaatttaacactcagat

SEQ ID NO: 10018691 - DNA, 22 bp, Homo sapiens
gcagtgaagccagatctgaaat

SEQ ID NO: 10018692 - DNA, 22 bp, Homo sapiens
gcagtgaatctggcaagaattt

SEQ ID NO: 10018693 - DNA, 22 bp, Homo sapiens
gcagtggaagcctctttaagca

SEQ ID NO: 10018694 - DNA, 22 bp, Homo sapiens
gcagtgagttatgatcatgcca

SEQ ID NO: 10018695 - DNA, 22 bp, Homo sapiens
gcaggggagtggcaggcccgga

SEQ ID NO: 10018696 - DNA, 22 bp, Homo sapiens
gcaggggagtggcaggcccgga

SEQ ID NO: 10018697 - DNA, 22 bp, Homo sapiens
gcaggggagtggatgatggatt

SEQ ID NO: 10018698 - DNA, 22 bp, Homo sapiens
gcaggggagtggatgatggatt

SEQ ID NO: 10018699 - DNA, 22 bp, Homo sapiens
gcaggggagtccactctatgca

SEQ ID NO: 10018700 - DNA, 22 bp, Homo sapiens
gcaggggagtggatgatggatt

SEQ ID NO: 10018701 - DNA, 22 bp, Homo sapiens
gcagtggatggccagcaggggc

SEQ ID NO: 10018702 - DNA, 22 bp, Homo sapiens
gcagtggcaccgctggctctgg

SEQ ID NO: 10018703 - DNA, 22 bp, Homo sapiens
gcagtggatggccagcaggggc

SEQ ID NO: 10018704 - DNA, 17 bp, Homo sapiens
gcagtggaggggtagtt

SEQ ID NO: 10018705 - DNA, 22 bp, Homo sapiens
gcagtggatccaatggtatctt

SEQ ID NO: 10018706 - DNA, 22 bp, Homo sapiens
gcagtggatccaatggtatctt

SEQ ID NO: 10018707 - DNA, 22 bp, Homo sapiens
gcagtggatggccagcaggggc

SEQ ID NO: 10018708 - DNA, 23 bp, Homo sapiens
gcagtggaatgtctctgtttgga

SEQ ID NO: 10018709 - DNA, 17 bp, Homo sapiens
gcagtggaggggtagtt

SEQ ID NO: 10018710 - DNA, 17 bp, Homo sapiens
gcagtggaggggtagtt

SEQ ID NO: 10018711 - DNA, 22 bp, Homo sapiens
gcagtggcatgatgtgggctca

SEQ ID NO: 10018712 - DNA, 22 bp, Homo sapiens
gcagtggcagctgagggggtat

SEQ ID NO: 10018713 - DNA, 22 bp, Homo sapiens
gcagtggcatgatgtgggctca

SEQ ID NO: 10018714 - DNA, 22 bp, Homo sapiens
gcatggcatttgaaggtagaag

SEQ ID NO: 10018715 - DNA, 22 bp, Homo sapiens
gcatgcagtcaaccagtaaggg

SEQ ID NO: 10018716 - DNA, 22 bp, Homo sapiens
gcatgcagtcaaccagtaaggg

SEQ ID NO: 10018717 - DNA, 22 bp, Homo sapiens
gcatgcagtaaaattcagcaac

SEQ ID NO: 10018718 - DNA, 22 bp, Homo sapiens
gcatgctgctgaggctggaata

SEQ ID NO: 10018719 - DNA, 22 bp, Homo sapiens
gcatgctgctgaggctggaata

SEQ ID NO: 10018720 - DNA, 22 bp, Homo sapiens
gcatgctgctgaggctggaata

SEQ ID NO: 10018721 - DNA, 21 bp, Homo sapiens
gcatgcctgcatcttagtgtt

SEQ ID NO: 10018722 - DNA, 22 bp, Homo sapiens
gcatgctgcaccagagcctctc

SEQ ID NO: 10018723 - DNA, 22 bp, Homo sapiens
gcatgctacagcccaactgtga

SEQ ID NO: 10018724 - DNA, 22 bp, Homo sapiens
gccaccagggggtgcaaggtcc

SEQ ID NO: 10018725 - DNA, 22 bp, Homo sapiens
gccaccaggttagatccagcct

SEQ ID NO: 10018726 - DNA, 22 bp, Homo sapiens
gccaccagtgggggcctgggca

SEQ ID NO: 10018727 - DNA, 22 bp, Homo sapiens
gccaccaggagcccagtccaaa

SEQ ID NO: 10018728 - DNA, 22 bp, Homo sapiens
gccaccagccccatgcgctgtg

SEQ ID NO: 10018729 - DNA, 22 bp, Homo sapiens
gccaccaggagcccagtccaaa

SEQ ID NO: 10018730 - DNA, 22 bp, Homo sapiens
gccaccagggggctccagtgag

SEQ ID NO: 10018731 - DNA, 22 bp, Homo sapiens
gccaccagggggctccagtgag

SEQ ID NO: 10018732 - DNA, 22 bp, Homo sapiens
gccacaggcttaggagggaggt

SEQ ID NO: 10018733 - DNA, 20 bp, Homo sapiens
gccacagttttctcactgca

SEQ ID NO: 10018734 - DNA, 20 bp, Homo sapiens
gccacagttttctcactgca

SEQ ID NO: 10018735 - DNA, 22 bp, Homo sapiens
gccacaggcttaggagggaggt

SEQ ID NO: 10018736 - DNA, 22 bp, Homo sapiens
gccacaggcttaggagggaggt

SEQ ID NO: 10018737 - DNA, 22 bp, Homo sapiens
gccacaggcttaggagggaggt

SEQ ID NO: 10018738 - DNA, 22 bp, Homo sapiens
gccacatgtcatgtgctcagta

SEQ ID NO: 10018739 - DNA, 22 bp, Homo sapiens
gccacatgcaattgcagcacgt

SEQ ID NO: 10018740 - DNA, 22 bp, Homo sapiens
gccacatgcaattgcagcacgt

SEQ ID NO: 10018741 - DNA, 19 bp, Homo sapiens
gccacattcttccaggtgt

SEQ ID NO: 10018742 - DNA, 22 bp, Homo sapiens
gccaccagcagaaaaggggcca

SEQ ID NO: 10018743 - DNA, 22 bp, Homo sapiens
gccacattagccctcaccatct

SEQ ID NO: 10018744 - DNA, 22 bp, Homo sapiens
gccacattagccctcaccatct

SEQ ID NO: 10018745 - DNA, 22 bp, Homo sapiens
gccaccagcagaaaaggggcca

SEQ ID NO: 10018746 - DNA, 22 bp, Homo sapiens
gccagggcaggggagcatctgc

SEQ ID NO: 10018747 - DNA, 22 bp, Homo sapiens
gccagggctcgcggtccctcgt

SEQ ID NO: 10018748 - DNA, 22 bp, Homo sapiens
gccagggctcgcggtccctcgt

SEQ ID NO: 10018749 - DNA, 22 bp, Homo sapiens
gccagggctgtgcaggtttgtt

SEQ ID NO: 10018750 - DNA, 22 bp, Homo sapiens
gccagggctgtgcaggtttgtt

SEQ ID NO: 10018751 - DNA, 22 bp, Homo sapiens
gccagggctcgcggtccctcgt

SEQ ID NO: 10018752 - DNA, 22 bp, Homo sapiens
gccagggcaggggagcatctgc

SEQ ID NO: 10018753 - DNA, 22 bp, Homo sapiens
gccagggctcgcggtccctcgt

SEQ ID NO: 10018754 - DNA, 22 bp, Homo sapiens
gccagggaggctgtagggtcct

SEQ ID NO: 10018755 - DNA, 22 bp, Homo sapiens
gccaggcatgggcttctgggcg

SEQ ID NO: 10018756 - DNA, 22 bp, Homo sapiens
gccaggcagttcaagtacacca

SEQ ID NO: 10018757 - DNA, 22 bp, Homo sapiens
gccagggaacccaagggcctca

SEQ ID NO: 10018758 - DNA, 22 bp, Homo sapiens
gccaggcagcaggaagccagtg

SEQ ID NO: 10018759 - DNA, 22 bp, Homo sapiens
gccaggcagcagcgaggatggt

SEQ ID NO: 10018760 - DNA, 22 bp, Homo sapiens
gccaggcagccaccctctgcga

SEQ ID NO: 10018761 - DNA, 22 bp, Homo sapiens
gccaggcagccaccctctgcga

SEQ ID NO: 10018762 - DNA, 22 bp, Homo sapiens
gccaggcagagccccgtgcagc

SEQ ID NO: 10018763 - DNA, 22 bp, Homo sapiens
gccaggcagatatgtgagctta

SEQ ID NO: 10018764 - DNA, 22 bp, Homo sapiens
gccaggcagatatgtgagctta

SEQ ID NO: 10018765 - DNA, 22 bp, Homo sapiens
gccaggcagctagcaacccctg

SEQ ID NO: 10018766 - DNA, 22 bp, Homo sapiens
gccaggcagctgggagggtgcc

SEQ ID NO: 10018767 - DNA, 22 bp, Homo sapiens
gccaggcaggccacgctgtgtt

SEQ ID NO: 10018768 - DNA, 18 bp, Homo sapiens
gccaggcagggtggggaa

SEQ ID NO: 10018769 - DNA, 22 bp, Homo sapiens
gccaggcaggtgtcggagccct

SEQ ID NO: 10018770 - DNA, 18 bp, Homo sapiens
gccaggcagggtggggaa

SEQ ID NO: 10018771 - DNA, 18 bp, Homo sapiens
gccaggcagggtggggaa

SEQ ID NO: 10018772 - DNA, 22 bp, Homo sapiens
gccaggcagacaggtcatcagg

SEQ ID NO: 10018773 - DNA, 20 bp, Homo sapiens
gccaggcactgttctcaata

SEQ ID NO: 10018774 - DNA, 22 bp, Homo sapiens
gccaggcactgctctaagccct

SEQ ID NO: 10018775 - DNA, 22 bp, Homo sapiens
gccagctgaagggaagctcctg

SEQ ID NO: 10018776 - DNA, 22 bp, Homo sapiens
gccagctcagatgcaggaagga

SEQ ID NO: 10018777 - DNA, 22 bp, Homo sapiens
gccagctcagatgcaggaagga

SEQ ID NO: 10018778 - DNA, 23 bp, Homo sapiens
gccagccttgctctcctgcagcc

SEQ ID NO: 10018779 - DNA, 22 bp, Homo sapiens
gccagccttctgtggcctgcaa

SEQ ID NO: 10018780 - DNA, 22 bp, Homo sapiens
gccagcctgtgggggctctgtg

SEQ ID NO: 10018781 - DNA, 21 bp, Homo sapiens
gccagcctgtttacctgtggt

SEQ ID NO: 10018782 - DNA, 21 bp, Homo sapiens
gccagcctgtttacctgtggt

SEQ ID NO: 10018783 - DNA, 21 bp, Homo sapiens
gccagcctgtttacctgtggt

SEQ ID NO: 10018784 - DNA, 22 bp, Homo sapiens
gccagcctgtgcttggccaggc

SEQ ID NO: 10018785 - DNA, 22 bp, Homo sapiens
gccagccccttagggctctccc

SEQ ID NO: 10018786 - DNA, 20 bp, Homo sapiens
gcagctgtgcattcttagga

SEQ ID NO: 10018787 - DNA, 22 bp, Homo sapiens
gcagctgtcggaaagctaagtg

SEQ ID NO: 10018788 - DNA, 22 bp, Homo sapiens
gcagctgtcgctaggagctgtg

SEQ ID NO: 10018789 - DNA, 22 bp, Homo sapiens
gcagctgtcatttacaacaggg

SEQ ID NO: 10018790 - DNA, 22 bp, Homo sapiens
gcagcctccgcactgcgagtcc

SEQ ID NO: 10018791 - DNA, 22 bp, Homo sapiens
gcagcctccgcactgcgagtcc

SEQ ID NO: 10018792 - DNA, 22 bp, Homo sapiens
gcagcctctgatgatggccgta

SEQ ID NO: 10018793 - DNA, 22 bp, Homo sapiens
gcagcctcagggcactcagatg

SEQ ID NO: 10018794 - DNA, 22 bp, Homo sapiens
gcagcctcagggcactcagatg

SEQ ID NO: 10018795 - DNA, 22 bp, Homo sapiens
gcagcctccgcactgcgagtcc

SEQ ID NO: 10018796 - DNA, 20 bp, Homo sapiens
gcagcctcaacaggcacagc

SEQ ID NO: 10018797 - DNA, 22 bp, Homo sapiens
gcagcctcaaactccccagctc

SEQ ID NO: 10018798 - DNA, 22 bp, Homo sapiens
gcagcctcaaactccccagctc

SEQ ID NO: 10018799 - DNA, 22 bp, Homo sapiens
gcagccctgcaggcagctccag

SEQ ID NO: 10018800 - DNA, 22 bp, Homo sapiens
gcaggaagatgagctcaggtaa

SEQ ID NO: 10018801 - DNA, 22 bp, Homo sapiens
gcaggaagaggctcgaagcccc

SEQ ID NO: 10018802 - DNA, 22 bp, Homo sapiens
gcaggaagaggctcgaagcccc

SEQ ID NO: 10018803 - DNA, 22 bp, Homo sapiens
gcaggaagaggctcgaagcccc

SEQ ID NO: 10018804 - DNA, 21 bp, Homo sapiens
gcaggaacaggtcatgatctg

SEQ ID NO: 10018805 - DNA, 22 bp, Homo sapiens
gcaggaagggaaaggttgactc

SEQ ID NO: 10018806 - DNA, 22 bp, Homo sapiens
gcaggaagggaaaggttgactc

SEQ ID NO: 10018807 - DNA, 23 bp, Homo sapiens
gcaggacaacagagtgggaaggc

SEQ ID NO: 10018808 - DNA, 22 bp, Homo sapiens
gcaggaagccttaccaagccca

SEQ ID NO: 10018809 - DNA, 22 bp, Homo sapiens
gcaggaagcatagaagaatgcc

SEQ ID NO: 10018810 - DNA, 22 bp, Homo sapiens
gcaggaagccttaccaagccca

SEQ ID NO: 10018811 - DNA, 22 bp, Homo sapiens
gcaggaagatgagctcaggtaa

SEQ ID NO: 10018812 - DNA, 22 bp, Homo sapiens
gcaggaagcatagaagaatgcc

SEQ ID NO: 10018813 - DNA, 22 bp, Homo sapiens
gcaggaagcatagaagaatgcc

SEQ ID NO: 10018814 - DNA, 22 bp, Homo sapiens
gcagatggcagcccaggctggg

SEQ ID NO: 10018815 - DNA, 23 bp, Homo sapiens
gcagatggccccagagtgctgcc

SEQ ID NO: 10018816 - DNA, 22 bp, Homo sapiens
gcagatggcagcccaggctggg

SEQ ID NO: 10018817 - DNA, 22 bp, Homo sapiens
gcagatggtggggcaggaaaat

SEQ ID NO: 10018818 - DNA, 22 bp, Homo sapiens
gcagatggtgccatgtcttgtg

SEQ ID NO: 10018819 - DNA, 21 bp, Homo sapiens
gcagatgggagtcatcaggct

SEQ ID NO: 10018820 - DNA, 22 bp, Homo sapiens
gcagatggctcagacactgggg

SEQ ID NO: 10018821 - DNA, 22 bp, Homo sapiens
gcagccctaacctgtcatagtg

SEQ ID NO: 10018822 - DNA, 22 bp, Homo sapiens
gcagccctccctgggtgtgtct

SEQ ID NO: 10018823 - DNA, 22 bp, Homo sapiens
gcagccctccctgggtgtgtct

SEQ ID NO: 10018824 - DNA, 22 bp, Homo sapiens
gcagccctagcgacaaattgat

SEQ ID NO: 10018825 - DNA, 22 bp, Homo sapiens
gcagccctcgctagctctcccc

SEQ ID NO: 10018826 - DNA, 22 bp, Homo sapiens
gcagggctctgctgtagtccta

SEQ ID NO: 10018827 - DNA, 22 bp, Homo sapiens
gcagggctctgctgtagtccta

SEQ ID NO: 10018828 - DNA, 22 bp, Homo sapiens
gcagggaccaaaagaggcagta

SEQ ID NO: 10018829 - DNA, 22 bp, Homo sapiens
gcagggacacctttgtgaagct

SEQ ID NO: 10018830 - DNA, 18 bp, Homo sapiens
gcagggacacagggtcac

SEQ ID NO: 10018831 - DNA, 22 bp, Homo sapiens
gcagggctgggtgggagacaga

SEQ ID NO: 10018832 - DNA, 22 bp, Homo sapiens
gcagggctgggtcctgtctcat

SEQ ID NO: 10018833 - DNA, 22 bp, Homo sapiens
gcaggggagtccactctatgca

SEQ ID NO: 10018834 - DNA, 22 bp, Homo sapiens
gcagggctgttcaggagggtgg

SEQ ID NO: 10018835 - DNA, 22 bp, Homo sapiens
gcagggctgttcaggagggtgg

SEQ ID NO: 10018836 - DNA, 22 bp, Homo sapiens
gcagggctgttcaggagggtgg

SEQ ID NO: 10018837 - DNA, 22 bp, Homo sapiens
gcagggctgtggacactttggt

SEQ ID NO: 10018838 - DNA, 19 bp, Homo sapiens
gcaggcagtggcattcgga

SEQ ID NO: 10018839 - DNA, 22 bp, Homo sapiens
gcaggcagttatttagtagaat

SEQ ID NO: 10018840 - DNA, 22 bp, Homo sapiens
gcaggcagtcatctttcatatt

SEQ ID NO: 10018841 - DNA, 19 bp, Homo sapiens
gcaggcagtggcattcgga

SEQ ID NO: 10018842 - DNA, 22 bp, Homo sapiens
gcaggcagtcatctttcatatt

SEQ ID NO: 10018843 - DNA, 22 bp, Homo sapiens
gcaggcagttatttagtagaat

SEQ ID NO: 10018844 - DNA, 22 bp, Homo sapiens
gcaggcagttatttagtagaat

SEQ ID NO: 10018845 - DNA, 22 bp, Homo sapiens
gcaggcagttatttagtagaat

SEQ ID NO: 10018846 - DNA, 22 bp, Homo sapiens
gcagggaaggggcatgctggag

SEQ ID NO: 10018847 - DNA, 22 bp, Homo sapiens
gcagggaagacccggagcagcg

SEQ ID NO: 10018848 - DNA, 22 bp, Homo sapiens
gcagggaagacccggagcagcg

SEQ ID NO: 10018849 - DNA, 22 bp, Homo sapiens
gcagggaagggaaacagagacc

SEQ ID NO: 10018850 - DNA, 22 bp, Homo sapiens
gcagggaagatcttggagctgc

SEQ ID NO: 10018851 - DNA, 22 bp, Homo sapiens
gcagggaagatcttggagctgc

SEQ ID NO: 10018852 - DNA, 22 bp, Homo sapiens
gcaggcaggtggcatcttgtga

SEQ ID NO: 10018853 - DNA, 22 bp, Homo sapiens
gcaggcaggtggcatcttgtga

SEQ ID NO: 10018854 - DNA, 22 bp, Homo sapiens
gcaggcagccacgattcccttg

SEQ ID NO: 10018855 - DNA, 19 bp, Homo sapiens
gcaggcagctggggtatcc

SEQ ID NO: 10018856 - DNA, 22 bp, Homo sapiens
gcaggcagatcacctgtcagga

SEQ ID NO: 10018857 - DNA, 22 bp, Homo sapiens
gcaggcagatcacctgtcagga

SEQ ID NO: 10018858 - DNA, 22 bp, Homo sapiens
gcaggcagatcacctgtcagga

SEQ ID NO: 10018859 - DNA, 16 bp, Homo sapiens
gcaggcagatcacatg

SEQ ID NO: 10018860 - DNA, 22 bp, Homo sapiens
gcaggcagagtcaatttgatcc

SEQ ID NO: 10018861 - DNA, 22 bp, Homo sapiens
gcaggcagaggtggaggagaca

SEQ ID NO: 10018862 - DNA, 22 bp, Homo sapiens
gcaggacacagatgcaaggcca

SEQ ID NO: 10018863 - DNA, 22 bp, Homo sapiens
gcaggacacagatgcaaggcca

SEQ ID NO: 10018864 - DNA, 22 bp, Homo sapiens
gcaggcagaggtggaggagaca

SEQ ID NO: 10018865 - DNA, 22 bp, Homo sapiens
gcaggcagaggtggaggagaca

SEQ ID NO: 10018866 - DNA, 22 bp, Homo sapiens
gcacagttaaagggtcatgtga

SEQ ID NO: 10018867 - DNA, 22 bp, Homo sapiens
gcacagttgatttatgctggtg

SEQ ID NO: 10018868 - DNA, 21 bp, Homo sapiens
gcacagtgccaggcacacagt

SEQ ID NO: 10018869 - DNA, 21 bp, Homo sapiens
gcacagtgccaggcacacagt

SEQ ID NO: 10018870 - DNA, 22 bp, Homo sapiens
gcacatgaggctgtctttgtct

SEQ ID NO: 10018871 - DNA, 22 bp, Homo sapiens
gcacataactgaccacatctaa

SEQ ID NO: 10018872 - DNA, 19 bp, Homo sapiens
gcagacaggtccagagagg

SEQ ID NO: 10018873 - DNA, 21 bp, Homo sapiens
gcagactgccctgctgtcccc

SEQ ID NO: 10018874 - DNA, 22 bp, Homo sapiens
gcagacctgaccttgggcagca

SEQ ID NO: 10018875 - DNA, 22 bp, Homo sapiens
gcagactgtacctggaagaggg

SEQ ID NO: 10018876 - DNA, 22 bp, Homo sapiens
gcagactgtatcaatgtcagta

SEQ ID NO: 10018877 - DNA, 22 bp, Homo sapiens
gcagactggtcttcagccttgg

SEQ ID NO: 10018878 - DNA, 21 bp, Homo sapiens
gcagactgccctgctgtcccc

SEQ ID NO: 10018879 - DNA, 22 bp, Homo sapiens
gcagagcaccaaagtgaaagat

SEQ ID NO: 10018880 - DNA, 22 bp, Homo sapiens
gcagagcaccaaagtgaaagat

SEQ ID NO: 10018881 - DNA, 22 bp, Homo sapiens
gcagagcaccctgcagtggtat

SEQ ID NO: 10018882 - DNA, 22 bp, Homo sapiens
gcagaggtctcttcaaaataat

SEQ ID NO: 10018883 - DNA, 22 bp, Homo sapiens
gcagaggtctagcaccaagaat

SEQ ID NO: 10018884 - DNA, 19 bp, Homo sapiens
gcagagtggggtggagggt

SEQ ID NO: 10018885 - DNA, 22 bp, Homo sapiens
gcagaggtgagaagggcctccc

SEQ ID NO: 10018886 - DNA, 22 bp, Homo sapiens
gcagaggtgaccagcagcaggg

SEQ ID NO: 10018887 - DNA, 22 bp, Homo sapiens
gcagaggtgaccagcagcaggg

SEQ ID NO: 10018888 - DNA, 22 bp, Homo sapiens
gcagatggaaagtgcttgaggg

SEQ ID NO: 10018889 - DNA, 22 bp, Homo sapiens
gcagatggactgtatgacctga

SEQ ID NO: 10018890 - DNA, 20 bp, Homo sapiens
gcagagtgtgagagggtgaa

SEQ ID NO: 10018891 - DNA, 22 bp, Homo sapiens
gcagaggtcctagccaggagtc

SEQ ID NO: 10018892 - DNA, 22 bp, Homo sapiens
gcagaggtcaaatacctcattt

SEQ ID NO: 10018893 - DNA, 22 bp, Homo sapiens
gcagagggtcctgtgccagcag

SEQ ID NO: 10018894 - DNA, 22 bp, Homo sapiens
gcagagggtcctgtgccagcag

SEQ ID NO: 10018895 - DNA, 22 bp, Homo sapiens
gcagaggggaagctgaggaatt

SEQ ID NO: 10018896 - DNA, 22 bp, Homo sapiens
gcagagggggtacttcggccct

SEQ ID NO: 10018897 - DNA, 22 bp, Homo sapiens
gcagaggcatttctgacgctgc

SEQ ID NO: 10018898 - DNA, 22 bp, Homo sapiens
gcagaggccaggccaccagcaa

SEQ ID NO: 10018899 - DNA, 22 bp, Homo sapiens
gcagaggccaggccaccagcaa

SEQ ID NO: 10018900 - DNA, 22 bp, Homo sapiens
gcagaggaggacccaggaatta

SEQ ID NO: 10018901 - DNA, 22 bp, Homo sapiens
gcagaggagtgattatgccgtg

SEQ ID NO: 10018902 - DNA, 22 bp, Homo sapiens
gcagagcagtactctcttgact

SEQ ID NO: 10018903 - DNA, 22 bp, Homo sapiens
gcagagcagaggtgcaggttgg

SEQ ID NO: 10018904 - DNA, 22 bp, Homo sapiens
gcagagcaggaaggaagtcagg

SEQ ID NO: 10018905 - DNA, 22 bp, Homo sapiens
gcagagcaggaaggaagtcagg

SEQ ID NO: 10018906 - DNA, 22 bp, Homo sapiens
gcagagcagcaaatggaaagga

SEQ ID NO: 10018907 - DNA, 21 bp, Homo sapiens
gcagaggcacggcaccaaggg

SEQ ID NO: 10018908 - DNA, 22 bp, Homo sapiens
gcagaggatagcatatgaacct

SEQ ID NO: 10018909 - DNA, 22 bp, Homo sapiens
gcagaggcacagccccagatga

SEQ ID NO: 10018910 - DNA, 22 bp, Homo sapiens
gcagaggatcaggctctggaaa

SEQ ID NO: 10018911 - DNA, 22 bp, Homo sapiens
gcacacagtagggattcaatga

SEQ ID NO: 10018912 - DNA, 22 bp, Homo sapiens
gcacacagaatcagtgggcata

SEQ ID NO: 10018913 - DNA, 22 bp, Homo sapiens
gcaaatattcaagacttttcca

SEQ ID NO: 10018914 - DNA, 22 bp, Homo sapiens
gcaaatattcaagacttttcca

SEQ ID NO: 10018915 - DNA, 22 bp, Homo sapiens
gcacacactgttttcctcacat

SEQ ID NO: 10018916 - DNA, 22 bp, Homo sapiens
gcaaatatttctaattcctgaa

SEQ ID NO: 10018917 - DNA, 20 bp, Homo sapiens
gcacacatagaaatgcatat

SEQ ID NO: 10018918 - DNA, 22 bp, Homo sapiens
gcacacatatatatgagcatgt

SEQ ID NO: 10018919 - DNA, 22 bp, Homo sapiens
gcacacatatatatgagcatgt

SEQ ID NO: 10018920 - DNA, 19 bp, Homo sapiens
gcacacatacaccctttgg

SEQ ID NO: 10018921 - DNA, 22 bp, Homo sapiens
gcacacagtatatgctcattaa

SEQ ID NO: 10018922 - DNA, 22 bp, Homo sapiens
gcacacagtatatgctcattaa

SEQ ID NO: 10018923 - DNA, 22 bp, Homo sapiens
gcacacatgcatgtgtgcatcc

SEQ ID NO: 10018924 - DNA, 22 bp, Homo sapiens
gcacacatcttgtaatcctgag

SEQ ID NO: 10018925 - DNA, 22 bp, Homo sapiens
gcacacatgcatgcacaggagt

SEQ ID NO: 10018926 - DNA, 22 bp, Homo sapiens
gcacacattcggattcttaacc

SEQ ID NO: 10018927 - DNA, 22 bp, Homo sapiens
gcacacattcggattcttaacc

SEQ ID NO: 10018928 - DNA, 22 bp, Homo sapiens
gcacacatgtgagtgtcctttc

SEQ ID NO: 10018929 - DNA, 22 bp, Homo sapiens
gcacacatgcgtgtatatgggt

SEQ ID NO: 10018930 - DNA, 22 bp, Homo sapiens
gcacacatgcgtgtatatgggt

SEQ ID NO: 10018931 - DNA, 22 bp, Homo sapiens
gcacagtgataggcagttgtgc

SEQ ID NO: 10018932 - DNA, 22 bp, Homo sapiens
gcacagtacctgtcacagaggc

SEQ ID NO: 10018933 - DNA, 22 bp, Homo sapiens
gcacaggttgcaaaagttcaca

SEQ ID NO: 10018934 - DNA, 22 bp, Homo sapiens
gcacaggctccggaggagagct

SEQ ID NO: 10018935 - DNA, 22 bp, Homo sapiens
gcacaggctccggaggagagct

SEQ ID NO: 10018936 - DNA, 22 bp, Homo sapiens
gcacaggccatgggaggacagc

SEQ ID NO: 10018937 - DNA, 22 bp, Homo sapiens
gcacaggccatgggaggacagc

SEQ ID NO: 10018938 - DNA, 22 bp, Homo sapiens
gcacaggccatgggaggacagc

SEQ ID NO: 10018939 - DNA, 22 bp, Homo sapiens
gcacagaacactggtgagtccc

SEQ ID NO: 10018940 - DNA, 22 bp, Homo sapiens
gcacagaaatgtctacacatgt

SEQ ID NO: 10018941 - DNA, 22 bp, Homo sapiens
gcacagaaatgtctacacatgt

SEQ ID NO: 10018942 - DNA, 22 bp, Homo sapiens
gcacagaacagagaaatagcca

SEQ ID NO: 10018943 - DNA, 19 bp, Homo sapiens
gcacaccctgcaccaccat

SEQ ID NO: 10018944 - DNA, 22 bp, Homo sapiens
gcacacggcagcctcctcctga

SEQ ID NO: 10018945 - DNA, 22 bp, Homo sapiens
gcacacattctagccttttgtg

SEQ ID NO: 10018946 - DNA, 22 bp, Homo sapiens
gcacactcctggatcctagaga

SEQ ID NO: 10018947 - DNA, 22 bp, Homo sapiens
gaggccaggacatgaaagctga

SEQ ID NO: 10018948 - DNA, 22 bp, Homo sapiens
gaggccagtgaaatgttataaa

SEQ ID NO: 10018949 - DNA, 22 bp, Homo sapiens
gaggccaggaggatctctctaa

SEQ ID NO: 10018950 - DNA, 22 bp, Homo sapiens
gaggccagtgtgctgtgttttc

SEQ ID NO: 10018951 - DNA, 20 bp, Homo sapiens
gaggcccagagaggtgaagc

SEQ ID NO: 10018952 - DNA, 22 bp, Homo sapiens
gaggcccagagaggttgcatga

SEQ ID NO: 10018953 - DNA, 22 bp, Homo sapiens
gaggcccagagaggttgcatga

SEQ ID NO: 10018954 - DNA, 22 bp, Homo sapiens
gcaaagaaatgtcagtgagagg

SEQ ID NO: 10018955 - DNA, 22 bp, Homo sapiens
gcaaagaaatgtcagtgagagg

SEQ ID NO: 10018956 - DNA, 22 bp, Homo sapiens
gcaaagacggactcaggagtgc

SEQ ID NO: 10018957 - DNA, 22 bp, Homo sapiens
gcaaagatattagaatagagta

SEQ ID NO: 10018958 - DNA, 22 bp, Homo sapiens
gcaaagaaagttttaatgaggt

SEQ ID NO: 10018959 - DNA, 22 bp, Homo sapiens
gcaaagaaagccaaggtctaac

SEQ ID NO: 10018960 - DNA, 22 bp, Homo sapiens
gcaaagaaagccaaggtctaac

SEQ ID NO: 10018961 - DNA, 22 bp, Homo sapiens
gcaaactgttggagtagagtct

SEQ ID NO: 10018962 - DNA, 22 bp, Homo sapiens
gcaaactgttggagtagagtct

SEQ ID NO: 10018963 - DNA, 22 bp, Homo sapiens
gaggcccagcagcgcaggtctt

SEQ ID NO: 10018964 - DNA, 22 bp, Homo sapiens
gcaaactggtagctcgcctgcc

SEQ ID NO: 10018965 - DNA, 17 bp, Homo sapiens
gcaaaggtgaggagaga

SEQ ID NO: 10018966 - DNA, 22 bp, Homo sapiens
gcaaagctgggtgtgaatgcac

SEQ ID NO: 10018967 - DNA, 22 bp, Homo sapiens
gcaaatacatgttgagcaccta

SEQ ID NO: 10018968 - DNA, 21 bp, Homo sapiens
gcaaagtgtgggcataaacag

SEQ ID NO: 10018969 - DNA, 22 bp, Homo sapiens
gcaaagtgaaatggggcagaga

SEQ ID NO: 10018970 - DNA, 22 bp, Homo sapiens
gcaaagtgcttcagtgggagct

SEQ ID NO: 10018971 - DNA, 22 bp, Homo sapiens
gcaaagcaatcaggagtagcat

SEQ ID NO: 10018972 - DNA, 22 bp, Homo sapiens
gcaaagctgggtgtgaatgcac

SEQ ID NO: 10018973 - DNA, 22 bp, Homo sapiens
gcaaagcatcagtagaaatgtt

SEQ ID NO: 10018974 - DNA, 22 bp, Homo sapiens
gcaaagcacactggagatgtcg

SEQ ID NO: 10018975 - DNA, 22 bp, Homo sapiens
gctgcttctctgatggagtcca

SEQ ID NO: 10018976 - DNA, 22 bp, Homo sapiens
gctgctgtgttggagagggact

SEQ ID NO: 10018977 - DNA, 22 bp, Homo sapiens
gctgctgttccggctacagccc

SEQ ID NO: 10018978 - DNA, 21 bp, Homo sapiens
gctgctgtgggccagggaggc

SEQ ID NO: 10018979 - DNA, 22 bp, Homo sapiens
gctgctgtgtgggagacaggcg

SEQ ID NO: 10018980 - DNA, 22 bp, Homo sapiens
gctgctgtgttctcttgaccca

SEQ ID NO: 10018981 - DNA, 22 bp, Homo sapiens
gctgctccgtctgagctctggt

SEQ ID NO: 10018982 - DNA, 22 bp, Homo sapiens
gctgctccagctgtgctgcaga

SEQ ID NO: 10018983 - DNA, 22 bp, Homo sapiens
gctgctccagctgtgctgcaga

SEQ ID NO: 10018984 - DNA, 22 bp, Homo sapiens
gctgctgtctcatgcgatgcgg

SEQ ID NO: 10018985 - DNA, 21 bp, Homo sapiens
gctgctcgagatccagtgctt

SEQ ID NO: 10018986 - DNA, 22 bp, Homo sapiens
gctgctgtctggtctgagggct

SEQ ID NO: 10018987 - DNA, 22 bp, Homo sapiens
gctgctgtggcagattggattc

SEQ ID NO: 10018988 - DNA, 22 bp, Homo sapiens
gctgcctgtggcccttctgggt

SEQ ID NO: 10018989 - DNA, 22 bp, Homo sapiens
gctgcctgtggcccttctgggt

SEQ ID NO: 10018990 - DNA, 22 bp, Homo sapiens
gctgcctgtgtggccactcact

SEQ ID NO: 10018991 - DNA, 19 bp, Homo sapiens
gctgcctgtcttagccagt

SEQ ID NO: 10018992 - DNA, 22 bp, Homo sapiens
gctgcctgtcctgaggagtccg

SEQ ID NO: 10018993 - DNA, 22 bp, Homo sapiens
gctgcctgtctgctgacccagg

SEQ ID NO: 10018994 - DNA, 22 bp, Homo sapiens
gctgctcagtgggcctgagcct

SEQ ID NO: 10018995 - DNA, 22 bp, Homo sapiens
gctgctagggcattatgataaa

SEQ ID NO: 10018996 - DNA, 22 bp, Homo sapiens
gctgctaagcgtttctgttcca

SEQ ID NO: 10018997 - DNA, 18 bp, Homo sapiens
gctgcgtgggatgtgacc

SEQ ID NO: 10018998 - DNA, 20 bp, Homo sapiens
gctgcctgtttctgtaagta

SEQ ID NO: 10018999 - DNA, 20 bp, Homo sapiens
gctgcctgtttctgtaagta

SEQ ID NO: 10019000 - DNA, 20 bp, Homo sapiens
gctgcctgtttctgtaagta

SEQ ID NO: 10019001 - DNA, 22 bp, Homo sapiens
gctgccttagagggagtggttc

SEQ ID NO: 10019002 - DNA, 22 bp, Homo sapiens
gctgccccccggactcggcggg

SEQ ID NO: 10019003 - DNA, 22 bp, Homo sapiens
gctgccccgagccatccttcag

SEQ ID NO: 10019004 - DNA, 22 bp, Homo sapiens
gctgccctaatatcacatgtta

SEQ ID NO: 10019005 - DNA, 22 bp, Homo sapiens
gctgccccagctgggggctgga

SEQ ID NO: 10019006 - DNA, 22 bp, Homo sapiens
gctgcccattccactggatggt

SEQ ID NO: 10019007 - DNA, 22 bp, Homo sapiens
gctgccctagaagtacagagag

SEQ ID NO: 10019008 - DNA, 22 bp, Homo sapiens
gctgccctacccgaggcactct

SEQ ID NO: 10019009 - DNA, 22 bp, Homo sapiens
gctgccctacccgaggcactct

SEQ ID NO: 10019010 - DNA, 22 bp, Homo sapiens
gctgccctgtctgcagcaggac

SEQ ID NO: 10019011 - DNA, 22 bp, Homo sapiens
gctgccctgtggtagagggtgg

SEQ ID NO: 10019012 - DNA, 22 bp, Homo sapiens
gctgccgttggctcttcaggcc

SEQ ID NO: 10019013 - DNA, 22 bp, Homo sapiens
gctgcctcactccagcccaata

SEQ ID NO: 10019014 - DNA, 22 bp, Homo sapiens
gctgcctcactccagcccaata

SEQ ID NO: 10019015 - DNA, 22 bp, Homo sapiens
gctgccctgtttagccagggtt

SEQ ID NO: 10019016 - DNA, 22 bp, Homo sapiens
gctgccctgtttagccagggtt

SEQ ID NO: 10019017 - DNA, 22 bp, Homo sapiens
gctgccctgtttagccagggtt

SEQ ID NO: 10019018 - DNA, 22 bp, Homo sapiens
gctgccctgtggtccagcaggt

SEQ ID NO: 10019019 - DNA, 22 bp, Homo sapiens
gctgcctgtcccaggatgagga

SEQ ID NO: 10019020 - DNA, 22 bp, Homo sapiens
gctgcctccaatctgtgccccg

SEQ ID NO: 10019021 - DNA, 22 bp, Homo sapiens
gctgcctgtcctgaggagtccg

SEQ ID NO: 10019022 - DNA, 22 bp, Homo sapiens
gctgcctcaggcacctcctggc

SEQ ID NO: 10019023 - DNA, 22 bp, Homo sapiens
gctgagggcatgtgtggcgact

SEQ ID NO: 10019024 - DNA, 22 bp, Homo sapiens
gctgagggcatgtgtggcgact

SEQ ID NO: 10019025 - DNA, 22 bp, Homo sapiens
gctgagggcatgtgtggcgact

SEQ ID NO: 10019026 - DNA, 22 bp, Homo sapiens
gctgagggcatgtgtggcgact

SEQ ID NO: 10019027 - DNA, 19 bp, Homo sapiens
gctgagggccacccagccc

SEQ ID NO: 10019028 - DNA, 22 bp, Homo sapiens
gctgagggatagctgctcactg

SEQ ID NO: 10019029 - DNA, 22 bp, Homo sapiens
gctgagggcagcctcctaggtc

SEQ ID NO: 10019030 - DNA, 22 bp, Homo sapiens
gctgagggctgtaacagcagag

SEQ ID NO: 10019031 - DNA, 22 bp, Homo sapiens
gctgagggccgcatagggtcat

SEQ ID NO: 10019032 - DNA, 22 bp, Homo sapiens
gctgagggccgcatagggtcat

SEQ ID NO: 10019033 - DNA, 22 bp, Homo sapiens
gctgcccagcaggccccagggg

SEQ ID NO: 10019034 - DNA, 22 bp, Homo sapiens
gctgcccagttctgctgctgcc

SEQ ID NO: 10019035 - DNA, 22 bp, Homo sapiens
gctgcccagttctgctgctgcc

SEQ ID NO: 10019036 - DNA, 22 bp, Homo sapiens
gctgcccagggctgagtgtcct

SEQ ID NO: 10019037 - DNA, 22 bp, Homo sapiens
gctctggggatgcttctgccgt

SEQ ID NO: 10019038 - DNA, 22 bp, Homo sapiens
gctctgggctgccctctggaca

SEQ ID NO: 10019039 - DNA, 22 bp, Homo sapiens
gctctggggatgcttctgccgt

SEQ ID NO: 10019040 - DNA, 22 bp, Homo sapiens
gctctgggctgccctctggaca

SEQ ID NO: 10019041 - DNA, 22 bp, Homo sapiens
gctctgggattaccagccttag

SEQ ID NO: 10019042 - DNA, 20 bp, Homo sapiens
gctctgggagggatgtgatg

SEQ ID NO: 10019043 - DNA, 22 bp, Homo sapiens
gctctgggattaccagccttag

SEQ ID NO: 10019044 - DNA, 22 bp, Homo sapiens
gctctgggattaccagccttag

SEQ ID NO: 10019045 - DNA, 22 bp, Homo sapiens
gctctgggccatcctggccggg

SEQ ID NO: 10019046 - DNA, 22 bp, Homo sapiens
gctctgggccatcctggccggg

SEQ ID NO: 10019047 - DNA, 22 bp, Homo sapiens
gctctgggccgggcaccagcct

SEQ ID NO: 10019048 - DNA, 22 bp, Homo sapiens
gctcctccctgtgcagacccag

SEQ ID NO: 10019049 - DNA, 22 bp, Homo sapiens
gctcctccaatatggactcctc

SEQ ID NO: 10019050 - DNA, 22 bp, Homo sapiens
gctctggctactgtggctaccg

SEQ ID NO: 10019051 - DNA, 22 bp, Homo sapiens
gctccctgttctcagccatgat

SEQ ID NO: 10019052 - DNA, 22 bp, Homo sapiens
gctccctgttctcagccatgat

SEQ ID NO: 10019053 - DNA, 23 bp, Homo sapiens
gctccctgtgctccaggagatgc

SEQ ID NO: 10019054 - DNA, 22 bp, Homo sapiens
gctctgggaactgactgccttc

SEQ ID NO: 10019055 - DNA, 22 bp, Homo sapiens
gctctgggaaggatcgtagtga

SEQ ID NO: 10019056 - DNA, 22 bp, Homo sapiens
gctctgggaattcagaaagcct

SEQ ID NO: 10019057 - DNA, 22 bp, Homo sapiens
gctctgggaagtcctttaccat

SEQ ID NO: 10019058 - DNA, 22 bp, Homo sapiens
gctctggcttggggcactcgtc

SEQ ID NO: 10019059 - DNA, 22 bp, Homo sapiens
gctctgggaactgactgccttc

SEQ ID NO: 10019060 - DNA, 18 bp, Homo sapiens
gctctggctcacctccag

SEQ ID NO: 10019061 - DNA, 22 bp, Homo sapiens
gctgagagtgggtgcagtgctt

SEQ ID NO: 10019062 - DNA, 22 bp, Homo sapiens
gctgagactggcagcaggaagt

SEQ ID NO: 10019063 - DNA, 22 bp, Homo sapiens
gctgagagatcaaggcaggatt

SEQ ID NO: 10019064 - DNA, 22 bp, Homo sapiens
gctgagagatcaaggcaggatt

SEQ ID NO: 10019065 - DNA, 21 bp, Homo sapiens
gctgagacgcaacctcagtga

SEQ ID NO: 10019066 - DNA, 22 bp, Homo sapiens
gctgagaatgttcctactggta

SEQ ID NO: 10019067 - DNA, 22 bp, Homo sapiens
gctgacaatgagaaagagcaaa

SEQ ID NO: 10019068 - DNA, 17 bp, Homo sapiens
gctgagaaggggaagag

SEQ ID NO: 10019069 - DNA, 22 bp, Homo sapiens
gctgagagtccaggaaaacatc

SEQ ID NO: 10019070 - DNA, 22 bp, Homo sapiens
gctgagagtgagcactggatat

SEQ ID NO: 10019071 - DNA, 17 bp, Homo sapiens
gctgagaggcagcacag

SEQ ID NO: 10019072 - DNA, 22 bp, Homo sapiens
gctgagagcggccagctgggaa

SEQ ID NO: 10019073 - DNA, 22 bp, Homo sapiens
gctgagagcacatagaaggggc

SEQ ID NO: 10019074 - DNA, 22 bp, Homo sapiens
gctgagagcaaagcatgtctag

SEQ ID NO: 10019075 - DNA, 22 bp, Homo sapiens
gccttgctaatttctcctcaac

SEQ ID NO: 10019076 - DNA, 22 bp, Homo sapiens
gccttggactaccactcccaca

SEQ ID NO: 10019077 - DNA, 22 bp, Homo sapiens
gcctgagctactagggagtctg

SEQ ID NO: 10019078 - DNA, 20 bp, Homo sapiens
gcctgagctattgccaggat

SEQ ID NO: 10019079 - DNA, 20 bp, Homo sapiens
gcctgagctccgcctcctgt

SEQ ID NO: 10019080 - DNA, 20 bp, Homo sapiens
gcctgagctccgcctcctgt

SEQ ID NO: 10019081 - DNA, 22 bp, Homo sapiens
gccttggctgttggagcttgat

SEQ ID NO: 10019082 - DNA, 22 bp, Homo sapiens
gccttggctgatgtgcgaatga

SEQ ID NO: 10019083 - DNA, 22 bp, Homo sapiens
gccttggctgccaagctgctga

SEQ ID NO: 10019084 - DNA, 23 bp, Homo sapiens
gccttggcgatccgtggggcatc

SEQ ID NO: 10019085 - DNA, 22 bp, Homo sapiens
gccttggctgatgtgcgaatga

SEQ ID NO: 10019086 - DNA, 22 bp, Homo sapiens
gccttggccttcctaggcctga

SEQ ID NO: 10019087 - DNA, 22 bp, Homo sapiens
gcctctgggttggtgacaggct

SEQ ID NO: 10019088 - DNA, 22 bp, Homo sapiens
gcctctggtccctcatgctgtg

SEQ ID NO: 10019089 - DNA, 22 bp, Homo sapiens
gcctctgggggctcagacctgt

SEQ ID NO: 10019090 - DNA, 19 bp, Homo sapiens
gcctgagccagccatgcaa

SEQ ID NO: 10019091 - DNA, 19 bp, Homo sapiens
gcctgagccagccatgcaa

SEQ ID NO: 10019092 - DNA, 22 bp, Homo sapiens
gcctgagcccaggtgtgcagag

SEQ ID NO: 10019093 - DNA, 22 bp, Homo sapiens
gcctgagcaggcgtggaccatg

SEQ ID NO: 10019094 - DNA, 22 bp, Homo sapiens
gcctgagcaggcgtggaccatg

SEQ ID NO: 10019095 - DNA, 22 bp, Homo sapiens
gcctctgtaggagtgagagcat

SEQ ID NO: 10019096 - DNA, 22 bp, Homo sapiens
gcctctggtccctcatgctgtg

SEQ ID NO: 10019097 - DNA, 22 bp, Homo sapiens
gcctctggtccctcatgctgtg

SEQ ID NO: 10019098 - DNA, 22 bp, Homo sapiens
gcctgagcagctatacacacag

SEQ ID NO: 10019099 - DNA, 22 bp, Homo sapiens
gcgggtggatcatgaggtcagg

SEQ ID NO: 10019100 - DNA, 22 bp, Homo sapiens
gcctttgtaactcttttattgt

SEQ ID NO: 10019101 - DNA, 19 bp, Homo sapiens
gcctttgttccttttgtct

SEQ ID NO: 10019102 - DNA, 22 bp, Homo sapiens
gcctttattttcaacggagtgt

SEQ ID NO: 10019103 - DNA, 22 bp, Homo sapiens
gcctttatcttgggccaagttt

SEQ ID NO: 10019104 - DNA, 22 bp, Homo sapiens
gcggtggggaaaggaggtgctg

SEQ ID NO: 10019105 - DNA, 22 bp, Homo sapiens
gcggtgggggaaaggagcggtt

SEQ ID NO: 10019106 - DNA, 22 bp, Homo sapiens
gcggtcggcagaggggctctgc

SEQ ID NO: 10019107 - DNA, 22 bp, Homo sapiens
gcggtcggcagaggggctctgc

SEQ ID NO: 10019108 - DNA, 22 bp, Homo sapiens
gcgtgcatggccgtgtgtatgc

SEQ ID NO: 10019109 - DNA, 22 bp, Homo sapiens
gctacaggtatatagatgaaac

SEQ ID NO: 10019110 - DNA, 22 bp, Homo sapiens
gctacaggtgacagcctctgca

SEQ ID NO: 10019111 - DNA, 22 bp, Homo sapiens
gctacaggagctgtcacatgct

SEQ ID NO: 10019112 - DNA, 22 bp, Homo sapiens
gctacaggggtcagtcctttgc

SEQ ID NO: 10019113 - DNA, 22 bp, Homo sapiens
gctacaggtatatagatgaaac

SEQ ID NO: 10019114 - DNA, 22 bp, Homo sapiens
gctacagagctctgtgaagaga

SEQ ID NO: 10019115 - DNA, 22 bp, Homo sapiens
gctacaggagataaaggcctct

SEQ ID NO: 10019116 - DNA, 22 bp, Homo sapiens
gctacaggagctgtcacatgct

SEQ ID NO: 10019117 - DNA, 22 bp, Homo sapiens
gcgtggcttagagtggggtacc

SEQ ID NO: 10019118 - DNA, 22 bp, Homo sapiens
gcgtggcttagagtggggtacc

SEQ ID NO: 10019119 - DNA, 22 bp, Homo sapiens
gctacagactgagcatggctct

SEQ ID NO: 10019120 - DNA, 22 bp, Homo sapiens
gctccaggaggctcccgcgtct

SEQ ID NO: 10019121 - DNA, 22 bp, Homo sapiens
gctcagctgagcgaaggacatg

SEQ ID NO: 10019122 - DNA, 22 bp, Homo sapiens
gctccaggaggatgaccttcct

SEQ ID NO: 10019123 - DNA, 22 bp, Homo sapiens
gctccaggcagagcctctttcg

SEQ ID NO: 10019124 - DNA, 22 bp, Homo sapiens
gctccaggataataaagttgtt

SEQ ID NO: 10019125 - DNA, 22 bp, Homo sapiens
gctccagggtggatgacaattc

SEQ ID NO: 10019126 - DNA, 22 bp, Homo sapiens
gctccagggtcagctcagaact

SEQ ID NO: 10019127 - DNA, 22 bp, Homo sapiens
gctccagggacccaagagaaaa

SEQ ID NO: 10019128 - DNA, 22 bp, Homo sapiens
gctccagggagtacatttatca

SEQ ID NO: 10019129 - DNA, 22 bp, Homo sapiens
gctcagccgaacttcagagcag

SEQ ID NO: 10019130 - DNA, 22 bp, Homo sapiens
gctcagctacttacaggtggct

SEQ ID NO: 10019131 - DNA, 22 bp, Homo sapiens
gctcagctacttacaggtggct

SEQ ID NO: 10019132 - DNA, 22 bp, Homo sapiens
gctcagctctatggacacaaag

SEQ ID NO: 10019133 - DNA, 22 bp, Homo sapiens
gctcagctgagcgaaggacatg

SEQ ID NO: 10019134 - DNA, 22 bp, Homo sapiens
gctcagagttaattggatgggt

SEQ ID NO: 10019135 - DNA, 22 bp, Homo sapiens
gctcagagttaaatatagtgct

SEQ ID NO: 10019136 - DNA, 17 bp, Homo sapiens
gctcagagtacacgtgt

SEQ ID NO: 10019137 - DNA, 22 bp, Homo sapiens
gctcagagtggcctggctaggg

SEQ ID NO: 10019138 - DNA, 22 bp, Homo sapiens
gctcagagggttttggccaagt

SEQ ID NO: 10019139 - DNA, 23 bp, Homo sapiens
gctcagaggtttttctctggatg

SEQ ID NO: 10019140 - DNA, 22 bp, Homo sapiens
gctactgattgaccttggagag

SEQ ID NO: 10019141 - DNA, 22 bp, Homo sapiens
gctacccagagcctcaccctgt

SEQ ID NO: 10019142 - DNA, 22 bp, Homo sapiens
gctacatagtaacccacaaatc

SEQ ID NO: 10019143 - DNA, 22 bp, Homo sapiens
gctccctgcatttcccaccctt

SEQ ID NO: 10019144 - DNA, 22 bp, Homo sapiens
gctccctgcactctgcagccct

SEQ ID NO: 10019145 - DNA, 22 bp, Homo sapiens
gctccctgcactctgcagccct

SEQ ID NO: 10019146 - DNA, 22 bp, Homo sapiens
gctccctgcctacacggacctt

SEQ ID NO: 10019147 - DNA, 17 bp, Homo sapiens
gctccctgaggacagct

SEQ ID NO: 10019148 - DNA, 17 bp, Homo sapiens
gctccctgaggacagct

SEQ ID NO: 10019149 - DNA, 17 bp, Homo sapiens
gctccctgaggacagct

SEQ ID NO: 10019150 - DNA, 17 bp, Homo sapiens
gctccctgaggacagct

SEQ ID NO: 10019151 - DNA, 22 bp, Homo sapiens
gctccctgactcagttcctgag

SEQ ID NO: 10019152 - DNA, 22 bp, Homo sapiens
gctccctgtctctggggtccat

SEQ ID NO: 10019153 - DNA, 23 bp, Homo sapiens
gctccctgtgctccaggagatgc

SEQ ID NO: 10019154 - DNA, 22 bp, Homo sapiens
gctccctggtagccatgctctc

SEQ ID NO: 10019155 - DNA, 22 bp, Homo sapiens
gctccctggtagccatgctctc

SEQ ID NO: 10019156 - DNA, 22 bp, Homo sapiens
gctccctggtattgctgccact

SEQ ID NO: 10019157 - DNA, 21 bp, Homo sapiens
gctccctggctgtgtgacctg

SEQ ID NO: 10019158 - DNA, 22 bp, Homo sapiens
gctccctggtagccatgctctc

SEQ ID NO: 10019159 - DNA, 20 bp, Homo sapiens
gctccctggtagaaatgttt

SEQ ID NO: 10019160 - DNA, 22 bp, Homo sapiens
gctcccactgcagccctgagcc

SEQ ID NO: 10019161 - DNA, 22 bp, Homo sapiens
gctcccacctttgctatcagta

SEQ ID NO: 10019162 - DNA, 22 bp, Homo sapiens
gctcccacgcaattcttttcag

SEQ ID NO: 10019163 - DNA, 22 bp, Homo sapiens
gctcccacctttgctatcagta

SEQ ID NO: 10019164 - DNA, 22 bp, Homo sapiens
gctcccagaaccaaggctgggg

SEQ ID NO: 10019165 - DNA, 22 bp, Homo sapiens
gctcccagaaccaaggctgggg

SEQ ID NO: 10019166 - DNA, 22 bp, Homo sapiens
gctccctgaaaagaacaaagtc

SEQ ID NO: 10019167 - DNA, 22 bp, Homo sapiens
gctcccaccttaaccttcacat

SEQ ID NO: 10019168 - DNA, 22 bp, Homo sapiens
gctcccacctccagcctgagtt

SEQ ID NO: 10019169 - DNA, 22 bp, Homo sapiens
gctcccacctccagcctgagtt

SEQ ID NO: 10019170 - DNA, 22 bp, Homo sapiens
gctcccaccgccgctatgggta

SEQ ID NO: 10019171 - DNA, 22 bp, Homo sapiens
gctcccaccgccgctatgggta

SEQ ID NO: 10019172 - DNA, 22 bp, Homo sapiens
gctcccacaaccttcttgctcc

SEQ ID NO: 10019173 - DNA, 22 bp, Homo sapiens
gctcccaccaggcagacctacc

SEQ ID NO: 10019174 - DNA, 20 bp, Homo sapiens
gctccaggtcagagaggacg

SEQ ID NO: 10019175 - DNA, 20 bp, Homo sapiens
gctccaggtcagagaggacg

SEQ ID NO: 10019176 - DNA, 22 bp, Homo sapiens
gctccaggtatttgccctttta

SEQ ID NO: 10019177 - DNA, 22 bp, Homo sapiens
gctccaggtggcttatttgtat

SEQ ID NO: 10019178 - DNA, 22 bp, Homo sapiens
gctccaggtgaatcctctcacc

SEQ ID NO: 10019179 - DNA, 22 bp, Homo sapiens
gctccaggtgtcccaggtaaaa

SEQ ID NO: 10019180 - DNA, 22 bp, Homo sapiens
gctccaggtgtcccaggtaaaa

SEQ ID NO: 10019181 - DNA, 22 bp, Homo sapiens
gctcccacaaccttcttgctcc

SEQ ID NO: 10019182 - DNA, 19 bp, Homo sapiens
gctgtgggacagcagggtg

SEQ ID NO: 10019183 - DNA, 19 bp, Homo sapiens
gctgtgggacagcagggtg

SEQ ID NO: 10019184 - DNA, 22 bp, Homo sapiens
gctgtgggccacacggctgagt

SEQ ID NO: 10019185 - DNA, 22 bp, Homo sapiens
gctgtgggtaaacgctgagggt

SEQ ID NO: 10019186 - DNA, 22 bp, Homo sapiens
gctgtgggtaaacgctgagggt

SEQ ID NO: 10019187 - DNA, 22 bp, Homo sapiens
gctgtgggtttccaatcctgga

SEQ ID NO: 10019188 - DNA, 22 bp, Homo sapiens
gctgtgggtttccaatcctgga

SEQ ID NO: 10019189 - DNA, 22 bp, Homo sapiens
gctgtggcggcagcagctggtg

SEQ ID NO: 10019190 - DNA, 22 bp, Homo sapiens
gctgtggctgaagatgcaggga

SEQ ID NO: 10019191 - DNA, 22 bp, Homo sapiens
gctgtggcttgcagctggggct

SEQ ID NO: 10019192 - DNA, 22 bp, Homo sapiens
gctgtggcttgcagctggggct

SEQ ID NO: 10019193 - DNA, 22 bp, Homo sapiens
gctgtggctttctgtttctgtt

SEQ ID NO: 10019194 - DNA, 19 bp, Homo sapiens
gctgtgggacagcagggtg

SEQ ID NO: 10019195 - DNA, 19 bp, Homo sapiens
gctgtgggacagcagggtg

SEQ ID NO: 10019196 - DNA, 22 bp, Homo sapiens
gctggggcctgaacagtcagct

SEQ ID NO: 10019197 - DNA, 22 bp, Homo sapiens
gctggggagggcgtcaaggcca

SEQ ID NO: 10019198 - DNA, 22 bp, Homo sapiens
gctggggcctctgtgaggttaa

SEQ ID NO: 10019199 - DNA, 22 bp, Homo sapiens
gctggggaggcagcagagaaca

SEQ ID NO: 10019200 - DNA, 19 bp, Homo sapiens
gctgtgcctctctcctgct

SEQ ID NO: 10019201 - DNA, 22 bp, Homo sapiens
gctggggctgggctgaggaaga

SEQ ID NO: 10019202 - DNA, 22 bp, Homo sapiens
gctggggcctgaacagtcagct

SEQ ID NO: 10019203 - DNA, 19 bp, Homo sapiens
gctggggcctgaccagaca

SEQ ID NO: 10019204 - DNA, 22 bp, Homo sapiens
gctggggctgggctgaggaaga

SEQ ID NO: 10019205 - DNA, 19 bp, Homo sapiens
gctggggcctgaccagaca

SEQ ID NO: 10019206 - DNA, 19 bp, Homo sapiens
gctggggcctgaccagaca

SEQ ID NO: 10019207 - DNA, 22 bp, Homo sapiens
gctggggctgggctgaggaaga

SEQ ID NO: 10019208 - DNA, 22 bp, Homo sapiens
gctgtgtgaccctagccagtag

SEQ ID NO: 10019209 - DNA, 21 bp, Homo sapiens
gcttctgtatctagcaggaac

SEQ ID NO: 10019210 - DNA, 22 bp, Homo sapiens
gcttctggtgaggcctcaggaa

SEQ ID NO: 10019211 - DNA, 22 bp, Homo sapiens
gctgtgtcctcacacagccttt

SEQ ID NO: 10019212 - DNA, 22 bp, Homo sapiens
gctgtgtgaaaactgggcctgg

SEQ ID NO: 10019213 - DNA, 22 bp, Homo sapiens
gctgtgtatcagatgccacggg

SEQ ID NO: 10019214 - DNA, 22 bp, Homo sapiens
gctgtgtaaacttgtacagtgc

SEQ ID NO: 10019215 - DNA, 22 bp, Homo sapiens
gctgtgtatcagatgccacggg

SEQ ID NO: 10019216 - DNA, 22 bp, Homo sapiens
gctgtgtcagaaactctgggga

SEQ ID NO: 10019217 - DNA, 22 bp, Homo sapiens
gcttctgtggtgcatctttgct

SEQ ID NO: 10019218 - DNA, 22 bp, Homo sapiens
gcttctgtggttgtcacgacta

SEQ ID NO: 10019219 - DNA, 22 bp, Homo sapiens
gcttctgtggtgcatctttgct

SEQ ID NO: 10019220 - DNA, 22 bp, Homo sapiens
gcttctgtggtgcatctttgct

SEQ ID NO: 10019221 - DNA, 22 bp, Homo sapiens
gcttctgtggttgtcacgacta

SEQ ID NO: 10019222 - DNA, 22 bp, Homo sapiens
gcttctgtggttgtcacgacta

SEQ ID NO: 10019223 - DNA, 22 bp, Homo sapiens
gcttctgttaacttatgttccc

SEQ ID NO: 10019224 - DNA, 22 bp, Homo sapiens
gcttctgttaacttatgttccc

SEQ ID NO: 10019225 - DNA, 19 bp, Homo sapiens
gcttctgtttgggcttaga

SEQ ID NO: 10019226 - DNA, 22 bp, Homo sapiens
gcttctgttcaaggatataagg

SEQ ID NO: 10019227 - DNA, 22 bp, Homo sapiens
gcttctgttcaaggatataagg

SEQ ID NO: 10019228 - DNA, 19 bp, Homo sapiens
gcttctgtttgggcttaga

SEQ ID NO: 10019229 - DNA, 22 bp, Homo sapiens
gcttctgtcttagctacctccc

SEQ ID NO: 10019230 - DNA, 22 bp, Homo sapiens
gcttctgtgagtgcagatgctg

SEQ ID NO: 10019231 - DNA, 22 bp, Homo sapiens
gcttctgtggattggctggctt

SEQ ID NO: 10019232 - DNA, 22 bp, Homo sapiens
gcttctgtgagtgcagatgctg

SEQ ID NO: 10019233 - DNA, 22 bp, Homo sapiens
gcttctgtggtgaggtcacctt

SEQ ID NO: 10019234 - DNA, 22 bp, Homo sapiens
gcttctgtggtgaggtcacctt

SEQ ID NO: 10019235 - DNA, 22 bp, Homo sapiens
gcttctgtggattggctggctt

SEQ ID NO: 10019236 - DNA, 22 bp, Homo sapiens
gcttctgtcttagctacctccc

SEQ ID NO: 10019237 - DNA, 22 bp, Homo sapiens
gcttctgtatttattgtccttt

SEQ ID NO: 10019238 - DNA, 22 bp, Homo sapiens
gcttctgtcttagctacctccc

SEQ ID NO: 10019239 - DNA, 22 bp, Homo sapiens
gcttctgtcttagctacctccc

SEQ ID NO: 10019240 - DNA, 22 bp, Homo sapiens
gcttctgtatttattgtccttt

SEQ ID NO: 10019241 - DNA, 22 bp, Homo sapiens
gcttctgtatttattgtccttt

SEQ ID NO: 10019242 - DNA, 21 bp, Homo sapiens
gcttctgtatctagcaggaac

SEQ ID NO: 10019243 - DNA, 21 bp, Homo sapiens
gcttctgtatctagcaggaac

SEQ ID NO: 10019244 - DNA, 22 bp, Homo sapiens
gcttgcagtggttggcatgacc

SEQ ID NO: 10019245 - DNA, 22 bp, Homo sapiens
gcttctgttcaaggatataagg

SEQ ID NO: 10019246 - DNA, 22 bp, Homo sapiens
gcttgcatgatatggcatctgg

SEQ ID NO: 10019247 - DNA, 22 bp, Homo sapiens
gctttatgtgagtagcactgtc

SEQ ID NO: 10019248 - DNA, 22 bp, Homo sapiens
gctttatgtaagtccaaaggca

SEQ ID NO: 10019249 - DNA, 20 bp, Homo sapiens
gcttgctttgtctgatgggc

SEQ ID NO: 10019250 - DNA, 20 bp, Homo sapiens
gcttgctttgtctgatgggc

SEQ ID NO: 10019251 - DNA, 22 bp, Homo sapiens
gcttggaagtaggattgggaga

SEQ ID NO: 10019252 - DNA, 19 bp, Homo sapiens
gcttgctgctaggtaggga

SEQ ID NO: 10019253 - DNA, 22 bp, Homo sapiens
gcttgctgaacaggaacctggc

SEQ ID NO: 10019254 - DNA, 22 bp, Homo sapiens
gctggctgtgttccttctgcca

SEQ ID NO: 10019255 - DNA, 21 bp, Homo sapiens
gctggctggctgaccggcctt

SEQ ID NO: 10019256 - DNA, 23 bp, Homo sapiens
gctgggcttactctttcagtgag

SEQ ID NO: 10019257 - DNA, 23 bp, Homo sapiens
gctgggcttactctttcagtgag

SEQ ID NO: 10019258 - DNA, 22 bp, Homo sapiens
gctgggctgtagtttgctgacc

SEQ ID NO: 10019259 - DNA, 22 bp, Homo sapiens
gctggctttgtcaagggcagca

SEQ ID NO: 10019260 - DNA, 22 bp, Homo sapiens
gctgggaacacagccatgagag

SEQ ID NO: 10019261 - DNA, 22 bp, Homo sapiens
gctggctggaatgggagaagaa

SEQ ID NO: 10019262 - DNA, 22 bp, Homo sapiens
gctggctggaatgggagaagaa

SEQ ID NO: 10019263 - DNA, 22 bp, Homo sapiens
gctggctggaatgggagaagaa

SEQ ID NO: 10019264 - DNA, 22 bp, Homo sapiens
gctggctggaggagggaggttg

SEQ ID NO: 10019265 - DNA, 22 bp, Homo sapiens
gctggctggaggtgaggaagaa

SEQ ID NO: 10019266 - DNA, 22 bp, Homo sapiens
gctggctggaggtgaggaagaa

SEQ ID NO: 10019267 - DNA, 22 bp, Homo sapiens
gctggctggaactagcagttgg

SEQ ID NO: 10019268 - DNA, 22 bp, Homo sapiens
gctggagagataggcatggggt

SEQ ID NO: 10019269 - DNA, 20 bp, Homo sapiens
gctgctttcaaatgacacgt

SEQ ID NO: 10019270 - DNA, 22 bp, Homo sapiens
gctggagaaacaggaggaggaa

SEQ ID NO: 10019271 - DNA, 22 bp, Homo sapiens
gctgctttagaattgaaacaga

SEQ ID NO: 10019272 - DNA, 22 bp, Homo sapiens
gctggagacctcagagaaccca

SEQ ID NO: 10019273 - DNA, 22 bp, Homo sapiens
gctggagaaactgcagctgagg

SEQ ID NO: 10019274 - DNA, 22 bp, Homo sapiens
gctggagaaactgcagctgagg

SEQ ID NO: 10019275 - DNA, 22 bp, Homo sapiens
ggaagcacagcataaagttact

SEQ ID NO: 10019276 - DNA, 22 bp, Homo sapiens
ggaagcactgaggcagagaggg

SEQ ID NO: 10019277 - DNA, 22 bp, Homo sapiens
ggaagcagcctgaagccaaggg

SEQ ID NO: 10019278 - DNA, 22 bp, Homo sapiens
ggaagcagcctgaagccaaggg

SEQ ID NO: 10019279 - DNA, 22 bp, Homo sapiens
ggaagcagcctgaagccaaggg

SEQ ID NO: 10019280 - DNA, 22 bp, Homo sapiens
ggaatcttcagccatgccaaga

SEQ ID NO: 10019281 - DNA, 22 bp, Homo sapiens
ggaatcttaatggcatggagtt

SEQ ID NO: 10019282 - DNA, 22 bp, Homo sapiens
ggaatctagaaagggagcaagg

SEQ ID NO: 10019283 - DNA, 22 bp, Homo sapiens
ggaagaggctggtagtgcccgt

SEQ ID NO: 10019284 - DNA, 22 bp, Homo sapiens
ggaagaggctggtagtgcccgt

SEQ ID NO: 10019285 - DNA, 22 bp, Homo sapiens
ggaagaggctggtagtgcccgt

SEQ ID NO: 10019286 - DNA, 22 bp, Homo sapiens
ggaagagggaaccacgactgta

SEQ ID NO: 10019287 - DNA, 22 bp, Homo sapiens
ggaagagggaaccacgactgta

SEQ ID NO: 10019288 - DNA, 22 bp, Homo sapiens
ggaagattcagcatatatgagt

SEQ ID NO: 10019289 - DNA, 22 bp, Homo sapiens
ggaagattttccattcctcttt

SEQ ID NO: 10019290 - DNA, 22 bp, Homo sapiens
ggaagatttcccgtagctgtgc

SEQ ID NO: 10019291 - DNA, 22 bp, Homo sapiens
ggaagatgagaagtggggctcc

SEQ ID NO: 10019292 - DNA, 22 bp, Homo sapiens
ggaagatgagaagtggggctcc

SEQ ID NO: 10019293 - DNA, 22 bp, Homo sapiens
ggaatgagctcggagcagaagg

SEQ ID NO: 10019294 - DNA, 22 bp, Homo sapiens
ggaatgaatttccagctgggtc

SEQ ID NO: 10019295 - DNA, 22 bp, Homo sapiens
ggaatgagctcggagcagaagg

SEQ ID NO: 10019296 - DNA, 22 bp, Homo sapiens
ggaatgaagaaatagatggtgt

SEQ ID NO: 10019297 - DNA, 22 bp, Homo sapiens
ggaatgaagaaatagatggtgt

SEQ ID NO: 10019298 - DNA, 22 bp, Homo sapiens
ggaatgaaacacttctgattct

SEQ ID NO: 10019299 - DNA, 22 bp, Homo sapiens
ggaatgaaacacttctgattct

SEQ ID NO: 10019300 - DNA, 22 bp, Homo sapiens
ggaatctttttcataagcctca

SEQ ID NO: 10019301 - DNA, 22 bp, Homo sapiens
ggaatctttgaaggattttaag

SEQ ID NO: 10019302 - DNA, 22 bp, Homo sapiens
ggaatgtaacgtgaccaagttc

SEQ ID NO: 10019303 - DNA, 22 bp, Homo sapiens
ggaatgttctggaacaccgctt

SEQ ID NO: 10019304 - DNA, 22 bp, Homo sapiens
ggaatgttctggtctggttcat

SEQ ID NO: 10019305 - DNA, 22 bp, Homo sapiens
ggaatgttgtcatttacattat

SEQ ID NO: 10019306 - DNA, 22 bp, Homo sapiens
ggaatgttgtcatttacattat

SEQ ID NO: 10019307 - DNA, 23 bp, Homo sapiens
ggaatgtttacctgtgaatgtca

SEQ ID NO: 10019308 - DNA, 22 bp, Homo sapiens
ggaatgtttgctcccttcaggg

SEQ ID NO: 10019309 - DNA, 17 bp, Homo sapiens
ggacacagctcatggct

SEQ ID NO: 10019310 - DNA, 22 bp, Homo sapiens
ggacaaaccaatagacactggc

SEQ ID NO: 10019311 - DNA, 21 bp, Homo sapiens
ggaattgcaggctgtcttttg

SEQ ID NO: 10019312 - DNA, 22 bp, Homo sapiens
ggaattgctaacattctgaagg

SEQ ID NO: 10019313 - DNA, 22 bp, Homo sapiens
ggaattcttaaaatggtgtgta

SEQ ID NO: 10019314 - DNA, 22 bp, Homo sapiens
ggaatgtttttcattgctctct

SEQ ID NO: 10019315 - DNA, 22 bp, Homo sapiens
ggaatgttttccagacctagat

SEQ ID NO: 10019316 - DNA, 22 bp, Homo sapiens
ggaatgttttagcttgactttt

SEQ ID NO: 10019317 - DNA, 20 bp, Homo sapiens
ggaattgctttcctgtcttt

SEQ ID NO: 10019318 - DNA, 22 bp, Homo sapiens
ggaatttagatgtttctcaact

SEQ ID NO: 10019319 - DNA, 22 bp, Homo sapiens
ggacaaaatccaaacttcttag

SEQ ID NO: 10019320 - DNA, 22 bp, Homo sapiens
ggaagacaagcagtggctgagc

SEQ ID NO: 10019321 - DNA, 22 bp, Homo sapiens
ggaagacaagcagtggctgagc

SEQ ID NO: 10019322 - DNA, 22 bp, Homo sapiens
ggaagacaagcagtggctgagc

SEQ ID NO: 10019323 - DNA, 22 bp, Homo sapiens
ggaagacaagcagtggctgagc

SEQ ID NO: 10019324 - DNA, 22 bp, Homo sapiens
ggaagaggaggagccaggcttt

SEQ ID NO: 10019325 - DNA, 22 bp, Homo sapiens
gctttggagggcaagagctgtt

SEQ ID NO: 10019326 - DNA, 22 bp, Homo sapiens
gctttggagttaggactcggcc

SEQ ID NO: 10019327 - DNA, 22 bp, Homo sapiens
ggaagaggctgaggccatgctg

SEQ ID NO: 10019328 - DNA, 22 bp, Homo sapiens
ggaagaggctgagccaggtccc

SEQ ID NO: 10019329 - DNA, 22 bp, Homo sapiens
ggaagaggctgaggccatgctg

SEQ ID NO: 10019330 - DNA, 22 bp, Homo sapiens
ggaagaggctgagccaggtccc

SEQ ID NO: 10019331 - DNA, 22 bp, Homo sapiens
ggaagaggaggagccaggcttt

SEQ ID NO: 10019332 - DNA, 22 bp, Homo sapiens
ggaagaggctctcattgagggc

SEQ ID NO: 10019333 - DNA, 22 bp, Homo sapiens
ggaagaggctctcattgagggc

SEQ ID NO: 10019334 - DNA, 22 bp, Homo sapiens
ggaagaggctctcattgagggc

SEQ ID NO: 10019335 - DNA, 22 bp, Homo sapiens
ggaagaggctctcattgagggc

SEQ ID NO: 10019336 - DNA, 22 bp, Homo sapiens
ggaagaggctgagccaggtccc

SEQ ID NO: 10019337 - DNA, 22 bp, Homo sapiens
gctttggaaactggccctgcgc

SEQ ID NO: 10019338 - DNA, 22 bp, Homo sapiens
gctttggaacttaaatccttgg

SEQ ID NO: 10019339 - DNA, 22 bp, Homo sapiens
gctttctcttcactgatgttca

SEQ ID NO: 10019340 - DNA, 22 bp, Homo sapiens
gctttctgatgagcttaagaaa

SEQ ID NO: 10019341 - DNA, 22 bp, Homo sapiens
gctttctgatgagcttaagaaa

SEQ ID NO: 10019342 - DNA, 22 bp, Homo sapiens
gctttgctggcttgaaatgctg

SEQ ID NO: 10019343 - DNA, 22 bp, Homo sapiens
gctttctgattgcgaaaacaaa

SEQ ID NO: 10019344 - DNA, 20 bp, Homo sapiens
gctttcaagcttgtcattgt

SEQ ID NO: 10019345 - DNA, 22 bp, Homo sapiens
gctttcatgaaaataatctact

SEQ ID NO: 10019346 - DNA, 22 bp, Homo sapiens
gctttccctgccctcagaagga

SEQ ID NO: 10019347 - DNA, 22 bp, Homo sapiens
ggagcaggcagggccgtgtctg

SEQ ID NO: 10019348 - DNA, 22 bp, Homo sapiens
ggagcagcactgccacacagag

SEQ ID NO: 10019349 - DNA, 22 bp, Homo sapiens
ggagcagcactgattagcggtt

SEQ ID NO: 10019350 - DNA, 22 bp, Homo sapiens
ggagcagatgtcttcatggcct

SEQ ID NO: 10019351 - DNA, 22 bp, Homo sapiens
ggagcagatgtcttcatggcct

SEQ ID NO: 10019352 - DNA, 22 bp, Homo sapiens
ggagcagatgtcttcatggcct

SEQ ID NO: 10019353 - DNA, 22 bp, Homo sapiens
ggagcagcactgccacacagag

SEQ ID NO: 10019354 - DNA, 22 bp, Homo sapiens
ggagagaccctggagaaggtcc

SEQ ID NO: 10019355 - DNA, 22 bp, Homo sapiens
ggagagaccctggagaaggtcc

SEQ ID NO: 10019356 - DNA, 22 bp, Homo sapiens
ggagagaccctggagaaggtcc

SEQ ID NO: 10019357 - DNA, 22 bp, Homo sapiens
ggagagaattccatggacatgt

SEQ ID NO: 10019358 - DNA, 22 bp, Homo sapiens
ggagagagagctcattagctgc

SEQ ID NO: 10019359 - DNA, 22 bp, Homo sapiens
ggagagagacctccatgcccag

SEQ ID NO: 10019360 - DNA, 22 bp, Homo sapiens
ggagcatgtggggtgagcaggg

SEQ ID NO: 10019361 - DNA, 22 bp, Homo sapiens
ggagcatgtggggtgagcaggg

SEQ ID NO: 10019362 - DNA, 22 bp, Homo sapiens
ggagactgatctgagtgataac

SEQ ID NO: 10019363 - DNA, 22 bp, Homo sapiens
ggagagaaattgaggtagcaag

SEQ ID NO: 10019364 - DNA, 22 bp, Homo sapiens
ggagagaactgacctgaaagga

SEQ ID NO: 10019365 - DNA, 22 bp, Homo sapiens
ggagacagtgacttagagactg

SEQ ID NO: 10019366 - DNA, 22 bp, Homo sapiens
ggagacagtgacttagagactg

SEQ ID NO: 10019367 - DNA, 22 bp, Homo sapiens
ggagacagtgacttagagactg

SEQ ID NO: 10019368 - DNA, 22 bp, Homo sapiens
ggagacagtgacttagagactg

SEQ ID NO: 10019369 - DNA, 22 bp, Homo sapiens
ggagacagtggtagggcctaag

SEQ ID NO: 10019370 - DNA, 22 bp, Homo sapiens
ggagacagtggtagggcctaag

SEQ ID NO: 10019371 - DNA, 22 bp, Homo sapiens
ggagacagtggtagggcctaag

SEQ ID NO: 10019372 - DNA, 22 bp, Homo sapiens
ggagacagtgacttagagactg

SEQ ID NO: 10019373 - DNA, 22 bp, Homo sapiens
ggagaccagaaggaagcttcga

SEQ ID NO: 10019374 - DNA, 22 bp, Homo sapiens
ggacaggtgcaaagggcacatg

SEQ ID NO: 10019375 - DNA, 22 bp, Homo sapiens
ggacaggtgactgcccagagtg

SEQ ID NO: 10019376 - DNA, 21 bp, Homo sapiens
ggacagtagtagtcaggagag

SEQ ID NO: 10019377 - DNA, 22 bp, Homo sapiens
ggacagtgtctgcttcaggccc

SEQ ID NO: 10019378 - DNA, 20 bp, Homo sapiens
ggacagtgagacatatctca

SEQ ID NO: 10019379 - DNA, 22 bp, Homo sapiens
ggacacagctgcagccacaccc

SEQ ID NO: 10019380 - DNA, 22 bp, Homo sapiens
ggacagggtaagtactagtgtg

SEQ ID NO: 10019381 - DNA, 22 bp, Homo sapiens
ggacacagtggaagacagcttg

SEQ ID NO: 10019382 - DNA, 22 bp, Homo sapiens
ggagacagtatggcttgtagct

SEQ ID NO: 10019383 - DNA, 22 bp, Homo sapiens
ggagacagtatggcttgtagct

SEQ ID NO: 10019384 - DNA, 22 bp, Homo sapiens
ggagacagtatggcttgtagct

SEQ ID NO: 10019385 - DNA, 22 bp, Homo sapiens
ggagacagggttgaaccacgca

SEQ ID NO: 10019386 - DNA, 22 bp, Homo sapiens
ggagacagggttgaaccacgca

SEQ ID NO: 10019387 - DNA, 22 bp, Homo sapiens
ggacatgatatttcaggaagac

SEQ ID NO: 10019388 - DNA, 19 bp, Homo sapiens
ggaccagctttcaggaggc

SEQ ID NO: 10019389 - DNA, 22 bp, Homo sapiens
ggaccaggagctcagagccctc

SEQ ID NO: 10019390 - DNA, 22 bp, Homo sapiens
ggaccaggccagcctccctgcg

SEQ ID NO: 10019391 - DNA, 22 bp, Homo sapiens
ggaccaggctgagcacctgcct

SEQ ID NO: 10019392 - DNA, 22 bp, Homo sapiens
ggaccaggcaagctgaggcggg

SEQ ID NO: 10019393 - DNA, 22 bp, Homo sapiens
tatgtcttgaaatgagaagcca

SEQ ID NO: 10019394 - DNA, 22 bp, Homo sapiens
tatgtcttgaaatgagaagcca

SEQ ID NO: 10019395 - DNA, 22 bp, Homo sapiens
tatgtcttaactctagaaaggt

SEQ ID NO: 10019396 - DNA, 22 bp, Homo sapiens
tatgtctggcatgttgtaatta

SEQ ID NO: 10019397 - DNA, 22 bp, Homo sapiens
tatgtcttaatccttccttagg

SEQ ID NO: 10019398 - DNA, 22 bp, Homo sapiens
tatgtcttactacagcaattaa

SEQ ID NO: 10019399 - DNA, 22 bp, Homo sapiens
tatgtcttactacagcaattaa

SEQ ID NO: 10019400 - DNA, 22 bp, Homo sapiens
tatgtcttttccaatgctgtct

SEQ ID NO: 10019401 - DNA, 22 bp, Homo sapiens
tatgtctttagtatcttttgga

SEQ ID NO: 10019402 - DNA, 22 bp, Homo sapiens
tatgtcttgtgtttgctaatct

SEQ ID NO: 10019403 - DNA, 19 bp, Homo sapiens
tatgtgtgcatttgtgcat

SEQ ID NO: 10019404 - DNA, 22 bp, Homo sapiens
tatgtgtgcatgtatacattaa

SEQ ID NO: 10019405 - DNA, 22 bp, Homo sapiens
tatgtgtgcatgtatacattaa

SEQ ID NO: 10019406 - DNA, 22 bp, Homo sapiens
tatgtgcacattagagagatgg

SEQ ID NO: 10019407 - DNA, 22 bp, Homo sapiens
tatgtgcaaattaattgctaga

SEQ ID NO: 10019408 - DNA, 19 bp, Homo sapiens
tatgtgtgcatttgtgcat

SEQ ID NO: 10019409 - DNA, 22 bp, Homo sapiens
tatgtgtgctttttccatgcat

SEQ ID NO: 10019410 - DNA, 19 bp, Homo sapiens
tatgtgtgcatttgtgcat

SEQ ID NO: 10019411 - DNA, 22 bp, Homo sapiens
tatgtgtgctttttccatgcat

SEQ ID NO: 10019412 - DNA, 22 bp, Homo sapiens
tatgtgtggcagctgggagtgt

SEQ ID NO: 10019413 - DNA, 22 bp, Homo sapiens
tatgtgtggagccagcctggag

SEQ ID NO: 10019414 - DNA, 22 bp, Homo sapiens
tatgtgtggcagctgggagtgt

SEQ ID NO: 10019415 - DNA, 22 bp, Homo sapiens
tatgtgtggcagctgggagtgt

SEQ ID NO: 10019416 - DNA, 22 bp, Homo sapiens
tattacaatttacattgcactt

SEQ ID NO: 10019417 - DNA, 22 bp, Homo sapiens
tatgtgtggcagctgggagtgt

SEQ ID NO: 10019418 - DNA, 22 bp, Homo sapiens
tattacacagtgaaagcatgga

SEQ ID NO: 10019419 - DNA, 20 bp, Homo sapiens
tattacacacaatgagcagt

SEQ ID NO: 10019420 - DNA, 22 bp, Homo sapiens
tattacagggctagttatgagt

SEQ ID NO: 10019421 - DNA, 22 bp, Homo sapiens
tattacagaatcaggcataact

SEQ ID NO: 10019422 - DNA, 22 bp, Homo sapiens
tattagatttgtttctgtagat

SEQ ID NO: 10019423 - DNA, 22 bp, Homo sapiens
tattagattaactttaatgtct

SEQ ID NO: 10019424 - DNA, 22 bp, Homo sapiens
tattagaaaggctattgcatag

SEQ ID NO: 10019425 - DNA, 22 bp, Homo sapiens
tattagaaaggctattgcatag

SEQ ID NO: 10019426 - DNA, 22 bp, Homo sapiens
tatgtacagggatagaacttga

SEQ ID NO: 10019427 - DNA, 22 bp, Homo sapiens
tatgtacagggatagaacttga

SEQ ID NO: 10019428 - DNA, 22 bp, Homo sapiens
tatgtacacttaagtttgagaa

SEQ ID NO: 10019429 - DNA, 22 bp, Homo sapiens
tatgtacaccggggaaggtggg

SEQ ID NO: 10019430 - DNA, 22 bp, Homo sapiens
tatgtacacatacacttgtaat

SEQ ID NO: 10019431 - DNA, 22 bp, Homo sapiens
tatgtacacatacacttgtaat

SEQ ID NO: 10019432 - DNA, 22 bp, Homo sapiens
tatgtacacacacatgcatgta

SEQ ID NO: 10019433 - DNA, 22 bp, Homo sapiens
tatgtacacatacacttgtaat

SEQ ID NO: 10019434 - DNA, 22 bp, Homo sapiens
tatgtacacacacatgcatgta

SEQ ID NO: 10019435 - DNA, 22 bp, Homo sapiens
tatgtacaccaaggattgaaaa

SEQ ID NO: 10019436 - DNA, 22 bp, Homo sapiens
tatgtacacatacacttgtaat

SEQ ID NO: 10019437 - DNA, 22 bp, Homo sapiens
tatgtacaccaaggattgaaaa

SEQ ID NO: 10019438 - DNA, 22 bp, Homo sapiens
tatgtacataacatgaaatgca

SEQ ID NO: 10019439 - DNA, 22 bp, Homo sapiens
tatgtacagtccttaacttaaa

SEQ ID NO: 10019440 - DNA, 22 bp, Homo sapiens
tatgtacagtccttaacttaaa

SEQ ID NO: 10019441 - DNA, 22 bp, Homo sapiens
tatgtcctgctactctctcatg

SEQ ID NO: 10019442 - DNA, 22 bp, Homo sapiens
tatgtctggaagtgtacttgtc

SEQ ID NO: 10019443 - DNA, 22 bp, Homo sapiens
tatgtctgcttggttttggaat

SEQ ID NO: 10019444 - DNA, 22 bp, Homo sapiens
tatgtacatacatgtgcatacg

SEQ ID NO: 10019445 - DNA, 20 bp, Homo sapiens
tatgagtattactttcagga

SEQ ID NO: 10019446 - DNA, 22 bp, Homo sapiens
tatgagtacaaggaatcttcca

SEQ ID NO: 10019447 - DNA, 22 bp, Homo sapiens
tatgagtactgtgaacgagaat

SEQ ID NO: 10019448 - DNA, 22 bp, Homo sapiens
tatgtacaagcacacatgtgac

SEQ ID NO: 10019449 - DNA, 22 bp, Homo sapiens
tatgaggcacttcattagctgg

SEQ ID NO: 10019450 - DNA, 22 bp, Homo sapiens
tatgagtacaaggaaggatgga

SEQ ID NO: 10019451 - DNA, 22 bp, Homo sapiens
tatgtacaatcagcagttcata

SEQ ID NO: 10019452 - DNA, 22 bp, Homo sapiens
tatgtacaatttgttgtatgtc

SEQ ID NO: 10019453 - DNA, 22 bp, Homo sapiens
tatgtacaatttgttgtatgtc

SEQ ID NO: 10019454 - DNA, 22 bp, Homo sapiens
tatgtacaatttgttgtatgtc

SEQ ID NO: 10019455 - DNA, 22 bp, Homo sapiens
tatgtacaatttgttgtatgtc

SEQ ID NO: 10019456 - DNA, 22 bp, Homo sapiens
tatgtacacacacatgcatgta

SEQ ID NO: 10019457 - DNA, 22 bp, Homo sapiens
tatgtacacacacatgcatgta

SEQ ID NO: 10019458 - DNA, 22 bp, Homo sapiens
tatgtacacacacatgcatgta

SEQ ID NO: 10019459 - DNA, 22 bp, Homo sapiens
tatgtacaagcacacatgtgac

SEQ ID NO: 10019460 - DNA, 22 bp, Homo sapiens
tatgtacaagcacacatgtgac

SEQ ID NO: 10019461 - DNA, 22 bp, Homo sapiens
tatgtacaatcagcagttcata

SEQ ID NO: 10019462 - DNA, 22 bp, Homo sapiens
tatgtacaatcagcagttcata

SEQ ID NO: 10019463 - DNA, 22 bp, Homo sapiens
tatgtacaatcagcagttcata

SEQ ID NO: 10019464 - DNA, 22 bp, Homo sapiens
tatgtacaatcagcagttcata

SEQ ID NO: 10019465 - DNA, 22 bp, Homo sapiens
tatttctgaatccaaaaggtca

SEQ ID NO: 10019466 - DNA, 22 bp, Homo sapiens
tatttctgaatccaaaaggtca

SEQ ID NO: 10019467 - DNA, 22 bp, Homo sapiens
tatttctgagaaccaacttacc

SEQ ID NO: 10019468 - DNA, 22 bp, Homo sapiens
tatttctcagcattttacatcc

SEQ ID NO: 10019469 - DNA, 22 bp, Homo sapiens
tatttctcttcaaaattgatgt

SEQ ID NO: 10019470 - DNA, 22 bp, Homo sapiens
tatttctctcacggttgcctgg

SEQ ID NO: 10019471 - DNA, 22 bp, Homo sapiens
tatttctcagcattttacatcc

SEQ ID NO: 10019472 - DNA, 22 bp, Homo sapiens
tatttctattccccaggcaagt

SEQ ID NO: 10019473 - DNA, 22 bp, Homo sapiens
tatttctaagctgtaagtctga

SEQ ID NO: 10019474 - DNA, 22 bp, Homo sapiens
tatttctattccccaggcaagt

SEQ ID NO: 10019475 - DNA, 19 bp, Homo sapiens
tatttcaaagtgccgtcta

SEQ ID NO: 10019476 - DNA, 22 bp, Homo sapiens
tatttattggacagtgttgctg

SEQ ID NO: 10019477 - DNA, 22 bp, Homo sapiens
tatttattggacagtgttgctg

SEQ ID NO: 10019478 - DNA, 22 bp, Homo sapiens
tatttattctttgtactgcctt

SEQ ID NO: 10019479 - DNA, 21 bp, Homo sapiens
tatttattaatttgtaaggct

SEQ ID NO: 10019480 - DNA, 22 bp, Homo sapiens
tatttattcattcagcaagcat

SEQ ID NO: 10019481 - DNA, 22 bp, Homo sapiens
tatttattctttgtactgcctt

SEQ ID NO: 10019482 - DNA, 22 bp, Homo sapiens
tatttaattagtgattgtagag

SEQ ID NO: 10019483 - DNA, 22 bp, Homo sapiens
tattgacaatttgtgaaactat

SEQ ID NO: 10019484 - DNA, 22 bp, Homo sapiens
tatttaattagtgattgtagag

SEQ ID NO: 10019485 - DNA, 22 bp, Homo sapiens
tatttataacagtgagaacggg

SEQ ID NO: 10019486 - DNA, 22 bp, Homo sapiens
tatttataccaggtgatcggag

SEQ ID NO: 10019487 - DNA, 22 bp, Homo sapiens
tatttatcaaggtaggagaata

SEQ ID NO: 10019488 - DNA, 22 bp, Homo sapiens
tatttatgtggaccataagcct

SEQ ID NO: 10019489 - DNA, 22 bp, Homo sapiens
tatttatgtctctgcagagaat

SEQ ID NO: 10019490 - DNA, 22 bp, Homo sapiens
tattctgcatgaaaataaacag

SEQ ID NO: 10019491 - DNA, 22 bp, Homo sapiens
tattctgcatgaaaataaacag

SEQ ID NO: 10019492 - DNA, 22 bp, Homo sapiens
tattctgctaagtgatttctac

SEQ ID NO: 10019493 - DNA, 22 bp, Homo sapiens
tattctctgcagctgaatgttt

SEQ ID NO: 10019494 - DNA, 22 bp, Homo sapiens
tattctgtgtgatatgtaaatg

SEQ ID NO: 10019495 - DNA, 22 bp, Homo sapiens
tattctgtgtgatatgtaaatg

SEQ ID NO: 10019496 - DNA, 22 bp, Homo sapiens
tattctcagtgctataagtaga

SEQ ID NO: 10019497 - DNA, 22 bp, Homo sapiens
tattctcagcaacacacatgga

SEQ ID NO: 10019498 - DNA, 22 bp, Homo sapiens
tattctccccggatcagggcaa

SEQ ID NO: 10019499 - DNA, 22 bp, Homo sapiens
tattcttgactgcttactatgt

SEQ ID NO: 10019500 - DNA, 22 bp, Homo sapiens
tattcttgtaccttaaatgatt

SEQ ID NO: 10019501 - DNA, 22 bp, Homo sapiens
tattcttgtaccttaaatgatt

SEQ ID NO: 10019502 - DNA, 22 bp, Homo sapiens
tattgaaatccattacgttctt

SEQ ID NO: 10019503 - DNA, 22 bp, Homo sapiens
tattcttgtcttttccagaaat

SEQ ID NO: 10019504 - DNA, 22 bp, Homo sapiens
tattgaaatccattacgttctt

SEQ ID NO: 10019505 - DNA, 22 bp, Homo sapiens
tattcttgtatactacaatctt

SEQ ID NO: 10019506 - DNA, 22 bp, Homo sapiens
tattcttgtatactacaatctt

SEQ ID NO: 10019507 - DNA, 22 bp, Homo sapiens
tattgacaatttgtgaaactat

SEQ ID NO: 10019508 - DNA, 22 bp, Homo sapiens
tattgacaataggcaactgagg

SEQ ID NO: 10019509 - DNA, 22 bp, Homo sapiens
tattgaattagaccctaaaatg

SEQ ID NO: 10019510 - DNA, 22 bp, Homo sapiens
tattgaaattcttcatgtcctc

SEQ ID NO: 10019511 - DNA, 22 bp, Homo sapiens
tattgaaatgaatgacagtgat

SEQ ID NO: 10019512 - DNA, 22 bp, Homo sapiens
tattgaaattcttcatgtcctc

SEQ ID NO: 10019513 - DNA, 22 bp, Homo sapiens
tattgaaattcttcatgtcctc

SEQ ID NO: 10019514 - DNA, 22 bp, Homo sapiens
tattcaaagtaccttcattgcc

SEQ ID NO: 10019515 - DNA, 22 bp, Homo sapiens
tattattttagcactgaggatt

SEQ ID NO: 10019516 - DNA, 22 bp, Homo sapiens
tattattttagcactgaggatt

SEQ ID NO: 10019517 - DNA, 22 bp, Homo sapiens
tattctacagtgttagtgttag

SEQ ID NO: 10019518 - DNA, 22 bp, Homo sapiens
tattccaaaatagttaagcact

SEQ ID NO: 10019519 - DNA, 22 bp, Homo sapiens
tattcattatgaccaaatctag

SEQ ID NO: 10019520 - DNA, 22 bp, Homo sapiens
tattattatctttgaatgggac

SEQ ID NO: 10019521 - DNA, 22 bp, Homo sapiens
tattattatgcatagcatgaaa

SEQ ID NO: 10019522 - DNA, 22 bp, Homo sapiens
tattattatgcatagcatgaaa

SEQ ID NO: 10019523 - DNA, 22 bp, Homo sapiens
tattaggtagattttactgatt

SEQ ID NO: 10019524 - DNA, 22 bp, Homo sapiens
tattattatagttattgggaag

SEQ ID NO: 10019525 - DNA, 22 bp, Homo sapiens
tattattaaatggcagaatttt

SEQ ID NO: 10019526 - DNA, 22 bp, Homo sapiens
tataggaatgacgtcatttcct

SEQ ID NO: 10019527 - DNA, 22 bp, Homo sapiens
tataggaataaagtggggtata

SEQ ID NO: 10019528 - DNA, 21 bp, Homo sapiens
tataggaatcagtcacatctg

SEQ ID NO: 10019529 - DNA, 19 bp, Homo sapiens
tataggaagtgtggttaag

SEQ ID NO: 10019530 - DNA, 22 bp, Homo sapiens
tataggaagtaattgttgcctg

SEQ ID NO: 10019531 - DNA, 22 bp, Homo sapiens
tataggaagtgtagtgcttgga

SEQ ID NO: 10019532 - DNA, 22 bp, Homo sapiens
tataggaagtattcaaagactg

SEQ ID NO: 10019533 - DNA, 22 bp, Homo sapiens
tataggaaggcagattttagct

SEQ ID NO: 10019534 - DNA, 22 bp, Homo sapiens
tataggaaggcagattttagct

SEQ ID NO: 10019535 - DNA, 22 bp, Homo sapiens
tataggaaatttatctcctggg

SEQ ID NO: 10019536 - DNA, 22 bp, Homo sapiens
tataggaaataggtcttctgtg

SEQ ID NO: 10019537 - DNA, 22 bp, Homo sapiens
tataggaacagctagcacagaa

SEQ ID NO: 10019538 - DNA, 22 bp, Homo sapiens
tataggaaaggagtggtcacaa

SEQ ID NO: 10019539 - DNA, 22 bp, Homo sapiens
tataggaaacatacgtgactag

SEQ ID NO: 10019540 - DNA, 22 bp, Homo sapiens
tatagcacacagtttataaaag

SEQ ID NO: 10019541 - DNA, 22 bp, Homo sapiens
tatatatatgcacacacaccta

SEQ ID NO: 10019542 - DNA, 22 bp, Homo sapiens
tatatatatgcacacacaccta

SEQ ID NO: 10019543 - DNA, 22 bp, Homo sapiens
tatatatatgcacacacaccta

SEQ ID NO: 10019544 - DNA, 22 bp, Homo sapiens
tatagttagtttcataatcatg

SEQ ID NO: 10019545 - DNA, 22 bp, Homo sapiens
tatagttagtttcataatcatg

SEQ ID NO: 10019546 - DNA, 21 bp, Homo sapiens
tatagtgtggatatgctgatg

SEQ ID NO: 10019547 - DNA, 22 bp, Homo sapiens
tatagtacatggaatcttcata

SEQ ID NO: 10019548 - DNA, 22 bp, Homo sapiens
tatagtacatggaatcttcata

SEQ ID NO: 10019549 - DNA, 22 bp, Homo sapiens
tatagtacatggaatcttcata

SEQ ID NO: 10019550 - DNA, 22 bp, Homo sapiens
tatagtacacttaggtacttca

SEQ ID NO: 10019551 - DNA, 21 bp, Homo sapiens
tatagtcacttgagcattatc

SEQ ID NO: 10019552 - DNA, 22 bp, Homo sapiens
tataggtagccatatttgatag

SEQ ID NO: 10019553 - DNA, 22 bp, Homo sapiens
tatagtaaaattttcatttatg

SEQ ID NO: 10019554 - DNA, 22 bp, Homo sapiens
tataggaccgacttgtttatag

SEQ ID NO: 10019555 - DNA, 22 bp, Homo sapiens
tataggactgatcacattttca

SEQ ID NO: 10019556 - DNA, 22 bp, Homo sapiens
tataggcagatctgagaatatt

SEQ ID NO: 10019557 - DNA, 22 bp, Homo sapiens
tatccaattcaccattgatggg

SEQ ID NO: 10019558 - DNA, 22 bp, Homo sapiens
tatccaaagtttctcagaaact

SEQ ID NO: 10019559 - DNA, 22 bp, Homo sapiens
tatccaaagtggcatattatag

SEQ ID NO: 10019560 - DNA, 23 bp, Homo sapiens
tatccagtagggcccagagctga

SEQ ID NO: 10019561 - DNA, 22 bp, Homo sapiens
tatccattaggtctatggtcaa

SEQ ID NO: 10019562 - DNA, 22 bp, Homo sapiens
tatccatttattttctaggcaa

SEQ ID NO: 10019563 - DNA, 22 bp, Homo sapiens
tatatctaagtgtatgtaagag

SEQ ID NO: 10019564 - DNA, 19 bp, Homo sapiens
tatatattttggggttgtg

SEQ ID NO: 10019565 - DNA, 19 bp, Homo sapiens
tatatattttggggttgtg

SEQ ID NO: 10019566 - DNA, 22 bp, Homo sapiens
tatatattcttaagtagtgtag

SEQ ID NO: 10019567 - DNA, 19 bp, Homo sapiens
tatatattttggggttgtg

SEQ ID NO: 10019568 - DNA, 22 bp, Homo sapiens
tatatattcttaagtagtgtag

SEQ ID NO: 10019569 - DNA, 22 bp, Homo sapiens
tatgacattataaaggattatt

SEQ ID NO: 10019570 - DNA, 22 bp, Homo sapiens
tatgacaccattttggtcagtg

SEQ ID NO: 10019571 - DNA, 22 bp, Homo sapiens
tatgacaatgtgggcctaaggg

SEQ ID NO: 10019572 - DNA, 22 bp, Homo sapiens
tatgacttatttcatcagttct

SEQ ID NO: 10019573 - DNA, 22 bp, Homo sapiens
tatctagaaacagagttttact

SEQ ID NO: 10019574 - DNA, 22 bp, Homo sapiens
tatctagaaacagagttttact

SEQ ID NO: 10019575 - DNA, 22 bp, Homo sapiens
tatctacatgtaggtatgtatg

SEQ ID NO: 10019576 - DNA, 22 bp, Homo sapiens
tatctacagttaatatgtcatc

SEQ ID NO: 10019577 - DNA, 22 bp, Homo sapiens
tatctacagttaatatgtcatc

SEQ ID NO: 10019578 - DNA, 22 bp, Homo sapiens
tatctacaggtgtcaggtaaga

SEQ ID NO: 10019579 - DNA, 16 bp, Homo sapiens
tatctagagttgaggt

SEQ ID NO: 10019580 - DNA, 22 bp, Homo sapiens
tatctagatagtttagccatct

SEQ ID NO: 10019581 - DNA, 22 bp, Homo sapiens
tatctagataccaagaagcaca

SEQ ID NO: 10019582 - DNA, 22 bp, Homo sapiens
tatctagatatttggataaatg

SEQ ID NO: 10019583 - DNA, 19 bp, Homo sapiens
tatgacaagtactagttct

SEQ ID NO: 10019584 - DNA, 22 bp, Homo sapiens
tatctagagcctggaagtcttg

SEQ ID NO: 10019585 - DNA, 22 bp, Homo sapiens
tatctagagcagtggttctcaa

SEQ ID NO: 10019586 - DNA, 22 bp, Homo sapiens
tatctagagtcctgctgagaac

SEQ ID NO: 10019587 - DNA, 22 bp, Homo sapiens
tatctagagcctggaagtcttg

SEQ ID NO: 10019588 - DNA, 22 bp, Homo sapiens
tatctagaaatttcttttgttg

SEQ ID NO: 10019589 - DNA, 22 bp, Homo sapiens
tatctagaaacagagttttact

SEQ ID NO: 10019590 - DNA, 22 bp, Homo sapiens
tatctagaactccagaatgtag

SEQ ID NO: 10019591 - DNA, 22 bp, Homo sapiens
tatctagaactccagaatgtag

SEQ ID NO: 10019592 - DNA, 22 bp, Homo sapiens
tatctaaatggaatattccaga

SEQ ID NO: 10019593 - DNA, 22 bp, Homo sapiens
tatctaaatggaatattccaga

SEQ ID NO: 10019594 - DNA, 22 bp, Homo sapiens
tatctaataaatctgataagta

SEQ ID NO: 10019595 - DNA, 22 bp, Homo sapiens
tatctaagagagtcaatattta

SEQ ID NO: 10019596 - DNA, 22 bp, Homo sapiens
tatctaaaggatttaatttagt

SEQ ID NO: 10019597 - DNA, 22 bp, Homo sapiens
tatctaaaggatttaatttagt

SEQ ID NO: 10019598 - DNA, 22 bp, Homo sapiens
tatctaaaggatttaatttagt

SEQ ID NO: 10019599 - DNA, 22 bp, Homo sapiens
tatctaaaggatttaatttagt

SEQ ID NO: 10019600 - DNA, 23 bp, Homo sapiens
tatcctaaaggcaacaggaagtc

SEQ ID NO: 10019601 - DNA, 22 bp, Homo sapiens
tatccttgtactatagtattta

SEQ ID NO: 10019602 - DNA, 22 bp, Homo sapiens
tatcctgttttgcacaattata

SEQ ID NO: 10019603 - DNA, 22 bp, Homo sapiens
tataattttaagtggtaaatta

SEQ ID NO: 10019604 - DNA, 22 bp, Homo sapiens
tataatttggggaaagtggtgt

SEQ ID NO: 10019605 - DNA, 22 bp, Homo sapiens
tataatttggggaaagtggtgt

SEQ ID NO: 10019606 - DNA, 22 bp, Homo sapiens
tatacaagaggtgagatgagca

SEQ ID NO: 10019607 - DNA, 22 bp, Homo sapiens
tataattttaagtggtaaatta

SEQ ID NO: 10019608 - DNA, 22 bp, Homo sapiens
tatacaagtaatgctgaatgat

SEQ ID NO: 10019609 - DNA, 22 bp, Homo sapiens
tatacaatgagtacattctggg

SEQ ID NO: 10019610 - DNA, 22 bp, Homo sapiens
tatacaatggctgaatcatcca

SEQ ID NO: 10019611 - DNA, 22 bp, Homo sapiens
tatacaatggctgaatcatcca

SEQ ID NO: 10019612 - DNA, 22 bp, Homo sapiens
tatacaatggctgaatcatcca

SEQ ID NO: 10019613 - DNA, 22 bp, Homo sapiens
tatacacaaacaaggggttaag

SEQ ID NO: 10019614 - DNA, 22 bp, Homo sapiens
tatacacaaggtgtgcatttgt

SEQ ID NO: 10019615 - DNA, 22 bp, Homo sapiens
tatacacaaggtgtgcatttgt

SEQ ID NO: 10019616 - DNA, 22 bp, Homo sapiens
tatacacaaggtgtgcatttgt

SEQ ID NO: 10019617 - DNA, 22 bp, Homo sapiens
tatacacacatgctccggcctt

SEQ ID NO: 10019618 - DNA, 22 bp, Homo sapiens
tatacacacctccaaagcagga

SEQ ID NO: 10019619 - DNA, 22 bp, Homo sapiens
tatacacacctccaaagcagga

SEQ ID NO: 10019620 - DNA, 22 bp, Homo sapiens
tatacacatatacgtttgtgtg

SEQ ID NO: 10019621 - DNA, 22 bp, Homo sapiens
tatacacatatacgtttgtgtg

SEQ ID NO: 10019622 - DNA, 22 bp, Homo sapiens
tatacacaggaatctgtgaaaa

SEQ ID NO: 10019623 - DNA, 17 bp, Homo sapiens
tatacacagacagactg

SEQ ID NO: 10019624 - DNA, 17 bp, Homo sapiens
tatacacagacagactg

SEQ ID NO: 10019625 - DNA, 22 bp, Homo sapiens
tatacacacctccaaagcagga

SEQ ID NO: 10019626 - DNA, 22 bp, Homo sapiens
tatacacatatcttctaggcct

SEQ ID NO: 10019627 - DNA, 22 bp, Homo sapiens
tatacacatatcttctaggcct

SEQ ID NO: 10019628 - DNA, 22 bp, Homo sapiens
tatacacatcctccaaagatag

SEQ ID NO: 10019629 - DNA, 23 bp, Homo sapiens
tatacacatgtggcagtatagtg

SEQ ID NO: 10019630 - DNA, 22 bp, Homo sapiens
tatacacatcctccaaagatag

SEQ ID NO: 10019631 - DNA, 22 bp, Homo sapiens
tatacacatcctccaaagatag

SEQ ID NO: 10019632 - DNA, 22 bp, Homo sapiens
tatacacatcctccaaagatag

SEQ ID NO: 10019633 - DNA, 22 bp, Homo sapiens
tatacacatttttacctatagt

SEQ ID NO: 10019634 - DNA, 22 bp, Homo sapiens
tatacacatttttacctatagt

SEQ ID NO: 10019635 - DNA, 23 bp, Homo sapiens
tatacacatgtggcagtatagtg

SEQ ID NO: 10019636 - DNA, 23 bp, Homo sapiens
tatacacatgtggcagtatagtg

SEQ ID NO: 10019637 - DNA, 22 bp, Homo sapiens
tatacacattacagtttcagga

SEQ ID NO: 10019638 - DNA, 22 bp, Homo sapiens
tatacacatgtgtgtattcata

SEQ ID NO: 10019639 - DNA, 20 bp, Homo sapiens
tataaattcagagctttggt

SEQ ID NO: 10019640 - DNA, 22 bp, Homo sapiens
tataaattattaggctgctaaa

SEQ ID NO: 10019641 - DNA, 22 bp, Homo sapiens
tataaattattaggctgctaaa

SEQ ID NO: 10019642 - DNA, 22 bp, Homo sapiens
tataaattattaggctgctaaa

SEQ ID NO: 10019643 - DNA, 22 bp, Homo sapiens
tataacaccatgttctacagat

SEQ ID NO: 10019644 - DNA, 20 bp, Homo sapiens
tataaattcagagctttggt

SEQ ID NO: 10019645 - DNA, 20 bp, Homo sapiens
tataaattcagagctttggt

SEQ ID NO: 10019646 - DNA, 20 bp, Homo sapiens
tataaattcagagctttggt

SEQ ID NO: 10019647 - DNA, 22 bp, Homo sapiens
tataacagtttaggtggtgtca

SEQ ID NO: 10019648 - DNA, 22 bp, Homo sapiens
tataacaccatgttctacagat

SEQ ID NO: 10019649 - DNA, 22 bp, Homo sapiens
tataacactcagaaagaatcat

SEQ ID NO: 10019650 - DNA, 22 bp, Homo sapiens
tataaatgccaggactttagat

SEQ ID NO: 10019651 - DNA, 22 bp, Homo sapiens
tataaatgccaggactttagat

SEQ ID NO: 10019652 - DNA, 22 bp, Homo sapiens
tataaattaatgtgcccatgag

SEQ ID NO: 10019653 - DNA, 22 bp, Homo sapiens
tataaatgcacttttgaaatat

SEQ ID NO: 10019654 - DNA, 22 bp, Homo sapiens
tataaatgcacttttgaaatat

SEQ ID NO: 10019655 - DNA, 22 bp, Homo sapiens
tataaatgccaggactttagat

SEQ ID NO: 10019656 - DNA, 22 bp, Homo sapiens
tataaagtttcgaaagatgtat

SEQ ID NO: 10019657 - DNA, 22 bp, Homo sapiens
tataaatgcacttttgaaatat

SEQ ID NO: 10019658 - DNA, 22 bp, Homo sapiens
tataaatgcacttttgaaatat

SEQ ID NO: 10019659 - DNA, 22 bp, Homo sapiens
tataaagtttcgaaagatgtat

SEQ ID NO: 10019660 - DNA, 22 bp, Homo sapiens
tataaagtttcgaaagatgtat

SEQ ID NO: 10019661 - DNA, 22 bp, Homo sapiens
taggtcagaacaagcagtatcg

SEQ ID NO: 10019662 - DNA, 21 bp, Homo sapiens
taggtatttctatcatgtctc

SEQ ID NO: 10019663 - DNA, 22 bp, Homo sapiens
taggggtgtttcgagagaggtt

SEQ ID NO: 10019664 - DNA, 22 bp, Homo sapiens
taggggtgaggccaggcatcag

SEQ ID NO: 10019665 - DNA, 22 bp, Homo sapiens
taggtctgatttccattcagtc

SEQ ID NO: 10019666 - DNA, 22 bp, Homo sapiens
taggtgagtttggggaagatag

SEQ ID NO: 10019667 - DNA, 22 bp, Homo sapiens
taggtgtctgctcttatttaac

SEQ ID NO: 10019668 - DNA, 22 bp, Homo sapiens
tagccccagctactcggaagct

SEQ ID NO: 10019669 - DNA, 22 bp, Homo sapiens
tagcccctgcctttgaacctgg

SEQ ID NO: 10019670 - DNA, 22 bp, Homo sapiens
tagcccagcttggcctatttct

SEQ ID NO: 10019671 - DNA, 22 bp, Homo sapiens
tagcccagctcaaatgaccggt

SEQ ID NO: 10019672 - DNA, 22 bp, Homo sapiens
tagcccaggctggagggcagtg

SEQ ID NO: 10019673 - DNA, 22 bp, Homo sapiens
tagcccagcatgagcagagctg

SEQ ID NO: 10019674 - DNA, 22 bp, Homo sapiens
tagcagctccatttctctggca

SEQ ID NO: 10019675 - DNA, 22 bp, Homo sapiens
tagcagctcacagcctcccatt

SEQ ID NO: 10019676 - DNA, 22 bp, Homo sapiens
tagcagctatgccattttgaca

SEQ ID NO: 10019677 - DNA, 22 bp, Homo sapiens
tagcagctcactaactctgcgt

SEQ ID NO: 10019678 - DNA, 22 bp, Homo sapiens
tagctgaagggcatttaataaa

SEQ ID NO: 10019679 - DNA, 22 bp, Homo sapiens
tagctgttttttgtgaggaaat

SEQ ID NO: 10019680 - DNA, 22 bp, Homo sapiens
tagctgttggcttacatctgtt

SEQ ID NO: 10019681 - DNA, 22 bp, Homo sapiens
tagctgttgcaataaacagttc

SEQ ID NO: 10019682 - DNA, 22 bp, Homo sapiens
tagctgttcccagctctgtgta

SEQ ID NO: 10019683 - DNA, 22 bp, Homo sapiens
tagctgaatgtgaccttaaaga

SEQ ID NO: 10019684 - DNA, 22 bp, Homo sapiens
tagctgaatgtgaccttaaaga

SEQ ID NO: 10019685 - DNA, 22 bp, Homo sapiens
tagcgaggtgtttctaggactg

SEQ ID NO: 10019686 - DNA, 22 bp, Homo sapiens
tagctcctggtgagcctactct

SEQ ID NO: 10019687 - DNA, 22 bp, Homo sapiens
tagccgggtgttgtgtcatgca

SEQ ID NO: 10019688 - DNA, 22 bp, Homo sapiens
tagccgggtgtggtggaactcc

SEQ ID NO: 10019689 - DNA, 22 bp, Homo sapiens
tagccgggtgtggtggaactcc

SEQ ID NO: 10019690 - DNA, 22 bp, Homo sapiens
tagccgggtgttgtgtcatgca

SEQ ID NO: 10019691 - DNA, 19 bp, Homo sapiens
tagctctgtcttattccaa

SEQ ID NO: 10019692 - DNA, 22 bp, Homo sapiens
tagctctgtgctctggatctgt

SEQ ID NO: 10019693 - DNA, 22 bp, Homo sapiens
tagctctggagtcttctcagaa

SEQ ID NO: 10019694 - DNA, 22 bp, Homo sapiens
tagctctggcattctttccaaa

SEQ ID NO: 10019695 - DNA, 22 bp, Homo sapiens
tagcagcatgtaagtgagtaga

SEQ ID NO: 10019696 - DNA, 22 bp, Homo sapiens
tagcagcatcctgtggtgatgg

SEQ ID NO: 10019697 - DNA, 22 bp, Homo sapiens
tagcagcatgtaagtgagtaga

SEQ ID NO: 10019698 - DNA, 22 bp, Homo sapiens
tagcagcattaattccatttgc

SEQ ID NO: 10019699 - DNA, 23 bp, Homo sapiens
tagcagcatttttagcctctgtc

SEQ ID NO: 10019700 - DNA, 22 bp, Homo sapiens
tagcagcatttttgtagagtat

SEQ ID NO: 10019701 - DNA, 22 bp, Homo sapiens
tagcagcgactaatgaataagt

SEQ ID NO: 10019702 - DNA, 22 bp, Homo sapiens
tagcagctacctggctaagagt

SEQ ID NO: 10019703 - DNA, 22 bp, Homo sapiens
tagcagctacctggctaagagt

SEQ ID NO: 10019704 - DNA, 22 bp, Homo sapiens
tagcagcagtggtgtatttaga

SEQ ID NO: 10019705 - DNA, 17 bp, Homo sapiens
tagcagcagtaattgtg

SEQ ID NO: 10019706 - DNA, 22 bp, Homo sapiens
tagcagagtagtgcctccagat

SEQ ID NO: 10019707 - DNA, 22 bp, Homo sapiens
tagcagaggaaaagagaacatt

SEQ ID NO: 10019708 - DNA, 22 bp, Homo sapiens
tagcagaggaaatccagagtaa

SEQ ID NO: 10019709 - DNA, 19 bp, Homo sapiens
tagcagagatgactccagc

SEQ ID NO: 10019710 - DNA, 19 bp, Homo sapiens
tagcagagatgactccagc

SEQ ID NO: 10019711 - DNA, 22 bp, Homo sapiens
tagcagagaggggacagtggca

SEQ ID NO: 10019712 - DNA, 22 bp, Homo sapiens
tagcagaagttgcaaactaggg

SEQ ID NO: 10019713 - DNA, 22 bp, Homo sapiens
tagcagaagttgcaaactaggg

SEQ ID NO: 10019714 - DNA, 22 bp, Homo sapiens
tagcagaagaacaacatgatct

SEQ ID NO: 10019715 - DNA, 22 bp, Homo sapiens
tagcagaaccagtcagtgagcc

SEQ ID NO: 10019716 - DNA, 22 bp, Homo sapiens
tagaggtgttgttgatatagaa

SEQ ID NO: 10019717 - DNA, 22 bp, Homo sapiens
tagcagaaccagtcagtgagcc

SEQ ID NO: 10019718 - DNA, 22 bp, Homo sapiens
tagaggtgagccatcaaggggc

SEQ ID NO: 10019719 - DNA, 20 bp, Homo sapiens
tagaggtgggatttgggttt

SEQ ID NO: 10019720 - DNA, 22 bp, Homo sapiens
tagaggtgttcattctctccat

SEQ ID NO: 10019721 - DNA, 22 bp, Homo sapiens
tagaggtgtcactttgggaagt

SEQ ID NO: 10019722 - DNA, 22 bp, Homo sapiens
tagaggtgttgacgccaaggta

SEQ ID NO: 10019723 - DNA, 22 bp, Homo sapiens
tagaggtgttcattctctccat

SEQ ID NO: 10019724 - DNA, 22 bp, Homo sapiens
tagagggttattaggacagaag

SEQ ID NO: 10019725 - DNA, 22 bp, Homo sapiens
tagaggtagagttacattagtc

SEQ ID NO: 10019726 - DNA, 22 bp, Homo sapiens
tagaggtgagatattttatttt

SEQ ID NO: 10019727 - DNA, 22 bp, Homo sapiens
tagaggtgagaggaactttgga

SEQ ID NO: 10019728 - DNA, 22 bp, Homo sapiens
tagaggtgagatattttatttt

SEQ ID NO: 10019729 - DNA, 22 bp, Homo sapiens
tagaggtgagattgtggtgctg

SEQ ID NO: 10019730 - DNA, 22 bp, Homo sapiens
tagaggtgagccatcaaggggc

SEQ ID NO: 10019731 - DNA, 22 bp, Homo sapiens
tagaggtgacactgagaccata

SEQ ID NO: 10019732 - DNA, 22 bp, Homo sapiens
tagaggtgagacttcagtgaca

SEQ ID NO: 10019733 - DNA, 22 bp, Homo sapiens
tagggagaggaagcaggccgct

SEQ ID NO: 10019734 - DNA, 22 bp, Homo sapiens
tagggatgatggagcctatgta

SEQ ID NO: 10019735 - DNA, 22 bp, Homo sapiens
tagggatgagccagtgggtagt

SEQ ID NO: 10019736 - DNA, 22 bp, Homo sapiens
tagggcaatatttcccagaaaa

SEQ ID NO: 10019737 - DNA, 22 bp, Homo sapiens
tagggcaatatttcccagaaaa

SEQ ID NO: 10019738 - DNA, 22 bp, Homo sapiens
taggctgggcattctggccagg

SEQ ID NO: 10019739 - DNA, 22 bp, Homo sapiens
taggctgggagcctgaggctag

SEQ ID NO: 10019740 - DNA, 22 bp, Homo sapiens
taggctgggcattctggccagg

SEQ ID NO: 10019741 - DNA, 22 bp, Homo sapiens
tagggactagtttcaaggctaa

SEQ ID NO: 10019742 - DNA, 22 bp, Homo sapiens
tagggagaaacaccaatttatt

SEQ ID NO: 10019743 - DNA, 22 bp, Homo sapiens
tagggactgtgtgagggacttg

SEQ ID NO: 10019744 - DNA, 22 bp, Homo sapiens
taggcaatgttctaaggaatga

SEQ ID NO: 10019745 - DNA, 21 bp, Homo sapiens
taggcaatttgttgtcatagc

SEQ ID NO: 10019746 - DNA, 22 bp, Homo sapiens
taggcacaaaatgaaaatggca

SEQ ID NO: 10019747 - DNA, 22 bp, Homo sapiens
taggcacaagaccatgcaaagg

SEQ ID NO: 10019748 - DNA, 22 bp, Homo sapiens
taggattttttggattctggat

SEQ ID NO: 10019749 - DNA, 22 bp, Homo sapiens
taggcaacatgtcgaatactgt

SEQ ID NO: 10019750 - DNA, 22 bp, Homo sapiens
taggatttattctacaatattg

SEQ ID NO: 10019751 - DNA, 22 bp, Homo sapiens
taggatttggctttagtcaggt

SEQ ID NO: 10019752 - DNA, 22 bp, Homo sapiens
taggcaagtggaccagaggttt

SEQ ID NO: 10019753 - DNA, 22 bp, Homo sapiens
tagcttttaagtcataacctca

SEQ ID NO: 10019754 - DNA, 16 bp, Homo sapiens
tagctttttcctatgt

SEQ ID NO: 10019755 - DNA, 22 bp, Homo sapiens
tagcttttatccactgcttttg

SEQ ID NO: 10019756 - DNA, 22 bp, Homo sapiens
tagcttttagtacttaatggct

SEQ ID NO: 10019757 - DNA, 22 bp, Homo sapiens
tagctttaggcacgtttgaatt

SEQ ID NO: 10019758 - DNA, 22 bp, Homo sapiens
taggatttactttgacaatatt

SEQ ID NO: 10019759 - DNA, 22 bp, Homo sapiens
taggatttaggctttaacatct

SEQ ID NO: 10019760 - DNA, 22 bp, Homo sapiens
taggatggtcacagagatggac

SEQ ID NO: 10019761 - DNA, 22 bp, Homo sapiens
taggaaacaaagtggatgaaat

SEQ ID NO: 10019762 - DNA, 22 bp, Homo sapiens
taggaaacagtgcatatatagt

SEQ ID NO: 10019763 - DNA, 22 bp, Homo sapiens
tagaaatgcagtgtactgtgtc

SEQ ID NO: 10019764 - DNA, 22 bp, Homo sapiens
tagaaatgcagtgtactgtgtc

SEQ ID NO: 10019765 - DNA, 22 bp, Homo sapiens
tagaaatgcccagattctgcta

SEQ ID NO: 10019766 - DNA, 22 bp, Homo sapiens
tagaaatggagaacagattaat

SEQ ID NO: 10019767 - DNA, 22 bp, Homo sapiens
tagaaatgagccatggtagagc

SEQ ID NO: 10019768 - DNA, 22 bp, Homo sapiens
tagaaatgagccatggtagagc

SEQ ID NO: 10019769 - DNA, 22 bp, Homo sapiens
tagaaatgattgagctgtaata

SEQ ID NO: 10019770 - DNA, 22 bp, Homo sapiens
tagaaatgattgagctgtaata

SEQ ID NO: 10019771 - DNA, 22 bp, Homo sapiens
tagaaatgaatgtttaaaagtc

SEQ ID NO: 10019772 - DNA, 22 bp, Homo sapiens
tagaaatcttgttactatgtgt

SEQ ID NO: 10019773 - DNA, 22 bp, Homo sapiens
tagaaagtgaaggttaattaat

SEQ ID NO: 10019774 - DNA, 22 bp, Homo sapiens
tagaaagtggttgagagtttag

SEQ ID NO: 10019775 - DNA, 22 bp, Homo sapiens
tagaaataaatctgcagctggg

SEQ ID NO: 10019776 - DNA, 22 bp, Homo sapiens
tagaaatctacttagactttct

SEQ ID NO: 10019777 - DNA, 22 bp, Homo sapiens
tagaaatccccagtctcatagt

SEQ ID NO: 10019778 - DNA, 22 bp, Homo sapiens
tagaaatcaggtttttagaaag

SEQ ID NO: 10019779 - DNA, 22 bp, Homo sapiens
tagaaatcatttagaagtattg

SEQ ID NO: 10019780 - DNA, 22 bp, Homo sapiens
tagaaaggatattgagatgaat

SEQ ID NO: 10019781 - DNA, 22 bp, Homo sapiens
tagaaagcttggggtgtttaaa

SEQ ID NO: 10019782 - DNA, 22 bp, Homo sapiens
tagaaagcgttaaatctacaga

SEQ ID NO: 10019783 - DNA, 22 bp, Homo sapiens
tagaaagtactaaatttaactg

SEQ ID NO: 10019784 - DNA, 22 bp, Homo sapiens
tagaaagtaaatcagttttatt

SEQ ID NO: 10019785 - DNA, 22 bp, Homo sapiens
tagaaagtaaacacgaagtctc

SEQ ID NO: 10019786 - DNA, 22 bp, Homo sapiens
tagaaagtagccacttacagag

SEQ ID NO: 10019787 - DNA, 22 bp, Homo sapiens
tagaaagtagggaaggtaggat

SEQ ID NO: 10019788 - DNA, 22 bp, Homo sapiens
tagaaagtagccacttacagag

SEQ ID NO: 10019789 - DNA, 22 bp, Homo sapiens
tagaaagtcaaaacactgtgtt

SEQ ID NO: 10019790 - DNA, 21 bp, Homo sapiens
tagaaagtcaaagctatcagc

SEQ ID NO: 10019791 - DNA, 22 bp, Homo sapiens
tagaaagtcatgaattacacca

SEQ ID NO: 10019792 - DNA, 22 bp, Homo sapiens
tagaatgtagtgcttcaagatt

SEQ ID NO: 10019793 - DNA, 22 bp, Homo sapiens
tagaatgagaaagtgtagcagg

SEQ ID NO: 10019794 - DNA, 22 bp, Homo sapiens
tagaatgacctcctcttagctt

SEQ ID NO: 10019795 - DNA, 22 bp, Homo sapiens
tagaatgagaaagtgtagcagg

SEQ ID NO: 10019796 - DNA, 21 bp, Homo sapiens
tagaatgctattgtcttttct

SEQ ID NO: 10019797 - DNA, 19 bp, Homo sapiens
tagaatgcccacttaaaaa

SEQ ID NO: 10019798 - DNA, 22 bp, Homo sapiens
tagaatctttaaaattcatagt

SEQ ID NO: 10019799 - DNA, 22 bp, Homo sapiens
tagaatctttaaaattcatagt

SEQ ID NO: 10019800 - DNA, 20 bp, Homo sapiens
tagaatctgttctgattcat

SEQ ID NO: 10019801 - DNA, 22 bp, Homo sapiens
tagaatgtggaggtaacagact

SEQ ID NO: 10019802 - DNA, 22 bp, Homo sapiens
tagaattcatgttactgttagc

SEQ ID NO: 10019803 - DNA, 22 bp, Homo sapiens
tagaattcaagattcaacaggc

SEQ ID NO: 10019804 - DNA, 22 bp, Homo sapiens
tagaattttctgctttgatagt

SEQ ID NO: 10019805 - DNA, 22 bp, Homo sapiens
tagacaaaagggggcagatatg

SEQ ID NO: 10019806 - DNA, 22 bp, Homo sapiens
tagacaaaagggggcagatatg

SEQ ID NO: 10019807 - DNA, 22 bp, Homo sapiens
tagacaaactgatacttggcga

SEQ ID NO: 10019808 - DNA, 22 bp, Homo sapiens
tagacaaactgatacttggcga

SEQ ID NO: 10019809 - DNA, 22 bp, Homo sapiens
tagaattttctgctttgatagt

SEQ ID NO: 10019810 - DNA, 22 bp, Homo sapiens
tagaattttctgctttgatagt

SEQ ID NO: 10019811 - DNA, 22 bp, Homo sapiens
tagacacaggggaatgtgaggt

SEQ ID NO: 10019812 - DNA, 22 bp, Homo sapiens
tagacacaggggaatgtgaggt

SEQ ID NO: 10019813 - DNA, 22 bp, Homo sapiens
tagacaatatttgaaagtagtg

SEQ ID NO: 10019814 - DNA, 22 bp, Homo sapiens
tagacaatgccatcttgtggtt

SEQ ID NO: 10019815 - DNA, 22 bp, Homo sapiens
tagacacaaatctcagtgacac

SEQ ID NO: 10019816 - DNA, 22 bp, Homo sapiens
tagacagatttaaaggaatgga

SEQ ID NO: 10019817 - DNA, 22 bp, Homo sapiens
tagacagatttaaaggaatgga

SEQ ID NO: 10019818 - DNA, 22 bp, Homo sapiens
tagaggcagaagaaattgacaa

SEQ ID NO: 10019819 - DNA, 22 bp, Homo sapiens
tagacacatcaagtatagttaa

SEQ ID NO: 10019820 - DNA, 22 bp, Homo sapiens
tagacacatcttcatccacaat

SEQ ID NO: 10019821 - DNA, 22 bp, Homo sapiens
tagaggcttctactgctcactt

SEQ ID NO: 10019822 - DNA, 22 bp, Homo sapiens
tagaggctgggaattattttca

SEQ ID NO: 10019823 - DNA, 22 bp, Homo sapiens
tagaggctttcagcggtaggtc

SEQ ID NO: 10019824 - DNA, 22 bp, Homo sapiens
tagaggcttctactgctcactt

SEQ ID NO: 10019825 - DNA, 22 bp, Homo sapiens
tagagggcaggagtgtcctact

SEQ ID NO: 10019826 - DNA, 22 bp, Homo sapiens
tagagggccagctggacagcga

SEQ ID NO: 10019827 - DNA, 22 bp, Homo sapiens
tagaggcattgcttaatttcag

SEQ ID NO: 10019828 - DNA, 22 bp, Homo sapiens
tagaggcattaatgaataaaca

SEQ ID NO: 10019829 - DNA, 22 bp, Homo sapiens
tagaggctactagaggcacctg

SEQ ID NO: 10019830 - DNA, 22 bp, Homo sapiens
tagaggcctgaaagaatgatca

SEQ ID NO: 10019831 - DNA, 22 bp, Homo sapiens
tagaggcctgaaagaatgatca

SEQ ID NO: 10019832 - DNA, 22 bp, Homo sapiens
tagaggctcctgtgtgtaggtt

SEQ ID NO: 10019833 - DNA, 22 bp, Homo sapiens
tagaggctcttcattgcagtag

SEQ ID NO: 10019834 - DNA, 22 bp, Homo sapiens
tacattttctaggggaccaaga

SEQ ID NO: 10019835 - DNA, 22 bp, Homo sapiens
taccaaaaccaagccattatct

SEQ ID NO: 10019836 - DNA, 22 bp, Homo sapiens
taccaaaaccaagccattatct

SEQ ID NO: 10019837 - DNA, 22 bp, Homo sapiens
taccaaaagcttgtttcataca

SEQ ID NO: 10019838 - DNA, 22 bp, Homo sapiens
taccaaaagcttgtttcataca

SEQ ID NO: 10019839 - DNA, 22 bp, Homo sapiens
tactttggggacaatatggaat

SEQ ID NO: 10019840 - DNA, 22 bp, Homo sapiens
tactttggggacaatatggaat

SEQ ID NO: 10019841 - DNA, 22 bp, Homo sapiens
tactttgggtttagaataaact

SEQ ID NO: 10019842 - DNA, 22 bp, Homo sapiens
tactttggtatcaaactaaaac

SEQ ID NO: 10019843 - DNA, 22 bp, Homo sapiens
tactttggatccttacaatagc

SEQ ID NO: 10019844 - DNA, 22 bp, Homo sapiens
tacttttagcctatttgattct

SEQ ID NO: 10019845 - DNA, 22 bp, Homo sapiens
tacttttaaaattcacaggtat

SEQ ID NO: 10019846 - DNA, 22 bp, Homo sapiens
tactttggttgaatatgtaatg

SEQ ID NO: 10019847 - DNA, 22 bp, Homo sapiens
tactttggttgaatatgtaatg

SEQ ID NO: 10019848 - DNA, 22 bp, Homo sapiens
tactttttagcacagtgtgtgc

SEQ ID NO: 10019849 - DNA, 22 bp, Homo sapiens
tactttttatgataagaactga

SEQ ID NO: 10019850 - DNA, 22 bp, Homo sapiens
tactttttatgataagaactga

SEQ ID NO: 10019851 - DNA, 22 bp, Homo sapiens
tacttttatgtgatgaaatctg

SEQ ID NO: 10019852 - DNA, 22 bp, Homo sapiens
tacttttcctggaaccactgct

SEQ ID NO: 10019853 - DNA, 22 bp, Homo sapiens
tactttttgtctctttgaatgt

SEQ ID NO: 10019854 - DNA, 22 bp, Homo sapiens
tagaaaactaatacatgcttga

SEQ ID NO: 10019855 - DNA, 22 bp, Homo sapiens
tagaaaactaatacatgcttga

SEQ ID NO: 10019856 - DNA, 22 bp, Homo sapiens
tactttttgtctctttgaatgt

SEQ ID NO: 10019857 - DNA, 22 bp, Homo sapiens
tagaaaagaagtctggccggga

SEQ ID NO: 10019858 - DNA, 22 bp, Homo sapiens
tagaaaagaagtctggccggga

SEQ ID NO: 10019859 - DNA, 22 bp, Homo sapiens
tagaaaagaattttatttgata

SEQ ID NO: 10019860 - DNA, 22 bp, Homo sapiens
tagaaaagaattttatttgata

SEQ ID NO: 10019861 - DNA, 22 bp, Homo sapiens
tagaaaagaattttatttgata

SEQ ID NO: 10019862 - DNA, 22 bp, Homo sapiens
tagaaaagaattttatttgata

SEQ ID NO: 10019863 - DNA, 22 bp, Homo sapiens
tagaaaagataacattctgtgc

SEQ ID NO: 10019864 - DNA, 22 bp, Homo sapiens
tagaaaagataacattctgtgc

SEQ ID NO: 10019865 - DNA, 22 bp, Homo sapiens
tagaaaagataacattctgtgc

SEQ ID NO: 10019866 - DNA, 22 bp, Homo sapiens
tagaaaagataacattctgtgc

SEQ ID NO: 10019867 - DNA, 22 bp, Homo sapiens
tagaaacagagcaggtggccca

SEQ ID NO: 10019868 - DNA, 22 bp, Homo sapiens
tagaaacagagagatatgcccc

SEQ ID NO: 10019869 - DNA, 22 bp, Homo sapiens
tagaaacagatgtttttgaaga

SEQ ID NO: 10019870 - DNA, 22 bp, Homo sapiens
tagaaacagatgtttttgaaga

SEQ ID NO: 10019871 - DNA, 22 bp, Homo sapiens
tagaaacagatgtttttgaaga

SEQ ID NO: 10019872 - DNA, 22 bp, Homo sapiens
tagaaacagcatatattagccc

SEQ ID NO: 10019873 - DNA, 22 bp, Homo sapiens
tagaaacagcatatattagccc

SEQ ID NO: 10019874 - DNA, 22 bp, Homo sapiens
tagaaacatataggatggcagg

SEQ ID NO: 10019875 - DNA, 22 bp, Homo sapiens
tagaaacatatgtttgagacat

SEQ ID NO: 10019876 - DNA, 22 bp, Homo sapiens
tagaaacacagagagacccatg

SEQ ID NO: 10019877 - DNA, 22 bp, Homo sapiens
tagaaacaatgacatgcttgta

SEQ ID NO: 10019878 - DNA, 22 bp, Homo sapiens
tagaaacaatgacatgcttgta

SEQ ID NO: 10019879 - DNA, 22 bp, Homo sapiens
tagaaaagataacattctgtgc

SEQ ID NO: 10019880 - DNA, 22 bp, Homo sapiens
tagaaacacagatctggtgtca

SEQ ID NO: 10019881 - DNA, 22 bp, Homo sapiens
tagaaacacagagagacccatg

SEQ ID NO: 10019882 - DNA, 22 bp, Homo sapiens
tagaaacagaaaactgtaatag

SEQ ID NO: 10019883 - DNA, 22 bp, Homo sapiens
tagaaacagaatatgagtgaga

SEQ ID NO: 10019884 - DNA, 22 bp, Homo sapiens
tagaaacatatgtttgagacat

SEQ ID NO: 10019885 - DNA, 22 bp, Homo sapiens
tagaaacatcagctaaccaaaa

SEQ ID NO: 10019886 - DNA, 22 bp, Homo sapiens
tagaaacatcagctaaccaaaa

SEQ ID NO: 10019887 - DNA, 22 bp, Homo sapiens
tagaaacatcagctaaccaaaa

SEQ ID NO: 10019888 - DNA, 22 bp, Homo sapiens
tagaaacatcagctaaccaaaa

SEQ ID NO: 10019889 - DNA, 22 bp, Homo sapiens
tagaaacatcagctaaccaaaa

SEQ ID NO: 10019890 - DNA, 22 bp, Homo sapiens
tagaaacatgttctgttctgtt

SEQ ID NO: 10019891 - DNA, 22 bp, Homo sapiens
tagaaacatgagagaaactctt

SEQ ID NO: 10019892 - DNA, 22 bp, Homo sapiens
tagaaacatgagagaaactctt

SEQ ID NO: 10019893 - DNA, 22 bp, Homo sapiens
tagaaacattcagttgcagtcc

SEQ ID NO: 10019894 - DNA, 22 bp, Homo sapiens
tagaaaccatctcactgctcag

SEQ ID NO: 10019895 - DNA, 22 bp, Homo sapiens
tagaaacctcagggaaatcttt

SEQ ID NO: 10019896 - DNA, 22 bp, Homo sapiens
tagaaactagattgatagcgga

SEQ ID NO: 10019897 - DNA, 22 bp, Homo sapiens
tagaaactactagaataagaga

SEQ ID NO: 10019898 - DNA, 22 bp, Homo sapiens
tagaaactgatagtcttgtgct

SEQ ID NO: 10019899 - DNA, 22 bp, Homo sapiens
tagaaactgatagtcttgtgct

SEQ ID NO: 10019900 - DNA, 22 bp, Homo sapiens
tagaaactctcacgagtgaaac

SEQ ID NO: 10019901 - DNA, 22 bp, Homo sapiens
tagaaactagattgatagcgga

SEQ ID NO: 10019902 - DNA, 22 bp, Homo sapiens
tagaaactcacgttatcattgc

SEQ ID NO: 10019903 - DNA, 22 bp, Homo sapiens
tagaaactctcaatctgggatg

SEQ ID NO: 10019904 - DNA, 22 bp, Homo sapiens
tagaaactcaggatactcttcc

SEQ ID NO: 10019905 - DNA, 22 bp, Homo sapiens
tagaaactcacgttatcattgc

SEQ ID NO: 10019906 - DNA, 22 bp, Homo sapiens
tagaaactcacgttatcattgc

SEQ ID NO: 10019907 - DNA, 22 bp, Homo sapiens
taaattatgttccatgtccttt

SEQ ID NO: 10019908 - DNA, 22 bp, Homo sapiens
taaattcactcctggtagacct

SEQ ID NO: 10019909 - DNA, 22 bp, Homo sapiens
taaattatgttccatgtccttt

SEQ ID NO: 10019910 - DNA, 22 bp, Homo sapiens
taaattatgttccatgtccttt

SEQ ID NO: 10019911 - DNA, 22 bp, Homo sapiens
taaattatgtcacatgactctg

SEQ ID NO: 10019912 - DNA, 22 bp, Homo sapiens
taaattagggactttagttaat

SEQ ID NO: 10019913 - DNA, 20 bp, Homo sapiens
taaattagccttgaagatta

SEQ ID NO: 10019914 - DNA, 20 bp, Homo sapiens
taaattagccttgaagatta

SEQ ID NO: 10019915 - DNA, 20 bp, Homo sapiens
taaattagccttgaagatta

SEQ ID NO: 10019916 - DNA, 22 bp, Homo sapiens
taaattatggctggcagagcag

SEQ ID NO: 10019917 - DNA, 22 bp, Homo sapiens
taaattaaagattggagaagga

SEQ ID NO: 10019918 - DNA, 22 bp, Homo sapiens
taaagtgtgcatggtcaaatat

SEQ ID NO: 10019919 - DNA, 22 bp, Homo sapiens
taaattaaagattggagaagga

SEQ ID NO: 10019920 - DNA, 22 bp, Homo sapiens
taaagtgcttatgataaccaag

SEQ ID NO: 10019921 - DNA, 22 bp, Homo sapiens
taaagtgcttcctaacccagag

SEQ ID NO: 10019922 - DNA, 22 bp, Homo sapiens
taaattactcaatgcacataaa

SEQ ID NO: 10019923 - DNA, 22 bp, Homo sapiens
taaattactcaatgcacataaa

SEQ ID NO: 10019924 - DNA, 22 bp, Homo sapiens
taaattaaagattggagaagga

SEQ ID NO: 10019925 - DNA, 22 bp, Homo sapiens
taaattaaagattggagaagga

SEQ ID NO: 10019926 - DNA, 22 bp, Homo sapiens
taaaggttagtagcagggaaac

SEQ ID NO: 10019927 - DNA, 22 bp, Homo sapiens
taaaggttataaaggttagggg

SEQ ID NO: 10019928 - DNA, 22 bp, Homo sapiens
taaaggtagtgtgacatattgt

SEQ ID NO: 10019929 - DNA, 22 bp, Homo sapiens
taaaggtagcatgaaactgcaa

SEQ ID NO: 10019930 - DNA, 22 bp, Homo sapiens
taaaggtaacatgaactgcttt

SEQ ID NO: 10019931 - DNA, 22 bp, Homo sapiens
taaaggtttattcaacaaaata

SEQ ID NO: 10019932 - DNA, 22 bp, Homo sapiens
taaaggttgaaaactgactgcc

SEQ ID NO: 10019933 - DNA, 22 bp, Homo sapiens
taaaggttattgcactggagtt

SEQ ID NO: 10019934 - DNA, 22 bp, Homo sapiens
taaagtaatccttcataaggag

SEQ ID NO: 10019935 - DNA, 22 bp, Homo sapiens
taaagtaatccttcataaggag

SEQ ID NO: 10019936 - DNA, 22 bp, Homo sapiens
taaagtataagcattggagtat

SEQ ID NO: 10019937 - DNA, 22 bp, Homo sapiens
taaagtagcgcctaactaatgt

SEQ ID NO: 10019938 - DNA, 22 bp, Homo sapiens
taaagtgctcataaaaatggat

SEQ ID NO: 10019939 - DNA, 23 bp, Homo sapiens
taaagtgctgatggtgagggagc

SEQ ID NO: 10019940 - DNA, 22 bp, Homo sapiens
taaagtgcgacccagtccccag

SEQ ID NO: 10019941 - DNA, 22 bp, Homo sapiens
taaagtgcctcaggtcctgggt

SEQ ID NO: 10019942 - DNA, 22 bp, Homo sapiens
taaagtgctggatttgagtaaa

SEQ ID NO: 10019943 - DNA, 22 bp, Homo sapiens
taaagtgctgggattataggcc

SEQ ID NO: 10019944 - DNA, 22 bp, Homo sapiens
taaagtatattttttctcaata

SEQ ID NO: 10019945 - DNA, 22 bp, Homo sapiens
taaagtataagcattggagtat

SEQ ID NO: 10019946 - DNA, 22 bp, Homo sapiens
taaagtatccagttattcttct

SEQ ID NO: 10019947 - DNA, 22 bp, Homo sapiens
taaagtatattttttctcaata

SEQ ID NO: 10019948 - DNA, 22 bp, Homo sapiens
taaagtgcccagggaaagcggg

SEQ ID NO: 10019949 - DNA, 22 bp, Homo sapiens
taaagtatccagttattcttct

SEQ ID NO: 10019950 - DNA, 22 bp, Homo sapiens
taaagtatccagttattcttct

SEQ ID NO: 10019951 - DNA, 22 bp, Homo sapiens
taaagtatccagttattcttct

SEQ ID NO: 10019952 - DNA, 22 bp, Homo sapiens
taaattcagtgagtaatttctg

SEQ ID NO: 10019953 - DNA, 22 bp, Homo sapiens
taaattgaaaatctacagaaca

SEQ ID NO: 10019954 - DNA, 22 bp, Homo sapiens
taaattgaaaatctacagaaca

SEQ ID NO: 10019955 - DNA, 22 bp, Homo sapiens
taaattgaaaatctacagaaca

SEQ ID NO: 10019956 - DNA, 22 bp, Homo sapiens
taaattctacaacttcaaagat

SEQ ID NO: 10019957 - DNA, 22 bp, Homo sapiens
taaattctacaacttcaaagat

SEQ ID NO: 10019958 - DNA, 22 bp, Homo sapiens
taacctacatgagaactttaaa

SEQ ID NO: 10019959 - DNA, 18 bp, Homo sapiens
taacatgttttcattaag

SEQ ID NO: 10019960 - DNA, 23 bp, Homo sapiens
taaatttcttgattcttatgtga

SEQ ID NO: 10019961 - DNA, 22 bp, Homo sapiens
taaccaaagggcctaaggaatg

SEQ ID NO: 10019962 - DNA, 22 bp, Homo sapiens
taacattaaaagagataattga

SEQ ID NO: 10019963 - DNA, 22 bp, Homo sapiens
taacattacagacaccttgtgt

SEQ ID NO: 10019964 - DNA, 22 bp, Homo sapiens
taactaggattacaagcgtgcg

SEQ ID NO: 10019965 - DNA, 22 bp, Homo sapiens
taactaggattacaagcgtgcg

SEQ ID NO: 10019966 - DNA, 22 bp, Homo sapiens
taactaggattacaagcgtgcg

SEQ ID NO: 10019967 - DNA, 22 bp, Homo sapiens
taactctgaatcctcacagcag

SEQ ID NO: 10019968 - DNA, 22 bp, Homo sapiens
taactgaaaatccctcttctcc

SEQ ID NO: 10019969 - DNA, 22 bp, Homo sapiens
taactgaagctggaagcgctgg

SEQ ID NO: 10019970 - DNA, 22 bp, Homo sapiens
taactgaatgtattacaacaga

SEQ ID NO: 10019971 - DNA, 22 bp, Homo sapiens
taactgaatgtattacaacaga

SEQ ID NO: 10019972 - DNA, 22 bp, Homo sapiens
taacgtttgataacttctgttc

SEQ ID NO: 10019973 - DNA, 22 bp, Homo sapiens
taactacaagggcggtctctgt

SEQ ID NO: 10019974 - DNA, 22 bp, Homo sapiens
taactagaatggctattttgag

SEQ ID NO: 10019975 - DNA, 22 bp, Homo sapiens
taactacatttcactgcaatta

SEQ ID NO: 10019976 - DNA, 22 bp, Homo sapiens
taactacatttcactgcaatta

SEQ ID NO: 10019977 - DNA, 22 bp, Homo sapiens
taactacatttcactgcaatta

SEQ ID NO: 10019978 - DNA, 22 bp, Homo sapiens
taacctgactgctctttagaat

SEQ ID NO: 10019979 - DNA, 22 bp, Homo sapiens
gtttccaaccccaccaaagtgc

SEQ ID NO: 10019980 - DNA, 22 bp, Homo sapiens
gtttcatttacatctgtaggta

SEQ ID NO: 10019981 - DNA, 22 bp, Homo sapiens
gtttccaagatgctgccatcag

SEQ ID NO: 10019982 - DNA, 22 bp, Homo sapiens
gtttccaagtctctcaacaccc

SEQ ID NO: 10019983 - DNA, 22 bp, Homo sapiens
gtttccagagatcatttacata

SEQ ID NO: 10019984 - DNA, 22 bp, Homo sapiens
gtttccaggaagggttgggagg

SEQ ID NO: 10019985 - DNA, 22 bp, Homo sapiens
gtttccagcttgggcccgggga

SEQ ID NO: 10019986 - DNA, 22 bp, Homo sapiens
gtttccagcctcctgggtaaag

SEQ ID NO: 10019987 - DNA, 22 bp, Homo sapiens
gtttccagagtgagggcacttg

SEQ ID NO: 10019988 - DNA, 21 bp, Homo sapiens
gttttcatgatagagtctgta

SEQ ID NO: 10019989 - DNA, 21 bp, Homo sapiens
gttttcatgatagagtctgta

SEQ ID NO: 10019990 - DNA, 22 bp, Homo sapiens
gtttccatgggagaagacagtg

SEQ ID NO: 10019991 - DNA, 22 bp, Homo sapiens
gtttccaggctttggtatggtt

SEQ ID NO: 10019992 - DNA, 22 bp, Homo sapiens
gtttccaggctgggcagcgagc

SEQ ID NO: 10019993 - DNA, 22 bp, Homo sapiens
gttttgtgaggcacccacaggt

SEQ ID NO: 10019994 - DNA, 22 bp, Homo sapiens
gttttgttcatgaacattgggt

SEQ ID NO: 10019995 - DNA, 22 bp, Homo sapiens
gttttgttcatgaacattgggt

SEQ ID NO: 10019996 - DNA, 22 bp, Homo sapiens
gttttgttgctgcagagctcaa

SEQ ID NO: 10019997 - DNA, 22 bp, Homo sapiens
gttttgttcttgtccagggaaa

SEQ ID NO: 10019998 - DNA, 22 bp, Homo sapiens
gttttgttcttgtccagggaaa

SEQ ID NO: 10019999 - DNA, 22 bp, Homo sapiens
gttttgatatatgcatacatta

SEQ ID NO: 10020000 - DNA, 19 bp, Homo sapiens
gttttgcaggcagagggga

SEQ ID NO: 10020001 - DNA, 22 bp, Homo sapiens
gttttgcttctcatgttaagtg

SEQ ID NO: 10020002 - DNA, 22 bp, Homo sapiens
gttttcttcctgcaattggcat

SEQ ID NO: 10020003 - DNA, 22 bp, Homo sapiens
gttttcttcctgcaattggcat

SEQ ID NO: 10020004 - DNA, 22 bp, Homo sapiens
gttttcttcctgcaattggcat

SEQ ID NO: 10020005 - DNA, 22 bp, Homo sapiens
gttttcatgtctattgggcata

SEQ ID NO: 10020006 - DNA, 22 bp, Homo sapiens
gttttcatgtctattgggcata

SEQ ID NO: 10020007 - DNA, 22 bp, Homo sapiens
gttttcattactgctgtgattt

SEQ ID NO: 10020008 - DNA, 22 bp, Homo sapiens
gttttcattactgctgtgattt

SEQ ID NO: 10020009 - DNA, 22 bp, Homo sapiens
gttttctttgaatgcttctaga

SEQ ID NO: 10020010 - DNA, 21 bp, Homo sapiens
gttttctttgatagagggaag

SEQ ID NO: 10020011 - DNA, 22 bp, Homo sapiens
taaacaagctgtctgatattct

SEQ ID NO: 10020012 - DNA, 22 bp, Homo sapiens
taaacaagggttactgagcatg

SEQ ID NO: 10020013 - DNA, 22 bp, Homo sapiens
taaacagaaagcagatgtactt

SEQ ID NO: 10020014 - DNA, 22 bp, Homo sapiens
taaacagaatgcgtaagaagtg

SEQ ID NO: 10020015 - DNA, 22 bp, Homo sapiens
taaacagaatgcgtaagaagtg

SEQ ID NO: 10020016 - DNA, 22 bp, Homo sapiens
taaacactcacttcatagccat

SEQ ID NO: 10020017 - DNA, 22 bp, Homo sapiens
taaaatgtgtttctgtatggtt

SEQ ID NO: 10020018 - DNA, 18 bp, Homo sapiens
taaaattcaaggcagggt

SEQ ID NO: 10020019 - DNA, 22 bp, Homo sapiens
taaaatgtttgcaagagaccag

SEQ ID NO: 10020020 - DNA, 22 bp, Homo sapiens
taaaatgtttgcaagagaccag

SEQ ID NO: 10020021 - DNA, 22 bp, Homo sapiens
taaaatttgtccctgagtgttg

SEQ ID NO: 10020022 - DNA, 22 bp, Homo sapiens
taaaatttgtccctgagtgttg

SEQ ID NO: 10020023 - DNA, 22 bp, Homo sapiens
taaacaagctggactgataagt

SEQ ID NO: 10020024 - DNA, 19 bp, Homo sapiens
taaaatgtctgtggtcagt

SEQ ID NO: 10020025 - DNA, 22 bp, Homo sapiens
taaaatgtagcttctaggctgg

SEQ ID NO: 10020026 - DNA, 22 bp, Homo sapiens
taaaatggtaactttcatttgc

SEQ ID NO: 10020027 - DNA, 22 bp, Homo sapiens
taaaatgccagaccagttcacg

SEQ ID NO: 10020028 - DNA, 22 bp, Homo sapiens
taaaatgccagaccagttcacg

SEQ ID NO: 10020029 - DNA, 22 bp, Homo sapiens
taaaagttttagttgtacataa

SEQ ID NO: 10020030 - DNA, 22 bp, Homo sapiens
taaaagttttagttgtacataa

SEQ ID NO: 10020031 - DNA, 22 bp, Homo sapiens
taaaatagaggatgtcatgcta

SEQ ID NO: 10020032 - DNA, 22 bp, Homo sapiens
taaaatagaggatgtcatgcta

SEQ ID NO: 10020033 - DNA, 22 bp, Homo sapiens
taaaatagaggatgtcatgcta

SEQ ID NO: 10020034 - DNA, 22 bp, Homo sapiens
taaaatagaggatgtcatgcta

SEQ ID NO: 10020035 - DNA, 22 bp, Homo sapiens
taaaatagaggatgtcatgcta

SEQ ID NO: 10020036 - DNA, 22 bp, Homo sapiens
taaaatgcacagcagttgaaag

SEQ ID NO: 10020037 - DNA, 22 bp, Homo sapiens
gtttttatctaatagcagttat

SEQ ID NO: 10020038 - DNA, 22 bp, Homo sapiens
gtttttattgtgtaaatgtggg

SEQ ID NO: 10020039 - DNA, 22 bp, Homo sapiens
taaaagttagctaggacaaagt

SEQ ID NO: 10020040 - DNA, 22 bp, Homo sapiens
gttttgttgctgcagagctcaa

SEQ ID NO: 10020041 - DNA, 22 bp, Homo sapiens
gttttgttgctgcagagctcaa

SEQ ID NO: 10020042 - DNA, 19 bp, Homo sapiens
gttttgtttgcagaactta

SEQ ID NO: 10020043 - DNA, 19 bp, Homo sapiens
gttttgtttgcagaactta

SEQ ID NO: 10020044 - DNA, 19 bp, Homo sapiens
gttttgtttgcagaactta

SEQ ID NO: 10020045 - DNA, 22 bp, Homo sapiens
gttttgttttgagtcaactcca

SEQ ID NO: 10020046 - DNA, 22 bp, Homo sapiens
gttttgttttgagtcaactcca

SEQ ID NO: 10020047 - DNA, 22 bp, Homo sapiens
gttttgttttgagtcaactcca

SEQ ID NO: 10020048 - DNA, 22 bp, Homo sapiens
gtgtggctgattgacatggtca

SEQ ID NO: 10020049 - DNA, 23 bp, Homo sapiens
gtgtgcctttatcttctgtactc

SEQ ID NO: 10020050 - DNA, 22 bp, Homo sapiens
gtgtgcccgggggaagcaggtg

SEQ ID NO: 10020051 - DNA, 22 bp, Homo sapiens
gtgtgcctcccattagggtgta

SEQ ID NO: 10020052 - DNA, 22 bp, Homo sapiens
gttaacatttctaggtgcaggg

SEQ ID NO: 10020053 - DNA, 22 bp, Homo sapiens
gttaacattcaattaaacagtc

SEQ ID NO: 10020054 - DNA, 22 bp, Homo sapiens
gtgtgggacgggtgagtggcca

SEQ ID NO: 10020055 - DNA, 22 bp, Homo sapiens
gttaactttttacagaaatgaa

SEQ ID NO: 10020056 - DNA, 22 bp, Homo sapiens
gtgtgggaatggcggtcgtgca

SEQ ID NO: 10020057 - DNA, 22 bp, Homo sapiens
gttaatacaaccatgatcttct

SEQ ID NO: 10020058 - DNA, 22 bp, Homo sapiens
gttaatgtcttcctattctaca

SEQ ID NO: 10020059 - DNA, 22 bp, Homo sapiens
gttaatgtgtctgacacaatgg

SEQ ID NO: 10020060 - DNA, 22 bp, Homo sapiens
gttaatgtgtctgacacaatgg

SEQ ID NO: 10020061 - DNA, 22 bp, Homo sapiens
gttaagtaaactatgatttatc

SEQ ID NO: 10020062 - DNA, 22 bp, Homo sapiens
gttaagtaccagattgtctgaa

SEQ ID NO: 10020063 - DNA, 22 bp, Homo sapiens
gttacaaactcaggtgccaaaa

SEQ ID NO: 10020064 - DNA, 22 bp, Homo sapiens
gttacaaactcaggtgccaaaa

SEQ ID NO: 10020065 - DNA, 22 bp, Homo sapiens
gttacaaactcaggtgccaaaa

SEQ ID NO: 10020066 - DNA, 22 bp, Homo sapiens
gttacaaactcaggtgccaaaa

SEQ ID NO: 10020067 - DNA, 22 bp, Homo sapiens
gttaatttgcagctttcgagct

SEQ ID NO: 10020068 - DNA, 22 bp, Homo sapiens
gttaatttagtagagtccagat

SEQ ID NO: 10020069 - DNA, 18 bp, Homo sapiens
gttaattttgaagttcat

SEQ ID NO: 10020070 - DNA, 22 bp, Homo sapiens
gttacaaactcaggtgccaaaa

SEQ ID NO: 10020071 - DNA, 22 bp, Homo sapiens
gttacaaagcacttcaagtgaa

SEQ ID NO: 10020072 - DNA, 22 bp, Homo sapiens
gttacaaagcacttcaagtgaa

SEQ ID NO: 10020073 - DNA, 22 bp, Homo sapiens
gttacaaagcacttcaagtgaa

SEQ ID NO: 10020074 - DNA, 22 bp, Homo sapiens
gttacaaagcacttcaagtgaa

SEQ ID NO: 10020075 - DNA, 22 bp, Homo sapiens
gttacaaaggaagcttcactgc

SEQ ID NO: 10020076 - DNA, 22 bp, Homo sapiens
gttacaaaggaagcttcactgc

SEQ ID NO: 10020077 - DNA, 22 bp, Homo sapiens
gttacaaaggaagcttcactgc

SEQ ID NO: 10020078 - DNA, 22 bp, Homo sapiens
gttacaaaggaagcttcactgc

SEQ ID NO: 10020079 - DNA, 22 bp, Homo sapiens
gttacaaagcacttcaagtgaa

SEQ ID NO: 10020080 - DNA, 22 bp, Homo sapiens
gttacaaaggaagcttcactgc

SEQ ID NO: 10020081 - DNA, 22 bp, Homo sapiens
gtgctcactgtgagacgtcctg

SEQ ID NO: 10020082 - DNA, 22 bp, Homo sapiens
gtgctcatagatgatgctcttt

SEQ ID NO: 10020083 - DNA, 22 bp, Homo sapiens
gtgctcatcgtggagcctgagg

SEQ ID NO: 10020084 - DNA, 22 bp, Homo sapiens
gtgctcatcgtggagcctgagg

SEQ ID NO: 10020085 - DNA, 22 bp, Homo sapiens
gtgctcagggcctggctgggga

SEQ ID NO: 10020086 - DNA, 22 bp, Homo sapiens
gtgctcatgtcctttcactgca

SEQ ID NO: 10020087 - DNA, 22 bp, Homo sapiens
gtgctccatggcctgtgtccat

SEQ ID NO: 10020088 - DNA, 22 bp, Homo sapiens
gtgctccaggtcgctcagagag

SEQ ID NO: 10020089 - DNA, 22 bp, Homo sapiens
gtgctccaggtcgctcagagag

SEQ ID NO: 10020090 - DNA, 22 bp, Homo sapiens
gtgctccctccttcctcaagga

SEQ ID NO: 10020091 - DNA, 22 bp, Homo sapiens
gtgctccctccttcctcaagga

SEQ ID NO: 10020092 - DNA, 22 bp, Homo sapiens
gtgctccctccttcctcaagga

SEQ ID NO: 10020093 - DNA, 22 bp, Homo sapiens
gtgctctaggaccttagaagtg

SEQ ID NO: 10020094 - DNA, 22 bp, Homo sapiens
gtgctctgcctggggtcatggc

SEQ ID NO: 10020095 - DNA, 23 bp, Homo sapiens
gtgctctgcggtctgctagtctg

SEQ ID NO: 10020096 - DNA, 22 bp, Homo sapiens
gtgctgaaatagaggaggtggc

SEQ ID NO: 10020097 - DNA, 22 bp, Homo sapiens
gtgctctgtggattgagttgaa

SEQ ID NO: 10020098 - DNA, 22 bp, Homo sapiens
gtgctctgtgtattaggatgtc

SEQ ID NO: 10020099 - DNA, 22 bp, Homo sapiens
gtgctctggctggtctcccggt

SEQ ID NO: 10020100 - DNA, 21 bp, Homo sapiens
gtgctctgggcagcagagggc

SEQ ID NO: 10020101 - DNA, 21 bp, Homo sapiens
gtgctctgggcagcagagggc

SEQ ID NO: 10020102 - DNA, 22 bp, Homo sapiens
gtgctctgggctgcctgacatg

SEQ ID NO: 10020103 - DNA, 22 bp, Homo sapiens
gtgtgcatatgtgtggctctcc

SEQ ID NO: 10020104 - DNA, 22 bp, Homo sapiens
gtgtgcagtgagcaaaagatct

SEQ ID NO: 10020105 - DNA, 22 bp, Homo sapiens
gtgtgcatctcacccttccccg

SEQ ID NO: 10020106 - DNA, 22 bp, Homo sapiens
gtgtgcatcttttctgcttgat

SEQ ID NO: 10020107 - DNA, 22 bp, Homo sapiens
gtgtgcatgaggataggaataa

SEQ ID NO: 10020108 - DNA, 22 bp, Homo sapiens
gtgtgcatatgtgtggctctcc

SEQ ID NO: 10020109 - DNA, 18 bp, Homo sapiens
gtgtgcagttgcaggggt

SEQ ID NO: 10020110 - DNA, 22 bp, Homo sapiens
gtgctgaagtgaaattcatcaa

SEQ ID NO: 10020111 - DNA, 22 bp, Homo sapiens
gtgctgaagaagtctgttcgcc

SEQ ID NO: 10020112 - DNA, 18 bp, Homo sapiens
gtgtgcagttgcaggggt

SEQ ID NO: 10020113 - DNA, 18 bp, Homo sapiens
gtgtgcagttgcaggggt

SEQ ID NO: 10020114 - DNA, 22 bp, Homo sapiens
gtgctgaaatggacctcaggaa

SEQ ID NO: 10020115 - DNA, 22 bp, Homo sapiens
gtgctgaactataaaaagcttt

SEQ ID NO: 10020116 - DNA, 22 bp, Homo sapiens
gtgctgaacatttgggacttgt

SEQ ID NO: 10020117 - DNA, 22 bp, Homo sapiens
gtgtgcatgtgcttgcacagat

SEQ ID NO: 10020118 - DNA, 22 bp, Homo sapiens
gtgtgcatgtggaagcatgtat

SEQ ID NO: 10020119 - DNA, 22 bp, Homo sapiens
gtgtgcatgtatatacttttat

SEQ ID NO: 10020120 - DNA, 22 bp, Homo sapiens
gtgtgcatgcatagacaccaca

SEQ ID NO: 10020121 - DNA, 22 bp, Homo sapiens
gtgtgcatggagggggcagtga

SEQ ID NO: 10020122 - DNA, 22 bp, Homo sapiens
gtgtgcatgtgcttgcacagat

SEQ ID NO: 10020123 - DNA, 22 bp, Homo sapiens
gtgtgccaacaaaagacagtgc

SEQ ID NO: 10020124 - DNA, 22 bp, Homo sapiens
gtgtgccaacaaaagacagtgc

SEQ ID NO: 10020125 - DNA, 23 bp, Homo sapiens
gtgtgccaagcactgtgccagga

SEQ ID NO: 10020126 - DNA, 23 bp, Homo sapiens
gtgtgccaagcactgtgccagga

SEQ ID NO: 10020127 - DNA, 22 bp, Homo sapiens
gtgtgccagacatgatgctatg

SEQ ID NO: 10020128 - DNA, 22 bp, Homo sapiens
gtgtgccaggaactggctgctg

SEQ ID NO: 10020129 - DNA, 22 bp, Homo sapiens
gtgtgccaccagtcaaggtgaa

SEQ ID NO: 10020130 - DNA, 22 bp, Homo sapiens
gtgtgccaccactgacaggatt

SEQ ID NO: 10020131 - DNA, 22 bp, Homo sapiens
gtgtgccaccagtcaaggtgaa

SEQ ID NO: 10020132 - DNA, 22 bp, Homo sapiens
gtttcataattcaatcaaatga

SEQ ID NO: 10020133 - DNA, 22 bp, Homo sapiens
gtttcatacagattattcatgg

SEQ ID NO: 10020134 - DNA, 22 bp, Homo sapiens
gtttcatatatagtaactgaaa

SEQ ID NO: 10020135 - DNA, 22 bp, Homo sapiens
gtttcatatgcagttaacagca

SEQ ID NO: 10020136 - DNA, 22 bp, Homo sapiens
gtttcataggcatgtgacctat

SEQ ID NO: 10020137 - DNA, 22 bp, Homo sapiens
gtttcatagctacgattttggg

SEQ ID NO: 10020138 - DNA, 22 bp, Homo sapiens
gtttcatagcatatacgtgtgt

SEQ ID NO: 10020139 - DNA, 22 bp, Homo sapiens
gtttcatataccaagcacttga

SEQ ID NO: 10020140 - DNA, 22 bp, Homo sapiens
gtttcattcggcagctcataag

SEQ ID NO: 10020141 - DNA, 22 bp, Homo sapiens
gtttcattcggcagctcataag

SEQ ID NO: 10020142 - DNA, 20 bp, Homo sapiens
gtttccaaattgtgcatttt

SEQ ID NO: 10020143 - DNA, 22 bp, Homo sapiens
gtttcagatttggtttcagaag

SEQ ID NO: 10020144 - DNA, 22 bp, Homo sapiens
gtttcagatatatttgtactta

SEQ ID NO: 10020145 - DNA, 22 bp, Homo sapiens
gttgtacagcatccagtgcaga

SEQ ID NO: 10020146 - DNA, 19 bp, Homo sapiens
gttgtaaatggaggtttct

SEQ ID NO: 10020147 - DNA, 22 bp, Homo sapiens
gttgtaaatacagtactgaaac

SEQ ID NO: 10020148 - DNA, 22 bp, Homo sapiens
gttgggagcagcagaccaagag

SEQ ID NO: 10020149 - DNA, 22 bp, Homo sapiens
gttgctcaatgggaataagaat

SEQ ID NO: 10020150 - DNA, 22 bp, Homo sapiens
gttgctcaggcaggagtacagt

SEQ ID NO: 10020151 - DNA, 22 bp, Homo sapiens
gttgctcaggcaggagtacagt

SEQ ID NO: 10020152 - DNA, 22 bp, Homo sapiens
gttggtcatatcattgaagctt

SEQ ID NO: 10020153 - DNA, 22 bp, Homo sapiens
gttggggtaccttgaggctggg

SEQ ID NO: 10020154 - DNA, 22 bp, Homo sapiens
gttgcctaggctggagtgcagt

SEQ ID NO: 10020155 - DNA, 22 bp, Homo sapiens
gttgcaggaggatggctgcata

SEQ ID NO: 10020156 - DNA, 22 bp, Homo sapiens
gttgcagacactccacagtcga

SEQ ID NO: 10020157 - DNA, 22 bp, Homo sapiens
gttgcacactggctataacaag

SEQ ID NO: 10020158 - DNA, 22 bp, Homo sapiens
gttgcacagttcctcaagcagg

SEQ ID NO: 10020159 - DNA, 22 bp, Homo sapiens
gttgatttagtgagtgagcagt

SEQ ID NO: 10020160 - DNA, 22 bp, Homo sapiens
gttgatttagtgagtgagcagt

SEQ ID NO: 10020161 - DNA, 22 bp, Homo sapiens
gttgatgaaaatgaattgcatg

SEQ ID NO: 10020162 - DNA, 22 bp, Homo sapiens
gttcatttatgatgtaacatgt

SEQ ID NO: 10020163 - DNA, 19 bp, Homo sapiens
gttcatgtgaggaaggaac

SEQ ID NO: 10020164 - DNA, 22 bp, Homo sapiens
gttcatttaggaaaggaagagt

SEQ ID NO: 10020165 - DNA, 22 bp, Homo sapiens
gttcattctgaaaagcagcttg

SEQ ID NO: 10020166 - DNA, 22 bp, Homo sapiens
gttcagtgtttttattgacagg

SEQ ID NO: 10020167 - DNA, 22 bp, Homo sapiens
gttcagtgtttgatttctgctg

SEQ ID NO: 10020168 - DNA, 22 bp, Homo sapiens
gttcagtgtttacatgattgtt

SEQ ID NO: 10020169 - DNA, 22 bp, Homo sapiens
gttcagtggggccttgggggac

SEQ ID NO: 10020170 - DNA, 22 bp, Homo sapiens
gttcagtgccagttctaagact

SEQ ID NO: 10020171 - DNA, 22 bp, Homo sapiens
gttcagtggtgtatccccagtg

SEQ ID NO: 10020172 - DNA, 22 bp, Homo sapiens
gttcagtgtctctctattttat

SEQ ID NO: 10020173 - DNA, 22 bp, Homo sapiens
gttcagtgattctcggtgttca

SEQ ID NO: 10020174 - DNA, 22 bp, Homo sapiens
gttcatatttaactaagatagg

SEQ ID NO: 10020175 - DNA, 22 bp, Homo sapiens
gttcatatttaactaagatagg

SEQ ID NO: 10020176 - DNA, 22 bp, Homo sapiens
gttcatctcacagataggcagt

SEQ ID NO: 10020177 - DNA, 22 bp, Homo sapiens
gttcatattactttgagtgcag

SEQ ID NO: 10020178 - DNA, 22 bp, Homo sapiens
gttcataatttgaaggaatagg

SEQ ID NO: 10020179 - DNA, 21 bp, Homo sapiens
gttcaatagctctttgaatgc

SEQ ID NO: 10020180 - DNA, 22 bp, Homo sapiens
gttcaatttagaaagcacagtt

SEQ ID NO: 10020181 - DNA, 22 bp, Homo sapiens
gttacaaaggactgggggccac

SEQ ID NO: 10020182 - DNA, 22 bp, Homo sapiens
gttacaaaggactgggggccac

SEQ ID NO: 10020183 - DNA, 22 bp, Homo sapiens
gttacaaaggactgggggccac

SEQ ID NO: 10020184 - DNA, 22 bp, Homo sapiens
gttacaaaggactgggggccac

SEQ ID NO: 10020185 - DNA, 22 bp, Homo sapiens
gttcagcaagaatgtttctatt

SEQ ID NO: 10020186 - DNA, 22 bp, Homo sapiens
gttcagctaggaatggagatgc

SEQ ID NO: 10020187 - DNA, 22 bp, Homo sapiens
gttcagggagggacagatgaag

SEQ ID NO: 10020188 - DNA, 22 bp, Homo sapiens
gttcagcacaggtgctcagaca

SEQ ID NO: 10020189 - DNA, 22 bp, Homo sapiens
gttcagcagcagtgattttgtg

SEQ ID NO: 10020190 - DNA, 22 bp, Homo sapiens
tacattgactctctgtccctaa

SEQ ID NO: 10020191 - DNA, 22 bp, Homo sapiens
tacattgactgtgtgcatcaca

SEQ ID NO: 10020192 - DNA, 22 bp, Homo sapiens
tacattgagaaccactgcttag

SEQ ID NO: 10020193 - DNA, 22 bp, Homo sapiens
tacattgacttggattgttaga

SEQ ID NO: 10020194 - DNA, 22 bp, Homo sapiens
tacattgacctttgttaggttg

SEQ ID NO: 10020195 - DNA, 22 bp, Homo sapiens
tacattgaattttttagcatgt

SEQ ID NO: 10020196 - DNA, 21 bp, Homo sapiens
tacattgaagaatgggaatga

SEQ ID NO: 10020197 - DNA, 22 bp, Homo sapiens
tacattgaattttttagcatgt

SEQ ID NO: 10020198 - DNA, 21 bp, Homo sapiens
tacattgactacaaataaagc

SEQ ID NO: 10020199 - DNA, 21 bp, Homo sapiens
tacattgactacaaataaagc

SEQ ID NO: 10020200 - DNA, 22 bp, Homo sapiens
tacattgatggagtacctagct

SEQ ID NO: 10020201 - DNA, 22 bp, Homo sapiens
tacattgagtattatttagcca

SEQ ID NO: 10020202 - DNA, 22 bp, Homo sapiens
tacattgaggcagtagctggag

SEQ ID NO: 10020203 - DNA, 22 bp, Homo sapiens
tacattgagcacgtactatgtg

SEQ ID NO: 10020204 - DNA, 22 bp, Homo sapiens
tacattgaaagtcatttaatcc

SEQ ID NO: 10020205 - DNA, 22 bp, Homo sapiens
tacattgaaatcaatggatgtg

SEQ ID NO: 10020206 - DNA, 22 bp, Homo sapiens
tacattgaaatcaatggatgtg

SEQ ID NO: 10020207 - DNA, 22 bp, Homo sapiens
tacattgaactatgagttcagt

SEQ ID NO: 10020208 - DNA, 23 bp, Homo sapiens
tacattctgtatttttatagagt

SEQ ID NO: 10020209 - DNA, 22 bp, Homo sapiens
tacattctggtggagaaagtaa

SEQ ID NO: 10020210 - DNA, 22 bp, Homo sapiens
tacatcatggcttcatgctgca

SEQ ID NO: 10020211 - DNA, 22 bp, Homo sapiens
tacatcatggcttcatgctgca

SEQ ID NO: 10020212 - DNA, 22 bp, Homo sapiens
tacatcatgtaagcagaatcat

SEQ ID NO: 10020213 - DNA, 22 bp, Homo sapiens
tacatatagacagttactctag

SEQ ID NO: 10020214 - DNA, 22 bp, Homo sapiens
tacatatactgagtgatttgct

SEQ ID NO: 10020215 - DNA, 22 bp, Homo sapiens
tacatatagacagttactctag

SEQ ID NO: 10020216 - DNA, 22 bp, Homo sapiens
tacatagtgaacatttacagag

SEQ ID NO: 10020217 - DNA, 22 bp, Homo sapiens
tacatatactgagtgatttgct

SEQ ID NO: 10020218 - DNA, 22 bp, Homo sapiens
tacatagctcctagtgatgcat

SEQ ID NO: 10020219 - DNA, 22 bp, Homo sapiens
tacattcccccaattaccaatg

SEQ ID NO: 10020220 - DNA, 22 bp, Homo sapiens
tacatctatctagatgctcaga

SEQ ID NO: 10020221 - DNA, 22 bp, Homo sapiens
tacatctgatttacctactgaa

SEQ ID NO: 10020222 - DNA, 22 bp, Homo sapiens
tacatctcatctgtgctctccg

SEQ ID NO: 10020223 - DNA, 22 bp, Homo sapiens
tacatctagccttacaattatt

SEQ ID NO: 10020224 - DNA, 19 bp, Homo sapiens
tacatcctcttcctctttg

SEQ ID NO: 10020225 - DNA, 22 bp, Homo sapiens
tacatcattttggagatgagca

SEQ ID NO: 10020226 - DNA, 22 bp, Homo sapiens
tacagtaatgtgtccctgcagg

SEQ ID NO: 10020227 - DNA, 22 bp, Homo sapiens
tacagtaatctggacatgattt

SEQ ID NO: 10020228 - DNA, 22 bp, Homo sapiens
tacagtaataaaatgagctaca

SEQ ID NO: 10020229 - DNA, 21 bp, Homo sapiens
tacagtaagttgggtggtcct

SEQ ID NO: 10020230 - DNA, 22 bp, Homo sapiens
tacagtaataaaatgagctaca

SEQ ID NO: 10020231 - DNA, 22 bp, Homo sapiens
tacagtaataaaatgagctaca

SEQ ID NO: 10020232 - DNA, 22 bp, Homo sapiens
tacagtaccagaaatgctaaga

SEQ ID NO: 10020233 - DNA, 22 bp, Homo sapiens
tacagtaccctgatgaactaaa

SEQ ID NO: 10020234 - DNA, 22 bp, Homo sapiens
tacagtagaatcttatagccca

SEQ ID NO: 10020235 - DNA, 22 bp, Homo sapiens
tacagtacacaggtaccaagct

SEQ ID NO: 10020236 - DNA, 22 bp, Homo sapiens
tacagtaccagaaatgctaaga

SEQ ID NO: 10020237 - DNA, 22 bp, Homo sapiens
tacagtacagtctagactctgg

SEQ ID NO: 10020238 - DNA, 22 bp, Homo sapiens
tacagtagctactcaataacta

SEQ ID NO: 10020239 - DNA, 22 bp, Homo sapiens
tacagtagctgaggttctcagg

SEQ ID NO: 10020240 - DNA, 22 bp, Homo sapiens
tacagtacctgccacgttgttg

SEQ ID NO: 10020241 - DNA, 22 bp, Homo sapiens
tacagtagaatgcggtgccagt

SEQ ID NO: 10020242 - DNA, 22 bp, Homo sapiens
tacatagcaaggaaatgacaga

SEQ ID NO: 10020243 - DNA, 22 bp, Homo sapiens
tacatagattttgaaactggac

SEQ ID NO: 10020244 - DNA, 22 bp, Homo sapiens
tacatagagggtaatagcatca

SEQ ID NO: 10020245 - DNA, 22 bp, Homo sapiens
tacatagagggtaatagcatca

SEQ ID NO: 10020246 - DNA, 22 bp, Homo sapiens
tacatagaatatttcacttaaa

SEQ ID NO: 10020247 - DNA, 22 bp, Homo sapiens
tacatacattacctcatttagt

SEQ ID NO: 10020248 - DNA, 22 bp, Homo sapiens
tacatacattacctcatttagt

SEQ ID NO: 10020249 - DNA, 22 bp, Homo sapiens
tacagtaactggaattcttctt

SEQ ID NO: 10020250 - DNA, 22 bp, Homo sapiens
tacagtaactggaattcttctt

SEQ ID NO: 10020251 - DNA, 22 bp, Homo sapiens
tacagtaagatgaaatagcaat

SEQ ID NO: 10020252 - DNA, 22 bp, Homo sapiens
tacagggactcccgcagagata

SEQ ID NO: 10020253 - DNA, 22 bp, Homo sapiens
tacagggacatggaacaggctc

SEQ ID NO: 10020254 - DNA, 22 bp, Homo sapiens
tacagggaccaataataactat

SEQ ID NO: 10020255 - DNA, 22 bp, Homo sapiens
tacaggcatgaatgaaatctgt

SEQ ID NO: 10020256 - DNA, 22 bp, Homo sapiens
tacaggcatgtagcatggtgat

SEQ ID NO: 10020257 - DNA, 22 bp, Homo sapiens
tacaggcccatagtccctgctt

SEQ ID NO: 10020258 - DNA, 22 bp, Homo sapiens
tacagggaatgggacataaatc

SEQ ID NO: 10020259 - DNA, 22 bp, Homo sapiens
tacaggcactgaaatgcttatt

SEQ ID NO: 10020260 - DNA, 19 bp, Homo sapiens
tacaggcagtttctacaat

SEQ ID NO: 10020261 - DNA, 19 bp, Homo sapiens
tacaggaggcctgcaatct

SEQ ID NO: 10020262 - DNA, 20 bp, Homo sapiens
tacaggagtgagtgggtggg

SEQ ID NO: 10020263 - DNA, 22 bp, Homo sapiens
tacagcacggtgcatttactac

SEQ ID NO: 10020264 - DNA, 22 bp, Homo sapiens
tacaggagcacaaaagagttga

SEQ ID NO: 10020265 - DNA, 22 bp, Homo sapiens
tacaggagcatggggaagggat

SEQ ID NO: 10020266 - DNA, 22 bp, Homo sapiens
tacagagtggtgagatcttttg

SEQ ID NO: 10020267 - DNA, 22 bp, Homo sapiens
tacagagtgttattacagaatc

SEQ ID NO: 10020268 - DNA, 22 bp, Homo sapiens
tacagagtgttattacagaatc

SEQ ID NO: 10020269 - DNA, 22 bp, Homo sapiens
tacagagttttcctgccaagaa

SEQ ID NO: 10020270 - DNA, 23 bp, Homo sapiens
tacagaaggagtagtcactaaga

SEQ ID NO: 10020271 - DNA, 17 bp, Homo sapiens
tacagaaggcaccacaa

SEQ ID NO: 10020272 - DNA, 22 bp, Homo sapiens
tacagaagttggttttagttta

SEQ ID NO: 10020273 - DNA, 22 bp, Homo sapiens
tacagataactgaatgcagact

SEQ ID NO: 10020274 - DNA, 22 bp, Homo sapiens
tacagatagaattagtgagtta

SEQ ID NO: 10020275 - DNA, 22 bp, Homo sapiens
tacagataaattttaagtagaa

SEQ ID NO: 10020276 - DNA, 22 bp, Homo sapiens
tacagataaaaatgctgttctt

SEQ ID NO: 10020277 - DNA, 22 bp, Homo sapiens
tacagaaatacagtcaggccta

SEQ ID NO: 10020278 - DNA, 22 bp, Homo sapiens
tacagaaatcacatcgctttga

SEQ ID NO: 10020279 - DNA, 22 bp, Homo sapiens
tacagaaatactggggggttct

SEQ ID NO: 10020280 - DNA, 22 bp, Homo sapiens
tacagaaatcacatcgctttga

SEQ ID NO: 10020281 - DNA, 22 bp, Homo sapiens
tacagaaattgccaccagctct

SEQ ID NO: 10020282 - DNA, 22 bp, Homo sapiens
tacagaaattgccaccagctct

SEQ ID NO: 10020283 - DNA, 23 bp, Homo sapiens
tacagaaggagtagtcactaaga

SEQ ID NO: 10020284 - DNA, 22 bp, Homo sapiens
tacagaactgaagtagtgaaaa

SEQ ID NO: 10020285 - DNA, 22 bp, Homo sapiens
tacagaagctgagacactgaga

SEQ ID NO: 10020286 - DNA, 22 bp, Homo sapiens
tacagcaatgcctgaaatagta

SEQ ID NO: 10020287 - DNA, 22 bp, Homo sapiens
tacagcaatgctacaagatgac

SEQ ID NO: 10020288 - DNA, 22 bp, Homo sapiens
tacagcaatgcctgaaatagta

SEQ ID NO: 10020289 - DNA, 22 bp, Homo sapiens
tacagcaatgcctgaaatagta

SEQ ID NO: 10020290 - DNA, 22 bp, Homo sapiens
tacagcaatgctacaagatgac

SEQ ID NO: 10020291 - DNA, 22 bp, Homo sapiens
tacagcaatggttctaagagtc

SEQ ID NO: 10020292 - DNA, 22 bp, Homo sapiens
tacagcaagacagaccgctcaa

SEQ ID NO: 10020293 - DNA, 23 bp, Homo sapiens
tacagcaaggacaacataggtgg

SEQ ID NO: 10020294 - DNA, 22 bp, Homo sapiens
tacagcaataatgacaccgctc

SEQ ID NO: 10020295 - DNA, 22 bp, Homo sapiens
tacagatttggggagtaaagtt

SEQ ID NO: 10020296 - DNA, 21 bp, Homo sapiens
tacagcaacggaggttttcta

SEQ ID NO: 10020297 - DNA, 22 bp, Homo sapiens
tacagcaaagaaaccctcagtc

SEQ ID NO: 10020298 - DNA, 22 bp, Homo sapiens
tacagattttgtgaagaagtgt

SEQ ID NO: 10020299 - DNA, 18 bp, Homo sapiens
tacagattatagatacat

SEQ ID NO: 10020300 - DNA, 21 bp, Homo sapiens
tacagatgaggagaccaaggc

SEQ ID NO: 10020301 - DNA, 22 bp, Homo sapiens
tacagatatttctcttcaacaa

SEQ ID NO: 10020302 - DNA, 22 bp, Homo sapiens
tacagatatagagatttataga

SEQ ID NO: 10020303 - DNA, 22 bp, Homo sapiens
tacagatatagagatttataga

SEQ ID NO: 10020304 - DNA, 22 bp, Homo sapiens
tacagatatagggcgagcttag

SEQ ID NO: 10020305 - DNA, 22 bp, Homo sapiens
tacaaagtgctttagaaatgaa

SEQ ID NO: 10020306 - DNA, 22 bp, Homo sapiens
tacaaagtttgagaatgctttc

SEQ ID NO: 10020307 - DNA, 22 bp, Homo sapiens
tacaaagtgaaataattctgag

SEQ ID NO: 10020308 - DNA, 22 bp, Homo sapiens
tacaaagtcagaataacaggtg

SEQ ID NO: 10020309 - DNA, 22 bp, Homo sapiens
tacaaagtcccattgccatgga

SEQ ID NO: 10020310 - DNA, 22 bp, Homo sapiens
tacaaagtcttgggttctaggc

SEQ ID NO: 10020311 - DNA, 22 bp, Homo sapiens
tacaacagacctagatgaatga

SEQ ID NO: 10020312 - DNA, 22 bp, Homo sapiens
tacaacagacaggaataagatt

SEQ ID NO: 10020313 - DNA, 22 bp, Homo sapiens
tacaacagacaggaataagatt

SEQ ID NO: 10020314 - DNA, 22 bp, Homo sapiens
tacaacagacaggaataagatt

SEQ ID NO: 10020315 - DNA, 22 bp, Homo sapiens
tacaacactgttcagcctcttc

SEQ ID NO: 10020316 - DNA, 22 bp, Homo sapiens
tacaacagaagtgtttatttag

SEQ ID NO: 10020317 - DNA, 22 bp, Homo sapiens
tacaacactgttcagcctcttc

SEQ ID NO: 10020318 - DNA, 22 bp, Homo sapiens
tacaacactggttcgacatgtg

SEQ ID NO: 10020319 - DNA, 22 bp, Homo sapiens
tacaacactggttcgacatgtg

SEQ ID NO: 10020320 - DNA, 22 bp, Homo sapiens
tacaacactggttcgacatgtg

SEQ ID NO: 10020321 - DNA, 22 bp, Homo sapiens
tacaacaatttccacattagaa

SEQ ID NO: 10020322 - DNA, 22 bp, Homo sapiens
tacaacaatttccacattagaa

SEQ ID NO: 10020323 - DNA, 20 bp, Homo sapiens
tacaacaagtagagacatac

SEQ ID NO: 10020324 - DNA, 22 bp, Homo sapiens
tacaaatcagatcatgagttta

SEQ ID NO: 10020325 - DNA, 22 bp, Homo sapiens
tacaaatcagatcatgagttta

SEQ ID NO: 10020326 - DNA, 22 bp, Homo sapiens
tacagaaaaacatctggagccg

SEQ ID NO: 10020327 - DNA, 22 bp, Homo sapiens
tacagaaaaacatctggagccg

SEQ ID NO: 10020328 - DNA, 22 bp, Homo sapiens
tacaacaggaatttcaactttg

SEQ ID NO: 10020329 - DNA, 22 bp, Homo sapiens
tacaacagttcatgaaatgaaa

SEQ ID NO: 10020330 - DNA, 22 bp, Homo sapiens
tacaacagttcatgaaatgaaa

SEQ ID NO: 10020331 - DNA, 21 bp, Homo sapiens
tacactcatcctctcccaagg

SEQ ID NO: 10020332 - DNA, 22 bp, Homo sapiens
tacagaaaaacttggaggcttt

SEQ ID NO: 10020333 - DNA, 22 bp, Homo sapiens
tacagaaaaactggcattgaag

SEQ ID NO: 10020334 - DNA, 22 bp, Homo sapiens
tacagaaaaacatctggagccg

SEQ ID NO: 10020335 - DNA, 22 bp, Homo sapiens
tacagaaaaactggcattgaag

SEQ ID NO: 10020336 - DNA, 22 bp, Homo sapiens
tacagaaacagcgtggttagaa

SEQ ID NO: 10020337 - DNA, 22 bp, Homo sapiens
tacagaaaaacttggaggcttt

SEQ ID NO: 10020338 - DNA, 22 bp, Homo sapiens
tacagaaacagcgtggttagaa

SEQ ID NO: 10020339 - DNA, 22 bp, Homo sapiens
tacagaaagggatgattgatct

SEQ ID NO: 10020340 - DNA, 22 bp, Homo sapiens
tacagaaagggatgattgatct

SEQ ID NO: 10020341 - DNA, 20 bp, Homo sapiens
tacagaaacaggacttttgg

SEQ ID NO: 10020342 - DNA, 22 bp, Homo sapiens
tacagaaagacctctcgggaaa

SEQ ID NO: 10020343 - DNA, 20 bp, Homo sapiens
tacagaaacaggacttttgg

SEQ ID NO: 10020344 - DNA, 20 bp, Homo sapiens
tacagaaacaggacttttgg

SEQ ID NO: 10020345 - DNA, 22 bp, Homo sapiens
taataatagcagtagctgccac

SEQ ID NO: 10020346 - DNA, 22 bp, Homo sapiens
taatacagatacaaaggaggac

SEQ ID NO: 10020347 - DNA, 22 bp, Homo sapiens
taatacatcattcatctaagga

SEQ ID NO: 10020348 - DNA, 22 bp, Homo sapiens
taatacagtagcttttacacag

SEQ ID NO: 10020349 - DNA, 22 bp, Homo sapiens
taataagtctgttgtttaattg

SEQ ID NO: 10020350 - DNA, 18 bp, Homo sapiens
taagtgtaattgacaatt

SEQ ID NO: 10020351 - DNA, 22 bp, Homo sapiens
taataccttgatctctcttgtc

SEQ ID NO: 10020352 - DNA, 22 bp, Homo sapiens
taatacctactggtcattgcaa

SEQ ID NO: 10020353 - DNA, 22 bp, Homo sapiens
taataccactgtgctcattata

SEQ ID NO: 10020354 - DNA, 22 bp, Homo sapiens
taatacctactggtcattgcaa

SEQ ID NO: 10020355 - DNA, 22 bp, Homo sapiens
taatacatcattcatctaagga

SEQ ID NO: 10020356 - DNA, 22 bp, Homo sapiens
taatacatcattcatctaagga

SEQ ID NO: 10020357 - DNA, 22 bp, Homo sapiens
taatacatcattcatctaagga

SEQ ID NO: 10020358 - DNA, 22 bp, Homo sapiens
taatacatcattcatctaagga

SEQ ID NO: 10020359 - DNA, 22 bp, Homo sapiens
taagtgagctagcagaagtgac

SEQ ID NO: 10020360 - DNA, 22 bp, Homo sapiens
taagtagtagggccagaatttg

SEQ ID NO: 10020361 - DNA, 22 bp, Homo sapiens
taagtgaaatggtgcatcaaat

SEQ ID NO: 10020362 - DNA, 23 bp, Homo sapiens
taagtgattagaatttgctgtca

SEQ ID NO: 10020363 - DNA, 22 bp, Homo sapiens
taagtgatgagcacagtaatta

SEQ ID NO: 10020364 - DNA, 22 bp, Homo sapiens
taagtgatgtcttggttaatga

SEQ ID NO: 10020365 - DNA, 23 bp, Homo sapiens
taagtgataaagagtagagatgg

SEQ ID NO: 10020366 - DNA, 22 bp, Homo sapiens
taagtgatgaaagcagatgtct

SEQ ID NO: 10020367 - DNA, 23 bp, Homo sapiens
taagtgataaagagtagagatgg

SEQ ID NO: 10020368 - DNA, 22 bp, Homo sapiens
taagtgcatgattgaacttggc

SEQ ID NO: 10020369 - DNA, 22 bp, Homo sapiens
taagtgatttgtagtatactat

SEQ ID NO: 10020370 - DNA, 23 bp, Homo sapiens
taagtgattccaagtttcaggga

SEQ ID NO: 10020371 - DNA, 22 bp, Homo sapiens
taagtaatttgtgcagagatac

SEQ ID NO: 10020372 - DNA, 22 bp, Homo sapiens
taagtaattgcagcaatttgcc

SEQ ID NO: 10020373 - DNA, 18 bp, Homo sapiens
taagtaaggtcatatggg

SEQ ID NO: 10020374 - DNA, 18 bp, Homo sapiens
taagtaaggtcatatggg

SEQ ID NO: 10020375 - DNA, 22 bp, Homo sapiens
taagtaaatttataatgtgatt

SEQ ID NO: 10020376 - DNA, 22 bp, Homo sapiens
taagtaaatttataatgtgatt

SEQ ID NO: 10020377 - DNA, 22 bp, Homo sapiens
taagtacatttgggaccacctg

SEQ ID NO: 10020378 - DNA, 22 bp, Homo sapiens
taaggtttggctgtctcttggt

SEQ ID NO: 10020379 - DNA, 22 bp, Homo sapiens
taaggtttgtggggagcaaaag

SEQ ID NO: 10020380 - DNA, 22 bp, Homo sapiens
taaggttttgagaccagaacgt

SEQ ID NO: 10020381 - DNA, 22 bp, Homo sapiens
taaggttttgagaccagaacgt

SEQ ID NO: 10020382 - DNA, 22 bp, Homo sapiens
taagtaaatttataatgtgatt

SEQ ID NO: 10020383 - DNA, 22 bp, Homo sapiens
taagtaaaacattcaagaagtc

SEQ ID NO: 10020384 - DNA, 22 bp, Homo sapiens
taagggttcagaatgcagtggt

SEQ ID NO: 10020385 - DNA, 22 bp, Homo sapiens
taagggttcagaatgcagtggt

SEQ ID NO: 10020386 - DNA, 22 bp, Homo sapiens
taaggtttcttcagatactagt

SEQ ID NO: 10020387 - DNA, 22 bp, Homo sapiens
taaggtttgaagaagactgagc

SEQ ID NO: 10020388 - DNA, 22 bp, Homo sapiens
taaggtttgcttatcttcgcct

SEQ ID NO: 10020389 - DNA, 19 bp, Homo sapiens
taaggtttaccagcaaaat

SEQ ID NO: 10020390 - DNA, 22 bp, Homo sapiens
taaggtttctagtttctaaact

SEQ ID NO: 10020391 - DNA, 22 bp, Homo sapiens
taaggtctttaacaggtctttt

SEQ ID NO: 10020392 - DNA, 22 bp, Homo sapiens
taaggtgtggtagtttagttct

SEQ ID NO: 10020393 - DNA, 22 bp, Homo sapiens
taaggtttaacgccctgtctcg

SEQ ID NO: 10020394 - DNA, 22 bp, Homo sapiens
taaggctccctttgccacttgt

SEQ ID NO: 10020395 - DNA, 22 bp, Homo sapiens
taaggcttatatacttagacat

SEQ ID NO: 10020396 - DNA, 22 bp, Homo sapiens
taaggctttccttgtcatcttt

SEQ ID NO: 10020397 - DNA, 22 bp, Homo sapiens
taaggctttatttttacaatgc

SEQ ID NO: 10020398 - DNA, 22 bp, Homo sapiens
taaggcttttgttcagcgtggg

SEQ ID NO: 10020399 - DNA, 22 bp, Homo sapiens
taaggctttgtagtgattgctt

SEQ ID NO: 10020400 - DNA, 22 bp, Homo sapiens
taaggctttggtcaccatggag

SEQ ID NO: 10020401 - DNA, 22 bp, Homo sapiens
taaggctttctaaatatgcaga

SEQ ID NO: 10020402 - DNA, 22 bp, Homo sapiens
taaggctttctaaatatgcaga

SEQ ID NO: 10020403 - DNA, 22 bp, Homo sapiens
taaggccaccgttatagaacca

SEQ ID NO: 10020404 - DNA, 22 bp, Homo sapiens
taaggcataaggaagatttgga

SEQ ID NO: 10020405 - DNA, 22 bp, Homo sapiens
taaggcatgagtttatttcata

SEQ ID NO: 10020406 - DNA, 23 bp, Homo sapiens
taaggcattttttctgtatcagt

SEQ ID NO: 10020407 - DNA, 22 bp, Homo sapiens
taaggcaagagcagggtctttg

SEQ ID NO: 10020408 - DNA, 22 bp, Homo sapiens
taaggcaatggcattcttgaca

SEQ ID NO: 10020409 - DNA, 22 bp, Homo sapiens
taaggcaaagtgatttcttaaa

SEQ ID NO: 10020410 - DNA, 23 bp, Homo sapiens
taattatggaataatttgcaacg

SEQ ID NO: 10020411 - DNA, 22 bp, Homo sapiens
taattatagccgctattttgct

SEQ ID NO: 10020412 - DNA, 22 bp, Homo sapiens
tacaaaaaattgatactgacga

SEQ ID NO: 10020413 - DNA, 22 bp, Homo sapiens
tacaaaaaattgatactgacga

SEQ ID NO: 10020414 - DNA, 22 bp, Homo sapiens
tacaaactctttatatttcata

SEQ ID NO: 10020415 - DNA, 22 bp, Homo sapiens
tacaaactctttatatttcata

SEQ ID NO: 10020416 - DNA, 22 bp, Homo sapiens
tacaaactgtccagcccagagg

SEQ ID NO: 10020417 - DNA, 22 bp, Homo sapiens
tacaaactgttattattattgt

SEQ ID NO: 10020418 - DNA, 22 bp, Homo sapiens
tacaaactgttattattattgt

SEQ ID NO: 10020419 - DNA, 22 bp, Homo sapiens
tacaaactccgaagtttgtacc

SEQ ID NO: 10020420 - DNA, 22 bp, Homo sapiens
tacaaactctttatatttcata

SEQ ID NO: 10020421 - DNA, 22 bp, Homo sapiens
tacaaagaggtaattgcatata

SEQ ID NO: 10020422 - DNA, 22 bp, Homo sapiens
tacaaagaggtaattgcatata

SEQ ID NO: 10020423 - DNA, 22 bp, Homo sapiens
tacaaagaggtaattgcatata

SEQ ID NO: 10020424 - DNA, 22 bp, Homo sapiens
tacaaagagtttggtctctaga

SEQ ID NO: 10020425 - DNA, 22 bp, Homo sapiens
tacaaagagtttggtctctaga

SEQ ID NO: 10020426 - DNA, 22 bp, Homo sapiens
tacaaagagtttggtctctaga

SEQ ID NO: 10020427 - DNA, 22 bp, Homo sapiens
tacaaagagtttggtctctaga

SEQ ID NO: 10020428 - DNA, 22 bp, Homo sapiens
tacaaagagtttggtctctaga

SEQ ID NO: 10020429 - DNA, 22 bp, Homo sapiens
tacaaagaggtaattgcatata

SEQ ID NO: 10020430 - DNA, 22 bp, Homo sapiens
tacaaactgttattattattgt

SEQ ID NO: 10020431 - DNA, 20 bp, Homo sapiens
tacaaagaatgaggttcagg

SEQ ID NO: 10020432 - DNA, 22 bp, Homo sapiens
tacaaacttgttttaagtaagt

SEQ ID NO: 10020433 - DNA, 20 bp, Homo sapiens
tacaaagagcccctctcttc

SEQ ID NO: 10020434 - DNA, 20 bp, Homo sapiens
tacaaagagcccctctcttc

SEQ ID NO: 10020435 - DNA, 22 bp, Homo sapiens
tacaaagaggcagctccatttt

SEQ ID NO: 10020436 - DNA, 22 bp, Homo sapiens
tacaaagaggcagctccatttt

SEQ ID NO: 10020437 - DNA, 20 bp, Homo sapiens
tacaaagaatgaggttcagg

SEQ ID NO: 10020438 - DNA, 20 bp, Homo sapiens
tacaaagaatgaggttcagg

SEQ ID NO: 10020439 - DNA, 22 bp, Homo sapiens
tacaaaggaaacttcttttccc

SEQ ID NO: 10020440 - DNA, 22 bp, Homo sapiens
tacaaaggacagcagaaaaata

SEQ ID NO: 10020441 - DNA, 22 bp, Homo sapiens
tacaaaggacagcagaaaaata

SEQ ID NO: 10020442 - DNA, 22 bp, Homo sapiens
tacaaaggagactctgtattta

SEQ ID NO: 10020443 - DNA, 22 bp, Homo sapiens
tacaaagcctggtagatatctg

SEQ ID NO: 10020444 - DNA, 22 bp, Homo sapiens
tacaaagctactcgagggcagg

SEQ ID NO: 10020445 - DNA, 22 bp, Homo sapiens
tacaaagcagttccaacacgaa

SEQ ID NO: 10020446 - DNA, 22 bp, Homo sapiens
tacaaagctgtatagcctggtc

SEQ ID NO: 10020447 - DNA, 22 bp, Homo sapiens
tacaaagcctggtagatatctg

SEQ ID NO: 10020448 - DNA, 22 bp, Homo sapiens
tacaaagcttgtactgtgtgac

SEQ ID NO: 10020449 - DNA, 22 bp, Homo sapiens
tacaaagatggaaggttatgtt

SEQ ID NO: 10020450 - DNA, 22 bp, Homo sapiens
tacaaagatggaaggttatgtt

SEQ ID NO: 10020451 - DNA, 22 bp, Homo sapiens
tacaaagcaaatcatctaagag

SEQ ID NO: 10020452 - DNA, 22 bp, Homo sapiens
tacaaagcaaatcatctaagag

SEQ ID NO: 10020453 - DNA, 22 bp, Homo sapiens
tacaaagatggaaggttatgtt

SEQ ID NO: 10020454 - DNA, 22 bp, Homo sapiens
tacaaagatagtgttagagtaa

SEQ ID NO: 10020455 - DNA, 22 bp, Homo sapiens
tacaaagatagtgttagagtaa

SEQ ID NO: 10020456 - DNA, 22 bp, Homo sapiens
tacaaagataaaatctcaccat

SEQ ID NO: 10020457 - DNA, 22 bp, Homo sapiens
tacaaagataaaatctcaccat

SEQ ID NO: 10020458 - DNA, 22 bp, Homo sapiens
tacaaagataaaatctcaccat

SEQ ID NO: 10020459 - DNA, 22 bp, Homo sapiens
tacaaaggaggtgcatagaaca

SEQ ID NO: 10020460 - DNA, 22 bp, Homo sapiens
tacaaaggaggtgcatagaaca

SEQ ID NO: 10020461 - DNA, 22 bp, Homo sapiens
tacaaaggcggtttttctgggc

SEQ ID NO: 10020462 - DNA, 21 bp, Homo sapiens
tacaaagggaaattctggctc

SEQ ID NO: 10020463 - DNA, 22 bp, Homo sapiens
tacaaagtcacattgaaatgaa

SEQ ID NO: 10020464 - DNA, 22 bp, Homo sapiens
tacaaagtaatgtataatatcg

SEQ ID NO: 10020465 - DNA, 22 bp, Homo sapiens
taatacttttgccttgtattca

SEQ ID NO: 10020466 - DNA, 22 bp, Homo sapiens
taatagaatagtggaaacattg

SEQ ID NO: 10020467 - DNA, 22 bp, Homo sapiens
taatacttgtcataaaggcatt

SEQ ID NO: 10020468 - DNA, 22 bp, Homo sapiens
taatactttgaatgagagctaa

SEQ ID NO: 10020469 - DNA, 22 bp, Homo sapiens
taatacttgctttggatgtatg

SEQ ID NO: 10020470 - DNA, 22 bp, Homo sapiens
taatacttaccttgcagagtct

SEQ ID NO: 10020471 - DNA, 22 bp, Homo sapiens
taatgtttagaagcagacagct

SEQ ID NO: 10020472 - DNA, 22 bp, Homo sapiens
taatgtttagaagcagacagct

SEQ ID NO: 10020473 - DNA, 22 bp, Homo sapiens
taatggctaaaattcagaagaa

SEQ ID NO: 10020474 - DNA, 22 bp, Homo sapiens
taatagaatagtggaaacattg

SEQ ID NO: 10020475 - DNA, 22 bp, Homo sapiens
taatggcattgattacatgaaa

SEQ ID NO: 10020476 - DNA, 22 bp, Homo sapiens
taatggcagagtcatgctttct

SEQ ID NO: 10020477 - DNA, 22 bp, Homo sapiens
taatggcagagtcatgctttct

SEQ ID NO: 10020478 - DNA, 22 bp, Homo sapiens
taattataacagttacatctta

SEQ ID NO: 10020479 - DNA, 22 bp, Homo sapiens
taattataacagttacatctta

SEQ ID NO: 10020480 - DNA, 21 bp, Homo sapiens
taattagcaaagctgagattc

SEQ ID NO: 10020481 - DNA, 23 bp, Homo sapiens
taattagatgttgattcctgaga

SEQ ID NO: 10020482 - DNA, 22 bp, Homo sapiens
taattataacatgctttctggc

SEQ ID NO: 10020483 - DNA, 22 bp, Homo sapiens
taattataacatgctttctggc

SEQ ID NO: 10020484 - DNA, 22 bp, Homo sapiens
taatgtttttctcaacattgct

SEQ ID NO: 10020485 - DNA, 22 bp, Homo sapiens
taattacaaagcaagcacaggg

SEQ ID NO: 10020486 - DNA, 22 bp, Homo sapiens
taattagagtttggtaaacaat

SEQ ID NO: 10020487 - DNA, 22 bp, Homo sapiens
taattacaggtccaaaacaatc

SEQ ID NO: 10020488 - DNA, 22 bp, Homo sapiens
taattacaggtccaaaacaatc

SEQ ID NO: 10020489 - DNA, 22 bp, Homo sapiens
tcacccaggctggagtgtagtg

SEQ ID NO: 10020490 - DNA, 22 bp, Homo sapiens
tcacccaggctggagtgcagtg

SEQ ID NO: 10020491 - DNA, 22 bp, Homo sapiens
tcacccaggctggactgcagtg

SEQ ID NO: 10020492 - DNA, 22 bp, Homo sapiens
tcacccaggctggagtgcagtg

SEQ ID NO: 10020493 - DNA, 22 bp, Homo sapiens
tcacccaggctggagtgtagtg

SEQ ID NO: 10020494 - DNA, 22 bp, Homo sapiens
tcacccaggctggtatgcagtg

SEQ ID NO: 10020495 - DNA, 22 bp, Homo sapiens
tcacccaggctggtgcgcagtg

SEQ ID NO: 10020496 - DNA, 22 bp, Homo sapiens
tcacccaggctggtatgcagtg

SEQ ID NO: 10020497 - DNA, 22 bp, Homo sapiens
tcacccaggatattgaagtcag

SEQ ID NO: 10020498 - DNA, 22 bp, Homo sapiens
tcacccagcgggcgcacactcg

SEQ ID NO: 10020499 - DNA, 22 bp, Homo sapiens
tcacccagcgggcgcacactcg

SEQ ID NO: 10020500 - DNA, 22 bp, Homo sapiens
tcacccagccttggcgggtttg

SEQ ID NO: 10020501 - DNA, 22 bp, Homo sapiens
tcacccaggctggactgcagtg

SEQ ID NO: 10020502 - DNA, 22 bp, Homo sapiens
tcacccaggctggactgcagtg

SEQ ID NO: 10020503 - DNA, 19 bp, Homo sapiens
tcacccaggctgctggctc

SEQ ID NO: 10020504 - DNA, 22 bp, Homo sapiens
tcacattttttactggacttaa

SEQ ID NO: 10020505 - DNA, 22 bp, Homo sapiens
tcaccaggcaactatgtactcc

SEQ ID NO: 10020506 - DNA, 22 bp, Homo sapiens
tcaccaggattgggctgtaggc

SEQ ID NO: 10020507 - DNA, 22 bp, Homo sapiens
tcaccaggctagagtgcagtgg

SEQ ID NO: 10020508 - DNA, 22 bp, Homo sapiens
tcaccaggattcctatcagtag

SEQ ID NO: 10020509 - DNA, 22 bp, Homo sapiens
tcacattttctactactgtacg

SEQ ID NO: 10020510 - DNA, 22 bp, Homo sapiens
tcacattttcaaaagctggtgc

SEQ ID NO: 10020511 - DNA, 22 bp, Homo sapiens
tcacattttgttcaaggctagt

SEQ ID NO: 10020512 - DNA, 22 bp, Homo sapiens
tcacattttctactactgtacg

SEQ ID NO: 10020513 - DNA, 22 bp, Homo sapiens
tcacattttctactactgtacg

SEQ ID NO: 10020514 - DNA, 22 bp, Homo sapiens
tcacagtataacctcatatagg

SEQ ID NO: 10020515 - DNA, 22 bp, Homo sapiens
tcacattttcaaaagctggtgc

SEQ ID NO: 10020516 - DNA, 22 bp, Homo sapiens
tcacattttcaaaagctggtgc

SEQ ID NO: 10020517 - DNA, 22 bp, Homo sapiens
tcacattttatctgagattgac

SEQ ID NO: 10020518 - DNA, 22 bp, Homo sapiens
tcactctgttttactcactgtt

SEQ ID NO: 10020519 - DNA, 22 bp, Homo sapiens
tcactgaaaaccatacttcttt

SEQ ID NO: 10020520 - DNA, 22 bp, Homo sapiens
tcactgaaccagggatctctag

SEQ ID NO: 10020521 - DNA, 22 bp, Homo sapiens
tcactgaactctcatagagaaa

SEQ ID NO: 10020522 - DNA, 22 bp, Homo sapiens
tcactgaaagaatgacattatg

SEQ ID NO: 10020523 - DNA, 22 bp, Homo sapiens
tcactgaaagtaattctagtga

SEQ ID NO: 10020524 - DNA, 22 bp, Homo sapiens
tcactgaagtcttcaagtagga

SEQ ID NO: 10020525 - DNA, 22 bp, Homo sapiens
tcactgaagtcttcaagtagga

SEQ ID NO: 10020526 - DNA, 22 bp, Homo sapiens
tcactgaatgcagatacgtgac

SEQ ID NO: 10020527 - DNA, 22 bp, Homo sapiens
tcactgaatacttgtctcatcc

SEQ ID NO: 10020528 - DNA, 22 bp, Homo sapiens
tcactgaaggaagacactgtca

SEQ ID NO: 10020529 - DNA, 21 bp, Homo sapiens
tcactgaagcctaagatgttt

SEQ ID NO: 10020530 - DNA, 22 bp, Homo sapiens
tcactgaagactgggctctaaa

SEQ ID NO: 10020531 - DNA, 22 bp, Homo sapiens
tcactgaatttcaagctagtgg

SEQ ID NO: 10020532 - DNA, 20 bp, Homo sapiens
tcacttcttccttttgtcta

SEQ ID NO: 10020533 - DNA, 22 bp, Homo sapiens
tcacttcttcagctttccttga

SEQ ID NO: 10020534 - DNA, 22 bp, Homo sapiens
tcacttcttcagctttccttga

SEQ ID NO: 10020535 - DNA, 19 bp, Homo sapiens
tcacttctgttagcatgga

SEQ ID NO: 10020536 - DNA, 22 bp, Homo sapiens
tcactttagatcttcatctctt

SEQ ID NO: 10020537 - DNA, 22 bp, Homo sapiens
tcactttgacggccaacttcta

SEQ ID NO: 10020538 - DNA, 22 bp, Homo sapiens
tcagcaagtggaccatcctggg

SEQ ID NO: 10020539 - DNA, 22 bp, Homo sapiens
tcagcaagtggaccatcctggg

SEQ ID NO: 10020540 - DNA, 22 bp, Homo sapiens
tcagcactcgctacctagtaaa

SEQ ID NO: 10020541 - DNA, 22 bp, Homo sapiens
tcagcactgtcttttatttgaa

SEQ ID NO: 10020542 - DNA, 22 bp, Homo sapiens
tcagcactgtctattagtgaga

SEQ ID NO: 10020543 - DNA, 22 bp, Homo sapiens
tcagcactgtgtccagtctccc

SEQ ID NO: 10020544 - DNA, 22 bp, Homo sapiens
tcagcacttactagtggccttt

SEQ ID NO: 10020545 - DNA, 22 bp, Homo sapiens
tcagcactgaatctggatttgc

SEQ ID NO: 10020546 - DNA, 22 bp, Homo sapiens
tcagcactggcgctgggcaggt

SEQ ID NO: 10020547 - DNA, 22 bp, Homo sapiens
tcagaggaacactgtttcatgc

SEQ ID NO: 10020548 - DNA, 22 bp, Homo sapiens
tcagaggaaaggtcagatggct

SEQ ID NO: 10020549 - DNA, 22 bp, Homo sapiens
tcagaggaaaggtcagatggct

SEQ ID NO: 10020550 - DNA, 22 bp, Homo sapiens
tcagaggaaagggaacatagtc

SEQ ID NO: 10020551 - DNA, 22 bp, Homo sapiens
tcagcaaggctgcattctcatc

SEQ ID NO: 10020552 - DNA, 22 bp, Homo sapiens
tcagcaaggcagaagggaggta

SEQ ID NO: 10020553 - DNA, 22 bp, Homo sapiens
tcagcaagcagggggatgttca

SEQ ID NO: 10020554 - DNA, 22 bp, Homo sapiens
tcagcaaggcagaagggaggta

SEQ ID NO: 10020555 - DNA, 22 bp, Homo sapiens
tcagcaagtattttctgaatgc

SEQ ID NO: 10020556 - DNA, 22 bp, Homo sapiens
tcagcaaggctgcattctcatc

SEQ ID NO: 10020557 - DNA, 22 bp, Homo sapiens
tcagcaagtattttctgaatgc

SEQ ID NO: 10020558 - DNA, 22 bp, Homo sapiens
tcagcaagcagggggatgttca

SEQ ID NO: 10020559 - DNA, 22 bp, Homo sapiens
tcagagccctgctcctccccaa

SEQ ID NO: 10020560 - DNA, 22 bp, Homo sapiens
tcagagccaatcatggtgcatt

SEQ ID NO: 10020561 - DNA, 22 bp, Homo sapiens
tcagagctttggagaccaggaa

SEQ ID NO: 10020562 - DNA, 22 bp, Homo sapiens
tcagagcttatctcttgctgga

SEQ ID NO: 10020563 - DNA, 22 bp, Homo sapiens
tcagagctgtgcttcaggaaag

SEQ ID NO: 10020564 - DNA, 22 bp, Homo sapiens
tcagagctgggtgcttcttcct

SEQ ID NO: 10020565 - DNA, 20 bp, Homo sapiens
tcagagctgcaggagagaaa

SEQ ID NO: 10020566 - DNA, 22 bp, Homo sapiens
tcagagccaatcatggtgcatt

SEQ ID NO: 10020567 - DNA, 22 bp, Homo sapiens
tcagagccaatcatggtgcatt

SEQ ID NO: 10020568 - DNA, 22 bp, Homo sapiens
tcagagcattcgggtgacaaat

SEQ ID NO: 10020569 - DNA, 22 bp, Homo sapiens
tcagagcactggtgctaccttg

SEQ ID NO: 10020570 - DNA, 23 bp, Homo sapiens
tcagagaggccccctgcagagat

SEQ ID NO: 10020571 - DNA, 23 bp, Homo sapiens
tcagagaggccccctgcagagat

SEQ ID NO: 10020572 - DNA, 22 bp, Homo sapiens
tcagacatgttttaagacttat

SEQ ID NO: 10020573 - DNA, 22 bp, Homo sapiens
tcagaccatcctgctgttagtg

SEQ ID NO: 10020574 - DNA, 22 bp, Homo sapiens
tcagacatctcataatgtatta

SEQ ID NO: 10020575 - DNA, 22 bp, Homo sapiens
tcagacagtttgcagtgtgcct

SEQ ID NO: 10020576 - DNA, 22 bp, Homo sapiens
tcagacagtgtgatcagtctct

SEQ ID NO: 10020577 - DNA, 22 bp, Homo sapiens
tcagacagtgtgatcagtctct

SEQ ID NO: 10020578 - DNA, 20 bp, Homo sapiens
tcagacccagattagcaggt

SEQ ID NO: 10020579 - DNA, 22 bp, Homo sapiens
tcagacctggccgcctccatcc

SEQ ID NO: 10020580 - DNA, 23 bp, Homo sapiens
tcagagaactcgggcagatgacc

SEQ ID NO: 10020581 - DNA, 20 bp, Homo sapiens
tcagagaaggagctttcctg

SEQ ID NO: 10020582 - DNA, 22 bp, Homo sapiens
tcagacagcttgggataactga

SEQ ID NO: 10020583 - DNA, 22 bp, Homo sapiens
tcagacagattttgacacttgc

SEQ ID NO: 10020584 - DNA, 22 bp, Homo sapiens
tcagaaaaggtagctgtgacaa

SEQ ID NO: 10020585 - DNA, 22 bp, Homo sapiens
tcagacagggcttctcaaactt

SEQ ID NO: 10020586 - DNA, 20 bp, Homo sapiens
tcagacagtcgcagttctgg

SEQ ID NO: 10020587 - DNA, 20 bp, Homo sapiens
tcagacagtcgcagttctgg

SEQ ID NO: 10020588 - DNA, 22 bp, Homo sapiens
tcagacaggctggacagcttgc

SEQ ID NO: 10020589 - DNA, 22 bp, Homo sapiens
tcacttttgatccctatgcagt

SEQ ID NO: 10020590 - DNA, 22 bp, Homo sapiens
tcagaaaagactcaggggctga

SEQ ID NO: 10020591 - DNA, 22 bp, Homo sapiens
tcagaaaagaccacattattct

SEQ ID NO: 10020592 - DNA, 22 bp, Homo sapiens
tcagaaaagagaaaatcttata

SEQ ID NO: 10020593 - DNA, 22 bp, Homo sapiens
tcacaggctaaatttatgcagg

SEQ ID NO: 10020594 - DNA, 22 bp, Homo sapiens
tcacaggctccagggcctggat

SEQ ID NO: 10020595 - DNA, 23 bp, Homo sapiens
tcacagggcactggctggggttg

SEQ ID NO: 10020596 - DNA, 22 bp, Homo sapiens
tcacagggatggaatagaaata

SEQ ID NO: 10020597 - DNA, 22 bp, Homo sapiens
tcacaggctggtctccgaggac

SEQ ID NO: 10020598 - DNA, 22 bp, Homo sapiens
tcacaggctctccaccatgagg

SEQ ID NO: 10020599 - DNA, 22 bp, Homo sapiens
tcacagtaaaagcatggaagag

SEQ ID NO: 10020600 - DNA, 22 bp, Homo sapiens
tcacagtacatgattcagtggt

SEQ ID NO: 10020601 - DNA, 22 bp, Homo sapiens
tcacagtactccccaaagtttc

SEQ ID NO: 10020602 - DNA, 22 bp, Homo sapiens
tcacagtactgtgtgacttgag

SEQ ID NO: 10020603 - DNA, 22 bp, Homo sapiens
tcacagggtatctgggatggat

SEQ ID NO: 10020604 - DNA, 22 bp, Homo sapiens
tcacagggtatctgggatggat

SEQ ID NO: 10020605 - DNA, 22 bp, Homo sapiens
tcacagggtgtacatcacctat

SEQ ID NO: 10020606 - DNA, 22 bp, Homo sapiens
tcacagggtttggaagcctcct

SEQ ID NO: 10020607 - DNA, 20 bp, Homo sapiens
tcacaggggaccaggagcag

SEQ ID NO: 10020608 - DNA, 22 bp, Homo sapiens
tcacagggcattatggctccag

SEQ ID NO: 10020609 - DNA, 23 bp, Homo sapiens
tcacaggggccagcgctctgtgg

SEQ ID NO: 10020610 - DNA, 23 bp, Homo sapiens
tcacaggggccagcgctctgtgg

SEQ ID NO: 10020611 - DNA, 22 bp, Homo sapiens
tcacagaataaatgtactggcc

SEQ ID NO: 10020612 - DNA, 22 bp, Homo sapiens
tcacagaagttgaatttgcatg

SEQ ID NO: 10020613 - DNA, 22 bp, Homo sapiens
tcacagaataaattgagaagac

SEQ ID NO: 10020614 - DNA, 22 bp, Homo sapiens
tcacaggcccaaaccacgctta

SEQ ID NO: 10020615 - DNA, 22 bp, Homo sapiens
tcacagaagccctcgcaaacta

SEQ ID NO: 10020616 - DNA, 22 bp, Homo sapiens
tcacagaaggcatcacagaaga

SEQ ID NO: 10020617 - DNA, 22 bp, Homo sapiens
tcacagaaggagggaagctagt

SEQ ID NO: 10020618 - DNA, 22 bp, Homo sapiens
tcacagaagcttgaagattttc

SEQ ID NO: 10020619 - DNA, 22 bp, Homo sapiens
tcacagaagggaaagatgccaa

SEQ ID NO: 10020620 - DNA, 22 bp, Homo sapiens
tcacaaatagctatattaagga

SEQ ID NO: 10020621 - DNA, 22 bp, Homo sapiens
tcacaagagctggactgtcttt

SEQ ID NO: 10020622 - DNA, 22 bp, Homo sapiens
tcacaagagtaagttcatgcct

SEQ ID NO: 10020623 - DNA, 22 bp, Homo sapiens
tcacaaagggagggatagctgg

SEQ ID NO: 10020624 - DNA, 22 bp, Homo sapiens
tcacaaagggagggatagctgg

SEQ ID NO: 10020625 - DNA, 22 bp, Homo sapiens
tcacaaaggatgatgaattctg

SEQ ID NO: 10020626 - DNA, 22 bp, Homo sapiens
tcacaaagtgaagtgtgtcatg

SEQ ID NO: 10020627 - DNA, 22 bp, Homo sapiens
tcacaaggataagccacatata

SEQ ID NO: 10020628 - DNA, 19 bp, Homo sapiens
tcacaaggcctcttagtct

SEQ ID NO: 10020629 - DNA, 22 bp, Homo sapiens
tcacaaggtcctggtggataga

SEQ ID NO: 10020630 - DNA, 22 bp, Homo sapiens
tcacaatactcactcaatggct

SEQ ID NO: 10020631 - DNA, 22 bp, Homo sapiens
tcacaaggttcactataaattg

SEQ ID NO: 10020632 - DNA, 22 bp, Homo sapiens
tcacaagggccctgcagtccac

SEQ ID NO: 10020633 - DNA, 22 bp, Homo sapiens
tcacaagagtaagttcatgcct

SEQ ID NO: 10020634 - DNA, 22 bp, Homo sapiens
tcacaagatacagttagaagca

SEQ ID NO: 10020635 - DNA, 22 bp, Homo sapiens
tcacaagatatttcagtccttt

SEQ ID NO: 10020636 - DNA, 22 bp, Homo sapiens
tcacaaagctttgataagcaga

SEQ ID NO: 10020637 - DNA, 22 bp, Homo sapiens
tcacaaagctttgataagcaga

SEQ ID NO: 10020638 - DNA, 22 bp, Homo sapiens
tcacaaagctttgataagcaga

SEQ ID NO: 10020639 - DNA, 22 bp, Homo sapiens
tcacaaagagaattgtgggtgt

SEQ ID NO: 10020640 - DNA, 22 bp, Homo sapiens
tcacaaacaatgctttggaatt

SEQ ID NO: 10020641 - DNA, 20 bp, Homo sapiens
tcaattttctacaacatttg

SEQ ID NO: 10020642 - DNA, 20 bp, Homo sapiens
tcaattttctacaacatttg

SEQ ID NO: 10020643 - DNA, 22 bp, Homo sapiens
tcacaaaagcttttgaatttgg

SEQ ID NO: 10020644 - DNA, 22 bp, Homo sapiens
tcacagaaagctgtgtcctgac

SEQ ID NO: 10020645 - DNA, 22 bp, Homo sapiens
tcacagaaataagatagttatt

SEQ ID NO: 10020646 - DNA, 22 bp, Homo sapiens
tcacagaaataagatagttatt

SEQ ID NO: 10020647 - DNA, 22 bp, Homo sapiens
tcacagaaataagatagttatt

SEQ ID NO: 10020648 - DNA, 22 bp, Homo sapiens
tcacagaacaagcctggtggag

SEQ ID NO: 10020649 - DNA, 22 bp, Homo sapiens
tcacagaaatctgttttttcta

SEQ ID NO: 10020650 - DNA, 22 bp, Homo sapiens
tcacagaagagcattaagatga

SEQ ID NO: 10020651 - DNA, 22 bp, Homo sapiens
tcacagaagagcattaagatga

SEQ ID NO: 10020652 - DNA, 22 bp, Homo sapiens
tcacagaagagatattgacaga

SEQ ID NO: 10020653 - DNA, 22 bp, Homo sapiens
tcacagaacacaaatgccactt

SEQ ID NO: 10020654 - DNA, 22 bp, Homo sapiens
tcacagaagaagtagattgcat

SEQ ID NO: 10020655 - DNA, 22 bp, Homo sapiens
tcacagaagaagtagattgcat

SEQ ID NO: 10020656 - DNA, 22 bp, Homo sapiens
tcacacatgagtaaatacaggg

SEQ ID NO: 10020657 - DNA, 22 bp, Homo sapiens
tcacaatgcaagtgttcagtgg

SEQ ID NO: 10020658 - DNA, 20 bp, Homo sapiens
tcacaatatgagctcataca

SEQ ID NO: 10020659 - DNA, 22 bp, Homo sapiens
tcacaatactcactcaatggct

SEQ ID NO: 10020660 - DNA, 20 bp, Homo sapiens
tcacaatatgagctcataca

SEQ ID NO: 10020661 - DNA, 22 bp, Homo sapiens
tcacaatatttatcttccaatt

SEQ ID NO: 10020662 - DNA, 22 bp, Homo sapiens
tcacaatatttatcttccaatt

SEQ ID NO: 10020663 - DNA, 20 bp, Homo sapiens
tcacaatatgagctcataca

SEQ ID NO: 10020664 - DNA, 22 bp, Homo sapiens
tcacacatgctaagccagagat

SEQ ID NO: 10020665 - DNA, 20 bp, Homo sapiens
tcacacatggtaagctatga

SEQ ID NO: 10020666 - DNA, 22 bp, Homo sapiens
tcacagaaaagctgagcatcag

SEQ ID NO: 10020667 - DNA, 20 bp, Homo sapiens
tcacagaaacaaatagagaa

SEQ ID NO: 10020668 - DNA, 22 bp, Homo sapiens
tatttctgtttatttgtacatc

SEQ ID NO: 10020669 - DNA, 22 bp, Homo sapiens
tatttctgtttatttgtacatc

SEQ ID NO: 10020670 - DNA, 22 bp, Homo sapiens
tatttctgtatgcataaaagga

SEQ ID NO: 10020671 - DNA, 22 bp, Homo sapiens
tatttctgtatgcataaaagga

SEQ ID NO: 10020672 - DNA, 22 bp, Homo sapiens
tatttctgtcagccagatatgg

SEQ ID NO: 10020673 - DNA, 22 bp, Homo sapiens
tatttctgggagttcagaaatt

SEQ ID NO: 10020674 - DNA, 22 bp, Homo sapiens
tatttctgggagttcagaaatt

SEQ ID NO: 10020675 - DNA, 20 bp, Homo sapiens
tatttctgggcaaccattta

SEQ ID NO: 10020676 - DNA, 22 bp, Homo sapiens
tatttctgaggcccaggaagtg

SEQ ID NO: 10020677 - DNA, 22 bp, Homo sapiens
tatttctgattgctcatgaggc

SEQ ID NO: 10020678 - DNA, 22 bp, Homo sapiens
tatttctgggagttcagaaatt

SEQ ID NO: 10020679 - DNA, 22 bp, Homo sapiens
tatttcttcgggattcaagcta

SEQ ID NO: 10020680 - DNA, 22 bp, Homo sapiens
tatttcttcgggattcaagcta

SEQ ID NO: 10020681 - DNA, 22 bp, Homo sapiens
tatttcttgagactcgtcttcc

SEQ ID NO: 10020682 - DNA, 22 bp, Homo sapiens
tatttcttgagactcgtcttcc

SEQ ID NO: 10020683 - DNA, 22 bp, Homo sapiens
tatttcttcgggattcaagcta

SEQ ID NO: 10020684 - DNA, 22 bp, Homo sapiens
tatttcttgagactcgtcttcc

SEQ ID NO: 10020685 - DNA, 22 bp, Homo sapiens
tatttcttgagactcgtcttcc

SEQ ID NO: 10020686 - DNA, 22 bp, Homo sapiens
tatttcttgagtggtcagtttc

SEQ ID NO: 10020687 - DNA, 22 bp, Homo sapiens
tatttcttgagtggtcagtttc

SEQ ID NO: 10020688 - DNA, 22 bp, Homo sapiens
tcaagaatagctgcaaacaggg

SEQ ID NO: 10020689 - DNA, 22 bp, Homo sapiens
tcaagaatagctgcaaacaggg

SEQ ID NO: 10020690 - DNA, 22 bp, Homo sapiens
tcaagaatttggataagaaatg

SEQ ID NO: 10020691 - DNA, 20 bp, Homo sapiens
tcaagacagacatggagttt

SEQ ID NO: 10020692 - DNA, 18 bp, Homo sapiens
tcaagacatcatgaaata

SEQ ID NO: 10020693 - DNA, 18 bp, Homo sapiens
tcaagacatcatgaaata

SEQ ID NO: 10020694 - DNA, 22 bp, Homo sapiens
tcaagagccaggtaagcacagg

SEQ ID NO: 10020695 - DNA, 22 bp, Homo sapiens
tcaagaatttttaatgtgactg

SEQ ID NO: 10020696 - DNA, 22 bp, Homo sapiens
tcaagacagatgggtaacttgg

SEQ ID NO: 10020697 - DNA, 21 bp, Homo sapiens
tcaagacagcatatttaagaa

SEQ ID NO: 10020698 - DNA, 22 bp, Homo sapiens
tcaagacagtgtgatactggcc

SEQ ID NO: 10020699 - DNA, 22 bp, Homo sapiens
tcaagacatattaaatgtgcga

SEQ ID NO: 10020700 - DNA, 22 bp, Homo sapiens
tcaaggaagatagctattatga

SEQ ID NO: 10020701 - DNA, 22 bp, Homo sapiens
tcaaggaagggatattcttgaa

SEQ ID NO: 10020702 - DNA, 22 bp, Homo sapiens
tcaagataccaccattatatgt

SEQ ID NO: 10020703 - DNA, 22 bp, Homo sapiens
tcaaggaagggatattcttgaa

SEQ ID NO: 10020704 - DNA, 22 bp, Homo sapiens
tcaaggaaggtctgttgctcca

SEQ ID NO: 10020705 - DNA, 22 bp, Homo sapiens
tcaaggaatgactatatgagga

SEQ ID NO: 10020706 - DNA, 22 bp, Homo sapiens
tcaaggaatgactatatgagga

SEQ ID NO: 10020707 - DNA, 22 bp, Homo sapiens
tcaaggactattgcatgactcc

SEQ ID NO: 10020708 - DNA, 22 bp, Homo sapiens
tcaaggaatttagtttagtaaa

SEQ ID NO: 10020709 - DNA, 22 bp, Homo sapiens
tcaagtattattacagatgtag

SEQ ID NO: 10020710 - DNA, 22 bp, Homo sapiens
tcaagtatttatttctgctggc

SEQ ID NO: 10020711 - DNA, 22 bp, Homo sapiens
tcaagtctggagatctggaact

SEQ ID NO: 10020712 - DNA, 22 bp, Homo sapiens
tcaaggttgccaggaaggaaga

SEQ ID NO: 10020713 - DNA, 22 bp, Homo sapiens
tcaaggtgctgtgctgtgctag

SEQ ID NO: 10020714 - DNA, 22 bp, Homo sapiens
tcaaggtgactgaactataaac

SEQ ID NO: 10020715 - DNA, 22 bp, Homo sapiens
tcaagtatgacatcaagtttct

SEQ ID NO: 10020716 - DNA, 22 bp, Homo sapiens
tcaagtatatctagtcattagg

SEQ ID NO: 10020717 - DNA, 22 bp, Homo sapiens
tcaaggtgactgaactataaac

SEQ ID NO: 10020718 - DNA, 22 bp, Homo sapiens
tcaaggcaaagtaaatattcaa

SEQ ID NO: 10020719 - DNA, 22 bp, Homo sapiens
tcaaggagcccacagtctaatg

SEQ ID NO: 10020720 - DNA, 22 bp, Homo sapiens
tcaatttcccctattgatagac

SEQ ID NO: 10020721 - DNA, 22 bp, Homo sapiens
tcaatttcttggtttgataata

SEQ ID NO: 10020722 - DNA, 22 bp, Homo sapiens
tcaatttcttggtttgataata

SEQ ID NO: 10020723 - DNA, 22 bp, Homo sapiens
tcaatttcttggtttgataata

SEQ ID NO: 10020724 - DNA, 22 bp, Homo sapiens
tcaattttatgaaacaaagtga

SEQ ID NO: 10020725 - DNA, 22 bp, Homo sapiens
tcaatacagaaaggatattttg

SEQ ID NO: 10020726 - DNA, 21 bp, Homo sapiens
tcaatacaggtgcatgtgtct

SEQ ID NO: 10020727 - DNA, 22 bp, Homo sapiens
tcaatacacatgccgctgttct

SEQ ID NO: 10020728 - DNA, 17 bp, Homo sapiens
tcaatacactgctttta

SEQ ID NO: 10020729 - DNA, 22 bp, Homo sapiens
tcaataaaattgttttcctatc

SEQ ID NO: 10020730 - DNA, 22 bp, Homo sapiens
tcaataaatagcttggctcagc

SEQ ID NO: 10020731 - DNA, 22 bp, Homo sapiens
tcaataactttgtttagcattg

SEQ ID NO: 10020732 - DNA, 22 bp, Homo sapiens
tcaagtgtagtggtgtcaggtc

SEQ ID NO: 10020733 - DNA, 22 bp, Homo sapiens
tcaagttacctggtcattacta

SEQ ID NO: 10020734 - DNA, 22 bp, Homo sapiens
tcaagtttctctcagattatgg

SEQ ID NO: 10020735 - DNA, 22 bp, Homo sapiens
tcaagttaggtggttgttagga

SEQ ID NO: 10020736 - DNA, 20 bp, Homo sapiens
tcaagttttgcttgacaaga

SEQ ID NO: 10020737 - DNA, 22 bp, Homo sapiens
tcatgctttggttgctgtcctt

SEQ ID NO: 10020738 - DNA, 22 bp, Homo sapiens
tcatggaaacagcaatgctaat

SEQ ID NO: 10020739 - DNA, 22 bp, Homo sapiens
tcatggcacttagcacagtcct

SEQ ID NO: 10020740 - DNA, 20 bp, Homo sapiens
tcatggcagccacccacagg

SEQ ID NO: 10020741 - DNA, 22 bp, Homo sapiens
tcatggcacttagtgtctcaaa

SEQ ID NO: 10020742 - DNA, 22 bp, Homo sapiens
tcatggctaaccaaggcctgat

SEQ ID NO: 10020743 - DNA, 22 bp, Homo sapiens
tcatggcattgttaagggtttt

SEQ ID NO: 10020744 - DNA, 22 bp, Homo sapiens
tcatggacgtcaccatggtcct

SEQ ID NO: 10020745 - DNA, 23 bp, Homo sapiens
tcatggaatgaattcttctgtta

SEQ ID NO: 10020746 - DNA, 22 bp, Homo sapiens
tcatggatggccgggaggtgat

SEQ ID NO: 10020747 - DNA, 22 bp, Homo sapiens
tcatggatgatagcttcattgc

SEQ ID NO: 10020748 - DNA, 19 bp, Homo sapiens
tcatggatcaggtagttta

SEQ ID NO: 10020749 - DNA, 22 bp, Homo sapiens
tcatggataaaatattggttaa

SEQ ID NO: 10020750 - DNA, 22 bp, Homo sapiens
tcatggcacttagcacagtcct

SEQ ID NO: 10020751 - DNA, 22 bp, Homo sapiens
tcatggcacatgccctccaggg

SEQ ID NO: 10020752 - DNA, 22 bp, Homo sapiens
tcatggatgggcccagctctgt

SEQ ID NO: 10020753 - DNA, 22 bp, Homo sapiens
tcatggattaaattattaagtt

SEQ ID NO: 10020754 - DNA, 21 bp, Homo sapiens
tcatggattttctctgctttt

SEQ ID NO: 10020755 - DNA, 22 bp, Homo sapiens
tcattataaacatatgctaaag

SEQ ID NO: 10020756 - DNA, 22 bp, Homo sapiens
tcattattctctttaatgttct

SEQ ID NO: 10020757 - DNA, 22 bp, Homo sapiens
tcattagaaatgcagattctca

SEQ ID NO: 10020758 - DNA, 20 bp, Homo sapiens
tcattacagtgctaagatgt

SEQ ID NO: 10020759 - DNA, 22 bp, Homo sapiens
tcattacacagttcagtggaaa

SEQ ID NO: 10020760 - DNA, 22 bp, Homo sapiens
tcatggctgaaacagtaacaca

SEQ ID NO: 10020761 - DNA, 22 bp, Homo sapiens
tcattcactgcccagcagtgta

SEQ ID NO: 10020762 - DNA, 22 bp, Homo sapiens
tcattcactttgaaataaacga

SEQ ID NO: 10020763 - DNA, 16 bp, Homo sapiens
tcattgaagacagtac

SEQ ID NO: 10020764 - DNA, 22 bp, Homo sapiens
tcattgaacgaagagctccatt

SEQ ID NO: 10020765 - DNA, 18 bp, Homo sapiens
tcattcaaagtctactga

SEQ ID NO: 10020766 - DNA, 22 bp, Homo sapiens
tcattcaagatttcaatagatt

SEQ ID NO: 10020767 - DNA, 22 bp, Homo sapiens
tcattcaatgtaagcatatata

SEQ ID NO: 10020768 - DNA, 22 bp, Homo sapiens
tcatataccagagagtttatat

SEQ ID NO: 10020769 - DNA, 22 bp, Homo sapiens
tcatataagtttaaaactatct

SEQ ID NO: 10020770 - DNA, 22 bp, Homo sapiens
tcatataccagagagtttatat

SEQ ID NO: 10020771 - DNA, 22 bp, Homo sapiens
tcatatatctgcaaagcagtat

SEQ ID NO: 10020772 - DNA, 22 bp, Homo sapiens
tcatatagagggcatacaaatg

SEQ ID NO: 10020773 - DNA, 22 bp, Homo sapiens
tcatatactgccttgtagatta

SEQ ID NO: 10020774 - DNA, 22 bp, Homo sapiens
tcatatatttagttgtgcaaca

SEQ ID NO: 10020775 - DNA, 21 bp, Homo sapiens
tcatatctgctttgctgtctg

SEQ ID NO: 10020776 - DNA, 22 bp, Homo sapiens
tcatatgtcactcatgggcata

SEQ ID NO: 10020777 - DNA, 20 bp, Homo sapiens
tcatatgtggttgtatacaa

SEQ ID NO: 10020778 - DNA, 22 bp, Homo sapiens
tcagtgttcgctcagggactcc

SEQ ID NO: 10020779 - DNA, 22 bp, Homo sapiens
tcagtgttattagatgaggttt

SEQ ID NO: 10020780 - DNA, 22 bp, Homo sapiens
tcagtgttcagcggtgtgtgca

SEQ ID NO: 10020781 - DNA, 22 bp, Homo sapiens
tcagtgttagacaagtttggaa

SEQ ID NO: 10020782 - DNA, 22 bp, Homo sapiens
tcatataagagctttagagtca

SEQ ID NO: 10020783 - DNA, 22 bp, Homo sapiens
tcatataagtttaaaactatct

SEQ ID NO: 10020784 - DNA, 22 bp, Homo sapiens
tcatataagtttaaaactatct

SEQ ID NO: 10020785 - DNA, 22 bp, Homo sapiens
tcatagttctgttttgaaggat

SEQ ID NO: 10020786 - DNA, 22 bp, Homo sapiens
tcatagttatggagattaagga

SEQ ID NO: 10020787 - DNA, 22 bp, Homo sapiens
tcatataactggatattttcaa

SEQ ID NO: 10020788 - DNA, 22 bp, Homo sapiens
tcatagtttagttagtatgatt

SEQ ID NO: 10020789 - DNA, 22 bp, Homo sapiens
tcatataactggatattttcaa

SEQ ID NO: 10020790 - DNA, 22 bp, Homo sapiens
tcatattagggtaatgataaga

SEQ ID NO: 10020791 - DNA, 21 bp, Homo sapiens
tcatatttctcttgctattgt

SEQ ID NO: 10020792 - DNA, 22 bp, Homo sapiens
tcatatttatatgttggcacag

SEQ ID NO: 10020793 - DNA, 22 bp, Homo sapiens
tcatatttcaaaatggctggag

SEQ ID NO: 10020794 - DNA, 22 bp, Homo sapiens
tcatatttagttcacgctcaat

SEQ ID NO: 10020795 - DNA, 22 bp, Homo sapiens
tcatgctctggtttagctgttt

SEQ ID NO: 10020796 - DNA, 22 bp, Homo sapiens
tcatgctcatcattagagtgac

SEQ ID NO: 10020797 - DNA, 19 bp, Homo sapiens
tcatgcatttctaagtgca

SEQ ID NO: 10020798 - DNA, 22 bp, Homo sapiens
tcagtgaaatgcatattcttcg

SEQ ID NO: 10020799 - DNA, 22 bp, Homo sapiens
tcagtgactgggtattaaatca

SEQ ID NO: 10020800 - DNA, 22 bp, Homo sapiens
tcagtgatctaagggtatggcc

SEQ ID NO: 10020801 - DNA, 22 bp, Homo sapiens
tcagtgaatgagataactttag

SEQ ID NO: 10020802 - DNA, 22 bp, Homo sapiens
tcagtgaaccttctgtggcagg

SEQ ID NO: 10020803 - DNA, 22 bp, Homo sapiens
tcagtgaagtaatggtgagaga

SEQ ID NO: 10020804 - DNA, 22 bp, Homo sapiens
tcagtgatgaggtggctttcaa

SEQ ID NO: 10020805 - DNA, 22 bp, Homo sapiens
tcagtgattggtggactgccta

SEQ ID NO: 10020806 - DNA, 22 bp, Homo sapiens
tcagtgcagcggcagcagctct

SEQ ID NO: 10020807 - DNA, 22 bp, Homo sapiens
tcagtgcaggaatctctagcca

SEQ ID NO: 10020808 - DNA, 22 bp, Homo sapiens
tcagtgcagaatagtgatgcat

SEQ ID NO: 10020809 - DNA, 22 bp, Homo sapiens
tcagtgcagaatagtgatgcat

SEQ ID NO: 10020810 - DNA, 22 bp, Homo sapiens
tcagtgcaaaaaatgggctaga

SEQ ID NO: 10020811 - DNA, 21 bp, Homo sapiens
tcagtgcaattctatggggaa

SEQ ID NO: 10020812 - DNA, 22 bp, Homo sapiens
tcagtgcaatcaaggtatgttt

SEQ ID NO: 10020813 - DNA, 22 bp, Homo sapiens
tcagtgcacaatgacggtggct

SEQ ID NO: 10020814 - DNA, 22 bp, Homo sapiens
tcagtgttaatcagtggtacct

SEQ ID NO: 10020815 - DNA, 22 bp, Homo sapiens
tcagtgtctatagataaggttt

SEQ ID NO: 10020816 - DNA, 22 bp, Homo sapiens
tcagtgtctcatatgaggtttc

SEQ ID NO: 10020817 - DNA, 19 bp, Homo sapiens
tcagtgtgtgggaggtggt

SEQ ID NO: 10020818 - DNA, 22 bp, Homo sapiens
tcagtgtccaaaaagaggcaag

SEQ ID NO: 10020819 - DNA, 22 bp, Homo sapiens
tcagtgtccggagcctgagtgc

SEQ ID NO: 10020820 - DNA, 22 bp, Homo sapiens
tcagtgcagggtgggagagaga

SEQ ID NO: 10020821 - DNA, 22 bp, Homo sapiens
tcagtggttggatgatggtcgc

SEQ ID NO: 10020822 - DNA, 22 bp, Homo sapiens
tcagtgtaagttatgtagatgt

SEQ ID NO: 10020823 - DNA, 22 bp, Homo sapiens
tcagtgtagcagacttgtagcc

SEQ ID NO: 10020824 - DNA, 22 bp, Homo sapiens
tcagtgtcacaggatgctatgc

SEQ ID NO: 10020825 - DNA, 22 bp, Homo sapiens
tcagtgtcatatcaagaagatg

SEQ ID NO: 10020826 - DNA, 22 bp, Homo sapiens
tcaggtttttctcaaatcaggt

SEQ ID NO: 10020827 - DNA, 22 bp, Homo sapiens
tcaggtttttctcaaatcaggt

SEQ ID NO: 10020828 - DNA, 22 bp, Homo sapiens
tcaggttctggtgagggccctt

SEQ ID NO: 10020829 - DNA, 22 bp, Homo sapiens
tcagggaataagtagatgagtg

SEQ ID NO: 10020830 - DNA, 19 bp, Homo sapiens
tcagggaagttcaaagctc

SEQ ID NO: 10020831 - DNA, 21 bp, Homo sapiens
tcagggaagtgtgcagaaggg

SEQ ID NO: 10020832 - DNA, 18 bp, Homo sapiens
tcagggaagagaatatga

SEQ ID NO: 10020833 - DNA, 22 bp, Homo sapiens
tcagggaagacttcttagagga

SEQ ID NO: 10020834 - DNA, 22 bp, Homo sapiens
tcagggaagaaatgggacttta

SEQ ID NO: 10020835 - DNA, 17 bp, Homo sapiens
tcagggaatgaggttgt

SEQ ID NO: 10020836 - DNA, 22 bp, Homo sapiens
tcaggctggagtgcagtggcgc

SEQ ID NO: 10020837 - DNA, 22 bp, Homo sapiens
tcaggctggaatgcagtggggc

SEQ ID NO: 10020838 - DNA, 22 bp, Homo sapiens
tcaggctgctttcatgcttaga

SEQ ID NO: 10020839 - DNA, 18 bp, Homo sapiens
tcaggctggaagtttgcc

SEQ ID NO: 10020840 - DNA, 22 bp, Homo sapiens
tcaggccttcagacctggcccg

SEQ ID NO: 10020841 - DNA, 22 bp, Homo sapiens
tcaggcctggagaaaggaatga

SEQ ID NO: 10020842 - DNA, 22 bp, Homo sapiens
tcaggccttcagacctggcccg

SEQ ID NO: 10020843 - DNA, 22 bp, Homo sapiens
tcaggctgctggccagcaggct

SEQ ID NO: 10020844 - DNA, 22 bp, Homo sapiens
tcaggctgctggccagcaggct

SEQ ID NO: 10020845 - DNA, 22 bp, Homo sapiens
tcaggctgggagacaatcactg

SEQ ID NO: 10020846 - DNA, 22 bp, Homo sapiens
tcaggctggagtgcagtggcgc

SEQ ID NO: 10020847 - DNA, 18 bp, Homo sapiens
tcaggctgggcctccttc

SEQ ID NO: 10020848 - DNA, 22 bp, Homo sapiens
tcaggctgggctcctctcccca

SEQ ID NO: 10020849 - DNA, 22 bp, Homo sapiens
tcaggctggggtgctaaggtgt

SEQ ID NO: 10020850 - DNA, 22 bp, Homo sapiens
tcagggaaaagtcacactgggt

SEQ ID NO: 10020851 - DNA, 22 bp, Homo sapiens
tcagggaaatagcagggctgaa

SEQ ID NO: 10020852 - DNA, 22 bp, Homo sapiens
tcagggaaaggggagagtcatt

SEQ ID NO: 10020853 - DNA, 22 bp, Homo sapiens
tcagggaaatagcagggctgaa

SEQ ID NO: 10020854 - DNA, 22 bp, Homo sapiens
tcagggaaattcaagggagatt

SEQ ID NO: 10020855 - DNA, 22 bp, Homo sapiens
tcaggcagtggtaaatgagtta

SEQ ID NO: 10020856 - DNA, 20 bp, Homo sapiens
tcaggcagtggggaaaggca

SEQ ID NO: 10020857 - DNA, 20 bp, Homo sapiens
tcaggcagtggggaaaggca

SEQ ID NO: 10020858 - DNA, 22 bp, Homo sapiens
tcaggccaaagaaacagcatga

SEQ ID NO: 10020859 - DNA, 22 bp, Homo sapiens
tcaggccaaggtagacatgact

SEQ ID NO: 10020860 - DNA, 22 bp, Homo sapiens
tcaggccaaggtagacatgact

SEQ ID NO: 10020861 - DNA, 19 bp, Homo sapiens
tcaggcagttattcacaaa

SEQ ID NO: 10020862 - DNA, 22 bp, Homo sapiens
tcaggcctgcaggcttcctgga

SEQ ID NO: 10020863 - DNA, 22 bp, Homo sapiens
tcaggcctgcaggcttcctgga

SEQ ID NO: 10020864 - DNA, 22 bp, Homo sapiens
tcaggcctgcaggcttcctgga

SEQ ID NO: 10020865 - DNA, 22 bp, Homo sapiens
tcaggcctgcaaatgaatggta

SEQ ID NO: 10020866 - DNA, 22 bp, Homo sapiens
tcaggccacggctcactgagac

SEQ ID NO: 10020867 - DNA, 22 bp, Homo sapiens
tcaggccacggctcactgagac

SEQ ID NO: 10020868 - DNA, 22 bp, Homo sapiens
tcaggccacttcacaggtgatt

SEQ ID NO: 10020869 - DNA, 21 bp, Homo sapiens
tcaggcagtgcaaatacatgg

SEQ ID NO: 10020870 - DNA, 23 bp, Homo sapiens
tcaggatattgtgtgccaaggtg

SEQ ID NO: 10020871 - DNA, 22 bp, Homo sapiens
tcaggatacctcagttttagct

SEQ ID NO: 10020872 - DNA, 22 bp, Homo sapiens
tcaggataaaatgtaatggcaa

SEQ ID NO: 10020873 - DNA, 18 bp, Homo sapiens
tcaggagtttgtggatgg

SEQ ID NO: 10020874 - DNA, 22 bp, Homo sapiens
tcaggagtttggcctacagagg

SEQ ID NO: 10020875 - DNA, 22 bp, Homo sapiens
tcaggagtgataccatttgtca

SEQ ID NO: 10020876 - DNA, 22 bp, Homo sapiens
tcaggagtgataccatttgtca

SEQ ID NO: 10020877 - DNA, 22 bp, Homo sapiens
tcaggagtctgtgcagttccac

SEQ ID NO: 10020878 - DNA, 22 bp, Homo sapiens
tcaggagtcctgcctgcagcct

SEQ ID NO: 10020879 - DNA, 22 bp, Homo sapiens
tcaggagtgcagcagtttggag

SEQ ID NO: 10020880 - DNA, 22 bp, Homo sapiens
tcaggagtgccagtaccttttg

SEQ ID NO: 10020881 - DNA, 22 bp, Homo sapiens
tcaggagtttcaggtgtaagtg

SEQ ID NO: 10020882 - DNA, 21 bp, Homo sapiens
tcaggagtggagagaattggt

SEQ ID NO: 10020883 - DNA, 19 bp, Homo sapiens
tcaggagttagttgtgctc

SEQ ID NO: 10020884 - DNA, 22 bp, Homo sapiens
tcaggagttgaaggggatcctg

SEQ ID NO: 10020885 - DNA, 22 bp, Homo sapiens
tcaggaagaaagaagggagtgt

SEQ ID NO: 10020886 - DNA, 22 bp, Homo sapiens
tcaggaagaaagaagggagtgt

SEQ ID NO: 10020887 - DNA, 22 bp, Homo sapiens
tcaggaagaaagaagggagtgt

SEQ ID NO: 10020888 - DNA, 22 bp, Homo sapiens
tcaggaagaaattctgtatctt

SEQ ID NO: 10020889 - DNA, 22 bp, Homo sapiens
tcaggaagaagacggggcagga

SEQ ID NO: 10020890 - DNA, 22 bp, Homo sapiens
tcaggaagaagacggggcagga

SEQ ID NO: 10020891 - DNA, 22 bp, Homo sapiens
tcaggaagacaatctttggctc

SEQ ID NO: 10020892 - DNA, 22 bp, Homo sapiens
tcagctctgcactccactgtgg

SEQ ID NO: 10020893 - DNA, 22 bp, Homo sapiens
tcagctctgcaaggtcacctcc

SEQ ID NO: 10020894 - DNA, 21 bp, Homo sapiens
tcaggaagagccagttcatgc

SEQ ID NO: 10020895 - DNA, 21 bp, Homo sapiens
tcaggaagagccagttcatgc

SEQ ID NO: 10020896 - DNA, 21 bp, Homo sapiens
tcaggaagagcttctcccact

SEQ ID NO: 10020897 - DNA, 22 bp, Homo sapiens
tcaggaagcatcctgaggtgtc

SEQ ID NO: 10020898 - DNA, 22 bp, Homo sapiens
tcaggaagattagtttcctacc

SEQ ID NO: 10020899 - DNA, 21 bp, Homo sapiens
tcaggaagagcttctcccact

SEQ ID NO: 10020900 - DNA, 22 bp, Homo sapiens
tcaggaagccactccacagaga

SEQ ID NO: 10020901 - DNA, 22 bp, Homo sapiens
tcaggaagcatcctgaggtgtc

SEQ ID NO: 10020902 - DNA, 22 bp, Homo sapiens
tcaggaagcatcctgaggtgtc

SEQ ID NO: 10020903 - DNA, 22 bp, Homo sapiens
tcaggaagccggttaaatagat

SEQ ID NO: 10020904 - DNA, 22 bp, Homo sapiens
tcaggaagccactccacagaga

SEQ ID NO: 10020905 - DNA, 22 bp, Homo sapiens
tcaggaagccggttaaatagat

SEQ ID NO: 10020906 - DNA, 22 bp, Homo sapiens
tcaggaagctactgccagcagc

SEQ ID NO: 10020907 - DNA, 22 bp, Homo sapiens
tcaggaagctactgccagcagc

SEQ ID NO: 10020908 - DNA, 22 bp, Homo sapiens
tcaggaagctcttgctgattct

SEQ ID NO: 10020909 - DNA, 22 bp, Homo sapiens
tcaggaagctcttgctgattct

SEQ ID NO: 10020910 - DNA, 22 bp, Homo sapiens
tcaggaaggagctggcctgcca

SEQ ID NO: 10020911 - DNA, 22 bp, Homo sapiens
tcaggaaggagctggcctgcca

SEQ ID NO: 10020912 - DNA, 22 bp, Homo sapiens
tcaggaaggcaaattgcatgat

SEQ ID NO: 10020913 - DNA, 22 bp, Homo sapiens
tcaggaagctgaattacaaaaa

SEQ ID NO: 10020914 - DNA, 22 bp, Homo sapiens
tcaggaagctgctctgggtggt

SEQ ID NO: 10020915 - DNA, 22 bp, Homo sapiens
tcaggaaggcaaattgcatgat

SEQ ID NO: 10020916 - DNA, 22 bp, Homo sapiens
tcaggaaggcacttggtgtgtt

SEQ ID NO: 10020917 - DNA, 22 bp, Homo sapiens
tcaggaaggcgccccatcagga

SEQ ID NO: 10020918 - DNA, 22 bp, Homo sapiens
tcaggaaggcttcacacgagtg

SEQ ID NO: 10020919 - DNA, 22 bp, Homo sapiens
tcaggaagggctcagtctgtgc

SEQ ID NO: 10020920 - DNA, 22 bp, Homo sapiens
tcaggaggttgaccacggggca

SEQ ID NO: 10020921 - DNA, 22 bp, Homo sapiens
tcaggagtaagttataagtatt

SEQ ID NO: 10020922 - DNA, 22 bp, Homo sapiens
tcaggagtactggtgtctacag

SEQ ID NO: 10020923 - DNA, 22 bp, Homo sapiens
tcaggaggtttggattcagtta

SEQ ID NO: 10020924 - DNA, 22 bp, Homo sapiens
tcaggagtaaagaagacttgac

SEQ ID NO: 10020925 - DNA, 22 bp, Homo sapiens
tcaggagtaaagacagagttcc

SEQ ID NO: 10020926 - DNA, 22 bp, Homo sapiens
tcaggagtaagggtaacccaga

SEQ ID NO: 10020927 - DNA, 22 bp, Homo sapiens
tcagcctgctccaagtgctgcc

SEQ ID NO: 10020928 - DNA, 22 bp, Homo sapiens
tcagcctgctccaagtgctgcc

SEQ ID NO: 10020929 - DNA, 22 bp, Homo sapiens
tcagcaggcacggacaggctgc

SEQ ID NO: 10020930 - DNA, 22 bp, Homo sapiens
tcagcctgcgtcatggtgacac

SEQ ID NO: 10020931 - DNA, 21 bp, Homo sapiens
tcagcagcttttgcagtccct

SEQ ID NO: 10020932 - DNA, 22 bp, Homo sapiens
tcagcagccgcagctgactcag

SEQ ID NO: 10020933 - DNA, 18 bp, Homo sapiens
tcagcctgttgtctgcct

SEQ ID NO: 10020934 - DNA, 22 bp, Homo sapiens
tcagcctggtgattcctctgtc

SEQ ID NO: 10020935 - DNA, 22 bp, Homo sapiens
tcagcctggcaggatggcctgg

SEQ ID NO: 10020936 - DNA, 22 bp, Homo sapiens
tcagctacagcatctctgcttt

SEQ ID NO: 10020937 - DNA, 22 bp, Homo sapiens
tcagctcctcatgcaggggata

SEQ ID NO: 10020938 - DNA, 22 bp, Homo sapiens
tcagctcctcagagcctcagtt

SEQ ID NO: 10020939 - DNA, 22 bp, Homo sapiens
tcagctcctcagagcctcagtt

SEQ ID NO: 10020940 - DNA, 22 bp, Homo sapiens
tcagctccagagttgcacagtg

SEQ ID NO: 10020941 - DNA, 22 bp, Homo sapiens
tcagctccagagttgcacagtg

SEQ ID NO: 10020942 - DNA, 22 bp, Homo sapiens
tcagctcctatactttgtcctg

SEQ ID NO: 10020943 - DNA, 22 bp, Homo sapiens
tcagctctctgggctcgaacct

SEQ ID NO: 10020944 - DNA, 22 bp, Homo sapiens
tcagctctcacagatctcaacc

SEQ ID NO: 10020945 - DNA, 22 bp, Homo sapiens
tcagctctaagttttatgcaaa

SEQ ID NO: 10020946 - DNA, 22 bp, Homo sapiens
tcagctctacacacacctgtgt

SEQ ID NO: 10020947 - DNA, 22 bp, Homo sapiens
tccccaggggcctgggcacagt

SEQ ID NO: 10020948 - DNA, 22 bp, Homo sapiens
tccccaggggcatctctctgct

SEQ ID NO: 10020949 - DNA, 20 bp, Homo sapiens
tccccagggcatcaggagca

SEQ ID NO: 10020950 - DNA, 22 bp, Homo sapiens
tccccaggactaagttgcaatc

SEQ ID NO: 10020951 - DNA, 21 bp, Homo sapiens
tccccacatttctaaacagac

SEQ ID NO: 10020952 - DNA, 22 bp, Homo sapiens
tccccacatctctgcatcaggc

SEQ ID NO: 10020953 - DNA, 22 bp, Homo sapiens
tccccacagcagaagatctgag

SEQ ID NO: 10020954 - DNA, 22 bp, Homo sapiens
tccccacatctctgcatcaggc

SEQ ID NO: 10020955 - DNA, 22 bp, Homo sapiens
tccccacactttcactcctggc

SEQ ID NO: 10020956 - DNA, 22 bp, Homo sapiens
tccccacacagatacagagtag

SEQ ID NO: 10020957 - DNA, 22 bp, Homo sapiens
tccccaaaatacatggacgtgt

SEQ ID NO: 10020958 - DNA, 22 bp, Homo sapiens
tccccaaaatacatggacgtgt

SEQ ID NO: 10020959 - DNA, 22 bp, Homo sapiens
tccccaaagctttgtggtcagg

SEQ ID NO: 10020960 - DNA, 22 bp, Homo sapiens
tccccaaagctttgtggtcagg

SEQ ID NO: 10020961 - DNA, 22 bp, Homo sapiens
tcccacagggcttctctgtaca

SEQ ID NO: 10020962 - DNA, 22 bp, Homo sapiens
tcccacaggggctctgtgggtt

SEQ ID NO: 10020963 - DNA, 22 bp, Homo sapiens
tcccacagggcttctctgtaca

SEQ ID NO: 10020964 - DNA, 22 bp, Homo sapiens
tcccacaggcccagggcggaaa

SEQ ID NO: 10020965 - DNA, 22 bp, Homo sapiens
tcccacaggaaagtagacattg

SEQ ID NO: 10020966 - DNA, 22 bp, Homo sapiens
tcccacaggagcctgagtccca

SEQ ID NO: 10020967 - DNA, 22 bp, Homo sapiens
tcccacaggagcctgagtccca

SEQ ID NO: 10020968 - DNA, 22 bp, Homo sapiens
tcccacaggtggagcttgcagt

SEQ ID NO: 10020969 - DNA, 22 bp, Homo sapiens
tcccagggtgcgcctgccctcg

SEQ ID NO: 10020970 - DNA, 18 bp, Homo sapiens
tcccatcatcctctccag

SEQ ID NO: 10020971 - DNA, 20 bp, Homo sapiens
tcccatcacgcctgtgccag

SEQ ID NO: 10020972 - DNA, 22 bp, Homo sapiens
tcccatgttaccaaggagtcac

SEQ ID NO: 10020973 - DNA, 22 bp, Homo sapiens
tccagggccatctccatgaggc

SEQ ID NO: 10020974 - DNA, 22 bp, Homo sapiens
tccagggccagtccttgtctgt

SEQ ID NO: 10020975 - DNA, 22 bp, Homo sapiens
tccagggccatctccatgaggc

SEQ ID NO: 10020976 - DNA, 22 bp, Homo sapiens
tccagggccacagaggatgcta

SEQ ID NO: 10020977 - DNA, 22 bp, Homo sapiens
tccagggccacagaggatgcta

SEQ ID NO: 10020978 - DNA, 22 bp, Homo sapiens
tccagggccacagaggatgcta

SEQ ID NO: 10020979 - DNA, 22 bp, Homo sapiens
tccagggccatgaagttgcaca

SEQ ID NO: 10020980 - DNA, 22 bp, Homo sapiens
tccagggccccccagttgcacg

SEQ ID NO: 10020981 - DNA, 20 bp, Homo sapiens
tccagggccctggctcctct

SEQ ID NO: 10020982 - DNA, 20 bp, Homo sapiens
tccagggccctggctcctct

SEQ ID NO: 10020983 - DNA, 22 bp, Homo sapiens
tccagggcagccgcgggtgcgc

SEQ ID NO: 10020984 - DNA, 22 bp, Homo sapiens
tccagggcagccgcgggtgcgc

SEQ ID NO: 10020985 - DNA, 22 bp, Homo sapiens
tccagggcagccgcgggtgcgc

SEQ ID NO: 10020986 - DNA, 19 bp, Homo sapiens
tccagggcaggaacatgta

SEQ ID NO: 10020987 - DNA, 22 bp, Homo sapiens
tccagggccaagtcatggaacc

SEQ ID NO: 10020988 - DNA, 22 bp, Homo sapiens
tccaggctggaaatgtcaaact

SEQ ID NO: 10020989 - DNA, 22 bp, Homo sapiens
tccagttgtttgtattaactct

SEQ ID NO: 10020990 - DNA, 21 bp, Homo sapiens
tccagttgagactgaagatct

SEQ ID NO: 10020991 - DNA, 22 bp, Homo sapiens
tccagttgcctgtctctgatta

SEQ ID NO: 10020992 - DNA, 22 bp, Homo sapiens
tccagggctcattccctctgca

SEQ ID NO: 10020993 - DNA, 22 bp, Homo sapiens
tccagggctccccaacatccag

SEQ ID NO: 10020994 - DNA, 20 bp, Homo sapiens
tccagggctagggagctcat

SEQ ID NO: 10020995 - DNA, 22 bp, Homo sapiens
tccagggctcattccctctgca

SEQ ID NO: 10020996 - DNA, 22 bp, Homo sapiens
tccagggctcattccctctgca

SEQ ID NO: 10020997 - DNA, 22 bp, Homo sapiens
tccatcaccatttctgcgagct

SEQ ID NO: 10020998 - DNA, 22 bp, Homo sapiens
tccatccacattaacagatacg

SEQ ID NO: 10020999 - DNA, 22 bp, Homo sapiens
tccatcatgttcacagctatat

SEQ ID NO: 10021000 - DNA, 22 bp, Homo sapiens
tccatcatggcagcagcagtga

SEQ ID NO: 10021001 - DNA, 22 bp, Homo sapiens
tccagggccttacctcttcaga

SEQ ID NO: 10021002 - DNA, 22 bp, Homo sapiens
tccagggcctgaggttgaagtg

SEQ ID NO: 10021003 - DNA, 22 bp, Homo sapiens
tccagggccttacctcttcaga

SEQ ID NO: 10021004 - DNA, 21 bp, Homo sapiens
tccagggcgggcgcacggaga

SEQ ID NO: 10021005 - DNA, 22 bp, Homo sapiens
tccagggcgtgtgtgaaggaaa

SEQ ID NO: 10021006 - DNA, 22 bp, Homo sapiens
tccagggcgtgtgtgaaggaaa

SEQ ID NO: 10021007 - DNA, 22 bp, Homo sapiens
tccagggcgtgtgtgaaggaaa

SEQ ID NO: 10021008 - DNA, 20 bp, Homo sapiens
tccagggccctggctcctct

SEQ ID NO: 10021009 - DNA, 20 bp, Homo sapiens
tccagggccctggctcctct

SEQ ID NO: 10021010 - DNA, 22 bp, Homo sapiens
tccagggccttacctcttcaga

SEQ ID NO: 10021011 - DNA, 22 bp, Homo sapiens
tccagggcgtgtgtgaaggaaa

SEQ ID NO: 10021012 - DNA, 22 bp, Homo sapiens
tccagggctacaaggcaccaga

SEQ ID NO: 10021013 - DNA, 22 bp, Homo sapiens
tccagggctacaaggcaccaga

SEQ ID NO: 10021014 - DNA, 22 bp, Homo sapiens
tccagggctacaaggcaccaga

SEQ ID NO: 10021015 - DNA, 20 bp, Homo sapiens
tccagggctagggagctcat

SEQ ID NO: 10021016 - DNA, 22 bp, Homo sapiens
tccatctcacctgcactctgcg

SEQ ID NO: 10021017 - DNA, 22 bp, Homo sapiens
tccatctcacctgcactctgcg

SEQ ID NO: 10021018 - DNA, 22 bp, Homo sapiens
tccatccatgtaggaagatggt

SEQ ID NO: 10021019 - DNA, 22 bp, Homo sapiens
tccatccatgtaggaagatggt

SEQ ID NO: 10021020 - DNA, 22 bp, Homo sapiens
tccatccatggatggaaatgtg

SEQ ID NO: 10021021 - DNA, 22 bp, Homo sapiens
tccatgagggacactggatgct

SEQ ID NO: 10021022 - DNA, 22 bp, Homo sapiens
tccatgagggacactggatgct

SEQ ID NO: 10021023 - DNA, 20 bp, Homo sapiens
tccatcttgggcagaagcag

SEQ ID NO: 10021024 - DNA, 20 bp, Homo sapiens
tccatgcagtttccatacag

SEQ ID NO: 10021025 - DNA, 22 bp, Homo sapiens
tccatgccaggcagtcgatgca

SEQ ID NO: 10021026 - DNA, 22 bp, Homo sapiens
tcccaaggcacagggcagggac

SEQ ID NO: 10021027 - DNA, 22 bp, Homo sapiens
tcccaattaacaggtatcaggc

SEQ ID NO: 10021028 - DNA, 21 bp, Homo sapiens
tcccacagaaactgcgaaatt

SEQ ID NO: 10021029 - DNA, 22 bp, Homo sapiens
tcccacagatgctgtccagagt

SEQ ID NO: 10021030 - DNA, 22 bp, Homo sapiens
tcccacagatgctgtccagagt

SEQ ID NO: 10021031 - DNA, 22 bp, Homo sapiens
tcccacagagtggctcacctag

SEQ ID NO: 10021032 - DNA, 21 bp, Homo sapiens
tcccacagcgccagctcctgt

SEQ ID NO: 10021033 - DNA, 22 bp, Homo sapiens
tcccacagcttcgtgcttcccc

SEQ ID NO: 10021034 - DNA, 21 bp, Homo sapiens
tcccacagcgccagctcctgt

SEQ ID NO: 10021035 - DNA, 22 bp, Homo sapiens
tccaggcatctgtattttttaa

SEQ ID NO: 10021036 - DNA, 22 bp, Homo sapiens
tccaggcatggtgtaattttgc

SEQ ID NO: 10021037 - DNA, 22 bp, Homo sapiens
tccaggcatgtggccagtactc

SEQ ID NO: 10021038 - DNA, 22 bp, Homo sapiens
tccaggccacatggatggcgat

SEQ ID NO: 10021039 - DNA, 22 bp, Homo sapiens
tccaggccacgacctcctggat

SEQ ID NO: 10021040 - DNA, 22 bp, Homo sapiens
tccaggccaatgtagcaggccc

SEQ ID NO: 10021041 - DNA, 22 bp, Homo sapiens
tccaggccaatgtagcaggccc

SEQ ID NO: 10021042 - DNA, 22 bp, Homo sapiens
tccaggccacgacctcctggat

SEQ ID NO: 10021043 - DNA, 22 bp, Homo sapiens
tccaggctctaggctgctctcc

SEQ ID NO: 10021044 - DNA, 22 bp, Homo sapiens
tccaggctctcaggtgtcagca

SEQ ID NO: 10021045 - DNA, 22 bp, Homo sapiens
tccaggctgacgcagctattta

SEQ ID NO: 10021046 - DNA, 23 bp, Homo sapiens
tccaggctgaaggagcagatttt

SEQ ID NO: 10021047 - DNA, 22 bp, Homo sapiens
tccaggctgatccatgaagaat

SEQ ID NO: 10021048 - DNA, 22 bp, Homo sapiens
tccaggagtcagacagatggtg

SEQ ID NO: 10021049 - DNA, 22 bp, Homo sapiens
tccaggagtcagacagatggtg

SEQ ID NO: 10021050 - DNA, 22 bp, Homo sapiens
tccaggaggttgagactgcagt

SEQ ID NO: 10021051 - DNA, 22 bp, Homo sapiens
tccaggagtcctgggtggcccc

SEQ ID NO: 10021052 - DNA, 22 bp, Homo sapiens
tccaggagtctagcctcaggcc

SEQ ID NO: 10021053 - DNA, 22 bp, Homo sapiens
tccaggagggggagccgtgccg

SEQ ID NO: 10021054 - DNA, 22 bp, Homo sapiens
tccaggagggattgggctgtgg

SEQ ID NO: 10021055 - DNA, 22 bp, Homo sapiens
tccaggagggggagccgtgccg

SEQ ID NO: 10021056 - DNA, 22 bp, Homo sapiens
tccaggagggttttctgccttc

SEQ ID NO: 10021057 - DNA, 22 bp, Homo sapiens
tccaggaggtgaggggaccaaa

SEQ ID NO: 10021058 - DNA, 22 bp, Homo sapiens
tccaggaggttgagactgcagt

SEQ ID NO: 10021059 - DNA, 22 bp, Homo sapiens
tccaggaggttgagactgcagt

SEQ ID NO: 10021060 - DNA, 22 bp, Homo sapiens
tccaggagtgataaggccactg

SEQ ID NO: 10021061 - DNA, 21 bp, Homo sapiens
tccaggagtggctgggcaggg

SEQ ID NO: 10021062 - DNA, 22 bp, Homo sapiens
tccaggagtttgagactgcagt

SEQ ID NO: 10021063 - DNA, 22 bp, Homo sapiens
tccaggagtttgagactgcagt

SEQ ID NO: 10021064 - DNA, 21 bp, Homo sapiens
tccaggagttctaataggtgt

SEQ ID NO: 10021065 - DNA, 22 bp, Homo sapiens
tccaggagtggggcagaggtct

SEQ ID NO: 10021066 - DNA, 22 bp, Homo sapiens
tccaggcagggcagccatcaag

SEQ ID NO: 10021067 - DNA, 22 bp, Homo sapiens
tccaggcataatgcccagtggt

SEQ ID NO: 10021068 - DNA, 22 bp, Homo sapiens
tccaggagtttgagactgcagt

SEQ ID NO: 10021069 - DNA, 19 bp, Homo sapiens
tccagaagtccctgagcgg

SEQ ID NO: 10021070 - DNA, 22 bp, Homo sapiens
tccagaatactctgaaatcatt

SEQ ID NO: 10021071 - DNA, 22 bp, Homo sapiens
tccagagaggtttctccatgct

SEQ ID NO: 10021072 - DNA, 22 bp, Homo sapiens
tcattgaattctgggggttgag

SEQ ID NO: 10021073 - DNA, 22 bp, Homo sapiens
tcattgaatttcacagctttat

SEQ ID NO: 10021074 - DNA, 22 bp, Homo sapiens
tcattgaatatggggccataca

SEQ ID NO: 10021075 - DNA, 22 bp, Homo sapiens
tcattgaatgagatgcaataga

SEQ ID NO: 10021076 - DNA, 22 bp, Homo sapiens
tcattgaagtgactgaaagatt

SEQ ID NO: 10021077 - DNA, 22 bp, Homo sapiens
tcattgaatacatatttgggat

SEQ ID NO: 10021078 - DNA, 22 bp, Homo sapiens
tcattgaagacttactggcttc

SEQ ID NO: 10021079 - DNA, 22 bp, Homo sapiens
tcattgaagcattttgtgtatt

SEQ ID NO: 10021080 - DNA, 22 bp, Homo sapiens
tcattgaagcccttgacaagcc

SEQ ID NO: 10021081 - DNA, 22 bp, Homo sapiens
tcattgaatttggttcaatatg

SEQ ID NO: 10021082 - DNA, 22 bp, Homo sapiens
tcattgaatgctctgcaggttg

SEQ ID NO: 10021083 - DNA, 22 bp, Homo sapiens
tcattgacttgaagaaaacaat

SEQ ID NO: 10021084 - DNA, 18 bp, Homo sapiens
tccagagctactgtggtg

SEQ ID NO: 10021085 - DNA, 22 bp, Homo sapiens
tccagagctaattcagcagctg

SEQ ID NO: 10021086 - DNA, 22 bp, Homo sapiens
tccagagcctgcgcactggctg

SEQ ID NO: 10021087 - DNA, 22 bp, Homo sapiens
tccagagcctgcgcactggctg

SEQ ID NO: 10021088 - DNA, 17 bp, Homo sapiens
tccagagcacagagctc

SEQ ID NO: 10021089 - DNA, 22 bp, Homo sapiens
tccagagatctctcttccctgt

SEQ ID NO: 10021090 - DNA, 22 bp, Homo sapiens
tccagagatcacactgggcagg

SEQ ID NO: 10021091 - DNA, 23 bp, Homo sapiens
tccagcagccaagaagggtagaa

SEQ ID NO: 10021092 - DNA, 23 bp, Homo sapiens
tccagcagccaagaagggtagaa

SEQ ID NO: 10021093 - DNA, 22 bp, Homo sapiens
tccagcagaggttgataatacc

SEQ ID NO: 10021094 - DNA, 18 bp, Homo sapiens
tccagcagcatagtttcc

SEQ ID NO: 10021095 - DNA, 22 bp, Homo sapiens
tccagcagagtctctgaggggg

SEQ ID NO: 10021096 - DNA, 23 bp, Homo sapiens
tccagcagagccttccaggaggg

SEQ ID NO: 10021097 - DNA, 23 bp, Homo sapiens
tccagcagagccttccaggaggg

SEQ ID NO: 10021098 - DNA, 22 bp, Homo sapiens
tccagcagaccatcaaggctca

SEQ ID NO: 10021099 - DNA, 22 bp, Homo sapiens
tccagcagactcatcagcaagg

SEQ ID NO: 10021100 - DNA, 22 bp, Homo sapiens
tccagcagcccgaaggcccatc

SEQ ID NO: 10021101 - DNA, 22 bp, Homo sapiens
tccagcagggaattagtagtct

SEQ ID NO: 10021102 - DNA, 22 bp, Homo sapiens
tccagcagccacacctctggac

SEQ ID NO: 10021103 - DNA, 22 bp, Homo sapiens
tccagcaggtccgagacaagtt

SEQ ID NO: 10021104 - DNA, 22 bp, Homo sapiens
tccagcaggtccgagacaagtt

SEQ ID NO: 10021105 - DNA, 22 bp, Homo sapiens
tccagcagggaattagtagtct

SEQ ID NO: 10021106 - DNA, 22 bp, Homo sapiens
tccagcaggtccgagacaagtt

SEQ ID NO: 10021107 - DNA, 22 bp, Homo sapiens
tccagcaggtccgagacaagtt

SEQ ID NO: 10021108 - DNA, 18 bp, Homo sapiens
tccagcaggtctgaggtg

SEQ ID NO: 10021109 - DNA, 22 bp, Homo sapiens
tccagcagaaccagagacctgg

SEQ ID NO: 10021110 - DNA, 22 bp, Homo sapiens
tccagaggggcagccctgtgct

SEQ ID NO: 10021111 - DNA, 22 bp, Homo sapiens
tccagagggcgatggctggggg

SEQ ID NO: 10021112 - DNA, 22 bp, Homo sapiens
tccagagggcgatggctggggg

SEQ ID NO: 10021113 - DNA, 22 bp, Homo sapiens
tccagagggcgatggctggggg

SEQ ID NO: 10021114 - DNA, 22 bp, Homo sapiens
tccagaggcagctgcggtcagg

SEQ ID NO: 10021115 - DNA, 22 bp, Homo sapiens
tccagaggctccaaagggagat

SEQ ID NO: 10021116 - DNA, 22 bp, Homo sapiens
tccagaggctccaaagggagat

SEQ ID NO: 10021117 - DNA, 22 bp, Homo sapiens
tccagaggctccaaagggagat

SEQ ID NO: 10021118 - DNA, 22 bp, Homo sapiens
tccagaggctccaaagggagat

SEQ ID NO: 10021119 - DNA, 22 bp, Homo sapiens
tccagaggctctgagggagagt

SEQ ID NO: 10021120 - DNA, 22 bp, Homo sapiens
tccagaggctctgagggagagt

SEQ ID NO: 10021121 - DNA, 22 bp, Homo sapiens
tccagaggctctgagggagagt

SEQ ID NO: 10021122 - DNA, 22 bp, Homo sapiens
tccagagctgtcctactgtgag

SEQ ID NO: 10021123 - DNA, 22 bp, Homo sapiens
tccagaggcaaaaaggtatgga

SEQ ID NO: 10021124 - DNA, 22 bp, Homo sapiens
tccagagctgggtctgtgctca

SEQ ID NO: 10021125 - DNA, 22 bp, Homo sapiens
tccagagctgggtctgtgctca

SEQ ID NO: 10021126 - DNA, 22 bp, Homo sapiens
tccagcttttattggatgagga

SEQ ID NO: 10021127 - DNA, 22 bp, Homo sapiens
tccagctttgcctgatcatata

SEQ ID NO: 10021128 - DNA, 22 bp, Homo sapiens
tccagctttggctctagctaca

SEQ ID NO: 10021129 - DNA, 22 bp, Homo sapiens
tccagctttcacgctcctgcct

SEQ ID NO: 10021130 - DNA, 22 bp, Homo sapiens
tccagctttcacgctcctgcct

SEQ ID NO: 10021131 - DNA, 22 bp, Homo sapiens
tccagcttgggtgggaggaggt

SEQ ID NO: 10021132 - DNA, 22 bp, Homo sapiens
tccagcttggcagagctacctg

SEQ ID NO: 10021133 - DNA, 20 bp, Homo sapiens
tccagctgtctttcagagac

SEQ ID NO: 10021134 - DNA, 22 bp, Homo sapiens
tccagctctaacatgctgggcc

SEQ ID NO: 10021135 - DNA, 22 bp, Homo sapiens
tccagctctaaggctgatagcc

SEQ ID NO: 10021136 - DNA, 21 bp, Homo sapiens
tccagctcctgccactcctta

SEQ ID NO: 10021137 - DNA, 22 bp, Homo sapiens
tccagctcctgagttcactgct

SEQ ID NO: 10021138 - DNA, 22 bp, Homo sapiens
tccagctcctgagttcactgct

SEQ ID NO: 10021139 - DNA, 22 bp, Homo sapiens
tccagctctgcttcacagtctc

SEQ ID NO: 10021140 - DNA, 22 bp, Homo sapiens
tccagctctgcttcacagtctc

SEQ ID NO: 10021141 - DNA, 18 bp, Homo sapiens
tccagctctgccacttac

SEQ ID NO: 10021142 - DNA, 22 bp, Homo sapiens
tccagctctgattctcactagc

SEQ ID NO: 10021143 - DNA, 21 bp, Homo sapiens
tccagctctcatagtgttcca

SEQ ID NO: 10021144 - DNA, 22 bp, Homo sapiens
tccagctctgattctcactagc

SEQ ID NO: 10021145 - DNA, 22 bp, Homo sapiens
tccagcagtccatgtgagacac

SEQ ID NO: 10021146 - DNA, 20 bp, Homo sapiens
tccagcagtatgctatactt

SEQ ID NO: 10021147 - DNA, 22 bp, Homo sapiens
tccagcaggttggtcaggtgca

SEQ ID NO: 10021148 - DNA, 22 bp, Homo sapiens
tccagcagtaaggaaagtacat

SEQ ID NO: 10021149 - DNA, 22 bp, Homo sapiens
tccagcaggttggtcaggtgca

SEQ ID NO: 10021150 - DNA, 19 bp, Homo sapiens
tccagcagtgcttgaaatc

SEQ ID NO: 10021151 - DNA, 22 bp, Homo sapiens
tccagcagtgctctagagcgtg

SEQ ID NO: 10021152 - DNA, 22 bp, Homo sapiens
tccagcagtccatgtgagacac

SEQ ID NO: 10021153 - DNA, 22 bp, Homo sapiens
tccagcagtgctcaggactcac

SEQ ID NO: 10021154 - DNA, 22 bp, Homo sapiens
tccagcctttctactcactgag

SEQ ID NO: 10021155 - DNA, 22 bp, Homo sapiens
tccagccaatcagagctgaggc

SEQ ID NO: 10021156 - DNA, 22 bp, Homo sapiens
tccagccaagggaggttactag

SEQ ID NO: 10021157 - DNA, 22 bp, Homo sapiens
tccagccaagccttggtagctg

SEQ ID NO: 10021158 - DNA, 22 bp, Homo sapiens
tccagccaactgcctagggagc

SEQ ID NO: 10021159 - DNA, 22 bp, Homo sapiens
tccagcattcttagacctctat

SEQ ID NO: 10021160 - DNA, 18 bp, Homo sapiens
tccagctcacagatgggc

SEQ ID NO: 10021161 - DNA, 22 bp, Homo sapiens
tccagctcaaattcagcttcca

SEQ ID NO: 10021162 - DNA, 18 bp, Homo sapiens
tccagcgtgctccagggc

SEQ ID NO: 10021163 - DNA, 22 bp, Homo sapiens
tccagctaacacctactggcca

SEQ ID NO: 10021164 - DNA, 22 bp, Homo sapiens
tccagctcatctgtctccatta

SEQ ID NO: 10021165 - DNA, 22 bp, Homo sapiens
tccagctcccactctcactgct

SEQ ID NO: 10021166 - DNA, 22 bp, Homo sapiens
tccagctccacagcctccctgt

SEQ ID NO: 10021167 - DNA, 22 bp, Homo sapiens
tccagctccacagcctccctgt

SEQ ID NO: 10021168 - DNA, 22 bp, Homo sapiens
tccagctcccactctcactgct

SEQ ID NO: 10021169 - DNA, 23 bp, Homo sapiens
tccagctcccttcaatggcactg

SEQ ID NO: 10021170 - DNA, 23 bp, Homo sapiens
tttgcaaattggacacaaccaca

SEQ ID NO: 10021171 - DNA, 22 bp, Homo sapiens
tttgcaaggcagcaggtgcagt

SEQ ID NO: 10021172 - DNA, 23 bp, Homo sapiens
tttgcaaattttcctgactactc

SEQ ID NO: 10021173 - DNA, 22 bp, Homo sapiens
tttgcacacattcttagaaatg

SEQ ID NO: 10021174 - DNA, 22 bp, Homo sapiens
tttgcacacacaataacaaatg

SEQ ID NO: 10021175 - DNA, 22 bp, Homo sapiens
tttgcacagcctttctggctgc

SEQ ID NO: 10021176 - DNA, 22 bp, Homo sapiens
tttgcactagcatttgtccatg

SEQ ID NO: 10021177 - DNA, 22 bp, Homo sapiens
tttgcacacattcttagaaatg

SEQ ID NO: 10021178 - DNA, 22 bp, Homo sapiens
tttgcacttaacttatttgaaa

SEQ ID NO: 10021179 - DNA, 22 bp, Homo sapiens
tttgcagcaaggagagagcatt

SEQ ID NO: 10021180 - DNA, 18 bp, Homo sapiens
tttctttctgcctggggc

SEQ ID NO: 10021181 - DNA, 22 bp, Homo sapiens
tttctttccatgagcctatgta

SEQ ID NO: 10021182 - DNA, 22 bp, Homo sapiens
tttctttccatgagcctatgta

SEQ ID NO: 10021183 - DNA, 22 bp, Homo sapiens
tttctttccatacatattgcta

SEQ ID NO: 10021184 - DNA, 22 bp, Homo sapiens
tttctttccatacatattgcta

SEQ ID NO: 10021185 - DNA, 22 bp, Homo sapiens
tttctttccagagtgattggca

SEQ ID NO: 10021186 - DNA, 22 bp, Homo sapiens
tttctttatcctcctttgcaca

SEQ ID NO: 10021187 - DNA, 22 bp, Homo sapiens
tttctttatcctcctttgcaca

SEQ ID NO: 10021188 - DNA, 22 bp, Homo sapiens
tttgcaaataaataagtgctcg

SEQ ID NO: 10021189 - DNA, 22 bp, Homo sapiens
tttgattttcagcaatagtggc

SEQ ID NO: 10021190 - DNA, 22 bp, Homo sapiens
tttgattttcagcaatagtggc

SEQ ID NO: 10021191 - DNA, 22 bp, Homo sapiens
tttgcaaatacagaggtcttgc

SEQ ID NO: 10021192 - DNA, 22 bp, Homo sapiens
tttgcaaataccatgaaacttg

SEQ ID NO: 10021193 - DNA, 22 bp, Homo sapiens
tttgcaaataccatgaaacttg

SEQ ID NO: 10021194 - DNA, 22 bp, Homo sapiens
tttggaaggtgaggcatgaagg

SEQ ID NO: 10021195 - DNA, 22 bp, Homo sapiens
tttggaaggtgaggcatgaagg

SEQ ID NO: 10021196 - DNA, 22 bp, Homo sapiens
tttggacttagcctgcagaatt

SEQ ID NO: 10021197 - DNA, 22 bp, Homo sapiens
tttggacttagcctgcagaatt

SEQ ID NO: 10021198 - DNA, 22 bp, Homo sapiens
tttggaagggaaccaaaacatg

SEQ ID NO: 10021199 - DNA, 22 bp, Homo sapiens
tttggaagggaaccaaaacatg

SEQ ID NO: 10021200 - DNA, 22 bp, Homo sapiens
tttggaagacagggcaggaaag

SEQ ID NO: 10021201 - DNA, 22 bp, Homo sapiens
tttggaagggaaagaaagtact

SEQ ID NO: 10021202 - DNA, 22 bp, Homo sapiens
tttggaagggaaagaaagtact

SEQ ID NO: 10021203 - DNA, 22 bp, Homo sapiens
tttggaggggaagaccttggag

SEQ ID NO: 10021204 - DNA, 22 bp, Homo sapiens
tttggagatagggcctagcaat

SEQ ID NO: 10021205 - DNA, 22 bp, Homo sapiens
tttggagagcagctaggccctt

SEQ ID NO: 10021206 - DNA, 22 bp, Homo sapiens
tttggagagagttaaatatgtt

SEQ ID NO: 10021207 - DNA, 20 bp, Homo sapiens
tttggagagaaagaagtagt

SEQ ID NO: 10021208 - DNA, 22 bp, Homo sapiens
tttggagaagttgctaaagtgt

SEQ ID NO: 10021209 - DNA, 22 bp, Homo sapiens
tttggatatgtttctgtcttct

SEQ ID NO: 10021210 - DNA, 22 bp, Homo sapiens
tttggatatgtttctgtcttct

SEQ ID NO: 10021211 - DNA, 22 bp, Homo sapiens
tttgtacatcctaattctgagt

SEQ ID NO: 10021212 - DNA, 22 bp, Homo sapiens
tttgtacaattagcagaggcta

SEQ ID NO: 10021213 - DNA, 22 bp, Homo sapiens
tttgtacatgaatgtgcaccca

SEQ ID NO: 10021214 - DNA, 23 bp, Homo sapiens
tttgtacattgaggaggcagaat

SEQ ID NO: 10021215 - DNA, 22 bp, Homo sapiens
tttgtacattcaaatgtcccat

SEQ ID NO: 10021216 - DNA, 22 bp, Homo sapiens
tttggcagagtcatttcagaaa

SEQ ID NO: 10021217 - DNA, 22 bp, Homo sapiens
tttggcactgttctaggtgcaa

SEQ ID NO: 10021218 - DNA, 22 bp, Homo sapiens
tttggcaagaaaatgtgattga

SEQ ID NO: 10021219 - DNA, 22 bp, Homo sapiens
tttgtttatcaaggtctagcat

SEQ ID NO: 10021220 - DNA, 22 bp, Homo sapiens
tttgtttatcaaggtctagcat

SEQ ID NO: 10021221 - DNA, 22 bp, Homo sapiens
tttgtttattaggggagagttg

SEQ ID NO: 10021222 - DNA, 22 bp, Homo sapiens
tttgtttcgcagcctctctctg

SEQ ID NO: 10021223 - DNA, 22 bp, Homo sapiens
tttgtttagatggtaaatcagt

SEQ ID NO: 10021224 - DNA, 22 bp, Homo sapiens
tttgtttagagaattgaagcag

SEQ ID NO: 10021225 - DNA, 22 bp, Homo sapiens
tttgtttagagaattgaagcag

SEQ ID NO: 10021226 - DNA, 22 bp, Homo sapiens
tttgttttcaatgtgtcattca

SEQ ID NO: 10021227 - DNA, 22 bp, Homo sapiens
tttgttttcaatgtgtcattca

SEQ ID NO: 10021228 - DNA, 22 bp, Homo sapiens
tttgttttcaatgtgtcattca

SEQ ID NO: 10021229 - DNA, 22 bp, Homo sapiens
tttgttttgaactagctcagaa

SEQ ID NO: 10021230 - DNA, 22 bp, Homo sapiens
tttgttttcaatgtgtcattca

SEQ ID NO: 10021231 - DNA, 22 bp, Homo sapiens
tttgttttctgtaggcctttcc

SEQ ID NO: 10021232 - DNA, 22 bp, Homo sapiens
tttgttttgaactagctcagaa

SEQ ID NO: 10021233 - DNA, 22 bp, Homo sapiens
ttttagaagtgcctatcctatg

SEQ ID NO: 10021234 - DNA, 22 bp, Homo sapiens
ttttatacacatgaacatgcag

SEQ ID NO: 10021235 - DNA, 22 bp, Homo sapiens
ttttagtttggatttctaaagc

SEQ ID NO: 10021236 - DNA, 22 bp, Homo sapiens
ttttagaagttcatgtgggatt

SEQ ID NO: 10021237 - DNA, 22 bp, Homo sapiens
ttttataaagagagtcagttgg

SEQ ID NO: 10021238 - DNA, 22 bp, Homo sapiens
ttttagtttggatttctaaagc

SEQ ID NO: 10021239 - DNA, 22 bp, Homo sapiens
ttttatatggcacattggttgg

SEQ ID NO: 10021240 - DNA, 22 bp, Homo sapiens
ttttatcagcagggataacaag

SEQ ID NO: 10021241 - DNA, 22 bp, Homo sapiens
ttttatcaatcattaagacatt

SEQ ID NO: 10021242 - DNA, 22 bp, Homo sapiens
tttgtagcagcatgatttataa

SEQ ID NO: 10021243 - DNA, 22 bp, Homo sapiens
tttgtacatttcactccattgt

SEQ ID NO: 10021244 - DNA, 22 bp, Homo sapiens
tttgtactatggtttttcacta

SEQ ID NO: 10021245 - DNA, 22 bp, Homo sapiens
tttgtactctcagaattcagaa

SEQ ID NO: 10021246 - DNA, 22 bp, Homo sapiens
tttgtactgaccaattatttga

SEQ ID NO: 10021247 - DNA, 23 bp, Homo sapiens
tttgtactgcattatgagacaca

SEQ ID NO: 10021248 - DNA, 23 bp, Homo sapiens
tttgtactgcattatgagacaca

SEQ ID NO: 10021249 - DNA, 22 bp, Homo sapiens
tttgtactgccacagctgacgt

SEQ ID NO: 10021250 - DNA, 22 bp, Homo sapiens
tttgtactggaagaacatgcaa

SEQ ID NO: 10021251 - DNA, 22 bp, Homo sapiens
tttgtagagaatgttaagcact

SEQ ID NO: 10021252 - DNA, 22 bp, Homo sapiens
tttgttcttagtatctgtgtgc

SEQ ID NO: 10021253 - DNA, 22 bp, Homo sapiens
tttgttcttagtatctgtgtgc

SEQ ID NO: 10021254 - DNA, 22 bp, Homo sapiens
tttgttcttgcaacagttatta

SEQ ID NO: 10021255 - DNA, 22 bp, Homo sapiens
tttgttctgcatcacagaaaaa

SEQ ID NO: 10021256 - DNA, 22 bp, Homo sapiens
tttgttctgaagcaagtaggga

SEQ ID NO: 10021257 - DNA, 22 bp, Homo sapiens
tttgttcttgcaacagttatta

SEQ ID NO: 10021258 - DNA, 22 bp, Homo sapiens
tttgtttacaaaaataagcagt

SEQ ID NO: 10021259 - DNA, 22 bp, Homo sapiens
tttgtttacaaaaataagcagt

SEQ ID NO: 10021260 - DNA, 22 bp, Homo sapiens
tttgtttacaaaaataagcagt

SEQ ID NO: 10021261 - DNA, 22 bp, Homo sapiens
tttgtttactcattcattgatg

SEQ ID NO: 10021262 - DNA, 22 bp, Homo sapiens
tttgtcagggatcagatcggta

SEQ ID NO: 10021263 - DNA, 22 bp, Homo sapiens
tttgtatttttcccagctagct

SEQ ID NO: 10021264 - DNA, 22 bp, Homo sapiens
tttgttcacatttaggactctc

SEQ ID NO: 10021265 - DNA, 22 bp, Homo sapiens
tttgttcacctcaaggatggga

SEQ ID NO: 10021266 - DNA, 22 bp, Homo sapiens
tttgttctgaaaatcttccctt

SEQ ID NO: 10021267 - DNA, 22 bp, Homo sapiens
ttttatctacctatgctcattt

SEQ ID NO: 10021268 - DNA, 22 bp, Homo sapiens
ttttatctacctatgctcattt

SEQ ID NO: 10021269 - DNA, 22 bp, Homo sapiens
ttttatctacctatgctcattt

SEQ ID NO: 10021270 - DNA, 22 bp, Homo sapiens
ttttatctacctatgctcattt

SEQ ID NO: 10021271 - DNA, 22 bp, Homo sapiens
ttttatctacctatgctcattt

SEQ ID NO: 10021272 - DNA, 22 bp, Homo sapiens
ttttatctgcttcattagttga

SEQ ID NO: 10021273 - DNA, 22 bp, Homo sapiens
ttttatctgcttcattagttga

SEQ ID NO: 10021274 - DNA, 22 bp, Homo sapiens
ttttatctacctatgctcattt

SEQ ID NO: 10021275 - DNA, 22 bp, Homo sapiens
ttttatctgtgacatctggcag

SEQ ID NO: 10021276 - DNA, 22 bp, Homo sapiens
ttttatctgtgacatctggcag

SEQ ID NO: 10021277 - DNA, 22 bp, Homo sapiens
ttttatctgtgacatctggcag

SEQ ID NO: 10021278 - DNA, 22 bp, Homo sapiens
ttttatctgcttcattagttga

SEQ ID NO: 10021279 - DNA, 22 bp, Homo sapiens
ttttatcttcattcctatctac

SEQ ID NO: 10021280 - DNA, 19 bp, Homo sapiens
ttttccttctatatgtttc

SEQ ID NO: 10021281 - DNA, 19 bp, Homo sapiens
ttttccttctcctcttaat

SEQ ID NO: 10021282 - DNA, 22 bp, Homo sapiens
ttttccttctgatactccattt

SEQ ID NO: 10021283 - DNA, 22 bp, Homo sapiens
ttttccttctgatactccattt

SEQ ID NO: 10021284 - DNA, 22 bp, Homo sapiens
ttttccttctgatactccattt

SEQ ID NO: 10021285 - DNA, 20 bp, Homo sapiens
ttttccttctgagtatgttg

SEQ ID NO: 10021286 - DNA, 20 bp, Homo sapiens
ttttccttctgagtatgttg

SEQ ID NO: 10021287 - DNA, 20 bp, Homo sapiens
ttttccttctgagtatgttg

SEQ ID NO: 10021288 - DNA, 22 bp, Homo sapiens
ttttcctttgattcccagatgt

SEQ ID NO: 10021289 - DNA, 22 bp, Homo sapiens
ttttcctttgaaaggtgagggc

SEQ ID NO: 10021290 - DNA, 22 bp, Homo sapiens
ttttcctttgattcccagatgt

SEQ ID NO: 10021291 - DNA, 22 bp, Homo sapiens
ttttcctttgaaaggtgagggc

SEQ ID NO: 10021292 - DNA, 22 bp, Homo sapiens
ttttcctttcatcaggacaaag

SEQ ID NO: 10021293 - DNA, 22 bp, Homo sapiens
ttttcctttcatcaggacaaag

SEQ ID NO: 10021294 - DNA, 20 bp, Homo sapiens
ttttccttgttgccgctgct

SEQ ID NO: 10021295 - DNA, 22 bp, Homo sapiens
ttttctttaatctggtggggtg

SEQ ID NO: 10021296 - DNA, 22 bp, Homo sapiens
ttttctattaactcattttgca

SEQ ID NO: 10021297 - DNA, 22 bp, Homo sapiens
ttttctaacatctagtaatttg

SEQ ID NO: 10021298 - DNA, 22 bp, Homo sapiens
ttttctaacatctagtaatttg

SEQ ID NO: 10021299 - DNA, 22 bp, Homo sapiens
ttttcgtttatttgacatgtaa

SEQ ID NO: 10021300 - DNA, 22 bp, Homo sapiens
ttttcgtttatttgacatgtaa

SEQ ID NO: 10021301 - DNA, 22 bp, Homo sapiens
ttttcgttggtcattccccagc

SEQ ID NO: 10021302 - DNA, 23 bp, Homo sapiens
ttttcctttggacaggctgtatt

SEQ ID NO: 10021303 - DNA, 23 bp, Homo sapiens
ttttcctttggacaggctgtatt

SEQ ID NO: 10021304 - DNA, 22 bp, Homo sapiens
ttttcctttggaagatgcatat

SEQ ID NO: 10021305 - DNA, 22 bp, Homo sapiens
ttttcctttggaagatgcatat

SEQ ID NO: 10021306 - DNA, 22 bp, Homo sapiens
ttttggcaagctgggagatatt

SEQ ID NO: 10021307 - DNA, 22 bp, Homo sapiens
ttttggaatctgggaaaacagt

SEQ ID NO: 10021308 - DNA, 22 bp, Homo sapiens
ttttggatgagcccagatttct

SEQ ID NO: 10021309 - DNA, 22 bp, Homo sapiens
ttttgaagaagatgggaattta

SEQ ID NO: 10021310 - DNA, 19 bp, Homo sapiens
ttttgaagtatgagacagg

SEQ ID NO: 10021311 - DNA, 22 bp, Homo sapiens
ttttgaataattcagaaacagc

SEQ ID NO: 10021312 - DNA, 19 bp, Homo sapiens
ttttgaagtatgagacagg

SEQ ID NO: 10021313 - DNA, 22 bp, Homo sapiens
ttttgacaatgctaatctcaat

SEQ ID NO: 10021314 - DNA, 20 bp, Homo sapiens
ttttgatagcaaagacggta

SEQ ID NO: 10021315 - DNA, 20 bp, Homo sapiens
ttttgatagcaaagacggta

SEQ ID NO: 10021316 - DNA, 22 bp, Homo sapiens
ttttgaaagccaggtttgtatg

SEQ ID NO: 10021317 - DNA, 22 bp, Homo sapiens
ttttgaaagccaggtttgtatg

SEQ ID NO: 10021318 - DNA, 22 bp, Homo sapiens
ttttgaaagggtgatttggctt

SEQ ID NO: 10021319 - DNA, 22 bp, Homo sapiens
ttttgaaagccaggtttgtatg

SEQ ID NO: 10021320 - DNA, 22 bp, Homo sapiens
ttttggccacatccttttgagt

SEQ ID NO: 10021321 - DNA, 22 bp, Homo sapiens
ttttggcactgcgtctacatgg

SEQ ID NO: 10021322 - DNA, 22 bp, Homo sapiens
tttttcatctgattgataactc

SEQ ID NO: 10021323 - DNA, 22 bp, Homo sapiens
tttttcatctgattgataactc

SEQ ID NO: 10021324 - DNA, 22 bp, Homo sapiens
tttttcatctgattgataactc

SEQ ID NO: 10021325 - DNA, 22 bp, Homo sapiens
tttttcatgagactagaagtca

SEQ ID NO: 10021326 - DNA, 22 bp, Homo sapiens
tttttcatgagactagaagtca

SEQ ID NO: 10021327 - DNA, 22 bp, Homo sapiens
tttttcatgagactagaagtca

SEQ ID NO: 10021328 - DNA, 22 bp, Homo sapiens
tttttcattgcagcctctctcc

SEQ ID NO: 10021329 - DNA, 22 bp, Homo sapiens
tttttcattgcagcctctctcc

SEQ ID NO: 10021330 - DNA, 22 bp, Homo sapiens
tttttcattgcagcctctctcc

SEQ ID NO: 10021331 - DNA, 22 bp, Homo sapiens
tttttcctagcgatttgtcagc

SEQ ID NO: 10021332 - DNA, 22 bp, Homo sapiens
tttttcctagcgatttgtcagc

SEQ ID NO: 10021333 - DNA, 22 bp, Homo sapiens
tttttcctaagcagtggagctg

SEQ ID NO: 10021334 - DNA, 22 bp, Homo sapiens
tttttcctagtgctttctggta

SEQ ID NO: 10021335 - DNA, 22 bp, Homo sapiens
tttttcctagtgctttctggta

SEQ ID NO: 10021336 - DNA, 22 bp, Homo sapiens
tttttccttaggggttactcac

SEQ ID NO: 10021337 - DNA, 20 bp, Homo sapiens
tttttccttctctacaggca

SEQ ID NO: 10021338 - DNA, 22 bp, Homo sapiens
tttttctactgcccacattgta

SEQ ID NO: 10021339 - DNA, 22 bp, Homo sapiens
tttttctactgcccacattgta

SEQ ID NO: 10021340 - DNA, 22 bp, Homo sapiens
tttttctactgcccacattgta

SEQ ID NO: 10021341 - DNA, 22 bp, Homo sapiens
tttttctactgcccacattgta

SEQ ID NO: 10021342 - DNA, 22 bp, Homo sapiens
tttttctaatggcttaggatgt

SEQ ID NO: 10021343 - DNA, 20 bp, Homo sapiens
tttttccttctctacaggca

SEQ ID NO: 10021344 - DNA, 22 bp, Homo sapiens
tttttccttggatgtgtctctc

SEQ ID NO: 10021345 - DNA, 22 bp, Homo sapiens
tttttgatctgagcagttggag

SEQ ID NO: 10021346 - DNA, 22 bp, Homo sapiens
tttttgaaggctgatgtgatta

SEQ ID NO: 10021347 - DNA, 22 bp, Homo sapiens
tttttgaaggctgatgtgatta

SEQ ID NO: 10021348 - DNA, 22 bp, Homo sapiens
tttttcttgtgctggatctaat

SEQ ID NO: 10021349 - DNA, 22 bp, Homo sapiens
tttttctactggtgttggtgta

SEQ ID NO: 10021350 - DNA, 22 bp, Homo sapiens
tttttcttgtgctggatctaat

SEQ ID NO: 10021351 - DNA, 22 bp, Homo sapiens
tttttcttgtgctggatctaat

SEQ ID NO: 10021352 - DNA, 22 bp, Homo sapiens
tttttcttgtgctggatctaat

SEQ ID NO: 10021353 - DNA, 22 bp, Homo sapiens
tttttggaaggagatccacact

SEQ ID NO: 10021354 - DNA, 22 bp, Homo sapiens
ttttttgtcttgaagaaatggt

SEQ ID NO: 10021355 - DNA, 22 bp, Homo sapiens
tttttgggtccaggctgtatct

SEQ ID NO: 10021356 - DNA, 22 bp, Homo sapiens
tttttgggtccaggctgtatct

SEQ ID NO: 10021357 - DNA, 22 bp, Homo sapiens
tttttgggtccaggctgtatct

SEQ ID NO: 10021358 - DNA, 22 bp, Homo sapiens
tttcagggtcagcctgtatgtg

SEQ ID NO: 10021359 - DNA, 22 bp, Homo sapiens
tttcagggagcctagaagagct

SEQ ID NO: 10021360 - DNA, 22 bp, Homo sapiens
tttcagggaagtgttgaaaagg

SEQ ID NO: 10021361 - DNA, 22 bp, Homo sapiens
tttcagtgcacgtagtttattt

SEQ ID NO: 10021362 - DNA, 22 bp, Homo sapiens
tttcagtgcccagagctttgca

SEQ ID NO: 10021363 - DNA, 22 bp, Homo sapiens
tttcagtgaaagctactgttag

SEQ ID NO: 10021364 - DNA, 22 bp, Homo sapiens
tttcagtgaaagctactgttag

SEQ ID NO: 10021365 - DNA, 22 bp, Homo sapiens
tttcaggcaggtggaatgagta

SEQ ID NO: 10021366 - DNA, 22 bp, Homo sapiens
tttcaggattttatgagatagt

SEQ ID NO: 10021367 - DNA, 22 bp, Homo sapiens
tttcaggattagtttaagcagg

SEQ ID NO: 10021368 - DNA, 19 bp, Homo sapiens
tttcaggagctatgcaggg

SEQ ID NO: 10021369 - DNA, 22 bp, Homo sapiens
tttcaggatcaaatgaaatcgt

SEQ ID NO: 10021370 - DNA, 22 bp, Homo sapiens
tttcaggagagaccagaaatga

SEQ ID NO: 10021371 - DNA, 22 bp, Homo sapiens
tttcaggaaacatttaatggca

SEQ ID NO: 10021372 - DNA, 22 bp, Homo sapiens
tttcaggactcaaaacgataat

SEQ ID NO: 10021373 - DNA, 22 bp, Homo sapiens
tttcaggacacctttaaaaacg

SEQ ID NO: 10021374 - DNA, 22 bp, Homo sapiens
tttcagatcactttcaggaaag

SEQ ID NO: 10021375 - DNA, 22 bp, Homo sapiens
tttcagagttgtcttcttgacc

SEQ ID NO: 10021376 - DNA, 22 bp, Homo sapiens
tttcagatgaaatgtgtatatt

SEQ ID NO: 10021377 - DNA, 23 bp, Homo sapiens
tttcagcattctagttcaggttc

SEQ ID NO: 10021378 - DNA, 23 bp, Homo sapiens
tttcaaagactttcccttagagt

SEQ ID NO: 10021379 - DNA, 22 bp, Homo sapiens
tttcaaagaccattaactatca

SEQ ID NO: 10021380 - DNA, 22 bp, Homo sapiens
tttcaaagacagccatatttgt

SEQ ID NO: 10021381 - DNA, 22 bp, Homo sapiens
tttcaaactttactcttgaatc

SEQ ID NO: 10021382 - DNA, 22 bp, Homo sapiens
tttcaaagagaggcagaaggaa

SEQ ID NO: 10021383 - DNA, 22 bp, Homo sapiens
tttcaaagcaactgaaaaggaa

SEQ ID NO: 10021384 - DNA, 20 bp, Homo sapiens
tttcaaaggcacctatgaag

SEQ ID NO: 10021385 - DNA, 22 bp, Homo sapiens
tttcagaggaggaaggcagtta

SEQ ID NO: 10021386 - DNA, 22 bp, Homo sapiens
tttccaaagctgagttgagcaa

SEQ ID NO: 10021387 - DNA, 22 bp, Homo sapiens
tttccaaaagtttgttctgtgc

SEQ ID NO: 10021388 - DNA, 22 bp, Homo sapiens
tttcatttcatagaattgtgtt

SEQ ID NO: 10021389 - DNA, 22 bp, Homo sapiens
tttcattttggttatgccataa

SEQ ID NO: 10021390 - DNA, 22 bp, Homo sapiens
tttcattttggttatgccataa

SEQ ID NO: 10021391 - DNA, 22 bp, Homo sapiens
tttcattttggttatgccataa

SEQ ID NO: 10021392 - DNA, 22 bp, Homo sapiens
tttcatttcatagaattgtgtt

SEQ ID NO: 10021393 - DNA, 22 bp, Homo sapiens
tttcattgtccccaggcaagac

SEQ ID NO: 10021394 - DNA, 22 bp, Homo sapiens
tttcattgtctacatatgacat

SEQ ID NO: 10021395 - DNA, 22 bp, Homo sapiens
tttcagtggagtgacatgatct

SEQ ID NO: 10021396 - DNA, 22 bp, Homo sapiens
tttcagtggaccacagtttgat

SEQ ID NO: 10021397 - DNA, 22 bp, Homo sapiens
tttcagtgcttctgtttaccgg

SEQ ID NO: 10021398 - DNA, 22 bp, Homo sapiens
tttcattggctccctgatgaat

SEQ ID NO: 10021399 - DNA, 22 bp, Homo sapiens
tttcctcttcttcccatgtcat

SEQ ID NO: 10021400 - DNA, 22 bp, Homo sapiens
tttcctcttcttcccatgtcat

SEQ ID NO: 10021401 - DNA, 22 bp, Homo sapiens
tttcctcttatacagtgtttat

SEQ ID NO: 10021402 - DNA, 22 bp, Homo sapiens
tttcctcttcgattaagtttgg

SEQ ID NO: 10021403 - DNA, 22 bp, Homo sapiens
tttcctctgctgccattgcccc

SEQ ID NO: 10021404 - DNA, 22 bp, Homo sapiens
tttcctctgctgccattgcccc

SEQ ID NO: 10021405 - DNA, 22 bp, Homo sapiens
tttcctctgatgctgacttgga

SEQ ID NO: 10021406 - DNA, 22 bp, Homo sapiens
tttcctctgggccctgccaccc

SEQ ID NO: 10021407 - DNA, 22 bp, Homo sapiens
tttccaaaggtggcaggaacaa

SEQ ID NO: 10021408 - DNA, 22 bp, Homo sapiens
tttccaaaggtggcaggaacaa

SEQ ID NO: 10021409 - DNA, 22 bp, Homo sapiens
tttccaaagttgccataagctt

SEQ ID NO: 10021410 - DNA, 19 bp, Homo sapiens
tttctcaggaagtttgtgt

SEQ ID NO: 10021411 - DNA, 22 bp, Homo sapiens
tttctcagctcagcatctgggt

SEQ ID NO: 10021412 - DNA, 22 bp, Homo sapiens
tttctagaatgactcatctgag

SEQ ID NO: 10021413 - DNA, 22 bp, Homo sapiens
tttctatttacagtgctaggta

SEQ ID NO: 10021414 - DNA, 22 bp, Homo sapiens
tttctatttacagtgctaggta

SEQ ID NO: 10021415 - DNA, 18 bp, Homo sapiens
tttctcagactctctttc

SEQ ID NO: 10021416 - DNA, 22 bp, Homo sapiens
tttctagaaacattatctctat

SEQ ID NO: 10021417 - DNA, 22 bp, Homo sapiens
tttctacttctcctgaatgtct

SEQ ID NO: 10021418 - DNA, 22 bp, Homo sapiens
tttctagaaagttcatgtgttt

SEQ ID NO: 10021419 - DNA, 22 bp, Homo sapiens
tttctagaaaccaagatattgt

SEQ ID NO: 10021420 - DNA, 22 bp, Homo sapiens
tttctcctcatgactggttgtg

SEQ ID NO: 10021421 - DNA, 23 bp, Homo sapiens
tttctcatccagagagtcagtcc

SEQ ID NO: 10021422 - DNA, 22 bp, Homo sapiens
tttctcatctggaaacagtgct

SEQ ID NO: 10021423 - DNA, 22 bp, Homo sapiens
tttctcatggacccttcatgat

SEQ ID NO: 10021424 - DNA, 22 bp, Homo sapiens
tttctcatctggaaacagtgct

SEQ ID NO: 10021425 - DNA, 22 bp, Homo sapiens
tttcctctttgtaccttgacta

SEQ ID NO: 10021426 - DNA, 21 bp, Homo sapiens
tttcctgccctttgtcatcac

SEQ ID NO: 10021427 - DNA, 22 bp, Homo sapiens
tttcctgcacccgctgatgcca

SEQ ID NO: 10021428 - DNA, 22 bp, Homo sapiens
tttcctgtcttttgtgaaggat

SEQ ID NO: 10021429 - DNA, 22 bp, Homo sapiens
tttcctgtgactaatctggaca

SEQ ID NO: 10021430 - DNA, 22 bp, Homo sapiens
tttcctgtgcttaacaaatatt

SEQ ID NO: 10021431 - DNA, 22 bp, Homo sapiens
tttcctgttgccatcaagaatg

SEQ ID NO: 10021432 - DNA, 22 bp, Homo sapiens
tttcctgttgccatcaagaatg

SEQ ID NO: 10021433 - DNA, 22 bp, Homo sapiens
tttccttcatcatctgagagct

SEQ ID NO: 10021434 - DNA, 22 bp, Homo sapiens
tttccttccctggatgagaagt

SEQ ID NO: 10021435 - DNA, 22 bp, Homo sapiens
tttccttctcagggagcttcaa

SEQ ID NO: 10021436 - DNA, 22 bp, Homo sapiens
tttctaaggtgatcctttctta

SEQ ID NO: 10021437 - DNA, 22 bp, Homo sapiens
tttctaaggtgaggtagaaaat

SEQ ID NO: 10021438 - DNA, 22 bp, Homo sapiens
tttctaatctgattctcctacc

SEQ ID NO: 10021439 - DNA, 22 bp, Homo sapiens
tttctaatctttagttacaaaa

SEQ ID NO: 10021440 - DNA, 22 bp, Homo sapiens
tttctaatctttagttacaaaa

SEQ ID NO: 10021441 - DNA, 22 bp, Homo sapiens
tttctaatctttagttacaaaa

SEQ ID NO: 10021442 - DNA, 22 bp, Homo sapiens
tttctacatgtcagtaactgat

SEQ ID NO: 10021443 - DNA, 19 bp, Homo sapiens
tttctaatgtgtttttctt

SEQ ID NO: 10021444 - DNA, 22 bp, Homo sapiens
tttctacatttgtaaccagatt

SEQ ID NO: 10021445 - DNA, 22 bp, Homo sapiens
tttctacattcaaaaactacca

SEQ ID NO: 10021446 - DNA, 22 bp, Homo sapiens
tttctacattcaaaaactacca

SEQ ID NO: 10021447 - DNA, 22 bp, Homo sapiens
tttctacattcaaaaactacca

SEQ ID NO: 10021448 - DNA, 22 bp, Homo sapiens
tttctaagtaaacacagcatac

SEQ ID NO: 10021449 - DNA, 21 bp, Homo sapiens
tttctaagtaactggcagcat

SEQ ID NO: 10021450 - DNA, 22 bp, Homo sapiens
tttctaagtgaacattcaagtt

SEQ ID NO: 10021451 - DNA, 22 bp, Homo sapiens
tttctaagtatcttgcagtttt

SEQ ID NO: 10021452 - DNA, 22 bp, Homo sapiens
tttctaatagttgagtcagcta

SEQ ID NO: 10021453 - DNA, 22 bp, Homo sapiens
tttctaagtgtgtttcatagga

SEQ ID NO: 10021454 - DNA, 22 bp, Homo sapiens
tttctaagtgtgtttcatagga

SEQ ID NO: 10021455 - DNA, 22 bp, Homo sapiens
tttctaagtgtattgagcttgg

SEQ ID NO: 10021456 - DNA, 21 bp, Homo sapiens
tttctaagtgcttggtttggg

SEQ ID NO: 10021457 - DNA, 22 bp, Homo sapiens
tttctaagtgtgattttagatt

SEQ ID NO: 10021458 - DNA, 22 bp, Homo sapiens
tttcttctctaatctcaatgat

SEQ ID NO: 10021459 - DNA, 22 bp, Homo sapiens
tttcttctctgattaaggctca

SEQ ID NO: 10021460 - DNA, 22 bp, Homo sapiens
tttcttctctgattaaggctca

SEQ ID NO: 10021461 - DNA, 20 bp, Homo sapiens
tttcttgtcggctgttgctg

SEQ ID NO: 10021462 - DNA, 20 bp, Homo sapiens
tttcttgtcggctgttgctg

SEQ ID NO: 10021463 - DNA, 22 bp, Homo sapiens
tttcttctgagatcagggagaa

SEQ ID NO: 10021464 - DNA, 20 bp, Homo sapiens
tttcttgtacttggagaagg

SEQ ID NO: 10021465 - DNA, 20 bp, Homo sapiens
tttcttgtacttggagaagg

SEQ ID NO: 10021466 - DNA, 22 bp, Homo sapiens
tttcttgtacactggaatttat

SEQ ID NO: 10021467 - DNA, 22 bp, Homo sapiens
tttctttatcatagcatctttg

SEQ ID NO: 10021468 - DNA, 22 bp, Homo sapiens
tttctttatcatagcatctttg

SEQ ID NO: 10021469 - DNA, 22 bp, Homo sapiens
tttctttaattctcacagcaat

SEQ ID NO: 10021470 - DNA, 22 bp, Homo sapiens
tttcttgtctttagtatctggc

SEQ ID NO: 10021471 - DNA, 22 bp, Homo sapiens
tttcttgtttcatggtgtctca

SEQ ID NO: 10021472 - DNA, 22 bp, Homo sapiens
tttcttgtttcatggtgtctca

SEQ ID NO: 10021473 - DNA, 22 bp, Homo sapiens
tttctttaattctcacagcaat

SEQ ID NO: 10021474 - DNA, 22 bp, Homo sapiens
tttcttctatgtgtgatatttt

SEQ ID NO: 10021475 - DNA, 22 bp, Homo sapiens
tttcttctaggactaataagag

SEQ ID NO: 10021476 - DNA, 22 bp, Homo sapiens
tttcttctatgtgtgatatttt

SEQ ID NO: 10021477 - DNA, 22 bp, Homo sapiens
tttcttctcacccaggacagag

SEQ ID NO: 10021478 - DNA, 22 bp, Homo sapiens
tttcttctcatccctgaaatca

SEQ ID NO: 10021479 - DNA, 22 bp, Homo sapiens
tttcttctcatccctgaaatca

SEQ ID NO: 10021480 - DNA, 22 bp, Homo sapiens
tttcttctccatggcaggtcct

SEQ ID NO: 10021481 - DNA, 23 bp, Homo sapiens
tttcttctcgaagagggagctta

SEQ ID NO: 10021482 - DNA, 22 bp, Homo sapiens
tttcttctcgacaccttatccc

SEQ ID NO: 10021483 - DNA, 22 bp, Homo sapiens
tttcttctaagatttcaaacta

SEQ ID NO: 10021484 - DNA, 22 bp, Homo sapiens
tttcttctaggactaataagag

SEQ ID NO: 10021485 - DNA, 22 bp, Homo sapiens
tttcttctaagatttcaaacta

SEQ ID NO: 10021486 - DNA, 20 bp, Homo sapiens
tttctgtgatagagaggtgt

SEQ ID NO: 10021487 - DNA, 20 bp, Homo sapiens
tttctgtgatagagaggtgt

SEQ ID NO: 10021488 - DNA, 20 bp, Homo sapiens
tttctgtgcccaggtctgtt

SEQ ID NO: 10021489 - DNA, 20 bp, Homo sapiens
tttctgtgcccaggtctgtt

SEQ ID NO: 10021490 - DNA, 22 bp, Homo sapiens
tttctgtctgacatccctgcct

SEQ ID NO: 10021491 - DNA, 22 bp, Homo sapiens
tttctgtgaattataaaatttg

SEQ ID NO: 10021492 - DNA, 22 bp, Homo sapiens
tttctgtatttaggacaggtgg

SEQ ID NO: 10021493 - DNA, 22 bp, Homo sapiens
tttctgtattttgtcataacct

SEQ ID NO: 10021494 - DNA, 22 bp, Homo sapiens
tttctgttgtacttaaactagg

SEQ ID NO: 10021495 - DNA, 21 bp, Homo sapiens
tttcttatctgtaaagtggga

SEQ ID NO: 10021496 - DNA, 23 bp, Homo sapiens
tttctgttgggtatatatccaag

SEQ ID NO: 10021497 - DNA, 23 bp, Homo sapiens
tttctgttgggtatatatccaag

SEQ ID NO: 10021498 - DNA, 23 bp, Homo sapiens
tttctgttgggtatatatccaag

SEQ ID NO: 10021499 - DNA, 19 bp, Homo sapiens
tttctgttagaaggataca

SEQ ID NO: 10021500 - DNA, 19 bp, Homo sapiens
tttctgttagaaggataca

SEQ ID NO: 10021501 - DNA, 22 bp, Homo sapiens
tttctgttaggcatcattttaa

SEQ ID NO: 10021502 - DNA, 22 bp, Homo sapiens
tttctgttaggcatcattttaa

SEQ ID NO: 10021503 - DNA, 22 bp, Homo sapiens
tttctgttaggcatcattttaa

SEQ ID NO: 10021504 - DNA, 22 bp, Homo sapiens
tttctgttaggcatcattttaa

SEQ ID NO: 10021505 - DNA, 22 bp, Homo sapiens
tttcttatgagcaagactctat

SEQ ID NO: 10021506 - DNA, 22 bp, Homo sapiens
tttcttatgagcaagactctat

SEQ ID NO: 10021507 - DNA, 22 bp, Homo sapiens
tttcttatggggtagtccttta

SEQ ID NO: 10021508 - DNA, 22 bp, Homo sapiens
tttcttcaattgctaacaagga

SEQ ID NO: 10021509 - DNA, 22 bp, Homo sapiens
tttcttcaattgctaacaagga

SEQ ID NO: 10021510 - DNA, 22 bp, Homo sapiens
tttcttcacagggtattgggtg

SEQ ID NO: 10021511 - DNA, 22 bp, Homo sapiens
tttcttcattgatgtcaggtgg

SEQ ID NO: 10021512 - DNA, 22 bp, Homo sapiens
tttcttcatagaccttgtcttg

SEQ ID NO: 10021513 - DNA, 22 bp, Homo sapiens
tttctggacagcaagatcagtt

SEQ ID NO: 10021514 - DNA, 17 bp, Homo sapiens
tttctggaatgggcaaa

SEQ ID NO: 10021515 - DNA, 22 bp, Homo sapiens
tttctgctgtgctttcttgcgt

SEQ ID NO: 10021516 - DNA, 22 bp, Homo sapiens
tttctgtacacccactattcat

SEQ ID NO: 10021517 - DNA, 22 bp, Homo sapiens
tttctgtaattaaaagggcagg

SEQ ID NO: 10021518 - DNA, 22 bp, Homo sapiens
tttctgtaagttcaggctttcc

SEQ ID NO: 10021519 - DNA, 22 bp, Homo sapiens
tttctgtaagtggcaaataatg

SEQ ID NO: 10021520 - DNA, 22 bp, Homo sapiens
tttctgtaagtggcaaataatg

SEQ ID NO: 10021521 - DNA, 20 bp, Homo sapiens
tttctgggtactctccctct

SEQ ID NO: 10021522 - DNA, 22 bp, Homo sapiens
tttctgggactggggagattct

SEQ ID NO: 10021523 - DNA, 22 bp, Homo sapiens
tttctggcagcgggacaggggt

SEQ ID NO: 10021524 - DNA, 22 bp, Homo sapiens
tttctgggtttatgtcacagct

SEQ ID NO: 10021525 - DNA, 22 bp, Homo sapiens
tttctgtaaagaccaagccagc

SEQ ID NO: 10021526 - DNA, 21 bp, Homo sapiens
tttctgggtggctgcatagtg

SEQ ID NO: 10021527 - DNA, 22 bp, Homo sapiens
tttctgagaaattaaacacttt

SEQ ID NO: 10021528 - DNA, 22 bp, Homo sapiens
tttctgagaaattaaacacttt

SEQ ID NO: 10021529 - DNA, 22 bp, Homo sapiens
tttctgaggaattaatacagaa

SEQ ID NO: 10021530 - DNA, 17 bp, Homo sapiens
tttctgcatgattggac

SEQ ID NO: 10021531 - DNA, 22 bp, Homo sapiens
tttctgctaatcttttactgag

SEQ ID NO: 10021532 - DNA, 22 bp, Homo sapiens
tttctgaataactctatgatat

SEQ ID NO: 10021533 - DNA, 22 bp, Homo sapiens
tttctgaattcctaggatgttg

SEQ ID NO: 10021534 - DNA, 22 bp, Homo sapiens
tttctgaattcctaggatgttg

SEQ ID NO: 10021535 - DNA, 22 bp, Homo sapiens
tttctgacagagtgctcagagt

SEQ ID NO: 10021536 - DNA, 22 bp, Homo sapiens
tttctgaataactctatgatat

SEQ ID NO: 10021537 - DNA, 22 bp, Homo sapiens
tttctgaaggttaaggaattag

SEQ ID NO: 10021538 - DNA, 22 bp, Homo sapiens
tttctcttaatgtctctgtgct

SEQ ID NO: 10021539 - DNA, 22 bp, Homo sapiens
tttctcttaatgtctctgtgct

SEQ ID NO: 10021540 - DNA, 22 bp, Homo sapiens
tttctcttaatgtctctgtgct

SEQ ID NO: 10021541 - DNA, 22 bp, Homo sapiens
tttctctgttctctaactgtaa

SEQ ID NO: 10021542 - DNA, 22 bp, Homo sapiens
tttctcttaatgtctctgtgct

SEQ ID NO: 10021543 - DNA, 22 bp, Homo sapiens
tttctctgtgccatttccataa

SEQ ID NO: 10021544 - DNA, 22 bp, Homo sapiens
tttctcggcagagatgatgggc

SEQ ID NO: 10021545 - DNA, 22 bp, Homo sapiens
tttctctagctattcattaaat

SEQ ID NO: 10021546 - DNA, 17 bp, Homo sapiens
tttctccttccatctca

SEQ ID NO: 10021547 - DNA, 22 bp, Homo sapiens
tttctctttcaatctgcagtac

SEQ ID NO: 10021548 - DNA, 22 bp, Homo sapiens
tttctctttgacaggaatcaga

SEQ ID NO: 10021549 - DNA, 22 bp, Homo sapiens
tttctctttgacaggaatcaga

SEQ ID NO: 10021550 - DNA, 22 bp, Homo sapiens
tttctctttgacaggaatcaga

SEQ ID NO: 10021551 - DNA, 22 bp, Homo sapiens
tttctctttggaggggctgaat

SEQ ID NO: 10021552 - DNA, 22 bp, Homo sapiens
tttctgaaaactgaagtagtgc

SEQ ID NO: 10021553 - DNA, 22 bp, Homo sapiens
tttctcttcactgtgtgcctca

SEQ ID NO: 10021554 - DNA, 22 bp, Homo sapiens
tttctcttcactgtgtgcctca

SEQ ID NO: 10021555 - DNA, 22 bp, Homo sapiens
tttctctttcaatctgcagtac

SEQ ID NO: 10021556 - DNA, 22 bp, Homo sapiens
tttctctttcaatctgcagtac

SEQ ID NO: 10021557 - DNA, 22 bp, Homo sapiens
tttctcttgcgatatgctacac

SEQ ID NO: 10021558 - DNA, 22 bp, Homo sapiens
tttctcttgcgatatgctacac

SEQ ID NO: 10021559 - DNA, 22 bp, Homo sapiens
tttctctttcaatctgcagtac

SEQ ID NO: 10021560 - DNA, 22 bp, Homo sapiens
tttctgaagatacagctttgct

SEQ ID NO: 10021561 - DNA, 22 bp, Homo sapiens
tttctgaagatacagctttgct

SEQ ID NO: 10021562 - DNA, 22 bp, Homo sapiens
tttctgaacttggtactggagc

SEQ ID NO: 10021563 - DNA, 21 bp, Homo sapiens
tttctgaaggcaacatctatc

SEQ ID NO: 10021564 - DNA, 22 bp, Homo sapiens
tttctgaacaaagccattatca

SEQ ID NO: 10021565 - DNA, 22 bp, Homo sapiens
tttctgaaatctcttttgagga

SEQ ID NO: 10021566 - DNA, 22 bp, Homo sapiens
ttgtttctccagtctaggaaaa

SEQ ID NO: 10021567 - DNA, 22 bp, Homo sapiens
ttgtttccctggatctagagct

SEQ ID NO: 10021568 - DNA, 21 bp, Homo sapiens
ttgtttcctcccaaaatgcca

SEQ ID NO: 10021569 - DNA, 21 bp, Homo sapiens
ttgtttcccagagctcgctcc

SEQ ID NO: 10021570 - DNA, 21 bp, Homo sapiens
ttgtttcccagagctcgctcc

SEQ ID NO: 10021571 - DNA, 22 bp, Homo sapiens
ttgtttcctttctatacaggat

SEQ ID NO: 10021572 - DNA, 22 bp, Homo sapiens
ttgtttcctttctatacaggat

SEQ ID NO: 10021573 - DNA, 20 bp, Homo sapiens
ttgtttcctggctgttctgc

SEQ ID NO: 10021574 - DNA, 20 bp, Homo sapiens
ttgtttcctggctgttctgc

SEQ ID NO: 10021575 - DNA, 20 bp, Homo sapiens
ttgtttctgctattttctaa

SEQ ID NO: 10021576 - DNA, 20 bp, Homo sapiens
ttgtttctgctattttctaa

SEQ ID NO: 10021577 - DNA, 22 bp, Homo sapiens
ttgtttctggaaaaggcgagaa

SEQ ID NO: 10021578 - DNA, 20 bp, Homo sapiens
ttgtttctgctattttctaa

SEQ ID NO: 10021579 - DNA, 20 bp, Homo sapiens
ttgtttctgctattttctaa

SEQ ID NO: 10021580 - DNA, 22 bp, Homo sapiens
ttgtttctgagttttcatgtat

SEQ ID NO: 10021581 - DNA, 22 bp, Homo sapiens
ttgtttcttcaggcttttagga

SEQ ID NO: 10021582 - DNA, 22 bp, Homo sapiens
ttgtttcttcaggcttttagga

SEQ ID NO: 10021583 - DNA, 22 bp, Homo sapiens
ttgtttcttcaggcttttagga

SEQ ID NO: 10021584 - DNA, 22 bp, Homo sapiens
ttgtttcttcaggcttttagga

SEQ ID NO: 10021585 - DNA, 22 bp, Homo sapiens
ttgtttcttcatttagaagctt

SEQ ID NO: 10021586 - DNA, 22 bp, Homo sapiens
ttgtttctttgaagtttctaga

SEQ ID NO: 10021587 - DNA, 22 bp, Homo sapiens
ttgtttctttgaagtttctaga

SEQ ID NO: 10021588 - DNA, 22 bp, Homo sapiens
ttgtttctttgaagtttctaga

SEQ ID NO: 10021589 - DNA, 17 bp, Homo sapiens
ttgtttcttctctgtgg

SEQ ID NO: 10021590 - DNA, 23 bp, Homo sapiens
ttgtttctttgtattgtctctat

SEQ ID NO: 10021591 - DNA, 23 bp, Homo sapiens
ttgtttctttgtattgtctctat

SEQ ID NO: 10021592 - DNA, 23 bp, Homo sapiens
ttgtttctttgtattgtctctat

SEQ ID NO: 10021593 - DNA, 22 bp, Homo sapiens
ttgtttgaggtcactgatattt

SEQ ID NO: 10021594 - DNA, 22 bp, Homo sapiens
ttgtttttaaacatgtgactga

SEQ ID NO: 10021595 - DNA, 22 bp, Homo sapiens
ttgttttggagatgagctaaaa

SEQ ID NO: 10021596 - DNA, 22 bp, Homo sapiens
ttgttttggagatgagctaaaa

SEQ ID NO: 10021597 - DNA, 22 bp, Homo sapiens
ttgttttgctaaagggtcatca

SEQ ID NO: 10021598 - DNA, 22 bp, Homo sapiens
ttgttttggaagaacttactct

SEQ ID NO: 10021599 - DNA, 22 bp, Homo sapiens
ttgttttctccactgcatctta

SEQ ID NO: 10021600 - DNA, 22 bp, Homo sapiens
ttgttttcctgggataccaacc

SEQ ID NO: 10021601 - DNA, 22 bp, Homo sapiens
ttgttttcacagctttgcccgg

SEQ ID NO: 10021602 - DNA, 22 bp, Homo sapiens
ttgttttcacagctttgcccgg

SEQ ID NO: 10021603 - DNA, 22 bp, Homo sapiens
ttgttttattctgcaatttccc

SEQ ID NO: 10021604 - DNA, 22 bp, Homo sapiens
ttgttttatctttctacagact

SEQ ID NO: 10021605 - DNA, 20 bp, Homo sapiens
ttgttttaaatcctggatga

SEQ ID NO: 10021606 - DNA, 22 bp, Homo sapiens
ttgttttaacctagtgtttatg

SEQ ID NO: 10021607 - DNA, 22 bp, Homo sapiens
ttgttttaagccagtctgccta

SEQ ID NO: 10021608 - DNA, 18 bp, Homo sapiens
ttgttttaagactctgtc

SEQ ID NO: 10021609 - DNA, 22 bp, Homo sapiens
ttgttttaacgactcagcttgt

SEQ ID NO: 10021610 - DNA, 22 bp, Homo sapiens
ttgttttaacgactcagcttgt

SEQ ID NO: 10021611 - DNA, 18 bp, Homo sapiens
ttgttttaagactctgtc

SEQ ID NO: 10021612 - DNA, 22 bp, Homo sapiens
ttgttttaatgagggaggttga

SEQ ID NO: 10021613 - DNA, 22 bp, Homo sapiens
ttgttttagtaggtacactgag

SEQ ID NO: 10021614 - DNA, 22 bp, Homo sapiens
ttgttactgttctacatacagt

SEQ ID NO: 10021615 - DNA, 22 bp, Homo sapiens
ttgttacatcttatgtaagtgg

SEQ ID NO: 10021616 - DNA, 22 bp, Homo sapiens
ttgttacatcttatgtaagtgg

SEQ ID NO: 10021617 - DNA, 22 bp, Homo sapiens
ttgttaaaaatagatttccagg

SEQ ID NO: 10021618 - DNA, 22 bp, Homo sapiens
ttgttacagcagcaatagaaaa

SEQ ID NO: 10021619 - DNA, 22 bp, Homo sapiens
ttgttattattactaagtcttc

SEQ ID NO: 10021620 - DNA, 22 bp, Homo sapiens
ttgttattattactaagtcttc

SEQ ID NO: 10021621 - DNA, 22 bp, Homo sapiens
ttgtttaaagaacttctgactt

SEQ ID NO: 10021622 - DNA, 22 bp, Homo sapiens
ttgttatctgcgtgaagaaaat

SEQ ID NO: 10021623 - DNA, 22 bp, Homo sapiens
ttgtttcatggggatgtttatt

SEQ ID NO: 10021624 - DNA, 22 bp, Homo sapiens
ttgtttccagcaaatagtccat

SEQ ID NO: 10021625 - DNA, 22 bp, Homo sapiens
ttgtttccataattaagtgtga

SEQ ID NO: 10021626 - DNA, 22 bp, Homo sapiens
ttgtttccattgcagactgtgt

SEQ ID NO: 10021627 - DNA, 21 bp, Homo sapiens
ttgtttcccagagctcgctcc

SEQ ID NO: 10021628 - DNA, 22 bp, Homo sapiens
ttgtgaatggtgccgcaataaa

SEQ ID NO: 10021629 - DNA, 22 bp, Homo sapiens
ttgtgaatggtgccgcaataaa

SEQ ID NO: 10021630 - DNA, 19 bp, Homo sapiens
ttgtgtgtcagtcagagtt

SEQ ID NO: 10021631 - DNA, 19 bp, Homo sapiens
ttgtgtgtcagtcagagtt

SEQ ID NO: 10021632 - DNA, 19 bp, Homo sapiens
ttgtgtgtcagtcagagtt

SEQ ID NO: 10021633 - DNA, 22 bp, Homo sapiens
ttgtgtgtcttcttcactgccc

SEQ ID NO: 10021634 - DNA, 22 bp, Homo sapiens
ttgtgtgtcttcttcactgccc

SEQ ID NO: 10021635 - DNA, 22 bp, Homo sapiens
ttgtgtgtcttcttcactgccc

SEQ ID NO: 10021636 - DNA, 22 bp, Homo sapiens
ttgtgtgtcttcttcactgccc

SEQ ID NO: 10021637 - DNA, 22 bp, Homo sapiens
ttgtgtgtgagccttcaccaca

SEQ ID NO: 10021638 - DNA, 22 bp, Homo sapiens
ttgtgtgtgagccttcaccaca

SEQ ID NO: 10021639 - DNA, 22 bp, Homo sapiens
ttgtgtgtgagccttcaccaca

SEQ ID NO: 10021640 - DNA, 22 bp, Homo sapiens
ttgtgtgtgagccttcaccaca

SEQ ID NO: 10021641 - DNA, 22 bp, Homo sapiens
ttgtgtgtttgtagaaaatcca

SEQ ID NO: 10021642 - DNA, 22 bp, Homo sapiens
ttgtgttaaggtgcatctagtg

SEQ ID NO: 10021643 - DNA, 22 bp, Homo sapiens
ttgtgtgtttgtagaaaatcca

SEQ ID NO: 10021644 - DNA, 22 bp, Homo sapiens
ttgtgtgtgtaactttatgaga

SEQ ID NO: 10021645 - DNA, 22 bp, Homo sapiens
ttgtgtgtttgtagaaaatcca

SEQ ID NO: 10021646 - DNA, 22 bp, Homo sapiens
ttgtgtgtgtaactttatgaga

SEQ ID NO: 10021647 - DNA, 22 bp, Homo sapiens
ttgtgtgtgtaactttatgaga

SEQ ID NO: 10021648 - DNA, 22 bp, Homo sapiens
ttgtgtgtgtaactttatgaga

SEQ ID NO: 10021649 - DNA, 22 bp, Homo sapiens
ttgtgttaaggtgcatctagtg

SEQ ID NO: 10021650 - DNA, 18 bp, Homo sapiens
ttggggtgaggccaggaa

SEQ ID NO: 10021651 - DNA, 22 bp, Homo sapiens
ttgcaagacacttggaagcaca

SEQ ID NO: 10021652 - DNA, 20 bp, Homo sapiens
ttgcaagctttcaagatagc

SEQ ID NO: 10021653 - DNA, 21 bp, Homo sapiens
ttgcaacaacctatatatttt

SEQ ID NO: 10021654 - DNA, 23 bp, Homo sapiens
ttgcaaatttcagttagttcatg

SEQ ID NO: 10021655 - DNA, 22 bp, Homo sapiens
ttggtcctgcagaggggtctgg

SEQ ID NO: 10021656 - DNA, 22 bp, Homo sapiens
ttggtccctcatggacacatga

SEQ ID NO: 10021657 - DNA, 22 bp, Homo sapiens
ttggtcttgagtggcttgttaa

SEQ ID NO: 10021658 - DNA, 22 bp, Homo sapiens
ttggtctgtgttacatcattta

SEQ ID NO: 10021659 - DNA, 22 bp, Homo sapiens
ttggtcttcagagatctggtgg

SEQ ID NO: 10021660 - DNA, 22 bp, Homo sapiens
ttggtcttcatccgtcacagca

SEQ ID NO: 10021661 - DNA, 22 bp, Homo sapiens
ttggtctgctctgatgttttct

SEQ ID NO: 10021662 - DNA, 22 bp, Homo sapiens
ttggtctgtagttttcttatgt

SEQ ID NO: 10021663 - DNA, 22 bp, Homo sapiens
ttggtcagctaataaggacagg

SEQ ID NO: 10021664 - DNA, 22 bp, Homo sapiens
ttggtgtgactaaggcagtgtg

SEQ ID NO: 10021665 - DNA, 22 bp, Homo sapiens
ttggttaaaatcaaattaatca

SEQ ID NO: 10021666 - DNA, 22 bp, Homo sapiens
ttggtgtacatctccccttcat

SEQ ID NO: 10021667 - DNA, 22 bp, Homo sapiens
ttggtgagtatggacacagaga

SEQ ID NO: 10021668 - DNA, 22 bp, Homo sapiens
ttggtgcaaattcctgtaagag

SEQ ID NO: 10021669 - DNA, 22 bp, Homo sapiens
ttggtttgttcaccatcaagca

SEQ ID NO: 10021670 - DNA, 22 bp, Homo sapiens
ttggtttagtacctgccagcgt

SEQ ID NO: 10021671 - DNA, 22 bp, Homo sapiens
ttggtttatttcttcctatgag

SEQ ID NO: 10021672 - DNA, 20 bp, Homo sapiens
ttggttgagccagggcctgg

SEQ ID NO: 10021673 - DNA, 22 bp, Homo sapiens
ttggttccttctgaaagtattg

SEQ ID NO: 10021674 - DNA, 23 bp, Homo sapiens
ttgtccttctgaaatatatctgg

SEQ ID NO: 10021675 - DNA, 22 bp, Homo sapiens
ttgtctaatgagctccacttca

SEQ ID NO: 10021676 - DNA, 22 bp, Homo sapiens
ttgtctactaagaaagacaatt

SEQ ID NO: 10021677 - DNA, 22 bp, Homo sapiens
ttgtccttggctctagaggtga

SEQ ID NO: 10021678 - DNA, 22 bp, Homo sapiens
ttgtctctaagtgtgatcttca

SEQ ID NO: 10021679 - DNA, 22 bp, Homo sapiens
ttgtctctcattcctgcaactc

SEQ ID NO: 10021680 - DNA, 22 bp, Homo sapiens
ttgtctctgtgtggcttcccta

SEQ ID NO: 10021681 - DNA, 22 bp, Homo sapiens
ttgtctgaaccatctccctggc

SEQ ID NO: 10021682 - DNA, 22 bp, Homo sapiens
ttgtctgaagtcacacagatgc

SEQ ID NO: 10021683 - DNA, 22 bp, Homo sapiens
ttgtctgagaaagtgagttgct

SEQ ID NO: 10021684 - DNA, 22 bp, Homo sapiens
ttgtctgagagatggcagaggt

SEQ ID NO: 10021685 - DNA, 22 bp, Homo sapiens
ttgtctgagggtttgagagaat

SEQ ID NO: 10021686 - DNA, 22 bp, Homo sapiens
ttgtctgatgttccctcatgat

SEQ ID NO: 10021687 - DNA, 22 bp, Homo sapiens
ttgtctgaattcttctaggcag

SEQ ID NO: 10021688 - DNA, 22 bp, Homo sapiens
ttgtctgacttctttagttact

SEQ ID NO: 10021689 - DNA, 22 bp, Homo sapiens
ttgtctgaatatgtatgtatcc

SEQ ID NO: 10021690 - DNA, 22 bp, Homo sapiens
ttgtctgaatctggagctctct

SEQ ID NO: 10021691 - DNA, 22 bp, Homo sapiens
ttgtgaatagtgccgctataaa

SEQ ID NO: 10021692 - DNA, 22 bp, Homo sapiens
ttgtgaatagtgctgcaataaa

SEQ ID NO: 10021693 - DNA, 22 bp, Homo sapiens
ttgtgaatagtgccgcaataaa

SEQ ID NO: 10021694 - DNA, 22 bp, Homo sapiens
ttgtgaatagtgccgctataaa

SEQ ID NO: 10021695 - DNA, 22 bp, Homo sapiens
ttgtgaatagtgccgctataaa

SEQ ID NO: 10021696 - DNA, 22 bp, Homo sapiens
ttgtgaatagtgccgcaataaa

SEQ ID NO: 10021697 - DNA, 22 bp, Homo sapiens
ttgtctgtaaagacggccacca

SEQ ID NO: 10021698 - DNA, 22 bp, Homo sapiens
ttgtctgtaaagacggccacca

SEQ ID NO: 10021699 - DNA, 22 bp, Homo sapiens
ttgtgaaatcgtgtttggaagc

SEQ ID NO: 10021700 - DNA, 22 bp, Homo sapiens
tttatactccactctgcaagcg

SEQ ID NO: 10021701 - DNA, 22 bp, Homo sapiens
tttatacttcataatgtctatt

SEQ ID NO: 10021702 - DNA, 22 bp, Homo sapiens
tttatacttcataatgtctatt

SEQ ID NO: 10021703 - DNA, 22 bp, Homo sapiens
tttatacttcataatgtctatt

SEQ ID NO: 10021704 - DNA, 22 bp, Homo sapiens
tttatagatgtctgtattataa

SEQ ID NO: 10021705 - DNA, 22 bp, Homo sapiens
tttatagatgtctgtattataa

SEQ ID NO: 10021706 - DNA, 22 bp, Homo sapiens
tttatacatggagaatttttgc

SEQ ID NO: 10021707 - DNA, 23 bp, Homo sapiens
tttatacaagaaaccgctggcct

SEQ ID NO: 10021708 - DNA, 22 bp, Homo sapiens
tttataattatctctactctta

SEQ ID NO: 10021709 - DNA, 22 bp, Homo sapiens
tttataattatctctactctta

SEQ ID NO: 10021710 - DNA, 22 bp, Homo sapiens
tttagtttgatgttctactcct

SEQ ID NO: 10021711 - DNA, 22 bp, Homo sapiens
tttagttttaactgaaagctat

SEQ ID NO: 10021712 - DNA, 22 bp, Homo sapiens
tttagttttgatgaaaatgcca

SEQ ID NO: 10021713 - DNA, 22 bp, Homo sapiens
tttagttctcccagtcttgatt

SEQ ID NO: 10021714 - DNA, 22 bp, Homo sapiens
tttagttcataaaaccagggtg

SEQ ID NO: 10021715 - DNA, 22 bp, Homo sapiens
tttagttattgttacagtatga

SEQ ID NO: 10021716 - DNA, 22 bp, Homo sapiens
tttagttcacaccagggtagca

SEQ ID NO: 10021717 - DNA, 22 bp, Homo sapiens
tttataaacagtaccacggtgc

SEQ ID NO: 10021718 - DNA, 22 bp, Homo sapiens
tttattaatgtagcatccatgg

SEQ ID NO: 10021719 - DNA, 22 bp, Homo sapiens
tttattaagatgcgaatgctga

SEQ ID NO: 10021720 - DNA, 22 bp, Homo sapiens
tttattaagatgcgaatgctga

SEQ ID NO: 10021721 - DNA, 22 bp, Homo sapiens
tttattaagatgcgaatgctga

SEQ ID NO: 10021722 - DNA, 22 bp, Homo sapiens
tttattaagatgcgaatgctga

SEQ ID NO: 10021723 - DNA, 22 bp, Homo sapiens
tttattaaaactgttggctctg

SEQ ID NO: 10021724 - DNA, 22 bp, Homo sapiens
tttattaaaactgttggctctg

SEQ ID NO: 10021725 - DNA, 22 bp, Homo sapiens
tttattaaaactgttggctctg

SEQ ID NO: 10021726 - DNA, 21 bp, Homo sapiens
tttattaacaactgtggacgt

SEQ ID NO: 10021727 - DNA, 21 bp, Homo sapiens
tttattaacaactgtggacgt

SEQ ID NO: 10021728 - DNA, 23 bp, Homo sapiens
tttatagcagcatgatttataat

SEQ ID NO: 10021729 - DNA, 23 bp, Homo sapiens
tttatagcagcatgatttatagt

SEQ ID NO: 10021730 - DNA, 22 bp, Homo sapiens
tttatagctgtgagaccttggg

SEQ ID NO: 10021731 - DNA, 22 bp, Homo sapiens
tttatataacagagactgctat

SEQ ID NO: 10021732 - DNA, 22 bp, Homo sapiens
tttatataacagagactgctat

SEQ ID NO: 10021733 - DNA, 22 bp, Homo sapiens
tttatagttatatacagatgtt

SEQ ID NO: 10021734 - DNA, 20 bp, Homo sapiens
tttatagtgatcaatttata

SEQ ID NO: 10021735 - DNA, 22 bp, Homo sapiens
tttatagtcgtctcagtaataa

SEQ ID NO: 10021736 - DNA, 22 bp, Homo sapiens
tttattattctctggagaatgt

SEQ ID NO: 10021737 - DNA, 22 bp, Homo sapiens
tttattatccagtgttgtcatg

SEQ ID NO: 10021738 - DNA, 22 bp, Homo sapiens
tttattaattagtgacccaatg

SEQ ID NO: 10021739 - DNA, 22 bp, Homo sapiens
tttattaatgtagcatccatgg

SEQ ID NO: 10021740 - DNA, 22 bp, Homo sapiens
tttattaattagtgacccaatg

SEQ ID NO: 10021741 - DNA, 22 bp, Homo sapiens
tttattaattagtgacccaatg

SEQ ID NO: 10021742 - DNA, 22 bp, Homo sapiens
tttattaattagtgacccaatg

SEQ ID NO: 10021743 - DNA, 22 bp, Homo sapiens
tttattatagtggtggggactg

SEQ ID NO: 10021744 - DNA, 22 bp, Homo sapiens
tttattatccagtgttgtcatg

SEQ ID NO: 10021745 - DNA, 22 bp, Homo sapiens
tttatttggcatctctgccaag

SEQ ID NO: 10021746 - DNA, 22 bp, Homo sapiens
tttatttggcatctctgccaag

SEQ ID NO: 10021747 - DNA, 22 bp, Homo sapiens
tttatttggcatccagggagaa

SEQ ID NO: 10021748 - DNA, 22 bp, Homo sapiens
tttatttcttagtttgccacag

SEQ ID NO: 10021749 - DNA, 23 bp, Homo sapiens
tttatttatttaggctgagggat

SEQ ID NO: 10021750 - DNA, 22 bp, Homo sapiens
tttatttcactctccggatact

SEQ ID NO: 10021751 - DNA, 22 bp, Homo sapiens
tttatttggcatccagggagaa

SEQ ID NO: 10021752 - DNA, 20 bp, Homo sapiens
tttcaaactgcacctttgct

SEQ ID NO: 10021753 - DNA, 22 bp, Homo sapiens
tttcaaacctacttgtatgttt

SEQ ID NO: 10021754 - DNA, 22 bp, Homo sapiens
tttcaaactatgtgtcaggcag

SEQ ID NO: 10021755 - DNA, 22 bp, Homo sapiens
tttcaaaccactgaggttctga

SEQ ID NO: 10021756 - DNA, 22 bp, Homo sapiens
tttcaaacattcctgggagact

SEQ ID NO: 10021757 - DNA, 22 bp, Homo sapiens
tttcaaactgcccagcacacct

SEQ ID NO: 10021758 - DNA, 22 bp, Homo sapiens
tttcaaactgggagtgagggga

SEQ ID NO: 10021759 - DNA, 22 bp, Homo sapiens
tttcaaactccagctcaccaat

SEQ ID NO: 10021760 - DNA, 22 bp, Homo sapiens
tttcaaacttaaatacctttcc

SEQ ID NO: 10021761 - DNA, 22 bp, Homo sapiens
tttcaaactgtactttccccta

SEQ ID NO: 10021762 - DNA, 22 bp, Homo sapiens
tttcaaacatagatctgaatat

SEQ ID NO: 10021763 - DNA, 22 bp, Homo sapiens
tttcaaacatatcttcattact

SEQ ID NO: 10021764 - DNA, 22 bp, Homo sapiens
tttactaacaccatacatgctg

SEQ ID NO: 10021765 - DNA, 22 bp, Homo sapiens
tttactaagcccagttatatgc

SEQ ID NO: 10021766 - DNA, 22 bp, Homo sapiens
tttactaagtacttgtatccct

SEQ ID NO: 10021767 - DNA, 22 bp, Homo sapiens
tttactacttgtgataactgaa

SEQ ID NO: 10021768 - DNA, 22 bp, Homo sapiens
tttacccagtaactgcttggct

SEQ ID NO: 10021769 - DNA, 22 bp, Homo sapiens
tttacccatattagcatcaagt

SEQ ID NO: 10021770 - DNA, 22 bp, Homo sapiens
tttaccatctgccacagatatg

SEQ ID NO: 10021771 - DNA, 22 bp, Homo sapiens
tttacgaaaagtgactaatagg

SEQ ID NO: 10021772 - DNA, 22 bp, Homo sapiens
tttaccttcttttaactacagt

SEQ ID NO: 10021773 - DNA, 19 bp, Homo sapiens
tttaccttcttgagagcag

SEQ ID NO: 10021774 - DNA, 22 bp, Homo sapiens
tttacccattcagactcacttg

SEQ ID NO: 10021775 - DNA, 22 bp, Homo sapiens
tttacctagtataatgcaacct

SEQ ID NO: 10021776 - DNA, 22 bp, Homo sapiens
tttacaacccaagtccagagag

SEQ ID NO: 10021777 - DNA, 22 bp, Homo sapiens
tttacaacctcatattctgatg

SEQ ID NO: 10021778 - DNA, 22 bp, Homo sapiens
tttacaacgttcctggtgctaa

SEQ ID NO: 10021779 - DNA, 22 bp, Homo sapiens
tttacaacctcatattctgatg

SEQ ID NO: 10021780 - DNA, 22 bp, Homo sapiens
tttacaagaaatcatgatgcta

SEQ ID NO: 10021781 - DNA, 22 bp, Homo sapiens
tttacaactttctgttctgtat

SEQ ID NO: 10021782 - DNA, 22 bp, Homo sapiens
tttacaaggcagaactgattaa

SEQ ID NO: 10021783 - DNA, 22 bp, Homo sapiens
tttacaagtacacctaacagct

SEQ ID NO: 10021784 - DNA, 22 bp, Homo sapiens
tttacaagtacacctaacagct

SEQ ID NO: 10021785 - DNA, 22 bp, Homo sapiens
tttactgtctcagagagacaaa

SEQ ID NO: 10021786 - DNA, 22 bp, Homo sapiens
tttactgttcaacttgcaagta

SEQ ID NO: 10021787 - DNA, 22 bp, Homo sapiens
tttactgttcaacttgcaagta

SEQ ID NO: 10021788 - DNA, 22 bp, Homo sapiens
tttactttctcaagtatatagg

SEQ ID NO: 10021789 - DNA, 22 bp, Homo sapiens
tttactttctcaagtatatagg

SEQ ID NO: 10021790 - DNA, 22 bp, Homo sapiens
tttactttgtgtcaagtcaaga

SEQ ID NO: 10021791 - DNA, 22 bp, Homo sapiens
tttagttattgttacagtatga

SEQ ID NO: 10021792 - DNA, 22 bp, Homo sapiens
tttagttattgttacagtatga

SEQ ID NO: 10021793 - DNA, 22 bp, Homo sapiens
tttagttattgcacagaattag

SEQ ID NO: 10021794 - DNA, 22 bp, Homo sapiens
tttagaacagatattgtaactt

SEQ ID NO: 10021795 - DNA, 22 bp, Homo sapiens
tttacttttggtaaggtcattt

SEQ ID NO: 10021796 - DNA, 22 bp, Homo sapiens
tttagaaattcatctatggcct

SEQ ID NO: 10021797 - DNA, 22 bp, Homo sapiens
tttagaaattcatctatggcct

SEQ ID NO: 10021798 - DNA, 22 bp, Homo sapiens
tttaaaatttagacctctccac

SEQ ID NO: 10021799 - DNA, 22 bp, Homo sapiens
tttaaaatcagatgggagttgg

SEQ ID NO: 10021800 - DNA, 22 bp, Homo sapiens
tttaaaatttagacctctccac

SEQ ID NO: 10021801 - DNA, 22 bp, Homo sapiens
tttaaaatcagatgggagttgg

SEQ ID NO: 10021802 - DNA, 22 bp, Homo sapiens
tttaatgtgagtccctttcaag

SEQ ID NO: 10021803 - DNA, 22 bp, Homo sapiens
tttaaacatatctgttgaggga

SEQ ID NO: 10021804 - DNA, 22 bp, Homo sapiens
tttaaacaaataggattgccta

SEQ ID NO: 10021805 - DNA, 23 bp, Homo sapiens
ttgtttttagaggtggcatgaga

SEQ ID NO: 10021806 - DNA, 22 bp, Homo sapiens
ttgtttttgtgaggcagcccat

SEQ ID NO: 10021807 - DNA, 22 bp, Homo sapiens
ttgtttttatgaacatccagga

SEQ ID NO: 10021808 - DNA, 22 bp, Homo sapiens
ttgtttttagagaagccctgaa

SEQ ID NO: 10021809 - DNA, 22 bp, Homo sapiens
ttgtttttaaacatgtgactga

SEQ ID NO: 10021810 - DNA, 22 bp, Homo sapiens
ttgtttttagagaagccctgaa

SEQ ID NO: 10021811 - DNA, 22 bp, Homo sapiens
ttgtttttaaacatgtgactga

SEQ ID NO: 10021812 - DNA, 23 bp, Homo sapiens
tttaaaagttgtaatgtaggctt

SEQ ID NO: 10021813 - DNA, 22 bp, Homo sapiens
tttaaaagttatcatctgtcca

SEQ ID NO: 10021814 - DNA, 22 bp, Homo sapiens
tttaaaagttatcatctgtcca

SEQ ID NO: 10021815 - DNA, 23 bp, Homo sapiens
tttaaaagttgtaatgtaggctt

SEQ ID NO: 10021816 - DNA, 22 bp, Homo sapiens
tttaattttcctcttcctggag

SEQ ID NO: 10021817 - DNA, 22 bp, Homo sapiens
tttaattttcctcttcctggag

SEQ ID NO: 10021818 - DNA, 22 bp, Homo sapiens
tttaattttcctcttcctggag

SEQ ID NO: 10021819 - DNA, 22 bp, Homo sapiens
tttaattttctgggcccagcag

SEQ ID NO: 10021820 - DNA, 22 bp, Homo sapiens
tttacaacataggccccaagaa

SEQ ID NO: 10021821 - DNA, 22 bp, Homo sapiens
tttaattttcctggtaggcctg

SEQ ID NO: 10021822 - DNA, 22 bp, Homo sapiens
tttaatttgtatttctagaggg

SEQ ID NO: 10021823 - DNA, 22 bp, Homo sapiens
tttaatttgtatttctagaggg

SEQ ID NO: 10021824 - DNA, 22 bp, Homo sapiens
tttaattttcctcttcctggag

SEQ ID NO: 10021825 - DNA, 21 bp, Homo sapiens
tttaatttgcatgtatgacgc

SEQ ID NO: 10021826 - DNA, 22 bp, Homo sapiens
tttaatttgaaatgagtaaccc

SEQ ID NO: 10021827 - DNA, 22 bp, Homo sapiens
tttaattgttgtgggtacatag

SEQ ID NO: 10021828 - DNA, 22 bp, Homo sapiens
tttaattaggaaatgggcaggg

SEQ ID NO: 10021829 - DNA, 22 bp, Homo sapiens
tttaattatatctgggcagtta

SEQ ID NO: 10021830 - DNA, 22 bp, Homo sapiens
tttaattctggcataatagctc

SEQ ID NO: 10021831 - DNA, 22 bp, Homo sapiens
tttaattctggcataatagctc

SEQ ID NO: 10021832 - DNA, 22 bp, Homo sapiens
ttctaatctgggcttctgcagt

SEQ ID NO: 10021833 - DNA, 22 bp, Homo sapiens
ttctaatctgggcttctgcagt

SEQ ID NO: 10021834 - DNA, 22 bp, Homo sapiens
ttctaatgaaagtggaccatgg

SEQ ID NO: 10021835 - DNA, 22 bp, Homo sapiens
ttctaatgaaatctgtacagta

SEQ ID NO: 10021836 - DNA, 22 bp, Homo sapiens
ttctaagttactgttatggtct

SEQ ID NO: 10021837 - DNA, 19 bp, Homo sapiens
ttctaagttttgcttgctg

SEQ ID NO: 10021838 - DNA, 22 bp, Homo sapiens
ttctaagtctgctgtcttcatc

SEQ ID NO: 10021839 - DNA, 22 bp, Homo sapiens
ttctaatgatttcattcaaagc

SEQ ID NO: 10021840 - DNA, 22 bp, Homo sapiens
ttctaatgatttcattcaaagc

SEQ ID NO: 10021841 - DNA, 19 bp, Homo sapiens
ttctactttgtttccccct

SEQ ID NO: 10021842 - DNA, 16 bp, Homo sapiens
ttctagaaaagaaggt

SEQ ID NO: 10021843 - DNA, 22 bp, Homo sapiens
ttctagaaacacatgcaaacag

SEQ ID NO: 10021844 - DNA, 16 bp, Homo sapiens
ttctagaaaagaaggt

SEQ ID NO: 10021845 - DNA, 21 bp, Homo sapiens
ttctagaaaagtatgggactg

SEQ ID NO: 10021846 - DNA, 22 bp, Homo sapiens
ttctacaatatgaataatgaag

SEQ ID NO: 10021847 - DNA, 22 bp, Homo sapiens
ttctacacacctctgaggacat

SEQ ID NO: 10021848 - DNA, 22 bp, Homo sapiens
ttctacacagtgcgggttaaca

SEQ ID NO: 10021849 - DNA, 22 bp, Homo sapiens
ttctacaaatatttactgttcc

SEQ ID NO: 10021850 - DNA, 20 bp, Homo sapiens
ttctacaaaactgattctga

SEQ ID NO: 10021851 - DNA, 22 bp, Homo sapiens
ttctagagaactcgagtgcctt

SEQ ID NO: 10021852 - DNA, 22 bp, Homo sapiens
ttctagacttcaggcattctcc

SEQ ID NO: 10021853 - DNA, 22 bp, Homo sapiens
ttctagactgtgtacagattca

SEQ ID NO: 10021854 - DNA, 22 bp, Homo sapiens
ttctagacaaatgtgttcattc

SEQ ID NO: 10021855 - DNA, 22 bp, Homo sapiens
ttctagaggggagatactagta

SEQ ID NO: 10021856 - DNA, 22 bp, Homo sapiens
ttctagaggggagatactagta

SEQ ID NO: 10021857 - DNA, 22 bp, Homo sapiens
ttctagcacaagatatgaaagt

SEQ ID NO: 10021858 - DNA, 22 bp, Homo sapiens
ttctagcactgcctggaagaca

SEQ ID NO: 10021859 - DNA, 22 bp, Homo sapiens
ttctagcagagggcatctgctg

SEQ ID NO: 10021860 - DNA, 22 bp, Homo sapiens
ttctaggatgctgatgagaccc

SEQ ID NO: 10021861 - DNA, 22 bp, Homo sapiens
ttctaggaccctgcgtgagaac

SEQ ID NO: 10021862 - DNA, 22 bp, Homo sapiens
ttctaggaagggaagcatggca

SEQ ID NO: 10021863 - DNA, 22 bp, Homo sapiens
ttctagcatgccttttagcaca

SEQ ID NO: 10021864 - DNA, 20 bp, Homo sapiens
ttctagcatacttacaagga

SEQ ID NO: 10021865 - DNA, 22 bp, Homo sapiens
ttctaggggagaggaagaagtg

SEQ ID NO: 10021866 - DNA, 22 bp, Homo sapiens
ttctaggggacataatatgaaa

SEQ ID NO: 10021867 - DNA, 22 bp, Homo sapiens
ttctagggaatgggatgaggat

SEQ ID NO: 10021868 - DNA, 19 bp, Homo sapiens
ttctaggctatgaagcagt

SEQ ID NO: 10021869 - DNA, 23 bp, Homo sapiens
ttctaggctctgattgggcttcc

SEQ ID NO: 10021870 - DNA, 22 bp, Homo sapiens
ttctagaagtgtctatgtctgt

SEQ ID NO: 10021871 - DNA, 20 bp, Homo sapiens
ttctagaagtttgctaccca

SEQ ID NO: 10021872 - DNA, 22 bp, Homo sapiens
ttctagaagctgaaaaggggga

SEQ ID NO: 10021873 - DNA, 22 bp, Homo sapiens
ttctagaaggcaggctgggcca

SEQ ID NO: 10021874 - DNA, 22 bp, Homo sapiens
ttctagaatccttgtctacttt

SEQ ID NO: 10021875 - DNA, 22 bp, Homo sapiens
ttctagaatgttttgaaaggga

SEQ ID NO: 10021876 - DNA, 20 bp, Homo sapiens
ttctagaatgcccagggaca

SEQ ID NO: 10021877 - DNA, 22 bp, Homo sapiens
ttctagaatgatatgaggtact

SEQ ID NO: 10021878 - DNA, 22 bp, Homo sapiens
ttctagaacaggcaaaaccaat

SEQ ID NO: 10021879 - DNA, 22 bp, Homo sapiens
ttctagaacaggcaaaaccaat

SEQ ID NO: 10021880 - DNA, 22 bp, Homo sapiens
ttctagaaatccgtaagtgaat

SEQ ID NO: 10021881 - DNA, 22 bp, Homo sapiens
ttctagaaatccgtaagtgaat

SEQ ID NO: 10021882 - DNA, 22 bp, Homo sapiens
ttctagaaactggagcaaacag

SEQ ID NO: 10021883 - DNA, 22 bp, Homo sapiens
ttctagaaactggagcaaacag

SEQ ID NO: 10021884 - DNA, 21 bp, Homo sapiens
ttctagaaccgtgggcggttc

SEQ ID NO: 10021885 - DNA, 22 bp, Homo sapiens
ttctagaaccatgacttcaggg

SEQ ID NO: 10021886 - DNA, 19 bp, Homo sapiens
ttctagaactgttctctca

SEQ ID NO: 10021887 - DNA, 22 bp, Homo sapiens
ttctagaagctctaggggagaa

SEQ ID NO: 10021888 - DNA, 22 bp, Homo sapiens
ttctagaagaactagccaggaa

SEQ ID NO: 10021889 - DNA, 22 bp, Homo sapiens
ttctaagtcactcagattttgg

SEQ ID NO: 10021890 - DNA, 22 bp, Homo sapiens
ttctaagctctgaaataaatct

SEQ ID NO: 10021891 - DNA, 22 bp, Homo sapiens
ttctaagagtcattaatggcct

SEQ ID NO: 10021892 - DNA, 22 bp, Homo sapiens
ttccttctgaagcctttgtgtt

SEQ ID NO: 10021893 - DNA, 18 bp, Homo sapiens
ttccttctgatgtatatg

SEQ ID NO: 10021894 - DNA, 22 bp, Homo sapiens
ttctaagagagtacaagcaatt

SEQ ID NO: 10021895 - DNA, 22 bp, Homo sapiens
ttccttctattcagctccaaga

SEQ ID NO: 10021896 - DNA, 22 bp, Homo sapiens
ttccttctcagccctcgaggat

SEQ ID NO: 10021897 - DNA, 22 bp, Homo sapiens
ttccttctccagaacttctagg

SEQ ID NO: 10021898 - DNA, 22 bp, Homo sapiens
ttccttctccagaacttctagg

SEQ ID NO: 10021899 - DNA, 22 bp, Homo sapiens
ttccttctctgtggggaaggca

SEQ ID NO: 10021900 - DNA, 22 bp, Homo sapiens
ttccttctagcccaagtattgg

SEQ ID NO: 10021901 - DNA, 22 bp, Homo sapiens
ttccttctagagcttgtttagg

SEQ ID NO: 10021902 - DNA, 22 bp, Homo sapiens
ttccttagttgactgtcttagt

SEQ ID NO: 10021903 - DNA, 22 bp, Homo sapiens
ttcctgttgtgttagagtcaat

SEQ ID NO: 10021904 - DNA, 22 bp, Homo sapiens
ttcctgtttcatagaaaactga

SEQ ID NO: 10021905 - DNA, 22 bp, Homo sapiens
ttccttaatgaatcaggccatt

SEQ ID NO: 10021906 - DNA, 22 bp, Homo sapiens
ttccttagcagacctggtatcc

SEQ ID NO: 10021907 - DNA, 22 bp, Homo sapiens
ttccttacattcatatggcttc

SEQ ID NO: 10021908 - DNA, 22 bp, Homo sapiens
ttccttaatgaatcaggccatt

SEQ ID NO: 10021909 - DNA, 22 bp, Homo sapiens
ttcctgtggtgtttcccagaca

SEQ ID NO: 10021910 - DNA, 22 bp, Homo sapiens
ttcctgtggtccagagtcatcc

SEQ ID NO: 10021911 - DNA, 22 bp, Homo sapiens
ttcctgtggccttacatctgtg

SEQ ID NO: 10021912 - DNA, 22 bp, Homo sapiens
ttcctgtggctgtcactcctgg

SEQ ID NO: 10021913 - DNA, 22 bp, Homo sapiens
ttcctgtgtcccgggcaccctg

SEQ ID NO: 10021914 - DNA, 22 bp, Homo sapiens
ttcctgtgtgaccgagacagtg

SEQ ID NO: 10021915 - DNA, 22 bp, Homo sapiens
ttcctgtgcttattcttctctg

SEQ ID NO: 10021916 - DNA, 22 bp, Homo sapiens
ttcctgtgcttaattctcactg

SEQ ID NO: 10021917 - DNA, 19 bp, Homo sapiens
ttcctgtgctgctgtgtcc

SEQ ID NO: 10021918 - DNA, 22 bp, Homo sapiens
ttcctgtgaagatctgggtgct

SEQ ID NO: 10021919 - DNA, 22 bp, Homo sapiens
ttcctgtgaaatataggtccat

SEQ ID NO: 10021920 - DNA, 22 bp, Homo sapiens
ttcctgtccgcaatggcctggg

SEQ ID NO: 10021921 - DNA, 20 bp, Homo sapiens
ttcctgtcctctctttcagg

SEQ ID NO: 10021922 - DNA, 22 bp, Homo sapiens
ttcctcttattttcccagtgat

SEQ ID NO: 10021923 - DNA, 22 bp, Homo sapiens
ttcctccagaagctgtagggga

SEQ ID NO: 10021924 - DNA, 22 bp, Homo sapiens
ttcctcatctagcacagaaatt

SEQ ID NO: 10021925 - DNA, 22 bp, Homo sapiens
ttcctcatctagcacagaaatt

SEQ ID NO: 10021926 - DNA, 22 bp, Homo sapiens
ttcctctggaggctctaggaga

SEQ ID NO: 10021927 - DNA, 22 bp, Homo sapiens
ttcctcagttagtgcctgaggc

SEQ ID NO: 10021928 - DNA, 22 bp, Homo sapiens
ttcctcagttagtgcctgaggc

SEQ ID NO: 10021929 - DNA, 22 bp, Homo sapiens
ttcctcagggcggatgggcagg

SEQ ID NO: 10021930 - DNA, 22 bp, Homo sapiens
ttcctcaggcttccctttgtcc

SEQ ID NO: 10021931 - DNA, 22 bp, Homo sapiens
ttcctcagctgtgtcctggcga

SEQ ID NO: 10021932 - DNA, 22 bp, Homo sapiens
ttcctcagctgtgtcctggcga

SEQ ID NO: 10021933 - DNA, 22 bp, Homo sapiens
ttcctcagaaaatactgtccaa

SEQ ID NO: 10021934 - DNA, 22 bp, Homo sapiens
ttcctcagaccctcattgtgag

SEQ ID NO: 10021935 - DNA, 22 bp, Homo sapiens
ttcctcagagggcgctggggaa

SEQ ID NO: 10021936 - DNA, 22 bp, Homo sapiens
ttcctcagagggcgctggggaa

SEQ ID NO: 10021937 - DNA, 22 bp, Homo sapiens
ttcctcagagggcgctggggaa

SEQ ID NO: 10021938 - DNA, 22 bp, Homo sapiens
ttcctcagagagacagaaacta

SEQ ID NO: 10021939 - DNA, 22 bp, Homo sapiens
ttcctcagccaaggctgggatc

SEQ ID NO: 10021940 - DNA, 22 bp, Homo sapiens
ttcctcagccaaggctgggatc

SEQ ID NO: 10021941 - DNA, 22 bp, Homo sapiens
ttcctcagccagcacttagggg

SEQ ID NO: 10021942 - DNA, 22 bp, Homo sapiens
ttcctcagccagcacttagggg

SEQ ID NO: 10021943 - DNA, 22 bp, Homo sapiens
ttcctcagctggcctgattggg

SEQ ID NO: 10021944 - DNA, 22 bp, Homo sapiens
ttcctatggctcagttgcattt

SEQ ID NO: 10021945 - DNA, 22 bp, Homo sapiens
ttcctatggccagagtcaaaga

SEQ ID NO: 10021946 - DNA, 22 bp, Homo sapiens
ttcctatgtgggcagagacaca

SEQ ID NO: 10021947 - DNA, 22 bp, Homo sapiens
ttcctatggccagagtcaaaga

SEQ ID NO: 10021948 - DNA, 22 bp, Homo sapiens
ttcctagggcagagccgctggg

SEQ ID NO: 10021949 - DNA, 22 bp, Homo sapiens
ttcctaatgtctactttagttc

SEQ ID NO: 10021950 - DNA, 22 bp, Homo sapiens
ttcctacatttgtacaataaga

SEQ ID NO: 10021951 - DNA, 22 bp, Homo sapiens
ttcctacatttgcctcactccc

SEQ ID NO: 10021952 - DNA, 22 bp, Homo sapiens
ttcctaggatggtgaagcagga

SEQ ID NO: 10021953 - DNA, 18 bp, Homo sapiens
ttcctaggaactaagctt

SEQ ID NO: 10021954 - DNA, 22 bp, Homo sapiens
ttcctagggcagagccgctggg

SEQ ID NO: 10021955 - DNA, 22 bp, Homo sapiens
ttcctagctataaagctcttcc

SEQ ID NO: 10021956 - DNA, 22 bp, Homo sapiens
ttcctaacaaggggtattcatc

SEQ ID NO: 10021957 - DNA, 22 bp, Homo sapiens
ttcctaacaagtctatctttga

SEQ ID NO: 10021958 - DNA, 22 bp, Homo sapiens
ttccctgcaacctttccctggg

SEQ ID NO: 10021959 - DNA, 22 bp, Homo sapiens
ttcctaactctggcacctagtc

SEQ ID NO: 10021960 - DNA, 22 bp, Homo sapiens
ttcctaactggcctttatggat

SEQ ID NO: 10021961 - DNA, 22 bp, Homo sapiens
ttcctaactctggcacctagtc

SEQ ID NO: 10021962 - DNA, 22 bp, Homo sapiens
ttcctaacacagtgtaagcaag

SEQ ID NO: 10021963 - DNA, 22 bp, Homo sapiens
ttcctaacctctagctgcatat

SEQ ID NO: 10021964 - DNA, 22 bp, Homo sapiens
ttcctaacgccagtattttcat

SEQ ID NO: 10021965 - DNA, 17 bp, Homo sapiens
ttccacaatagtttgtc

SEQ ID NO: 10021966 - DNA, 23 bp, Homo sapiens
ttccacaatgaaaataaagcagg

SEQ ID NO: 10021967 - DNA, 22 bp, Homo sapiens
ttccacaatggttaagctcgtt

SEQ ID NO: 10021968 - DNA, 23 bp, Homo sapiens
ttccacaatgaaaataaagcagg

SEQ ID NO: 10021969 - DNA, 22 bp, Homo sapiens
ttccacaatgtatgaataagat

SEQ ID NO: 10021970 - DNA, 22 bp, Homo sapiens
ttccacaatgtatgaataagat

SEQ ID NO: 10021971 - DNA, 22 bp, Homo sapiens
ttccacaaacacatcctgagca

SEQ ID NO: 10021972 - DNA, 22 bp, Homo sapiens
ttccacaaatcaattctgctga

SEQ ID NO: 10021973 - DNA, 22 bp, Homo sapiens
ttccacaagatgtttcttagaa

SEQ ID NO: 10021974 - DNA, 22 bp, Homo sapiens
ttccacaagatgtttcttagaa

SEQ ID NO: 10021975 - DNA, 22 bp, Homo sapiens
ttccacaacaaccaagcatata

SEQ ID NO: 10021976 - DNA, 22 bp, Homo sapiens
ttccacaacaaccaagcatata

SEQ ID NO: 10021977 - DNA, 22 bp, Homo sapiens
ttccacaacaaccaagcatata

SEQ ID NO: 10021978 - DNA, 22 bp, Homo sapiens
ttccacagatgtatgaagtggt

SEQ ID NO: 10021979 - DNA, 22 bp, Homo sapiens
ttccacagcccaagctggtggc

SEQ ID NO: 10021980 - DNA, 22 bp, Homo sapiens
ttccacaggtttcagactgttc

SEQ ID NO: 10021981 - DNA, 22 bp, Homo sapiens
ttccacaggactaaatgtcatc

SEQ ID NO: 10021982 - DNA, 22 bp, Homo sapiens
ttccacaggactaaatgtcatc

SEQ ID NO: 10021983 - DNA, 22 bp, Homo sapiens
ttccacagtcatcctgggaatt

SEQ ID NO: 10021984 - DNA, 21 bp, Homo sapiens
ttccacagtcctgaggattca

SEQ ID NO: 10021985 - DNA, 21 bp, Homo sapiens
ttccacagtgagaactgcaag

SEQ ID NO: 10021986 - DNA, 22 bp, Homo sapiens
ttccacagtggctgtagttctg

SEQ ID NO: 10021987 - DNA, 22 bp, Homo sapiens
ttccacagtggctgtagttctg

SEQ ID NO: 10021988 - DNA, 20 bp, Homo sapiens
ttccacatctttgcacatgc

SEQ ID NO: 10021989 - DNA, 22 bp, Homo sapiens
ttccacattccttacattcata

SEQ ID NO: 10021990 - DNA, 23 bp, Homo sapiens
ttcaaagcttaagctctttccac

SEQ ID NO: 10021991 - DNA, 17 bp, Homo sapiens
ttcaaagcttatcaagg

SEQ ID NO: 10021992 - DNA, 22 bp, Homo sapiens
ttagataaaagtgttcaataaa

SEQ ID NO: 10021993 - DNA, 22 bp, Homo sapiens
ttagataaaagtgttcaataaa

SEQ ID NO: 10021994 - DNA, 22 bp, Homo sapiens
ttagagttaggatttgtcttta

SEQ ID NO: 10021995 - DNA, 20 bp, Homo sapiens
ttagagttagctgttatgca

SEQ ID NO: 10021996 - DNA, 22 bp, Homo sapiens
ttcaacaaatatttattgagct

SEQ ID NO: 10021997 - DNA, 22 bp, Homo sapiens
ttcaacaagtatttattgagca

SEQ ID NO: 10021998 - DNA, 22 bp, Homo sapiens
ttcaacaaggctgtcaaaagtt

SEQ ID NO: 10021999 - DNA, 17 bp, Homo sapiens
ttcaaagcttatcaagg

SEQ ID NO: 10022000 - DNA, 22 bp, Homo sapiens
ttcaaaggaaaggcagtgtcaa

SEQ ID NO: 10022001 - DNA, 22 bp, Homo sapiens
ttcaactaatgtttattttatg

SEQ ID NO: 10022002 - DNA, 22 bp, Homo sapiens
ttcaacatttatcagtttatca

SEQ ID NO: 10022003 - DNA, 22 bp, Homo sapiens
ttcaacatgttctacataaggg

SEQ ID NO: 10022004 - DNA, 22 bp, Homo sapiens
ttcaacatgttctacataaggg

SEQ ID NO: 10022005 - DNA, 22 bp, Homo sapiens
ttcaacatgttctacataaggg

SEQ ID NO: 10022006 - DNA, 22 bp, Homo sapiens
ttcaactattatgaataaaatt

SEQ ID NO: 10022007 - DNA, 22 bp, Homo sapiens
ttcaactattatgaataaaatt

SEQ ID NO: 10022008 - DNA, 22 bp, Homo sapiens
ttcaactagatttatacaattc

SEQ ID NO: 10022009 - DNA, 22 bp, Homo sapiens
ttcaactagatttatacaattc

SEQ ID NO: 10022010 - DNA, 22 bp, Homo sapiens
ttcaactttggagatttaataa

SEQ ID NO: 10022011 - DNA, 22 bp, Homo sapiens
ttcaactttatgcatatgtatt

SEQ ID NO: 10022012 - DNA, 22 bp, Homo sapiens
ttcaacagtgatggcctttgta

SEQ ID NO: 10022013 - DNA, 22 bp, Homo sapiens
ttcaacatagctgaggcatata

SEQ ID NO: 10022014 - DNA, 22 bp, Homo sapiens
ttcaacatcaagaatgcatgga

SEQ ID NO: 10022015 - DNA, 22 bp, Homo sapiens
ttcaacatcttggagctggaac

SEQ ID NO: 10022016 - DNA, 22 bp, Homo sapiens
ttcaacatgctttatttctaaa

SEQ ID NO: 10022017 - DNA, 22 bp, Homo sapiens
ttcaacatgctttatttctaaa

SEQ ID NO: 10022018 - DNA, 22 bp, Homo sapiens
ttcaacatgcaaacatgtttgt

SEQ ID NO: 10022019 - DNA, 22 bp, Homo sapiens
ttcaacatgcaaacatgtttgt

SEQ ID NO: 10022020 - DNA, 22 bp, Homo sapiens
ttcaacagatatttattgagca

SEQ ID NO: 10022021 - DNA, 22 bp, Homo sapiens
ttcaacagacccttctttcttt

SEQ ID NO: 10022022 - DNA, 22 bp, Homo sapiens
ttcaacactgatcgtttacaca

SEQ ID NO: 10022023 - DNA, 22 bp, Homo sapiens
ttcaacacaggaacatgatata

SEQ ID NO: 10022024 - DNA, 22 bp, Homo sapiens
ttcaacagggcatgatgagacg

SEQ ID NO: 10022025 - DNA, 22 bp, Homo sapiens
ttcaacaggaaagcactttaca

SEQ ID NO: 10022026 - DNA, 22 bp, Homo sapiens
ttcaacaattaagtatcagcct

SEQ ID NO: 10022027 - DNA, 22 bp, Homo sapiens
ttcaacaatgcacttgagtata

SEQ ID NO: 10022028 - DNA, 22 bp, Homo sapiens
ttcacaaagctggagcatttcc

SEQ ID NO: 10022029 - DNA, 21 bp, Homo sapiens
ttcacaacctgctttagtggg

SEQ ID NO: 10022030 - DNA, 22 bp, Homo sapiens
ttcacaaagctggagcatttcc

SEQ ID NO: 10022031 - DNA, 22 bp, Homo sapiens
ttcacaaagctggagcatttcc

SEQ ID NO: 10022032 - DNA, 22 bp, Homo sapiens
ttcacaaagctggagcatttcc

SEQ ID NO: 10022033 - DNA, 22 bp, Homo sapiens
ttcacaaagctggagcatttcc

SEQ ID NO: 10022034 - DNA, 22 bp, Homo sapiens
ttcacaagtcattagctgcata

SEQ ID NO: 10022035 - DNA, 22 bp, Homo sapiens
ttcacaagtcattagctgcata

SEQ ID NO: 10022036 - DNA, 22 bp, Homo sapiens
ttcacaataatgtccatcctct

SEQ ID NO: 10022037 - DNA, 22 bp, Homo sapiens
ttcacaataatgtccatcctct

SEQ ID NO: 10022038 - DNA, 22 bp, Homo sapiens
ttcacaataatgtccatcctct

SEQ ID NO: 10022039 - DNA, 22 bp, Homo sapiens
ttcacaatagctggcatcatct

SEQ ID NO: 10022040 - DNA, 22 bp, Homo sapiens
ttcacagtataggtttccagcg

SEQ ID NO: 10022041 - DNA, 22 bp, Homo sapiens
ttcacagtgctcacagttcagt

SEQ ID NO: 10022042 - DNA, 22 bp, Homo sapiens
ttcacagtgctcacagttcagt

SEQ ID NO: 10022043 - DNA, 22 bp, Homo sapiens
ttcacagtgctcacagttcagt

SEQ ID NO: 10022044 - DNA, 22 bp, Homo sapiens
ttcacagtgctgcacctggctt

SEQ ID NO: 10022045 - DNA, 22 bp, Homo sapiens
ttcacagtgagctatgtcttgt

SEQ ID NO: 10022046 - DNA, 22 bp, Homo sapiens
ttcacaaaatggtttgttgatg

SEQ ID NO: 10022047 - DNA, 22 bp, Homo sapiens
ttcacaaaaatgctgaacagtt

SEQ ID NO: 10022048 - DNA, 22 bp, Homo sapiens
ttcacaaaacactattttctgg

SEQ ID NO: 10022049 - DNA, 22 bp, Homo sapiens
ttcacaaaacactattttctgg

SEQ ID NO: 10022050 - DNA, 22 bp, Homo sapiens
ttcaattcaattctaaatatat

SEQ ID NO: 10022051 - DNA, 22 bp, Homo sapiens
ttcaattctaaactaatattct

SEQ ID NO: 10022052 - DNA, 22 bp, Homo sapiens
ttcaatgttaagaagaatatgt

SEQ ID NO: 10022053 - DNA, 22 bp, Homo sapiens
ttcaatgtttcttatcaagttg

SEQ ID NO: 10022054 - DNA, 22 bp, Homo sapiens
ttcaattctgatgaaggcaata

SEQ ID NO: 10022055 - DNA, 22 bp, Homo sapiens
ttcaattctgctctgatcttag

SEQ ID NO: 10022056 - DNA, 22 bp, Homo sapiens
ttcaattctgatgaaggcaata

SEQ ID NO: 10022057 - DNA, 22 bp, Homo sapiens
ttcaatgcatatagatatagaa

SEQ ID NO: 10022058 - DNA, 22 bp, Homo sapiens
ttcaatgcctagaacttagcat

SEQ ID NO: 10022059 - DNA, 22 bp, Homo sapiens
ttcaatgtggttataataacta

SEQ ID NO: 10022060 - DNA, 22 bp, Homo sapiens
ttcaagaaagagtggctattcc

SEQ ID NO: 10022061 - DNA, 22 bp, Homo sapiens
ttcaagaagcccaaagactagc

SEQ ID NO: 10022062 - DNA, 22 bp, Homo sapiens
ttcaatgcatatagatatagaa

SEQ ID NO: 10022063 - DNA, 22 bp, Homo sapiens
ttcaagaagcccaaagactagc

SEQ ID NO: 10022064 - DNA, 22 bp, Homo sapiens
ttcaggtgtggccagaggagaa

SEQ ID NO: 10022065 - DNA, 22 bp, Homo sapiens
ttcagtaagcacttctagagct

SEQ ID NO: 10022066 - DNA, 22 bp, Homo sapiens
ttcaggagaaagttcagtactt

SEQ ID NO: 10022067 - DNA, 22 bp, Homo sapiens
ttcaggagaattccaagaagta

SEQ ID NO: 10022068 - DNA, 22 bp, Homo sapiens
ttcaggagctggctgcgaagga

SEQ ID NO: 10022069 - DNA, 22 bp, Homo sapiens
ttcaggaggtgagcaagaaggg

SEQ ID NO: 10022070 - DNA, 22 bp, Homo sapiens
ttcacattataatcagttctgc

SEQ ID NO: 10022071 - DNA, 22 bp, Homo sapiens
ttcacattagtggttctatata

SEQ ID NO: 10022072 - DNA, 22 bp, Homo sapiens
ttcacattataatcagttctgc

SEQ ID NO: 10022073 - DNA, 22 bp, Homo sapiens
ttcacattatcaggattgtttc

SEQ ID NO: 10022074 - DNA, 22 bp, Homo sapiens
ttcacattgaaggtgctttctt

SEQ ID NO: 10022075 - DNA, 22 bp, Homo sapiens
ttcacattccgcggctattttc

SEQ ID NO: 10022076 - DNA, 22 bp, Homo sapiens
ttcacattccgcggctattttc

SEQ ID NO: 10022077 - DNA, 22 bp, Homo sapiens
ttcacattctcacaagaggaaa

SEQ ID NO: 10022078 - DNA, 22 bp, Homo sapiens
ttcacagtggccctctctgagt

SEQ ID NO: 10022079 - DNA, 22 bp, Homo sapiens
ttcacagtggctaagttctgca

SEQ ID NO: 10022080 - DNA, 22 bp, Homo sapiens
ttcacagtggctaagttctgca

SEQ ID NO: 10022081 - DNA, 22 bp, Homo sapiens
ttcacagtggctgacaggctgg

SEQ ID NO: 10022082 - DNA, 22 bp, Homo sapiens
ttcacagtggctgacaggctgg

SEQ ID NO: 10022083 - DNA, 22 bp, Homo sapiens
ttcacagtggctgtgccatttg

SEQ ID NO: 10022084 - DNA, 22 bp, Homo sapiens
ttcacattacaaggccatattt

SEQ ID NO: 10022085 - DNA, 22 bp, Homo sapiens
ttcacattacaaggccatattt

SEQ ID NO: 10022086 - DNA, 22 bp, Homo sapiens
ttcacattagtggttctatata

SEQ ID NO: 10022087 - DNA, 22 bp, Homo sapiens
ttccaatttgtggtgagttaat

SEQ ID NO: 10022088 - DNA, 22 bp, Homo sapiens
ttcatgtggaaaagggctttca

SEQ ID NO: 10022089 - DNA, 22 bp, Homo sapiens
ttcatgtgataaatgtgtgact

SEQ ID NO: 10022090 - DNA, 22 bp, Homo sapiens
ttcatgtgataaatgtgtgact

SEQ ID NO: 10022091 - DNA, 22 bp, Homo sapiens
ttcatgtgatcacagattgtaa

SEQ ID NO: 10022092 - DNA, 22 bp, Homo sapiens
ttcatgtaacttttcttctcca

SEQ ID NO: 10022093 - DNA, 20 bp, Homo sapiens
ttcatggtgtatttctttct

SEQ ID NO: 10022094 - DNA, 22 bp, Homo sapiens
ttcatgtaattccataaggtaa

SEQ ID NO: 10022095 - DNA, 22 bp, Homo sapiens
ttcatgtaataggatgtgttaa

SEQ ID NO: 10022096 - DNA, 20 bp, Homo sapiens
ttcatgggagcaaagaggcc

SEQ ID NO: 10022097 - DNA, 22 bp, Homo sapiens
ttcatgtgaatatatttgtctt

SEQ ID NO: 10022098 - DNA, 22 bp, Homo sapiens
ttcatgtatttatcatgtaaat

SEQ ID NO: 10022099 - DNA, 22 bp, Homo sapiens
ttcatgtattgcattgtgtcct

SEQ ID NO: 10022100 - DNA, 22 bp, Homo sapiens
ttcatgtaggctgcaatgcaca

SEQ ID NO: 10022101 - DNA, 22 bp, Homo sapiens
ttcatgtagtgtaatgtcttca

SEQ ID NO: 10022102 - DNA, 22 bp, Homo sapiens
ttcatgtagtgtaatgtcttca

SEQ ID NO: 10022103 - DNA, 22 bp, Homo sapiens
ttcatgtatgaggccaatcttt

SEQ ID NO: 10022104 - DNA, 22 bp, Homo sapiens
ttcatcattacagtcatgttat

SEQ ID NO: 10022105 - DNA, 22 bp, Homo sapiens
ttcatcattacagtcatgttat

SEQ ID NO: 10022106 - DNA, 22 bp, Homo sapiens
ttcatcattacagtcatgttat

SEQ ID NO: 10022107 - DNA, 22 bp, Homo sapiens
ttcatcattgccagtctttaaa

SEQ ID NO: 10022108 - DNA, 22 bp, Homo sapiens
ttcatgcactatttcttctagc

SEQ ID NO: 10022109 - DNA, 22 bp, Homo sapiens
ttcatggcgctgttctctccct

SEQ ID NO: 10022110 - DNA, 22 bp, Homo sapiens
ttcatggcctactttgcttcaa

SEQ ID NO: 10022111 - DNA, 22 bp, Homo sapiens
ttcatggatcatgccttttgtg

SEQ ID NO: 10022112 - DNA, 22 bp, Homo sapiens
ttcagtgccgtgctgggtcgct

SEQ ID NO: 10022113 - DNA, 22 bp, Homo sapiens
ttcagtgcctgtccacagcttc

SEQ ID NO: 10022114 - DNA, 22 bp, Homo sapiens
ttcagtgcttacaggtttcttt

SEQ ID NO: 10022115 - DNA, 22 bp, Homo sapiens
ttcagtgctaaaaagtctcaag

SEQ ID NO: 10022116 - DNA, 22 bp, Homo sapiens
ttcagtgcagacgccgaagccc

SEQ ID NO: 10022117 - DNA, 22 bp, Homo sapiens
ttcagtgcacagtactgagact

SEQ ID NO: 10022118 - DNA, 22 bp, Homo sapiens
ttcagtgcagtcggaactactg

SEQ ID NO: 10022119 - DNA, 22 bp, Homo sapiens
ttcagtgagtgaatgaatgaat

SEQ ID NO: 10022120 - DNA, 22 bp, Homo sapiens
ttcagtgtacagtgaagggatt

SEQ ID NO: 10022121 - DNA, 22 bp, Homo sapiens
ttcagtgtacagtgaagggatt

SEQ ID NO: 10022122 - DNA, 22 bp, Homo sapiens
ttcagtgtatattttttgagta

SEQ ID NO: 10022123 - DNA, 22 bp, Homo sapiens
ttcagtgtatattttttgagta

SEQ ID NO: 10022124 - DNA, 22 bp, Homo sapiens
ttctgagagtaaacatagcctg

SEQ ID NO: 10022125 - DNA, 22 bp, Homo sapiens
ttctgagacagcaaagattctt

SEQ ID NO: 10022126 - DNA, 22 bp, Homo sapiens
ttctgagatgtgaatctgtcaa

SEQ ID NO: 10022127 - DNA, 22 bp, Homo sapiens
ttctgaattcatgagatttggg

SEQ ID NO: 10022128 - DNA, 22 bp, Homo sapiens
ttctgacacattactacatgga

SEQ ID NO: 10022129 - DNA, 22 bp, Homo sapiens
ttctgacacattactacatgga

SEQ ID NO: 10022130 - DNA, 17 bp, Homo sapiens
ttctgaccctagagctc

SEQ ID NO: 10022131 - DNA, 22 bp, Homo sapiens
ttctgacatgtgagattttgtt

SEQ ID NO: 10022132 - DNA, 22 bp, Homo sapiens
ttctgacatttgtcaaaatgat

SEQ ID NO: 10022133 - DNA, 22 bp, Homo sapiens
ttctgacagtaatcagtttgct

SEQ ID NO: 10022134 - DNA, 22 bp, Homo sapiens
ttctagttctgaaagcctgaca

SEQ ID NO: 10022135 - DNA, 22 bp, Homo sapiens
ttctagttaatgtagcatcttg

SEQ ID NO: 10022136 - DNA, 22 bp, Homo sapiens
ttctagtgtccttggacttgct

SEQ ID NO: 10022137 - DNA, 22 bp, Homo sapiens
ttctagtctatggctagatagt

SEQ ID NO: 10022138 - DNA, 22 bp, Homo sapiens
ttctagtcctagaaactacatg

SEQ ID NO: 10022139 - DNA, 22 bp, Homo sapiens
ttctcttttcaccagttgctaa

SEQ ID NO: 10022140 - DNA, 22 bp, Homo sapiens
ttctcttttcaccagttgctaa

SEQ ID NO: 10022141 - DNA, 22 bp, Homo sapiens
ttctcttttcaccagttgctaa

SEQ ID NO: 10022142 - DNA, 22 bp, Homo sapiens
ttctcttttagaggctccatga

SEQ ID NO: 10022143 - DNA, 22 bp, Homo sapiens
ttctgaaggtcagcagcttggt

SEQ ID NO: 10022144 - DNA, 22 bp, Homo sapiens
ttctgaatcctcgaaacatagc

SEQ ID NO: 10022145 - DNA, 22 bp, Homo sapiens
ttctgaagggctaagtgtctat

SEQ ID NO: 10022146 - DNA, 22 bp, Homo sapiens
ttctgaagggctaagtgtctat

SEQ ID NO: 10022147 - DNA, 22 bp, Homo sapiens
ttctgaagggctaagtgtctat

SEQ ID NO: 10022148 - DNA, 22 bp, Homo sapiens
ttctagttttgccacaggatac

SEQ ID NO: 10022149 - DNA, 22 bp, Homo sapiens
ttctagttttgccttatcaaca

SEQ ID NO: 10022150 - DNA, 22 bp, Homo sapiens
ttctataaatgaatgtgtatat

SEQ ID NO: 10022151 - DNA, 22 bp, Homo sapiens
ttctggaaaagaaagttaagat

SEQ ID NO: 10022152 - DNA, 19 bp, Homo sapiens
ttctggaaacccaggtaat

SEQ ID NO: 10022153 - DNA, 19 bp, Homo sapiens
ttctgggcagcacatgaat

SEQ ID NO: 10022154 - DNA, 22 bp, Homo sapiens
ttctgggcagagctggagctgc

SEQ ID NO: 10022155 - DNA, 22 bp, Homo sapiens
ttctgggcaccaccacagactt

SEQ ID NO: 10022156 - DNA, 22 bp, Homo sapiens
ttctgggcatgttacattctgt

SEQ ID NO: 10022157 - DNA, 19 bp, Homo sapiens
ttctgggcattcatattta

SEQ ID NO: 10022158 - DNA, 19 bp, Homo sapiens
ttctgggcattcatattta

SEQ ID NO: 10022159 - DNA, 22 bp, Homo sapiens
ttctgggcagttggaaatttca

SEQ ID NO: 10022160 - DNA, 22 bp, Homo sapiens
ttctgcttttagctaaactata

SEQ ID NO: 10022161 - DNA, 22 bp, Homo sapiens
ttctgcttttagctaaactata

SEQ ID NO: 10022162 - DNA, 22 bp, Homo sapiens
ttctgcttttagctaaactata

SEQ ID NO: 10022163 - DNA, 20 bp, Homo sapiens
ttctgcttgcaaatatcaag

SEQ ID NO: 10022164 - DNA, 22 bp, Homo sapiens
ttctgctctgacttgcaaggaa

SEQ ID NO: 10022165 - DNA, 21 bp, Homo sapiens
ttctgctccagctcctctggg

SEQ ID NO: 10022166 - DNA, 21 bp, Homo sapiens
ttctgctccagctcctctggg

SEQ ID NO: 10022167 - DNA, 22 bp, Homo sapiens
ttctgctccaccacttccagca

SEQ ID NO: 10022168 - DNA, 22 bp, Homo sapiens
ttctgctccaccacttccagca

SEQ ID NO: 10022169 - DNA, 22 bp, Homo sapiens
ttctgccttacgatattttcaa

SEQ ID NO: 10022170 - DNA, 18 bp, Homo sapiens
ttctgcggtgacagatat

SEQ ID NO: 10022171 - DNA, 22 bp, Homo sapiens
ttctgctcagtagtaagagtgc

SEQ ID NO: 10022172 - DNA, 22 bp, Homo sapiens
ttctgagctacatagtactggg

SEQ ID NO: 10022173 - DNA, 22 bp, Homo sapiens
ttctgagcctttctaagaaaca

SEQ ID NO: 10022174 - DNA, 22 bp, Homo sapiens
ttctgagccagagtcagttatg

SEQ ID NO: 10022175 - DNA, 22 bp, Homo sapiens
ttctgagcctcattcatgaggc

SEQ ID NO: 10022176 - DNA, 22 bp, Homo sapiens
ttctgagcacgttcatttaaat

SEQ ID NO: 10022177 - DNA, 22 bp, Homo sapiens
ttctgagcaagctggacagtct

SEQ ID NO: 10022178 - DNA, 22 bp, Homo sapiens
ttctggggccccagtgtcctcg

SEQ ID NO: 10022179 - DNA, 22 bp, Homo sapiens
ttctggggccccagtgtcctcg

SEQ ID NO: 10022180 - DNA, 23 bp, Homo sapiens
ttctgggctgtggaagcctcggg

SEQ ID NO: 10022181 - DNA, 22 bp, Homo sapiens
ttctgggctctctttctgtgtg

SEQ ID NO: 10022182 - DNA, 22 bp, Homo sapiens
ttctgggctcacagagcagcag

SEQ ID NO: 10022183 - DNA, 22 bp, Homo sapiens
ttctgggctcccacatatttca

SEQ ID NO: 10022184 - DNA, 22 bp, Homo sapiens
ttctgggcctcctaggacaggc

SEQ ID NO: 10022185 - DNA, 22 bp, Homo sapiens
ttctgggcctcctaggacaggc

SEQ ID NO: 10022186 - DNA, 22 bp, Homo sapiens
ttctgggcccaaccctagagtg

SEQ ID NO: 10022187 - DNA, 22 bp, Homo sapiens
ttctgggcccactgtagcatcc

SEQ ID NO: 10022188 - DNA, 19 bp, Homo sapiens
ttctggggcctggccttgg

SEQ ID NO: 10022189 - DNA, 22 bp, Homo sapiens
ttctggggctaatacagaggtc

SEQ ID NO: 10022190 - DNA, 22 bp, Homo sapiens
ttctggggctaatacagaggtc

SEQ ID NO: 10022191 - DNA, 22 bp, Homo sapiens
ttctgggggaatacagctatga

SEQ ID NO: 10022192 - DNA, 22 bp, Homo sapiens
ttctgggggccaggacagtggt

SEQ ID NO: 10022193 - DNA, 22 bp, Homo sapiens
ttctgggggccaggacagtggt

SEQ ID NO: 10022194 - DNA, 21 bp, Homo sapiens
ttctgggttgttaatctgaac

SEQ ID NO: 10022195 - DNA, 22 bp, Homo sapiens
ttctggtggccagaagtctgaa

SEQ ID NO: 10022196 - DNA, 22 bp, Homo sapiens
ttcttacaagtattccaggtcc

SEQ ID NO: 10022197 - DNA, 22 bp, Homo sapiens
ttcttacaagtattccaggtcc

SEQ ID NO: 10022198 - DNA, 22 bp, Homo sapiens
ttcttacactcttaaaaatcat

SEQ ID NO: 10022199 - DNA, 22 bp, Homo sapiens
ttcttacagagtttacagagcc

SEQ ID NO: 10022200 - DNA, 22 bp, Homo sapiens
ttcttaaaacttatggacaggt

SEQ ID NO: 10022201 - DNA, 22 bp, Homo sapiens
ttctgttttgcacagacttgaa

SEQ ID NO: 10022202 - DNA, 22 bp, Homo sapiens
ttctgtttctggggtctctgac

SEQ ID NO: 10022203 - DNA, 22 bp, Homo sapiens
ttctgtttgccatatatagtag

SEQ ID NO: 10022204 - DNA, 22 bp, Homo sapiens
ttctgtttgccatatatagtag

SEQ ID NO: 10022205 - DNA, 22 bp, Homo sapiens
ttctgttttagaaataagtagt

SEQ ID NO: 10022206 - DNA, 22 bp, Homo sapiens
ttctgttttagaaataagtagt

SEQ ID NO: 10022207 - DNA, 22 bp, Homo sapiens
ttctgttttagaaataagtagt

SEQ ID NO: 10022208 - DNA, 22 bp, Homo sapiens
ttctgttttagaaataagtagt

SEQ ID NO: 10022209 - DNA, 22 bp, Homo sapiens
ttctggtgtgttctctctaggc

SEQ ID NO: 10022210 - DNA, 22 bp, Homo sapiens
ttctgttacatggggcacagtg

SEQ ID NO: 10022211 - DNA, 22 bp, Homo sapiens
ttctgttatcattaagcattat

SEQ ID NO: 10022212 - DNA, 22 bp, Homo sapiens
ttctgttatcattaagcattat

SEQ ID NO: 10022213 - DNA, 22 bp, Homo sapiens
ttctgttacttgcaaccacagg

SEQ ID NO: 10022214 - DNA, 22 bp, Homo sapiens
ttctgttactgttggtcataac

SEQ ID NO: 10022215 - DNA, 22 bp, Homo sapiens
ttctgtttattcctaggagctc

SEQ ID NO: 10022216 - DNA, 22 bp, Homo sapiens
ttctgtttactcagaaatacaa

SEQ ID NO: 10022217 - DNA, 22 bp, Homo sapiens
ttctgtttataatttgcagttg

SEQ ID NO: 10022218 - DNA, 22 bp, Homo sapiens
ttctgttctttatttaccatat

SEQ ID NO: 10022219 - DNA, 22 bp, Homo sapiens
ttctgttctgatacttgtttct

SEQ ID NO: 10022220 - DNA, 22 bp, Homo sapiens
ttctgttctttatttaccatat

SEQ ID NO: 10022221 - DNA, 22 bp, Homo sapiens
ttcttcttgtctgccctcacat

SEQ ID NO: 10022222 - DNA, 21 bp, Homo sapiens
ttcttcttggactgttttggc

SEQ ID NO: 10022223 - DNA, 22 bp, Homo sapiens
ttcttctttatctcagtatcct

SEQ ID NO: 10022224 - DNA, 22 bp, Homo sapiens
ttcttacatctataaagttggg

SEQ ID NO: 10022225 - DNA, 21 bp, Homo sapiens
ttcttcttggactgttttggc

SEQ ID NO: 10022226 - DNA, 22 bp, Homo sapiens
ttcttacatattttcatatggt

SEQ ID NO: 10022227 - DNA, 22 bp, Homo sapiens
ttcttacagagtttacagagcc

SEQ ID NO: 10022228 - DNA, 22 bp, Homo sapiens
ttcttacagagtttacagagcc

SEQ ID NO: 10022229 - DNA, 22 bp, Homo sapiens
ttcttctttccccctgtggtac

SEQ ID NO: 10022230 - DNA, 22 bp, Homo sapiens
ttcttctttccaattacatggt

SEQ ID NO: 10022231 - DNA, 22 bp, Homo sapiens
ttcttctttcctataattaatt

SEQ ID NO: 10022232 - DNA, 22 bp, Homo sapiens
ttcttctttcctataattaatt

SEQ ID NO: 10022233 - DNA, 22 bp, Homo sapiens
ttcttgagtatctgcacagtgc

SEQ ID NO: 10022234 - DNA, 22 bp, Homo sapiens
ttcttgaatcactttagagata

SEQ ID NO: 10022235 - DNA, 19 bp, Homo sapiens
ttcttgaacatgtttctca

SEQ ID NO: 10022236 - DNA, 22 bp, Homo sapiens
ttctttagcaacttggatttag

SEQ ID NO: 10022237 - DNA, 22 bp, Homo sapiens
ttctttatcagttactcatagg

SEQ ID NO: 10022238 - DNA, 20 bp, Homo sapiens
ttctttacgacctttctgca

SEQ ID NO: 10022239 - DNA, 22 bp, Homo sapiens
ttctttaccagtgaaatgttat

SEQ ID NO: 10022240 - DNA, 22 bp, Homo sapiens
ttctttaccactactcttccaa

SEQ ID NO: 10022241 - DNA, 18 bp, Homo sapiens
ttctttaattcagtttga

SEQ ID NO: 10022242 - DNA, 18 bp, Homo sapiens
ttctttaattcagtttga

SEQ ID NO: 10022243 - DNA, 18 bp, Homo sapiens
ttctttaattcagtttga

SEQ ID NO: 10022244 - DNA, 18 bp, Homo sapiens
ttctttaattcagtttga

SEQ ID NO: 10022245 - DNA, 22 bp, Homo sapiens
ttcttgatgaatgctaagaact

SEQ ID NO: 10022246 - DNA, 22 bp, Homo sapiens
ttcttgattcttccttgaagga

SEQ ID NO: 10022247 - DNA, 22 bp, Homo sapiens
ttcttgcatcactctgctgttc

SEQ ID NO: 10022248 - DNA, 22 bp, Homo sapiens
ttcttgatttcatgcagttaag

SEQ ID NO: 10022249 - DNA, 22 bp, Homo sapiens
ttcttgcatcaagacagcctgt

SEQ ID NO: 10022250 - DNA, 22 bp, Homo sapiens
ttctttaaatgaattctctgta

SEQ ID NO: 10022251 - DNA, 22 bp, Homo sapiens
ttctttaaatgaattctctgta

SEQ ID NO: 10022252 - DNA, 22 bp, Homo sapiens
ttctttaaaatagtgagaaaga

SEQ ID NO: 10022253 - DNA, 22 bp, Homo sapiens
ttctttaaatgaattctctgta

SEQ ID NO: 10022254 - DNA, 22 bp, Homo sapiens
ttcttgctcaatgtctgtttaa

SEQ ID NO: 10022255 - DNA, 20 bp, Homo sapiens
ttgcaaagtgaatagcaatt

SEQ ID NO: 10022256 - DNA, 22 bp, Homo sapiens
ttgcaaaggggaataaagcaat

SEQ ID NO: 10022257 - DNA, 22 bp, Homo sapiens
ttgcaaagttccctacacatgt

SEQ ID NO: 10022258 - DNA, 22 bp, Homo sapiens
ttgcaaagttccctacacatgt

SEQ ID NO: 10022259 - DNA, 22 bp, Homo sapiens
ttgcaaagactggcttaacagt

SEQ ID NO: 10022260 - DNA, 22 bp, Homo sapiens
ttgcaaagaattttacattcta

SEQ ID NO: 10022261 - DNA, 22 bp, Homo sapiens
ttgatttttccagcttctagag

SEQ ID NO: 10022262 - DNA, 22 bp, Homo sapiens
ttgattttgcctgatctgagag

SEQ ID NO: 10022263 - DNA, 22 bp, Homo sapiens
ttgattttcaattcattgacaa

SEQ ID NO: 10022264 - DNA, 22 bp, Homo sapiens
ttgattttcaattcattgacaa

SEQ ID NO: 10022265 - DNA, 22 bp, Homo sapiens
ttgattttcaattcattgacaa

SEQ ID NO: 10022266 - DNA, 22 bp, Homo sapiens
ttgatttatagaatgttcaagc

SEQ ID NO: 10022267 - DNA, 21 bp, Homo sapiens
ttgatttagcagatctagctg

SEQ ID NO: 10022268 - DNA, 22 bp, Homo sapiens
ttgatttatagaatgttcaagc

SEQ ID NO: 10022269 - DNA, 22 bp, Homo sapiens
ttgatttgtattgcaggcccct

SEQ ID NO: 10022270 - DNA, 22 bp, Homo sapiens
ttgatttgattgatgaactaag

SEQ ID NO: 10022271 - DNA, 22 bp, Homo sapiens
ttgatttgattgtaatggctct

SEQ ID NO: 10022272 - DNA, 22 bp, Homo sapiens
ttgatttgcagaaggtgtagag

SEQ ID NO: 10022273 - DNA, 22 bp, Homo sapiens
ttgatttgggaatggtctggca

SEQ ID NO: 10022274 - DNA, 22 bp, Homo sapiens
ttgatttgtaggaatggagacc

SEQ ID NO: 10022275 - DNA, 22 bp, Homo sapiens
ttgcaaatgaccattgccacat

SEQ ID NO: 10022276 - DNA, 22 bp, Homo sapiens
ttgcaaatgtgaataattacac

SEQ ID NO: 10022277 - DNA, 22 bp, Homo sapiens
ttgcaaatattgtttacctttc

SEQ ID NO: 10022278 - DNA, 22 bp, Homo sapiens
ttgatgttcataaatgatacag

SEQ ID NO: 10022279 - DNA, 22 bp, Homo sapiens
ttgatgtagaaccaagatcttt

SEQ ID NO: 10022280 - DNA, 22 bp, Homo sapiens
ttgatgtacagaattgttcaca

SEQ ID NO: 10022281 - DNA, 22 bp, Homo sapiens
ttgatgtaggtttatctattgt

SEQ ID NO: 10022282 - DNA, 22 bp, Homo sapiens
ttgatgtagcctaagacagaac

SEQ ID NO: 10022283 - DNA, 22 bp, Homo sapiens
ttgatgtagggattcctgtaaa

SEQ ID NO: 10022284 - DNA, 22 bp, Homo sapiens
ttgattctgatcctttgctagc

SEQ ID NO: 10022285 - DNA, 22 bp, Homo sapiens
ttgattctgatcctgtctggag

SEQ ID NO: 10022286 - DNA, 22 bp, Homo sapiens
ttgattctatgttgttgtctca

SEQ ID NO: 10022287 - DNA, 22 bp, Homo sapiens
ttgattctgctgatctcggacg

SEQ ID NO: 10022288 - DNA, 22 bp, Homo sapiens
ttgattcttctgaatttgcaga

SEQ ID NO: 10022289 - DNA, 22 bp, Homo sapiens
ttgattctggtgactgatggaa

SEQ ID NO: 10022290 - DNA, 22 bp, Homo sapiens
ttgatcttacagtgttcttcca

SEQ ID NO: 10022291 - DNA, 22 bp, Homo sapiens
ttgatctgcctcattcttgttc

SEQ ID NO: 10022292 - DNA, 22 bp, Homo sapiens
ttgatcttcatcgaaatattgt

SEQ ID NO: 10022293 - DNA, 22 bp, Homo sapiens
ttgatcttcatcgaaatattgt

SEQ ID NO: 10022294 - DNA, 22 bp, Homo sapiens
ttgatcttggactttccagcct

SEQ ID NO: 10022295 - DNA, 22 bp, Homo sapiens
ttgatctttataatagttttga

SEQ ID NO: 10022296 - DNA, 22 bp, Homo sapiens
ttgatctttataatagttttga

SEQ ID NO: 10022297 - DNA, 22 bp, Homo sapiens
ttgatgtaaagatagtttctgt

SEQ ID NO: 10022298 - DNA, 22 bp, Homo sapiens
ttgatgtaatactttgcaacca

SEQ ID NO: 10022299 - DNA, 22 bp, Homo sapiens
ttgatgtaaaagccttggtggc

SEQ ID NO: 10022300 - DNA, 22 bp, Homo sapiens
ttgatgtaaactttgatttcat

SEQ ID NO: 10022301 - DNA, 22 bp, Homo sapiens
ttgaggccaaaaagtcctatga

SEQ ID NO: 10022302 - DNA, 22 bp, Homo sapiens
ttgagtctgtgccctatgctgt

SEQ ID NO: 10022303 - DNA, 22 bp, Homo sapiens
ttgagtgtactttagtcatctg

SEQ ID NO: 10022304 - DNA, 22 bp, Homo sapiens
ttgagtgtaaggaatgtggggc

SEQ ID NO: 10022305 - DNA, 22 bp, Homo sapiens
ttgatcaagtgggaaatagtaa

SEQ ID NO: 10022306 - DNA, 22 bp, Homo sapiens
ttgatcaagtgggaaatagtaa

SEQ ID NO: 10022307 - DNA, 22 bp, Homo sapiens
ttgatctctgttgctgtctttg

SEQ ID NO: 10022308 - DNA, 22 bp, Homo sapiens
ttctttccttgcctcagtgaag

SEQ ID NO: 10022309 - DNA, 22 bp, Homo sapiens
ttctttccttgcctcagtgaag

SEQ ID NO: 10022310 - DNA, 22 bp, Homo sapiens
ttctttccttgcctcagtgaag

SEQ ID NO: 10022311 - DNA, 21 bp, Homo sapiens
ttctttccccagaggactaaa

SEQ ID NO: 10022312 - DNA, 22 bp, Homo sapiens
ttctttcccttccagcagctcc

SEQ ID NO: 10022313 - DNA, 22 bp, Homo sapiens
ttctttctcaacatgaatgttt

SEQ ID NO: 10022314 - DNA, 22 bp, Homo sapiens
ttctttctcaacatgaatgttt

SEQ ID NO: 10022315 - DNA, 22 bp, Homo sapiens
ttgaagaagtaattttaagtct

SEQ ID NO: 10022316 - DNA, 19 bp, Homo sapiens
ttgaagaataaaaacacat

SEQ ID NO: 10022317 - DNA, 19 bp, Homo sapiens
ttgaagaataaaaacacat

SEQ ID NO: 10022318 - DNA, 19 bp, Homo sapiens
ttgaagaataaaaacacat

SEQ ID NO: 10022319 - DNA, 22 bp, Homo sapiens
ttgaagacctttagtgctatgt

SEQ ID NO: 10022320 - DNA, 22 bp, Homo sapiens
ttgaagactaatttagataatg

SEQ ID NO: 10022321 - DNA, 22 bp, Homo sapiens
ttgaagacaagggcaggggttc

SEQ ID NO: 10022322 - DNA, 22 bp, Homo sapiens
ttgaagagacaatttggaaagc

SEQ ID NO: 10022323 - DNA, 22 bp, Homo sapiens
ttgaagagtagaaaatgcaaat

SEQ ID NO: 10022324 - DNA, 22 bp, Homo sapiens
ttgaagagtgtccttgtaaaaa

SEQ ID NO: 10022325 - DNA, 22 bp, Homo sapiens
ttgaagagtgcattagcatatt

SEQ ID NO: 10022326 - DNA, 19 bp, Homo sapiens
ttctttccacatcttctct

SEQ ID NO: 10022327 - DNA, 22 bp, Homo sapiens
ttctttcaatagctggcatatg

SEQ ID NO: 10022328 - DNA, 23 bp, Homo sapiens
ttctttcaagaagttcacagtgc

SEQ ID NO: 10022329 - DNA, 23 bp, Homo sapiens
ttctttcaagaagttcacagtgc

SEQ ID NO: 10022330 - DNA, 22 bp, Homo sapiens
ttctttatgttaatgaatctat

SEQ ID NO: 10022331 - DNA, 22 bp, Homo sapiens
ttctttatgcttctgtttaggc

SEQ ID NO: 10022332 - DNA, 22 bp, Homo sapiens
ttctttatcagttactcatagg

SEQ ID NO: 10022333 - DNA, 22 bp, Homo sapiens
ttgaatgaataaaagagtaagg

SEQ ID NO: 10022334 - DNA, 22 bp, Homo sapiens
ttgaagcatttgctatagcatt

SEQ ID NO: 10022335 - DNA, 22 bp, Homo sapiens
ttgagatattcagttccattga

SEQ ID NO: 10022336 - DNA, 22 bp, Homo sapiens
ttgagataggtggaatctcttt

SEQ ID NO: 10022337 - DNA, 22 bp, Homo sapiens
ttgagataggtggaatctcttt

SEQ ID NO: 10022338 - DNA, 22 bp, Homo sapiens
ttgaattataagtgtgtctact

SEQ ID NO: 10022339 - DNA, 22 bp, Homo sapiens
ttgaattagactttgctacagg

SEQ ID NO: 10022340 - DNA, 22 bp, Homo sapiens
ttgagcccaggaggcctgggtg

SEQ ID NO: 10022341 - DNA, 19 bp, Homo sapiens
ttgagcagtgcttagcacc

SEQ ID NO: 10022342 - DNA, 19 bp, Homo sapiens
ttgagcagtgcttagcacc

SEQ ID NO: 10022343 - DNA, 19 bp, Homo sapiens
ttgagcagtgcttagcacc

SEQ ID NO: 10022344 - DNA, 22 bp, Homo sapiens
ttgagcaggatggctatgcaca

SEQ ID NO: 10022345 - DNA, 22 bp, Homo sapiens
ttgagcaggaactagaagatag

SEQ ID NO: 10022346 - DNA, 22 bp, Homo sapiens
ttgagcaggatggctatgcaca

SEQ ID NO: 10022347 - DNA, 22 bp, Homo sapiens
tgtggttgaaggttattactta

SEQ ID NO: 10022348 - DNA, 22 bp, Homo sapiens
tgtggtggtaatgagccagatg

SEQ ID NO: 10022349 - DNA, 22 bp, Homo sapiens
tgtggtggctattctggtctca

SEQ ID NO: 10022350 - DNA, 18 bp, Homo sapiens
tgtggtggagctgccttc

SEQ ID NO: 10022351 - DNA, 22 bp, Homo sapiens
tgtgtaaaatctgattaatact

SEQ ID NO: 10022352 - DNA, 22 bp, Homo sapiens
tgtgtaaaatgagcctaaagtc

SEQ ID NO: 10022353 - DNA, 22 bp, Homo sapiens
tgtgtaaaatctgattaatact

SEQ ID NO: 10022354 - DNA, 22 bp, Homo sapiens
tgtgtaaagcttgttccagaaa

SEQ ID NO: 10022355 - DNA, 21 bp, Homo sapiens
tgtgtaaagttgaaatcctgt

SEQ ID NO: 10022356 - DNA, 22 bp, Homo sapiens
tgtgtaaagcttgttccagaaa

SEQ ID NO: 10022357 - DNA, 22 bp, Homo sapiens
tgtgtaaaatctgattaatact

SEQ ID NO: 10022358 - DNA, 22 bp, Homo sapiens
tgtgtcaggagatagcaaaggg

SEQ ID NO: 10022359 - DNA, 20 bp, Homo sapiens
tgtgtcaggccctgattaaa

SEQ ID NO: 10022360 - DNA, 19 bp, Homo sapiens
tgtgtcagcagggggcttc

SEQ ID NO: 10022361 - DNA, 22 bp, Homo sapiens
tgtgtcagcaggggagggaact

SEQ ID NO: 10022362 - DNA, 22 bp, Homo sapiens
tgtgtcagcacagtatcaatta

SEQ ID NO: 10022363 - DNA, 22 bp, Homo sapiens
tgtgtcagatttaggctcaaac

SEQ ID NO: 10022364 - DNA, 19 bp, Homo sapiens
tgtgtcagatttgctcctt

SEQ ID NO: 10022365 - DNA, 22 bp, Homo sapiens
tgtgtacaaactaacaacatat

SEQ ID NO: 10022366 - DNA, 21 bp, Homo sapiens
tgtgtaattttttaaatggcc

SEQ ID NO: 10022367 - DNA, 22 bp, Homo sapiens
tgtgtaaatttatttacataaa

SEQ ID NO: 10022368 - DNA, 22 bp, Homo sapiens
tgtgtaaatttatttacataaa

SEQ ID NO: 10022369 - DNA, 22 bp, Homo sapiens
tgtgtaaatggcatctctcagc

SEQ ID NO: 10022370 - DNA, 19 bp, Homo sapiens
tgtggggagtcagggggct

SEQ ID NO: 10022371 - DNA, 22 bp, Homo sapiens
tgtggggaggctgcagtgctgc

SEQ ID NO: 10022372 - DNA, 19 bp, Homo sapiens
tgtggggagtcagggggct

SEQ ID NO: 10022373 - DNA, 22 bp, Homo sapiens
tgtggtcagctactggtcatct

SEQ ID NO: 10022374 - DNA, 18 bp, Homo sapiens
tgtggtggagctgccttc

SEQ ID NO: 10022375 - DNA, 22 bp, Homo sapiens
tgtggtgccgagagtctggacg

SEQ ID NO: 10022376 - DNA, 21 bp, Homo sapiens
tgtggtcttttagttccatca

SEQ ID NO: 10022377 - DNA, 22 bp, Homo sapiens
tgtggtcctctcaactgaaggt

SEQ ID NO: 10022378 - DNA, 22 bp, Homo sapiens
tgtggtcccaaggcaactggaa

SEQ ID NO: 10022379 - DNA, 22 bp, Homo sapiens
tgtggtctcgttatgttgccca

SEQ ID NO: 10022380 - DNA, 22 bp, Homo sapiens
tgtggtctcctgtcttggcctt

SEQ ID NO: 10022381 - DNA, 22 bp, Homo sapiens
tgtgtgagacaattggctgtgg

SEQ ID NO: 10022382 - DNA, 22 bp, Homo sapiens
tgtgtgaattctgagcagttta

SEQ ID NO: 10022383 - DNA, 22 bp, Homo sapiens
tgtgtgacccccagtgaagcct

SEQ ID NO: 10022384 - DNA, 22 bp, Homo sapiens
tgtgtgacctggggtgagatag

SEQ ID NO: 10022385 - DNA, 22 bp, Homo sapiens
tgtgtgacacattgatatgtgc

SEQ ID NO: 10022386 - DNA, 22 bp, Homo sapiens
tgtgtgattgcaggagatgtgg

SEQ ID NO: 10022387 - DNA, 22 bp, Homo sapiens
tgtgtgattgcaggagatgtgg

SEQ ID NO: 10022388 - DNA, 19 bp, Homo sapiens
tgtgtgcaaatggaagcca

SEQ ID NO: 10022389 - DNA, 22 bp, Homo sapiens
tgtgtgcaagtgacattagaaa

SEQ ID NO: 10022390 - DNA, 22 bp, Homo sapiens
tgtgtgaggtggttctgagaag

SEQ ID NO: 10022391 - DNA, 22 bp, Homo sapiens
tgtgtgaaggagccactgttca

SEQ ID NO: 10022392 - DNA, 22 bp, Homo sapiens
tgtgtgaaggagccactgttca

SEQ ID NO: 10022393 - DNA, 22 bp, Homo sapiens
tgtgtctttggcgatgtctgga

SEQ ID NO: 10022394 - DNA, 22 bp, Homo sapiens
tgtgtcttaagttccaagacat

SEQ ID NO: 10022395 - DNA, 22 bp, Homo sapiens
tgtgtcttacataattacatgt

SEQ ID NO: 10022396 - DNA, 20 bp, Homo sapiens
tgtgtcttcctttctttatg

SEQ ID NO: 10022397 - DNA, 22 bp, Homo sapiens
tgtgtcccttggaacctcagct

SEQ ID NO: 10022398 - DNA, 22 bp, Homo sapiens
tgtgtccattcaggcactgacc

SEQ ID NO: 10022399 - DNA, 22 bp, Homo sapiens
tgtgtccatctgacaggagagg

SEQ ID NO: 10022400 - DNA, 21 bp, Homo sapiens
tgtgtcagtctttggaagcaa

SEQ ID NO: 10022401 - DNA, 22 bp, Homo sapiens
tgtgtcaggccttatcggtggc

SEQ ID NO: 10022402 - DNA, 22 bp, Homo sapiens
tgtgtcatattagtattgagag

SEQ ID NO: 10022403 - DNA, 22 bp, Homo sapiens
tgtgtcatctgtgttacataat

SEQ ID NO: 10022404 - DNA, 22 bp, Homo sapiens
tgtgtccatctgacaggagagg

SEQ ID NO: 10022405 - DNA, 22 bp, Homo sapiens
tgtgtctgttttgctcaccatt

SEQ ID NO: 10022406 - DNA, 22 bp, Homo sapiens
tgtgtccttctgggagtcccag

SEQ ID NO: 10022407 - DNA, 22 bp, Homo sapiens
tgtggccagcaggtggctgtgt

SEQ ID NO: 10022408 - DNA, 22 bp, Homo sapiens
tgtggcccagatgagtgtgcta

SEQ ID NO: 10022409 - DNA, 22 bp, Homo sapiens
tgtggcccagatgagtgtgcta

SEQ ID NO: 10022410 - DNA, 19 bp, Homo sapiens
tgtggccatggttcagctg

SEQ ID NO: 10022411 - DNA, 22 bp, Homo sapiens
tgtggccagggggccatgtccc

SEQ ID NO: 10022412 - DNA, 22 bp, Homo sapiens
tgtggcagtataagagctagaa

SEQ ID NO: 10022413 - DNA, 18 bp, Homo sapiens
tgtggcaggggtgggaga

SEQ ID NO: 10022414 - DNA, 22 bp, Homo sapiens
tgtggcagtctcactggagggc

SEQ ID NO: 10022415 - DNA, 22 bp, Homo sapiens
tgtggccaccagagctgctatt

SEQ ID NO: 10022416 - DNA, 22 bp, Homo sapiens
tgtggcagaaagcatgtggaca

SEQ ID NO: 10022417 - DNA, 22 bp, Homo sapiens
tgtggcagaaccagaattcaaa

SEQ ID NO: 10022418 - DNA, 22 bp, Homo sapiens
tgtggcagaactgggactcaaa

SEQ ID NO: 10022419 - DNA, 20 bp, Homo sapiens
tgtggatgaggtaaggatag

SEQ ID NO: 10022420 - DNA, 22 bp, Homo sapiens
tgtggatgagggagtgaacaaa

SEQ ID NO: 10022421 - DNA, 22 bp, Homo sapiens
tgtggagtggtctgaaggctcc

SEQ ID NO: 10022422 - DNA, 22 bp, Homo sapiens
tgtggaggtttaagtaatggga

SEQ ID NO: 10022423 - DNA, 21 bp, Homo sapiens
tgtggcagatgttgggaggca

SEQ ID NO: 10022424 - DNA, 22 bp, Homo sapiens
tgtggcagagtaaggacccagt

SEQ ID NO: 10022425 - DNA, 21 bp, Homo sapiens
tgtggcagatgttgggaggca

SEQ ID NO: 10022426 - DNA, 22 bp, Homo sapiens
tgtggcagaactgggactcaaa

SEQ ID NO: 10022427 - DNA, 22 bp, Homo sapiens
tgtggcagaaggctaaggtgtc

SEQ ID NO: 10022428 - DNA, 22 bp, Homo sapiens
tcccctctggttgacccaggag

SEQ ID NO: 10022429 - DNA, 18 bp, Homo sapiens
tcccctgctctggtgctc

SEQ ID NO: 10022430 - DNA, 18 bp, Homo sapiens
tcccctgctctggtgctc

SEQ ID NO: 10022431 - DNA, 22 bp, Homo sapiens
tcccctgcagcgcctgcttcta

SEQ ID NO: 10022432 - DNA, 22 bp, Homo sapiens
tcccctgcagatgagggcagtg

SEQ ID NO: 10022433 - DNA, 22 bp, Homo sapiens
tgtggacttgaaattacttttc

SEQ ID NO: 10022434 - DNA, 22 bp, Homo sapiens
tgtggactttattttagggagg

SEQ ID NO: 10022435 - DNA, 22 bp, Homo sapiens
tgtggactttggcattggactt

SEQ ID NO: 10022436 - DNA, 20 bp, Homo sapiens
tgtggactcagtttcttgct

SEQ ID NO: 10022437 - DNA, 22 bp, Homo sapiens
tgtggactagtgtttggatttt

SEQ ID NO: 10022438 - DNA, 22 bp, Homo sapiens
tcccccactctaaaggagcctt

SEQ ID NO: 10022439 - DNA, 22 bp, Homo sapiens
tcccccaactcttagcactgta

SEQ ID NO: 10022440 - DNA, 22 bp, Homo sapiens
tccccaggtcctgtcggctcct

SEQ ID NO: 10022441 - DNA, 22 bp, Homo sapiens
tccccctcattacctcattcaa

SEQ ID NO: 10022442 - DNA, 22 bp, Homo sapiens
tccccccagcctttcacatgag

SEQ ID NO: 10022443 - DNA, 22 bp, Homo sapiens
tccccccagcctttcacatgag

SEQ ID NO: 10022444 - DNA, 22 bp, Homo sapiens
tgtgtgcacaaagagtacatgg

SEQ ID NO: 10022445 - DNA, 22 bp, Homo sapiens
tgtgtgcaattcttaacataca

SEQ ID NO: 10022446 - DNA, 22 bp, Homo sapiens
tgtgtgcacaggagtgtttgaa

SEQ ID NO: 10022447 - DNA, 20 bp, Homo sapiens
tgtgtgcacacatgacattc

SEQ ID NO: 10022448 - DNA, 22 bp, Homo sapiens
tgtgtgcacgctgggagctgga

SEQ ID NO: 10022449 - DNA, 22 bp, Homo sapiens
tgtgtgcactgccttttgtgga

SEQ ID NO: 10022450 - DNA, 22 bp, Homo sapiens
tgtgtgcactgccttttgtgga

SEQ ID NO: 10022451 - DNA, 22 bp, Homo sapiens
tgtgtgcacgtacatactgtat

SEQ ID NO: 10022452 - DNA, 22 bp, Homo sapiens
tgtgtgcacttaatgcaatcat

SEQ ID NO: 10022453 - DNA, 22 bp, Homo sapiens
tgtgtgcacatgatttgaaatg

SEQ ID NO: 10022454 - DNA, 22 bp, Homo sapiens
tgtgtgcacatgatttgaaatg

SEQ ID NO: 10022455 - DNA, 22 bp, Homo sapiens
tgtgtgcacaggagtgtttgaa

SEQ ID NO: 10022456 - DNA, 18 bp, Homo sapiens
tgtgtgcacctgccttga

SEQ ID NO: 10022457 - DNA, 22 bp, Homo sapiens
tgtgtgcagacagatattactt

SEQ ID NO: 10022458 - DNA, 22 bp, Homo sapiens
tgtgtgcagcctctgtctttgg

SEQ ID NO: 10022459 - DNA, 22 bp, Homo sapiens
tgtgtgcacttaatgcaatcat

SEQ ID NO: 10022460 - DNA, 22 bp, Homo sapiens
tgtgtgcagcctctgtctttgg

SEQ ID NO: 10022461 - DNA, 22 bp, Homo sapiens
tgtgtgcaggcactgtgccaga

SEQ ID NO: 10022462 - DNA, 20 bp, Homo sapiens
tgtgtgcatctgtatgtatt

SEQ ID NO: 10022463 - DNA, 21 bp, Homo sapiens
tgtgtgcatatgcatgtacat

SEQ ID NO: 10022464 - DNA, 22 bp, Homo sapiens
tgtgtgcagctgaaaagcgctg

SEQ ID NO: 10022465 - DNA, 22 bp, Homo sapiens
tgtgtgcagcggcaggtgaagt

SEQ ID NO: 10022466 - DNA, 22 bp, Homo sapiens
tgtgtgcaggcactgtgccaga

SEQ ID NO: 10022467 - DNA, 22 bp, Homo sapiens
tgtgtgcatacacacggtaaca

SEQ ID NO: 10022468 - DNA, 21 bp, Homo sapiens
tgtgttcttctaggtcagcta

SEQ ID NO: 10022469 - DNA, 22 bp, Homo sapiens
tgtgttgtgacattcttggatg

SEQ ID NO: 10022470 - DNA, 22 bp, Homo sapiens
tgtgttgtgacattcttggatg

SEQ ID NO: 10022471 - DNA, 21 bp, Homo sapiens
tgtgtgcatatgcatgtacat

SEQ ID NO: 10022472 - DNA, 22 bp, Homo sapiens
tgtgttaattccacaaacattc

SEQ ID NO: 10022473 - DNA, 22 bp, Homo sapiens
tgtgttaattttccctttctct

SEQ ID NO: 10022474 - DNA, 22 bp, Homo sapiens
tgtgttaattccacaaacattc

SEQ ID NO: 10022475 - DNA, 22 bp, Homo sapiens
tgtgttctgaaggagaagagtg

SEQ ID NO: 10022476 - DNA, 22 bp, Homo sapiens
tgtgttcaagattagttctagt

SEQ ID NO: 10022477 - DNA, 21 bp, Homo sapiens
tgtgtttgagactatgtttcc

SEQ ID NO: 10022478 - DNA, 22 bp, Homo sapiens
tgtgtttctctgaggggtccct

SEQ ID NO: 10022479 - DNA, 22 bp, Homo sapiens
tgtgtttcagaaccttctttca

SEQ ID NO: 10022480 - DNA, 22 bp, Homo sapiens
tgtgtttgaggcatgttgcaga

SEQ ID NO: 10022481 - DNA, 21 bp, Homo sapiens
tgtgtttgagactatgtttcc

SEQ ID NO: 10022482 - DNA, 22 bp, Homo sapiens
tgtgttgtgacattcttggatg

SEQ ID NO: 10022483 - DNA, 22 bp, Homo sapiens
tgtgttgttttaagctgctgca

SEQ ID NO: 10022484 - DNA, 22 bp, Homo sapiens
tgtgtttgggggagatgcattt

SEQ ID NO: 10022485 - DNA, 22 bp, Homo sapiens
tgtgttttacaaattctcttaa

SEQ ID NO: 10022486 - DNA, 21 bp, Homo sapiens
tgtgttttaatgatattctgt

SEQ ID NO: 10022487 - DNA, 22 bp, Homo sapiens
tgtgttttggaaggaacatgca

SEQ ID NO: 10022488 - DNA, 22 bp, Homo sapiens
tgttatttatttcacctccaga

SEQ ID NO: 10022489 - DNA, 22 bp, Homo sapiens
tgttatttatttcacctccaga

SEQ ID NO: 10022490 - DNA, 22 bp, Homo sapiens
tgttatttatttcacctccaga

SEQ ID NO: 10022491 - DNA, 22 bp, Homo sapiens
tgttatttctttgccatatctt

SEQ ID NO: 10022492 - DNA, 20 bp, Homo sapiens
tgttattagcaagcttcttt

SEQ ID NO: 10022493 - DNA, 22 bp, Homo sapiens
tgttattatctgttaggtgttc

SEQ ID NO: 10022494 - DNA, 22 bp, Homo sapiens
tgttattatgtttccagagcct

SEQ ID NO: 10022495 - DNA, 23 bp, Homo sapiens
tgttattccaggttaatgtactt

SEQ ID NO: 10022496 - DNA, 22 bp, Homo sapiens
tgttattgatatctaatgctct

SEQ ID NO: 10022497 - DNA, 22 bp, Homo sapiens
tgttatttatctgagcatttat

SEQ ID NO: 10022498 - DNA, 21 bp, Homo sapiens
tgttatgtgcttcaagaagtg

SEQ ID NO: 10022499 - DNA, 22 bp, Homo sapiens
tgttatgtgccacacttgaggg

SEQ ID NO: 10022500 - DNA, 21 bp, Homo sapiens
tgttatgtgcttcaagaagtg

SEQ ID NO: 10022501 - DNA, 22 bp, Homo sapiens
tgttatgagaaagacattaggt

SEQ ID NO: 10022502 - DNA, 22 bp, Homo sapiens
tgttatgagtcctcatatacta

SEQ ID NO: 10022503 - DNA, 22 bp, Homo sapiens
tgttatctgagcaacgtcgacg

SEQ ID NO: 10022504 - DNA, 22 bp, Homo sapiens
tgttatacagacacgatggtat

SEQ ID NO: 10022505 - DNA, 22 bp, Homo sapiens
tgttatatctaaatagccacat

SEQ ID NO: 10022506 - DNA, 22 bp, Homo sapiens
tgttagttgttcatgttaagag

SEQ ID NO: 10022507 - DNA, 22 bp, Homo sapiens
tgttaaaaatgcagattcctat

SEQ ID NO: 10022508 - DNA, 22 bp, Homo sapiens
tgttaaaaatgcagattcctat

SEQ ID NO: 10022509 - DNA, 22 bp, Homo sapiens
tgttatcacttagacatgctag

SEQ ID NO: 10022510 - DNA, 22 bp, Homo sapiens
tgttatttgggaaagttgtaca

SEQ ID NO: 10022511 - DNA, 22 bp, Homo sapiens
tgttcaaaaatatcttctgcaa

SEQ ID NO: 10022512 - DNA, 22 bp, Homo sapiens
tgttcaaatcttttgcttattt

SEQ ID NO: 10022513 - DNA, 22 bp, Homo sapiens
tgttcaagtggatgtggctttt

SEQ ID NO: 10022514 - DNA, 21 bp, Homo sapiens
tgttcaaacgtacacatttct

SEQ ID NO: 10022515 - DNA, 21 bp, Homo sapiens
tgttcaaacgtacacatttct

SEQ ID NO: 10022516 - DNA, 21 bp, Homo sapiens
tgttcaaacgtacacatttct

SEQ ID NO: 10022517 - DNA, 21 bp, Homo sapiens
tgttcacatggagcagaatgt

SEQ ID NO: 10022518 - DNA, 22 bp, Homo sapiens
tgttcacatgtacatgaatatt

SEQ ID NO: 10022519 - DNA, 20 bp, Homo sapiens
tgttcacagtagttgctgct

SEQ ID NO: 10022520 - DNA, 20 bp, Homo sapiens
tgttcacagtagttgctgct

SEQ ID NO: 10022521 - DNA, 21 bp, Homo sapiens
tgttcacatggagcagaatgt

SEQ ID NO: 10022522 - DNA, 22 bp, Homo sapiens
tgttcacaacgtgcaggtttgt

SEQ ID NO: 10022523 - DNA, 22 bp, Homo sapiens
tgttcacacagtctatacggat

SEQ ID NO: 10022524 - DNA, 22 bp, Homo sapiens
tgttcacacacggaggccacag

SEQ ID NO: 10022525 - DNA, 22 bp, Homo sapiens
tgttcctgaggcatgtgtcaat

SEQ ID NO: 10022526 - DNA, 22 bp, Homo sapiens
tgttcctgacggccaaagaggt

SEQ ID NO: 10022527 - DNA, 22 bp, Homo sapiens
tgttcctgaatgcctggctggc

SEQ ID NO: 10022528 - DNA, 22 bp, Homo sapiens
tgttcctgtactgctgtggctt

SEQ ID NO: 10022529 - DNA, 22 bp, Homo sapiens
tgttcctggttcctgcatgatg

SEQ ID NO: 10022530 - DNA, 22 bp, Homo sapiens
tgttcctggaaagccaggtggg

SEQ ID NO: 10022531 - DNA, 22 bp, Homo sapiens
tgttccgaccgtggggtttgat

SEQ ID NO: 10022532 - DNA, 22 bp, Homo sapiens
tgttccgaccgtggggtttgat

SEQ ID NO: 10022533 - DNA, 22 bp, Homo sapiens
tgttctggggttgagagacaat

SEQ ID NO: 10022534 - DNA, 22 bp, Homo sapiens
tgttctgtacctgtcctggggc

SEQ ID NO: 10022535 - DNA, 22 bp, Homo sapiens
tgtttaagttctgctccttatt

SEQ ID NO: 10022536 - DNA, 22 bp, Homo sapiens
tgttctgtgcatctagccagta

SEQ ID NO: 10022537 - DNA, 22 bp, Homo sapiens
tgttctcttccacggcgctcgg

SEQ ID NO: 10022538 - DNA, 17 bp, Homo sapiens
tgttctcttcagaaatc

SEQ ID NO: 10022539 - DNA, 22 bp, Homo sapiens
tgttctctctggctgccagtac

SEQ ID NO: 10022540 - DNA, 22 bp, Homo sapiens
tgttctctctggctgccagtac

SEQ ID NO: 10022541 - DNA, 22 bp, Homo sapiens
tgttctgccagcacttctcagc

SEQ ID NO: 10022542 - DNA, 22 bp, Homo sapiens
tgttctggagataagaggtaga

SEQ ID NO: 10022543 - DNA, 22 bp, Homo sapiens
tgttctgcaatgctgcctcctt

SEQ ID NO: 10022544 - DNA, 22 bp, Homo sapiens
tgttctgcaatgctgcctcctt

SEQ ID NO: 10022545 - DNA, 22 bp, Homo sapiens
tgttctcttttcctgctgagcc

SEQ ID NO: 10022546 - DNA, 22 bp, Homo sapiens
tgttctcttttcctgctgagcc

SEQ ID NO: 10022547 - DNA, 22 bp, Homo sapiens
tgttctgcaagccctgccacct

SEQ ID NO: 10022548 - DNA, 22 bp, Homo sapiens
tgttctcagtaattctatttta

SEQ ID NO: 10022549 - DNA, 22 bp, Homo sapiens
tgttctcagtaattctatttta

SEQ ID NO: 10022550 - DNA, 22 bp, Homo sapiens
tgttctctaagaaaagaagcat

SEQ ID NO: 10022551 - DNA, 22 bp, Homo sapiens
tgttctcactggatgcttcaca

SEQ ID NO: 10022552 - DNA, 22 bp, Homo sapiens
tgttctagcaacacagttttgg

SEQ ID NO: 10022553 - DNA, 19 bp, Homo sapiens
tgttctagcggcaccaggc

SEQ ID NO: 10022554 - DNA, 19 bp, Homo sapiens
tgttctagcggcaccaggc

SEQ ID NO: 10022555 - DNA, 22 bp, Homo sapiens
tgttctaggcaaaagctgattt

SEQ ID NO: 10022556 - DNA, 22 bp, Homo sapiens
tgttctaggcaaaagctgattt

SEQ ID NO: 10022557 - DNA, 21 bp, Homo sapiens
tgttcctgttctctaggatcc

SEQ ID NO: 10022558 - DNA, 22 bp, Homo sapiens
tgttccttcacagcagtggaca

SEQ ID NO: 10022559 - DNA, 23 bp, Homo sapiens
tgttcctgtcaaattttcttccc

SEQ ID NO: 10022560 - DNA, 22 bp, Homo sapiens
tgttcctgtactgctgtggctt

SEQ ID NO: 10022561 - DNA, 21 bp, Homo sapiens
tgttcctgttctctaggatcc

SEQ ID NO: 10022562 - DNA, 22 bp, Homo sapiens
tgttcgtagcacgtagtttctt

SEQ ID NO: 10022563 - DNA, 22 bp, Homo sapiens
tgttctaaatttgcatggtcca

SEQ ID NO: 10022564 - DNA, 22 bp, Homo sapiens
tgttctaagtgttttgttcatg

SEQ ID NO: 10022565 - DNA, 22 bp, Homo sapiens
tgtttaatcttcaggacagtct

SEQ ID NO: 10022566 - DNA, 21 bp, Homo sapiens
tgtttaatacatatttgtgga

SEQ ID NO: 10022567 - DNA, 22 bp, Homo sapiens
tgtttaataattctatgatagt

SEQ ID NO: 10022568 - DNA, 22 bp, Homo sapiens
tgtttaattcaccatcatgttc

SEQ ID NO: 10022569 - DNA, 22 bp, Homo sapiens
tgtttaattcaccatcatgttc

SEQ ID NO: 10022570 - DNA, 22 bp, Homo sapiens
tgtttaattcaccatcatgttc

SEQ ID NO: 10022571 - DNA, 22 bp, Homo sapiens
tgtttaattgggccaacagcgg

SEQ ID NO: 10022572 - DNA, 22 bp, Homo sapiens
tgtttaatttcacaaagttgac

SEQ ID NO: 10022573 - DNA, 22 bp, Homo sapiens
tgtttaatttcacaaagttgac

SEQ ID NO: 10022574 - DNA, 22 bp, Homo sapiens
tgtttacaaggagtttatattg

SEQ ID NO: 10022575 - DNA, 22 bp, Homo sapiens
tgtttacaaggagaatttgagg

SEQ ID NO: 10022576 - DNA, 22 bp, Homo sapiens
tgtttacaaaaccgtggtactg

SEQ ID NO: 10022577 - DNA, 22 bp, Homo sapiens
tgtttacaagccacttgttaag

SEQ ID NO: 10022578 - DNA, 22 bp, Homo sapiens
tgtttacaaggagaatttgagg

SEQ ID NO: 10022579 - DNA, 22 bp, Homo sapiens
tgtttacagggtgattttacct

SEQ ID NO: 10022580 - DNA, 22 bp, Homo sapiens
tgtttacagggtgattttacct

SEQ ID NO: 10022581 - DNA, 22 bp, Homo sapiens
tgtttacacaatagtctctctc

SEQ ID NO: 10022582 - DNA, 22 bp, Homo sapiens
tgtttacacaatagtctctctc

SEQ ID NO: 10022583 - DNA, 22 bp, Homo sapiens
tgtttacagaaggcagacttcc

SEQ ID NO: 10022584 - DNA, 22 bp, Homo sapiens
tgtttacagaaggcagacttcc

SEQ ID NO: 10022585 - DNA, 22 bp, Homo sapiens
tgtttgacacctcagtgtttct

SEQ ID NO: 10022586 - DNA, 22 bp, Homo sapiens
tgtttgcaaccccttgtgagaa

SEQ ID NO: 10022587 - DNA, 19 bp, Homo sapiens
tgttttcaagtgggattat

SEQ ID NO: 10022588 - DNA, 22 bp, Homo sapiens
tgttttcacaatgatgtcagat

SEQ ID NO: 10022589 - DNA, 22 bp, Homo sapiens
tgttttcacaatgatgtcagat

SEQ ID NO: 10022590 - DNA, 22 bp, Homo sapiens
tgttttcacaatgatgtcagat

SEQ ID NO: 10022591 - DNA, 22 bp, Homo sapiens
tgttttcagtcatatagcaggt

SEQ ID NO: 10022592 - DNA, 22 bp, Homo sapiens
tgttttctcttgaaaagcagtc

SEQ ID NO: 10022593 - DNA, 22 bp, Homo sapiens
tgttttctcttgaaaagcagtc

SEQ ID NO: 10022594 - DNA, 22 bp, Homo sapiens
tgtttctttgtagatattcttt

SEQ ID NO: 10022595 - DNA, 20 bp, Homo sapiens
tgtttcttttaatgagcggc

SEQ ID NO: 10022596 - DNA, 22 bp, Homo sapiens
tgtttcttgggtgctcacatca

SEQ ID NO: 10022597 - DNA, 22 bp, Homo sapiens
tgtttcctaagtgtctctgaag

SEQ ID NO: 10022598 - DNA, 18 bp, Homo sapiens
tgtttcctcctggaggct

SEQ ID NO: 10022599 - DNA, 22 bp, Homo sapiens
tgtttcctttctggtgagcata

SEQ ID NO: 10022600 - DNA, 22 bp, Homo sapiens
tgtttcatgtggacatagttgt

SEQ ID NO: 10022601 - DNA, 22 bp, Homo sapiens
tgtttcatgaaacatgtttagg

SEQ ID NO: 10022602 - DNA, 22 bp, Homo sapiens
tgtttccatggtgacagcagct

SEQ ID NO: 10022603 - DNA, 22 bp, Homo sapiens
tgtttccatggtgacagcagct

SEQ ID NO: 10022604 - DNA, 22 bp, Homo sapiens
tgtttcattagtactgacaata

SEQ ID NO: 10022605 - DNA, 22 bp, Homo sapiens
tgtttcatgtggacatagttgt

SEQ ID NO: 10022606 - DNA, 22 bp, Homo sapiens
tgtttacatgcataagcttaag

SEQ ID NO: 10022607 - DNA, 22 bp, Homo sapiens
tgtttacatgcataagcttaag

SEQ ID NO: 10022608 - DNA, 22 bp, Homo sapiens
tgtttcaagcaatagcatttca

SEQ ID NO: 10022609 - DNA, 22 bp, Homo sapiens
tgtttcaagcaatagcatttca

SEQ ID NO: 10022610 - DNA, 22 bp, Homo sapiens
tgtttcaactgttaagatatgc

SEQ ID NO: 10022611 - DNA, 22 bp, Homo sapiens
ttactttgggtcctgcttataa

SEQ ID NO: 10022612 - DNA, 22 bp, Homo sapiens
ttactttggcaaactcctgccc

SEQ ID NO: 10022613 - DNA, 22 bp, Homo sapiens
ttactttatctcctagattcca

SEQ ID NO: 10022614 - DNA, 22 bp, Homo sapiens
ttactttagggatgttttgctt

SEQ ID NO: 10022615 - DNA, 22 bp, Homo sapiens
ttagaaaatttgcttctttgga

SEQ ID NO: 10022616 - DNA, 22 bp, Homo sapiens
ttagaaaatttgcttctttgga

SEQ ID NO: 10022617 - DNA, 19 bp, Homo sapiens
ttagaaactgttgacactg

SEQ ID NO: 10022618 - DNA, 22 bp, Homo sapiens
ttagaaactcaactctgggaat

SEQ ID NO: 10022619 - DNA, 22 bp, Homo sapiens
ttagaaacaaaatagttatttg

SEQ ID NO: 10022620 - DNA, 22 bp, Homo sapiens
ttagaaacccagactcttaggt

SEQ ID NO: 10022621 - DNA, 22 bp, Homo sapiens
ttagaaagagtataccagaaac

SEQ ID NO: 10022622 - DNA, 22 bp, Homo sapiens
ttagaaagaatagcctggctgc

SEQ ID NO: 10022623 - DNA, 22 bp, Homo sapiens
ttagaaagaactttagatatca

SEQ ID NO: 10022624 - DNA, 22 bp, Homo sapiens
ttagaaactttggaggatagat

SEQ ID NO: 10022625 - DNA, 22 bp, Homo sapiens
ttagaagcaggctgtgtcccca

SEQ ID NO: 10022626 - DNA, 22 bp, Homo sapiens
ttagaagcatcacctgttctgg

SEQ ID NO: 10022627 - DNA, 22 bp, Homo sapiens
ttagaagccaggatggagcagg

SEQ ID NO: 10022628 - DNA, 22 bp, Homo sapiens
ttagaagtaaggtcagatttct

SEQ ID NO: 10022629 - DNA, 22 bp, Homo sapiens
ttagacatagaatattgtctag

SEQ ID NO: 10022630 - DNA, 21 bp, Homo sapiens
ttagaagctaatgcagctggt

SEQ ID NO: 10022631 - DNA, 19 bp, Homo sapiens
ttagaagccataggtacag

SEQ ID NO: 10022632 - DNA, 19 bp, Homo sapiens
ttagaagccataggtacag

SEQ ID NO: 10022633 - DNA, 22 bp, Homo sapiens
ttagacatgtttgctaaaatga

SEQ ID NO: 10022634 - DNA, 22 bp, Homo sapiens
ttagacatagaatattgtctag

SEQ ID NO: 10022635 - DNA, 22 bp, Homo sapiens
ttagacatcagtgcttctcagc

SEQ ID NO: 10022636 - DNA, 22 bp, Homo sapiens
ttagacatcagtgcttctcagc

SEQ ID NO: 10022637 - DNA, 22 bp, Homo sapiens
ttagacatgtttgctaaaatga

SEQ ID NO: 10022638 - DNA, 22 bp, Homo sapiens
ttagagaattccaaatgactac

SEQ ID NO: 10022639 - DNA, 22 bp, Homo sapiens
ttagagattgtctagtattgtg

SEQ ID NO: 10022640 - DNA, 22 bp, Homo sapiens
ttagagatgtcccaaaatgaag

SEQ ID NO: 10022641 - DNA, 22 bp, Homo sapiens
ttagagatacatttgtagcttg

SEQ ID NO: 10022642 - DNA, 23 bp, Homo sapiens
ttagagatgattaaaaaatcttg

SEQ ID NO: 10022643 - DNA, 22 bp, Homo sapiens
ttagagatacatttgtagcttg

SEQ ID NO: 10022644 - DNA, 22 bp, Homo sapiens
ttagagccccagaaaacagtgg

SEQ ID NO: 10022645 - DNA, 22 bp, Homo sapiens
ttagagattgtctagtattgtg

SEQ ID NO: 10022646 - DNA, 17 bp, Homo sapiens
ttagagctacatgttga

SEQ ID NO: 10022647 - DNA, 22 bp, Homo sapiens
ttagagctagatgaggtcatga

SEQ ID NO: 10022648 - DNA, 22 bp, Homo sapiens
ttagaggggctgctgaatggga

SEQ ID NO: 10022649 - DNA, 22 bp, Homo sapiens
ttagagctgggatggattttcc

SEQ ID NO: 10022650 - DNA, 22 bp, Homo sapiens
ttactttagaaatagtcatcaa

SEQ ID NO: 10022651 - DNA, 22 bp, Homo sapiens
ttacttgcttataatcaaaaca

SEQ ID NO: 10022652 - DNA, 22 bp, Homo sapiens
ttacttcagattgtggaaggca

SEQ ID NO: 10022653 - DNA, 19 bp, Homo sapiens
ttacttcaggagtgaaatt

SEQ ID NO: 10022654 - DNA, 22 bp, Homo sapiens
ttactgttcctctctcaaagag

SEQ ID NO: 10022655 - DNA, 22 bp, Homo sapiens
ttacttaaacagaaatgcagaa

SEQ ID NO: 10022656 - DNA, 22 bp, Homo sapiens
ttacttaaacagaaatgcagaa

SEQ ID NO: 10022657 - DNA, 22 bp, Homo sapiens
ttacttaaacagaaatgcagaa

SEQ ID NO: 10022658 - DNA, 22 bp, Homo sapiens
ttacttaaaaattctaagcccc

SEQ ID NO: 10022659 - DNA, 22 bp, Homo sapiens
ttaccaaatgaaatagagattt

SEQ ID NO: 10022660 - DNA, 22 bp, Homo sapiens
ttacattttggggtaaggataa

SEQ ID NO: 10022661 - DNA, 22 bp, Homo sapiens
ttactacagagagagctccagt

SEQ ID NO: 10022662 - DNA, 22 bp, Homo sapiens
ttactacattgtaacacagtac

SEQ ID NO: 10022663 - DNA, 22 bp, Homo sapiens
ttactagctgagggaacttggg

SEQ ID NO: 10022664 - DNA, 22 bp, Homo sapiens
ttactagccatgtgtgagaaga

SEQ ID NO: 10022665 - DNA, 22 bp, Homo sapiens
ttactcttaatggcaacaactg

SEQ ID NO: 10022666 - DNA, 22 bp, Homo sapiens
ttactagtatatgtcaagcaac

SEQ ID NO: 10022667 - DNA, 22 bp, Homo sapiens
ttactgctaattctgtaggttt

SEQ ID NO: 10022668 - DNA, 22 bp, Homo sapiens
ttactgcacgtgggacatatat

SEQ ID NO: 10022669 - DNA, 22 bp, Homo sapiens
ttactgtagcttgacatatgtc

SEQ ID NO: 10022670 - DNA, 22 bp, Homo sapiens
ttactgaaagtatacatttctg

SEQ ID NO: 10022671 - DNA, 22 bp, Homo sapiens
ttacatagttaaatagtacagc

SEQ ID NO: 10022672 - DNA, 22 bp, Homo sapiens
ttacagtattgttaaactcttt

SEQ ID NO: 10022673 - DNA, 22 bp, Homo sapiens
ttacagtatgatcaacttttca

SEQ ID NO: 10022674 - DNA, 22 bp, Homo sapiens
ttacagtattggtcacgtttgt

SEQ ID NO: 10022675 - DNA, 22 bp, Homo sapiens
ttacagtagctttatttggagt

SEQ ID NO: 10022676 - DNA, 23 bp, Homo sapiens
ttacagtaggagttggaaaacca

SEQ ID NO: 10022677 - DNA, 22 bp, Homo sapiens
ttacaggtggagaagtaaggct

SEQ ID NO: 10022678 - DNA, 22 bp, Homo sapiens
ttacagtacctgtatggccact

SEQ ID NO: 10022679 - DNA, 22 bp, Homo sapiens
ttacagtagatacaatgagtaa

SEQ ID NO: 10022680 - DNA, 22 bp, Homo sapiens
ttacagtagattttgaatgtgg

SEQ ID NO: 10022681 - DNA, 22 bp, Homo sapiens
ttacagtacagaaaataacaga

SEQ ID NO: 10022682 - DNA, 22 bp, Homo sapiens
ttacagtaatgtattatttaac

SEQ ID NO: 10022683 - DNA, 22 bp, Homo sapiens
ttacagtaacattttcagtctg

SEQ ID NO: 10022684 - DNA, 22 bp, Homo sapiens
ttacagtaatcgagtgttgtgg

SEQ ID NO: 10022685 - DNA, 22 bp, Homo sapiens
ttacagtaatgtattatttaac

SEQ ID NO: 10022686 - DNA, 22 bp, Homo sapiens
ttacaggaggtgctaggtgttt

SEQ ID NO: 10022687 - DNA, 22 bp, Homo sapiens
ttacactttggcaagctattaa

SEQ ID NO: 10022688 - DNA, 22 bp, Homo sapiens
ttacacttctaaaaaaagcagg

SEQ ID NO: 10022689 - DNA, 22 bp, Homo sapiens
ttacacttgtaattatataacg

SEQ ID NO: 10022690 - DNA, 22 bp, Homo sapiens
ttaatttttatgtatagtgtgt

SEQ ID NO: 10022691 - DNA, 22 bp, Homo sapiens
ttacaaacaacagacatttatt

SEQ ID NO: 10022692 - DNA, 22 bp, Homo sapiens
ttaattttctcatctgtgaaat

SEQ ID NO: 10022693 - DNA, 21 bp, Homo sapiens
ttaatttattcatgatagcta

SEQ ID NO: 10022694 - DNA, 21 bp, Homo sapiens
ttaatttattcatgatagcta

SEQ ID NO: 10022695 - DNA, 22 bp, Homo sapiens
ttaatttatgtccaaaccagat

SEQ ID NO: 10022696 - DNA, 21 bp, Homo sapiens
ttaatttattcatgatagcta

SEQ ID NO: 10022697 - DNA, 21 bp, Homo sapiens
ttaatttattcatgatagcta

SEQ ID NO: 10022698 - DNA, 22 bp, Homo sapiens
ttacaaactgtcatatagtatt

SEQ ID NO: 10022699 - DNA, 22 bp, Homo sapiens
ttacaaactgtcatatagtatt

SEQ ID NO: 10022700 - DNA, 22 bp, Homo sapiens
ttacaaactgtcatatagtatt

SEQ ID NO: 10022701 - DNA, 22 bp, Homo sapiens
ttacaaacaacagacatttatt

SEQ ID NO: 10022702 - DNA, 22 bp, Homo sapiens
ttacaaacaacagacatttatt

SEQ ID NO: 10022703 - DNA, 22 bp, Homo sapiens
ttacaaacaagatcttattctt

SEQ ID NO: 10022704 - DNA, 22 bp, Homo sapiens
ttacacaaacacattccagata

SEQ ID NO: 10022705 - DNA, 22 bp, Homo sapiens
ttacacaaagttagctcttgca

SEQ ID NO: 10022706 - DNA, 22 bp, Homo sapiens
ttacacaacatctgtattatta

SEQ ID NO: 10022707 - DNA, 22 bp, Homo sapiens
ttacacaacatctgtattatta

SEQ ID NO: 10022708 - DNA, 22 bp, Homo sapiens
ttacacaagttctttaacctat

SEQ ID NO: 10022709 - DNA, 22 bp, Homo sapiens
ttacacacaattagcatagtaa

SEQ ID NO: 10022710 - DNA, 22 bp, Homo sapiens
ttacacacagagctgggcctgg

SEQ ID NO: 10022711 - DNA, 22 bp, Homo sapiens
ttacacacagagctgggcctgg

SEQ ID NO: 10022712 - DNA, 22 bp, Homo sapiens
ttacacacaattagcatagtaa

SEQ ID NO: 10022713 - DNA, 22 bp, Homo sapiens
ttacacaattactcactcctgg

SEQ ID NO: 10022714 - DNA, 22 bp, Homo sapiens
ttacacaattttattgacctaa

SEQ ID NO: 10022715 - DNA, 22 bp, Homo sapiens
ttacacagaaattttattgcct

SEQ ID NO: 10022716 - DNA, 22 bp, Homo sapiens
ttacacagaaattttattgcct

SEQ ID NO: 10022717 - DNA, 22 bp, Homo sapiens
ttacacactctgccctgctgtt

SEQ ID NO: 10022718 - DNA, 22 bp, Homo sapiens
ttacacactctgccctgctgtt

SEQ ID NO: 10022719 - DNA, 21 bp, Homo sapiens
ttacacactgcttctagaatg

SEQ ID NO: 10022720 - DNA, 22 bp, Homo sapiens
ttacacagatggttagtagagg

SEQ ID NO: 10022721 - DNA, 22 bp, Homo sapiens
ttacacagcttctatccttgaa

SEQ ID NO: 10022722 - DNA, 22 bp, Homo sapiens
ttacacaggcacttaaaatgca

SEQ ID NO: 10022723 - DNA, 17 bp, Homo sapiens
ttacacaggagagctct

SEQ ID NO: 10022724 - DNA, 22 bp, Homo sapiens
ttacacaggcacttaaaatgca

SEQ ID NO: 10022725 - DNA, 17 bp, Homo sapiens
ttacacaggagagctct

SEQ ID NO: 10022726 - DNA, 19 bp, Homo sapiens
ttacactcctgggcagtgg

SEQ ID NO: 10022727 - DNA, 22 bp, Homo sapiens
ttacactctggttgtgggcctt

SEQ ID NO: 10022728 - DNA, 22 bp, Homo sapiens
ttacactcatattgcacttacc

SEQ ID NO: 10022729 - DNA, 22 bp, Homo sapiens
ttacactaagctacttctatat

SEQ ID NO: 10022730 - DNA, 22 bp, Homo sapiens
ttacacattgcagatcaaaatg

SEQ ID NO: 10022731 - DNA, 22 bp, Homo sapiens
ttacacatgctttgtgtgtatg

SEQ ID NO: 10022732 - DNA, 22 bp, Homo sapiens
ttacacatgaaggtccaatgtt

SEQ ID NO: 10022733 - DNA, 22 bp, Homo sapiens
ttacacatgaaggtccaatgtt

SEQ ID NO: 10022734 - DNA, 22 bp, Homo sapiens
ttacacagtgcacaagcagagt

SEQ ID NO: 10022735 - DNA, 22 bp, Homo sapiens
ttacacagtgcacaagcagagt

SEQ ID NO: 10022736 - DNA, 22 bp, Homo sapiens
ttacacagttggtaggggcaga

SEQ ID NO: 10022737 - DNA, 22 bp, Homo sapiens
ttacacagtggttaagtctggg

SEQ ID NO: 10022738 - DNA, 22 bp, Homo sapiens
ttaaatattatgttgtctgcaa

SEQ ID NO: 10022739 - DNA, 22 bp, Homo sapiens
ttaaatattatgttgtctgcaa

SEQ ID NO: 10022740 - DNA, 22 bp, Homo sapiens
ttaaatattttcagcagggtca

SEQ ID NO: 10022741 - DNA, 22 bp, Homo sapiens
ttaaatattttcagcagggtca

SEQ ID NO: 10022742 - DNA, 22 bp, Homo sapiens
ttaaatattatgttgtctgcaa

SEQ ID NO: 10022743 - DNA, 22 bp, Homo sapiens
ttaaatattatgttgtctgcaa

SEQ ID NO: 10022744 - DNA, 22 bp, Homo sapiens
ttaaatattatgttgtctgcaa

SEQ ID NO: 10022745 - DNA, 22 bp, Homo sapiens
ttaaatagtaggtctattttgg

SEQ ID NO: 10022746 - DNA, 22 bp, Homo sapiens
ttaaatagtcaaatcagtggca

SEQ ID NO: 10022747 - DNA, 22 bp, Homo sapiens
ttaaagcatcacactattaatt

SEQ ID NO: 10022748 - DNA, 22 bp, Homo sapiens
tgtttttatctctgtgtacaac

SEQ ID NO: 10022749 - DNA, 22 bp, Homo sapiens
tgtttttatctctgtgtacaac

SEQ ID NO: 10022750 - DNA, 22 bp, Homo sapiens
ttaaagcagtttgtatacatgg

SEQ ID NO: 10022751 - DNA, 22 bp, Homo sapiens
tgttttgtttatgagagcacag

SEQ ID NO: 10022752 - DNA, 22 bp, Homo sapiens
tgtttttaaataatgatagaaa

SEQ ID NO: 10022753 - DNA, 22 bp, Homo sapiens
tgtttttaaataatgatagaaa

SEQ ID NO: 10022754 - DNA, 22 bp, Homo sapiens
tgtttttaaataatgatagaaa

SEQ ID NO: 10022755 - DNA, 22 bp, Homo sapiens
tgtttttaaataatgatagaaa

SEQ ID NO: 10022756 - DNA, 22 bp, Homo sapiens
tgtttttactgtgatccagaaa

SEQ ID NO: 10022757 - DNA, 22 bp, Homo sapiens
tgttttgcttctctgtttccca

SEQ ID NO: 10022758 - DNA, 22 bp, Homo sapiens
tgttttgcttctctgtttccca

SEQ ID NO: 10022759 - DNA, 23 bp, Homo sapiens
tgttttcttgtcctggtataatt

SEQ ID NO: 10022760 - DNA, 22 bp, Homo sapiens
tgttttgtagctaatagctatt

SEQ ID NO: 10022761 - DNA, 22 bp, Homo sapiens
tgttttgtagctaatagctatt

SEQ ID NO: 10022762 - DNA, 22 bp, Homo sapiens
tgttttgttagcactctgggaa

SEQ ID NO: 10022763 - DNA, 22 bp, Homo sapiens
tgttttgttagcactctgggaa

SEQ ID NO: 10022764 - DNA, 22 bp, Homo sapiens
tgttttgtttatgagagcacag

SEQ ID NO: 10022765 - DNA, 22 bp, Homo sapiens
tgttttgttcactgcattgtcc

SEQ ID NO: 10022766 - DNA, 22 bp, Homo sapiens
tgttttgtgcatttacaacatg

SEQ ID NO: 10022767 - DNA, 22 bp, Homo sapiens
tgttttgtgcatttacaacatg

SEQ ID NO: 10022768 - DNA, 19 bp, Homo sapiens
tgttttgttaaagcagtcc

SEQ ID NO: 10022769 - DNA, 19 bp, Homo sapiens
tgttttgttaaagcagtcc

SEQ ID NO: 10022770 - DNA, 19 bp, Homo sapiens
tgttttgttaaagcagtcc

SEQ ID NO: 10022771 - DNA, 22 bp, Homo sapiens
tgttttgtgcacttctatagca

SEQ ID NO: 10022772 - DNA, 22 bp, Homo sapiens
tgttttgtctaatctaaattct

SEQ ID NO: 10022773 - DNA, 22 bp, Homo sapiens
tgttttgtccttttctatatac

SEQ ID NO: 10022774 - DNA, 22 bp, Homo sapiens
tgttttgtccttttctatatac

SEQ ID NO: 10022775 - DNA, 22 bp, Homo sapiens
tgttttgtctaatagggcaggt

SEQ ID NO: 10022776 - DNA, 22 bp, Homo sapiens
tgttttcttcctaattgctcat

SEQ ID NO: 10022777 - DNA, 22 bp, Homo sapiens
tgttttcttcctaattgctcat

SEQ ID NO: 10022778 - DNA, 22 bp, Homo sapiens
tgttttcttcctaattgctcat

SEQ ID NO: 10022779 - DNA, 22 bp, Homo sapiens
tgttttctgtgtagagatcaca

SEQ ID NO: 10022780 - DNA, 22 bp, Homo sapiens
tgttttctgatggttaatgagt

SEQ ID NO: 10022781 - DNA, 17 bp, Homo sapiens
tgttttctgctaccttt

SEQ ID NO: 10022782 - DNA, 17 bp, Homo sapiens
tgttttctgctaccttt

SEQ ID NO: 10022783 - DNA, 22 bp, Homo sapiens
tgttttctgggtggaaggtact

SEQ ID NO: 10022784 - DNA, 22 bp, Homo sapiens
tgttttctgattctcgtgtggt

SEQ ID NO: 10022785 - DNA, 22 bp, Homo sapiens
ttaaatgatgcatatcatttag

SEQ ID NO: 10022786 - DNA, 22 bp, Homo sapiens
ttaaatgatgcatatcatttag

SEQ ID NO: 10022787 - DNA, 22 bp, Homo sapiens
ttaaatgatgcatatcatttag

SEQ ID NO: 10022788 - DNA, 22 bp, Homo sapiens
ttaaatgagatgttcagatatt

SEQ ID NO: 10022789 - DNA, 22 bp, Homo sapiens
ttaaatattttcagcagggtca

SEQ ID NO: 10022790 - DNA, 22 bp, Homo sapiens
ttaaatcagtaggctactcctt

SEQ ID NO: 10022791 - DNA, 22 bp, Homo sapiens
ttaaatctgttctcatgtctgt

SEQ ID NO: 10022792 - DNA, 22 bp, Homo sapiens
ttaaatcaggcatcatttcagt

SEQ ID NO: 10022793 - DNA, 22 bp, Homo sapiens
ttaaatcaggcatcatttcagt

SEQ ID NO: 10022794 - DNA, 22 bp, Homo sapiens
ttaaatgacttttattattctc

SEQ ID NO: 10022795 - DNA, 22 bp, Homo sapiens
ttaaatgagatgttcagatatt

SEQ ID NO: 10022796 - DNA, 22 bp, Homo sapiens
ttaaatgagatgttcagatatt

SEQ ID NO: 10022797 - DNA, 22 bp, Homo sapiens
ttaaatgacttttattattctc

SEQ ID NO: 10022798 - DNA, 22 bp, Homo sapiens
ttaaatgaacgagatatgcaac

SEQ ID NO: 10022799 - DNA, 22 bp, Homo sapiens
ttaaatgaacgagatatgcaac

SEQ ID NO: 10022800 - DNA, 22 bp, Homo sapiens
ttaaattaggactctagttctg

SEQ ID NO: 10022801 - DNA, 22 bp, Homo sapiens
ttaacaaaaatatcaggcatca

SEQ ID NO: 10022802 - DNA, 22 bp, Homo sapiens
ttaaattaggactctagttctg

SEQ ID NO: 10022803 - DNA, 22 bp, Homo sapiens
ttaaattaggactctagttctg

SEQ ID NO: 10022804 - DNA, 22 bp, Homo sapiens
ttaaattaggactctagttctg

SEQ ID NO: 10022805 - DNA, 22 bp, Homo sapiens
ttaaattaggactctagttctg

SEQ ID NO: 10022806 - DNA, 22 bp, Homo sapiens
ttaaatgtctgtagatgtgctg

SEQ ID NO: 10022807 - DNA, 22 bp, Homo sapiens
ttaaatgtgatttcatttatgt

SEQ ID NO: 10022808 - DNA, 22 bp, Homo sapiens
ttaaatgtgatttcatttatgt

SEQ ID NO: 10022809 - DNA, 22 bp, Homo sapiens
ttaaatgtttaatctaacttga

SEQ ID NO: 10022810 - DNA, 22 bp, Homo sapiens
ttaaatgtttaatctaacttga

SEQ ID NO: 10022811 - DNA, 22 bp, Homo sapiens
ttaacacagggggagacaaagt

SEQ ID NO: 10022812 - DNA, 22 bp, Homo sapiens
ttaacacagggggagacaaagt

SEQ ID NO: 10022813 - DNA, 22 bp, Homo sapiens
ttaacacatatttatcaattgc

SEQ ID NO: 10022814 - DNA, 22 bp, Homo sapiens
ttaacacatatttatcaattgc

SEQ ID NO: 10022815 - DNA, 22 bp, Homo sapiens
ttaacaaagtaacgggaaaaga

SEQ ID NO: 10022816 - DNA, 22 bp, Homo sapiens
ttaacaaaaatatcaggcatca

SEQ ID NO: 10022817 - DNA, 22 bp, Homo sapiens
ttaacaaagctctgttcctttt

SEQ ID NO: 10022818 - DNA, 22 bp, Homo sapiens
ttaacaaatatttcccatgccc

SEQ ID NO: 10022819 - DNA, 19 bp, Homo sapiens
ttaacagtcaccaaggaga

SEQ ID NO: 10022820 - DNA, 22 bp, Homo sapiens
ttaacagctttgggtctgatat

SEQ ID NO: 10022821 - DNA, 22 bp, Homo sapiens
ttaacatcctgtttaaatttgg

SEQ ID NO: 10022822 - DNA, 22 bp, Homo sapiens
ttaacatacatcatgaacaatg

SEQ ID NO: 10022823 - DNA, 22 bp, Homo sapiens
ttaacagacatatatatttgta

SEQ ID NO: 10022824 - DNA, 22 bp, Homo sapiens
ttaacactatctgtcataatta

SEQ ID NO: 10022825 - DNA, 22 bp, Homo sapiens
ttaacacatccctgctctaccc

SEQ ID NO: 10022826 - DNA, 22 bp, Homo sapiens
ttaacattgtccttagcagatt

SEQ ID NO: 10022827 - DNA, 22 bp, Homo sapiens
ttaacattgtccttagcagatt

SEQ ID NO: 10022828 - DNA, 22 bp, Homo sapiens
ttaacattgtccttagcagatt

SEQ ID NO: 10022829 - DNA, 22 bp, Homo sapiens
ttaacatttagtgtacccctgt

SEQ ID NO: 10022830 - DNA, 22 bp, Homo sapiens
ttaacatgtcttgacttcatct

SEQ ID NO: 10022831 - DNA, 22 bp, Homo sapiens
ttaacattaaaagcagcatttt

SEQ ID NO: 10022832 - DNA, 22 bp, Homo sapiens
ttaacatttgtgaagcatttag

SEQ ID NO: 10022833 - DNA, 22 bp, Homo sapiens
ttaacatttgtgaagcatttag

SEQ ID NO: 10022834 - DNA, 22 bp, Homo sapiens
ttaacatttcttttccactcat

SEQ ID NO: 10022835 - DNA, 22 bp, Homo sapiens
ttaacatttcttttccactcat

SEQ ID NO: 10022836 - DNA, 22 bp, Homo sapiens
ttaactctccctccttacatcc

SEQ ID NO: 10022837 - DNA, 22 bp, Homo sapiens
ttaactctccctccttacatcc

SEQ ID NO: 10022838 - DNA, 22 bp, Homo sapiens
ttaactggggaagcatttcatg

SEQ ID NO: 10022839 - DNA, 22 bp, Homo sapiens
ttaactgtgacagtttctcaga

SEQ ID NO: 10022840 - DNA, 22 bp, Homo sapiens
ttaaggaaagccaaaatgaatt

SEQ ID NO: 10022841 - DNA, 22 bp, Homo sapiens
ttaaggaaggagtcttaaatgg

SEQ ID NO: 10022842 - DNA, 22 bp, Homo sapiens
ttaacttcaacactctcttgta

SEQ ID NO: 10022843 - DNA, 22 bp, Homo sapiens
ttaacttttatttctgctcgcc

SEQ ID NO: 10022844 - DNA, 22 bp, Homo sapiens
ttaagaagccacacacctcttt

SEQ ID NO: 10022845 - DNA, 20 bp, Homo sapiens
ttaagaaaagcacatcctgc

SEQ ID NO: 10022846 - DNA, 20 bp, Homo sapiens
ttaagaaaagcacatcctgc

SEQ ID NO: 10022847 - DNA, 22 bp, Homo sapiens
ttaagaagtgattttcctcatt

SEQ ID NO: 10022848 - DNA, 22 bp, Homo sapiens
ttaagaaggtactcaaagatct

SEQ ID NO: 10022849 - DNA, 22 bp, Homo sapiens
ttaagacacatttctcagacgg

SEQ ID NO: 10022850 - DNA, 22 bp, Homo sapiens
ttaataaacaggtgcagctgaa

SEQ ID NO: 10022851 - DNA, 22 bp, Homo sapiens
ttaataaacaggtgcagctgaa

SEQ ID NO: 10022852 - DNA, 22 bp, Homo sapiens
ttaattaattagttaagcatgt

SEQ ID NO: 10022853 - DNA, 22 bp, Homo sapiens
ttaataaacaggtgcagctgaa

SEQ ID NO: 10022854 - DNA, 22 bp, Homo sapiens
ttaataaacaggtgcagctgaa

SEQ ID NO: 10022855 - DNA, 22 bp, Homo sapiens
ttaattagagctgatgttcata

SEQ ID NO: 10022856 - DNA, 22 bp, Homo sapiens
ttaattaattagttaagcatgt

SEQ ID NO: 10022857 - DNA, 22 bp, Homo sapiens
ttaattagtagaggcatttagt

SEQ ID NO: 10022858 - DNA, 22 bp, Homo sapiens
ttaattgatataaagaacttca

SEQ ID NO: 10022859 - DNA, 22 bp, Homo sapiens
ttaattctgcctttcatgtaac

SEQ ID NO: 10022860 - DNA, 22 bp, Homo sapiens
ttaattctgcctttcatgtaac

SEQ ID NO: 10022861 - DNA, 22 bp, Homo sapiens
ttaatttatgtccaaaccagat

SEQ ID NO: 10022862 - DNA, 22 bp, Homo sapiens
ttaatttatacataatcacagg

SEQ ID NO: 10022863 - DNA, 22 bp, Homo sapiens
ttaatttatacataatcacagg

SEQ ID NO: 10022864 - DNA, 22 bp, Homo sapiens
ttaatttatacataatcacagg

SEQ ID NO: 10022865 - DNA, 22 bp, Homo sapiens
ttaatttaagaaacggcaggcc

SEQ ID NO: 10022866 - DNA, 22 bp, Homo sapiens
ttaaggtagtcagcctctgtgt

SEQ ID NO: 10022867 - DNA, 22 bp, Homo sapiens
ttaaggtagtcagcctctgtgt

SEQ ID NO: 10022868 - DNA, 22 bp, Homo sapiens
ttaaggtagctcactaaatatg

SEQ ID NO: 10022869 - DNA, 22 bp, Homo sapiens
ttaaggcattctcctactaata

SEQ ID NO: 10022870 - DNA, 22 bp, Homo sapiens
ttaaggaattacgaaaatattt

SEQ ID NO: 10022871 - DNA, 22 bp, Homo sapiens
ttaaggaatttatagttgtact

SEQ ID NO: 10022872 - DNA, 22 bp, Homo sapiens
ttaagtgtcataatttccaaga

SEQ ID NO: 10022873 - DNA, 22 bp, Homo sapiens
ttaagtccttggtaattttctt

SEQ ID NO: 10022874 - DNA, 22 bp, Homo sapiens
ttaagtacagggttagtgacgg

SEQ ID NO: 10022875 - DNA, 22 bp, Homo sapiens
ttaagtagattcagtgttaagg

SEQ ID NO: 10022876 - DNA, 22 bp, Homo sapiens
ttaagtatatccatttgactgg

SEQ ID NO: 10022877 - DNA, 22 bp, Homo sapiens
cctgtgcagcccttgccagttt

SEQ ID NO: 10022878 - DNA, 22 bp, Homo sapiens
atggcatgtggctgggttttca

SEQ ID NO: 10022879 - DNA, 22 bp, Homo sapiens
atgtgaccatcagtgtgaagga

SEQ ID NO: 10022880 - DNA, 22 bp, Homo sapiens
atgacatgattctttctttcat

SEQ ID NO: 10022881 - DNA, 22 bp, Homo sapiens
atgacatgaggcatctttggag

SEQ ID NO: 10022882 - DNA, 22 bp, Homo sapiens
atgacatgaataaaaatcgtgt

SEQ ID NO: 10022883 - DNA, 22 bp, Homo sapiens
atgacatgacctggtagagaca

SEQ ID NO: 10022884 - DNA, 22 bp, Homo sapiens
atgacagttctttagagatgta

SEQ ID NO: 10022885 - DNA, 22 bp, Homo sapiens
atgacagtactggtgacaatac

SEQ ID NO: 10022886 - DNA, 22 bp, Homo sapiens
atgacagtgggtcttgcaaaga

SEQ ID NO: 10022887 - DNA, 22 bp, Homo sapiens
atgctatgtaactggcagatag

SEQ ID NO: 10022888 - DNA, 19 bp, Homo sapiens
atttttcttcctctgtgca

SEQ ID NO: 10022889 - DNA, 22 bp, Homo sapiens
atttttctctttccactgagat

SEQ ID NO: 10022890 - DNA, 22 bp, Homo sapiens
atttttctctcacacttaccag

SEQ ID NO: 10022891 - DNA, 22 bp, Homo sapiens
atttttctctccactccattaa

SEQ ID NO: 10022892 - DNA, 22 bp, Homo sapiens
caaacaatttgcatttccttag

SEQ ID NO: 10022893 - DNA, 22 bp, Homo sapiens
gctgacattccctgtgaaactt

SEQ ID NO: 10022894 - DNA, 22 bp, Homo sapiens
atttggaatagctgtagaaata

SEQ ID NO: 10022895 - DNA, 22 bp, Homo sapiens
atttggaatgctagtgaatgta

SEQ ID NO: 10022896 - DNA, 22 bp, Homo sapiens
atttggaatggtctggcatttg

SEQ ID NO: 10022897 - DNA, 22 bp, Homo sapiens
atttggaagtttggagtgaagg

SEQ ID NO: 10022898 - DNA, 22 bp, Homo sapiens
atttggaaggtttacaaagaga

SEQ ID NO: 10022899 - DNA, 22 bp, Homo sapiens
atttggaaggcgtttctctgta

SEQ ID NO: 10022900 - DNA, 22 bp, Homo sapiens
atttggaaatgcatctcttgag

SEQ ID NO: 10022901 - DNA, 22 bp, Homo sapiens
atttggaaacaattatattctt

SEQ ID NO: 10022902 - DNA, 22 bp, Homo sapiens
atttggaaaatctggttataga

SEQ ID NO: 10022903 - DNA, 22 bp, Homo sapiens
atttggaacaaatattagtaaa

SEQ ID NO: 10022904 - DNA, 22 bp, Homo sapiens
atgacaagggttgacacatgtc

SEQ ID NO: 10022905 - DNA, 22 bp, Homo sapiens
agatgacaaatcaggggacggg

SEQ ID NO: 10022906 - DNA, 22 bp, Homo sapiens
agatgacaagagcttgctgcag

SEQ ID NO: 10022907 - DNA, 22 bp, Homo sapiens
agatgacaatgaaggaaaatgt

SEQ ID NO: 10022908 - DNA, 22 bp, Homo sapiens
agatgacaatgaggttgttatt

SEQ ID NO: 10022909 - DNA, 22 bp, Homo sapiens
agatgacacacacgcacccgga

SEQ ID NO: 10022910 - DNA, 22 bp, Homo sapiens
agatgacagccaaggagatgaa

SEQ ID NO: 10022911 - DNA, 22 bp, Homo sapiens
agatgacacaccatttttactt

SEQ ID NO: 10022912 - DNA, 22 bp, Homo sapiens
agatgacagctacgggatgaaa

SEQ ID NO: 10022913 - DNA, 22 bp, Homo sapiens
agatgacatggttcaagtttcc

SEQ ID NO: 10022914 - DNA, 22 bp, Homo sapiens
agatgacatgggagcaagcact

SEQ ID NO: 10022915 - DNA, 22 bp, Homo sapiens
agatgacagtagctcccccatt

SEQ ID NO: 10022916 - DNA, 22 bp, Homo sapiens
agatgacaggtttttttggctt

SEQ ID NO: 10022917 - DNA, 22 bp, Homo sapiens
cagagtgatttgatgagttgca

SEQ ID NO: 10022918 - DNA, 22 bp, Homo sapiens
aggcagatatttcagttcacat

SEQ ID NO: 10022919 - DNA, 22 bp, Homo sapiens
aggcagatattggggtgatgtg

SEQ ID NO: 10022920 - DNA, 22 bp, Homo sapiens
aggcagatcacaggagggcctg

SEQ ID NO: 10022921 - DNA, 22 bp, Homo sapiens
aggcagatggtaactgtgatat

SEQ ID NO: 10022922 - DNA, 22 bp, Homo sapiens
aggcagatgtgattaatttcct

SEQ ID NO: 10022923 - DNA, 22 bp, Homo sapiens
aggcagatgtgtcttctaaaat

SEQ ID NO: 10022924 - DNA, 22 bp, Homo sapiens
aggcagatgggcgtctataaat

SEQ ID NO: 10022925 - DNA, 22 bp, Homo sapiens
aggcagattaggattaggaaat

SEQ ID NO: 10022926 - DNA, 22 bp, Homo sapiens
aggcagattacttgaggccagg

SEQ ID NO: 10022927 - DNA, 22 bp, Homo sapiens
aggcagatgtttggcattgctt

SEQ ID NO: 10022928 - DNA, 22 bp, Homo sapiens
aggcagatgggagctggaagtt

SEQ ID NO: 10022929 - DNA, 22 bp, Homo sapiens
aggcagatgaacctgggttgag

SEQ ID NO: 10022930 - DNA, 22 bp, Homo sapiens
aggcagatcagtacagggttaa

SEQ ID NO: 10022931 - DNA, 22 bp, Homo sapiens
aggcagatggatgggcatttgt

SEQ ID NO: 10022932 - DNA, 22 bp, Homo sapiens
aggcagatcacttgaggccagg

SEQ ID NO: 10022933 - DNA, 22 bp, Homo sapiens
aggcagatttaggagaaaagaa

SEQ ID NO: 10022934 - DNA, 22 bp, Homo sapiens
aggcagattttctttactcagt

SEQ ID NO: 10022935 - DNA, 22 bp, Homo sapiens
acagtgagcggtagtgattgct

SEQ ID NO: 10022936 - DNA, 22 bp, Homo sapiens
acagtggaaagaacatggattt

SEQ ID NO: 10022937 - DNA, 22 bp, Homo sapiens
acatgtgaggtgtgagtgatac

SEQ ID NO: 10022938 - DNA, 22 bp, Homo sapiens
aaaagagtgactgataagtata

SEQ ID NO: 10022939 - DNA, 20 bp, Homo sapiens
aaaagagtgcttcaactgct

SEQ ID NO: 10022940 - DNA, 22 bp, Homo sapiens
aaaagagtcttaggcagtcata

SEQ ID NO: 10022941 - DNA, 22 bp, Homo sapiens
acatgacagggaatgaggtgaa

SEQ ID NO: 10022942 - DNA, 22 bp, Homo sapiens
acatcctcccgatctactggct

SEQ ID NO: 10022943 - DNA, 22 bp, Homo sapiens
agcgtgaattagttggtacaca

SEQ ID NO: 10022944 - DNA, 22 bp, Homo sapiens
aatttggagctttgtttctaga

SEQ ID NO: 10022945 - DNA, 22 bp, Homo sapiens
tcactttggattatgtaatttc

SEQ ID NO: 10022946 - DNA, 22 bp, Homo sapiens
tcactttgacggccaacttcta

SEQ ID NO: 10022947 - DNA, 22 bp, Homo sapiens
tcactttgacagagaaatgaat

SEQ ID NO: 10022948 - DNA, 22 bp, Homo sapiens
tcactttgaattccttgatttt

SEQ ID NO: 10022949 - DNA, 22 bp, Homo sapiens
tcactttggaagatagcacatc

SEQ ID NO: 10022950 - DNA, 22 bp, Homo sapiens
tcactttgccctgtaccttggg

SEQ ID NO: 10022951 - DNA, 23 bp, Homo sapiens
tcactttgatgtaattgaaaagc

SEQ ID NO: 10022952 - DNA, 22 bp, Homo sapiens
tcactttgatgacattgtagct

SEQ ID NO: 10022953 - DNA, 22 bp, Homo sapiens
taaacaattcctctctaggcat

SEQ ID NO: 10022954 - DNA, 22 bp, Homo sapiens
tatgacattgctttttagaact

SEQ ID NO: 10022955 - DNA, 22 bp, Homo sapiens
ggacagtgtgggccatctcact

SEQ ID NO: 10022956 - DNA, 22 bp, Homo sapiens
gcctttggatggtttttctatt

SEQ ID NO: 10022957 - DNA, 22 bp, Homo sapiens
gcacatgacagtaagtagagca

SEQ ID NO: 10022958 - DNA, 22 bp, Homo sapiens
ggcagtgaacagaaatgcagaa

SEQ ID NO: 10022959 - DNA, 22 bp, Homo sapiens
gaagagtggttatccctgctgt

SEQ ID NO: 10022960 - DNA, 22 bp, Homo sapiens
cttgatctacatagtgaaaccc

SEQ ID NO: 10022961 - DNA, 22 bp, Homo sapiens
ctctggaatgggtgtttctaac

SEQ ID NO: 10022962 - DNA, 22 bp, Homo sapiens
ctgacatggggatccaccttag

SEQ ID NO: 10022963 - DNA, 22 bp, Homo sapiens
ctgacatgtataagctttaagt

SEQ ID NO: 10022964 - DNA, 21 bp, Homo sapiens
ctgacatgtggaaaaggagag

SEQ ID NO: 10022965 - DNA, 19 bp, Homo sapiens
ctgacatgtgggggatgtc

SEQ ID NO: 10022966 - DNA, 22 bp, Homo sapiens
ctgacatgttgacaagaaataa

SEQ ID NO: 10022967 - DNA, 23 bp, Homo sapiens
tcagatgaggaatgcatactaat

SEQ ID NO: 10022968 - DNA, 22 bp, Homo sapiens
catggcaggaaaatgaacaggc

SEQ ID NO: 10022969 - DNA, 22 bp, Homo sapiens
catgcatctggtcttggaaata

SEQ ID NO: 10022970 - DNA, 22 bp, Homo sapiens
tacaaaaaattgatactgacga

SEQ ID NO: 10022971 - DNA, 22 bp, Homo sapiens
tgacagtgtttgcacttcaggt

SEQ ID NO: 10022972 - DNA, 21 bp, Homo sapiens
tgacagtgtggcatggaaggt

SEQ ID NO: 10022973 - DNA, 22 bp, Homo sapiens
tgacagtgttgggggtaaattt

SEQ ID NO: 10022974 - DNA, 22 bp, Homo sapiens
tgacagtgtgcccggaggttag

SEQ ID NO: 10022975 - DNA, 23 bp, Homo sapiens
tgacagtgtatttgactatatgg

SEQ ID NO: 10022976 - DNA, 22 bp, Homo sapiens
tgacagtgcgggtacatcatag

SEQ ID NO: 10022977 - DNA, 22 bp, Homo sapiens
tgacagtggtgacaggatgggg

SEQ ID NO: 10022978 - DNA, 22 bp, Homo sapiens
tgaggtagggagtttgttgttg

SEQ ID NO: 10022979 - DNA, 22 bp, Homo sapiens
tgcctgttgcccacctgataaa

SEQ ID NO: 10022980 - DNA, 22 bp, Homo sapiens
cctagcagggaagcagtgagga

SEQ ID NO: 10022981 - DNA, 22 bp, Homo sapiens
ttctactttggacataaaggac

SEQ ID NO: 10022982 - DNA, 22 bp, Homo sapiens
ttttggcagccacatgcacttg

SEQ ID NO: 10022983 - DNA, 22 bp, Homo sapiens
tttgcaaatatgtgtttctatt

SEQ ID NO: 10022984 - DNA, 22 bp, Homo sapiens
caggtgaccctcagtgtggact

SEQ ID NO: 10022985 - DNA, 21 bp, Homo sapiens
agttttctgagttataaaata

SEQ ID NO: 10022986 - DNA, 22 bp, Homo sapiens
ggcagatgacagaccagtatgt

SEQ ID NO: 10022987 - DNA, 18 bp, Homo sapiens
ggcagatgacaggagaga

SEQ ID NO: 10022988 - DNA, 20 bp, Homo sapiens
ggcagatgcagagctatgca

SEQ ID NO: 10022989 - DNA, 22 bp, Homo sapiens
ggcagatgctggcttctgctgt

SEQ ID NO: 10022990 - DNA, 21 bp, Homo sapiens
cagatgacccacatggtgtct

SEQ ID NO: 10022991 - DNA, 22 bp, Homo sapiens
cagatgaataaatgatgaggta

SEQ ID NO: 10022992 - DNA, 22 bp, Homo sapiens
gcagagaccccgcagtgaggcc

SEQ ID NO: 10022993 - DNA, 22 bp, Homo sapiens
atttggaatgtgtttgatcacc

SEQ ID NO: 10022994 - DNA, 22 bp, Homo sapiens
atggcagagaaagcgagccaca

SEQ ID NO: 10022995 - DNA, 22 bp, Homo sapiens
atggcagacgaggcagcagggg

SEQ ID NO: 10022996 - DNA, 22 bp, Homo sapiens
atggcagagaacaaagcaacaa

SEQ ID NO: 10022997 - DNA, 22 bp, Homo sapiens
atggcagacctgggctggagaa

SEQ ID NO: 10022998 - DNA, 22 bp, Homo sapiens
atggcagaaagaatagaggcta

SEQ ID NO: 10022999 - DNA, 22 bp, Homo sapiens
atggcagaaaggcatgtgggcc

SEQ ID NO: 10023000 - DNA, 22 bp, Homo sapiens
atggcagaatccatagtaggtg

SEQ ID NO: 10023001 - DNA, 22 bp, Homo sapiens
atggcagaagtcaagatgagtt

SEQ ID NO: 10023002 - DNA, 22 bp, Homo sapiens
atggcagaatcaagccgacagc

SEQ ID NO: 10023003 - DNA, 22 bp, Homo sapiens
atggcagaatatctgcatcgca

SEQ ID NO: 10023004 - DNA, 22 bp, Homo sapiens
atggcagaattaggatttcaag

SEQ ID NO: 10023005 - DNA, 22 bp, Homo sapiens
atggcagacacaggcaggcaga

SEQ ID NO: 10023006 - DNA, 22 bp, Homo sapiens
atggcagacctcctggccacaa

SEQ ID NO: 10023007 - DNA, 22 bp, Homo sapiens
atgacatggtgcagacagtgtc

SEQ ID NO: 10023008 - DNA, 22 bp, Homo sapiens
atgacatgcgaatgtactggag

SEQ ID NO: 10023009 - DNA, 22 bp, Homo sapiens
atgacatgtactgctctctcat

SEQ ID NO: 10023010 - DNA, 22 bp, Homo sapiens
atgacatgtcctagttggtcta

SEQ ID NO: 10023011 - DNA, 22 bp, Homo sapiens
atgacatgttccctttttctca

SEQ ID NO: 10023012 - DNA, 22 bp, Homo sapiens
atgacatgttgggaaccctgct

SEQ ID NO: 10023013 - DNA, 22 bp, Homo sapiens
atgacatgattgccatttgata

SEQ ID NO: 10023014 - DNA, 22 bp, Homo sapiens
aacatgcatataggtaaatgga

SEQ ID NO: 10023015 - DNA, 22 bp, Homo sapiens
aacatgcatgaagaagttatat

SEQ ID NO: 10023016 - DNA, 18 bp, Homo sapiens
aacatgcattagaactgc

SEQ ID NO: 10023017 - DNA, 20 bp, Homo sapiens
aaaaacagtaatgctgaaga

SEQ ID NO: 10023018 - DNA, 17 bp, Homo sapiens
atttggaatttctcttc

SEQ ID NO: 10023019 - DNA, 19 bp, Homo sapiens
acatttggcattttctctt

SEQ ID NO: 10023020 - DNA, 22 bp, Homo sapiens
ggctcactgcaacttccgcctc

SEQ ID NO: 10023021 - DNA, 21 bp, Homo sapiens
ggcagtgatgtgaagtgcatc

SEQ ID NO: 10023022 - DNA, 22 bp, Homo sapiens
ggcagtgagaggtctcctggtc

SEQ ID NO: 10023023 - DNA, 22 bp, Homo sapiens
ggcagatgttgcagtgagcaga

SEQ ID NO: 10023024 - DNA, 22 bp, Homo sapiens
ggcagatgttatatgatctgag

SEQ ID NO: 10023025 - DNA, 22 bp, Homo sapiens
ggcagatggggtgacaagagag

SEQ ID NO: 10023026 - DNA, 22 bp, Homo sapiens
ggcagatggaatgagctgtcta

SEQ ID NO: 10023027 - DNA, 22 bp, Homo sapiens
ggcagatggagaagcagcaggt

SEQ ID NO: 10023028 - DNA, 22 bp, Homo sapiens
ggcacgatttttgagttgtgtc

SEQ ID NO: 10023029 - DNA, 22 bp, Homo sapiens
ctgtggcaagtctgcctgtcac

SEQ ID NO: 10023030 - DNA, 22 bp, Homo sapiens
ctgtggcactcaagaagcctcc

SEQ ID NO: 10023031 - DNA, 22 bp, Homo sapiens
ctgtggcaaatgatacctccca

SEQ ID NO: 10023032 - DNA, 19 bp, Homo sapiens
ctttggagtcttttactct

SEQ ID NO: 10023033 - DNA, 22 bp, Homo sapiens
ctttttcttctaggtgtgcctg

SEQ ID NO: 10023034 - DNA, 22 bp, Homo sapiens
ctttttctgatgttccatgatt

SEQ ID NO: 10023035 - DNA, 16 bp, Homo sapiens
ctttttctcccctctt

SEQ ID NO: 10023036 - DNA, 20 bp, Homo sapiens
ctttttctccagctctgagc

SEQ ID NO: 10023037 - DNA, 22 bp, Homo sapiens
ctttttctaatcataattgtct

SEQ ID NO: 10023038 - DNA, 22 bp, Homo sapiens
cttggaaaggttttacaaagcg

SEQ ID NO: 10023039 - DNA, 22 bp, Homo sapiens
cttggaaagaatatatgatgct

SEQ ID NO: 10023040 - DNA, 22 bp, Homo sapiens
ttctggaaggatgtttctatct

SEQ ID NO: 10023041 - DNA, 22 bp, Homo sapiens
ctgagcagtgctttgcagtggg

SEQ ID NO: 10023042 - DNA, 22 bp, Homo sapiens
tttgacattttctcactgtgtt

SEQ ID NO: 10023043 - DNA, 22 bp, Homo sapiens
tggaagacaggctgtattttaa

SEQ ID NO: 10023044 - DNA, 22 bp, Homo sapiens
tgaccatgctgtggatagcagt

SEQ ID NO: 10023045 - DNA, 22 bp, Homo sapiens
tgatgacatgtgggctgtggct

SEQ ID NO: 10023046 - DNA, 22 bp, Homo sapiens
tgatgacagtgttacagctcca

SEQ ID NO: 10023047 - DNA, 22 bp, Homo sapiens
tgatgacagcatggaccccagg

SEQ ID NO: 10023048 - DNA, 22 bp, Homo sapiens
tgatgacaggcagggttaagtg

SEQ ID NO: 10023049 - DNA, 22 bp, Homo sapiens
tgatgacaatgttgctgcaata

SEQ ID NO: 10023050 - DNA, 16 bp, Homo sapiens
tgatgacagatatggc

SEQ ID NO: 10023051 - DNA, 22 bp, Homo sapiens
tgatgacagcaaaaaatgctag

SEQ ID NO: 10023052 - DNA, 22 bp, Homo sapiens
tgatgacaaactttcctgatgc

SEQ ID NO: 10023053 - DNA, 22 bp, Homo sapiens
cattgcaacttcaaactcctgg

SEQ ID NO: 10023054 - DNA, 19 bp, Homo sapiens
ccactttgcttctctgggt

SEQ ID NO: 10023055 - DNA, 22 bp, Homo sapiens
ccactttggcaccttctgccta

SEQ ID NO: 10023056 - DNA, 22 bp, Homo sapiens
ccactttgtaatgtgttatgtt

SEQ ID NO: 10023057 - DNA, 22 bp, Homo sapiens
ccactttgaaccactgaggtgg

SEQ ID NO: 10023058 - DNA, 18 bp, Homo sapiens
ccactttgcagcctggcc

SEQ ID NO: 10023059 - DNA, 19 bp, Homo sapiens
ccactttgcagatagtgag

SEQ ID NO: 10023060 - DNA, 22 bp, Homo sapiens
ccactttgagaagctgatgaaa

SEQ ID NO: 10023061 - DNA, 22 bp, Homo sapiens
ccactttgcaagatattcagag

SEQ ID NO: 10023062 - DNA, 22 bp, Homo sapiens
tcagatgagtgctttcagctgc

SEQ ID NO: 10023063 - DNA, 22 bp, Homo sapiens
tttggaaagtgtacaaatttga

SEQ ID NO: 10023064 - DNA, 22 bp, Homo sapiens
ttctggaagtggaatttttgta

SEQ ID NO: 10023065 - DNA, 22 bp, Homo sapiens
ttggaaaggtgcttttgtctgt

SEQ ID NO: 10023066 - DNA, 22 bp, Homo sapiens
ttggaaagtgacgttcaactgt

SEQ ID NO: 10023067 - DNA, 22 bp, Homo sapiens
ttggaaacaagatttctactta

SEQ ID NO: 10023068 - DNA, 22 bp, Homo sapiens
ttgcagattaaaacactgagct

SEQ ID NO: 10023069 - DNA, 22 bp, Homo sapiens
ttggagaactggcatttttaat

SEQ ID NO: 10023070 - DNA, 22 bp, Homo sapiens
gcagatgagtgagatagacttc

SEQ ID NO: 10023071 - DNA, 22 bp, Homo sapiens
gcagatgaggaagctaatgctg

SEQ ID NO: 10023072 - DNA, 18 bp, Homo sapiens
gcagatgagtagtgtacc

SEQ ID NO: 10023073 - DNA, 20 bp, Homo sapiens
gcagatgagactcacagagg

SEQ ID NO: 10023074 - DNA, 22 bp, Homo sapiens
gcagatgaaaatgctgccgtgc

SEQ ID NO: 10023075 - DNA, 22 bp, Homo sapiens
gcagatgaagtttacaggaaac

SEQ ID NO: 10023076 - DNA, 19 bp, Homo sapiens
gcagatgatgaggctggtc

SEQ ID NO: 10023077 - DNA, 22 bp, Homo sapiens
gcagatgatgtagacagacagt

SEQ ID NO: 10023078 - DNA, 22 bp, Homo sapiens
aggatgacatgaagtggtgttc

SEQ ID NO: 10023079 - DNA, 22 bp, Homo sapiens
aggaaacagttggtaatgcata

SEQ ID NO: 10023080 - DNA, 22 bp, Homo sapiens
agtgtgacagtcctgctgcttt

SEQ ID NO: 10023081 - DNA, 22 bp, Homo sapiens
agtgtgaccttatttggaaaca

SEQ ID NO: 10023082 - DNA, 22 bp, Homo sapiens
agtagaggagataggattgtta

SEQ ID NO: 10023083 - DNA, 22 bp, Homo sapiens
atctggttttggctgtgtccct

SEQ ID NO: 10023084 - DNA, 22 bp, Homo sapiens
actttggagggtgttgtagatg

SEQ ID NO: 10023085 - DNA, 22 bp, Homo sapiens
aggtgacattcagagaacattt

SEQ ID NO: 10023086 - DNA, 19 bp, Homo sapiens
aggtgacatgtgacagcct

SEQ ID NO: 10023087 - DNA, 19 bp, Homo sapiens
aggtgacaggtgcacttgc

SEQ ID NO: 10023088 - DNA, 22 bp, Homo sapiens
agtgaaggaaacaattggttga

SEQ ID NO: 10023089 - DNA, 22 bp, Homo sapiens
aggcatgtcagttgttttagtg

SEQ ID NO: 10023090 - DNA, 22 bp, Homo sapiens
aggcatgtatatgtgcacatgt

SEQ ID NO: 10023091 - DNA, 22 bp, Homo sapiens
cagatgtcgaaggatgtgaccg

SEQ ID NO: 10023092 - DNA, 22 bp, Homo sapiens
attttatctgcttactttcagg

SEQ ID NO: 10023093 - DNA, 22 bp, Homo sapiens
caaagagttttttcatataatg

SEQ ID NO: 10023094 - DNA, 22 bp, Homo sapiens
atgcctttggcattatttcttg

SEQ ID NO: 10023095 - DNA, 22 bp, Homo sapiens
acagatgagagacaatgtgcta

SEQ ID NO: 10023096 - DNA, 20 bp, Homo sapiens
acagatgaggaaaatgaagt

SEQ ID NO: 10023097 - DNA, 22 bp, Homo sapiens
acagatgagattcattgaccac

SEQ ID NO: 10023098 - DNA, 22 bp, Homo sapiens
acagatgaggaaacagggtcag

SEQ ID NO: 10023099 - DNA, 22 bp, Homo sapiens
acagatgaggaagagtcagcca

SEQ ID NO: 10023100 - DNA, 22 bp, Homo sapiens
acagtgcaggtctcaacaatta

SEQ ID NO: 10023101 - DNA, 22 bp, Homo sapiens
agcactttgagcagatgaagga

SEQ ID NO: 10023102 - DNA, 22 bp, Homo sapiens
acagatgaaaaagcttgtggat

SEQ ID NO: 10023103 - DNA, 22 bp, Homo sapiens
acagatgagactccaggacctt

SEQ ID NO: 10023104 - DNA, 22 bp, Homo sapiens
acagatgagaaggctgaccagt

SEQ ID NO: 10023105 - DNA, 22 bp, Homo sapiens
acagatgagaagctgcattcaa

SEQ ID NO: 10023106 - DNA, 22 bp, Homo sapiens
acagatgacttgtctgctgtaa

SEQ ID NO: 10023107 - DNA, 22 bp, Homo sapiens
acagatgaattttaattgtgtt

SEQ ID NO: 10023108 - DNA, 22 bp, Homo sapiens
acagatgaatttatggatggaa

SEQ ID NO: 10023109 - DNA, 22 bp, Homo sapiens
acagatgaatctgtgattgctg

SEQ ID NO: 10023110 - DNA, 23 bp, Homo sapiens
acagatgaaagtgtggctcagag

SEQ ID NO: 10023111 - DNA, 22 bp, Homo sapiens
acagatgaaacccagctagttg

SEQ ID NO: 10023112 - DNA, 19 bp, Homo sapiens
gctggcagaattttgaacc

SEQ ID NO: 10023113 - DNA, 22 bp, Homo sapiens
gtgaggtgggctgggctctatg

SEQ ID NO: 10023114 - DNA, 22 bp, Homo sapiens
gtgaggtgcctaataccgtgac

SEQ ID NO: 10023115 - DNA, 17 bp, Homo sapiens
ggcaggtgacagacacc

SEQ ID NO: 10023116 - DNA, 22 bp, Homo sapiens
ggatgacagctcttccatgtgg

SEQ ID NO: 10023117 - DNA, 22 bp, Homo sapiens
ggatgacagcaagggggtgaag

SEQ ID NO: 10023118 - DNA, 22 bp, Homo sapiens
ggatgacacagttagaaagaga

SEQ ID NO: 10023119 - DNA, 22 bp, Homo sapiens
ggatgacagatgcaggctttga

SEQ ID NO: 10023120 - DNA, 22 bp, Homo sapiens
ggatgacagataacagtattaa

SEQ ID NO: 10023121 - DNA, 22 bp, Homo sapiens
ggatgacaaggaaagcaaacca

SEQ ID NO: 10023122 - DNA, 22 bp, Homo sapiens
gggaggtgattaggaccatgta

SEQ ID NO: 10023123 - DNA, 23 bp, Homo sapiens
taagagtgaggtcataaattttc

SEQ ID NO: 10023124 - DNA, 22 bp, Homo sapiens
ttgcacttatcctagcaaaagg

SEQ ID NO: 10023125 - DNA, 22 bp, Homo sapiens
cgatgacagtgagttccttctt

SEQ ID NO: 10023126 - DNA, 18 bp, Homo sapiens
tttttctgataaaacaag

SEQ ID NO: 10023127 - DNA, 22 bp, Homo sapiens
gaaacaatcatcatgtgatttg

SEQ ID NO: 10023128 - DNA, 22 bp, Homo sapiens
gaaacaatacttgtcctcacta

SEQ ID NO: 10023129 - DNA, 22 bp, Homo sapiens
gaaacaatttttgttgtctaag

SEQ ID NO: 10023130 - DNA, 22 bp, Homo sapiens
tgcactttgcaggcatggaaac

SEQ ID NO: 10023131 - DNA, 22 bp, Homo sapiens
tgaaacaattagaatgtaatga

SEQ ID NO: 10023132 - DNA, 22 bp, Homo sapiens
tgaaacaatgtgaagttgctga

SEQ ID NO: 10023133 - DNA, 18 bp, Homo sapiens
tgaaacaagaatggtgca

SEQ ID NO: 10023134 - DNA, 22 bp, Homo sapiens
tgaaacaaatttggaaaatcta

SEQ ID NO: 10023135 - DNA, 22 bp, Homo sapiens
tgaaacaagatccacagacttg

SEQ ID NO: 10023136 - DNA, 22 bp, Homo sapiens
tgaaacaagggaccgtcctttc

SEQ ID NO: 10023137 - DNA, 21 bp, Homo sapiens
tgaaacaatcagacagagtct

SEQ ID NO: 10023138 - DNA, 22 bp, Homo sapiens
tgaaacaagtttaagggatcta

SEQ ID NO: 10023139 - DNA, 22 bp, Homo sapiens
tgaaacaagggccatgggaaac

SEQ ID NO: 10023140 - DNA, 19 bp, Homo sapiens
tgaaacaaacttaaaagga

SEQ ID NO: 10023141 - DNA, 23 bp, Homo sapiens
tggaaacattctgaatgtccatc

SEQ ID NO: 10023142 - DNA, 22 bp, Homo sapiens
tggagatgaacatggtgatgtt

SEQ ID NO: 10023143 - DNA, 22 bp, Homo sapiens
tggcagtggctcagagtgcaga

SEQ ID NO: 10023144 - DNA, 21 bp, Homo sapiens
ttttttcttgcgtgaggcctg

SEQ ID NO: 10023145 - DNA, 22 bp, Homo sapiens
tttgacatgcaaagcactttag

SEQ ID NO: 10023146 - DNA, 22 bp, Homo sapiens
ttggcagaaatgtggctgggag

SEQ ID NO: 10023147 - DNA, 22 bp, Homo sapiens
ttggcagaaaatgcttcctcag

SEQ ID NO: 10023148 - DNA, 22 bp, Homo sapiens
ttggcagaatgggcagcttgag

SEQ ID NO: 10023149 - DNA, 22 bp, Homo sapiens
ttggcagaattaaccactgaag

SEQ ID NO: 10023150 - DNA, 22 bp, Homo sapiens
ttggcagatggattcaacatta

SEQ ID NO: 10023151 - DNA, 22 bp, Homo sapiens
ttggcagatttgtcagtaagct

SEQ ID NO: 10023152 - DNA, 22 bp, Homo sapiens
ttggcagattctgaacaaagcc

SEQ ID NO: 10023153 - DNA, 22 bp, Homo sapiens
ttggcagattcatttaataaat

SEQ ID NO: 10023154 - DNA, 22 bp, Homo sapiens
ttggcagagccccagccttgga

SEQ ID NO: 10023155 - DNA, 22 bp, Homo sapiens
ttggcagagagtatgctgaaga

SEQ ID NO: 10023156 - DNA, 22 bp, Homo sapiens
ttggcagactgggtcctgggga

SEQ ID NO: 10023157 - DNA, 22 bp, Homo sapiens
ttggcagactgttttcaaaagt

SEQ ID NO: 10023158 - DNA, 22 bp, Homo sapiens
ttggcagactgacaatctgttt

SEQ ID NO: 10023159 - DNA, 22 bp, Homo sapiens
ttggcagatgagaccaggggtt

SEQ ID NO: 10023160 - DNA, 22 bp, Homo sapiens
ttggcagaggtctcgttgtggc

SEQ ID NO: 10023161 - DNA, 22 bp, Homo sapiens
ttggcagatgaacacaactgga

SEQ ID NO: 10023162 - DNA, 22 bp, Homo sapiens
ttggcagagggaccagcctaca

SEQ ID NO: 10023163 - DNA, 22 bp, Homo sapiens
ttggcagaggccgaggtgaaga

SEQ ID NO: 10023164 - DNA, 22 bp, Homo sapiens
ttggcagaggggccacctgccc

SEQ ID NO: 10023165 - DNA, 22 bp, Homo sapiens
ttggcagaggggtttctggtgg

SEQ ID NO: 10023166 - DNA, 22 bp, Homo sapiens
ttatggaaatgaaattttattg

SEQ ID NO: 10023167 - DNA, 22 bp, Homo sapiens
ttatggaataacctttctgaaa

SEQ ID NO: 10023168 - DNA, 22 bp, Homo sapiens
ttgacatgtagtatagttgcat

SEQ ID NO: 10023169 - DNA, 22 bp, Homo sapiens
ttgacagttgagggttgtctaa

SEQ ID NO: 10023170 - DNA, 22 bp, Homo sapiens
ttgagaaaggggtcaatatctc

SEQ ID NO: 10023171 - DNA, 22 bp, Homo sapiens
ccagtgagaatgaagataaggc

SEQ ID NO: 10023172 - DNA, 23 bp, Homo sapiens
ccagtgagcatggctgtgttcca

SEQ ID NO: 10023173 - DNA, 22 bp, Homo sapiens
aggcatgtgctgtttgtctcca

SEQ ID NO: 10023174 - DNA, 22 bp, Homo sapiens
aggcatgtgaccctggactcag

SEQ ID NO: 10023175 - DNA, 22 bp, Homo sapiens
aggcatgtcatttcttttctga

SEQ ID NO: 10023176 - DNA, 20 bp, Homo sapiens
aggcatgtcccagtttctcc

SEQ ID NO: 10023177 - DNA, 22 bp, Homo sapiens
aggcatgtcttcctttgagtgt

SEQ ID NO: 10023178 - DNA, 22 bp, Homo sapiens
aggcatgtcggattgttgtatt

SEQ ID NO: 10023179 - DNA, 16 bp, Homo sapiens
aggcagatattgagtg

SEQ ID NO: 10023180 - DNA, 22 bp, Homo sapiens
ccttggcagtggagtgaggtgg

SEQ ID NO: 10023181 - DNA, 22 bp, Homo sapiens
ggcagatggaagaggctgggtc

SEQ ID NO: 10023182 - DNA, 22 bp, Homo sapiens
ggcagatggaaggacagacgga

SEQ ID NO: 10023183 - DNA, 18 bp, Homo sapiens
ggatgtgattttggtttt

SEQ ID NO: 10023184 - DNA, 22 bp, Homo sapiens
ggctatgtgtccagcatctttg

SEQ ID NO: 10023185 - DNA, 22 bp, Homo sapiens
caaaaaacacagatgtctgtgt

SEQ ID NO: 10023186 - DNA, 22 bp, Homo sapiens
attggaaatgctacaagttaga

SEQ ID NO: 10023187 - DNA, 22 bp, Homo sapiens
attggaaatactgagagataaa

SEQ ID NO: 10023188 - DNA, 22 bp, Homo sapiens
attggaaatacagtagaaaaat

SEQ ID NO: 10023189 - DNA, 22 bp, Homo sapiens
attggaaaatatggtttctgga

SEQ ID NO: 10023190 - DNA, 22 bp, Homo sapiens
atttctacagtacacatgcatt

SEQ ID NO: 10023191 - DNA, 22 bp, Homo sapiens
atgaggtgttcgctggcctttt

SEQ ID NO: 10023192 - DNA, 22 bp, Homo sapiens
atgcactttgtaatctgttcaa

SEQ ID NO: 10023193 - DNA, 22 bp, Homo sapiens
atgcacttcaagcatctctctg

SEQ ID NO: 10023194 - DNA, 22 bp, Homo sapiens
atgcagctgtcagggagaacat

SEQ ID NO: 10023195 - DNA, 22 bp, Homo sapiens
atggcagagggattgaacagct

SEQ ID NO: 10023196 - DNA, 22 bp, Homo sapiens
atggcagatccacagtttgaag

SEQ ID NO: 10023197 - DNA, 22 bp, Homo sapiens
atggcagagtcctaagccttta

SEQ ID NO: 10023198 - DNA, 18 bp, Homo sapiens
atggcagatgataagtgc

SEQ ID NO: 10023199 - DNA, 22 bp, Homo sapiens
atggcagatggctggagcaggt

SEQ ID NO: 10023200 - DNA, 22 bp, Homo sapiens
attttctctcaaaccttaaaat

SEQ ID NO: 10023201 - DNA, 22 bp, Homo sapiens
atatccagcagcaggtgagtat

SEQ ID NO: 10023202 - DNA, 22 bp, Homo sapiens
agaaacaacttgtttctcttgc

SEQ ID NO: 10023203 - DNA, 22 bp, Homo sapiens
agaaacaaggtgtaggttgacc

SEQ ID NO: 10023204 - DNA, 20 bp, Homo sapiens
acttggaactcatttttctt

SEQ ID NO: 10023205 - DNA, 22 bp, Homo sapiens
acactttgctacatttcatatt

SEQ ID NO: 10023206 - DNA, 22 bp, Homo sapiens
acactttgggctggataattat

SEQ ID NO: 10023207 - DNA, 22 bp, Homo sapiens
acactttgtcctttttcattgt

SEQ ID NO: 10023208 - DNA, 22 bp, Homo sapiens
acactttgaagatggaaacttg

SEQ ID NO: 10023209 - DNA, 22 bp, Homo sapiens
acactttgatagataatgcagg

SEQ ID NO: 10023210 - DNA, 22 bp, Homo sapiens
acactttgttgtggcatatacg

SEQ ID NO: 10023211 - DNA, 22 bp, Homo sapiens
acagatgagttagaataggcag

SEQ ID NO: 10023212 - DNA, 22 bp, Homo sapiens
acagatgagttaaagcagagtg

SEQ ID NO: 10023213 - DNA, 22 bp, Homo sapiens
acagatgaggctggcgagggca

SEQ ID NO: 10023214 - DNA, 22 bp, Homo sapiens
acagatgaggcccatcagtctg

SEQ ID NO: 10023215 - DNA, 22 bp, Homo sapiens
acagatgaggtgtttggagagc

SEQ ID NO: 10023216 - DNA, 22 bp, Homo sapiens
acagatgatgtgcacagataga

SEQ ID NO: 10023217 - DNA, 22 bp, Homo sapiens
acagatgatttttatgaaaaca

SEQ ID NO: 10023218 - DNA, 22 bp, Homo sapiens
acagatgaggaatttatttggt

SEQ ID NO: 10023219 - DNA, 20 bp, Homo sapiens
acagatgaggatgcggaggc

SEQ ID NO: 10023220 - DNA, 22 bp, Homo sapiens
agcagatgtttcagagcaggct

SEQ ID NO: 10023221 - DNA, 22 bp, Homo sapiens
agcagatgcgtctgagtgggag

SEQ ID NO: 10023222 - DNA, 22 bp, Homo sapiens
agcagatgggagatggagctgc

SEQ ID NO: 10023223 - DNA, 22 bp, Homo sapiens
agcagatgcaaacttaccttga

SEQ ID NO: 10023224 - DNA, 22 bp, Homo sapiens
agcagatgcattatgattgaaa

SEQ ID NO: 10023225 - DNA, 22 bp, Homo sapiens
agcagatgagcctcatgactgg

SEQ ID NO: 10023226 - DNA, 22 bp, Homo sapiens
agcagatggtgtcatgggatgg

SEQ ID NO: 10023227 - DNA, 22 bp, Homo sapiens
agcagatggagaatggagtcag

SEQ ID NO: 10023228 - DNA, 22 bp, Homo sapiens
agcagatgttccctggtccctt

SEQ ID NO: 10023229 - DNA, 22 bp, Homo sapiens
agcagatgtgtctctgcactgt

SEQ ID NO: 10023230 - DNA, 22 bp, Homo sapiens
agcagatgaatcccagataaag

SEQ ID NO: 10023231 - DNA, 22 bp, Homo sapiens
aatgtgaccttctttggaaata

SEQ ID NO: 10023232 - DNA, 22 bp, Homo sapiens
ggaaacaaaccactcatggtgg

SEQ ID NO: 10023233 - DNA, 22 bp, Homo sapiens
ggaggtgtcttgagattatcat

SEQ ID NO: 10023234 - DNA, 22 bp, Homo sapiens
gggcagatcacctgaggtcagg

SEQ ID NO: 10023235 - DNA, 22 bp, Homo sapiens
gggcagatggggcacaggctga

SEQ ID NO: 10023236 - DNA, 22 bp, Homo sapiens
gggcagatgtctggacacctca

SEQ ID NO: 10023237 - DNA, 20 bp, Homo sapiens
gggcagatgtttttatgttg

SEQ ID NO: 10023238 - DNA, 18 bp, Homo sapiens
gggcagatgtcccaagat

SEQ ID NO: 10023239 - DNA, 22 bp, Homo sapiens
gtggcagagggtgagctggact

SEQ ID NO: 10023240 - DNA, 22 bp, Homo sapiens
gtggcagaggctgtgaggatgc

SEQ ID NO: 10023241 - DNA, 22 bp, Homo sapiens
gtggcagagccttgcggctttg

SEQ ID NO: 10023242 - DNA, 22 bp, Homo sapiens
gtggcagaggctctgggaccag

SEQ ID NO: 10023243 - DNA, 22 bp, Homo sapiens
gtggcagagccgtgcaggtagg

SEQ ID NO: 10023244 - DNA, 22 bp, Homo sapiens
gtggcagattgctcaccatggt

SEQ ID NO: 10023245 - DNA, 22 bp, Homo sapiens
gtggcagagttgctgactagaa

SEQ ID NO: 10023246 - DNA, 22 bp, Homo sapiens
gtggcagagttcaggcgtttgg

SEQ ID NO: 10023247 - DNA, 22 bp, Homo sapiens
gtggcagagtgcggttctgacc

SEQ ID NO: 10023248 - DNA, 22 bp, Homo sapiens
gtggcagaggttcctcagtgtg

SEQ ID NO: 10023249 - DNA, 22 bp, Homo sapiens
gtggcagagccaggctttgaac

SEQ ID NO: 10023250 - DNA, 22 bp, Homo sapiens
gtggcagagccaaggctggagc

SEQ ID NO: 10023251 - DNA, 22 bp, Homo sapiens
gtgacagtggtcacttgtagtt

SEQ ID NO: 10023252 - DNA, 22 bp, Homo sapiens
gtgacatgcatggtgctggtgg

SEQ ID NO: 10023253 - DNA, 22 bp, Homo sapiens
gtgacatggtttgccgtccctg

SEQ ID NO: 10023254 - DNA, 22 bp, Homo sapiens
gtgacatgttatggactggcta

SEQ ID NO: 10023255 - DNA, 22 bp, Homo sapiens
gttctactttctgtgtctttga

SEQ ID NO: 10023256 - DNA, 21 bp, Homo sapiens
gtgtcatggttgactttggca

SEQ ID NO: 10023257 - DNA, 20 bp, Homo sapiens
gtttttcttgggcgagctat

SEQ ID NO: 10023258 - DNA, 22 bp, Homo sapiens
gtttttctttgtgtgaagacaa

SEQ ID NO: 10023259 - DNA, 22 bp, Homo sapiens
gtttttctaggaccatgtgatt

SEQ ID NO: 10023260 - DNA, 22 bp, Homo sapiens
gtttttctagactgggagtttg

SEQ ID NO: 10023261 - DNA, 22 bp, Homo sapiens
gtttttctagaaatctcctcct

SEQ ID NO: 10023262 - DNA, 22 bp, Homo sapiens
gtttttctgtgagcggtaaagg

SEQ ID NO: 10023263 - DNA, 22 bp, Homo sapiens
gtttttctctgaaatagttgac

SEQ ID NO: 10023264 - DNA, 20 bp, Homo sapiens
gtttttctctcttgccacta

SEQ ID NO: 10023265 - DNA, 22 bp, Homo sapiens
gtttttctaagtagcgatattt

SEQ ID NO: 10023266 - DNA, 22 bp, Homo sapiens
gatgcacaggtgagcaggtgca

SEQ ID NO: 10023267 - DNA, 20 bp, Homo sapiens
gatgacatactcacttaggg

SEQ ID NO: 10023268 - DNA, 22 bp, Homo sapiens
gatgacatggctagcactgtga

SEQ ID NO: 10023269 - DNA, 22 bp, Homo sapiens
gatggacacctcctgaggttct

SEQ ID NO: 10023270 - DNA, 22 bp, Homo sapiens
gcactttgcccctcctttggca

SEQ ID NO: 10023271 - DNA, 22 bp, Homo sapiens
gcactttggaaaattttgagtt

SEQ ID NO: 10023272 - DNA, 22 bp, Homo sapiens
gcactttgtggattgtatttcc

SEQ ID NO: 10023273 - DNA, 22 bp, Homo sapiens
gatttttcagtataaaatatat

SEQ ID NO: 10023274 - DNA, 22 bp, Homo sapiens
tttaaaaaactagtctgagtct

SEQ ID NO: 10023275 - DNA, 22 bp, Homo sapiens
ttgagaaacatctaatctttgt

SEQ ID NO: 10023276 - DNA, 22 bp, Homo sapiens
ctggaaaccaggcagttaagag

SEQ ID NO: 10023277 - DNA, 20 bp, Homo sapiens
ctggaaaccctgctgatggt

SEQ ID NO: 10023278 - DNA, 22 bp, Homo sapiens
ctggcagattggggtcagcagt

SEQ ID NO: 10023279 - DNA, 22 bp, Homo sapiens
ctggcagatatttgcagacatg

SEQ ID NO: 10023280 - DNA, 22 bp, Homo sapiens
ctggcagagtctgctgtctgca

SEQ ID NO: 10023281 - DNA, 22 bp, Homo sapiens
ctggcagagttgggtctcaaat

SEQ ID NO: 10023282 - DNA, 22 bp, Homo sapiens
ctggcagaggatggggacccag

SEQ ID NO: 10023283 - DNA, 22 bp, Homo sapiens
ctggcagacttaccatcagaca

SEQ ID NO: 10023284 - DNA, 22 bp, Homo sapiens
ctggcagatagtaagtgatcaa

SEQ ID NO: 10023285 - DNA, 22 bp, Homo sapiens
ctggcagatagccacgcctgtc

SEQ ID NO: 10023286 - DNA, 22 bp, Homo sapiens
ctggcatgctaatacagcctgt

SEQ ID NO: 10023287 - DNA, 22 bp, Homo sapiens
ctggcatggaggactactgagc

SEQ ID NO: 10023288 - DNA, 22 bp, Homo sapiens
ctggcatgccttgggtgcctct

SEQ ID NO: 10023289 - DNA, 22 bp, Homo sapiens
ctggcatgcccagggtatgtgg

SEQ ID NO: 10023290 - DNA, 22 bp, Homo sapiens
tggcagattgtaggcagttagg

SEQ ID NO: 10023291 - DNA, 22 bp, Homo sapiens
tggcagatttaacattggaact

SEQ ID NO: 10023292 - DNA, 22 bp, Homo sapiens
tggcagatgtggtttgagacag

SEQ ID NO: 10023293 - DNA, 22 bp, Homo sapiens
tggcagattctggttgatactt

SEQ ID NO: 10023294 - DNA, 22 bp, Homo sapiens
tggcagatgtatatcacagctt

SEQ ID NO: 10023295 - DNA, 22 bp, Homo sapiens
tggcagatgtggcatagagcat

SEQ ID NO: 10023296 - DNA, 22 bp, Homo sapiens
tggcagatggcctggaaccaaa

SEQ ID NO: 10023297 - DNA, 22 bp, Homo sapiens
tggcagatgagccgcgctccaa

SEQ ID NO: 10023298 - DNA, 22 bp, Homo sapiens
tggcagatgcgttttcattttc

SEQ ID NO: 10023299 - DNA, 22 bp, Homo sapiens
tggcagattttgaagacagaga

SEQ ID NO: 10023300 - DNA, 22 bp, Homo sapiens
tggcagattttctctggaggag

SEQ ID NO: 10023301 - DNA, 22 bp, Homo sapiens
tctgtggcctccttccacttac

SEQ ID NO: 10023302 - DNA, 22 bp, Homo sapiens
tctgtggcatgttgcacttgta

SEQ ID NO: 10023303 - DNA, 22 bp, Homo sapiens
tgtgagcagagcctgacatgag

SEQ ID NO: 10023304 - DNA, 22 bp, Homo sapiens
cctggcaggtagcattgaggag

SEQ ID NO: 10023305 - DNA, 22 bp, Homo sapiens
cctggcaggctggggacagtgc

SEQ ID NO: 10023306 - DNA, 23 bp, Homo sapiens
cctggcagcaaacgaggaggtta

SEQ ID NO: 10023307 - DNA, 22 bp, Homo sapiens
caggatgatgagtagagtgtga

SEQ ID NO: 10023308 - DNA, 22 bp, Homo sapiens
taaaaaacattactctgtcctg

SEQ ID NO: 10023309 - DNA, 22 bp, Homo sapiens
gtggcagagcaggagacaggac

SEQ ID NO: 10023310 - DNA, 22 bp, Homo sapiens
gtggcagaaatgggactttgag

SEQ ID NO: 10023311 - DNA, 22 bp, Homo sapiens
gtggcagaaatattcttgctct

SEQ ID NO: 10023312 - DNA, 22 bp, Homo sapiens
gtggcagaaactggcagaggag

SEQ ID NO: 10023313 - DNA, 22 bp, Homo sapiens
gtggcagaactatgtgattgct

SEQ ID NO: 10023314 - DNA, 22 bp, Homo sapiens
gtggcagaagagtaggatgggc

SEQ ID NO: 10023315 - DNA, 22 bp, Homo sapiens
gtggcagagagcaagtgtctga

SEQ ID NO: 10023316 - DNA, 22 bp, Homo sapiens
gtggcagagatagaactggaat

SEQ ID NO: 10023317 - DNA, 22 bp, Homo sapiens
gtggcagagaacaaggagaggt

SEQ ID NO: 10023318 - DNA, 22 bp, Homo sapiens
gtggcagaccttcccttctcct

SEQ ID NO: 10023319 - DNA, 20 bp, Homo sapiens
gtgtgacctcctgtggatgc

SEQ ID NO: 10023320 - DNA, 22 bp, Homo sapiens
gtgggtgtgataagaccaaggg

SEQ ID NO: 10023321 - DNA, 22 bp, Homo sapiens
tctgtggcacgattgcactgca

SEQ ID NO: 10023322 - DNA, 22 bp, Homo sapiens
ccagatgagaccacactgctgg

SEQ ID NO: 10023323 - DNA, 16 bp, Homo sapiens
ccagatgaatgggagt

SEQ ID NO: 10023324 - DNA, 19 bp, Homo sapiens
ccagatgagcagctgagat

SEQ ID NO: 10023325 - DNA, 22 bp, Homo sapiens
ccagatgaggtcatgctgggtt

SEQ ID NO: 10023326 - DNA, 22 bp, Homo sapiens
tctcgtgcaggccttgctcgga

SEQ ID NO: 10023327 - DNA, 22 bp, Homo sapiens
tgaacagtgtgagggtgtgacc

SEQ ID NO: 10023328 - DNA, 22 bp, Homo sapiens
tgaaagagtttgacatgattct

SEQ ID NO: 10023329 - DNA, 21 bp, Homo sapiens
tgaaagaggatgtggtcattc

SEQ ID NO: 10023330 - DNA, 22 bp, Homo sapiens
tgaaacaaaattaagattctcg

SEQ ID NO: 10023331 - DNA, 22 bp, Homo sapiens
tgaaacaaaccagtaattttgt

SEQ ID NO: 10023332 - DNA, 22 bp, Homo sapiens
tgaaacaaaagtatgtagcttg

SEQ ID NO: 10023333 - DNA, 22 bp, Homo sapiens
tgacatgtcctgagaagatggc

SEQ ID NO: 10023334 - DNA, 22 bp, Homo sapiens
tgacagggtgtttgtgagacta

SEQ ID NO: 10023335 - DNA, 22 bp, Homo sapiens
tgacagtgcatgtgacaaagga

SEQ ID NO: 10023336 - DNA, 22 bp, Homo sapiens
tgcagttttccttcaacattgt

SEQ ID NO: 10023337 - DNA, 22 bp, Homo sapiens
tgcacttttatatcactctggc

SEQ ID NO: 10023338 - DNA, 22 bp, Homo sapiens
tgcagatgagggatgaaaatga

SEQ ID NO: 10023339 - DNA, 22 bp, Homo sapiens
tgcagatgaatgctgagacact

SEQ ID NO: 10023340 - DNA, 22 bp, Homo sapiens
tgcagatgagagggagttttta

SEQ ID NO: 10023341 - DNA, 22 bp, Homo sapiens
tgcagatggggatcagtggctc

SEQ ID NO: 10023342 - DNA, 22 bp, Homo sapiens
tgcagatgcctgggctgcacca

SEQ ID NO: 10023343 - DNA, 22 bp, Homo sapiens
tgcaaacagaaaagctactttg

SEQ ID NO: 10023344 - DNA, 22 bp, Homo sapiens
tgtgggcactaatgacatgcag

SEQ ID NO: 10023345 - DNA, 22 bp, Homo sapiens
tggtatgaccgtggtgcaagca

SEQ ID NO: 10023346 - DNA, 22 bp, Homo sapiens
tgtcacttcagttttgaaacaa

SEQ ID NO: 10023347 - DNA, 22 bp, Homo sapiens
tgtcagtgttttatgtgccctt

SEQ ID NO: 10023348 - DNA, 22 bp, Homo sapiens
tggaaagagatgttgtttctga

SEQ ID NO: 10023349 - DNA, 22 bp, Homo sapiens
tggaaacagatcataactaagc

SEQ ID NO: 10023350 - DNA, 22 bp, Homo sapiens
tggaagacatactgttttctta

SEQ ID NO: 10023351 - DNA, 17 bp, Homo sapiens
tggcatgagggtgtggg

SEQ ID NO: 10023352 - DNA, 22 bp, Homo sapiens
tggcatgaagtcagcagctggg

SEQ ID NO: 10023353 - DNA, 22 bp, Homo sapiens
tggcatgagggaagtttgtggc

SEQ ID NO: 10023354 - DNA, 22 bp, Homo sapiens
tggcagtgctgcagtgccctta

SEQ ID NO: 10023355 - DNA, 22 bp, Homo sapiens
tggcagtggcgggactcagggc

SEQ ID NO: 10023356 - DNA, 18 bp, Homo sapiens
tggcaggtccagctgtgg

SEQ ID NO: 10023357 - DNA, 22 bp, Homo sapiens
tggcaggtgaagttgttaggga

SEQ ID NO: 10023358 - DNA, 23 bp, Homo sapiens
tggcagatacaggcatgacttct

SEQ ID NO: 10023359 - DNA, 22 bp, Homo sapiens
tggcagatacccaggcaaatgg

SEQ ID NO: 10023360 - DNA, 22 bp, Homo sapiens
tggcagatagagctcctgaaga

SEQ ID NO: 10023361 - DNA, 22 bp, Homo sapiens
tggcagataaacatgtgataaa

SEQ ID NO: 10023362 - DNA, 22 bp, Homo sapiens
tggcagataaaataatagggaa

SEQ ID NO: 10023363 - DNA, 22 bp, Homo sapiens
tggcagataacctgctgtgccc

SEQ ID NO: 10023364 - DNA, 19 bp, Homo sapiens
tggcagataatttgtgtta

SEQ ID NO: 10023365 - DNA, 21 bp, Homo sapiens
tggcaatggccaacagtcatc

SEQ ID NO: 10023366 - DNA, 22 bp, Homo sapiens
tggcaatgaggtcagatgtctt

SEQ ID NO: 10023367 - DNA, 22 bp, Homo sapiens
agaaattattagtgaatagtct

SEQ ID NO: 10023368 - DNA, 22 bp, Homo sapiens
aagcattttgccacttgaagtt

SEQ ID NO: 10023369 - DNA, 22 bp, Homo sapiens
aaccctgggaggcagctcagtt

SEQ ID NO: 10023370 - DNA, 22 bp, Homo sapiens
aacatctcatggactacattct

SEQ ID NO: 10023371 - DNA, 22 bp, Homo sapiens
aaatctgagaaatattgtccag

SEQ ID NO: 10023372 - DNA, 22 bp, Homo sapiens
agtttacccactgttgaaatta

SEQ ID NO: 10023373 - DNA, 22 bp, Homo sapiens
atagtttacaaaaatgatgcat

SEQ ID NO: 10023374 - DNA, 22 bp, Homo sapiens
acattttttagagtcccacatt

SEQ ID NO: 10023375 - DNA, 22 bp, Homo sapiens
atgtttgttgaacatctactgc

SEQ ID NO: 10023376 - DNA, 22 bp, Homo sapiens
atggaagttggaaccattcata

SEQ ID NO: 10023377 - DNA, 22 bp, Homo sapiens
atgtctttattaatatcatgcc

SEQ ID NO: 10023378 - DNA, 22 bp, Homo sapiens
cttgtttaagccgctgttaagc

SEQ ID NO: 10023379 - DNA, 22 bp, Homo sapiens
attattcttgaggtgtttattg

SEQ ID NO: 10023380 - DNA, 22 bp, Homo sapiens
atgtgttttggtggatcattca

SEQ ID NO: 10023381 - DNA, 22 bp, Homo sapiens
caacattcaaccaacatttatg

SEQ ID NO: 10023382 - DNA, 22 bp, Homo sapiens
agtatcattttggcattagtat

SEQ ID NO: 10023383 - DNA, 22 bp, Homo sapiens
ataatatttgcattactgtgat

SEQ ID NO: 10023384 - DNA, 22 bp, Homo sapiens
agtttaatatccttcaactttc

SEQ ID NO: 10023385 - DNA, 22 bp, Homo sapiens
atcatgttgtatgtaatctttt

SEQ ID NO: 10023386 - DNA, 22 bp, Homo sapiens
atcatgttggctctgacaaaaa

SEQ ID NO: 10023387 - DNA, 22 bp, Homo sapiens
atcatgttcatcgtatttaggc

SEQ ID NO: 10023388 - DNA, 22 bp, Homo sapiens
ccagtttaagacttatctcaat

SEQ ID NO: 10023389 - DNA, 22 bp, Homo sapiens
tcagtttaagatgactaacaat

SEQ ID NO: 10023390 - DNA, 22 bp, Homo sapiens
tcatttcaatgatactactaag

SEQ ID NO: 10023391 - DNA, 22 bp, Homo sapiens
tcagtttataaattgtatttag

SEQ ID NO: 10023392 - DNA, 22 bp, Homo sapiens
catgtcttaattggagcccaga

SEQ ID NO: 10023393 - DNA, 22 bp, Homo sapiens
catgtcttatgcggaactttca

SEQ ID NO: 10023394 - DNA, 22 bp, Homo sapiens
catatacacttccacctctgtg

SEQ ID NO: 10023395 - DNA, 22 bp, Homo sapiens
gtttacatgtactcattatact

SEQ ID NO: 10023396 - DNA, 22 bp, Homo sapiens
gtttacatgtaatgtgttattg

SEQ ID NO: 10023397 - DNA, 22 bp, Homo sapiens
gtttacatgtttttctcttaca

SEQ ID NO: 10023398 - DNA, 22 bp, Homo sapiens
taacattccctttgtgccaagg

SEQ ID NO: 10023399 - DNA, 22 bp, Homo sapiens
taacattccatggatctgcaga

SEQ ID NO: 10023400 - DNA, 22 bp, Homo sapiens
taacattcttaacttagaaaca

SEQ ID NO: 10023401 - DNA, 22 bp, Homo sapiens
taacaatacccattctaattac

SEQ ID NO: 10023402 - DNA, 22 bp, Homo sapiens
tacatatttgtctttgtactgt

SEQ ID NO: 10023403 - DNA, 22 bp, Homo sapiens
ttcccacttttacagttgtctg

SEQ ID NO: 10023404 - DNA, 22 bp, Homo sapiens
ctcagtttctgacattaaaatc

SEQ ID NO: 10023405 - DNA, 22 bp, Homo sapiens
ctcagtttgtgtgatattgtct

SEQ ID NO: 10023406 - DNA, 22 bp, Homo sapiens
gattcactcatattttacgttt

SEQ ID NO: 10023407 - DNA, 22 bp, Homo sapiens
gtttaataatgttgaattacta

SEQ ID NO: 10023408 - DNA, 22 bp, Homo sapiens
gtatatattggataaaccagag

SEQ ID NO: 10023409 - DNA, 22 bp, Homo sapiens
tgctttaaaatggactgttttg

SEQ ID NO: 10023410 - DNA, 22 bp, Homo sapiens
tgtatacatgtgttcatgcatg

SEQ ID NO: 10023411 - DNA, 22 bp, Homo sapiens
tgtaaattgaaggaaatttgtg

SEQ ID NO: 10023412 - DNA, 22 bp, Homo sapiens
tgggtgctctgcgaccgtaggg

SEQ ID NO: 10023413 - DNA, 22 bp, Homo sapiens
tgtttatagggtctgtcacttg

SEQ ID NO: 10023414 - DNA, 22 bp, Homo sapiens
tgtttaaatagaacatactgca

SEQ ID NO: 10023415 - DNA, 22 bp, Homo sapiens
tgttaaatgtattatgtgttct

SEQ ID NO: 10023416 - DNA, 22 bp, Homo sapiens
tgtgataagttaaattaaacct

SEQ ID NO: 10023417 - DNA, 22 bp, Homo sapiens
ttaatacaactgttgtcactgg

SEQ ID NO: 10023418 - DNA, 22 bp, Homo sapiens
ttaatacaagcatatgcacaca

SEQ ID NO: 10023419 - DNA, 22 bp, Homo sapiens
ttagaaaggttttgctctgaaa

SEQ ID NO: 10023420 - DNA, 22 bp, Homo sapiens
tgcagattcaaatgaaatgcaa

SEQ ID NO: 10023421 - DNA, 22 bp, Homo sapiens
tgaaggtggggcttaggaatct

SEQ ID NO: 10023422 - DNA, 22 bp, Homo sapiens
tgaaggtacagatattttgtaa

SEQ ID NO: 10023423 - DNA, 18 bp, Homo sapiens
tcttttccttccacttcc

SEQ ID NO: 10023424 - DNA, 22 bp, Homo sapiens
tcttttcctcctcttgttggcc

SEQ ID NO: 10023425 - DNA, 22 bp, Homo sapiens
tcttttccttccctacagatct

SEQ ID NO: 10023426 - DNA, 22 bp, Homo sapiens
tcttttccttgatggttaaata

SEQ ID NO: 10023427 - DNA, 21 bp, Homo sapiens
tgaacaaagttcttatcgtga

SEQ ID NO: 10023428 - DNA, 22 bp, Homo sapiens
tgaacaaactgcattcttcact

SEQ ID NO: 10023429 - DNA, 22 bp, Homo sapiens
tgaactttcacaagaatatgct

SEQ ID NO: 10023430 - DNA, 22 bp, Homo sapiens
tctttccaaggactctgtagca

SEQ ID NO: 10023431 - DNA, 22 bp, Homo sapiens
aactttccatctttatcgtctt

SEQ ID NO: 10023432 - DNA, 22 bp, Homo sapiens
aacattctgtcaattgatgacc

SEQ ID NO: 10023433 - DNA, 22 bp, Homo sapiens
aacattcttcaaatatcactct

SEQ ID NO: 10023434 - DNA, 22 bp, Homo sapiens
aaacatctatcagcatttttta

SEQ ID NO: 10023435 - DNA, 22 bp, Homo sapiens
aactcactttgtggcttctgaa

SEQ ID NO: 10023436 - DNA, 22 bp, Homo sapiens
agctcagttggccactctttca

SEQ ID NO: 10023437 - DNA, 22 bp, Homo sapiens
acattacagcaagtttacgtta

SEQ ID NO: 10023438 - DNA, 22 bp, Homo sapiens
acttatccatgtctatatgttg

SEQ ID NO: 10023439 - DNA, 22 bp, Homo sapiens
aggactttaacatattaactgt

SEQ ID NO: 10023440 - DNA, 22 bp, Homo sapiens
accttttccagcttctagaggc

SEQ ID NO: 10023441 - DNA, 16 bp, Homo sapiens
acttttccaccttttt

SEQ ID NO: 10023442 - DNA, 22 bp, Homo sapiens
acttttcccttggtagagttgc

SEQ ID NO: 10023443 - DNA, 22 bp, Homo sapiens
cttctgagatgttgttttacag

SEQ ID NO: 10023444 - DNA, 22 bp, Homo sapiens
atcatacatgtaactaagtaaa

SEQ ID NO: 10023445 - DNA, 22 bp, Homo sapiens
ctggcaggtctcgctgacgtgt

SEQ ID NO: 10023446 - DNA, 22 bp, Homo sapiens
ccctattagtgaccacatcata

SEQ ID NO: 10023447 - DNA, 22 bp, Homo sapiens
attgtttccccggaattattca

SEQ ID NO: 10023448 - DNA, 22 bp, Homo sapiens
attgttctgtagtgacatgtag

SEQ ID NO: 10023449 - DNA, 22 bp, Homo sapiens
attgttctggatatttacattg

SEQ ID NO: 10023450 - DNA, 22 bp, Homo sapiens
attttaccttaaagtctatatt

SEQ ID NO: 10023451 - DNA, 22 bp, Homo sapiens
gaactttgcgcagttcccgggg

SEQ ID NO: 10023452 - DNA, 22 bp, Homo sapiens
gactttcttaggccccctaata

SEQ ID NO: 10023453 - DNA, 22 bp, Homo sapiens
tatattcaatgattagtatcag

SEQ ID NO: 10023454 - DNA, 22 bp, Homo sapiens
tcaaattatttaggatagtgct

SEQ ID NO: 10023455 - DNA, 22 bp, Homo sapiens
catcatatatttctacaagtgc

SEQ ID NO: 10023456 - DNA, 22 bp, Homo sapiens
catcatatggaatttaaagtca

SEQ ID NO: 10023457 - DNA, 22 bp, Homo sapiens
catctacaggagaatgtcactg

SEQ ID NO: 10023458 - DNA, 22 bp, Homo sapiens
cattttactgactcttgaatta

SEQ ID NO: 10023459 - DNA, 22 bp, Homo sapiens
catttcatagttgtcacaataa

SEQ ID NO: 10023460 - DNA, 21 bp, Homo sapiens
tctagaagaggttgagaatat

SEQ ID NO: 10023461 - DNA, 22 bp, Homo sapiens
ctttaattgtagctcccataat

SEQ ID NO: 10023462 - DNA, 22 bp, Homo sapiens
ttgtttacactgcagaattggg

SEQ ID NO: 10023463 - DNA, 22 bp, Homo sapiens
ttgtttaatgcctcatacatct

SEQ ID NO: 10023464 - DNA, 22 bp, Homo sapiens
ttgtttaatatcgtgaagtact

SEQ ID NO: 10023465 - DNA, 22 bp, Homo sapiens
tttatatgtattgactttgatg

SEQ ID NO: 10023466 - DNA, 22 bp, Homo sapiens
ttattattttgtgtacagcaaa

SEQ ID NO: 10023467 - DNA, 22 bp, Homo sapiens
ttaatagatttgattttaaagg

SEQ ID NO: 10023468 - DNA, 22 bp, Homo sapiens
ttaaaatgcagattatgactca

SEQ ID NO: 10023469 - DNA, 22 bp, Homo sapiens
tgtttataccttggtataacca

SEQ ID NO: 10023470 - DNA, 22 bp, Homo sapiens
gtttacattgctgtttgtgtct

SEQ ID NO: 10023471 - DNA, 22 bp, Homo sapiens
gtttagaattctaactttaagg

SEQ ID NO: 10023472 - DNA, 22 bp, Homo sapiens
tagaaggtaatgaaatgctgat

SEQ ID NO: 10023473 - DNA, 18 bp, Homo sapiens
taggttacagccagccag

SEQ ID NO: 10023474 - DNA, 22 bp, Homo sapiens
tatgtttacgctggtagaatta

SEQ ID NO: 10023475 - DNA, 22 bp, Homo sapiens
tatgtttagtatccattttcag

SEQ ID NO: 10023476 - DNA, 22 bp, Homo sapiens
tatgttaagtgggataatcaaa

SEQ ID NO: 10023477 - DNA, 22 bp, Homo sapiens
tatacatgttttacataagtga

SEQ ID NO: 10023478 - DNA, 22 bp, Homo sapiens
tatcaatacatgttatcagtgt

SEQ ID NO: 10023479 - DNA, 22 bp, Homo sapiens
tatattcaacaggctaatgtca

SEQ ID NO: 10023480 - DNA, 22 bp, Homo sapiens
tcatgtttttgccatatgactc

SEQ ID NO: 10023481 - DNA, 22 bp, Homo sapiens
tcatgttattgactcataatat

SEQ ID NO: 10023482 - DNA, 22 bp, Homo sapiens
ggtaacttagctcatggctgtg

SEQ ID NO: 10023483 - DNA, 22 bp, Homo sapiens
gccttattacctgcactttgaa

SEQ ID NO: 10023484 - DNA, 22 bp, Homo sapiens
ttccccttgataatgcagtaag

SEQ ID NO: 10023485 - DNA, 22 bp, Homo sapiens
ttgttgaattagttgactgtgt

SEQ ID NO: 10023486 - DNA, 22 bp, Homo sapiens
ttgtttaaaagaaatcatagaa

SEQ ID NO: 10023487 - DNA, 22 bp, Homo sapiens
ttgtttaaaatgtagcaagaaa

SEQ ID NO: 10023488 - DNA, 22 bp, Homo sapiens
tttacacttgaggaaactgagg

SEQ ID NO: 10023489 - DNA, 22 bp, Homo sapiens
tttacactcctggaaatgatat

SEQ ID NO: 10023490 - DNA, 19 bp, Homo sapiens
ttttccttctatatgtttc

SEQ ID NO: 10023491 - DNA, 22 bp, Homo sapiens
ttttcctctgagctttgaataa

SEQ ID NO: 10023492 - DNA, 22 bp, Homo sapiens
ttttcccatctacaaagcaggg

SEQ ID NO: 10023493 - DNA, 20 bp, Homo sapiens
ttttccactcctcaaaacag

SEQ ID NO: 10023494 - DNA, 22 bp, Homo sapiens
acatgtttaagtttgttatatg

SEQ ID NO: 10023495 - DNA, 22 bp, Homo sapiens
accagccaccaccaggagatcg

SEQ ID NO: 10023496 - DNA, 22 bp, Homo sapiens
acatattaactgcactacacta

SEQ ID NO: 10023497 - DNA, 22 bp, Homo sapiens
actttcccacttaatgtattta

SEQ ID NO: 10023498 - DNA, 22 bp, Homo sapiens
atattcatcgtgtagaaatact

SEQ ID NO: 10023499 - DNA, 22 bp, Homo sapiens
atgtttacaattcagtattaca

SEQ ID NO: 10023500 - DNA, 21 bp, Homo sapiens
atgtttacactgactactgtg

SEQ ID NO: 10023501 - DNA, 22 bp, Homo sapiens
atgtttactggtttatagaata

SEQ ID NO: 10023502 - DNA, 22 bp, Homo sapiens
atgtttatgcaaacatgtgagt

SEQ ID NO: 10023503 - DNA, 20 bp, Homo sapiens
attcatgtctttataaaagc

SEQ ID NO: 10023504 - DNA, 22 bp, Homo sapiens
attcatgttagcccacatgtag

SEQ ID NO: 10023505 - DNA, 22 bp, Homo sapiens
aaacagtttctaatcatggaga

SEQ ID NO: 10023506 - DNA, 22 bp, Homo sapiens
aaacagtttcattttcatgacc

SEQ ID NO: 10023507 - DNA, 22 bp, Homo sapiens
aaacagtttataacatgatact

SEQ ID NO: 10023508 - DNA, 22 bp, Homo sapiens
aacaaacaaacattttgtcatc

SEQ ID NO: 10023509 - DNA, 22 bp, Homo sapiens
aaagtactaatgaatattttgc

SEQ ID NO: 10023510 - DNA, 22 bp, Homo sapiens
aagtactttaggatatgtaact

SEQ ID NO: 10023511 - DNA, 22 bp, Homo sapiens
aagtacttgatagattaactgt

SEQ ID NO: 10023512 - DNA, 23 bp, Homo sapiens
acacatatattcagatacagatg

SEQ ID NO: 10023513 - DNA, 22 bp, Homo sapiens
aattatacattgaacaatctag

SEQ ID NO: 10023514 - DNA, 19 bp, Homo sapiens
cttctccagcttctagaag

SEQ ID NO: 10023515 - DNA, 22 bp, Homo sapiens
attatattgagtataaccagag

SEQ ID NO: 10023516 - DNA, 22 bp, Homo sapiens
attccacttccactagtttctc

SEQ ID NO: 10023517 - DNA, 22 bp, Homo sapiens
ggtagtttaagaaataattgtt

SEQ ID NO: 10023518 - DNA, 22 bp, Homo sapiens
cacttgttggtggtgaaatcac

SEQ ID NO: 10023519 - DNA, 22 bp, Homo sapiens
agttttcctctcatttatcaat

SEQ ID NO: 10023520 - DNA, 22 bp, Homo sapiens
tatttataacagtgagaacggg

SEQ ID NO: 10023521 - DNA, 22 bp, Homo sapiens
tagaatatgtggtgtatacttt

SEQ ID NO: 10023522 - DNA, 22 bp, Homo sapiens
tagaatatgattaattttctta

SEQ ID NO: 10023523 - DNA, 22 bp, Homo sapiens
cattcactcagcgatgccagta

SEQ ID NO: 10023524 - DNA, 22 bp, Homo sapiens
cattcacaaaaccacatgccat

SEQ ID NO: 10023525 - DNA, 22 bp, Homo sapiens
catgtttaattgcgatgtttga

SEQ ID NO: 10023526 - DNA, 22 bp, Homo sapiens
catgttatttatccattaaaca

SEQ ID NO: 10023527 - DNA, 19 bp, Homo sapiens
catgttatgctgtagtatc

SEQ ID NO: 10023528 - DNA, 21 bp, Homo sapiens
tgtaagtttcatctgaattgg

SEQ ID NO: 10023529 - DNA, 22 bp, Homo sapiens
ctctgaaggtttctgttactgt

SEQ ID NO: 10023530 - DNA, 22 bp, Homo sapiens
tttctacatgtcaatccaaacc

SEQ ID NO: 10023531 - DNA, 22 bp, Homo sapiens
tttccactctggccaccatctt

SEQ ID NO: 10023532 - DNA, 22 bp, Homo sapiens
ttctgaagctcccttttgtagt

SEQ ID NO: 10023533 - DNA, 22 bp, Homo sapiens
ttggaagggatattggcatatg

SEQ ID NO: 10023534 - DNA, 22 bp, Homo sapiens
ttatcattgtcgcagtctaatt

SEQ ID NO: 10023535 - DNA, 22 bp, Homo sapiens
ccttttcccatgtttctggagc

SEQ ID NO: 10023536 - DNA, 22 bp, Homo sapiens
ctgttaaagatagttaagcttc

SEQ ID NO: 10023537 - DNA, 22 bp, Homo sapiens
gtctaaagtctatacttttgtg

SEQ ID NO: 10023538 - DNA, 22 bp, Homo sapiens
gtctatatattgcttgaataat

SEQ ID NO: 10023539 - DNA, 22 bp, Homo sapiens
tactacattaataaaacattca

SEQ ID NO: 10023540 - DNA, 22 bp, Homo sapiens
taatataccaaactgtaatttt

SEQ ID NO: 10023541 - DNA, 22 bp, Homo sapiens
gttatataagacaaatcagagt

SEQ ID NO: 10023542 - DNA, 22 bp, Homo sapiens
tagtttactcatctataaaatg

SEQ ID NO: 10023543 - DNA, 19 bp, Homo sapiens
tcctgaagatttcctcagc

SEQ ID NO: 10023544 - DNA, 22 bp, Homo sapiens
tttcacctcagtctttttatat

SEQ ID NO: 10023545 - DNA, 22 bp, Homo sapiens
tttatatatggctggtctggat

SEQ ID NO: 10023546 - DNA, 22 bp, Homo sapiens
tttaaatgtgttcttagtagct

SEQ ID NO: 10023547 - DNA, 22 bp, Homo sapiens
ttatatgaactggactttagga

SEQ ID NO: 10023548 - DNA, 22 bp, Homo sapiens
ttttcattgttactatgagcta

SEQ ID NO: 10023549 - DNA, 22 bp, Homo sapiens
ttttccacagcaccataagatt

SEQ ID NO: 10023550 - DNA, 19 bp, Homo sapiens
ttttccacagaaatatgtt

SEQ ID NO: 10023551 - DNA, 22 bp, Homo sapiens
acaacatttccatttccttggt

SEQ ID NO: 10023552 - DNA, 22 bp, Homo sapiens
acacatatgtggcaactgtaga

SEQ ID NO: 10023553 - DNA, 22 bp, Homo sapiens
acttttatcaaggaagtgatct

SEQ ID NO: 10023554 - DNA, 20 bp, Homo sapiens
acacatatagcagcataaac

SEQ ID NO: 10023555 - DNA, 22 bp, Homo sapiens
acacatataccactgtaaatga

SEQ ID NO: 10023556 - DNA, 22 bp, Homo sapiens
actttagagaaatgtagaagta

SEQ ID NO: 10023557 - DNA, 22 bp, Homo sapiens
actttacaggcacttcaagtat

SEQ ID NO: 10023558 - DNA, 22 bp, Homo sapiens
atagaagtatcaagatcttgaa

SEQ ID NO: 10023559 - DNA, 22 bp, Homo sapiens
atacactactaagcacagattg

SEQ ID NO: 10023560 - DNA, 22 bp, Homo sapiens
atatagtaagcagtctgtaaat

SEQ ID NO: 10023561 - DNA, 22 bp, Homo sapiens
atatagaaggtgctatttacat

SEQ ID NO: 10023562 - DNA, 22 bp, Homo sapiens
atattaattatttacacatgag

SEQ ID NO: 10023563 - DNA, 22 bp, Homo sapiens
agtaacatctttgacatttgtt

SEQ ID NO: 10023564 - DNA, 22 bp, Homo sapiens
agtaacatatagcacttttgga

SEQ ID NO: 10023565 - DNA, 22 bp, Homo sapiens
caatttcttgttaattctcagg

SEQ ID NO: 10023566 - DNA, 22 bp, Homo sapiens
attgttaaactgaagcattact

SEQ ID NO: 10023567 - DNA, 22 bp, Homo sapiens
attgttaaagtaataaccatgg

SEQ ID NO: 10023568 - DNA, 22 bp, Homo sapiens
attgtggtgtcagttataggca

SEQ ID NO: 10023569 - DNA, 22 bp, Homo sapiens
attgttaataactattacattg

SEQ ID NO: 10023570 - DNA, 22 bp, Homo sapiens
gctcttgtcaaaaattagttga

SEQ ID NO: 10023571 - DNA, 22 bp, Homo sapiens
caaacattcaagtacaagtctt

SEQ ID NO: 10023572 - DNA, 22 bp, Homo sapiens
atttttccatgatacttatctg

SEQ ID NO: 10023573 - DNA, 22 bp, Homo sapiens
ctttccccagtatatcattgcc

SEQ ID NO: 10023574 - DNA, 22 bp, Homo sapiens
atgtcatgaaatgctactaact

SEQ ID NO: 10023575 - DNA, 22 bp, Homo sapiens
atgtcatgggccaaaaatagtt

SEQ ID NO: 10023576 - DNA, 22 bp, Homo sapiens
atgtttaaagggttgagaaata

SEQ ID NO: 10023577 - DNA, 22 bp, Homo sapiens
caagtactttgaaaagttgaat

SEQ ID NO: 10023578 - DNA, 22 bp, Homo sapiens
ctaggtgatccactgctctctt

SEQ ID NO: 10023579 - DNA, 22 bp, Homo sapiens
cttagaaggatgtttgctgttt

SEQ ID NO: 10023580 - DNA, 22 bp, Homo sapiens
atattgttgactataagagtaa

SEQ ID NO: 10023581 - DNA, 22 bp, Homo sapiens
atatgcagtctcttgcccttct

SEQ ID NO: 10023582 - DNA, 22 bp, Homo sapiens
atattataagttatttcaagtt

SEQ ID NO: 10023583 - DNA, 22 bp, Homo sapiens
agttatattccatagattcaga

SEQ ID NO: 10023584 - DNA, 22 bp, Homo sapiens
agttatatgtgaaaacacgtat

SEQ ID NO: 10023585 - DNA, 21 bp, Homo sapiens
tgagaagtatgtcttcagcca

SEQ ID NO: 10023586 - DNA, 22 bp, Homo sapiens
tattattaaatggcagaatttt

SEQ ID NO: 10023587 - DNA, 22 bp, Homo sapiens
tattttacatgacaggtgttta

SEQ ID NO: 10023588 - DNA, 22 bp, Homo sapiens
catctgctgttccttggactca

SEQ ID NO: 10023589 - DNA, 22 bp, Homo sapiens
cagttttcttgttatatttggg

SEQ ID NO: 10023590 - DNA, 22 bp, Homo sapiens
cattacatttcaaaatgtttcc

SEQ ID NO: 10023591 - DNA, 22 bp, Homo sapiens
ttttcacttaaggaatttcatg

SEQ ID NO: 10023592 - DNA, 22 bp, Homo sapiens
tttgtacacaggatgttataat

SEQ ID NO: 10023593 - DNA, 20 bp, Homo sapiens
tttccactgtaatgtatgat

SEQ ID NO: 10023594 - DNA, 22 bp, Homo sapiens
tgtgtatacaacttataggagc

SEQ ID NO: 10023595 - DNA, 21 bp, Homo sapiens
gaacatttgggttgtttctac

SEQ ID NO: 10023596 - DNA, 22 bp, Homo sapiens
tatacacatgtgtgtattcata

SEQ ID NO: 10023597 - DNA, 22 bp, Homo sapiens
tattcattatgaccaaatctag

SEQ ID NO: 10023598 - DNA, 22 bp, Homo sapiens
tatttataccaggtgatcggag

SEQ ID NO: 10023599 - DNA, 22 bp, Homo sapiens
tacttttctataggtttgaaat

SEQ ID NO: 10023600 - DNA, 22 bp, Homo sapiens
tagaatgtgcaaatgtgcacac

SEQ ID NO: 10023601 - DNA, 22 bp, Homo sapiens
tagaaagtcaaaacactgtgtt

SEQ ID NO: 10023602 - DNA, 22 bp, Homo sapiens
tcatataactggatattttcaa

SEQ ID NO: 10023603 - DNA, 22 bp, Homo sapiens
tcattatagagttgtattttag

SEQ ID NO: 10023604 - DNA, 21 bp, Homo sapiens
tccccacatttctaaacagac

SEQ ID NO: 10023605 - DNA, 22 bp, Homo sapiens
tttctttatcctcctttgcaca

SEQ ID NO: 10023606 - DNA, 22 bp, Homo sapiens
tttgtttagatggtaaatcagt

SEQ ID NO: 10023607 - DNA, 22 bp, Homo sapiens
tttttcatgagactagaagtca

SEQ ID NO: 10023608 - DNA, 20 bp, Homo sapiens
ttttccttctgagtatgttg

SEQ ID NO: 10023609 - DNA, 22 bp, Homo sapiens
tttaccatacatcaaaatattt

SEQ ID NO: 10023610 - DNA, 22 bp, Homo sapiens
tttatataacagagactgctat

SEQ ID NO: 10023611 - DNA, 22 bp, Homo sapiens
tttataacatttcttacctgtg

SEQ ID NO: 10023612 - DNA, 22 bp, Homo sapiens
ttgtttaagccacccaatctgt

SEQ ID NO: 10023613 - DNA, 20 bp, Homo sapiens
ttgtttaaaggtgaagaggc

SEQ ID NO: 10023614 - DNA, 22 bp, Homo sapiens
tttctgtatttaaaagatctgg

SEQ ID NO: 10023615 - DNA, 22 bp, Homo sapiens
tttctgtagtgtggtatgtagg

SEQ ID NO: 10023616 - DNA, 22 bp, Homo sapiens
tttcctcttatacagtgtttat

SEQ ID NO: 10023617 - DNA, 22 bp, Homo sapiens
tttcattttggttatgccataa

SEQ ID NO: 10023618 - DNA, 22 bp, Homo sapiens
ttgattaaaatgagacatcatt

SEQ ID NO: 10023619 - DNA, 22 bp, Homo sapiens
ttacatattgtctattgttcaa

SEQ ID NO: 10023620 - DNA, 22 bp, Homo sapiens
tgtttacacttcaaggttaagg

SEQ ID NO: 10023621 - DNA, 22 bp, Homo sapiens
tgtttacagggtgattttacct

SEQ ID NO: 10023622 - DNA, 22 bp, Homo sapiens
tgtttacaagccacttgttaag

SEQ ID NO: 10023623 - DNA, 22 bp, Homo sapiens
tgtttacaaggagtttatattg

SEQ ID NO: 10023624 - DNA, 22 bp, Homo sapiens
atactaagctcattacattttg

SEQ ID NO: 10023625 - DNA, 19 bp, Homo sapiens
ctggaatgatagagacctc

SEQ ID NO: 10023626 - DNA, 22 bp, Homo sapiens
ctggaatgagcagggcttatgg

SEQ ID NO: 10023627 - DNA, 22 bp, Homo sapiens
ctggaatgtagagacagcttag

SEQ ID NO: 10023628 - DNA, 22 bp, Homo sapiens
ctgagaaaggacctcaaacagg

SEQ ID NO: 10023629 - DNA, 22 bp, Homo sapiens
cctacacatctcacctcacagg

SEQ ID NO: 10023630 - DNA, 22 bp, Homo sapiens
caagtcaaagactagaactagt

SEQ ID NO: 10023631 - DNA, 22 bp, Homo sapiens
atgaaacaaacctctatggagt

SEQ ID NO: 10023632 - DNA, 22 bp, Homo sapiens
gaacaaacacatcccagcagtg

SEQ ID NO: 10023633 - DNA, 20 bp, Homo sapiens
attctacaagaataagcatg

SEQ ID NO: 10023634 - DNA, 22 bp, Homo sapiens
attctacaacccaataataatt

SEQ ID NO: 10023635 - DNA, 22 bp, Homo sapiens
agcaataacagaaaactttcct

SEQ ID NO: 10023636 - DNA, 22 bp, Homo sapiens
agtgcaatagcaaagaacaaca

SEQ ID NO: 10023637 - DNA, 23 bp, Homo sapiens
atcaagtcatcagcaaaatacat

SEQ ID NO: 10023638 - DNA, 22 bp, Homo sapiens
atctggaaaacacagtgtagac

SEQ ID NO: 10023639 - DNA, 22 bp, Homo sapiens
acatttctcagggagttttgct

SEQ ID NO: 10023640 - DNA, 22 bp, Homo sapiens
acatttctccttgcaggagtca

SEQ ID NO: 10023641 - DNA, 22 bp, Homo sapiens
acatttctcattctcccctaac

SEQ ID NO: 10023642 - DNA, 22 bp, Homo sapiens
acatttctcatctagtagagta

SEQ ID NO: 10023643 - DNA, 22 bp, Homo sapiens
acatttctcaggtaagtcattt

SEQ ID NO: 10023644 - DNA, 22 bp, Homo sapiens
acatttctccctgcatgcctgc

SEQ ID NO: 10023645 - DNA, 22 bp, Homo sapiens
accagacactgtgaagacaggc

SEQ ID NO: 10023646 - DNA, 22 bp, Homo sapiens
acaggcctgtgtgcacacgagg

SEQ ID NO: 10023647 - DNA, 18 bp, Homo sapiens
aagaactgaggtcctaga

SEQ ID NO: 10023648 - DNA, 21 bp, Homo sapiens
aagaactattgaggtacacag

SEQ ID NO: 10023649 - DNA, 22 bp, Homo sapiens
aatgtacaaaccttctttgtag

SEQ ID NO: 10023650 - DNA, 22 bp, Homo sapiens
aaaacatgtccatacagaaact

SEQ ID NO: 10023651 - DNA, 22 bp, Homo sapiens
aaaagttacctctgtaatataa

SEQ ID NO: 10023652 - DNA, 22 bp, Homo sapiens
aaaagtgttcaggaagaataat

SEQ ID NO: 10023653 - DNA, 22 bp, Homo sapiens
aacatgaaacccaaacagaata

SEQ ID NO: 10023654 - DNA, 22 bp, Homo sapiens
acttttatgataatcaatgttc

SEQ ID NO: 10023655 - DNA, 22 bp, Homo sapiens
agaactggtggtgatcagttat

SEQ ID NO: 10023656 - DNA, 22 bp, Homo sapiens
actgtacacagtggtgtactgt

SEQ ID NO: 10023657 - DNA, 22 bp, Homo sapiens
actgtacacattcgtcaagact

SEQ ID NO: 10023658 - DNA, 22 bp, Homo sapiens
actgtacatatggattctaaga

SEQ ID NO: 10023659 - DNA, 22 bp, Homo sapiens
actgtacacgtgtcatttacag

SEQ ID NO: 10023660 - DNA, 22 bp, Homo sapiens
actgtacatgcatcttgtctat

SEQ ID NO: 10023661 - DNA, 22 bp, Homo sapiens
actgtccataatattggtgaac

SEQ ID NO: 10023662 - DNA, 22 bp, Homo sapiens
actgtacaaatattgcaaaata

SEQ ID NO: 10023663 - DNA, 22 bp, Homo sapiens
actgtacaactgctgagcagaa

SEQ ID NO: 10023664 - DNA, 22 bp, Homo sapiens
actgtacaacctctgcccctgt

SEQ ID NO: 10023665 - DNA, 22 bp, Homo sapiens
actgtacacacttctctgtctt

SEQ ID NO: 10023666 - DNA, 22 bp, Homo sapiens
actgtaaccagtgtggtgagag

SEQ ID NO: 10023667 - DNA, 22 bp, Homo sapiens
actgaaaatgaattagaaacag

SEQ ID NO: 10023668 - DNA, 20 bp, Homo sapiens
acagcagataccacaactat

SEQ ID NO: 10023669 - DNA, 22 bp, Homo sapiens
tcagtcttccctccagtgcaac

SEQ ID NO: 10023670 - DNA, 22 bp, Homo sapiens
tcaagtcttgatgagacaaacc

SEQ ID NO: 10023671 - DNA, 22 bp, Homo sapiens
tcaagtctggagatctggaact

SEQ ID NO: 10023672 - DNA, 22 bp, Homo sapiens
tcacaagatacagttagaagca

SEQ ID NO: 10023673 - DNA, 22 bp, Homo sapiens
tatttctaagctgtaagtctga

SEQ ID NO: 10023674 - DNA, 22 bp, Homo sapiens
tatttctattccccaggcaagt

SEQ ID NO: 10023675 - DNA, 22 bp, Homo sapiens
taaacaagggttactgagcatg

SEQ ID NO: 10023676 - DNA, 22 bp, Homo sapiens
taaacaagctgtctgatattct

SEQ ID NO: 10023677 - DNA, 22 bp, Homo sapiens
tacaaaaaattgatactgacga

SEQ ID NO: 10023678 - DNA, 22 bp, Homo sapiens
ggtttggttttggccatcttcc

SEQ ID NO: 10023679 - DNA, 22 bp, Homo sapiens
gaaatccagttccctactctta

SEQ ID NO: 10023680 - DNA, 22 bp, Homo sapiens
gacaagacattggtaaagatat

SEQ ID NO: 10023681 - DNA, 22 bp, Homo sapiens
gacaagacatgtgatgacatca

SEQ ID NO: 10023682 - DNA, 22 bp, Homo sapiens
gacaagactatgtagaaagtat

SEQ ID NO: 10023683 - DNA, 22 bp, Homo sapiens
gacaagacagcttgcagacaac

SEQ ID NO: 10023684 - DNA, 17 bp, Homo sapiens
gacaagacagaattcat

SEQ ID NO: 10023685 - DNA, 22 bp, Homo sapiens
gacaagacacctctctccatcc

SEQ ID NO: 10023686 - DNA, 22 bp, Homo sapiens
gacaagactggtttatttaagg

SEQ ID NO: 10023687 - DNA, 22 bp, Homo sapiens
ctacaggtatgtgcatgacatc

SEQ ID NO: 10023688 - DNA, 22 bp, Homo sapiens
ctacaggtcagtaagacctaga

SEQ ID NO: 10023689 - DNA, 22 bp, Homo sapiens
ctacagcagagctacactaact

SEQ ID NO: 10023690 - DNA, 22 bp, Homo sapiens
cagtattttcaggatttggaag

SEQ ID NO: 10023691 - DNA, 22 bp, Homo sapiens
taatccaatggcacaatgtatg

SEQ ID NO: 10023692 - DNA, 22 bp, Homo sapiens
taatccaaaactgaatctgtgg

SEQ ID NO: 10023693 - DNA, 22 bp, Homo sapiens
taatcacagaaacagactgttt

SEQ ID NO: 10023694 - DNA, 22 bp, Homo sapiens
ttcagtctcctcattttacaaa

SEQ ID NO: 10023695 - DNA, 22 bp, Homo sapiens
tttctacattcaaaaactacca

SEQ ID NO: 10023696 - DNA, 22 bp, Homo sapiens
tttctacatttgtaaccagatt

SEQ ID NO: 10023697 - DNA, 22 bp, Homo sapiens
ttttatcagcagggataacaag

SEQ ID NO: 10023698 - DNA, 20 bp, Homo sapiens
ttttatatgtagggtatatg

SEQ ID NO: 10023699 - DNA, 22 bp, Homo sapiens
agtttctagcctcactgtttag

SEQ ID NO: 10023700 - DNA, 22 bp, Homo sapiens
atctggaacaaagcttaggaat

SEQ ID NO: 10023701 - DNA, 21 bp, Homo sapiens
atctggaagaactggtaagtg

SEQ ID NO: 10023702 - DNA, 17 bp, Homo sapiens
atctggaagctagctga

SEQ ID NO: 10023703 - DNA, 22 bp, Homo sapiens
atctggaagccagatactcagt

SEQ ID NO: 10023704 - DNA, 22 bp, Homo sapiens
agtctcttggcattctgaaaca

SEQ ID NO: 10023705 - DNA, 22 bp, Homo sapiens
ctacagaaaatcagccacaggc

SEQ ID NO: 10023706 - DNA, 22 bp, Homo sapiens
ctacaagatttttaaaactgta

SEQ ID NO: 10023707 - DNA, 23 bp, Homo sapiens
ctacaagagcaagcatggacaag

SEQ ID NO: 10023708 - DNA, 22 bp, Homo sapiens
catgtacattctgtagatggag

SEQ ID NO: 10023709 - DNA, 22 bp, Homo sapiens
ccagcttttcttatcattataa

SEQ ID NO: 10023710 - DNA, 22 bp, Homo sapiens
cactgtacagcattaacaaggc

SEQ ID NO: 10023711 - DNA, 22 bp, Homo sapiens
cactgtacccatttaaataaat

SEQ ID NO: 10023712 - DNA, 22 bp, Homo sapiens
cactgtactgggttgaaggacg

SEQ ID NO: 10023713 - DNA, 22 bp, Homo sapiens
cactgtactgtgaataaggagg

SEQ ID NO: 10023714 - DNA, 22 bp, Homo sapiens
caaagactgcataacacatgaa

SEQ ID NO: 10023715 - DNA, 22 bp, Homo sapiens
attgtacagatgaggtaagtga

SEQ ID NO: 10023716 - DNA, 22 bp, Homo sapiens
atctggaatccttgtggacaat

SEQ ID NO: 10023717 - DNA, 19 bp, Homo sapiens
acaaactgagtacacttgt

SEQ ID NO: 10023718 - DNA, 22 bp, Homo sapiens
acactgtagctgagggcatgcg

SEQ ID NO: 10023719 - DNA, 22 bp, Homo sapiens
acactgtaaattgagtgcgtga

SEQ ID NO: 10023720 - DNA, 22 bp, Homo sapiens
acagcaaaggacgaacactctg

SEQ ID NO: 10023721 - DNA, 22 bp, Homo sapiens
aagtcaatcacatgcacactga

SEQ ID NO: 10023722 - DNA, 22 bp, Homo sapiens
aagtcaattagtaaacttggaa

SEQ ID NO: 10023723 - DNA, 21 bp, Homo sapiens
accatcttccatgcattatat

SEQ ID NO: 10023724 - DNA, 22 bp, Homo sapiens
accatcttaaggggacttctta

SEQ ID NO: 10023725 - DNA, 22 bp, Homo sapiens
aagctttaaggaattttatgga

SEQ ID NO: 10023726 - DNA, 22 bp, Homo sapiens
actaagacctagatactagggg

SEQ ID NO: 10023727 - DNA, 22 bp, Homo sapiens
aataagaatttacttgtcaaga

SEQ ID NO: 10023728 - DNA, 22 bp, Homo sapiens
aaagtcaatgatttctcctgga

SEQ ID NO: 10023729 - DNA, 22 bp, Homo sapiens
aaagtcaaaatgctctcctgtc

SEQ ID NO: 10023730 - DNA, 22 bp, Homo sapiens
aaagttcagtgccttctataca

SEQ ID NO: 10023731 - DNA, 22 bp, Homo sapiens
aaactgaaacatcatcatgttg

SEQ ID NO: 10023732 - DNA, 21 bp, Homo sapiens
aaactgaagagacaggaactt

SEQ ID NO: 10023733 - DNA, 22 bp, Homo sapiens
aaaaacctttcccatactaaga

SEQ ID NO: 10023734 - DNA, 23 bp, Homo sapiens
aaaaaaccatgtaggcactcagt

SEQ ID NO: 10023735 - DNA, 22 bp, Homo sapiens
aactgttcttcattttcagtat

SEQ ID NO: 10023736 - DNA, 22 bp, Homo sapiens
aagatttaccactttattcaag

SEQ ID NO: 10023737 - DNA, 22 bp, Homo sapiens
aagagctgtgggtggtagtcct

SEQ ID NO: 10023738 - DNA, 22 bp, Homo sapiens
atgaaactgggataactatagc

SEQ ID NO: 10023739 - DNA, 22 bp, Homo sapiens
cacaagacttatttgtgtagaa

SEQ ID NO: 10023740 - DNA, 21 bp, Homo sapiens
cacaagacacatagggtgttt

SEQ ID NO: 10023741 - DNA, 22 bp, Homo sapiens
cacagtcctacagagatcagag

SEQ ID NO: 10023742 - DNA, 23 bp, Homo sapiens
agaaaagttcatacctttttaac

SEQ ID NO: 10023743 - DNA, 22 bp, Homo sapiens
atactgtatcacttgtgagtga

SEQ ID NO: 10023744 - DNA, 22 bp, Homo sapiens
actgtataaggcataggtaagc

SEQ ID NO: 10023745 - DNA, 22 bp, Homo sapiens
actgtacatgtaaacattgtca

SEQ ID NO: 10023746 - DNA, 22 bp, Homo sapiens
actgtaaattttggttgcaggt

SEQ ID NO: 10023747 - DNA, 22 bp, Homo sapiens
actgtacttttcttggctagat

SEQ ID NO: 10023748 - DNA, 22 bp, Homo sapiens
agtgcaatgtgtacagaaaaat

SEQ ID NO: 10023749 - DNA, 22 bp, Homo sapiens
acagttcccgtcttgcacagct

SEQ ID NO: 10023750 - DNA, 18 bp, Homo sapiens
acagtaaagaaaggaatt

SEQ ID NO: 10023751 - DNA, 22 bp, Homo sapiens
acagtcctgtacaggccatatc

SEQ ID NO: 10023752 - DNA, 22 bp, Homo sapiens
acatcacagagcccagataaag

SEQ ID NO: 10023753 - DNA, 18 bp, Homo sapiens
acatttctatgcttctgg

SEQ ID NO: 10023754 - DNA, 22 bp, Homo sapiens
acatttctttctattcagtagc

SEQ ID NO: 10023755 - DNA, 22 bp, Homo sapiens
acatttcttttcatctctatat

SEQ ID NO: 10023756 - DNA, 22 bp, Homo sapiens
acatttctttgctagacagcag

SEQ ID NO: 10023757 - DNA, 22 bp, Homo sapiens
acatttctcttgatgtctctat

SEQ ID NO: 10023758 - DNA, 22 bp, Homo sapiens
acatttctcttagagttggact

SEQ ID NO: 10023759 - DNA, 18 bp, Homo sapiens
acatttctaggtgaaagc

SEQ ID NO: 10023760 - DNA, 22 bp, Homo sapiens
acatttctaatttaatgtaaca

SEQ ID NO: 10023761 - DNA, 22 bp, Homo sapiens
acatttctagttgttcatctcc

SEQ ID NO: 10023762 - DNA, 22 bp, Homo sapiens
acattgtataatgattatcaca

SEQ ID NO: 10023763 - DNA, 22 bp, Homo sapiens
tccaataacatctaaaaactta

SEQ ID NO: 10023764 - DNA, 22 bp, Homo sapiens
tcatttctatctatgcagcttc

SEQ ID NO: 10023765 - DNA, 22 bp, Homo sapiens
tcatttctattgctactgtctg

SEQ ID NO: 10023766 - DNA, 22 bp, Homo sapiens
tcatttctccgacctgctgtcc

SEQ ID NO: 10023767 - DNA, 22 bp, Homo sapiens
tcatttctctgagtctgataat

SEQ ID NO: 10023768 - DNA, 20 bp, Homo sapiens
tcatttcttggggttccaag

SEQ ID NO: 10023769 - DNA, 22 bp, Homo sapiens
tcatgaaaatagatcagaaatt

SEQ ID NO: 10023770 - DNA, 22 bp, Homo sapiens
tcagtctcctttcctctagaca

SEQ ID NO: 10023771 - DNA, 22 bp, Homo sapiens
gttatatatagtatttctctga

SEQ ID NO: 10023772 - DNA, 21 bp, Homo sapiens
taaaactgtaactttgtcctg

SEQ ID NO: 10023773 - DNA, 22 bp, Homo sapiens
taaaactgcttggtatggtcta

SEQ ID NO: 10023774 - DNA, 22 bp, Homo sapiens
taaaactgaatacatactgagg

SEQ ID NO: 10023775 - DNA, 22 bp, Homo sapiens
taagacaattcttcagtcacaa

SEQ ID NO: 10023776 - DNA, 22 bp, Homo sapiens
taacagctctgtgtggctgtaa

SEQ ID NO: 10023777 - DNA, 22 bp, Homo sapiens
taacagctggcgttataggaat

SEQ ID NO: 10023778 - DNA, 22 bp, Homo sapiens
tacaagacgagggaagttcttt

SEQ ID NO: 10023779 - DNA, 21 bp, Homo sapiens
tacaagaccggattcgggccc

SEQ ID NO: 10023780 - DNA, 22 bp, Homo sapiens
tacaagatgacaggtgcatgat

SEQ ID NO: 10023781 - DNA, 22 bp, Homo sapiens
taccactacatttgctaatggc

SEQ ID NO: 10023782 - DNA, 22 bp, Homo sapiens
tactgtacattccgtttgttgc

SEQ ID NO: 10023783 - DNA, 22 bp, Homo sapiens
tactgtactcaacatgtgagtt

SEQ ID NO: 10023784 - DNA, 22 bp, Homo sapiens
tactgtactgtcttttttgctg

SEQ ID NO: 10023785 - DNA, 22 bp, Homo sapiens
tactgtactgcagttctgcaaa

SEQ ID NO: 10023786 - DNA, 20 bp, Homo sapiens
tacagtcagggcacaggcag

SEQ ID NO: 10023787 - DNA, 22 bp, Homo sapiens
ggttcagtttacattaaaatct

SEQ ID NO: 10023788 - DNA, 17 bp, Homo sapiens
ggttcagttctgcattc

SEQ ID NO: 10023789 - DNA, 22 bp, Homo sapiens
gcttttatttcttcacaaaagt

SEQ ID NO: 10023790 - DNA, 22 bp, Homo sapiens
gcttttattgtctttacgacga

SEQ ID NO: 10023791 - DNA, 19 bp, Homo sapiens
gctttagtttactcatcta

SEQ ID NO: 10023792 - DNA, 22 bp, Homo sapiens
gctgtacattctgtgggtttgg

SEQ ID NO: 10023793 - DNA, 22 bp, Homo sapiens
gctgtacattctgcacaggccc

SEQ ID NO: 10023794 - DNA, 22 bp, Homo sapiens
gctgtacatttgtgtacacttg

SEQ ID NO: 10023795 - DNA, 23 bp, Homo sapiens
gctgtacaggaaccagtttggag

SEQ ID NO: 10023796 - DNA, 22 bp, Homo sapiens
gctgtacagggttatcctttcc

SEQ ID NO: 10023797 - DNA, 19 bp, Homo sapiens
gctgtacagtaaggagaca

SEQ ID NO: 10023798 - DNA, 22 bp, Homo sapiens
gctgtacagtttactaggtggg

SEQ ID NO: 10023799 - DNA, 22 bp, Homo sapiens
gctgtacatcacaatttgctgt

SEQ ID NO: 10023800 - DNA, 22 bp, Homo sapiens
gaaaaagtgaccttggtagcta

SEQ ID NO: 10023801 - DNA, 22 bp, Homo sapiens
gaagaactgtgacagaagcagt

SEQ ID NO: 10023802 - DNA, 22 bp, Homo sapiens
ctgtgacagagcttgagtgaga

SEQ ID NO: 10023803 - DNA, 22 bp, Homo sapiens
ttatttattcattctgtctgtc

SEQ ID NO: 10023804 - DNA, 22 bp, Homo sapiens
tttctacaggttgatgggtttg

SEQ ID NO: 10023805 - DNA, 22 bp, Homo sapiens
tttctacagtactgatttcata

SEQ ID NO: 10023806 - DNA, 22 bp, Homo sapiens
tttctacatgtcaatccaaacc

SEQ ID NO: 10023807 - DNA, 22 bp, Homo sapiens
catttgtacagaacagctttat

SEQ ID NO: 10023808 - DNA, 22 bp, Homo sapiens
catgaaaaatttactgttaaca

SEQ ID NO: 10023809 - DNA, 21 bp, Homo sapiens
tcagctttgcaactgcacatc

SEQ ID NO: 10023810 - DNA, 22 bp, Homo sapiens
ttattatagattatgcaagatt

SEQ ID NO: 10023811 - DNA, 22 bp, Homo sapiens
ttatactaaaacgcattgaatt

SEQ ID NO: 10023812 - DNA, 22 bp, Homo sapiens
tttatatagagatttgtgcatg

SEQ ID NO: 10023813 - DNA, 22 bp, Homo sapiens
gacataaaattcaataatttgt

SEQ ID NO: 10023814 - DNA, 22 bp, Homo sapiens
gacataaaccttgagatattaa

SEQ ID NO: 10023815 - DNA, 22 bp, Homo sapiens
gaaaactgtgattagaatgcct

SEQ ID NO: 10023816 - DNA, 22 bp, Homo sapiens
atgtaacaaatggtatacatgt

SEQ ID NO: 10023817 - DNA, 22 bp, Homo sapiens
atgtaacattgaattatatagt

SEQ ID NO: 10023818 - DNA, 22 bp, Homo sapiens
atgtaacacccacttttatagc

SEQ ID NO: 10023819 - DNA, 22 bp, Homo sapiens
gcaaaaaccacaattactttta

SEQ ID NO: 10023820 - DNA, 22 bp, Homo sapiens
gcaaaaaccacaattacttttg

SEQ ID NO: 10023821 - DNA, 22 bp, Homo sapiens
gcaaaaactgcaattacttttg

SEQ ID NO: 10023822 - DNA, 22 bp, Homo sapiens
cacagcataatgaaatatactt

SEQ ID NO: 10023823 - DNA, 22 bp, Homo sapiens
cagctcctattagacactgaat

SEQ ID NO: 10023824 - DNA, 22 bp, Homo sapiens
caggtcctgcagggagagtaaa

SEQ ID NO: 10023825 - DNA, 22 bp, Homo sapiens
caggtcctggcatcaggcaggt

SEQ ID NO: 10023826 - DNA, 22 bp, Homo sapiens
cagttcctatgggcaaaacaca

SEQ ID NO: 10023827 - DNA, 22 bp, Homo sapiens
ataaactgaagggaacactgag

SEQ ID NO: 10023828 - DNA, 22 bp, Homo sapiens
ataaaagaagttttggtacttg

SEQ ID NO: 10023829 - DNA, 22 bp, Homo sapiens
ctatttatctatttctgaatga

SEQ ID NO: 10023830 - DNA, 21 bp, Homo sapiens
agaaaaacacgatataagccc

SEQ ID NO: 10023831 - DNA, 22 bp, Homo sapiens
atcagtctgtgttagaaaagag

SEQ ID NO: 10023832 - DNA, 22 bp, Homo sapiens
agcttttagtacgttaaaattg

SEQ ID NO: 10023833 - DNA, 20 bp, Homo sapiens
acatgaaaggaaacaggaaa

SEQ ID NO: 10023834 - DNA, 22 bp, Homo sapiens
acatgaaaagactatctgatta

SEQ ID NO: 10023835 - DNA, 22 bp, Homo sapiens
agactgtaattgacatgtcagc

SEQ ID NO: 10023836 - DNA, 22 bp, Homo sapiens
agactgtaatttgtggcctcct

SEQ ID NO: 10023837 - DNA, 22 bp, Homo sapiens
agactgtactttctgcagctct

SEQ ID NO: 10023838 - DNA, 22 bp, Homo sapiens
agactgtagggatagaggtctt

SEQ ID NO: 10023839 - DNA, 17 bp, Homo sapiens
agcactaaaatgcttcc

SEQ ID NO: 10023840 - DNA, 22 bp, Homo sapiens
acaggtccttataagagcactc

SEQ ID NO: 10023841 - DNA, 22 bp, Homo sapiens
aatgtacatctcagtgtagtac

SEQ ID NO: 10023842 - DNA, 22 bp, Homo sapiens
acaaaaagctccattactgtcc

SEQ ID NO: 10023843 - DNA, 22 bp, Homo sapiens
aacattaattacagtcaaacat

SEQ ID NO: 10023844 - DNA, 22 bp, Homo sapiens
aacaacttgcgttcagagatgt

SEQ ID NO: 10023845 - DNA, 22 bp, Homo sapiens
aagaatgttcattaaactgttg

SEQ ID NO: 10023846 - DNA, 22 bp, Homo sapiens
aagaaagtgggtaatatgattt

SEQ ID NO: 10023847 - DNA, 22 bp, Homo sapiens
aaatatgtaagattagcactag

SEQ ID NO: 10023848 - DNA, 22 bp, Homo sapiens
aaacttgatttagaactaaggc

SEQ ID NO: 10023849 - DNA, 22 bp, Homo sapiens
aaagaacttatcctagaatttg

SEQ ID NO: 10023850 - DNA, 22 bp, Homo sapiens
aaaaactgtaattacttttgca

SEQ ID NO: 10023851 - DNA, 22 bp, Homo sapiens
aaaaactggtaactattcccca

SEQ ID NO: 10023852 - DNA, 22 bp, Homo sapiens
aaacaacttctgcactatgggt

SEQ ID NO: 10023853 - DNA, 22 bp, Homo sapiens
aacactgtactggaagatggac

SEQ ID NO: 10023854 - DNA, 22 bp, Homo sapiens
aacaagtaagtttatatatatt

SEQ ID NO: 10023855 - DNA, 22 bp, Homo sapiens
aagaattttccagcatgtcagt

SEQ ID NO: 10023856 - DNA, 22 bp, Homo sapiens
acaactgtcagtaaagaatatt

SEQ ID NO: 10023857 - DNA, 22 bp, Homo sapiens
acagatcctggttacagccatt

SEQ ID NO: 10023858 - DNA, 22 bp, Homo sapiens
acactacaatctcagaactata

SEQ ID NO: 10023859 - DNA, 22 bp, Homo sapiens
tatatgtgtggattcttgtaga

SEQ ID NO: 10023860 - DNA, 22 bp, Homo sapiens
tagcatttggacattgtcacct

SEQ ID NO: 10023861 - DNA, 22 bp, Homo sapiens
tagcatttggcaccagttattt

SEQ ID NO: 10023862 - DNA, 22 bp, Homo sapiens
tagcatttcactgatcttcact

SEQ ID NO: 10023863 - DNA, 22 bp, Homo sapiens
tagcatttcccaaatgcatttg

SEQ ID NO: 10023864 - DNA, 22 bp, Homo sapiens
gtgttaaccagctaaactttgc

SEQ ID NO: 10023865 - DNA, 22 bp, Homo sapiens
tacaggaagcactcaagaaatg

SEQ ID NO: 10023866 - DNA, 22 bp, Homo sapiens
cctgtacaagctcttggtgaca

SEQ ID NO: 10023867 - DNA, 22 bp, Homo sapiens
cctgtacaagagccatctggat

SEQ ID NO: 10023868 - DNA, 22 bp, Homo sapiens
cctgtacacggtctatgcctcc

SEQ ID NO: 10023869 - DNA, 22 bp, Homo sapiens
cctgtacacaattccgaggata

SEQ ID NO: 10023870 - DNA, 22 bp, Homo sapiens
cctgtacagtgaatgaatgtga

SEQ ID NO: 10023871 - DNA, 22 bp, Homo sapiens
cctgtacattagctgtgaattg

SEQ ID NO: 10023872 - DNA, 19 bp, Homo sapiens
cctgtacattattctcccc

SEQ ID NO: 10023873 - DNA, 22 bp, Homo sapiens
cctgtacatggccatctttacc

SEQ ID NO: 10023874 - DNA, 22 bp, Homo sapiens
cctgtacatctgctctcattgc

SEQ ID NO: 10023875 - DNA, 22 bp, Homo sapiens
ttctaccattgggaaaacagcc

SEQ ID NO: 10023876 - DNA, 22 bp, Homo sapiens
ttctaccagctactcactgata

SEQ ID NO: 10023877 - DNA, 22 bp, Homo sapiens
ttctaccagaccccagacttgt

SEQ ID NO: 10023878 - DNA, 22 bp, Homo sapiens
ttctacactcacccagctgtaa

SEQ ID NO: 10023879 - DNA, 21 bp, Homo sapiens
ttctacaggatgaatgaaaac

SEQ ID NO: 10023880 - DNA, 22 bp, Homo sapiens
tttatatccatctttgaagtaa

SEQ ID NO: 10023881 - DNA, 22 bp, Homo sapiens
ctgaaacattgcaataacaaag

SEQ ID NO: 10023882 - DNA, 22 bp, Homo sapiens
ctgtaaaactgcttaagtatgc

SEQ ID NO: 10023883 - DNA, 22 bp, Homo sapiens
ctgtaaaacactgtagtatctg

SEQ ID NO: 10023884 - DNA, 22 bp, Homo sapiens
ctgtacagagttctgagtgtac

SEQ ID NO: 10023885 - DNA, 22 bp, Homo sapiens
ctgtacataaaggaataggtgt

SEQ ID NO: 10023886 - DNA, 22 bp, Homo sapiens
ctgtacaggtcaatgataagat

SEQ ID NO: 10023887 - DNA, 22 bp, Homo sapiens
catttctaagaaggctgcacat

SEQ ID NO: 10023888 - DNA, 22 bp, Homo sapiens
catttctagacaagtcctggag

SEQ ID NO: 10023889 - DNA, 22 bp, Homo sapiens
catttctagggatcataaagta

SEQ ID NO: 10023890 - DNA, 22 bp, Homo sapiens
catttctacagcttcttcagaa

SEQ ID NO: 10023891 - DNA, 21 bp, Homo sapiens
catttctattgatgagaaaag

SEQ ID NO: 10023892 - DNA, 22 bp, Homo sapiens
catttctatggcaatgggaaaa

SEQ ID NO: 10023893 - DNA, 23 bp, Homo sapiens
catgtacacacagctgtacagtg

SEQ ID NO: 10023894 - DNA, 22 bp, Homo sapiens
tgaaacaaatttggaaaatcta

SEQ ID NO: 10023895 - DNA, 22 bp, Homo sapiens
tgaaacaagggaccgtcctttc

SEQ ID NO: 10023896 - DNA, 22 bp, Homo sapiens
tcttacagaaaatagataacat

SEQ ID NO: 10023897 - DNA, 22 bp, Homo sapiens
ttgtatatattcttaaagatgt

SEQ ID NO: 10023898 - DNA, 22 bp, Homo sapiens
cagtctctgtgccagatcctgg

SEQ ID NO: 10023899 - DNA, 22 bp, Homo sapiens
atacaagatcactccagaaaat

SEQ ID NO: 10023900 - DNA, 22 bp, Homo sapiens
atacaagactcagcacagacgg

SEQ ID NO: 10023901 - DNA, 22 bp, Homo sapiens
ataatacatggttgatcttttc

SEQ ID NO: 10023902 - DNA, 22 bp, Homo sapiens
gctgtacaaattccacaagaga

SEQ ID NO: 10023903 - DNA, 22 bp, Homo sapiens
gctgtacaaggcctctgccatc

SEQ ID NO: 10023904 - DNA, 22 bp, Homo sapiens
atttctacagtacacatgcatt

SEQ ID NO: 10023905 - DNA, 22 bp, Homo sapiens
caaaaactgcaattacttttac

SEQ ID NO: 10023906 - DNA, 22 bp, Homo sapiens
caaaactgtctagagagagaag

SEQ ID NO: 10023907 - DNA, 22 bp, Homo sapiens
caaactgttctctgtgggattc

SEQ ID NO: 10023908 - DNA, 22 bp, Homo sapiens
cttggtcatttcttgtcctgtt

SEQ ID NO: 10023909 - DNA, 22 bp, Homo sapiens
cttggtcatttggggctgctat

SEQ ID NO: 10023910 - DNA, 22 bp, Homo sapiens
attaaacaatgtaaagttcttg

SEQ ID NO: 10023911 - DNA, 22 bp, Homo sapiens
atttattattgtggttacttct

SEQ ID NO: 10023912 - DNA, 22 bp, Homo sapiens
atttaacaagacagagaactgg

SEQ ID NO: 10023913 - DNA, 22 bp, Homo sapiens
agcaaacagtgtgctaagaaat

SEQ ID NO: 10023914 - DNA, 22 bp, Homo sapiens
cacagtccagactcctggagtt

SEQ ID NO: 10023915 - DNA, 22 bp, Homo sapiens
agcataaaggtcaacgttttag

SEQ ID NO: 10023916 - DNA, 22 bp, Homo sapiens
acataaaggtgactaacatctt

SEQ ID NO: 10023917 - DNA, 22 bp, Homo sapiens
acaggcctcaagacacccaggt

SEQ ID NO: 10023918 - DNA, 22 bp, Homo sapiens
agtttctaacatatagcattgg

SEQ ID NO: 10023919 - DNA, 22 bp, Homo sapiens
actaaaaactactgccaatagc

SEQ ID NO: 10023920 - DNA, 20 bp, Homo sapiens
actggacactgaggtgagct

SEQ ID NO: 10023921 - DNA, 22 bp, Homo sapiens
aagactgtctgggacaagatga

SEQ ID NO: 10023922 - DNA, 22 bp, Homo sapiens
aagactgtgtctatggctactc

SEQ ID NO: 10023923 - DNA, 22 bp, Homo sapiens
aagactgtatgagacaatataa

SEQ ID NO: 10023924 - DNA, 22 bp, Homo sapiens
aagactgtacattttccagtct

SEQ ID NO: 10023925 - DNA, 22 bp, Homo sapiens
aactgtaaaggttgagtggtaa

SEQ ID NO: 10023926 - DNA, 22 bp, Homo sapiens
aactgtaagacaaatgacttct

SEQ ID NO: 10023927 - DNA, 22 bp, Homo sapiens
aactgtaaggcttagaacagca

SEQ ID NO: 10023928 - DNA, 22 bp, Homo sapiens
aactgtacgataataaatttgt

SEQ ID NO: 10023929 - DNA, 22 bp, Homo sapiens
aactgtaatttttacatagtaa

SEQ ID NO: 10023930 - DNA, 22 bp, Homo sapiens
aactgtaatgaattgttcatga

SEQ ID NO: 10023931 - DNA, 22 bp, Homo sapiens
aacactgtggtcttttcagtaa

SEQ ID NO: 10023932 - DNA, 20 bp, Homo sapiens
aacactgtgcgtggtaggtg

SEQ ID NO: 10023933 - DNA, 22 bp, Homo sapiens
aaagactgggactgcagcaggc

SEQ ID NO: 10023934 - DNA, 22 bp, Homo sapiens
aaagactggtgtgttacatata

SEQ ID NO: 10023935 - DNA, 22 bp, Homo sapiens
aaagactgcaaaaacgcacaga

SEQ ID NO: 10023936 - DNA, 23 bp, Homo sapiens
aaagactgctgagaattttagga

SEQ ID NO: 10023937 - DNA, 22 bp, Homo sapiens
aaactgtaaatactagtaagtg

SEQ ID NO: 10023938 - DNA, 22 bp, Homo sapiens
aaactgtaaagcaggtgagtag

SEQ ID NO: 10023939 - DNA, 22 bp, Homo sapiens
aaactgtaggagggaaaggaag

SEQ ID NO: 10023940 - DNA, 22 bp, Homo sapiens
aaactgtaagagaataaactac

SEQ ID NO: 10023941 - DNA, 22 bp, Homo sapiens
aaaaactgcaattacttttgtc

SEQ ID NO: 10023942 - DNA, 22 bp, Homo sapiens
aaaactgtatcttcttgggact

SEQ ID NO: 10023943 - DNA, 22 bp, Homo sapiens
aaaactgtaggaattgggtgcc

SEQ ID NO: 10023944 - DNA, 22 bp, Homo sapiens
aaacactagcaggaagcactga

SEQ ID NO: 10023945 - DNA, 22 bp, Homo sapiens
aacatgaaaacctccacagcaa

SEQ ID NO: 10023946 - DNA, 22 bp, Homo sapiens
aacatgtagcagaaacgactaa

SEQ ID NO: 10023947 - DNA, 20 bp, Homo sapiens
aagaaacttgaaagtacaag

SEQ ID NO: 10023948 - DNA, 22 bp, Homo sapiens
aagaaactgaaagtggcttcat

SEQ ID NO: 10023949 - DNA, 22 bp, Homo sapiens
aagaaactgttgcgtgacagcg

SEQ ID NO: 10023950 - DNA, 21 bp, Homo sapiens
acagcagagatcaagactaag

SEQ ID NO: 10023951 - DNA, 22 bp, Homo sapiens
acatttcttccctttagcagaa

SEQ ID NO: 10023952 - DNA, 22 bp, Homo sapiens
acatttcttagcctagttccag

SEQ ID NO: 10023953 - DNA, 22 bp, Homo sapiens
acatttcttccacatgctgctg

SEQ ID NO: 10023954 - DNA, 22 bp, Homo sapiens
acatttctgtcttagggactgt

SEQ ID NO: 10023955 - DNA, 22 bp, Homo sapiens
acatttctgctagaataggtga

SEQ ID NO: 10023956 - DNA, 22 bp, Homo sapiens
acatttctgagcagggagctgt

SEQ ID NO: 10023957 - DNA, 22 bp, Homo sapiens
acatttctgcatgtagggtaat

SEQ ID NO: 10023958 - DNA, 22 bp, Homo sapiens
actgttcatttgtcctgtatct

SEQ ID NO: 10023959 - DNA, 22 bp, Homo sapiens
actgttcatttggatttctctg

SEQ ID NO: 10023960 - DNA, 22 bp, Homo sapiens
actatacattgaatgttaaggt

SEQ ID NO: 10023961 - DNA, 22 bp, Homo sapiens
actgatacatctgtggaagtgg

SEQ ID NO: 10023962 - DNA, 22 bp, Homo sapiens
acaagattttatgactcttttt

SEQ ID NO: 10023963 - DNA, 22 bp, Homo sapiens
acagacaagtagttcagacaag

SEQ ID NO: 10023964 - DNA, 22 bp, Homo sapiens
acagactgtttggttcatgtct

SEQ ID NO: 10023965 - DNA, 22 bp, Homo sapiens
gaactgtataggagcagtgttt

SEQ ID NO: 10023966 - DNA, 22 bp, Homo sapiens
gactgtacgtcattgaaggcca

SEQ ID NO: 10023967 - DNA, 22 bp, Homo sapiens
gactgtacttgagagaggaact

SEQ ID NO: 10023968 - DNA, 22 bp, Homo sapiens
ttggccacactcactagagccc

SEQ ID NO: 10023969 - DNA, 22 bp, Homo sapiens
ttttattctcaagacaatggga

SEQ ID NO: 10023970 - DNA, 22 bp, Homo sapiens
taaaaagtagtgagaatggcgc

SEQ ID NO: 10023971 - DNA, 19 bp, Homo sapiens
taaaaactgaaggaagcag

SEQ ID NO: 10023972 - DNA, 22 bp, Homo sapiens
caggaatgacccaacagtttca

SEQ ID NO: 10023973 - DNA, 22 bp, Homo sapiens
cagtttctctcatacatatttg

SEQ ID NO: 10023974 - DNA, 22 bp, Homo sapiens
tatctgcatctgcatgtgtatt

SEQ ID NO: 10023975 - DNA, 22 bp, Homo sapiens
catttacttaaatctttacaag

SEQ ID NO: 10023976 - DNA, 22 bp, Homo sapiens
tcttattattgttgtaaaagca

SEQ ID NO: 10023977 - DNA, 22 bp, Homo sapiens
tctgtacatttggggaccccag

SEQ ID NO: 10023978 - DNA, 22 bp, Homo sapiens
tctgtacatttgtgttgtgaat

SEQ ID NO: 10023979 - DNA, 23 bp, Homo sapiens
tctgtacacatcagcatctccca

SEQ ID NO: 10023980 - DNA, 23 bp, Homo sapiens
tctgtacaattgagaagagaaca

SEQ ID NO: 10023981 - DNA, 22 bp, Homo sapiens
tctgtacaccaggggccattct

SEQ ID NO: 10023982 - DNA, 20 bp, Homo sapiens
tctgtacactcatcttctgc

SEQ ID NO: 10023983 - DNA, 22 bp, Homo sapiens
tctgtacacttcagcatgcatc

SEQ ID NO: 10023984 - DNA, 22 bp, Homo sapiens
tctgtacatgagttgagaatca

SEQ ID NO: 10023985 - DNA, 21 bp, Homo sapiens
tctgtacatcattgagtcccc

SEQ ID NO: 10023986 - DNA, 22 bp, Homo sapiens
tctgtacagtaccagatagtaa

SEQ ID NO: 10023987 - DNA, 22 bp, Homo sapiens
tctgtacaacaaagggatgaga

SEQ ID NO: 10023988 - DNA, 22 bp, Homo sapiens
tctgtacaaaggctatttggag

SEQ ID NO: 10023989 - DNA, 21 bp, Homo sapiens
tctgagaacttctgctgcagc

SEQ ID NO: 10023990 - DNA, 22 bp, Homo sapiens
tctgaaaatgttgactttgttt

SEQ ID NO: 10023991 - DNA, 22 bp, Homo sapiens
tctaccactaagtgtgctttga

SEQ ID NO: 10023992 - DNA, 22 bp, Homo sapiens
tctaccacttattagctctgtg

SEQ ID NO: 10023993 - DNA, 22 bp, Homo sapiens
tcttttattaggctgaaatggg

SEQ ID NO: 10023994 - DNA, 22 bp, Homo sapiens
tcttttatctgttgtgtaacaa

SEQ ID NO: 10023995 - DNA, 22 bp, Homo sapiens
tgaaacaaaccagtaattttgt

SEQ ID NO: 10023996 - DNA, 19 bp, Homo sapiens
tgaaacaaacttaaaagga

SEQ ID NO: 10023997 - DNA, 22 bp, Homo sapiens
tgaaacaaaagtatgtagcttg

SEQ ID NO: 10023998 - DNA, 22 bp, Homo sapiens
tgatcagtgttggttctatcta

SEQ ID NO: 10023999 - DNA, 22 bp, Homo sapiens
ttagatcttaggcaaatgtgtt

SEQ ID NO: 10024000 - DNA, 22 bp, Homo sapiens
tgtaacaaaataccttggattg

SEQ ID NO: 10024001 - DNA, 22 bp, Homo sapiens
tgctcagtgagtctgtgacagg

SEQ ID NO: 10024002 - DNA, 22 bp, Homo sapiens
tgggaatgtgagcattcattca

SEQ ID NO: 10024003 - DNA, 22 bp, Homo sapiens
acagagagctgtgattgagtta

SEQ ID NO: 10024004 - DNA, 22 bp, Homo sapiens
acacagagtttgacacatggga

SEQ ID NO: 10024005 - DNA, 22 bp, Homo sapiens
acacagatgcattacacatcta

SEQ ID NO: 10024006 - DNA, 21 bp, Homo sapiens
acacagaggcatcatcacttt

SEQ ID NO: 10024007 - DNA, 22 bp, Homo sapiens
acactctgtaatgtcacactcc

SEQ ID NO: 10024008 - DNA, 22 bp, Homo sapiens
acactctcagcttttcaactta

SEQ ID NO: 10024009 - DNA, 22 bp, Homo sapiens
acactcaccctcccactgcctg

SEQ ID NO: 10024010 - DNA, 22 bp, Homo sapiens
acaacatttccatttccttggt

SEQ ID NO: 10024011 - DNA, 22 bp, Homo sapiens
acaaaggcatagtgaatgtttt

SEQ ID NO: 10024012 - DNA, 22 bp, Homo sapiens
aatggcagaggcaaagatggta

SEQ ID NO: 10024013 - DNA, 22 bp, Homo sapiens
aattaaaaaaggagagcttgct

SEQ ID NO: 10024014 - DNA, 22 bp, Homo sapiens
agagccaggctctacctgggtt

SEQ ID NO: 10024015 - DNA, 22 bp, Homo sapiens
actgcactccaacctgggtgac

SEQ ID NO: 10024016 - DNA, 22 bp, Homo sapiens
actgcactccagcctgggtaac

SEQ ID NO: 10024017 - DNA, 22 bp, Homo sapiens
actggagctgagagcatgggta

SEQ ID NO: 10024018 - DNA, 22 bp, Homo sapiens
aagtctctgatgtgtgttaggt

SEQ ID NO: 10024019 - DNA, 22 bp, Homo sapiens
actgggctgcctggttcttcta

SEQ ID NO: 10024020 - DNA, 22 bp, Homo sapiens
actgggctgtaaagagaggcaa

SEQ ID NO: 10024021 - DNA, 22 bp, Homo sapiens
actgggctgcttgagtgccttc

SEQ ID NO: 10024022 - DNA, 22 bp, Homo sapiens
actgggctggttagttttacta

SEQ ID NO: 10024023 - DNA, 22 bp, Homo sapiens
actgggctgttttttgagtgga

SEQ ID NO: 10024024 - DNA, 23 bp, Homo sapiens
actgggcttatgaggaggcttgt

SEQ ID NO: 10024025 - DNA, 22 bp, Homo sapiens
actgggcttatgctgtggagta

SEQ ID NO: 10024026 - DNA, 22 bp, Homo sapiens
actgggcttatttcttgtgaac

SEQ ID NO: 10024027 - DNA, 23 bp, Homo sapiens
actttattgaccccaggtcagtt

SEQ ID NO: 10024028 - DNA, 22 bp, Homo sapiens
agaaattattagtgaatagtct

SEQ ID NO: 10024029 - DNA, 22 bp, Homo sapiens
aaggctcagggtttaagtttct

SEQ ID NO: 10024030 - DNA, 22 bp, Homo sapiens
aaggctctgggtttcataggtg

SEQ ID NO: 10024031 - DNA, 22 bp, Homo sapiens
acccaggaggtggaggctgcag

SEQ ID NO: 10024032 - DNA, 22 bp, Homo sapiens
acccaggagccgtgagaggtta

SEQ ID NO: 10024033 - DNA, 22 bp, Homo sapiens
acccaggaggcaaggttgcagt

SEQ ID NO: 10024034 - DNA, 22 bp, Homo sapiens
acccaggaggcagaggttgcag

SEQ ID NO: 10024035 - DNA, 22 bp, Homo sapiens
aagcattttgccacttgaagtt

SEQ ID NO: 10024036 - DNA, 18 bp, Homo sapiens
aagctctggctaggaaaa

SEQ ID NO: 10024037 - DNA, 20 bp, Homo sapiens
aaggagaatgacacggctgc

SEQ ID NO: 10024038 - DNA, 22 bp, Homo sapiens
aaggagaatttggcttgtgatg

SEQ ID NO: 10024039 - DNA, 22 bp, Homo sapiens
aaggagaagtctgttgagattg

SEQ ID NO: 10024040 - DNA, 22 bp, Homo sapiens
aagcagctgatttcacagctca

SEQ ID NO: 10024041 - DNA, 22 bp, Homo sapiens
acacatcttagactgaaatatg

SEQ ID NO: 10024042 - DNA, 22 bp, Homo sapiens
aagacttgaccaggttgaaggc

SEQ ID NO: 10024043 - DNA, 22 bp, Homo sapiens
aatagatactacttagatgtag

SEQ ID NO: 10024044 - DNA, 22 bp, Homo sapiens
aacatctcatggactacattct

SEQ ID NO: 10024045 - DNA, 22 bp, Homo sapiens
aaccctgggaggcagctcagtt

SEQ ID NO: 10024046 - DNA, 22 bp, Homo sapiens
aacctcaggctctctggacaat

SEQ ID NO: 10024047 - DNA, 22 bp, Homo sapiens
aacccgggaggtggaggttatg

SEQ ID NO: 10024048 - DNA, 22 bp, Homo sapiens
aacccgggaggcggaggttgtg

SEQ ID NO: 10024049 - DNA, 22 bp, Homo sapiens
aacccgggaggcagaggttgtg

SEQ ID NO: 10024050 - DNA, 22 bp, Homo sapiens
aacacagatcaaaatatttcct

SEQ ID NO: 10024051 - DNA, 22 bp, Homo sapiens
aaacagataatgctataaatgg

SEQ ID NO: 10024052 - DNA, 22 bp, Homo sapiens
aaagccagagcaagctgtcaca

SEQ ID NO: 10024053 - DNA, 22 bp, Homo sapiens
aaagccagagtgtgttagagac

SEQ ID NO: 10024054 - DNA, 22 bp, Homo sapiens
aaagccaggaggagggcgctcg

SEQ ID NO: 10024055 - DNA, 22 bp, Homo sapiens
aaagccagctctgagctgcacc

SEQ ID NO: 10024056 - DNA, 22 bp, Homo sapiens
aaagaaatacctttctcagctt

SEQ ID NO: 10024057 - DNA, 22 bp, Homo sapiens
aagaacataaacagaaggacag

SEQ ID NO: 10024058 - DNA, 22 bp, Homo sapiens
aacccaggagccggaggttgtg

SEQ ID NO: 10024059 - DNA, 22 bp, Homo sapiens
aacccaggagatggaggttgtg

SEQ ID NO: 10024060 - DNA, 22 bp, Homo sapiens
aacccaggagacaggttgcagt

SEQ ID NO: 10024061 - DNA, 22 bp, Homo sapiens
aacccaggagacaggttgcagt

SEQ ID NO: 10024062 - DNA, 22 bp, Homo sapiens
aacccagggtggaggttgcagt

SEQ ID NO: 10024063 - DNA, 22 bp, Homo sapiens
aacccagggtggaggttgcagt

SEQ ID NO: 10024064 - DNA, 22 bp, Homo sapiens
aacccaggaggtggaggttgtg

SEQ ID NO: 10024065 - DNA, 22 bp, Homo sapiens
aacccaggagttggaggctgtg

SEQ ID NO: 10024066 - DNA, 22 bp, Homo sapiens
aacccaggaggcggaggttgtg

SEQ ID NO: 10024067 - DNA, 22 bp, Homo sapiens
aacccaggaggcagaggctgca

SEQ ID NO: 10024068 - DNA, 22 bp, Homo sapiens
aacccaggaggcagatgttgtg

SEQ ID NO: 10024069 - DNA, 22 bp, Homo sapiens
aaatactgctgctattcctttt

SEQ ID NO: 10024070 - DNA, 22 bp, Homo sapiens
aaatctgagaaatattgtccag

SEQ ID NO: 10024071 - DNA, 22 bp, Homo sapiens
agtggctgccaagagcaatgct

SEQ ID NO: 10024072 - DNA, 22 bp, Homo sapiens
actccaggcatctgcttctgct

SEQ ID NO: 10024073 - DNA, 22 bp, Homo sapiens
agtctgggagaaggtgagatta

SEQ ID NO: 10024074 - DNA, 22 bp, Homo sapiens
acctggagaaagcctctccctg

SEQ ID NO: 10024075 - DNA, 22 bp, Homo sapiens
aggtagcatattccagacttgt

SEQ ID NO: 10024076 - DNA, 22 bp, Homo sapiens
aggtagcaagacacctgctttt

SEQ ID NO: 10024077 - DNA, 22 bp, Homo sapiens
agggctttaatgattattttct

SEQ ID NO: 10024078 - DNA, 22 bp, Homo sapiens
agtttacccactgttgaaatta

SEQ ID NO: 10024079 - DNA, 22 bp, Homo sapiens
acttgggaaaggaagaattgca

SEQ ID NO: 10024080 - DNA, 22 bp, Homo sapiens
atagtttacaaaaatgatgcat

SEQ ID NO: 10024081 - DNA, 22 bp, Homo sapiens
atatatttgagaatattcatga

SEQ ID NO: 10024082 - DNA, 21 bp, Homo sapiens
acaggctctggggatgctggg

SEQ ID NO: 10024083 - DNA, 22 bp, Homo sapiens
acagctctgcatggcagttatt

SEQ ID NO: 10024084 - DNA, 22 bp, Homo sapiens
acagctctgtgtattgtcatct

SEQ ID NO: 10024085 - DNA, 22 bp, Homo sapiens
acagctctgttgccagatctgc

SEQ ID NO: 10024086 - DNA, 22 bp, Homo sapiens
agctggggctgcagagaacagg

SEQ ID NO: 10024087 - DNA, 21 bp, Homo sapiens
aggcaggattcaaacacagag

SEQ ID NO: 10024088 - DNA, 22 bp, Homo sapiens
aggcagcatgggccccagctcc

SEQ ID NO: 10024089 - DNA, 22 bp, Homo sapiens
aggaggaactcagaaagaaggt

SEQ ID NO: 10024090 - DNA, 22 bp, Homo sapiens
acattttttagagtcccacatt

SEQ ID NO: 10024091 - DNA, 22 bp, Homo sapiens
agggaattcactggaacgccct

SEQ ID NO: 10024092 - DNA, 22 bp, Homo sapiens
acccggagtcggaggttgcagt

SEQ ID NO: 10024093 - DNA, 22 bp, Homo sapiens
acccggcggagcctgcagtgag

SEQ ID NO: 10024094 - DNA, 22 bp, Homo sapiens
acccacacatctctaattcagt

SEQ ID NO: 10024095 - DNA, 22 bp, Homo sapiens
acccacacctccgtatatcact

SEQ ID NO: 10024096 - DNA, 22 bp, Homo sapiens
accattgcctagaaaaattcct

SEQ ID NO: 10024097 - DNA, 22 bp, Homo sapiens
aggctaggggaacactagaatc

SEQ ID NO: 10024098 - DNA, 22 bp, Homo sapiens
acatgacttttctcttccagag

SEQ ID NO: 10024099 - DNA, 22 bp, Homo sapiens
agcaggtataggaggtatcctg

SEQ ID NO: 10024100 - DNA, 22 bp, Homo sapiens
cacatccctggagttacccagt

SEQ ID NO: 10024101 - DNA, 22 bp, Homo sapiens
cagcagaggttggaacagttct

SEQ ID NO: 10024102 - DNA, 22 bp, Homo sapiens
cagcacaggtcagttttttaag

SEQ ID NO: 10024103 - DNA, 17 bp, Homo sapiens
cagaaggaagcatggca

SEQ ID NO: 10024104 - DNA, 22 bp, Homo sapiens
agcccagctttgaaccatatca

SEQ ID NO: 10024105 - DNA, 22 bp, Homo sapiens
cagacagagtcttcccatcagt

SEQ ID NO: 10024106 - DNA, 22 bp, Homo sapiens
cagacagagctcacaagtcttt

SEQ ID NO: 10024107 - DNA, 22 bp, Homo sapiens
agatgaagcctgtacttagtct

SEQ ID NO: 10024108 - DNA, 22 bp, Homo sapiens
atttaaattttctgatggagag

SEQ ID NO: 10024109 - DNA, 22 bp, Homo sapiens
agaggtagaggttgcagtgagc

SEQ ID NO: 10024110 - DNA, 22 bp, Homo sapiens
atgtttgttgaacatctactgc

SEQ ID NO: 10024111 - DNA, 22 bp, Homo sapiens
atggcagatggctggagcaggt

SEQ ID NO: 10024112 - DNA, 22 bp, Homo sapiens
atggcagatccacagtttgaag

SEQ ID NO: 10024113 - DNA, 22 bp, Homo sapiens
atggcagagggattgaacagct

SEQ ID NO: 10024114 - DNA, 20 bp, Homo sapiens
atggaggtggatgtgactgc

SEQ ID NO: 10024115 - DNA, 22 bp, Homo sapiens
atggaggtgatgttaatgatgc

SEQ ID NO: 10024116 - DNA, 19 bp, Homo sapiens
atggaggtctttatatctt

SEQ ID NO: 10024117 - DNA, 22 bp, Homo sapiens
atggaggtgccaggtgtgaggg

SEQ ID NO: 10024118 - DNA, 22 bp, Homo sapiens
atgtccagctcatgatactatc

SEQ ID NO: 10024119 - DNA, 22 bp, Homo sapiens
atgtccagccaaccactggatt

SEQ ID NO: 10024120 - DNA, 22 bp, Homo sapiens
agacacataggaccacactgtg

SEQ ID NO: 10024121 - DNA, 22 bp, Homo sapiens
cttgtttaagccgctgttaagc

SEQ ID NO: 10024122 - DNA, 22 bp, Homo sapiens
cttgttaaaatgcagattccaa

SEQ ID NO: 10024123 - DNA, 22 bp, Homo sapiens
atcttttacattactgcccaga

SEQ ID NO: 10024124 - DNA, 22 bp, Homo sapiens
cttttcacaggaggataagccc

SEQ ID NO: 10024125 - DNA, 22 bp, Homo sapiens
atgtctttattaatatcatgcc

SEQ ID NO: 10024126 - DNA, 22 bp, Homo sapiens
gaggccagggatgcaatgagag

SEQ ID NO: 10024127 - DNA, 22 bp, Homo sapiens
gaggccaggggcctggagatga

SEQ ID NO: 10024128 - DNA, 22 bp, Homo sapiens
atggaagttggaaccattcata

SEQ ID NO: 10024129 - DNA, 22 bp, Homo sapiens
atggaatgtgaacatgatggca

SEQ ID NO: 10024130 - DNA, 22 bp, Homo sapiens
atgtgttttggtggatcattca

SEQ ID NO: 10024131 - DNA, 22 bp, Homo sapiens
attaaaattccaaggtatgcca

SEQ ID NO: 10024132 - DNA, 22 bp, Homo sapiens
attattcttgaggtgtttattg

SEQ ID NO: 10024133 - DNA, 22 bp, Homo sapiens
gcagcagggtgccagctttgca

SEQ ID NO: 10024134 - DNA, 22 bp, Homo sapiens
attgcacttcagcctgggtgac

SEQ ID NO: 10024135 - DNA, 22 bp, Homo sapiens
gctgtctgccgcaggctgccac

SEQ ID NO: 10024136 - DNA, 22 bp, Homo sapiens
cacacatttcagatgctacaat

SEQ ID NO: 10024137 - DNA, 22 bp, Homo sapiens
cacaatgtatatgtatatcaaa

SEQ ID NO: 10024138 - DNA, 22 bp, Homo sapiens
cacaactttaggaaccacattc

SEQ ID NO: 10024139 - DNA, 22 bp, Homo sapiens
caacattcaaccaacatttatg

SEQ ID NO: 10024140 - DNA, 22 bp, Homo sapiens
gctgcagtgttggacctcaggg

SEQ ID NO: 10024141 - DNA, 22 bp, Homo sapiens
gctgcagtgagccaagatcgtg

SEQ ID NO: 10024142 - DNA, 22 bp, Homo sapiens
gctcctcttctcccactgaatg

SEQ ID NO: 10024143 - DNA, 22 bp, Homo sapiens
caaccccactacacgttggaga

SEQ ID NO: 10024144 - DNA, 22 bp, Homo sapiens
caaggacactccctgctgggca

SEQ ID NO: 10024145 - DNA, 22 bp, Homo sapiens
caaggacactgagctttgtaaa

SEQ ID NO: 10024146 - DNA, 22 bp, Homo sapiens
caagaggattattaataaataa

SEQ ID NO: 10024147 - DNA, 22 bp, Homo sapiens
cactgcactccagcttgggtga

SEQ ID NO: 10024148 - DNA, 22 bp, Homo sapiens
cacccacattccatcactctgc

SEQ ID NO: 10024149 - DNA, 22 bp, Homo sapiens
cacccacatggaaattcacagt

SEQ ID NO: 10024150 - DNA, 22 bp, Homo sapiens
cacactgtcaggtaaataacac

SEQ ID NO: 10024151 - DNA, 22 bp, Homo sapiens
cagaggctgctctgggtggcat

SEQ ID NO: 10024152 - DNA, 20 bp, Homo sapiens
cagaggcattttcagactct

SEQ ID NO: 10024153 - DNA, 22 bp, Homo sapiens
gggacaatggaggcctctctcc

SEQ ID NO: 10024154 - DNA, 22 bp, Homo sapiens
gtatgaaggcgagagcccacta

SEQ ID NO: 10024155 - DNA, 22 bp, Homo sapiens
gtatgaagttggactgtataaa

SEQ ID NO: 10024156 - DNA, 22 bp, Homo sapiens
gtatgaagtaagatattgttca

SEQ ID NO: 10024157 - DNA, 22 bp, Homo sapiens
cagccaagaaccacagacccag

SEQ ID NO: 10024158 - DNA, 22 bp, Homo sapiens
ataatatttgcattactgtgat

SEQ ID NO: 10024159 - DNA, 22 bp, Homo sapiens
agtttaatatccttcaactttc

SEQ ID NO: 10024160 - DNA, 22 bp, Homo sapiens
ctgcagcctcctccagctacgt

SEQ ID NO: 10024161 - DNA, 22 bp, Homo sapiens
ctgagggtcaacttgattgtat

SEQ ID NO: 10024162 - DNA, 22 bp, Homo sapiens
agttctttatatattagggata

SEQ ID NO: 10024163 - DNA, 22 bp, Homo sapiens
atcatgttcatcgtatttaggc

SEQ ID NO: 10024164 - DNA, 22 bp, Homo sapiens
ctgtcctccagacgacagtccc

SEQ ID NO: 10024165 - DNA, 22 bp, Homo sapiens
atcatgttggctctgacaaaaa

SEQ ID NO: 10024166 - DNA, 22 bp, Homo sapiens
atcatgttgtatgtaatctttt

SEQ ID NO: 10024167 - DNA, 22 bp, Homo sapiens
atccaagtcagggatagtttga

SEQ ID NO: 10024168 - DNA, 22 bp, Homo sapiens
atatgaagttacaggtaagaaa

SEQ ID NO: 10024169 - DNA, 22 bp, Homo sapiens
atatgaagtcagacaaactggg

SEQ ID NO: 10024170 - DNA, 22 bp, Homo sapiens
atatgaagaattccaatttgga

SEQ ID NO: 10024171 - DNA, 22 bp, Homo sapiens
atatgaagaatctaggataggc

SEQ ID NO: 10024172 - DNA, 22 bp, Homo sapiens
agtatcattttggcattagtat

SEQ ID NO: 10024173 - DNA, 22 bp, Homo sapiens
agtatgaacctgggttctggat

SEQ ID NO: 10024174 - DNA, 22 bp, Homo sapiens
agtatgaaagttaatcaattta

SEQ ID NO: 10024175 - DNA, 22 bp, Homo sapiens
agtatgaatctctttattctgc

SEQ ID NO: 10024176 - DNA, 22 bp, Homo sapiens
agtatgaatggaaactacctat

SEQ ID NO: 10024177 - DNA, 22 bp, Homo sapiens
agtatgaatctttcagaccgta

SEQ ID NO: 10024178 - DNA, 22 bp, Homo sapiens
agtatgaatacagattttctct

SEQ ID NO: 10024179 - DNA, 22 bp, Homo sapiens
agtatgaagattataatttttc

SEQ ID NO: 10024180 - DNA, 22 bp, Homo sapiens
agtatgaagctgaatgatttta

SEQ ID NO: 10024181 - DNA, 22 bp, Homo sapiens
agtatgaagatgatgaaaaata

SEQ ID NO: 10024182 - DNA, 22 bp, Homo sapiens
agtatgaagaatacatagatga

SEQ ID NO: 10024183 - DNA, 22 bp, Homo sapiens
agtatgaacggaaggcctggga

SEQ ID NO: 10024184 - DNA, 22 bp, Homo sapiens
ctcagctctgacaggaggcatc

SEQ ID NO: 10024185 - DNA, 22 bp, Homo sapiens
ctctgtatagaaaggaaacatt

SEQ ID NO: 10024186 - DNA, 22 bp, Homo sapiens
ctctggtttcgcaggaaataga

SEQ ID NO: 10024187 - DNA, 22 bp, Homo sapiens
ctcttgcagataccttgaagga

SEQ ID NO: 10024188 - DNA, 22 bp, Homo sapiens
ctcctgcaagcctccccaagca

SEQ ID NO: 10024189 - DNA, 22 bp, Homo sapiens
ccttgctcaagctagtgacggg

SEQ ID NO: 10024190 - DNA, 22 bp, Homo sapiens
aggtggctctgacagctctggt

SEQ ID NO: 10024191 - DNA, 20 bp, Homo sapiens
agggtctgatgtggtggccc

SEQ ID NO: 10024192 - DNA, 23 bp, Homo sapiens
cctctctccctgtttggcaaata

SEQ ID NO: 10024193 - DNA, 22 bp, Homo sapiens
cctctgcaaagaatttgtctcc

SEQ ID NO: 10024194 - DNA, 22 bp, Homo sapiens
cagtctctttatccaccaagcc

SEQ ID NO: 10024195 - DNA, 22 bp, Homo sapiens
aggagaaagactggacagccaa

SEQ ID NO: 10024196 - DNA, 22 bp, Homo sapiens
aggaagcttggggcagggctac

SEQ ID NO: 10024197 - DNA, 22 bp, Homo sapiens
aggaggaattgacacagaagcc

SEQ ID NO: 10024198 - DNA, 22 bp, Homo sapiens
aggaggaggctggagtacaccc

SEQ ID NO: 10024199 - DNA, 22 bp, Homo sapiens
aggaggaggtaagaaaagcata

SEQ ID NO: 10024200 - DNA, 22 bp, Homo sapiens
cattcccacgtgttctttgctt

SEQ ID NO: 10024201 - DNA, 22 bp, Homo sapiens
aggcagcatttctgcttatcca

SEQ ID NO: 10024202 - DNA, 22 bp, Homo sapiens
agctctgactgaagagatgcaa

SEQ ID NO: 10024203 - DNA, 22 bp, Homo sapiens
agctctgcttcttgggaagatg

SEQ ID NO: 10024204 - DNA, 21 bp, Homo sapiens
agctgcagtcaagccagaggt

SEQ ID NO: 10024205 - DNA, 22 bp, Homo sapiens
caggagtccagagtgtcatttt

SEQ ID NO: 10024206 - DNA, 22 bp, Homo sapiens
ccagtttaagacttatctcaat

SEQ ID NO: 10024207 - DNA, 22 bp, Homo sapiens
ccaggctctgacatagatggga

SEQ ID NO: 10024208 - DNA, 22 bp, Homo sapiens
ccaggctctgagcctcactctt

SEQ ID NO: 10024209 - DNA, 22 bp, Homo sapiens
ccaggctctgagaggaatgtga

SEQ ID NO: 10024210 - DNA, 22 bp, Homo sapiens
ccaggctctgcaaaatcaggct

SEQ ID NO: 10024211 - DNA, 15 bp, Homo sapiens
ccaggctctgcactc

SEQ ID NO: 10024212 - DNA, 22 bp, Homo sapiens
ccaggctctgccaggcccttga

SEQ ID NO: 10024213 - DNA, 21 bp, Homo sapiens
ccaggctcctgaggctggtca

SEQ ID NO: 10024214 - DNA, 22 bp, Homo sapiens
ccaggctctatccctccttctt

SEQ ID NO: 10024215 - DNA, 22 bp, Homo sapiens
aggctccataccatctccggag

SEQ ID NO: 10024216 - DNA, 22 bp, Homo sapiens
aggccaagattttggatcagct

SEQ ID NO: 10024217 - DNA, 22 bp, Homo sapiens
aggccaagctcccagagaagct

SEQ ID NO: 10024218 - DNA, 22 bp, Homo sapiens
aggccaagtagctagcattgaa

SEQ ID NO: 10024219 - DNA, 22 bp, Homo sapiens
ccatctccaaataccatcacat

SEQ ID NO: 10024220 - DNA, 22 bp, Homo sapiens
aggctgtgtggatgagtcttac

SEQ ID NO: 10024221 - DNA, 19 bp, Homo sapiens
ccaaaagcaattccaagta

SEQ ID NO: 10024222 - DNA, 22 bp, Homo sapiens
ccacagctgaaagcagaggctc

SEQ ID NO: 10024223 - DNA, 22 bp, Homo sapiens
ccacacagataagtgttttcta

SEQ ID NO: 10024224 - DNA, 22 bp, Homo sapiens
ccagatagaaaagaaggcagga

SEQ ID NO: 10024225 - DNA, 22 bp, Homo sapiens
ccagaggtgagggggattcttg

SEQ ID NO: 10024226 - DNA, 22 bp, Homo sapiens
ccaggaggcagaagttgcagtg

SEQ ID NO: 10024227 - DNA, 22 bp, Homo sapiens
ccagctctcaaggctccctggg

SEQ ID NO: 10024228 - DNA, 21 bp, Homo sapiens
ccagcccagctgtgtcccagc

SEQ ID NO: 10024229 - DNA, 19 bp, Homo sapiens
ccagcccacagtgactttc

SEQ ID NO: 10024230 - DNA, 19 bp, Homo sapiens
caggtcttcttggaggact

SEQ ID NO: 10024231 - DNA, 22 bp, Homo sapiens
caggtcttttctactggtggag

SEQ ID NO: 10024232 - DNA, 22 bp, Homo sapiens
caggtcttttctactggtggag

SEQ ID NO: 10024233 - DNA, 22 bp, Homo sapiens
caggtctgtttccatcagtgct

SEQ ID NO: 10024234 - DNA, 22 bp, Homo sapiens
caggtctgtttccatcagtgct

SEQ ID NO: 10024235 - DNA, 22 bp, Homo sapiens
caggtctggtgagagaacagtt

SEQ ID NO: 10024236 - DNA, 22 bp, Homo sapiens
caggggccaagggtccagacct

SEQ ID NO: 10024237 - DNA, 22 bp, Homo sapiens
catacatttatacacatctatg

SEQ ID NO: 10024238 - DNA, 22 bp, Homo sapiens
tcagctctgttttgagtggaac

SEQ ID NO: 10024239 - DNA, 22 bp, Homo sapiens
tcagctctgtgtacagttagca

SEQ ID NO: 10024240 - DNA, 22 bp, Homo sapiens
catatacacttccacctctgtg

SEQ ID NO: 10024241 - DNA, 22 bp, Homo sapiens
catcacagaaataaacatacct

SEQ ID NO: 10024242 - DNA, 22 bp, Homo sapiens
catcacaggtcctgatgacatt

SEQ ID NO: 10024243 - DNA, 22 bp, Homo sapiens
catgtcttatgcggaactttca

SEQ ID NO: 10024244 - DNA, 22 bp, Homo sapiens
catgtcttaattggagcccaga

SEQ ID NO: 10024245 - DNA, 22 bp, Homo sapiens
tcagtttataaattgtatttag

SEQ ID NO: 10024246 - DNA, 22 bp, Homo sapiens
tcatttcaatgatactactaag

SEQ ID NO: 10024247 - DNA, 22 bp, Homo sapiens
tcagtttaagatgactaacaat

SEQ ID NO: 10024248 - DNA, 22 bp, Homo sapiens
taaacatttgttattcttgttt

SEQ ID NO: 10024249 - DNA, 22 bp, Homo sapiens
caggagaagtctctagggggtg

SEQ ID NO: 10024250 - DNA, 22 bp, Homo sapiens
caggagaaggtttggagtgcag

SEQ ID NO: 10024251 - DNA, 22 bp, Homo sapiens
caggagatgtaagacttctgtt

SEQ ID NO: 10024252 - DNA, 18 bp, Homo sapiens
taaatatatttccccctt

SEQ ID NO: 10024253 - DNA, 22 bp, Homo sapiens
tacatatttgtctttgtactgt

SEQ ID NO: 10024254 - DNA, 22 bp, Homo sapiens
caggccctgggcaggcacagag

SEQ ID NO: 10024255 - DNA, 22 bp, Homo sapiens
caggcagcaggagccctgctcg

SEQ ID NO: 10024256 - DNA, 22 bp, Homo sapiens
taacaatacccattctaattac

SEQ ID NO: 10024257 - DNA, 22 bp, Homo sapiens
taacattcttaacttagaaaca

SEQ ID NO: 10024258 - DNA, 22 bp, Homo sapiens
taacattccatggatctgcaga

SEQ ID NO: 10024259 - DNA, 22 bp, Homo sapiens
taacattccctttgtgccaagg

SEQ ID NO: 10024260 - DNA, 22 bp, Homo sapiens
caggcagaaagtattctgtgta

SEQ ID NO: 10024261 - DNA, 22 bp, Homo sapiens
gtttacatgtttttctcttaca

SEQ ID NO: 10024262 - DNA, 22 bp, Homo sapiens
gtttacatgtaatgtgttattg

SEQ ID NO: 10024263 - DNA, 22 bp, Homo sapiens
gtttacatgtactcattatact

SEQ ID NO: 10024264 - DNA, 22 bp, Homo sapiens
caggaacatgttggaaagaaat

SEQ ID NO: 10024265 - DNA, 22 bp, Homo sapiens
gttctgggaaggtggacctgtt

SEQ ID NO: 10024266 - DNA, 22 bp, Homo sapiens
gtgtatgatttcaaatggctag

SEQ ID NO: 10024267 - DNA, 22 bp, Homo sapiens
gtgtatgagcctccagctgggc

SEQ ID NO: 10024268 - DNA, 22 bp, Homo sapiens
gtgtatgaggggagaatgtttt

SEQ ID NO: 10024269 - DNA, 22 bp, Homo sapiens
gtgtatgaacgaaagaatggat

SEQ ID NO: 10024270 - DNA, 18 bp, Homo sapiens
cagctgcaggctcaggac

SEQ ID NO: 10024271 - DNA, 22 bp, Homo sapiens
gtggcagggtgctcatcatgca

SEQ ID NO: 10024272 - DNA, 22 bp, Homo sapiens
gtggcaggtggagcctcctgca

SEQ ID NO: 10024273 - DNA, 22 bp, Homo sapiens
cagcccagccttgtctctttat

SEQ ID NO: 10024274 - DNA, 21 bp, Homo sapiens
cagcccagcccattgacagtg

SEQ ID NO: 10024275 - DNA, 22 bp, Homo sapiens
gtggccaggccgactgccaggc

SEQ ID NO: 10024276 - DNA, 22 bp, Homo sapiens
gtggcaggttccgtagacagca

SEQ ID NO: 10024277 - DNA, 22 bp, Homo sapiens
gtggcaggttccgtagacagca

SEQ ID NO: 10024278 - DNA, 22 bp, Homo sapiens
cagctctgctgggaggatgcag

SEQ ID NO: 10024279 - DNA, 22 bp, Homo sapiens
cagctctttgagtattccattt

SEQ ID NO: 10024280 - DNA, 22 bp, Homo sapiens
cagctcttttttgcagcagctg

SEQ ID NO: 10024281 - DNA, 22 bp, Homo sapiens
cagctctgttcatagatggtgc

SEQ ID NO: 10024282 - DNA, 22 bp, Homo sapiens
gtggcttggaccagtcacagtg

SEQ ID NO: 10024283 - DNA, 19 bp, Homo sapiens
gtgggacagacattacata

SEQ ID NO: 10024284 - DNA, 22 bp, Homo sapiens
ttttattatctttgaatgggac

SEQ ID NO: 10024285 - DNA, 22 bp, Homo sapiens
ctctgggcaagtttcttcatga

SEQ ID NO: 10024286 - DNA, 22 bp, Homo sapiens
ctctgggcactgtatgggttct

SEQ ID NO: 10024287 - DNA, 17 bp, Homo sapiens
ctctgggcagcctgggg

SEQ ID NO: 10024288 - DNA, 20 bp, Homo sapiens
ctcttttgactctttgcaag

SEQ ID NO: 10024289 - DNA, 20 bp, Homo sapiens
ctgaaccaaggctttctcag

SEQ ID NO: 10024290 - DNA, 22 bp, Homo sapiens
ctgaaccatctctgttctgtat

SEQ ID NO: 10024291 - DNA, 22 bp, Homo sapiens
ctgaaccactaatattttgatt

SEQ ID NO: 10024292 - DNA, 22 bp, Homo sapiens
ctgcagccacgagtcacagccc

SEQ ID NO: 10024293 - DNA, 22 bp, Homo sapiens
ctggcagggtgggctttgcttt

SEQ ID NO: 10024294 - DNA, 22 bp, Homo sapiens
ctggcctggggggacacatccc

SEQ ID NO: 10024295 - DNA, 22 bp, Homo sapiens
ctggaaagacctgcttgctttt

SEQ ID NO: 10024296 - DNA, 22 bp, Homo sapiens
ctggaaagggtcctcattctgt

SEQ ID NO: 10024297 - DNA, 22 bp, Homo sapiens
ctgcctggccacaacccagggt

SEQ ID NO: 10024298 - DNA, 22 bp, Homo sapiens
ctggaggcacccttagagaggc

SEQ ID NO: 10024299 - DNA, 22 bp, Homo sapiens
ctggaggtctacagtggtagct

SEQ ID NO: 10024300 - DNA, 22 bp, Homo sapiens
ctcatcaccacatataacaaag

SEQ ID NO: 10024301 - DNA, 22 bp, Homo sapiens
ctcagtttgtgtgatattgtct

SEQ ID NO: 10024302 - DNA, 22 bp, Homo sapiens
ctcagtttctgacattaaaatc

SEQ ID NO: 10024303 - DNA, 22 bp, Homo sapiens
ttgttaaagatgcagattccat

SEQ ID NO: 10024304 - DNA, 22 bp, Homo sapiens
ctccagggttccccgatccact

SEQ ID NO: 10024305 - DNA, 22 bp, Homo sapiens
ttggggtgttggatggagcaag

SEQ ID NO: 10024306 - DNA, 22 bp, Homo sapiens
ttgggtaggagaaagaacagat

SEQ ID NO: 10024307 - DNA, 22 bp, Homo sapiens
ctccagggggcatccacacagc

SEQ ID NO: 10024308 - DNA, 22 bp, Homo sapiens
tttaaatttagaagaaacactg

SEQ ID NO: 10024309 - DNA, 22 bp, Homo sapiens
ctcctctgtctaccacgagggt

SEQ ID NO: 10024310 - DNA, 22 bp, Homo sapiens
ctcctctgggtcctggtggcca

SEQ ID NO: 10024311 - DNA, 22 bp, Homo sapiens
ctcctctgtattgattgggact

SEQ ID NO: 10024312 - DNA, 22 bp, Homo sapiens
ttcccacttttacagttgtctg

SEQ ID NO: 10024313 - DNA, 22 bp, Homo sapiens
ttcccacagagattacattgaa

SEQ ID NO: 10024314 - DNA, 22 bp, Homo sapiens
ttcccacattctttacattcat

SEQ ID NO: 10024315 - DNA, 22 bp, Homo sapiens
ttcccacagtgttgaatcctct

SEQ ID NO: 10024316 - DNA, 22 bp, Homo sapiens
ctagggaatgagagactggatc

SEQ ID NO: 10024317 - DNA, 22 bp, Homo sapiens
ctagggaaataaactgagtggt

SEQ ID NO: 10024318 - DNA, 22 bp, Homo sapiens
cctggctcctgcctctgcaggg

SEQ ID NO: 10024319 - DNA, 22 bp, Homo sapiens
tgtaaacataccagagccaagt

SEQ ID NO: 10024320 - DNA, 22 bp, Homo sapiens
tgtaaacagccccatggagagc

SEQ ID NO: 10024321 - DNA, 22 bp, Homo sapiens
tgtaggctgaagatgaagtgga

SEQ ID NO: 10024322 - DNA, 22 bp, Homo sapiens
tgtaaagaaagacgcagagtta

SEQ ID NO: 10024323 - DNA, 23 bp, Homo sapiens
tgtaaacatcaccccctggagtt

SEQ ID NO: 10024324 - DNA, 22 bp, Homo sapiens
tgtaaacatatgtatgtatgta

SEQ ID NO: 10024325 - DNA, 22 bp, Homo sapiens
tgtagtagcattcacgaagtgt

SEQ ID NO: 10024326 - DNA, 22 bp, Homo sapiens
tgtgaggacattggaggactca

SEQ ID NO: 10024327 - DNA, 22 bp, Homo sapiens
tgtgaagatttggcatgcagaa

SEQ ID NO: 10024328 - DNA, 22 bp, Homo sapiens
cctggggacctgcctcagccct

SEQ ID NO: 10024329 - DNA, 22 bp, Homo sapiens
cctggggaatcttgcaggggaa

SEQ ID NO: 10024330 - DNA, 22 bp, Homo sapiens
cctggggaagtcacttctcttt

SEQ ID NO: 10024331 - DNA, 22 bp, Homo sapiens
cctggggaatagagtcaagggg

SEQ ID NO: 10024332 - DNA, 22 bp, Homo sapiens
cctgggctttgctggcaaggcc

SEQ ID NO: 10024333 - DNA, 22 bp, Homo sapiens
cctgggctttggaacagtactt

SEQ ID NO: 10024334 - DNA, 22 bp, Homo sapiens
cctggggaaaagcaggcattta

SEQ ID NO: 10024335 - DNA, 20 bp, Homo sapiens
cctgggctcaaagcatcctc

SEQ ID NO: 10024336 - DNA, 22 bp, Homo sapiens
cctgggctttgagggcaggatg

SEQ ID NO: 10024337 - DNA, 22 bp, Homo sapiens
cctgggcttccacgagcagagg

SEQ ID NO: 10024338 - DNA, 22 bp, Homo sapiens
cctgggctcaagcgatcttgtc

SEQ ID NO: 10024339 - DNA, 22 bp, Homo sapiens
cccccaaagtttgcacggataa

SEQ ID NO: 10024340 - DNA, 22 bp, Homo sapiens
tggcacagggcttggtcgctca

SEQ ID NO: 10024341 - DNA, 22 bp, Homo sapiens
tggccaggaggctgcttctgac

SEQ ID NO: 10024342 - DNA, 22 bp, Homo sapiens
gaccatcctggccaacgtggta

SEQ ID NO: 10024343 - DNA, 22 bp, Homo sapiens
gagacagagtttcactcttgtt

SEQ ID NO: 10024344 - DNA, 22 bp, Homo sapiens
gacacagagggcaccagatatg

SEQ ID NO: 10024345 - DNA, 22 bp, Homo sapiens
gacacagagctcacagtctcct

SEQ ID NO: 10024346 - DNA, 22 bp, Homo sapiens
gacacagatatctctgagatta

SEQ ID NO: 10024347 - DNA, 22 bp, Homo sapiens
gaactgagttttctgcctggac

SEQ ID NO: 10024348 - DNA, 20 bp, Homo sapiens
gaacctggggaaggagtagg

SEQ ID NO: 10024349 - DNA, 22 bp, Homo sapiens
gaacccggggaggttgcagtga

SEQ ID NO: 10024350 - DNA, 22 bp, Homo sapiens
gaacccaggaggcagaggttgc

SEQ ID NO: 10024351 - DNA, 22 bp, Homo sapiens
gaacacatgattataaatgcta

SEQ ID NO: 10024352 - DNA, 22 bp, Homo sapiens
cttgggaggagaacaaagctcc

SEQ ID NO: 10024353 - DNA, 22 bp, Homo sapiens
cttgggctctgtgggccttagt

SEQ ID NO: 10024354 - DNA, 22 bp, Homo sapiens
cttgggctcagacttgaggaca

SEQ ID NO: 10024355 - DNA, 21 bp, Homo sapiens
cttgggcttgtagatggtgga

SEQ ID NO: 10024356 - DNA, 18 bp, Homo sapiens
gatgaagctgctggggat

SEQ ID NO: 10024357 - DNA, 22 bp, Homo sapiens
gatgaagctatttggttggcac

SEQ ID NO: 10024358 - DNA, 22 bp, Homo sapiens
gatgaagctttgaagtctaatc

SEQ ID NO: 10024359 - DNA, 21 bp, Homo sapiens
gatgaagcaatctttctgttg

SEQ ID NO: 10024360 - DNA, 22 bp, Homo sapiens
gatgaagccccagtgtaagtaa

SEQ ID NO: 10024361 - DNA, 22 bp, Homo sapiens
gatgaagcctgacttctcggtg

SEQ ID NO: 10024362 - DNA, 22 bp, Homo sapiens
gatgaagctaaatctaaggttt

SEQ ID NO: 10024363 - DNA, 22 bp, Homo sapiens
gatctttgacacagtggattag

SEQ ID NO: 10024364 - DNA, 20 bp, Homo sapiens
gatacacagcacagagggcc

SEQ ID NO: 10024365 - DNA, 22 bp, Homo sapiens
gatcagagtggctagagccttg

SEQ ID NO: 10024366 - DNA, 22 bp, Homo sapiens
gagtgatgtctgtagtgaagaa

SEQ ID NO: 10024367 - DNA, 18 bp, Homo sapiens
gagtgtggcactgggccc

SEQ ID NO: 10024368 - DNA, 22 bp, Homo sapiens
gaggaggctatcagcaatcagg

SEQ ID NO: 10024369 - DNA, 22 bp, Homo sapiens
gagatatgttggcagctggtat

SEQ ID NO: 10024370 - DNA, 22 bp, Homo sapiens
gattcactcatattttacgttt

SEQ ID NO: 10024371 - DNA, 22 bp, Homo sapiens
gatgcctgcatttcaggagagt

SEQ ID NO: 10024372 - DNA, 22 bp, Homo sapiens
gcacacacatgtgagtacatgc

SEQ ID NO: 10024373 - DNA, 16 bp, Homo sapiens
gcacacacatcaatga

SEQ ID NO: 10024374 - DNA, 22 bp, Homo sapiens
gcaggagacaactgtaaggaga

SEQ ID NO: 10024375 - DNA, 22 bp, Homo sapiens
gcagctctctggcctgccctgg

SEQ ID NO: 10024376 - DNA, 22 bp, Homo sapiens
gcagctctcctctgtgaggaac

SEQ ID NO: 10024377 - DNA, 22 bp, Homo sapiens
gcagctctgacaatgcctggaa

SEQ ID NO: 10024378 - DNA, 22 bp, Homo sapiens
gcagctcttttcttaaagagat

SEQ ID NO: 10024379 - DNA, 22 bp, Homo sapiens
gccaatgacagtctcagttctg

SEQ ID NO: 10024380 - DNA, 20 bp, Homo sapiens
gccagaggccggcaggggct

SEQ ID NO: 10024381 - DNA, 22 bp, Homo sapiens
gctccaaggtatccaccagggt

SEQ ID NO: 10024382 - DNA, 22 bp, Homo sapiens
gctcctctcccagagctgcagg

SEQ ID NO: 10024383 - DNA, 22 bp, Homo sapiens
gctccaggagagggaagcagat

SEQ ID NO: 10024384 - DNA, 22 bp, Homo sapiens
gctcatgactgtaatcccagca

SEQ ID NO: 10024385 - DNA, 22 bp, Homo sapiens
gctcctgggccctgggctaact

SEQ ID NO: 10024386 - DNA, 22 bp, Homo sapiens
gctcctgggtgtggctgcccct

SEQ ID NO: 10024387 - DNA, 22 bp, Homo sapiens
gcctcctgtcccaggctgagga

SEQ ID NO: 10024388 - DNA, 22 bp, Homo sapiens
gccggggctggggagagacatg

SEQ ID NO: 10024389 - DNA, 22 bp, Homo sapiens
gcctggaatgcaatgtgacgaa

SEQ ID NO: 10024390 - DNA, 22 bp, Homo sapiens
gcctggaagtgtgtcgtgggaa

SEQ ID NO: 10024391 - DNA, 22 bp, Homo sapiens
gcctggaatcatgcaggggtta

SEQ ID NO: 10024392 - DNA, 22 bp, Homo sapiens
gtatatattggataaaccagag

SEQ ID NO: 10024393 - DNA, 22 bp, Homo sapiens
gtacacacaatctctggtcagt

SEQ ID NO: 10024394 - DNA, 22 bp, Homo sapiens
ggtggccaggccagctctggcc

SEQ ID NO: 10024395 - DNA, 22 bp, Homo sapiens
ggtggcagagaggaggtagttt

SEQ ID NO: 10024396 - DNA, 22 bp, Homo sapiens
gtggcaacaaaagagcctagtg

SEQ ID NO: 10024397 - DNA, 22 bp, Homo sapiens
gtggaggtcccgggcaggagca

SEQ ID NO: 10024398 - DNA, 20 bp, Homo sapiens
gtggcaggcagtgaaggagc

SEQ ID NO: 10024399 - DNA, 22 bp, Homo sapiens
gtggcaggggcgggctgttccg

SEQ ID NO: 10024400 - DNA, 22 bp, Homo sapiens
gtggcagggctttgctgttctt

SEQ ID NO: 10024401 - DNA, 22 bp, Homo sapiens
gtggccagccccatggacagtt

SEQ ID NO: 10024402 - DNA, 22 bp, Homo sapiens
gtggccagccagggtgctgatg

SEQ ID NO: 10024403 - DNA, 22 bp, Homo sapiens
gtggccagcaagtgctgcctct

SEQ ID NO: 10024404 - DNA, 22 bp, Homo sapiens
gtttaataatgttgaattacta

SEQ ID NO: 10024405 - DNA, 22 bp, Homo sapiens
gtgtgagggacagagaaagggg

SEQ ID NO: 10024406 - DNA, 22 bp, Homo sapiens
gttcaagaccagcctggccaac

SEQ ID NO: 10024407 - DNA, 22 bp, Homo sapiens
gtggggtgtccagcagcgagct

SEQ ID NO: 10024408 - DNA, 22 bp, Homo sapiens
gtggggtgcagcagtactgtgt

SEQ ID NO: 10024409 - DNA, 22 bp, Homo sapiens
gtggggtagatctttctcagga

SEQ ID NO: 10024410 - DNA, 18 bp, Homo sapiens
gtggggtgttgtgaggat

SEQ ID NO: 10024411 - DNA, 22 bp, Homo sapiens
gtggtttttagatttctacagt

SEQ ID NO: 10024412 - DNA, 22 bp, Homo sapiens
gtgggctggatttgcttgcaga

SEQ ID NO: 10024413 - DNA, 22 bp, Homo sapiens
gtgggcttcccttaagccagag

SEQ ID NO: 10024414 - DNA, 22 bp, Homo sapiens
gtgggcttctgttagggaggct

SEQ ID NO: 10024415 - DNA, 22 bp, Homo sapiens
gtgggctttgctggatccttcc

SEQ ID NO: 10024416 - DNA, 22 bp, Homo sapiens
gtgggctttggcctctttctcc

SEQ ID NO: 10024417 - DNA, 22 bp, Homo sapiens
gtgggcttgttttgatgagatc

SEQ ID NO: 10024418 - DNA, 22 bp, Homo sapiens
gtggggacgggatggctcactg

SEQ ID NO: 10024419 - DNA, 22 bp, Homo sapiens
gtgggcttttgacagtgcctgg

SEQ ID NO: 10024420 - DNA, 22 bp, Homo sapiens
gggcggatcacctgaggtcagg

SEQ ID NO: 10024421 - DNA, 22 bp, Homo sapiens
gggcggatcatttgaggtcagg

SEQ ID NO: 10024422 - DNA, 22 bp, Homo sapiens
gggctacattgtgagagaagtt

SEQ ID NO: 10024423 - DNA, 19 bp, Homo sapiens
gggacctgactaattggca

SEQ ID NO: 10024424 - DNA, 22 bp, Homo sapiens
gggacctgaggaggggtttcag

SEQ ID NO: 10024425 - DNA, 22 bp, Homo sapiens
gggacccaggtaatcctgtgct

SEQ ID NO: 10024426 - DNA, 22 bp, Homo sapiens
gggacctggggactccttgttc

SEQ ID NO: 10024427 - DNA, 22 bp, Homo sapiens
gggacctggtctagcactgagc

SEQ ID NO: 10024428 - DNA, 23 bp, Homo sapiens
gggacctggtaggaggtgattgg

SEQ ID NO: 10024429 - DNA, 22 bp, Homo sapiens
gggacctgggccagaggacagt

SEQ ID NO: 10024430 - DNA, 22 bp, Homo sapiens
gggacctggcgagggtcacaca

SEQ ID NO: 10024431 - DNA, 22 bp, Homo sapiens
gggacctgccattgctcacagg

SEQ ID NO: 10024432 - DNA, 22 bp, Homo sapiens
gggacctgccaaggccacccag

SEQ ID NO: 10024433 - DNA, 22 bp, Homo sapiens
gggacctgaggccctgctccac

SEQ ID NO: 10024434 - DNA, 22 bp, Homo sapiens
gggacctgcgccactcactgtc

SEQ ID NO: 10024435 - DNA, 22 bp, Homo sapiens
gggacctggacatgtgtgtgct

SEQ ID NO: 10024436 - DNA, 22 bp, Homo sapiens
gggacctggcacctttgctctg

SEQ ID NO: 10024437 - DNA, 22 bp, Homo sapiens
gggctaggcttggccagcactg

SEQ ID NO: 10024438 - DNA, 22 bp, Homo sapiens
ggggacctttccatttctgaga

SEQ ID NO: 10024439 - DNA, 22 bp, Homo sapiens
ggggacctggccacccatcctt

SEQ ID NO: 10024440 - DNA, 22 bp, Homo sapiens
ggggaccttcccagagcagttg

SEQ ID NO: 10024441 - DNA, 22 bp, Homo sapiens
ggggacctgggcttcaagggtt

SEQ ID NO: 10024442 - DNA, 22 bp, Homo sapiens
ggggacctaggctctgtctctt

SEQ ID NO: 10024443 - DNA, 22 bp, Homo sapiens
ggccagagctcaaacagtcgca

SEQ ID NO: 10024444 - DNA, 22 bp, Homo sapiens
ggccagaagttggaaaagagcc

SEQ ID NO: 10024445 - DNA, 22 bp, Homo sapiens
ggcccaaacgggtccagtgaaa

SEQ ID NO: 10024446 - DNA, 22 bp, Homo sapiens
ggcccagcctcagacatgccct

SEQ ID NO: 10024447 - DNA, 22 bp, Homo sapiens
ggctccaagtctcagagtgaag

SEQ ID NO: 10024448 - DNA, 22 bp, Homo sapiens
ggctccaaagggcagtgtgagg

SEQ ID NO: 10024449 - DNA, 22 bp, Homo sapiens
ggctgcaggcagaggctgtctg

SEQ ID NO: 10024450 - DNA, 20 bp, Homo sapiens
ggctgcaggactcattggct

SEQ ID NO: 10024451 - DNA, 22 bp, Homo sapiens
ggctgcagagctgggtgggcct

SEQ ID NO: 10024452 - DNA, 22 bp, Homo sapiens
ggctttgggccctcaagtctcc

SEQ ID NO: 10024453 - DNA, 22 bp, Homo sapiens
ggctttggtagacacagattga

SEQ ID NO: 10024454 - DNA, 22 bp, Homo sapiens
ggctttggggtgtgcagagatg

SEQ ID NO: 10024455 - DNA, 22 bp, Homo sapiens
ggaggtgggctaaggactctct

SEQ ID NO: 10024456 - DNA, 22 bp, Homo sapiens
ggaggccatgggcagaatcttt

SEQ ID NO: 10024457 - DNA, 22 bp, Homo sapiens
ggcaggctgggtgtcatggagt

SEQ ID NO: 10024458 - DNA, 22 bp, Homo sapiens
ggcaggctgggagtcatcagag

SEQ ID NO: 10024459 - DNA, 22 bp, Homo sapiens
ggcaggctggctttgttccagg

SEQ ID NO: 10024460 - DNA, 19 bp, Homo sapiens
ggcaggctggatagagagg

SEQ ID NO: 10024461 - DNA, 22 bp, Homo sapiens
ggcaggctgcttgggtcatgtc

SEQ ID NO: 10024462 - DNA, 22 bp, Homo sapiens
ggcaggctagcactgatgtcct

SEQ ID NO: 10024463 - DNA, 22 bp, Homo sapiens
ggcaggctcttggccttatgag

SEQ ID NO: 10024464 - DNA, 18 bp, Homo sapiens
ggcaggctctctgggtca

SEQ ID NO: 10024465 - DNA, 22 bp, Homo sapiens
ggcaggctccgtgttccattcc

SEQ ID NO: 10024466 - DNA, 22 bp, Homo sapiens
ggcaggctccagagccctctcc

SEQ ID NO: 10024467 - DNA, 22 bp, Homo sapiens
ggcaggctccaagcatcctatg

SEQ ID NO: 10024468 - DNA, 22 bp, Homo sapiens
ggcaggctcagcagccaaggag

SEQ ID NO: 10024469 - DNA, 22 bp, Homo sapiens
ggagtgtgggatggagctcagg

SEQ ID NO: 10024470 - DNA, 21 bp, Homo sapiens
ggcagagaagctggaagttgg

SEQ ID NO: 10024471 - DNA, 22 bp, Homo sapiens
ggcacagagctttgtcccagtt

SEQ ID NO: 10024472 - DNA, 17 bp, Homo sapiens
gcttctggagcttctgt

SEQ ID NO: 10024473 - DNA, 22 bp, Homo sapiens
gcttctggaagctgcttctgcc

SEQ ID NO: 10024474 - DNA, 22 bp, Homo sapiens
gcttctggaggagctgggctga

SEQ ID NO: 10024475 - DNA, 22 bp, Homo sapiens
gcttctggggttctggcatgct

SEQ ID NO: 10024476 - DNA, 22 bp, Homo sapiens
gcttctggtagaattcaataga

SEQ ID NO: 10024477 - DNA, 22 bp, Homo sapiens
gcttctgggcacctgaacagga

SEQ ID NO: 10024478 - DNA, 22 bp, Homo sapiens
gcttctggcagtgcagccacca

SEQ ID NO: 10024479 - DNA, 22 bp, Homo sapiens
gcttctggagtcttcagaggaa

SEQ ID NO: 10024480 - DNA, 19 bp, Homo sapiens
ggaaacaggggccagagga

SEQ ID NO: 10024481 - DNA, 22 bp, Homo sapiens
ggaagaaagcacacaaacttga

SEQ ID NO: 10024482 - DNA, 22 bp, Homo sapiens
ggaaggggtgtcgcccatggat

SEQ ID NO: 10024483 - DNA, 22 bp, Homo sapiens
gctgggctctgtcatgccttcc

SEQ ID NO: 10024484 - DNA, 22 bp, Homo sapiens
gctgggctgcgtcggggaagcc

SEQ ID NO: 10024485 - DNA, 22 bp, Homo sapiens
gctgggctgagctagacttggc

SEQ ID NO: 10024486 - DNA, 22 bp, Homo sapiens
gcttctggaagcatatgcaaga

SEQ ID NO: 10024487 - DNA, 22 bp, Homo sapiens
ggaggccaccatggagtcactt

SEQ ID NO: 10024488 - DNA, 22 bp, Homo sapiens
ggaggccagcctgaggctgagg

SEQ ID NO: 10024489 - DNA, 22 bp, Homo sapiens
ggagaaggaatattggagtagg

SEQ ID NO: 10024490 - DNA, 21 bp, Homo sapiens
ggagaaggacaatgttgagta

SEQ ID NO: 10024491 - DNA, 17 bp, Homo sapiens
ggagatctggcagaggg

SEQ ID NO: 10024492 - DNA, 22 bp, Homo sapiens
tggctttatgtgttacgaaaat

SEQ ID NO: 10024493 - DNA, 22 bp, Homo sapiens
tggctggagcattccttgtctt

SEQ ID NO: 10024494 - DNA, 22 bp, Homo sapiens
tggcgtctctcataagtatgtg

SEQ ID NO: 10024495 - DNA, 23 bp, Homo sapiens
tggcaactagtggtgaagagcct

SEQ ID NO: 10024496 - DNA, 22 bp, Homo sapiens
tggattgggtgctgaagcatag

SEQ ID NO: 10024497 - DNA, 22 bp, Homo sapiens
tggcagagcccagactccagtc

SEQ ID NO: 10024498 - DNA, 22 bp, Homo sapiens
tggcagagagagtgcagtcgac

SEQ ID NO: 10024499 - DNA, 22 bp, Homo sapiens
tggcagagagactctccttgat

SEQ ID NO: 10024500 - DNA, 22 bp, Homo sapiens
tggcagagaacacggctgatct

SEQ ID NO: 10024501 - DNA, 22 bp, Homo sapiens
tggcagagaacacacatgattc

SEQ ID NO: 10024502 - DNA, 22 bp, Homo sapiens
tggcagagtcatcacatctgga

SEQ ID NO: 10024503 - DNA, 22 bp, Homo sapiens
tggcagggcctaccccaatatc

SEQ ID NO: 10024504 - DNA, 22 bp, Homo sapiens
tggcaggcaagttcagctccac

SEQ ID NO: 10024505 - DNA, 22 bp, Homo sapiens
tggcatgggcaaaccagggaaa

SEQ ID NO: 10024506 - DNA, 19 bp, Homo sapiens
tggccaggtactgtctgct

SEQ ID NO: 10024507 - DNA, 23 bp, Homo sapiens
tggccaggtagaggaggtagtga

SEQ ID NO: 10024508 - DNA, 22 bp, Homo sapiens
tggccaggttgggctttgcagc

SEQ ID NO: 10024509 - DNA, 23 bp, Homo sapiens
tggccagggtactacacccaccc

SEQ ID NO: 10024510 - DNA, 22 bp, Homo sapiens
tggccaggctggtctggaacgc

SEQ ID NO: 10024511 - DNA, 22 bp, Homo sapiens
tggccaggcctcttggtgccca

SEQ ID NO: 10024512 - DNA, 22 bp, Homo sapiens
tgctctgtattctatggcagtt

SEQ ID NO: 10024513 - DNA, 22 bp, Homo sapiens
tgctgagcgcatccggcggccg

SEQ ID NO: 10024514 - DNA, 22 bp, Homo sapiens
tgcttctgagttgcaggacttg

SEQ ID NO: 10024515 - DNA, 22 bp, Homo sapiens
tgcttctgatgtgagcagcccc

SEQ ID NO: 10024516 - DNA, 22 bp, Homo sapiens
tgcttctgattcatggttattg

SEQ ID NO: 10024517 - DNA, 22 bp, Homo sapiens
tgcttctgcaacttgaatgtac

SEQ ID NO: 10024518 - DNA, 22 bp, Homo sapiens
tgcttctgcaggagctcctgat

SEQ ID NO: 10024519 - DNA, 22 bp, Homo sapiens
tgcttctgctcagcttcctact

SEQ ID NO: 10024520 - DNA, 22 bp, Homo sapiens
tgcttctgcattcaatgttgga

SEQ ID NO: 10024521 - DNA, 22 bp, Homo sapiens
tgcttctgacatgttcttggtt

SEQ ID NO: 10024522 - DNA, 22 bp, Homo sapiens
tgcttctgactaagctgcatga

SEQ ID NO: 10024523 - DNA, 22 bp, Homo sapiens
tgcttctgactgggtcagttga

SEQ ID NO: 10024524 - DNA, 22 bp, Homo sapiens
tgcttctgaagtggatgggtgc

SEQ ID NO: 10024525 - DNA, 22 bp, Homo sapiens
tgcttctgaactcagcatgtgg

SEQ ID NO: 10024526 - DNA, 22 bp, Homo sapiens
tgcttctgaaatgcaggtcttc

SEQ ID NO: 10024527 - DNA, 22 bp, Homo sapiens
tgctttaaaatggactgttttg

SEQ ID NO: 10024528 - DNA, 22 bp, Homo sapiens
tgcttctggggacaggctgcct

SEQ ID NO: 10024529 - DNA, 19 bp, Homo sapiens
tgcttctggggcttctcca

SEQ ID NO: 10024530 - DNA, 22 bp, Homo sapiens
tgcttctggcttatctcgtgcc

SEQ ID NO: 10024531 - DNA, 22 bp, Homo sapiens
tgcttctgggcctggtgttccc

SEQ ID NO: 10024532 - DNA, 22 bp, Homo sapiens
tgcttctgggcaaatgtgtgtg

SEQ ID NO: 10024533 - DNA, 22 bp, Homo sapiens
tgcttctggaaacagtggctgt

SEQ ID NO: 10024534 - DNA, 19 bp, Homo sapiens
tgcttctggaaccatgatc

SEQ ID NO: 10024535 - DNA, 22 bp, Homo sapiens
tgcttctgctttacttggttca

SEQ ID NO: 10024536 - DNA, 22 bp, Homo sapiens
tgcttctgctgatattttgtga

SEQ ID NO: 10024537 - DNA, 19 bp, Homo sapiens
tgcttctggaatgcaaggc

SEQ ID NO: 10024538 - DNA, 22 bp, Homo sapiens
tgcttctggcacttgagggggt

SEQ ID NO: 10024539 - DNA, 22 bp, Homo sapiens
tgcttctggcagattgagtgag

SEQ ID NO: 10024540 - DNA, 22 bp, Homo sapiens
tgcttctggagtaacagggtga

SEQ ID NO: 10024541 - DNA, 22 bp, Homo sapiens
tgcttctgggtaggcctcagga

SEQ ID NO: 10024542 - DNA, 22 bp, Homo sapiens
tgcttctgggtcccagcctggc

SEQ ID NO: 10024543 - DNA, 22 bp, Homo sapiens
tgcttctgtattttgggcttga

SEQ ID NO: 10024544 - DNA, 17 bp, Homo sapiens
tgcttctgtattgctgg

SEQ ID NO: 10024545 - DNA, 22 bp, Homo sapiens
tgcttctgtattgaaattgtta

SEQ ID NO: 10024546 - DNA, 22 bp, Homo sapiens
tgcttctgtctcttatgccttg

SEQ ID NO: 10024547 - DNA, 22 bp, Homo sapiens
tgcttctgttacataccagaac

SEQ ID NO: 10024548 - DNA, 22 bp, Homo sapiens
tgcttctgttctttcacctacg

SEQ ID NO: 10024549 - DNA, 22 bp, Homo sapiens
tgcttctgtttcattgatctta

SEQ ID NO: 10024550 - DNA, 22 bp, Homo sapiens
tgcttctgtttgtttctgtcat

SEQ ID NO: 10024551 - DNA, 22 bp, Homo sapiens
tggaaacatctctgcctttatt

SEQ ID NO: 10024552 - DNA, 22 bp, Homo sapiens
tggaacactttgttgaaatgca

SEQ ID NO: 10024553 - DNA, 22 bp, Homo sapiens
tggaacacaagtcattgagggg

SEQ ID NO: 10024554 - DNA, 22 bp, Homo sapiens
tggaacacatctaaggaagcag

SEQ ID NO: 10024555 - DNA, 22 bp, Homo sapiens
tggaacacagtgattgatagcg

SEQ ID NO: 10024556 - DNA, 22 bp, Homo sapiens
tggaacactgtggatgagaaga

SEQ ID NO: 10024557 - DNA, 22 bp, Homo sapiens
tggaacactggctttccactgt

SEQ ID NO: 10024558 - DNA, 22 bp, Homo sapiens
tggaacactgatcattgccttt

SEQ ID NO: 10024559 - DNA, 22 bp, Homo sapiens
tggaagagaaaatccaccctta

SEQ ID NO: 10024560 - DNA, 22 bp, Homo sapiens
tggaatgttgtgtataggtcag

SEQ ID NO: 10024561 - DNA, 21 bp, Homo sapiens
tggacctgtccttctcgctgt

SEQ ID NO: 10024562 - DNA, 19 bp, Homo sapiens
tggacctgtgcccatggct

SEQ ID NO: 10024563 - DNA, 22 bp, Homo sapiens
tggactggaatgctgatcctct

SEQ ID NO: 10024564 - DNA, 22 bp, Homo sapiens
tggaggcccaagattctacagc

SEQ ID NO: 10024565 - DNA, 22 bp, Homo sapiens
tggaggtggcatctgacagctg

SEQ ID NO: 10024566 - DNA, 22 bp, Homo sapiens
tggaggtggcacaagggaggtc

SEQ ID NO: 10024567 - DNA, 22 bp, Homo sapiens
tgtaaattgaaggaaatttgtg

SEQ ID NO: 10024568 - DNA, 22 bp, Homo sapiens
tgtaacactcaatctgtttaac

SEQ ID NO: 10024569 - DNA, 23 bp, Homo sapiens
tggtggttgatctggggcacagc

SEQ ID NO: 10024570 - DNA, 22 bp, Homo sapiens
tggttccttctgcattttcagc

SEQ ID NO: 10024571 - DNA, 22 bp, Homo sapiens
tgtaaaataattctccatgttt

SEQ ID NO: 10024572 - DNA, 22 bp, Homo sapiens
tgtaaaggtaggtgcaaaatga

SEQ ID NO: 10024573 - DNA, 22 bp, Homo sapiens
tggtgcttgtggagctggtgct

SEQ ID NO: 10024574 - DNA, 22 bp, Homo sapiens
tggtcctgccccgtgcacagag

SEQ ID NO: 10024575 - DNA, 22 bp, Homo sapiens
tggtcctggaaggtcctgaggg

SEQ ID NO: 10024576 - DNA, 22 bp, Homo sapiens
tgtatacatgtgttcatgcatg

SEQ ID NO: 10024577 - DNA, 22 bp, Homo sapiens
tgtatgaatgggaaaaggaaac

SEQ ID NO: 10024578 - DNA, 22 bp, Homo sapiens
tgtatgaatctcatttgtttaa

SEQ ID NO: 10024579 - DNA, 23 bp, Homo sapiens
tgtatgaatatgccacagtttaa

SEQ ID NO: 10024580 - DNA, 22 bp, Homo sapiens
tgtatgaagttactgagcctct

SEQ ID NO: 10024581 - DNA, 22 bp, Homo sapiens
tgtatgaaggtttacctgctgt

SEQ ID NO: 10024582 - DNA, 22 bp, Homo sapiens
tgtatgaagccagaatctgttt

SEQ ID NO: 10024583 - DNA, 22 bp, Homo sapiens
tgtatgaatatgtattttcata

SEQ ID NO: 10024584 - DNA, 22 bp, Homo sapiens
tgtatgaatatgttggggaggt

SEQ ID NO: 10024585 - DNA, 22 bp, Homo sapiens
tgtatgaaagaacaagggctta

SEQ ID NO: 10024586 - DNA, 22 bp, Homo sapiens
tgtatgaacctttaatatagtg

SEQ ID NO: 10024587 - DNA, 22 bp, Homo sapiens
tgtatgaagacttcttctgtgt

SEQ ID NO: 10024588 - DNA, 16 bp, Homo sapiens
tgtatgaacgtctcca

SEQ ID NO: 10024589 - DNA, 22 bp, Homo sapiens
tgtatgaaaaggaatagattga

SEQ ID NO: 10024590 - DNA, 22 bp, Homo sapiens
tgtagaagttcttcaggagaat

SEQ ID NO: 10024591 - DNA, 18 bp, Homo sapiens
tgtagagccaggtttgcc

SEQ ID NO: 10024592 - DNA, 22 bp, Homo sapiens
tgtcacagtgcacagctaagaa

SEQ ID NO: 10024593 - DNA, 22 bp, Homo sapiens
tgtcatcagggtgcaagagtta

SEQ ID NO: 10024594 - DNA, 22 bp, Homo sapiens
tgtcatcatttgagagaagaaa

SEQ ID NO: 10024595 - DNA, 22 bp, Homo sapiens
tgtccaggtggcctctgctgct

SEQ ID NO: 10024596 - DNA, 22 bp, Homo sapiens
tgggtgctctgcgaccgtaggg

SEQ ID NO: 10024597 - DNA, 22 bp, Homo sapiens
tgggggctgtgcacaggctcac

SEQ ID NO: 10024598 - DNA, 22 bp, Homo sapiens
tgggtaggaccagaaatgcact

SEQ ID NO: 10024599 - DNA, 22 bp, Homo sapiens
tgggggattgttttaatgaata

SEQ ID NO: 10024600 - DNA, 22 bp, Homo sapiens
tgggctttatcatgggtctggt

SEQ ID NO: 10024601 - DNA, 22 bp, Homo sapiens
tgggcttctgatgttgagtgct

SEQ ID NO: 10024602 - DNA, 22 bp, Homo sapiens
tgggcttctggagtggggcaga

SEQ ID NO: 10024603 - DNA, 22 bp, Homo sapiens
tgggcttcctggagcctgtgct

SEQ ID NO: 10024604 - DNA, 22 bp, Homo sapiens
tgggcttcataattggtcctag

SEQ ID NO: 10024605 - DNA, 22 bp, Homo sapiens
tgggcttaggtcggaggcggcc

SEQ ID NO: 10024606 - DNA, 22 bp, Homo sapiens
tggggaccagattagaccatgg

SEQ ID NO: 10024607 - DNA, 22 bp, Homo sapiens
tggggacccggactcctgggtc

SEQ ID NO: 10024608 - DNA, 23 bp, Homo sapiens
tgggatggattcaccagtgtgct

SEQ ID NO: 10024609 - DNA, 22 bp, Homo sapiens
tgggatggagcctgagtatagt

SEQ ID NO: 10024610 - DNA, 22 bp, Homo sapiens
tgggagtgatacagtatggaat

SEQ ID NO: 10024611 - DNA, 22 bp, Homo sapiens
tgggaggccgaggcaggtggat

SEQ ID NO: 10024612 - DNA, 22 bp, Homo sapiens
tgggagtgaggcagagtctatc

SEQ ID NO: 10024613 - DNA, 22 bp, Homo sapiens
tgggccagcaattgctgctcag

SEQ ID NO: 10024614 - DNA, 22 bp, Homo sapiens
tgggccagctgaagtgccgccc

SEQ ID NO: 10024615 - DNA, 22 bp, Homo sapiens
tgggcagggagctggaaccaca

SEQ ID NO: 10024616 - DNA, 22 bp, Homo sapiens
tgggccaggcatgtgatcagca

SEQ ID NO: 10024617 - DNA, 22 bp, Homo sapiens
tgggccaggtctgtgtcagctg

SEQ ID NO: 10024618 - DNA, 22 bp, Homo sapiens
tgggctcagtctgcttggtcct

SEQ ID NO: 10024619 - DNA, 22 bp, Homo sapiens
tgggctctcaaagtgcggcttg

SEQ ID NO: 10024620 - DNA, 22 bp, Homo sapiens
tgggctgaacttcatctgatga

SEQ ID NO: 10024621 - DNA, 22 bp, Homo sapiens
tgggctgagagtaccttataaa

SEQ ID NO: 10024622 - DNA, 22 bp, Homo sapiens
tgggctgaaatgctgtggacta

SEQ ID NO: 10024623 - DNA, 22 bp, Homo sapiens
tgggctgagcactgaggaagga

SEQ ID NO: 10024624 - DNA, 22 bp, Homo sapiens
tgggctgaggggccttgatgac

SEQ ID NO: 10024625 - DNA, 22 bp, Homo sapiens
tgggctgagtggcagccagagt

SEQ ID NO: 10024626 - DNA, 20 bp, Homo sapiens
tgggctgaggatcaggtgcc

SEQ ID NO: 10024627 - DNA, 22 bp, Homo sapiens
tgggctgagcagtgaagctcat

SEQ ID NO: 10024628 - DNA, 22 bp, Homo sapiens
tgggctgagtgtggaactagtt

SEQ ID NO: 10024629 - DNA, 22 bp, Homo sapiens
ttagaaaggttttgctctgaaa

SEQ ID NO: 10024630 - DNA, 22 bp, Homo sapiens
ttagatgaacagtcacttcccc

SEQ ID NO: 10024631 - DNA, 22 bp, Homo sapiens
ttatgaagttcctgttacagtg

SEQ ID NO: 10024632 - DNA, 19 bp, Homo sapiens
ttatgaaggctggggggag

SEQ ID NO: 10024633 - DNA, 22 bp, Homo sapiens
ttatgaaggatcaggtacttgg

SEQ ID NO: 10024634 - DNA, 22 bp, Homo sapiens
ttaatacaagcatatgcacaca

SEQ ID NO: 10024635 - DNA, 22 bp, Homo sapiens
ttaatacaactgttgtcactgg

SEQ ID NO: 10024636 - DNA, 22 bp, Homo sapiens
ttacagaaaagggctttaagag

SEQ ID NO: 10024637 - DNA, 22 bp, Homo sapiens
ttcacatttgaaaggaaagata

SEQ ID NO: 10024638 - DNA, 22 bp, Homo sapiens
ttccagcccgcgacttgttcag

SEQ ID NO: 10024639 - DNA, 22 bp, Homo sapiens
ttccagccatggtttccctatg

SEQ ID NO: 10024640 - DNA, 22 bp, Homo sapiens
ttccagctaactcacatccctt

SEQ ID NO: 10024641 - DNA, 22 bp, Homo sapiens
tgtgataagttaaattaaacct

SEQ ID NO: 10024642 - DNA, 23 bp, Homo sapiens
tgtctggagcctgagcaggtgct

SEQ ID NO: 10024643 - DNA, 22 bp, Homo sapiens
tgttaaatgtattatgtgttct

SEQ ID NO: 10024644 - DNA, 22 bp, Homo sapiens
tgtttaaatagaacatactgca

SEQ ID NO: 10024645 - DNA, 22 bp, Homo sapiens
tgtttatagggtctgtcacttg

SEQ ID NO: 10024646 - DNA, 22 bp, Homo sapiens
ttaaaactgcaaatcctactga

SEQ ID NO: 10024647 - DNA, 23 bp, Homo sapiens
tgtggctgagaaattgacaactt

SEQ ID NO: 10024648 - DNA, 22 bp, Homo sapiens
tgagtgtatatcaggagagagc

SEQ ID NO: 10024649 - DNA, 22 bp, Homo sapiens
tgagtgtgcagggaagtggcgg

SEQ ID NO: 10024650 - DNA, 21 bp, Homo sapiens
tgcaatccagcctgggcgaca

SEQ ID NO: 10024651 - DNA, 22 bp, Homo sapiens
tgcagattcaaatgaaatgcaa

SEQ ID NO: 10024652 - DNA, 22 bp, Homo sapiens
tgcagagaaaactcctgggtac

SEQ ID NO: 10024653 - DNA, 22 bp, Homo sapiens
tgcactactgtgatacacagcc

SEQ ID NO: 10024654 - DNA, 22 bp, Homo sapiens
tgcacagctggctctccttttc

SEQ ID NO: 10024655 - DNA, 22 bp, Homo sapiens
tgcacagcgcttgtcgggtgtg

SEQ ID NO: 10024656 - DNA, 22 bp, Homo sapiens
tgcagcccctgaaaatggcagc

SEQ ID NO: 10024657 - DNA, 22 bp, Homo sapiens
tgcaggctccacgttgttgtcc

SEQ ID NO: 10024658 - DNA, 22 bp, Homo sapiens
tgcaggctcatctcaagagtag

SEQ ID NO: 10024659 - DNA, 22 bp, Homo sapiens
tgcaggctcacctgccagggcc

SEQ ID NO: 10024660 - DNA, 22 bp, Homo sapiens
tgcaggctatcctttgctgcaa

SEQ ID NO: 10024661 - DNA, 22 bp, Homo sapiens
tgcaggctcaccctggagctga

SEQ ID NO: 10024662 - DNA, 21 bp, Homo sapiens
tgcaggctacttctgactcta

SEQ ID NO: 10024663 - DNA, 22 bp, Homo sapiens
tgcaggctatatcttatttgac

SEQ ID NO: 10024664 - DNA, 23 bp, Homo sapiens
tgcaggctaggaagagagccttc

SEQ ID NO: 10024665 - DNA, 23 bp, Homo sapiens
tgccaaagtttacctaacactgg

SEQ ID NO: 10024666 - DNA, 22 bp, Homo sapiens
tgcaggtaggcctgacttccag

SEQ ID NO: 10024667 - DNA, 22 bp, Homo sapiens
tgcaggtacttgacaacttggg

SEQ ID NO: 10024668 - DNA, 23 bp, Homo sapiens
tgcaggtagggcccagcagtctt

SEQ ID NO: 10024669 - DNA, 22 bp, Homo sapiens
tgcaggctttagccccatggct

SEQ ID NO: 10024670 - DNA, 20 bp, Homo sapiens
tgcaggcttcgctctaggag

SEQ ID NO: 10024671 - DNA, 22 bp, Homo sapiens
tgcaggctgtttggtggatctc

SEQ ID NO: 10024672 - DNA, 22 bp, Homo sapiens
tgcaggcttggatcacatctcc

SEQ ID NO: 10024673 - DNA, 21 bp, Homo sapiens
tgcaggctgtttaagaggcaa

SEQ ID NO: 10024674 - DNA, 22 bp, Homo sapiens
tgcaggctgtgtcatttagtga

SEQ ID NO: 10024675 - DNA, 18 bp, Homo sapiens
tgcaggctgttgaaactg

SEQ ID NO: 10024676 - DNA, 17 bp, Homo sapiens
tgcaggctgttatagcc

SEQ ID NO: 10024677 - DNA, 22 bp, Homo sapiens
tgcaggctgtaatctgaggcta

SEQ ID NO: 10024678 - DNA, 21 bp, Homo sapiens
tgcaggctgtgcgctcctgcc

SEQ ID NO: 10024679 - DNA, 22 bp, Homo sapiens
tgcaggctgaggctggctcaac

SEQ ID NO: 10024680 - DNA, 22 bp, Homo sapiens
tgcaggctgcacccctgccctg

SEQ ID NO: 10024681 - DNA, 22 bp, Homo sapiens
tgcaggctgcagtctcaggtgg

SEQ ID NO: 10024682 - DNA, 22 bp, Homo sapiens
tgcaggctcttggtgacgtggg

SEQ ID NO: 10024683 - DNA, 22 bp, Homo sapiens
tgcaggctctgtgtgtgcctgg

SEQ ID NO: 10024684 - DNA, 22 bp, Homo sapiens
tgcaggctctggtttatagtgc

SEQ ID NO: 10024685 - DNA, 17 bp, Homo sapiens
tgcaggctcctgtccct

SEQ ID NO: 10024686 - DNA, 22 bp, Homo sapiens
tgcaggctctctgctgccagat

SEQ ID NO: 10024687 - DNA, 22 bp, Homo sapiens
tgcaggctccatgaggacaggc

SEQ ID NO: 10024688 - DNA, 22 bp, Homo sapiens
tgcaggctccaggtgcacatat

SEQ ID NO: 10024689 - DNA, 22 bp, Homo sapiens
tgcaggctgctcaagacttagt

SEQ ID NO: 10024690 - DNA, 22 bp, Homo sapiens
tgcaggctgccttcacagagcc

SEQ ID NO: 10024691 - DNA, 22 bp, Homo sapiens
tgcaggctgctggcagtagctt

SEQ ID NO: 10024692 - DNA, 22 bp, Homo sapiens
tgcaggctggatttgcttttgt

SEQ ID NO: 10024693 - DNA, 22 bp, Homo sapiens
tgcaggctggaggagggactaa

SEQ ID NO: 10024694 - DNA, 22 bp, Homo sapiens
tgcaggctggcagatatctcat

SEQ ID NO: 10024695 - DNA, 18 bp, Homo sapiens
tgcaggctggggttcctc

SEQ ID NO: 10024696 - DNA, 22 bp, Homo sapiens
tgcaggctggggaggcagactt

SEQ ID NO: 10024697 - DNA, 22 bp, Homo sapiens
tgcaggctggcagtgctgaaat

SEQ ID NO: 10024698 - DNA, 22 bp, Homo sapiens
tgcaggctgggaagagggacaa

SEQ ID NO: 10024699 - DNA, 22 bp, Homo sapiens
tgccccctggtggccagagccg

SEQ ID NO: 10024700 - DNA, 22 bp, Homo sapiens
tgcccccttttcttgttacact

SEQ ID NO: 10024701 - DNA, 20 bp, Homo sapiens
tgccaggcacggagtgcatg

SEQ ID NO: 10024702 - DNA, 22 bp, Homo sapiens
tgccaggcacgtgagagtggcc

SEQ ID NO: 10024703 - DNA, 19 bp, Homo sapiens
tcttttcacgcattttgaa

SEQ ID NO: 10024704 - DNA, 23 bp, Homo sapiens
tcttttcaatggttctttatgtg

SEQ ID NO: 10024705 - DNA, 22 bp, Homo sapiens
tcttttccttgatggttaaata

SEQ ID NO: 10024706 - DNA, 22 bp, Homo sapiens
tcttttccttccctacagatct

SEQ ID NO: 10024707 - DNA, 22 bp, Homo sapiens
tcttttcctcctcttgttggcc

SEQ ID NO: 10024708 - DNA, 18 bp, Homo sapiens
tcttttccttccacttcc

SEQ ID NO: 10024709 - DNA, 22 bp, Homo sapiens
tgaactttcacaagaatatgct

SEQ ID NO: 10024710 - DNA, 22 bp, Homo sapiens
tgaaccacatgcaaagtgaata

SEQ ID NO: 10024711 - DNA, 22 bp, Homo sapiens
tgaacaaactgcattcttcact

SEQ ID NO: 10024712 - DNA, 21 bp, Homo sapiens
tgaacaaagttcttatcgtga

SEQ ID NO: 10024713 - DNA, 22 bp, Homo sapiens
tgaagactcagaagctaagata

SEQ ID NO: 10024714 - DNA, 22 bp, Homo sapiens
tgaagcacaggcatacacaacc

SEQ ID NO: 10024715 - DNA, 23 bp, Homo sapiens
tgaaatattcttttgcatgagct

SEQ ID NO: 10024716 - DNA, 22 bp, Homo sapiens
tgaaatatcattttcatctccc

SEQ ID NO: 10024717 - DNA, 22 bp, Homo sapiens
tgaaggtacagatattttgtaa

SEQ ID NO: 10024718 - DNA, 22 bp, Homo sapiens
tgaaggtggggcttaggaatct

SEQ ID NO: 10024719 - DNA, 22 bp, Homo sapiens
tgaagcttgagtgtcagttcct

SEQ ID NO: 10024720 - DNA, 22 bp, Homo sapiens
tgaagccaatctgccaggcaga

SEQ ID NO: 10024721 - DNA, 22 bp, Homo sapiens
tgaagccactttccagaatcac

SEQ ID NO: 10024722 - DNA, 22 bp, Homo sapiens
tgaagccataggacagaggata

SEQ ID NO: 10024723 - DNA, 21 bp, Homo sapiens
tgacagcatagagcagggagg

SEQ ID NO: 10024724 - DNA, 22 bp, Homo sapiens
tgacagattttttctgagctaa

SEQ ID NO: 10024725 - DNA, 21 bp, Homo sapiens
tgactgaggcttcttcacaca

SEQ ID NO: 10024726 - DNA, 22 bp, Homo sapiens
tgagagcacacagaaatatttt

SEQ ID NO: 10024727 - DNA, 22 bp, Homo sapiens
tgagatcattgacttgttcctg

SEQ ID NO: 10024728 - DNA, 22 bp, Homo sapiens
tgagtagagaattcagctaagg

SEQ ID NO: 10024729 - DNA, 22 bp, Homo sapiens
tgaggtggtccaaagactgttt

SEQ ID NO: 10024730 - DNA, 23 bp, Homo sapiens
tgaggagcatagctgactgacag

SEQ ID NO: 10024731 - DNA, 22 bp, Homo sapiens
tgaggagcttctggaaagtgca

SEQ ID NO: 10024732 - DNA, 22 bp, Homo sapiens
tgaggagcgggcagggatgcag

SEQ ID NO: 10024733 - DNA, 22 bp, Homo sapiens
tctaggagtaatgagctagcac

SEQ ID NO: 10024734 - DNA, 22 bp, Homo sapiens
tctaggagcttaaaggaggcca

SEQ ID NO: 10024735 - DNA, 22 bp, Homo sapiens
tctaggagcatgaagggaaggc

SEQ ID NO: 10024736 - DNA, 18 bp, Homo sapiens
tctaggagagtacctacc

SEQ ID NO: 10024737 - DNA, 22 bp, Homo sapiens
tctaggagaaccatcagggagg

SEQ ID NO: 10024738 - DNA, 17 bp, Homo sapiens
tcggtttgccaggcttc

SEQ ID NO: 10024739 - DNA, 21 bp, Homo sapiens
tcctgtaagcttgggtggctc

SEQ ID NO: 10024740 - DNA, 21 bp, Homo sapiens
tcctgtaagcttgggtggctc

SEQ ID NO: 10024741 - DNA, 22 bp, Homo sapiens
tcctggggttttggccgcagct

SEQ ID NO: 10024742 - DNA, 22 bp, Homo sapiens
taagaacagtagaacagtaggt

SEQ ID NO: 10024743 - DNA, 22 bp, Homo sapiens
taagaactcgtgatcatttgaa

SEQ ID NO: 10024744 - DNA, 22 bp, Homo sapiens
taagaacttggcagcaagaaat

SEQ ID NO: 10024745 - DNA, 22 bp, Homo sapiens
tctctttaaaaatagtgaaata

SEQ ID NO: 10024746 - DNA, 22 bp, Homo sapiens
tctctttagtgcttagacgtct

SEQ ID NO: 10024747 - DNA, 22 bp, Homo sapiens
tctctttaaagactcagagatt

SEQ ID NO: 10024748 - DNA, 22 bp, Homo sapiens
tctctttctattgcaccatgct

SEQ ID NO: 10024749 - DNA, 22 bp, Homo sapiens
tctcttaattgtaatggttcct

SEQ ID NO: 10024750 - DNA, 22 bp, Homo sapiens
tctcctgtcttctcagcacccc

SEQ ID NO: 10024751 - DNA, 22 bp, Homo sapiens
tctcctgctcagaacagcctca

SEQ ID NO: 10024752 - DNA, 22 bp, Homo sapiens
tctccaggcctttcccatctta

SEQ ID NO: 10024753 - DNA, 22 bp, Homo sapiens
tctccaagcagggctgcaaggc

SEQ ID NO: 10024754 - DNA, 22 bp, Homo sapiens
tctccaagaaaagatctcagct

SEQ ID NO: 10024755 - DNA, 22 bp, Homo sapiens
tctccaggaagccctccctgac

SEQ ID NO: 10024756 - DNA, 22 bp, Homo sapiens
tctccaggagcaagtcacccag

SEQ ID NO: 10024757 - DNA, 22 bp, Homo sapiens
tctgcagatttatcagcagctg

SEQ ID NO: 10024758 - DNA, 22 bp, Homo sapiens
tctgggctgctgtgcagtgacc

SEQ ID NO: 10024759 - DNA, 22 bp, Homo sapiens
tctgggctgctatgaggcagag

SEQ ID NO: 10024760 - DNA, 22 bp, Homo sapiens
tctgggctgaaatgaaggcctt

SEQ ID NO: 10024761 - DNA, 23 bp, Homo sapiens
tctgggctgagacttggaaggtc

SEQ ID NO: 10024762 - DNA, 22 bp, Homo sapiens
tctggcagggtcagggcccagg

SEQ ID NO: 10024763 - DNA, 22 bp, Homo sapiens
tctgctggaaaaccagggaatt

SEQ ID NO: 10024764 - DNA, 18 bp, Homo sapiens
tctggggtgtgctgtgta

SEQ ID NO: 10024765 - DNA, 22 bp, Homo sapiens
tctggggtgaggcctggttatc

SEQ ID NO: 10024766 - DNA, 22 bp, Homo sapiens
tctgggcttggattggctctgc

SEQ ID NO: 10024767 - DNA, 22 bp, Homo sapiens
tctgggcttggttagggctgtt

SEQ ID NO: 10024768 - DNA, 22 bp, Homo sapiens
tctgggctttagtttgttatct

SEQ ID NO: 10024769 - DNA, 20 bp, Homo sapiens
tctggggatgaggtctagga

SEQ ID NO: 10024770 - DNA, 22 bp, Homo sapiens
tctgggctttgtaatgggaggt

SEQ ID NO: 10024771 - DNA, 22 bp, Homo sapiens
tctggggatggtctactttctg

SEQ ID NO: 10024772 - DNA, 22 bp, Homo sapiens
tctggggatgagtgatgtcgta

SEQ ID NO: 10024773 - DNA, 22 bp, Homo sapiens
tctggggcagttactggggcct

SEQ ID NO: 10024774 - DNA, 17 bp, Homo sapiens
tctgggcttcagtggtc

SEQ ID NO: 10024775 - DNA, 22 bp, Homo sapiens
tctgggctggttgtgcttgctt

SEQ ID NO: 10024776 - DNA, 22 bp, Homo sapiens
tctgggctggctttatgctgac

SEQ ID NO: 10024777 - DNA, 22 bp, Homo sapiens
tctgggctgggagcgtgtggac

SEQ ID NO: 10024778 - DNA, 22 bp, Homo sapiens
tctgtttaggcaaaatagctac

SEQ ID NO: 10024779 - DNA, 22 bp, Homo sapiens
tctgtgactgatggaggctttt

SEQ ID NO: 10024780 - DNA, 22 bp, Homo sapiens
tctgtggaaatttcctgaggca

SEQ ID NO: 10024781 - DNA, 22 bp, Homo sapiens
tctgtgctgtctcagataagca

SEQ ID NO: 10024782 - DNA, 22 bp, Homo sapiens
tctttccaaggactctgtagca

SEQ ID NO: 10024783 - DNA, 22 bp, Homo sapiens
tctttattgctactggtttgtc

SEQ ID NO: 10024784 - DNA, 22 bp, Homo sapiens
tctttgaagttgaagtagttgg

SEQ ID NO: 10024785 - DNA, 22 bp, Homo sapiens
acacccaggctggcgtgcagtg

SEQ ID NO: 10024786 - DNA, 22 bp, Homo sapiens
acacacagaaggaagccccact

SEQ ID NO: 10024787 - DNA, 22 bp, Homo sapiens
acacacagcgcctaccatgtgc

SEQ ID NO: 10024788 - DNA, 22 bp, Homo sapiens
acacacagagtttatacaggca

SEQ ID NO: 10024789 - DNA, 22 bp, Homo sapiens
acacacatgcatgcttgccatt

SEQ ID NO: 10024790 - DNA, 22 bp, Homo sapiens
acacacaggtaaaggagcctgg

SEQ ID NO: 10024791 - DNA, 22 bp, Homo sapiens
aactttccatctttatcgtctt

SEQ ID NO: 10024792 - DNA, 22 bp, Homo sapiens
aaggccacacttgctggccagc

SEQ ID NO: 10024793 - DNA, 22 bp, Homo sapiens
aaggagaaatggtagatgtgca

SEQ ID NO: 10024794 - DNA, 22 bp, Homo sapiens
aacattcttcaaatatcactct

SEQ ID NO: 10024795 - DNA, 22 bp, Homo sapiens
aacattctgtcaattgatgacc

SEQ ID NO: 10024796 - DNA, 22 bp, Homo sapiens
aatatttctgtagctatgttct

SEQ ID NO: 10024797 - DNA, 22 bp, Homo sapiens
aaagaacttatcctagaatttg

SEQ ID NO: 10024798 - DNA, 22 bp, Homo sapiens
aaagaactattaacgaggaagc

SEQ ID NO: 10024799 - DNA, 22 bp, Homo sapiens
aaatagaaaccaacaaggtcag

SEQ ID NO: 10024800 - DNA, 22 bp, Homo sapiens
aaatagaattaactagctactg

SEQ ID NO: 10024801 - DNA, 22 bp, Homo sapiens
aaacatctatcagcatttttta

SEQ ID NO: 10024802 - DNA, 22 bp, Homo sapiens
aacaagagactctgttccagaa

SEQ ID NO: 10024803 - DNA, 22 bp, Homo sapiens
aacacatatttatatatgcaca

SEQ ID NO: 10024804 - DNA, 21 bp, Homo sapiens
aacacatccagagtatttgac

SEQ ID NO: 10024805 - DNA, 22 bp, Homo sapiens
aacacataggcagagcatgaca

SEQ ID NO: 10024806 - DNA, 22 bp, Homo sapiens
aactcactttgtggcttctgaa

SEQ ID NO: 10024807 - DNA, 22 bp, Homo sapiens
agagtgaaaagctagagcagta

SEQ ID NO: 10024808 - DNA, 22 bp, Homo sapiens
agaggcaacatggggaacagat

SEQ ID NO: 10024809 - DNA, 22 bp, Homo sapiens
agaggcttggcctcagttctgt

SEQ ID NO: 10024810 - DNA, 22 bp, Homo sapiens
agaataaaatagtctgaagatg

SEQ ID NO: 10024811 - DNA, 22 bp, Homo sapiens
agagatcactacatttgtaaaa

SEQ ID NO: 10024812 - DNA, 21 bp, Homo sapiens
agagatagactagaattgatg

SEQ ID NO: 10024813 - DNA, 20 bp, Homo sapiens
agagagaggtaaattgagca

SEQ ID NO: 10024814 - DNA, 22 bp, Homo sapiens
agctcagttggccactctttca

SEQ ID NO: 10024815 - DNA, 22 bp, Homo sapiens
agcccaggtctggcccagcctg

SEQ ID NO: 10024816 - DNA, 22 bp, Homo sapiens
acacacatggtattgttcagaa

SEQ ID NO: 10024817 - DNA, 22 bp, Homo sapiens
acacactcaattgcataagcac

SEQ ID NO: 10024818 - DNA, 21 bp, Homo sapiens
acacactctgagtcttctatt

SEQ ID NO: 10024819 - DNA, 21 bp, Homo sapiens
acacactgagttttccactgt

SEQ ID NO: 10024820 - DNA, 18 bp, Homo sapiens
acacacacacctgtgtat

SEQ ID NO: 10024821 - DNA, 22 bp, Homo sapiens
acacacatgcctttcctaagta

SEQ ID NO: 10024822 - DNA, 22 bp, Homo sapiens
acacactgtaaggactatcact

SEQ ID NO: 10024823 - DNA, 22 bp, Homo sapiens
acacactgttgctcatccaggc

SEQ ID NO: 10024824 - DNA, 22 bp, Homo sapiens
acacactttaaattaaacctct

SEQ ID NO: 10024825 - DNA, 22 bp, Homo sapiens
acacactggcccccagtactga

SEQ ID NO: 10024826 - DNA, 22 bp, Homo sapiens
agcagctcctgccatgagtgct

SEQ ID NO: 10024827 - DNA, 22 bp, Homo sapiens
agcaggagcccttatcaccagg

SEQ ID NO: 10024828 - DNA, 22 bp, Homo sapiens
agcaggagggttttgtagagtc

SEQ ID NO: 10024829 - DNA, 22 bp, Homo sapiens
acaggtcctcaagtcagctggg

SEQ ID NO: 10024830 - DNA, 23 bp, Homo sapiens
acaggctcttaatcagtgctcct

SEQ ID NO: 10024831 - DNA, 22 bp, Homo sapiens
acaggctctggggcaggatggc

SEQ ID NO: 10024832 - DNA, 22 bp, Homo sapiens
acattacagcaagtttacgtta

SEQ ID NO: 10024833 - DNA, 22 bp, Homo sapiens
acataatgagctctttataaat

SEQ ID NO: 10024834 - DNA, 22 bp, Homo sapiens
accacccattcagaaacactga

SEQ ID NO: 10024835 - DNA, 22 bp, Homo sapiens
acttatccatgtctatatgttg

SEQ ID NO: 10024836 - DNA, 22 bp, Homo sapiens
aatactgtctttcacagatatt

SEQ ID NO: 10024837 - DNA, 22 bp, Homo sapiens
aatcttttaggggatcctgagg

SEQ ID NO: 10024838 - DNA, 22 bp, Homo sapiens
aatatgttgagtctatctttat

SEQ ID NO: 10024839 - DNA, 22 bp, Homo sapiens
agcactgtgatttataacattt

SEQ ID NO: 10024840 - DNA, 22 bp, Homo sapiens
agcaggtgggcatgaaagctga

SEQ ID NO: 10024841 - DNA, 22 bp, Homo sapiens
cactgtgggtcccagactggag

SEQ ID NO: 10024842 - DNA, 22 bp, Homo sapiens
agcaggcttatggttgaaggga

SEQ ID NO: 10024843 - DNA, 22 bp, Homo sapiens
agcaggcttactttctgattag

SEQ ID NO: 10024844 - DNA, 22 bp, Homo sapiens
agcaggctgggcaatatgggca

SEQ ID NO: 10024845 - DNA, 22 bp, Homo sapiens
agctacaatcaatgtacatcat

SEQ ID NO: 10024846 - DNA, 22 bp, Homo sapiens
agcctgggggcgcagaaaccgg

SEQ ID NO: 10024847 - DNA, 22 bp, Homo sapiens
agctagcaaatagcatgtagga

SEQ ID NO: 10024848 - DNA, 22 bp, Homo sapiens
agctctttatgtggaagaggca

SEQ ID NO: 10024849 - DNA, 22 bp, Homo sapiens
agctctttgctggcagtaggct

SEQ ID NO: 10024850 - DNA, 22 bp, Homo sapiens
agctctttgagcaaggcagctc

SEQ ID NO: 10024851 - DNA, 22 bp, Homo sapiens
agctctttgagaaggcagtgtg

SEQ ID NO: 10024852 - DNA, 22 bp, Homo sapiens
agctctttctacaagcaggcag

SEQ ID NO: 10024853 - DNA, 22 bp, Homo sapiens
agctctggttattgaagcaggg

SEQ ID NO: 10024854 - DNA, 22 bp, Homo sapiens
cagagctcagagcagggcactc

SEQ ID NO: 10024855 - DNA, 22 bp, Homo sapiens
agccagagttgaatgtgagtct

SEQ ID NO: 10024856 - DNA, 22 bp, Homo sapiens
agccagagagtgttggagatgt

SEQ ID NO: 10024857 - DNA, 22 bp, Homo sapiens
agagcagatggagctggaagag

SEQ ID NO: 10024858 - DNA, 22 bp, Homo sapiens
agagcagatttcaaatattggc

SEQ ID NO: 10024859 - DNA, 22 bp, Homo sapiens
atgcctggtcccacctctaggt

SEQ ID NO: 10024860 - DNA, 22 bp, Homo sapiens
atgccaaattctcagcctcttt

SEQ ID NO: 10024861 - DNA, 22 bp, Homo sapiens
agaatattgaaagttcttgaca

SEQ ID NO: 10024862 - DNA, 22 bp, Homo sapiens
agatcagaaatgtaatggcagt

SEQ ID NO: 10024863 - DNA, 22 bp, Homo sapiens
agagtcccagggacactccaga

SEQ ID NO: 10024864 - DNA, 22 bp, Homo sapiens
agaggcaggaggttgacttgag

SEQ ID NO: 10024865 - DNA, 23 bp, Homo sapiens
agaggccagcctttggagacacc

SEQ ID NO: 10024866 - DNA, 22 bp, Homo sapiens
agaggccagcactgcagggaag

SEQ ID NO: 10024867 - DNA, 17 bp, Homo sapiens
aggcatggtctggggtg

SEQ ID NO: 10024868 - DNA, 19 bp, Homo sapiens
acattcccatcagcaatgt

SEQ ID NO: 10024869 - DNA, 20 bp, Homo sapiens
accccacagagtccattgca

SEQ ID NO: 10024870 - DNA, 22 bp, Homo sapiens
accaagcttcgtggaggaagtt

SEQ ID NO: 10024871 - DNA, 22 bp, Homo sapiens
accaagctagaacattacaggc

SEQ ID NO: 10024872 - DNA, 22 bp, Homo sapiens
accaagctctcttcccggctct

SEQ ID NO: 10024873 - DNA, 22 bp, Homo sapiens
accaagctgtatattattggtt

SEQ ID NO: 10024874 - DNA, 22 bp, Homo sapiens
accagtgggaagtggaaaatga

SEQ ID NO: 10024875 - DNA, 22 bp, Homo sapiens
agctttggttgccatgatctga

SEQ ID NO: 10024876 - DNA, 20 bp, Homo sapiens
agctttggttaagccagtgg

SEQ ID NO: 10024877 - DNA, 22 bp, Homo sapiens
agctgtggccagatgtgagcgg

SEQ ID NO: 10024878 - DNA, 22 bp, Homo sapiens
aggactttaacatattaactgt

SEQ ID NO: 10024879 - DNA, 23 bp, Homo sapiens
aggaaggaggtcctaacagtatc

SEQ ID NO: 10024880 - DNA, 22 bp, Homo sapiens
aggaaggagggcagatattaag

SEQ ID NO: 10024881 - DNA, 22 bp, Homo sapiens
acatacacaagcgtacatgaac

SEQ ID NO: 10024882 - DNA, 22 bp, Homo sapiens
acatacacatgaatatattttt

SEQ ID NO: 10024883 - DNA, 23 bp, Homo sapiens
acatacatggagataaagtgatg

SEQ ID NO: 10024884 - DNA, 21 bp, Homo sapiens
acatacataccttaccacctt

SEQ ID NO: 10024885 - DNA, 22 bp, Homo sapiens
aggagggaataagaaagagtca

SEQ ID NO: 10024886 - DNA, 23 bp, Homo sapiens
aggcaaacctataaaataggaat

SEQ ID NO: 10024887 - DNA, 22 bp, Homo sapiens
acttttcccttggtagagttgc

SEQ ID NO: 10024888 - DNA, 16 bp, Homo sapiens
acttttccaccttttt

SEQ ID NO: 10024889 - DNA, 22 bp, Homo sapiens
atcccacacccctacaacatat

SEQ ID NO: 10024890 - DNA, 22 bp, Homo sapiens
atccccacgatatagccaaagc

SEQ ID NO: 10024891 - DNA, 22 bp, Homo sapiens
atacaaaatatatactggagac

SEQ ID NO: 10024892 - DNA, 22 bp, Homo sapiens
actgggctcaagtgattgtcct

SEQ ID NO: 10024893 - DNA, 21 bp, Homo sapiens
actgggctagcctgacttctg

SEQ ID NO: 10024894 - DNA, 22 bp, Homo sapiens
actgggctccaaggacctggag

SEQ ID NO: 10024895 - DNA, 22 bp, Homo sapiens
actgggctagagtggaagctgg

SEQ ID NO: 10024896 - DNA, 22 bp, Homo sapiens
accttttccagcttctagaggc

SEQ ID NO: 10024897 - DNA, 22 bp, Homo sapiens
actgcactccagcctgggtgat

SEQ ID NO: 10024898 - DNA, 22 bp, Homo sapiens
actgcactcctgcctgggtaac

SEQ ID NO: 10024899 - DNA, 22 bp, Homo sapiens
actgcacttcaccctgggtgac

SEQ ID NO: 10024900 - DNA, 22 bp, Homo sapiens
agtgaaccaggctgcgtccctg

SEQ ID NO: 10024901 - DNA, 22 bp, Homo sapiens
actgagagtcaagatagcatgg

SEQ ID NO: 10024902 - DNA, 22 bp, Homo sapiens
actggcttgaagtagattcaaa

SEQ ID NO: 10024903 - DNA, 22 bp, Homo sapiens
actgccaatggtagtttgatgg

SEQ ID NO: 10024904 - DNA, 20 bp, Homo sapiens
ctaggaactatggtctggct

SEQ ID NO: 10024905 - DNA, 22 bp, Homo sapiens
ctaggaatcaccaagattctag

SEQ ID NO: 10024906 - DNA, 22 bp, Homo sapiens
ctaggaatccttttagagttgg

SEQ ID NO: 10024907 - DNA, 22 bp, Homo sapiens
ctaggaatggtacctcttacaa

SEQ ID NO: 10024908 - DNA, 22 bp, Homo sapiens
agtgtgagcctacaggccaaag

SEQ ID NO: 10024909 - DNA, 18 bp, Homo sapiens
agttccttaaattggtgt

SEQ ID NO: 10024910 - DNA, 22 bp, Homo sapiens
ctggcaggtctcgctgacgtgt

SEQ ID NO: 10024911 - DNA, 22 bp, Homo sapiens
ctggcctcagagggtcatggtg

SEQ ID NO: 10024912 - DNA, 20 bp, Homo sapiens
atacacatgcagacagatgc

SEQ ID NO: 10024913 - DNA, 22 bp, Homo sapiens
ctgggagaggaacctcgagggt

SEQ ID NO: 10024914 - DNA, 22 bp, Homo sapiens
atcatacatgtaactaagtaaa

SEQ ID NO: 10024915 - DNA, 22 bp, Homo sapiens
cttcaaatgtgattttaataac

SEQ ID NO: 10024916 - DNA, 22 bp, Homo sapiens
cttctgagatgttgttttacag

SEQ ID NO: 10024917 - DNA, 22 bp, Homo sapiens
cttcttaaattggattgctatt

SEQ ID NO: 10024918 - DNA, 22 bp, Homo sapiens
ctgtaatcccagctacctggga

SEQ ID NO: 10024919 - DNA, 22 bp, Homo sapiens
atcacagagctcccttccactg

SEQ ID NO: 10024920 - DNA, 22 bp, Homo sapiens
atcacagagattgcttttaaaa

SEQ ID NO: 10024921 - DNA, 22 bp, Homo sapiens
atcacaatgtacgttaaaatgt

SEQ ID NO: 10024922 - DNA, 22 bp, Homo sapiens
atattattctagctcttgtgtg

SEQ ID NO: 10024923 - DNA, 23 bp, Homo sapiens
ctggggctttcaaatctgggcag

SEQ ID NO: 10024924 - DNA, 22 bp, Homo sapiens
ctgggaggggtagccaatccta

SEQ ID NO: 10024925 - DNA, 22 bp, Homo sapiens
aggagcagcttctgaaccatgt

SEQ ID NO: 10024926 - DNA, 22 bp, Homo sapiens
aggcagaggaagggtggatttg

SEQ ID NO: 10024927 - DNA, 22 bp, Homo sapiens
aggcagaggagaatgatcttcc

SEQ ID NO: 10024928 - DNA, 23 bp, Homo sapiens
agctttggtgatgtgacagataa

SEQ ID NO: 10024929 - DNA, 22 bp, Homo sapiens
agctcttttatcatgaggagag

SEQ ID NO: 10024930 - DNA, 22 bp, Homo sapiens
agctctttggcactgagcagca

SEQ ID NO: 10024931 - DNA, 22 bp, Homo sapiens
agctgctgggagaagtgagcca

SEQ ID NO: 10024932 - DNA, 22 bp, Homo sapiens
ccctattagtgaccacatcata

SEQ ID NO: 10024933 - DNA, 22 bp, Homo sapiens
ccccttccacagtgcttcctaa

SEQ ID NO: 10024934 - DNA, 22 bp, Homo sapiens
cccagtttcaactttccagtgg

SEQ ID NO: 10024935 - DNA, 22 bp, Homo sapiens
aggcctctgctggaaagagttg

SEQ ID NO: 10024936 - DNA, 22 bp, Homo sapiens
aggcccaaaagaaaccactggg

SEQ ID NO: 10024937 - DNA, 21 bp, Homo sapiens
ccaggctgggagggcagttcc

SEQ ID NO: 10024938 - DNA, 22 bp, Homo sapiens
aggctacaggagacgccaggag

SEQ ID NO: 10024939 - DNA, 22 bp, Homo sapiens
aggctacagcctcaagagtgca

SEQ ID NO: 10024940 - DNA, 22 bp, Homo sapiens
aggctacaataattcccatgca

SEQ ID NO: 10024941 - DNA, 22 bp, Homo sapiens
aggctacagatacagaggctac

SEQ ID NO: 10024942 - DNA, 22 bp, Homo sapiens
cagctctgagactgaggctatg

SEQ ID NO: 10024943 - DNA, 22 bp, Homo sapiens
gtcctctgttagaaatgtgctt

SEQ ID NO: 10024944 - DNA, 22 bp, Homo sapiens
gtcctctgtttccatctgactt

SEQ ID NO: 10024945 - DNA, 22 bp, Homo sapiens
gtcctctgtgtaggctgcagac

SEQ ID NO: 10024946 - DNA, 22 bp, Homo sapiens
cagagttttgtgaacaacttgg

SEQ ID NO: 10024947 - DNA, 23 bp, Homo sapiens
ggggtcttggaacaggtggccct

SEQ ID NO: 10024948 - DNA, 22 bp, Homo sapiens
ggggtccctgcaccagcatgtc

SEQ ID NO: 10024949 - DNA, 22 bp, Homo sapiens
cagagttttatcatacgtggat

SEQ ID NO: 10024950 - DNA, 22 bp, Homo sapiens
cagaggcagaggtcatctctgg

SEQ ID NO: 10024951 - DNA, 22 bp, Homo sapiens
cagagagaatcttggcagctga

SEQ ID NO: 10024952 - DNA, 22 bp, Homo sapiens
ggaggagattcccctctcactt

SEQ ID NO: 10024953 - DNA, 22 bp, Homo sapiens
cacagctaactttcactgagca

SEQ ID NO: 10024954 - DNA, 22 bp, Homo sapiens
cacagagacagaagcacttatg

SEQ ID NO: 10024955 - DNA, 20 bp, Homo sapiens
gctgggctaccactggccct

SEQ ID NO: 10024956 - DNA, 22 bp, Homo sapiens
ggcaggaataaattatggactt

SEQ ID NO: 10024957 - DNA, 22 bp, Homo sapiens
cactgtccaatagatacataat

SEQ ID NO: 10024958 - DNA, 22 bp, Homo sapiens
cactgtccatgcttgctaaccc

SEQ ID NO: 10024959 - DNA, 22 bp, Homo sapiens
cactgtccctgtttcctggaaa

SEQ ID NO: 10024960 - DNA, 22 bp, Homo sapiens
gcacacaggcagtttccagcca

SEQ ID NO: 10024961 - DNA, 22 bp, Homo sapiens
gcacagaggatgaggcagctct

SEQ ID NO: 10024962 - DNA, 22 bp, Homo sapiens
attgttctggatatttacattg

SEQ ID NO: 10024963 - DNA, 22 bp, Homo sapiens
attgttctgtagtgacatgtag

SEQ ID NO: 10024964 - DNA, 22 bp, Homo sapiens
attgttgggtctcactcctaga

SEQ ID NO: 10024965 - DNA, 22 bp, Homo sapiens
attgtttccccggaattattca

SEQ ID NO: 10024966 - DNA, 22 bp, Homo sapiens
attggtggtgaggacatgccag

SEQ ID NO: 10024967 - DNA, 22 bp, Homo sapiens
attggtggtgaggacatgccag

SEQ ID NO: 10024968 - DNA, 22 bp, Homo sapiens
gcaggggttttctgacttgagt

SEQ ID NO: 10024969 - DNA, 16 bp, Homo sapiens
gcaggggtgggtggag

SEQ ID NO: 10024970 - DNA, 22 bp, Homo sapiens
gcaggggtagtgtcttcctgag

SEQ ID NO: 10024971 - DNA, 22 bp, Homo sapiens
attttaccttaaagtctatatt

SEQ ID NO: 10024972 - DNA, 23 bp, Homo sapiens
atttgacagagcatagcatttct

SEQ ID NO: 10024973 - DNA, 22 bp, Homo sapiens
gccagaggggctcgaaggcgcg

SEQ ID NO: 10024974 - DNA, 22 bp, Homo sapiens
gcccagccacagtcactttcat

SEQ ID NO: 10024975 - DNA, 21 bp, Homo sapiens
gccccctggactcctcatcca

SEQ ID NO: 10024976 - DNA, 22 bp, Homo sapiens
gctcaaagcaccctggaataag

SEQ ID NO: 10024977 - DNA, 22 bp, Homo sapiens
gctcaaaggccaggtagcagca

SEQ ID NO: 10024978 - DNA, 22 bp, Homo sapiens
gctcaaagaccagacagaggag

SEQ ID NO: 10024979 - DNA, 22 bp, Homo sapiens
gctacaagtcttgtcattcatt

SEQ ID NO: 10024980 - DNA, 22 bp, Homo sapiens
gctctagtaggaatgtccctct

SEQ ID NO: 10024981 - DNA, 22 bp, Homo sapiens
gctctgagacagtagagatggc

SEQ ID NO: 10024982 - DNA, 20 bp, Homo sapiens
gctctgaccatatcaagaca

SEQ ID NO: 10024983 - DNA, 22 bp, Homo sapiens
gctctgagaggatgctgagcag

SEQ ID NO: 10024984 - DNA, 22 bp, Homo sapiens
caaatattccaggtacatccct

SEQ ID NO: 10024985 - DNA, 22 bp, Homo sapiens
atgaatgctgggacaaatatat

SEQ ID NO: 10024986 - DNA, 22 bp, Homo sapiens
gaactttgcgcagttcccgggg

SEQ ID NO: 10024987 - DNA, 22 bp, Homo sapiens
gactttcttaggccccctaata

SEQ ID NO: 10024988 - DNA, 22 bp, Homo sapiens
gacccggctccaggcccagcag

SEQ ID NO: 10024989 - DNA, 22 bp, Homo sapiens
gaagcactgcatttcaagatca

SEQ ID NO: 10024990 - DNA, 22 bp, Homo sapiens
gaagcactgccataattcagac

SEQ ID NO: 10024991 - DNA, 22 bp, Homo sapiens
ccaggaggcggaggttgcagtg

SEQ ID NO: 10024992 - DNA, 22 bp, Homo sapiens
ccaggaggcggaggttgcagcg

SEQ ID NO: 10024993 - DNA, 22 bp, Homo sapiens
tctggggatgaggacctagatg

SEQ ID NO: 10024994 - DNA, 22 bp, Homo sapiens
tctggggagtgcctaagtggaa

SEQ ID NO: 10024995 - DNA, 22 bp, Homo sapiens
tctggggataagacccaggtat

SEQ ID NO: 10024996 - DNA, 22 bp, Homo sapiens
tctggggagggagccacaggtc

SEQ ID NO: 10024997 - DNA, 22 bp, Homo sapiens
tctggggagtcaaagagacctg

SEQ ID NO: 10024998 - DNA, 22 bp, Homo sapiens
tctgggcttttccatgcctgtg

SEQ ID NO: 10024999 - DNA, 21 bp, Homo sapiens
tctggggaagacatctaggat

SEQ ID NO: 10025000 - DNA, 22 bp, Homo sapiens
tctggggaatgttcatttctga

SEQ ID NO: 10025001 - DNA, 22 bp, Homo sapiens
tctgggcttttgcactggccat

SEQ ID NO: 10025002 - DNA, 22 bp, Homo sapiens
tctggggaccatggcatctaaa

SEQ ID NO: 10025003 - DNA, 22 bp, Homo sapiens
tctggggacggggcccagcaat

SEQ ID NO: 10025004 - DNA, 22 bp, Homo sapiens
tctggggagcagccctggtgag

SEQ ID NO: 10025005 - DNA, 22 bp, Homo sapiens
tgcactccaggctgggtgacag

SEQ ID NO: 10025006 - DNA, 22 bp, Homo sapiens
tgcagagaagaggacagttcta

SEQ ID NO: 10025007 - DNA, 22 bp, Homo sapiens
tgcagagagatcctcagggttt

SEQ ID NO: 10025008 - DNA, 22 bp, Homo sapiens
tgcagagagacccctgggccag

SEQ ID NO: 10025009 - DNA, 22 bp, Homo sapiens
ccatcacagtccccatcgtgat

SEQ ID NO: 10025010 - DNA, 17 bp, Homo sapiens
ccatactgacatattga

SEQ ID NO: 10025011 - DNA, 22 bp, Homo sapiens
ccatacacacaccaaatttgta

SEQ ID NO: 10025012 - DNA, 19 bp, Homo sapiens
cctgcctgagctgtccctc

SEQ ID NO: 10025013 - DNA, 22 bp, Homo sapiens
tggcaggcgggagccatagagg

SEQ ID NO: 10025014 - DNA, 22 bp, Homo sapiens
tggcacagtcctgggtgcctgc

SEQ ID NO: 10025015 - DNA, 22 bp, Homo sapiens
tgctctgcacatccctcacaaa

SEQ ID NO: 10025016 - DNA, 22 bp, Homo sapiens
ccccagctcagtgcagggacat

SEQ ID NO: 10025017 - DNA, 22 bp, Homo sapiens
cattacaaccccaaattacaaa

SEQ ID NO: 10025018 - DNA, 22 bp, Homo sapiens
tccaagatggttggtgtggtgg

SEQ ID NO: 10025019 - DNA, 22 bp, Homo sapiens
catctacaggagaatgtcactg

SEQ ID NO: 10025020 - DNA, 22 bp, Homo sapiens
tcatcacaattttatgaccctc

SEQ ID NO: 10025021 - DNA, 22 bp, Homo sapiens
tcatcacatatgtcatgatttg

SEQ ID NO: 10025022 - DNA, 22 bp, Homo sapiens
tcatcacatgtgtagtcatccc

SEQ ID NO: 10025023 - DNA, 22 bp, Homo sapiens
catcatatggaatttaaagtca

SEQ ID NO: 10025024 - DNA, 22 bp, Homo sapiens
catcatatatttctacaagtgc

SEQ ID NO: 10025025 - DNA, 22 bp, Homo sapiens
cattttactgactcttgaatta

SEQ ID NO: 10025026 - DNA, 22 bp, Homo sapiens
catttcatagttgtcacaataa

SEQ ID NO: 10025027 - DNA, 21 bp, Homo sapiens
tctagaagaggttgagaatat

SEQ ID NO: 10025028 - DNA, 22 bp, Homo sapiens
ccaccccaaatgaagacctctc

SEQ ID NO: 10025029 - DNA, 22 bp, Homo sapiens
ccagaggtgaacaggaggctgt

SEQ ID NO: 10025030 - DNA, 22 bp, Homo sapiens
tcaaattatttaggatagtgct

SEQ ID NO: 10025031 - DNA, 22 bp, Homo sapiens
cagtcccatgagcccagaacat

SEQ ID NO: 10025032 - DNA, 22 bp, Homo sapiens
tcaaaggcattgccaataagta

SEQ ID NO: 10025033 - DNA, 22 bp, Homo sapiens
tattcccattccacttatcaag

SEQ ID NO: 10025034 - DNA, 22 bp, Homo sapiens
tattcccagcctctttctatct

SEQ ID NO: 10025035 - DNA, 22 bp, Homo sapiens
tcactgcaacctccacctcctg

SEQ ID NO: 10025036 - DNA, 22 bp, Homo sapiens
tcactgcagagacctctagtca

SEQ ID NO: 10025037 - DNA, 20 bp, Homo sapiens
tcacacatggtaagctatga

SEQ ID NO: 10025038 - DNA, 22 bp, Homo sapiens
tcacacatttctcaagtgtagg

SEQ ID NO: 10025039 - DNA, 22 bp, Homo sapiens
tatattcaatgattagtatcag

SEQ ID NO: 10025040 - DNA, 22 bp, Homo sapiens
tacagagacccacaagagactg

SEQ ID NO: 10025041 - DNA, 22 bp, Homo sapiens
tacagccacaggtgactctcat

SEQ ID NO: 10025042 - DNA, 22 bp, Homo sapiens
caggctccttcccagggatggt

SEQ ID NO: 10025043 - DNA, 23 bp, Homo sapiens
caggctcccggaccaggatccgc

SEQ ID NO: 10025044 - DNA, 22 bp, Homo sapiens
caggccctgccttgagggacct

SEQ ID NO: 10025045 - DNA, 22 bp, Homo sapiens
caggccctcgcccgcagcgacc

SEQ ID NO: 10025046 - DNA, 22 bp, Homo sapiens
caggccctcaggcaagggctct

SEQ ID NO: 10025047 - DNA, 22 bp, Homo sapiens
gtggagcaggactagctgagaa

SEQ ID NO: 10025048 - DNA, 22 bp, Homo sapiens
tacacagatttcagtatcatca

SEQ ID NO: 10025049 - DNA, 22 bp, Homo sapiens
tacacagactcttcaattcaga

SEQ ID NO: 10025050 - DNA, 22 bp, Homo sapiens
tacacagatatgtgatcaatca

SEQ ID NO: 10025051 - DNA, 22 bp, Homo sapiens
tacacagaacctggtgtacagt

SEQ ID NO: 10025052 - DNA, 22 bp, Homo sapiens
ctgtagaacgatccaggcattt

SEQ ID NO: 10025053 - DNA, 22 bp, Homo sapiens
ctgtagaggaacaagagctctt

SEQ ID NO: 10025054 - DNA, 22 bp, Homo sapiens
ctggggacgtcgggcagtgttc

SEQ ID NO: 10025055 - DNA, 22 bp, Homo sapiens
ctggggaccgagcaagctctgg

SEQ ID NO: 10025056 - DNA, 20 bp, Homo sapiens
ctggggacagcaatggctgt

SEQ ID NO: 10025057 - DNA, 22 bp, Homo sapiens
ctggggaccagtgtctgtttgt

SEQ ID NO: 10025058 - DNA, 22 bp, Homo sapiens
ctggggacttgcagacacaatt

SEQ ID NO: 10025059 - DNA, 22 bp, Homo sapiens
ctggggactgaaggatgttgct

SEQ ID NO: 10025060 - DNA, 22 bp, Homo sapiens
ctggggactcattcagagcata

SEQ ID NO: 10025061 - DNA, 22 bp, Homo sapiens
ctggggactttggttctccatg

SEQ ID NO: 10025062 - DNA, 22 bp, Homo sapiens
ctgggctttgaagccaggctgc

SEQ ID NO: 10025063 - DNA, 22 bp, Homo sapiens
ctgggctttggtactgtgatta

SEQ ID NO: 10025064 - DNA, 22 bp, Homo sapiens
ctgggcttctccccctggcaga

SEQ ID NO: 10025065 - DNA, 22 bp, Homo sapiens
ctgggcttaggacctggtgcgg

SEQ ID NO: 10025066 - DNA, 22 bp, Homo sapiens
ctgggcttgagttcctgctcgt

SEQ ID NO: 10025067 - DNA, 22 bp, Homo sapiens
ctgggctttcaggccctaaggc

SEQ ID NO: 10025068 - DNA, 22 bp, Homo sapiens
ctgggcctgtcagggctttttg

SEQ ID NO: 10025069 - DNA, 22 bp, Homo sapiens
ctgggcttagcagctcctggtc

SEQ ID NO: 10025070 - DNA, 22 bp, Homo sapiens
ctgggctgtttgttctggtctc

SEQ ID NO: 10025071 - DNA, 22 bp, Homo sapiens
ctgggctgttctgcccctgggt

SEQ ID NO: 10025072 - DNA, 22 bp, Homo sapiens
ctgggctggataattctttgct

SEQ ID NO: 10025073 - DNA, 22 bp, Homo sapiens
ctttaattgtagctcccataat

SEQ ID NO: 10025074 - DNA, 22 bp, Homo sapiens
cttctgggccatggccttcctc

SEQ ID NO: 10025075 - DNA, 22 bp, Homo sapiens
cttctgggcattcagctgcaca

SEQ ID NO: 10025076 - DNA, 22 bp, Homo sapiens
cttctgggcagaagttttgaga

SEQ ID NO: 10025077 - DNA, 22 bp, Homo sapiens
cttctgggcatggcagagcctg

SEQ ID NO: 10025078 - DNA, 22 bp, Homo sapiens
cttctgggattaatttttcctg

SEQ ID NO: 10025079 - DNA, 22 bp, Homo sapiens
cttctgggagagcttttgcttc

SEQ ID NO: 10025080 - DNA, 22 bp, Homo sapiens
cttctgggatttttgaagactc

SEQ ID NO: 10025081 - DNA, 22 bp, Homo sapiens
cttctgggttgcaggtcttggc

SEQ ID NO: 10025082 - DNA, 22 bp, Homo sapiens
cttctgggtgtggagtgaggac

SEQ ID NO: 10025083 - DNA, 22 bp, Homo sapiens
cttctggggatggagcccagaa

SEQ ID NO: 10025084 - DNA, 22 bp, Homo sapiens
cttctgggtaattcttcttcat

SEQ ID NO: 10025085 - DNA, 22 bp, Homo sapiens
cttctgggtattccagatacct

SEQ ID NO: 10025086 - DNA, 22 bp, Homo sapiens
cttctgggtgcctgtgagtgtt

SEQ ID NO: 10025087 - DNA, 22 bp, Homo sapiens
cttacacagtctggcacttctt

SEQ ID NO: 10025088 - DNA, 22 bp, Homo sapiens
cttaaaatctggcagttagcta

SEQ ID NO: 10025089 - DNA, 22 bp, Homo sapiens
cttccaagatgaacagcaagcg

SEQ ID NO: 10025090 - DNA, 22 bp, Homo sapiens
gagacctcttggtatcgctagg

SEQ ID NO: 10025091 - DNA, 22 bp, Homo sapiens
gacagaggagaagatgctgtgg

SEQ ID NO: 10025092 - DNA, 17 bp, Homo sapiens
gaccaggagaaaccagg

SEQ ID NO: 10025093 - DNA, 22 bp, Homo sapiens
gaccaccagaggtccgtgggta

SEQ ID NO: 10025094 - DNA, 22 bp, Homo sapiens
gacacttcacctttcccagcct

SEQ ID NO: 10025095 - DNA, 22 bp, Homo sapiens
gaatatttgtaattactgttga

SEQ ID NO: 10025096 - DNA, 22 bp, Homo sapiens
gagccaggtttgaatctcagtc

SEQ ID NO: 10025097 - DNA, 22 bp, Homo sapiens
gaggcaggccctgaatgagtca

SEQ ID NO: 10025098 - DNA, 22 bp, Homo sapiens
ctgagggagctgctggccttgg

SEQ ID NO: 10025099 - DNA, 22 bp, Homo sapiens
ctgagagatcaagccacaggat

SEQ ID NO: 10025100 - DNA, 22 bp, Homo sapiens
ctgctggaatctttaagctgga

SEQ ID NO: 10025101 - DNA, 22 bp, Homo sapiens
tttatatgtattgactttgatg

SEQ ID NO: 10025102 - DNA, 22 bp, Homo sapiens
tttcaaatgcatgtctttcctc

SEQ ID NO: 10025103 - DNA, 22 bp, Homo sapiens
tttcaaatagaatctttccaaa

SEQ ID NO: 10025104 - DNA, 22 bp, Homo sapiens
ttgtttaatatcgtgaagtact

SEQ ID NO: 10025105 - DNA, 22 bp, Homo sapiens
ttgtttaatgcctcatacatct

SEQ ID NO: 10025106 - DNA, 22 bp, Homo sapiens
ttgtttacactgcagaattggg

SEQ ID NO: 10025107 - DNA, 23 bp, Homo sapiens
ctccctggcccttgggagacctg

SEQ ID NO: 10025108 - DNA, 22 bp, Homo sapiens
tttgaagggcacgacaatagtt

SEQ ID NO: 10025109 - DNA, 22 bp, Homo sapiens
tttgaagggcacgacaatagtt

SEQ ID NO: 10025110 - DNA, 22 bp, Homo sapiens
ctctctggaagggggagctgat

SEQ ID NO: 10025111 - DNA, 22 bp, Homo sapiens
ctacatggagaagaaaattctt

SEQ ID NO: 10025112 - DNA, 18 bp, Homo sapiens
ctacattcataggaaagg

SEQ ID NO: 10025113 - DNA, 22 bp, Homo sapiens
ttccacattccttacattcata

SEQ ID NO: 10025114 - DNA, 22 bp, Homo sapiens
ttgcacagggctggaatgtcct

SEQ ID NO: 10025115 - DNA, 22 bp, Homo sapiens
ttgcacagcaacgtgaatgtac

SEQ ID NO: 10025116 - DNA, 22 bp, Homo sapiens
ttgcacagtttgaagatgactc

SEQ ID NO: 10025117 - DNA, 22 bp, Homo sapiens
ctcagccccaattctccccatt

SEQ ID NO: 10025118 - DNA, 19 bp, Homo sapiens
ttgaaggttcggagatagg

SEQ ID NO: 10025119 - DNA, 22 bp, Homo sapiens
ttaatagatttgattttaaagg

SEQ ID NO: 10025120 - DNA, 22 bp, Homo sapiens
ttaagctagtgaagtccctcaa

SEQ ID NO: 10025121 - DNA, 22 bp, Homo sapiens
ttaaaatgcagattatgactca

SEQ ID NO: 10025122 - DNA, 22 bp, Homo sapiens
ttacaataccacatcacctcat

SEQ ID NO: 10025123 - DNA, 22 bp, Homo sapiens
tgtttataccttggtataacca

SEQ ID NO: 10025124 - DNA, 22 bp, Homo sapiens
cctggggattctgacacggagt

SEQ ID NO: 10025125 - DNA, 22 bp, Homo sapiens
cctggggagccgcctgagcccc

SEQ ID NO: 10025126 - DNA, 23 bp, Homo sapiens
cctggggagctgtatccagagtg

SEQ ID NO: 10025127 - DNA, 22 bp, Homo sapiens
cctggggagaagagcttccccc

SEQ ID NO: 10025128 - DNA, 22 bp, Homo sapiens
cctggggagagaaagcccagcc

SEQ ID NO: 10025129 - DNA, 22 bp, Homo sapiens
tggttcctcaagcgctggcggc

SEQ ID NO: 10025130 - DNA, 22 bp, Homo sapiens
ttattattttgtgtacagcaaa

SEQ ID NO: 10025131 - DNA, 22 bp, Homo sapiens
cgaggctcagagagggtgactt

SEQ ID NO: 10025132 - DNA, 22 bp, Homo sapiens
cctttaaagactgcataacttc

SEQ ID NO: 10025133 - DNA, 22 bp, Homo sapiens
ccttcttctgtgtggcccaaga

SEQ ID NO: 10025134 - DNA, 22 bp, Homo sapiens
tacgcctgtaatcccagcactt

SEQ ID NO: 10025135 - DNA, 22 bp, Homo sapiens
tactgacacaaagccaatccct

SEQ ID NO: 10025136 - DNA, 22 bp, Homo sapiens
tacacatcactgtatctttcag

SEQ ID NO: 10025137 - DNA, 22 bp, Homo sapiens
tacacatctctgtcagtagtga

SEQ ID NO: 10025138 - DNA, 22 bp, Homo sapiens
tacacatcccagactcccagga

SEQ ID NO: 10025139 - DNA, 22 bp, Homo sapiens
tacacatccatgttttgacttt

SEQ ID NO: 10025140 - DNA, 22 bp, Homo sapiens
tacaatatgtggccttttgtga

SEQ ID NO: 10025141 - DNA, 22 bp, Homo sapiens
gttactcttccccggggtctgg

SEQ ID NO: 10025142 - DNA, 22 bp, Homo sapiens
gtttagaattctaactttaagg

SEQ ID NO: 10025143 - DNA, 22 bp, Homo sapiens
gtttacattgctgtttgtgtct

SEQ ID NO: 10025144 - DNA, 22 bp, Homo sapiens
tagcaagaagggagatggggtt

SEQ ID NO: 10025145 - DNA, 22 bp, Homo sapiens
tagatgtgttgcctggagttgt

SEQ ID NO: 10025146 - DNA, 22 bp, Homo sapiens
tagaaggtaatgaaatgctgat

SEQ ID NO: 10025147 - DNA, 18 bp, Homo sapiens
taggttacagccagccag

SEQ ID NO: 10025148 - DNA, 22 bp, Homo sapiens
taggttcagctttcatcctgaa

SEQ ID NO: 10025149 - DNA, 22 bp, Homo sapiens
taggttcaagttcaggctctat

SEQ ID NO: 10025150 - DNA, 22 bp, Homo sapiens
taggttcagcttccactgccta

SEQ ID NO: 10025151 - DNA, 22 bp, Homo sapiens
taggaagctgagcagcattcct

SEQ ID NO: 10025152 - DNA, 22 bp, Homo sapiens
tatacatgttttacataagtga

SEQ ID NO: 10025153 - DNA, 22 bp, Homo sapiens
tatattcaacaggctaatgtca

SEQ ID NO: 10025154 - DNA, 22 bp, Homo sapiens
tatcaatacatgttatcagtgt

SEQ ID NO: 10025155 - DNA, 22 bp, Homo sapiens
tatgttaagtgggataatcaaa

SEQ ID NO: 10025156 - DNA, 22 bp, Homo sapiens
tatgtttagtatccattttcag

SEQ ID NO: 10025157 - DNA, 22 bp, Homo sapiens
tatgtttacgctggtagaatta

SEQ ID NO: 10025158 - DNA, 22 bp, Homo sapiens
tcatgttattgactcataatat

SEQ ID NO: 10025159 - DNA, 22 bp, Homo sapiens
tcatgtttttgccatatgactc

SEQ ID NO: 10025160 - DNA, 22 bp, Homo sapiens
tccacacacatttctatgtgca

SEQ ID NO: 10025161 - DNA, 22 bp, Homo sapiens
tccacagcattattagaaggat

SEQ ID NO: 10025162 - DNA, 22 bp, Homo sapiens
tcccagctcacatatggtaact

SEQ ID NO: 10025163 - DNA, 22 bp, Homo sapiens
tcccagctgtgtggaggagatg

SEQ ID NO: 10025164 - DNA, 22 bp, Homo sapiens
tcccagcctttcttttctgctg

SEQ ID NO: 10025165 - DNA, 22 bp, Homo sapiens
tcccacatatgcaatcctgaat

SEQ ID NO: 10025166 - DNA, 22 bp, Homo sapiens
tccgggaggcagaggttgcagt

SEQ ID NO: 10025167 - DNA, 22 bp, Homo sapiens
tcctcctcctcacagtcacctg

SEQ ID NO: 10025168 - DNA, 22 bp, Homo sapiens
tccctgtgagaaatgaagcagg

SEQ ID NO: 10025169 - DNA, 22 bp, Homo sapiens
tcactgtatttgctgatgcata

SEQ ID NO: 10025170 - DNA, 22 bp, Homo sapiens
tcactgtatttggaagggatgg

SEQ ID NO: 10025171 - DNA, 22 bp, Homo sapiens
tcactgtagtgagcagaatata

SEQ ID NO: 10025172 - DNA, 22 bp, Homo sapiens
tcactgtaccttccatttcatt

SEQ ID NO: 10025173 - DNA, 20 bp, Homo sapiens
tcactgtaattgcctacatt

SEQ ID NO: 10025174 - DNA, 22 bp, Homo sapiens
tcactgtaataggtttgaagat

SEQ ID NO: 10025175 - DNA, 22 bp, Homo sapiens
tcactgtaaagtaatactgtca

SEQ ID NO: 10025176 - DNA, 22 bp, Homo sapiens
tcacacagctcctttccttagt

SEQ ID NO: 10025177 - DNA, 22 bp, Homo sapiens
tcacacagctgacagagccttt

SEQ ID NO: 10025178 - DNA, 22 bp, Homo sapiens
tcacacacataatctaagatta

SEQ ID NO: 10025179 - DNA, 22 bp, Homo sapiens
tcacacacatggatagtatttt

SEQ ID NO: 10025180 - DNA, 21 bp, Homo sapiens
tcacacacgtttccaagggca

SEQ ID NO: 10025181 - DNA, 22 bp, Homo sapiens
tcacacacatttgctgtctgat

SEQ ID NO: 10025182 - DNA, 22 bp, Homo sapiens
tcacagcaaaagtgtgcagagc

SEQ ID NO: 10025183 - DNA, 22 bp, Homo sapiens
tcacagcagaatttaggaggca

SEQ ID NO: 10025184 - DNA, 16 bp, Homo sapiens
tcacatacttccttgc

SEQ ID NO: 10025185 - DNA, 22 bp, Homo sapiens
tcatccctaaggacagctctgc

SEQ ID NO: 10025186 - DNA, 22 bp, Homo sapiens
tcaggctctgccacctagatta

SEQ ID NO: 10025187 - DNA, 22 bp, Homo sapiens
tcaggctctgggtacacctgac

SEQ ID NO: 10025188 - DNA, 18 bp, Homo sapiens
tcaggctctctggctaga

SEQ ID NO: 10025189 - DNA, 22 bp, Homo sapiens
tcaggctctgagctgatgctaa

SEQ ID NO: 10025190 - DNA, 22 bp, Homo sapiens
tcaggctcaggaatgtgtttat

SEQ ID NO: 10025191 - DNA, 22 bp, Homo sapiens
tcaggctcaaagggccggatga

SEQ ID NO: 10025192 - DNA, 22 bp, Homo sapiens
tcaggctcaggttaggggccaa

SEQ ID NO: 10025193 - DNA, 22 bp, Homo sapiens
tcaggctccctgctgggctctg

SEQ ID NO: 10025194 - DNA, 22 bp, Homo sapiens
tcaggctctcagaccaacagca

SEQ ID NO: 10025195 - DNA, 22 bp, Homo sapiens
tcaggctctacacttgacacac

SEQ ID NO: 10025196 - DNA, 20 bp, Homo sapiens
tcaggctccgcattaactta

SEQ ID NO: 10025197 - DNA, 22 bp, Homo sapiens
tcagggttgctgtgatcagtcc

SEQ ID NO: 10025198 - DNA, 22 bp, Homo sapiens
tcagcctcaggtgttcagattt

SEQ ID NO: 10025199 - DNA, 22 bp, Homo sapiens
tcagcctccgaaagtgctggga

SEQ ID NO: 10025200 - DNA, 22 bp, Homo sapiens
gccttattacctgcactttgaa

SEQ ID NO: 10025201 - DNA, 22 bp, Homo sapiens
gcctggggaacttgatcctgtc

SEQ ID NO: 10025202 - DNA, 20 bp, Homo sapiens
gctcaagagcccattctgaa

SEQ ID NO: 10025203 - DNA, 22 bp, Homo sapiens
gctcacagccggctggcagggg

SEQ ID NO: 10025204 - DNA, 22 bp, Homo sapiens
gctctcagatgctccagcagcc

SEQ ID NO: 10025205 - DNA, 22 bp, Homo sapiens
ggaaccacagcccccagcaggc

SEQ ID NO: 10025206 - DNA, 22 bp, Homo sapiens
ggaagcaggaggctggggtaaa

SEQ ID NO: 10025207 - DNA, 23 bp, Homo sapiens
ggacacatttatttcagaattca

SEQ ID NO: 10025208 - DNA, 21 bp, Homo sapiens
ggacaccagtcacactggatt

SEQ ID NO: 10025209 - DNA, 22 bp, Homo sapiens
ggagagcttggagtgcgatttt

SEQ ID NO: 10025210 - DNA, 22 bp, Homo sapiens
gcaggctcttctttctgcccag

SEQ ID NO: 10025211 - DNA, 22 bp, Homo sapiens
gcaggctcgttggaagtcccct

SEQ ID NO: 10025212 - DNA, 22 bp, Homo sapiens
gcaggctcccttgcagagcagg

SEQ ID NO: 10025213 - DNA, 20 bp, Homo sapiens
gcaggctccgggcttgggag

SEQ ID NO: 10025214 - DNA, 22 bp, Homo sapiens
gcaggctccaggccggcccctt

SEQ ID NO: 10025215 - DNA, 22 bp, Homo sapiens
gcaggctccaaggcctgggaga

SEQ ID NO: 10025216 - DNA, 22 bp, Homo sapiens
gcaggctcaaaagctggtagga

SEQ ID NO: 10025217 - DNA, 22 bp, Homo sapiens
gcaggctccaactggaggagtt

SEQ ID NO: 10025218 - DNA, 22 bp, Homo sapiens
gcaggctcactctgtttggctc

SEQ ID NO: 10025219 - DNA, 22 bp, Homo sapiens
gcaggctcagagcagattagca

SEQ ID NO: 10025220 - DNA, 22 bp, Homo sapiens
gcactgcttttacctaggtgag

SEQ ID NO: 10025221 - DNA, 22 bp, Homo sapiens
gaggggtccaggaggcacttac

SEQ ID NO: 10025222 - DNA, 22 bp, Homo sapiens
gaggggtcacatgggctggctt

SEQ ID NO: 10025223 - DNA, 22 bp, Homo sapiens
gccaggtggtctggctccagag

SEQ ID NO: 10025224 - DNA, 20 bp, Homo sapiens
gcctcagccaacccatgggg

SEQ ID NO: 10025225 - DNA, 22 bp, Homo sapiens
gccagagaggccttagaatcca

SEQ ID NO: 10025226 - DNA, 22 bp, Homo sapiens
gccaagctcaccttctgatgga

SEQ ID NO: 10025227 - DNA, 22 bp, Homo sapiens
gccaagctctttaaaggccaaa

SEQ ID NO: 10025228 - DNA, 22 bp, Homo sapiens
gccaagctgtttttcagagacg

SEQ ID NO: 10025229 - DNA, 22 bp, Homo sapiens
gccaagctggatgaagaggttg

SEQ ID NO: 10025230 - DNA, 22 bp, Homo sapiens
gccaagcttatatgatgcttga

SEQ ID NO: 10025231 - DNA, 22 bp, Homo sapiens
gccaagctttgcaggagtgttg

SEQ ID NO: 10025232 - DNA, 22 bp, Homo sapiens
gccaagcttggaaggatcatgg

SEQ ID NO: 10025233 - DNA, 22 bp, Homo sapiens
gcatccaaaccattcatcagcc

SEQ ID NO: 10025234 - DNA, 22 bp, Homo sapiens
ggtaacttagctcatggctgtg

SEQ ID NO: 10025235 - DNA, 22 bp, Homo sapiens
ggtacccagggttgcttcaagt

SEQ ID NO: 10025236 - DNA, 22 bp, Homo sapiens
gggtcaggctcagcagggcagc

SEQ ID NO: 10025237 - DNA, 22 bp, Homo sapiens
ggggatggaggcgtgtggtcct

SEQ ID NO: 10025238 - DNA, 22 bp, Homo sapiens
gggctctcatgagtgtgtggta

SEQ ID NO: 10025239 - DNA, 22 bp, Homo sapiens
gtcttctgttctgtgaggcttc

SEQ ID NO: 10025240 - DNA, 19 bp, Homo sapiens
gtcttctgaatgtggctgc

SEQ ID NO: 10025241 - DNA, 22 bp, Homo sapiens
gtaatctcagctacttgggagg

SEQ ID NO: 10025242 - DNA, 22 bp, Homo sapiens
gtagcccacctggggagggcga

SEQ ID NO: 10025243 - DNA, 22 bp, Homo sapiens
gtcctctgcccaggtcaaggtt

SEQ ID NO: 10025244 - DNA, 22 bp, Homo sapiens
gtcctctgaagttgtgcaatgc

SEQ ID NO: 10025245 - DNA, 22 bp, Homo sapiens
gtcctctgaaagatgaaccatg

SEQ ID NO: 10025246 - DNA, 22 bp, Homo sapiens
gtcctctgactcagccttggga

SEQ ID NO: 10025247 - DNA, 22 bp, Homo sapiens
gtcctctgatttctaggtatat

SEQ ID NO: 10025248 - DNA, 22 bp, Homo sapiens
gtcctctgagggggctgcacgc

SEQ ID NO: 10025249 - DNA, 22 bp, Homo sapiens
gtcctctgcccaggtcaaggtt

SEQ ID NO: 10025250 - DNA, 22 bp, Homo sapiens
ggctttgacatgctgaattaaa

SEQ ID NO: 10025251 - DNA, 21 bp, Homo sapiens
ggctaggatgctggggtttcc

SEQ ID NO: 10025252 - DNA, 20 bp, Homo sapiens
ggcagcaggagtttcctctt

SEQ ID NO: 10025253 - DNA, 22 bp, Homo sapiens
ggcaggtaggccccctctccag

SEQ ID NO: 10025254 - DNA, 22 bp, Homo sapiens
ggcagggtttacaatagcaata

SEQ ID NO: 10025255 - DNA, 22 bp, Homo sapiens
ggcctcagaaatagagtaaaat

SEQ ID NO: 10025256 - DNA, 19 bp, Homo sapiens
ggcgggtggactggagccc

SEQ ID NO: 10025257 - DNA, 22 bp, Homo sapiens
ggcgggtgtaagtaggacagcg

SEQ ID NO: 10025258 - DNA, 22 bp, Homo sapiens
ttgtatgaatgtatcctaattt

SEQ ID NO: 10025259 - DNA, 22 bp, Homo sapiens
ttgtatgaggatagcaagaagc

SEQ ID NO: 10025260 - DNA, 22 bp, Homo sapiens
ttgtatgaccacaatctgacgt

SEQ ID NO: 10025261 - DNA, 22 bp, Homo sapiens
ttgtatgagctccaggaactca

SEQ ID NO: 10025262 - DNA, 22 bp, Homo sapiens
ttgtatgagtatggtgtatagg

SEQ ID NO: 10025263 - DNA, 22 bp, Homo sapiens
ttgtatgatcccatttagtgaa

SEQ ID NO: 10025264 - DNA, 22 bp, Homo sapiens
ttgtatgatcaaaagaaatgta

SEQ ID NO: 10025265 - DNA, 19 bp, Homo sapiens
ttggggtgaatgccagaca

SEQ ID NO: 10025266 - DNA, 22 bp, Homo sapiens
ttggcttcttgtgaaatctgag

SEQ ID NO: 10025267 - DNA, 23 bp, Homo sapiens
ttgggctggctctcgatgcctct

SEQ ID NO: 10025268 - DNA, 22 bp, Homo sapiens
ttggcaactctattggcaaata

SEQ ID NO: 10025269 - DNA, 22 bp, Homo sapiens
ttggaagacagtgaaacagcac

SEQ ID NO: 10025270 - DNA, 22 bp, Homo sapiens
ttggaacatgccggggtccagg

SEQ ID NO: 10025271 - DNA, 22 bp, Homo sapiens
tttacactcctggaaatgatat

SEQ ID NO: 10025272 - DNA, 22 bp, Homo sapiens
tttacacttgaggaaactgagg

SEQ ID NO: 10025273 - DNA, 22 bp, Homo sapiens
ttgtttaaaatgtagcaagaaa

SEQ ID NO: 10025274 - DNA, 22 bp, Homo sapiens
tttaacatgtgaattttggaag

SEQ ID NO: 10025275 - DNA, 22 bp, Homo sapiens
ttgtttaaaagaaatcatagaa

SEQ ID NO: 10025276 - DNA, 22 bp, Homo sapiens
ttgttgaattagttgactgtgt

SEQ ID NO: 10025277 - DNA, 22 bp, Homo sapiens
tttcacatggaagctctcgaga

SEQ ID NO: 10025278 - DNA, 22 bp, Homo sapiens
tttcacattggcttctatttct

SEQ ID NO: 10025279 - DNA, 22 bp, Homo sapiens
ttccccttgataatgcagtaag

SEQ ID NO: 10025280 - DNA, 22 bp, Homo sapiens
ttccaagttaggcgagctggtg

SEQ ID NO: 10025281 - DNA, 22 bp, Homo sapiens
ttccaagtgttgagattagagg

SEQ ID NO: 10025282 - DNA, 22 bp, Homo sapiens
ttccaagttgagcgattttcct

SEQ ID NO: 10025283 - DNA, 22 bp, Homo sapiens
ttccaagtgggggaagctgagt

SEQ ID NO: 10025284 - DNA, 22 bp, Homo sapiens
ttccaagtgtcagatcagattt

SEQ ID NO: 10025285 - DNA, 22 bp, Homo sapiens
ttccaagtccagccaggccaaa

SEQ ID NO: 10025286 - DNA, 22 bp, Homo sapiens
ttccaagtcacccttagggtca

SEQ ID NO: 10025287 - DNA, 22 bp, Homo sapiens
ttccaagtctaagttataaatc

SEQ ID NO: 10025288 - DNA, 22 bp, Homo sapiens
ttccaagtgaaagtagctttgt

SEQ ID NO: 10025289 - DNA, 22 bp, Homo sapiens
ttccaagtgcccatatttcatc

SEQ ID NO: 10025290 - DNA, 23 bp, Homo sapiens
ttccaagtgctttacttaatcct

SEQ ID NO: 10025291 - DNA, 22 bp, Homo sapiens
ttccaagtgctgaggacagtag

SEQ ID NO: 10025292 - DNA, 22 bp, Homo sapiens
ttccaagtagaagcatttgcat

SEQ ID NO: 10025293 - DNA, 22 bp, Homo sapiens
ttcaatatcattgtttagtctc

SEQ ID NO: 10025294 - DNA, 22 bp, Homo sapiens
ttcaagatggcaccagtgagtg

SEQ ID NO: 10025295 - DNA, 22 bp, Homo sapiens
ttcaagatggccccagtgagcc

SEQ ID NO: 10025296 - DNA, 22 bp, Homo sapiens
ttattttaccttcctctgagct

SEQ ID NO: 10025297 - DNA, 22 bp, Homo sapiens
ttatttaatgtgatctgaagag

SEQ ID NO: 10025298 - DNA, 20 bp, Homo sapiens
ttttccactcctcaaaacag

SEQ ID NO: 10025299 - DNA, 22 bp, Homo sapiens
ttttcccatctacaaagcaggg

SEQ ID NO: 10025300 - DNA, 22 bp, Homo sapiens
ttttcctctgagctttgaataa

SEQ ID NO: 10025301 - DNA, 19 bp, Homo sapiens
ttttccttctatatgtttc

SEQ ID NO: 10025302 - DNA, 22 bp, Homo sapiens
tttgggttaagagatggtacca

SEQ ID NO: 10025303 - DNA, 22 bp, Homo sapiens
acatcacacgccttccaggagg

SEQ ID NO: 10025304 - DNA, 22 bp, Homo sapiens
acatcacagagcccagataaag

SEQ ID NO: 10025305 - DNA, 22 bp, Homo sapiens
acatcacagtagttaagccaga

SEQ ID NO: 10025306 - DNA, 22 bp, Homo sapiens
acatgtttaagtttgttatatg

SEQ ID NO: 10025307 - DNA, 22 bp, Homo sapiens
accagccaccaccaggagatcg

SEQ ID NO: 10025308 - DNA, 22 bp, Homo sapiens
acccaggagacggaggtgcagt

SEQ ID NO: 10025309 - DNA, 22 bp, Homo sapiens
acatattaactgcactacacta

SEQ ID NO: 10025310 - DNA, 22 bp, Homo sapiens
acaggaggggcatgaaagacgg

SEQ ID NO: 10025311 - DNA, 22 bp, Homo sapiens
aggacacacagaatacaaatcc

SEQ ID NO: 10025312 - DNA, 22 bp, Homo sapiens
actgcacttcagcctgggtgtc

SEQ ID NO: 10025313 - DNA, 22 bp, Homo sapiens
actgcacttcagcctgggtgac

SEQ ID NO: 10025314 - DNA, 18 bp, Homo sapiens
actggctttagcatcaga

SEQ ID NO: 10025315 - DNA, 22 bp, Homo sapiens
acgcctgtaatcccagcacttt

SEQ ID NO: 10025316 - DNA, 22 bp, Homo sapiens
ataaaatttgctactgttaaat

SEQ ID NO: 10025317 - DNA, 22 bp, Homo sapiens
atactgtacgtcccagatagga

SEQ ID NO: 10025318 - DNA, 22 bp, Homo sapiens
atattcatcgtgtagaaatact

SEQ ID NO: 10025319 - DNA, 22 bp, Homo sapiens
actttcccacttaatgtattta

SEQ ID NO: 10025320 - DNA, 22 bp, Homo sapiens
agcaggctccttccttctctgg

SEQ ID NO: 10025321 - DNA, 22 bp, Homo sapiens
agcaggctccaggctggccatc

SEQ ID NO: 10025322 - DNA, 22 bp, Homo sapiens
agcaggctgatgggcatgcttg

SEQ ID NO: 10025323 - DNA, 22 bp, Homo sapiens
agcaggctgagcacccaggggg

SEQ ID NO: 10025324 - DNA, 17 bp, Homo sapiens
agcaggctgcagaggcc

SEQ ID NO: 10025325 - DNA, 22 bp, Homo sapiens
cacaattttaatacacagtcaa

SEQ ID NO: 10025326 - DNA, 22 bp, Homo sapiens
cacacacagttttgtattctgt

SEQ ID NO: 10025327 - DNA, 22 bp, Homo sapiens
cacacactcttcctggcaccta

SEQ ID NO: 10025328 - DNA, 22 bp, Homo sapiens
cacacactgacaccttatcttg

SEQ ID NO: 10025329 - DNA, 22 bp, Homo sapiens
cacacactgttaatgtaggagt

SEQ ID NO: 10025330 - DNA, 22 bp, Homo sapiens
cacacactggagcaaggagatg

SEQ ID NO: 10025331 - DNA, 22 bp, Homo sapiens
cacctagggtttcgcctttctt

SEQ ID NO: 10025332 - DNA, 22 bp, Homo sapiens
cactgcacttcagcctgggtga

SEQ ID NO: 10025333 - DNA, 20 bp, Homo sapiens
agcaggtaaggcacagcagt

SEQ ID NO: 10025334 - DNA, 23 bp, Homo sapiens
agcaggctgcttctccacagctg

SEQ ID NO: 10025335 - DNA, 20 bp, Homo sapiens
agcaggctgcagggtgaaat

SEQ ID NO: 10025336 - DNA, 22 bp, Homo sapiens
agcaggctgccttccaaagcct

SEQ ID NO: 10025337 - DNA, 22 bp, Homo sapiens
agcaggctgctggcgttgaagt

SEQ ID NO: 10025338 - DNA, 22 bp, Homo sapiens
agcaggggctcctccacagcca

SEQ ID NO: 10025339 - DNA, 22 bp, Homo sapiens
caacagagagaccagaaacagg

SEQ ID NO: 10025340 - DNA, 21 bp, Homo sapiens
cagaggcaggtcctgggacgg

SEQ ID NO: 10025341 - DNA, 22 bp, Homo sapiens
cagaggcatataattgctgggg

SEQ ID NO: 10025342 - DNA, 22 bp, Homo sapiens
cagaaggagggggcaagccctg

SEQ ID NO: 10025343 - DNA, 22 bp, Homo sapiens
agccaccttctccaaggcctag

SEQ ID NO: 10025344 - DNA, 22 bp, Homo sapiens
agcctgagagccaagctgtgca

SEQ ID NO: 10025345 - DNA, 22 bp, Homo sapiens
agcctccatctcccatctgtga

SEQ ID NO: 10025346 - DNA, 22 bp, Homo sapiens
cagctcaggctctccatgctcc

SEQ ID NO: 10025347 - DNA, 22 bp, Homo sapiens
cagctcagtctggagagatgca

SEQ ID NO: 10025348 - DNA, 22 bp, Homo sapiens
cagctcagtcttgaagcactgg

SEQ ID NO: 10025349 - DNA, 22 bp, Homo sapiens
agagaagagtcttgtcaaatta

SEQ ID NO: 10025350 - DNA, 22 bp, Homo sapiens
agagacagggttttgtcgtgtt

SEQ ID NO: 10025351 - DNA, 22 bp, Homo sapiens
atggctagcaccgcgttgctgg

SEQ ID NO: 10025352 - DNA, 22 bp, Homo sapiens
agagagttgaggaagcaacact

SEQ ID NO: 10025353 - DNA, 22 bp, Homo sapiens
attcatgttagcccacatgtag

SEQ ID NO: 10025354 - DNA, 20 bp, Homo sapiens
attcatgtctttataaaagc

SEQ ID NO: 10025355 - DNA, 22 bp, Homo sapiens
agaggcaggaagagctgatttt

SEQ ID NO: 10025356 - DNA, 22 bp, Homo sapiens
atgtttatgcaaacatgtgagt

SEQ ID NO: 10025357 - DNA, 22 bp, Homo sapiens
atgtttactggtttatagaata

SEQ ID NO: 10025358 - DNA, 21 bp, Homo sapiens
atgtttacactgactactgtg

SEQ ID NO: 10025359 - DNA, 22 bp, Homo sapiens
atgtttacaattcagtattaca

SEQ ID NO: 10025360 - DNA, 22 bp, Homo sapiens
agaggacaggttttccatgggc

SEQ ID NO: 10025361 - DNA, 22 bp, Homo sapiens
agaggtctgactcagcagatta

SEQ ID NO: 10025362 - DNA, 22 bp, Homo sapiens
aatataatgctgttttatgcca

SEQ ID NO: 10025363 - DNA, 22 bp, Homo sapiens
aacagcataccaatgtacatat

SEQ ID NO: 10025364 - DNA, 22 bp, Homo sapiens
aacagcagctttcaggatcatc

SEQ ID NO: 10025365 - DNA, 22 bp, Homo sapiens
aacagccactgatactgaatag

SEQ ID NO: 10025366 - DNA, 22 bp, Homo sapiens
aacagcatgctgggtaacattg

SEQ ID NO: 10025367 - DNA, 23 bp, Homo sapiens
aacagccaactttagcgggtggc

SEQ ID NO: 10025368 - DNA, 22 bp, Homo sapiens
aaaatattttagggccaggaga

SEQ ID NO: 10025369 - DNA, 22 bp, Homo sapiens
aaattacagatcaccaatgcat

SEQ ID NO: 10025370 - DNA, 22 bp, Homo sapiens
aaacagtttataacatgatact

SEQ ID NO: 10025371 - DNA, 22 bp, Homo sapiens
aaacagtttcattttcatgacc

SEQ ID NO: 10025372 - DNA, 22 bp, Homo sapiens
aaacagtttctaatcatggaga

SEQ ID NO: 10025373 - DNA, 22 bp, Homo sapiens
aaagtactaatgaatattttgc

SEQ ID NO: 10025374 - DNA, 22 bp, Homo sapiens
aacaaacaaacattttgtcatc

SEQ ID NO: 10025375 - DNA, 22 bp, Homo sapiens
aaagccagtttgtctctttaaa

SEQ ID NO: 10025376 - DNA, 22 bp, Homo sapiens
aaagccagttcttagagaaagc

SEQ ID NO: 10025377 - DNA, 22 bp, Homo sapiens
aaagccagtggtatgagagaaa

SEQ ID NO: 10025378 - DNA, 22 bp, Homo sapiens
aaagccagggtccaggcctgcc

SEQ ID NO: 10025379 - DNA, 22 bp, Homo sapiens
aataattagtgggacagagaac

SEQ ID NO: 10025380 - DNA, 22 bp, Homo sapiens
aataattatttgagagcagacc

SEQ ID NO: 10025381 - DNA, 20 bp, Homo sapiens
actccaggtggcatgaggac

SEQ ID NO: 10025382 - DNA, 22 bp, Homo sapiens
acagttcccgtcttgcacagct

SEQ ID NO: 10025383 - DNA, 22 bp, Homo sapiens
aaggcaggtattgatgccacag

SEQ ID NO: 10025384 - DNA, 21 bp, Homo sapiens
aaggcagaagcatggaatgag

SEQ ID NO: 10025385 - DNA, 22 bp, Homo sapiens
aaggtggaggttgcagtgagct

SEQ ID NO: 10025386 - DNA, 18 bp, Homo sapiens
aaggtctgtctggtaggt

SEQ ID NO: 10025387 - DNA, 22 bp, Homo sapiens
aaggtctgttgagtgaatagta

SEQ ID NO: 10025388 - DNA, 22 bp, Homo sapiens
aagtacttgatagattaactgt

SEQ ID NO: 10025389 - DNA, 22 bp, Homo sapiens
aagtactttaggatatgtaact

SEQ ID NO: 10025390 - DNA, 22 bp, Homo sapiens
acagattcactgcactggccat

SEQ ID NO: 10025391 - DNA, 20 bp, Homo sapiens
agcctgccagctggcccaga

SEQ ID NO: 10025392 - DNA, 22 bp, Homo sapiens
agctagggcaaatatgagatac

SEQ ID NO: 10025393 - DNA, 23 bp, Homo sapiens
acactgtctcatggatagactgc

SEQ ID NO: 10025394 - DNA, 22 bp, Homo sapiens
acacatttgcataatacctcat

SEQ ID NO: 10025395 - DNA, 19 bp, Homo sapiens
acacatttgcacaatccac

SEQ ID NO: 10025396 - DNA, 23 bp, Homo sapiens
acacatatattcagatacagatg

SEQ ID NO: 10025397 - DNA, 22 bp, Homo sapiens
acaattctgatggtttcccagt

SEQ ID NO: 10025398 - DNA, 22 bp, Homo sapiens
acaattctgatggtttcccagt

SEQ ID NO: 10025399 - DNA, 22 bp, Homo sapiens
agcaccatcacagctgtatgtc

SEQ ID NO: 10025400 - DNA, 22 bp, Homo sapiens
aattatacattgaacaatctag

SEQ ID NO: 10025401 - DNA, 19 bp, Homo sapiens
agacagagctcagtgggtt

SEQ ID NO: 10025402 - DNA, 23 bp, Homo sapiens
agacagaggctgaggctggccgc

SEQ ID NO: 10025403 - DNA, 22 bp, Homo sapiens
agacagcacttttgtatggggg

SEQ ID NO: 10025404 - DNA, 22 bp, Homo sapiens
agacagcaatatgggagacgga

SEQ ID NO: 10025405 - DNA, 19 bp, Homo sapiens
cttctccagcttctagaag

SEQ ID NO: 10025406 - DNA, 21 bp, Homo sapiens
atctttattacgcagagaaga

SEQ ID NO: 10025407 - DNA, 22 bp, Homo sapiens
ctttattagatgtagactttct

SEQ ID NO: 10025408 - DNA, 22 bp, Homo sapiens
atgcctggactgtatcccagat

SEQ ID NO: 10025409 - DNA, 22 bp, Homo sapiens
atgcctggatttgggactcaaa

SEQ ID NO: 10025410 - DNA, 22 bp, Homo sapiens
atgcctggactgacatgcactg

SEQ ID NO: 10025411 - DNA, 22 bp, Homo sapiens
atggcagacctcctggccacaa

SEQ ID NO: 10025412 - DNA, 22 bp, Homo sapiens
atggcagacgaggcagcagggg

SEQ ID NO: 10025413 - DNA, 22 bp, Homo sapiens
atgggagggtggaaaggctctg

SEQ ID NO: 10025414 - DNA, 22 bp, Homo sapiens
atgtatgaagctttgtttggga

SEQ ID NO: 10025415 - DNA, 22 bp, Homo sapiens
atgtatgagagattcttttatt

SEQ ID NO: 10025416 - DNA, 19 bp, Homo sapiens
atgtatgaggtcttctgct

SEQ ID NO: 10025417 - DNA, 22 bp, Homo sapiens
atgtatgatatttccagtatca

SEQ ID NO: 10025418 - DNA, 22 bp, Homo sapiens
atgtatgatgctaggctctcag

SEQ ID NO: 10025419 - DNA, 22 bp, Homo sapiens
gaggctctgtgatgtgccaggc

SEQ ID NO: 10025420 - DNA, 22 bp, Homo sapiens
gaggttcagtcctgctctgtca

SEQ ID NO: 10025421 - DNA, 22 bp, Homo sapiens
gaggttcagtaaggaatactga

SEQ ID NO: 10025422 - DNA, 22 bp, Homo sapiens
gaggttcaggacatttctgggg

SEQ ID NO: 10025423 - DNA, 22 bp, Homo sapiens
gaggttcaggaaatgggcaaag

SEQ ID NO: 10025424 - DNA, 22 bp, Homo sapiens
gaggttcagctgctgcctggta

SEQ ID NO: 10025425 - DNA, 22 bp, Homo sapiens
gaggttcacttcctgaaatagc

SEQ ID NO: 10025426 - DNA, 19 bp, Homo sapiens
gaggttcacgcgctggatg

SEQ ID NO: 10025427 - DNA, 22 bp, Homo sapiens
gaggttcacaggctatcacagt

SEQ ID NO: 10025428 - DNA, 22 bp, Homo sapiens
gaggttcacttcctggatcctt

SEQ ID NO: 10025429 - DNA, 22 bp, Homo sapiens
atgtggctggtagttgacaact

SEQ ID NO: 10025430 - DNA, 22 bp, Homo sapiens
atttggtgttcatcttttagtg

SEQ ID NO: 10025431 - DNA, 22 bp, Homo sapiens
attccacttccactagtttctc

SEQ ID NO: 10025432 - DNA, 22 bp, Homo sapiens
attccacacagtaatactcaat

SEQ ID NO: 10025433 - DNA, 22 bp, Homo sapiens
attccacagctacatcaatcta

SEQ ID NO: 10025434 - DNA, 22 bp, Homo sapiens
attgcactccagcctgggtgac

SEQ ID NO: 10025435 - DNA, 22 bp, Homo sapiens
attgcactccggcctgggtgac

SEQ ID NO: 10025436 - DNA, 18 bp, Homo sapiens
attgcacaccagcctggg

SEQ ID NO: 10025437 - DNA, 22 bp, Homo sapiens
attgcactccagcctgggggac

SEQ ID NO: 10025438 - DNA, 22 bp, Homo sapiens
attatattgagtataaccagag

SEQ ID NO: 10025439 - DNA, 22 bp, Homo sapiens
gcaccaggcttagagccccagg

SEQ ID NO: 10025440 - DNA, 22 bp, Homo sapiens
gcacacagctagattaccattc

SEQ ID NO: 10025441 - DNA, 22 bp, Homo sapiens
gcagagaccccgcagtgaggcc

SEQ ID NO: 10025442 - DNA, 22 bp, Homo sapiens
gatggcaggtagtggtctcatc

SEQ ID NO: 10025443 - DNA, 22 bp, Homo sapiens
cactgcactccagcctgggtca

SEQ ID NO: 10025444 - DNA, 22 bp, Homo sapiens
cactgcactccagcctgggaga

SEQ ID NO: 10025445 - DNA, 22 bp, Homo sapiens
cactgcactccagcctgggtga

SEQ ID NO: 10025446 - DNA, 22 bp, Homo sapiens
cacttgttggtggtgaaatcac

SEQ ID NO: 10025447 - DNA, 22 bp, Homo sapiens
cactctccagcacaccccattt

SEQ ID NO: 10025448 - DNA, 22 bp, Homo sapiens
cacattcctggtgctcagcagc

SEQ ID NO: 10025449 - DNA, 22 bp, Homo sapiens
caagctctgggatagcagagag

SEQ ID NO: 10025450 - DNA, 22 bp, Homo sapiens
gctgggctcaccaggccactag

SEQ ID NO: 10025451 - DNA, 22 bp, Homo sapiens
gctgggcttggtttccctgctt

SEQ ID NO: 10025452 - DNA, 20 bp, Homo sapiens
gctgggctttgactgacaca

SEQ ID NO: 10025453 - DNA, 19 bp, Homo sapiens
gctggggaatggatattga

SEQ ID NO: 10025454 - DNA, 22 bp, Homo sapiens
gctggggaccagctgtctctga

SEQ ID NO: 10025455 - DNA, 22 bp, Homo sapiens
gctggggactccccaccatagc

SEQ ID NO: 10025456 - DNA, 22 bp, Homo sapiens
gctggggagaattgggttatct

SEQ ID NO: 10025457 - DNA, 22 bp, Homo sapiens
gctggggagcaagagtagtgag

SEQ ID NO: 10025458 - DNA, 22 bp, Homo sapiens
gctggggagctagacctcagca

SEQ ID NO: 10025459 - DNA, 22 bp, Homo sapiens
caatactgagtttacattcatc

SEQ ID NO: 10025460 - DNA, 22 bp, Homo sapiens
ggagaagggtatgtgtggcgga

SEQ ID NO: 10025461 - DNA, 22 bp, Homo sapiens
cacacagtaggcactcattaat

SEQ ID NO: 10025462 - DNA, 21 bp, Homo sapiens
cacacagtgatctatccacat

SEQ ID NO: 10025463 - DNA, 22 bp, Homo sapiens
ggagaaggcacacccacctctg

SEQ ID NO: 10025464 - DNA, 20 bp, Homo sapiens
cacaactgtccacatgctcc

SEQ ID NO: 10025465 - DNA, 22 bp, Homo sapiens
ggtagtttaagaaataattgtt

SEQ ID NO: 10025466 - DNA, 22 bp, Homo sapiens
ggtatgaattcactacttccaa

SEQ ID NO: 10025467 - DNA, 22 bp, Homo sapiens
ggtatgaaatgattccatgtta

SEQ ID NO: 10025468 - DNA, 22 bp, Homo sapiens
cagatgaggggcatataacaat

SEQ ID NO: 10025469 - DNA, 22 bp, Homo sapiens
ggggccttttctgaatgtggaa

SEQ ID NO: 10025470 - DNA, 22 bp, Homo sapiens
gggctgtaggagctggaatggg

SEQ ID NO: 10025471 - DNA, 22 bp, Homo sapiens
cagagcagtgaggagttgtgta

SEQ ID NO: 10025472 - DNA, 22 bp, Homo sapiens
gtaggcagtctctcaggtgatc

SEQ ID NO: 10025473 - DNA, 21 bp, Homo sapiens
gtacacacaggtggatgggct

SEQ ID NO: 10025474 - DNA, 22 bp, Homo sapiens
gtacacactatttaaagtgttt

SEQ ID NO: 10025475 - DNA, 22 bp, Homo sapiens
gtacacactatgtattgtacac

SEQ ID NO: 10025476 - DNA, 22 bp, Homo sapiens
gtacacactgtttgatcatttc

SEQ ID NO: 10025477 - DNA, 22 bp, Homo sapiens
gtcacacagggcctccaaatca

SEQ ID NO: 10025478 - DNA, 22 bp, Homo sapiens
gtgagagggctgggctcatgat

SEQ ID NO: 10025479 - DNA, 22 bp, Homo sapiens
cagccctcatctcagcttcttt

SEQ ID NO: 10025480 - DNA, 20 bp, Homo sapiens
cagccctccagtggaggcag

SEQ ID NO: 10025481 - DNA, 22 bp, Homo sapiens
aggccagaaatttggagtatgt

SEQ ID NO: 10025482 - DNA, 22 bp, Homo sapiens
aggccagaaatgtcagggagtg

SEQ ID NO: 10025483 - DNA, 22 bp, Homo sapiens
ccacagctgaccgcaggtgagc

SEQ ID NO: 10025484 - DNA, 22 bp, Homo sapiens
aggcaggggagctggaagggta

SEQ ID NO: 10025485 - DNA, 22 bp, Homo sapiens
aggctcctgcaggtgaggtgct

SEQ ID NO: 10025486 - DNA, 22 bp, Homo sapiens
ccctctctcaggctgacagcct

SEQ ID NO: 10025487 - DNA, 18 bp, Homo sapiens
ccctcttgcacaaagcaa

SEQ ID NO: 10025488 - DNA, 22 bp, Homo sapiens
cctgaggcaaggacttggtggc

SEQ ID NO: 10025489 - DNA, 22 bp, Homo sapiens
ccaagctacttaggagtctgag

SEQ ID NO: 10025490 - DNA, 19 bp, Homo sapiens
aggagaagtagcagaaatt

SEQ ID NO: 10025491 - DNA, 22 bp, Homo sapiens
aggagaagccaagttgtgagca

SEQ ID NO: 10025492 - DNA, 22 bp, Homo sapiens
catagagtgatgtaaggtatgt

SEQ ID NO: 10025493 - DNA, 22 bp, Homo sapiens
cagggctccccagagagcctct

SEQ ID NO: 10025494 - DNA, 22 bp, Homo sapiens
caggctgcctggaagaggactg

SEQ ID NO: 10025495 - DNA, 22 bp, Homo sapiens
agctgcagcactccagtagccg

SEQ ID NO: 10025496 - DNA, 22 bp, Homo sapiens
agctgccaagtttctcagttta

SEQ ID NO: 10025497 - DNA, 22 bp, Homo sapiens
cagctctgggtaggaggaatct

SEQ ID NO: 10025498 - DNA, 22 bp, Homo sapiens
agtcagagttttgaggtgtgac

SEQ ID NO: 10025499 - DNA, 22 bp, Homo sapiens
cgctaggattaggattaatcct

SEQ ID NO: 10025500 - DNA, 22 bp, Homo sapiens
cgcgaggtggaggttgcagtga

SEQ ID NO: 10025501 - DNA, 23 bp, Homo sapiens
aggtgtgcttctgggcacctggg

SEQ ID NO: 10025502 - DNA, 22 bp, Homo sapiens
aggtgagttacaggaggaggtc

SEQ ID NO: 10025503 - DNA, 22 bp, Homo sapiens
aggtgagttggtaggaagtttg

SEQ ID NO: 10025504 - DNA, 22 bp, Homo sapiens
aggtgagtcctgggcacaggta

SEQ ID NO: 10025505 - DNA, 19 bp, Homo sapiens
aggtgagtgtgggaaaggg

SEQ ID NO: 10025506 - DNA, 22 bp, Homo sapiens
agtctctttctaaataaggtca

SEQ ID NO: 10025507 - DNA, 18 bp, Homo sapiens
ctccagggaactcagtca

SEQ ID NO: 10025508 - DNA, 22 bp, Homo sapiens
ctcttaaagaatgttccagctg

SEQ ID NO: 10025509 - DNA, 19 bp, Homo sapiens
ctgagagatgcttcacaca

SEQ ID NO: 10025510 - DNA, 22 bp, Homo sapiens
ctctgagatagtttctatcaat

SEQ ID NO: 10025511 - DNA, 22 bp, Homo sapiens
atctccagattgtgatcatcag

SEQ ID NO: 10025512 - DNA, 22 bp, Homo sapiens
atctcccagccacagcattctt

SEQ ID NO: 10025513 - DNA, 18 bp, Homo sapiens
atccttgatgagaggtct

SEQ ID NO: 10025514 - DNA, 23 bp, Homo sapiens
cttcacaatcaaaatcagttctg

SEQ ID NO: 10025515 - DNA, 22 bp, Homo sapiens
ctgtaatcccagctactcggga

SEQ ID NO: 10025516 - DNA, 22 bp, Homo sapiens
ctgtatgaggatcagactggac

SEQ ID NO: 10025517 - DNA, 22 bp, Homo sapiens
ctgtatgagttgggaatagaat

SEQ ID NO: 10025518 - DNA, 23 bp, Homo sapiens
ctgtatgatgttaagtggaaagc

SEQ ID NO: 10025519 - DNA, 22 bp, Homo sapiens
ctgtatgatatccaaattgata

SEQ ID NO: 10025520 - DNA, 22 bp, Homo sapiens
ctgtatgattccatttctataa

SEQ ID NO: 10025521 - DNA, 22 bp, Homo sapiens
ctgtatgaacccatatacttat

SEQ ID NO: 10025522 - DNA, 22 bp, Homo sapiens
ctgtatgaaattgtcattttta

SEQ ID NO: 10025523 - DNA, 22 bp, Homo sapiens
ctgtatgaaattaagtaaacag

SEQ ID NO: 10025524 - DNA, 22 bp, Homo sapiens
ctggtggagggacaggcttagc

SEQ ID NO: 10025525 - DNA, 22 bp, Homo sapiens
ctggtggagagtgggctctgga

SEQ ID NO: 10025526 - DNA, 22 bp, Homo sapiens
ctggtggaggtgccaggatttg

SEQ ID NO: 10025527 - DNA, 22 bp, Homo sapiens
ctgggctgtcagttttgtttta

SEQ ID NO: 10025528 - DNA, 22 bp, Homo sapiens
agtttacaacagtagctatgga

SEQ ID NO: 10025529 - DNA, 22 bp, Homo sapiens
agttttcctctcatttatcaat

SEQ ID NO: 10025530 - DNA, 22 bp, Homo sapiens
atacatgactcacacattctgc

SEQ ID NO: 10025531 - DNA, 22 bp, Homo sapiens
ataatggccgggggctgaatgc

SEQ ID NO: 10025532 - DNA, 22 bp, Homo sapiens
atagggcctaaaaagtattgct

SEQ ID NO: 10025533 - DNA, 22 bp, Homo sapiens
atagtaagtgatagcatagact

SEQ ID NO: 10025534 - DNA, 23 bp, Homo sapiens
cagtgtgacgaggtgaggcaggc

SEQ ID NO: 10025535 - DNA, 22 bp, Homo sapiens
tatttataacagtgagaacggg

SEQ ID NO: 10025536 - DNA, 22 bp, Homo sapiens
cagtatagaaagttttaaattg

SEQ ID NO: 10025537 - DNA, 22 bp, Homo sapiens
tcacagagaaatgtggcacaaa

SEQ ID NO: 10025538 - DNA, 22 bp, Homo sapiens
tcacagcttcttgcgggtctga

SEQ ID NO: 10025539 - DNA, 22 bp, Homo sapiens
tagaatatgattaattttctta

SEQ ID NO: 10025540 - DNA, 22 bp, Homo sapiens
tagaatatgtggtgtatacttt

SEQ ID NO: 10025541 - DNA, 22 bp, Homo sapiens
tagaatatgattaattttctta

SEQ ID NO: 10025542 - DNA, 19 bp, Homo sapiens
tagaggagaagggaagtgg

SEQ ID NO: 10025543 - DNA, 22 bp, Homo sapiens
tagaggagaacacaaattatag

SEQ ID NO: 10025544 - DNA, 22 bp, Homo sapiens
tagctacaaggaagaatggaaa

SEQ ID NO: 10025545 - DNA, 21 bp, Homo sapiens
taggagctgatggggaagtag

SEQ ID NO: 10025546 - DNA, 22 bp, Homo sapiens
taggaggagggcatttgaagta

SEQ ID NO: 10025547 - DNA, 22 bp, Homo sapiens
taggagaagagtcagggcctaa

SEQ ID NO: 10025548 - DNA, 22 bp, Homo sapiens
catcttttcagaagccattctg

SEQ ID NO: 10025549 - DNA, 19 bp, Homo sapiens
catgttatgctgtagtatc

SEQ ID NO: 10025550 - DNA, 22 bp, Homo sapiens
catgttatttatccattaaaca

SEQ ID NO: 10025551 - DNA, 22 bp, Homo sapiens
catgtttaattgcgatgtttga

SEQ ID NO: 10025552 - DNA, 22 bp, Homo sapiens
cattcacaaaaccacatgccat

SEQ ID NO: 10025553 - DNA, 22 bp, Homo sapiens
cattcactcagcgatgccagta

SEQ ID NO: 10025554 - DNA, 22 bp, Homo sapiens
tctccacactttctctcccagg

SEQ ID NO: 10025555 - DNA, 22 bp, Homo sapiens
tcgcttgaacccaggaagtgga

SEQ ID NO: 10025556 - DNA, 22 bp, Homo sapiens
ccacccttgggttcggaggccg

SEQ ID NO: 10025557 - DNA, 18 bp, Homo sapiens
tcctctctttccccaggg

SEQ ID NO: 10025558 - DNA, 22 bp, Homo sapiens
tctgcagaaggaatcagctgag

SEQ ID NO: 10025559 - DNA, 19 bp, Homo sapiens
tctgcagaaggcatacatg

SEQ ID NO: 10025560 - DNA, 22 bp, Homo sapiens
tctcttaaaggtcttcagctga

SEQ ID NO: 10025561 - DNA, 22 bp, Homo sapiens
tctcttaaaagagtaatagaga

SEQ ID NO: 10025562 - DNA, 21 bp, Homo sapiens
tgtaagtttcatctgaattgg

SEQ ID NO: 10025563 - DNA, 22 bp, Homo sapiens
tgggtaggggacgtggaagaaa

SEQ ID NO: 10025564 - DNA, 22 bp, Homo sapiens
cctgcctgtctttatcccctgt

SEQ ID NO: 10025565 - DNA, 22 bp, Homo sapiens
tggtctgcattatctgtaatgg

SEQ ID NO: 10025566 - DNA, 22 bp, Homo sapiens
cctgaggggctgcaggccagct

SEQ ID NO: 10025567 - DNA, 22 bp, Homo sapiens
tggaggtgagtgtggtacagca

SEQ ID NO: 10025568 - DNA, 22 bp, Homo sapiens
ccggctactcgggaggctgacg

SEQ ID NO: 10025569 - DNA, 22 bp, Homo sapiens
tggctaggaatccatgactctc

SEQ ID NO: 10025570 - DNA, 22 bp, Homo sapiens
tggctaggactcatcctgtttc

SEQ ID NO: 10025571 - DNA, 22 bp, Homo sapiens
tggctaggtagctttctgctgt

SEQ ID NO: 10025572 - DNA, 22 bp, Homo sapiens
tggctacaaggtggctattcta

SEQ ID NO: 10025573 - DNA, 21 bp, Homo sapiens
tggctacagtggtaagaactg

SEQ ID NO: 10025574 - DNA, 22 bp, Homo sapiens
tggctacagcaagaggaaagaa

SEQ ID NO: 10025575 - DNA, 22 bp, Homo sapiens
tggctacagacattcctaggga

SEQ ID NO: 10025576 - DNA, 22 bp, Homo sapiens
tggctacatttgttgatcactt

SEQ ID NO: 10025577 - DNA, 22 bp, Homo sapiens
tggctacatttatactctcatt

SEQ ID NO: 10025578 - DNA, 18 bp, Homo sapiens
tgaggcagtcagtgatgg

SEQ ID NO: 10025579 - DNA, 22 bp, Homo sapiens
cccacactctgagaaatgctga

SEQ ID NO: 10025580 - DNA, 22 bp, Homo sapiens
cccagagggtggaggttgcagt

SEQ ID NO: 10025581 - DNA, 22 bp, Homo sapiens
tgcagtgagaagcagttatgat

SEQ ID NO: 10025582 - DNA, 22 bp, Homo sapiens
tgcagtgaaagtatcttaattt

SEQ ID NO: 10025583 - DNA, 21 bp, Homo sapiens
tgcagtgaggggagctgtcag

SEQ ID NO: 10025584 - DNA, 22 bp, Homo sapiens
cccagctccagagccagaaaca

SEQ ID NO: 10025585 - DNA, 22 bp, Homo sapiens
cccagcatgcacgctgacactc

SEQ ID NO: 10025586 - DNA, 22 bp, Homo sapiens
cccagcccccgagtgtctggaa

SEQ ID NO: 10025587 - DNA, 19 bp, Homo sapiens
cccaggaggcggaggttgc

SEQ ID NO: 10025588 - DNA, 22 bp, Homo sapiens
tgagagtctgttcctcttgcag

SEQ ID NO: 10025589 - DNA, 22 bp, Homo sapiens
tgagagtctcagacctcctggt

SEQ ID NO: 10025590 - DNA, 22 bp, Homo sapiens
ccaggctcacctggagcccctg

SEQ ID NO: 10025591 - DNA, 22 bp, Homo sapiens
ccaggctcacagcatcccagga

SEQ ID NO: 10025592 - DNA, 17 bp, Homo sapiens
ccaggctccatcactgt

SEQ ID NO: 10025593 - DNA, 22 bp, Homo sapiens
ccaggctcagggcagactttca

SEQ ID NO: 10025594 - DNA, 22 bp, Homo sapiens
ccaggctcaggtgcgagagaca

SEQ ID NO: 10025595 - DNA, 22 bp, Homo sapiens
ccaggctcaggcctgctcgttg

SEQ ID NO: 10025596 - DNA, 22 bp, Homo sapiens
ccaggctcactgactaccacat

SEQ ID NO: 10025597 - DNA, 22 bp, Homo sapiens
ccaggctcagctattaagaaac

SEQ ID NO: 10025598 - DNA, 22 bp, Homo sapiens
ccaggctcagcgcgcacgtctg

SEQ ID NO: 10025599 - DNA, 22 bp, Homo sapiens
tctttatttaagtctgttgtaa

SEQ ID NO: 10025600 - DNA, 22 bp, Homo sapiens
tctttatttctgaatcccccat

SEQ ID NO: 10025601 - DNA, 22 bp, Homo sapiens
tctttattttatgcttgtgcaa

SEQ ID NO: 10025602 - DNA, 22 bp, Homo sapiens
tctgcagaattcgaggaagaaa

SEQ ID NO: 10025603 - DNA, 23 bp, Homo sapiens
tctgcagacgctgttctattgtc

SEQ ID NO: 10025604 - DNA, 17 bp, Homo sapiens
tctgcagaggcaaacct

SEQ ID NO: 10025605 - DNA, 22 bp, Homo sapiens
tgaaggaatgagtatactgttt

SEQ ID NO: 10025606 - DNA, 22 bp, Homo sapiens
tgaacactgccatatttaagaa

SEQ ID NO: 10025607 - DNA, 22 bp, Homo sapiens
ccaggctcctcatgatcttgtt

SEQ ID NO: 10025608 - DNA, 22 bp, Homo sapiens
ccaggctccgcatagaccccac

SEQ ID NO: 10025609 - DNA, 22 bp, Homo sapiens
ccaggctccccaggaggccctt

SEQ ID NO: 10025610 - DNA, 22 bp, Homo sapiens
tttctacatgtcaatccaaacc

SEQ ID NO: 10025611 - DNA, 18 bp, Homo sapiens
ctctctttccactctttg

SEQ ID NO: 10025612 - DNA, 22 bp, Homo sapiens
tttccactctggccaccatctt

SEQ ID NO: 10025613 - DNA, 22 bp, Homo sapiens
tttccacaatgtttttgcagga

SEQ ID NO: 10025614 - DNA, 22 bp, Homo sapiens
ctctgaaggtttctgttactgt

SEQ ID NO: 10025615 - DNA, 22 bp, Homo sapiens
tttgaaaagaaccatcgcctta

SEQ ID NO: 10025616 - DNA, 22 bp, Homo sapiens
ctgcaggagggctggggaagcc

SEQ ID NO: 10025617 - DNA, 22 bp, Homo sapiens
ctggaaagtgtctccatcctgg

SEQ ID NO: 10025618 - DNA, 22 bp, Homo sapiens
cgctgataaacgtcacgttccc

SEQ ID NO: 10025619 - DNA, 22 bp, Homo sapiens
ccttttcccatgtttctggagc

SEQ ID NO: 10025620 - DNA, 22 bp, Homo sapiens
cgagagttagctaggagtcaca

SEQ ID NO: 10025621 - DNA, 22 bp, Homo sapiens
cggggccctggggctgaaggtc

SEQ ID NO: 10025622 - DNA, 22 bp, Homo sapiens
cggaggttgaggctgcagtgag

SEQ ID NO: 10025623 - DNA, 22 bp, Homo sapiens
cggagtcttgctatgttgccca

SEQ ID NO: 10025624 - DNA, 22 bp, Homo sapiens
ttatcattgtcgcagtctaatt

SEQ ID NO: 10025625 - DNA, 22 bp, Homo sapiens
ccttcaaaacactagtttttga

SEQ ID NO: 10025626 - DNA, 22 bp, Homo sapiens
ttggaagggatattggcatatg

SEQ ID NO: 10025627 - DNA, 20 bp, Homo sapiens
ttggaggtgcagtgcatgca

SEQ ID NO: 10025628 - DNA, 22 bp, Homo sapiens
ttctgaagctcccttttgtagt

SEQ ID NO: 10025629 - DNA, 22 bp, Homo sapiens
cgtgtggtcccggcaaggcaag

SEQ ID NO: 10025630 - DNA, 21 bp, Homo sapiens
ctcagagaaatgtctgggagc

SEQ ID NO: 10025631 - DNA, 19 bp, Homo sapiens
ctcagagaggggcagtgcc

SEQ ID NO: 10025632 - DNA, 22 bp, Homo sapiens
ctgtggcttctgcttgggcctc

SEQ ID NO: 10025633 - DNA, 22 bp, Homo sapiens
ctgtgggatgggacctcagctg

SEQ ID NO: 10025634 - DNA, 22 bp, Homo sapiens
ctggtggttcaggagaatggct

SEQ ID NO: 10025635 - DNA, 22 bp, Homo sapiens
ctggggctggtgaggcaggctc

SEQ ID NO: 10025636 - DNA, 22 bp, Homo sapiens
ctggggtggtgcaggcctcatg

SEQ ID NO: 10025637 - DNA, 22 bp, Homo sapiens
ctggggtgagcagaaacagggg

SEQ ID NO: 10025638 - DNA, 22 bp, Homo sapiens
ctggggtggagattggcaatct

SEQ ID NO: 10025639 - DNA, 22 bp, Homo sapiens
ctggggtgaaggattacctgag

SEQ ID NO: 10025640 - DNA, 22 bp, Homo sapiens
gaagaactgacaaactagatca

SEQ ID NO: 10025641 - DNA, 22 bp, Homo sapiens
gaagaactgtgacagaagcagt

SEQ ID NO: 10025642 - DNA, 22 bp, Homo sapiens
gaagaacttaacataataagga

SEQ ID NO: 10025643 - DNA, 22 bp, Homo sapiens
gaagaactttagggcagaattt

SEQ ID NO: 10025644 - DNA, 22 bp, Homo sapiens
gaaatattgtactggagatgtt

SEQ ID NO: 10025645 - DNA, 22 bp, Homo sapiens
gaaatattgggactcagagctt

SEQ ID NO: 10025646 - DNA, 22 bp, Homo sapiens
gaaatattcttgtcttgttttc

SEQ ID NO: 10025647 - DNA, 22 bp, Homo sapiens
gaaatattacagtggaggggat

SEQ ID NO: 10025648 - DNA, 22 bp, Homo sapiens
ctgttaaagatagttaagcttc

SEQ ID NO: 10025649 - DNA, 19 bp, Homo sapiens
gactccaactttaagcatg

SEQ ID NO: 10025650 - DNA, 22 bp, Homo sapiens
gagagaagaaagccatggtcct

SEQ ID NO: 10025651 - DNA, 22 bp, Homo sapiens
gagaggaggtggctatgacagc

SEQ ID NO: 10025652 - DNA, 22 bp, Homo sapiens
gagaggagttactatttccgag

SEQ ID NO: 10025653 - DNA, 22 bp, Homo sapiens
gagcactgatttatttttgtct

SEQ ID NO: 10025654 - DNA, 22 bp, Homo sapiens
gacagccatcagcacacgctgc

SEQ ID NO: 10025655 - DNA, 22 bp, Homo sapiens
gagctcagactcgggcctgggg

SEQ ID NO: 10025656 - DNA, 22 bp, Homo sapiens
gagctcagcaaaggtctgtgtg

SEQ ID NO: 10025657 - DNA, 22 bp, Homo sapiens
gagctcagattctggtgtcaga

SEQ ID NO: 10025658 - DNA, 22 bp, Homo sapiens
gagctcagcctgaggcctggct

SEQ ID NO: 10025659 - DNA, 22 bp, Homo sapiens
gagctcagggcattgagcaaga

SEQ ID NO: 10025660 - DNA, 22 bp, Homo sapiens
gaggccagaatgagctgaatgc

SEQ ID NO: 10025661 - DNA, 22 bp, Homo sapiens
gaggccagaagtctgagatcag

SEQ ID NO: 10025662 - DNA, 22 bp, Homo sapiens
gaggcaacaatgatggtgtgta

SEQ ID NO: 10025663 - DNA, 22 bp, Homo sapiens
gaggcaacacatttggaaagca

SEQ ID NO: 10025664 - DNA, 22 bp, Homo sapiens
gaggagaaagcagtgatttgtg

SEQ ID NO: 10025665 - DNA, 22 bp, Homo sapiens
gaggcggaggttgcagtgagcc

SEQ ID NO: 10025666 - DNA, 22 bp, Homo sapiens
gaggcggaggttgcagtgagct

SEQ ID NO: 10025667 - DNA, 22 bp, Homo sapiens
gaggcctgtcgctaggcctctg

SEQ ID NO: 10025668 - DNA, 22 bp, Homo sapiens
gagggtggcctttagagcccat

SEQ ID NO: 10025669 - DNA, 22 bp, Homo sapiens
gagggtggggaatagactgcta

SEQ ID NO: 10025670 - DNA, 22 bp, Homo sapiens
gaggtctgccttcaggagagtt

SEQ ID NO: 10025671 - DNA, 22 bp, Homo sapiens
gaggtctgggatggggcctgaa

SEQ ID NO: 10025672 - DNA, 22 bp, Homo sapiens
gaggtctgggcttgggcctggt

SEQ ID NO: 10025673 - DNA, 22 bp, Homo sapiens
gaggtggctccttcagggaata

SEQ ID NO: 10025674 - DNA, 22 bp, Homo sapiens
gaggtgagaagggggtcagatg

SEQ ID NO: 10025675 - DNA, 22 bp, Homo sapiens
gagtaagagctggctttggtgt

SEQ ID NO: 10025676 - DNA, 22 bp, Homo sapiens
gcttttaattagttgcttccat

SEQ ID NO: 10025677 - DNA, 22 bp, Homo sapiens
gcttggaagtaggattgggaga

SEQ ID NO: 10025678 - DNA, 22 bp, Homo sapiens
ggagaaaggataggaatgtgct

SEQ ID NO: 10025679 - DNA, 22 bp, Homo sapiens
gctagggatttctttctcacta

SEQ ID NO: 10025680 - DNA, 22 bp, Homo sapiens
gctaggagtggtgggtcaagga

SEQ ID NO: 10025681 - DNA, 22 bp, Homo sapiens
gctaggagtgggatggaagtcg

SEQ ID NO: 10025682 - DNA, 22 bp, Homo sapiens
gctaggaggaagaatgtgaatt

SEQ ID NO: 10025683 - DNA, 22 bp, Homo sapiens
gctaggagccgctgcactaggt

SEQ ID NO: 10025684 - DNA, 22 bp, Homo sapiens
gctaggagattgagctctgaag

SEQ ID NO: 10025685 - DNA, 22 bp, Homo sapiens
gctaggaatcggacccaggaag

SEQ ID NO: 10025686 - DNA, 17 bp, Homo sapiens
gctaggagagggaggag

SEQ ID NO: 10025687 - DNA, 20 bp, Homo sapiens
gctccccttctctgggcctc

SEQ ID NO: 10025688 - DNA, 22 bp, Homo sapiens
gctgcaggcggccgtggtggcg

SEQ ID NO: 10025689 - DNA, 22 bp, Homo sapiens
gcaggtgatgtgatgtgagcat

SEQ ID NO: 10025690 - DNA, 22 bp, Homo sapiens
gcagccagagggggtgtgatca

SEQ ID NO: 10025691 - DNA, 21 bp, Homo sapiens
gcagccagacgggattcagtt

SEQ ID NO: 10025692 - DNA, 22 bp, Homo sapiens
gcacagagaggctgtgagcgcc

SEQ ID NO: 10025693 - DNA, 22 bp, Homo sapiens
gcacagagtgggtgagatgtgg

SEQ ID NO: 10025694 - DNA, 19 bp, Homo sapiens
gcctcatttccacctcccc

SEQ ID NO: 10025695 - DNA, 22 bp, Homo sapiens
gcccacacaccagctcaggagg

SEQ ID NO: 10025696 - DNA, 22 bp, Homo sapiens
gcccacaccatttattctttgt

SEQ ID NO: 10025697 - DNA, 22 bp, Homo sapiens
gcccacacagcagatcctttgg

SEQ ID NO: 10025698 - DNA, 22 bp, Homo sapiens
gcctgcagaggtgctgctagct

SEQ ID NO: 10025699 - DNA, 22 bp, Homo sapiens
gcctgcagttctgtgctaggca

SEQ ID NO: 10025700 - DNA, 22 bp, Homo sapiens
gccaggcatgtcctctgcagaa

SEQ ID NO: 10025701 - DNA, 22 bp, Homo sapiens
gcccaagctggactgcagtggc

SEQ ID NO: 10025702 - DNA, 22 bp, Homo sapiens
gccagaaggggtggatccaggc

SEQ ID NO: 10025703 - DNA, 19 bp, Homo sapiens
ggggtggctggggctccag

SEQ ID NO: 10025704 - DNA, 22 bp, Homo sapiens
ggggtggccctaccctctggaa

SEQ ID NO: 10025705 - DNA, 22 bp, Homo sapiens
ggggtggccaaggactctgacc

SEQ ID NO: 10025706 - DNA, 22 bp, Homo sapiens
gtctatatattgcttgaataat

SEQ ID NO: 10025707 - DNA, 22 bp, Homo sapiens
gtctaaagtctatacttttgtg

SEQ ID NO: 10025708 - DNA, 22 bp, Homo sapiens
gtgagcagttgtgagccccaaa

SEQ ID NO: 10025709 - DNA, 22 bp, Homo sapiens
gtcctctggtgaaagcattccc

SEQ ID NO: 10025710 - DNA, 22 bp, Homo sapiens
gtcctctgggctttgagcagtc

SEQ ID NO: 10025711 - DNA, 22 bp, Homo sapiens
gtcctctgtagggctgggccac

SEQ ID NO: 10025712 - DNA, 22 bp, Homo sapiens
gtcctctgtccctggggcacgg

SEQ ID NO: 10025713 - DNA, 22 bp, Homo sapiens
gtcctctgcttcatgccctgat

SEQ ID NO: 10025714 - DNA, 22 bp, Homo sapiens
gtcctctggaagatgagttctt

SEQ ID NO: 10025715 - DNA, 22 bp, Homo sapiens
gtcctctgggcagctgccccac

SEQ ID NO: 10025716 - DNA, 22 bp, Homo sapiens
gtcctctgggagccttgagcct

SEQ ID NO: 10025717 - DNA, 23 bp, Homo sapiens
gtcctctggagagaaaggcagta

SEQ ID NO: 10025718 - DNA, 22 bp, Homo sapiens
gtcctctggaggtttttaggtg

SEQ ID NO: 10025719 - DNA, 22 bp, Homo sapiens
gtcctctggcctttcccaggac

SEQ ID NO: 10025720 - DNA, 22 bp, Homo sapiens
ggcagtgagaggtctcctggtc

SEQ ID NO: 10025721 - DNA, 22 bp, Homo sapiens
ggcaggctgttcacctgctttt

SEQ ID NO: 10025722 - DNA, 22 bp, Homo sapiens
ggcaggcttggtggcaccggtt

SEQ ID NO: 10025723 - DNA, 22 bp, Homo sapiens
ggcaggcttgatatggggggac

SEQ ID NO: 10025724 - DNA, 20 bp, Homo sapiens
ggcaggctttatatggaggg

SEQ ID NO: 10025725 - DNA, 22 bp, Homo sapiens
ggcaggctttgagaaagagcat

SEQ ID NO: 10025726 - DNA, 22 bp, Homo sapiens
ggcaggctttcagcatcaagtc

SEQ ID NO: 10025727 - DNA, 22 bp, Homo sapiens
ggctctgcagtgacttgagggg

SEQ ID NO: 10025728 - DNA, 22 bp, Homo sapiens
ggctctgcatgtgagtgggtgg

SEQ ID NO: 10025729 - DNA, 18 bp, Homo sapiens
ggcctctggactggcagc

SEQ ID NO: 10025730 - DNA, 22 bp, Homo sapiens
ggcccagcgaggccacctacag

SEQ ID NO: 10025731 - DNA, 22 bp, Homo sapiens
ggccagagttgatggcatcttg

SEQ ID NO: 10025732 - DNA, 22 bp, Homo sapiens
ggccagagtctatatgcagaca

SEQ ID NO: 10025733 - DNA, 21 bp, Homo sapiens
gggcagaggggcctcctgggt

SEQ ID NO: 10025734 - DNA, 22 bp, Homo sapiens
ggctgcagggcagctggtgtgg

SEQ ID NO: 10025735 - DNA, 22 bp, Homo sapiens
taccaccatttgcctgctgtat

SEQ ID NO: 10025736 - DNA, 22 bp, Homo sapiens
tactacattaataaaacattca

SEQ ID NO: 10025737 - DNA, 22 bp, Homo sapiens
tacacaactgacaaccattctg

SEQ ID NO: 10025738 - DNA, 22 bp, Homo sapiens
tacacacagaggccatgggatt

SEQ ID NO: 10025739 - DNA, 22 bp, Homo sapiens
tacacacttactggagatgaag

SEQ ID NO: 10025740 - DNA, 22 bp, Homo sapiens
tacacacatgcatttgccttat

SEQ ID NO: 10025741 - DNA, 22 bp, Homo sapiens
taatataccaaactgtaatttt

SEQ ID NO: 10025742 - DNA, 22 bp, Homo sapiens
gttatataagacaaatcagagt

SEQ ID NO: 10025743 - DNA, 22 bp, Homo sapiens
tagtttactcatctataaaatg

SEQ ID NO: 10025744 - DNA, 22 bp, Homo sapiens
taggcaggctgaatgtagattt

SEQ ID NO: 10025745 - DNA, 22 bp, Homo sapiens
taggcagatgttaacaggaaaa

SEQ ID NO: 10025746 - DNA, 23 bp, Homo sapiens
taggcaggactcagatatgacag

SEQ ID NO: 10025747 - DNA, 22 bp, Homo sapiens
taggcagattccatattttggc

SEQ ID NO: 10025748 - DNA, 22 bp, Homo sapiens
taggcagaaaggaaggcaagtt

SEQ ID NO: 10025749 - DNA, 22 bp, Homo sapiens
taggcagagaggccataagaat

SEQ ID NO: 10025750 - DNA, 22 bp, Homo sapiens
tagaagattctaaagtggagag

SEQ ID NO: 10025751 - DNA, 22 bp, Homo sapiens
tagatacaggctctctgagcct

SEQ ID NO: 10025752 - DNA, 22 bp, Homo sapiens
tagatgaatgtgaaaggctctt

SEQ ID NO: 10025753 - DNA, 22 bp, Homo sapiens
tcaaatattggctatttcacat

SEQ ID NO: 10025754 - DNA, 22 bp, Homo sapiens
tatgaagctttgaaaagcttac

SEQ ID NO: 10025755 - DNA, 22 bp, Homo sapiens
tatgaagctgataatcactgat

SEQ ID NO: 10025756 - DNA, 22 bp, Homo sapiens
tatgaagctctcactgtgtgtc

SEQ ID NO: 10025757 - DNA, 22 bp, Homo sapiens
tatgtaaagtagatggcaggta

SEQ ID NO: 10025758 - DNA, 22 bp, Homo sapiens
tccaagttgatgtttcttaaat

SEQ ID NO: 10025759 - DNA, 22 bp, Homo sapiens
tccaagtccattatggtggtct

SEQ ID NO: 10025760 - DNA, 22 bp, Homo sapiens
tccaagctctctatgccatgat

SEQ ID NO: 10025761 - DNA, 22 bp, Homo sapiens
tccaagctgtatgttcctagag

SEQ ID NO: 10025762 - DNA, 21 bp, Homo sapiens
tccaagctcaactcccttcct

SEQ ID NO: 10025763 - DNA, 22 bp, Homo sapiens
tccaagctactgaaggtttggg

SEQ ID NO: 10025764 - DNA, 22 bp, Homo sapiens
tccaagctttccatgccctcac

SEQ ID NO: 10025765 - DNA, 22 bp, Homo sapiens
tccaagcttgctttagccacag

SEQ ID NO: 10025766 - DNA, 22 bp, Homo sapiens
tcactgcaacctccacctcccg

SEQ ID NO: 10025767 - DNA, 22 bp, Homo sapiens
tcacataaatttaccagatgat

SEQ ID NO: 10025768 - DNA, 23 bp, Homo sapiens
tcacataatccttcatccacagg

SEQ ID NO: 10025769 - DNA, 22 bp, Homo sapiens
tcacatacactaggatattttt

SEQ ID NO: 10025770 - DNA, 22 bp, Homo sapiens
tcacatactgaaagtccagtga

SEQ ID NO: 10025771 - DNA, 19 bp, Homo sapiens
tcctgaagatttcctcagc

SEQ ID NO: 10025772 - DNA, 22 bp, Homo sapiens
tcccagcctcctgacagttttg

SEQ ID NO: 10025773 - DNA, 22 bp, Homo sapiens
tcccagccttccttgtggtgaa

SEQ ID NO: 10025774 - DNA, 22 bp, Homo sapiens
tcccagcctggaccctgccagt

SEQ ID NO: 10025775 - DNA, 22 bp, Homo sapiens
tttatatatggctggtctggat

SEQ ID NO: 10025776 - DNA, 20 bp, Homo sapiens
tttagaagaatgagcacttt

SEQ ID NO: 10025777 - DNA, 22 bp, Homo sapiens
tttagaagggctggtcagaaat

SEQ ID NO: 10025778 - DNA, 22 bp, Homo sapiens
tttaaatgtgttcttagtagct

SEQ ID NO: 10025779 - DNA, 22 bp, Homo sapiens
tttaaagtgctgctcctatcct

SEQ ID NO: 10025780 - DNA, 22 bp, Homo sapiens
tttcacctcagtctttttatat

SEQ ID NO: 10025781 - DNA, 22 bp, Homo sapiens
ttggagagcagtaaaccacact

SEQ ID NO: 10025782 - DNA, 22 bp, Homo sapiens
ttggcaggaatattgcagaggt

SEQ ID NO: 10025783 - DNA, 22 bp, Homo sapiens
ttggcaggaggcttcagttcct

SEQ ID NO: 10025784 - DNA, 22 bp, Homo sapiens
ttggcagggccaggctctctct

SEQ ID NO: 10025785 - DNA, 22 bp, Homo sapiens
ttgtaaactgctgcaggagtgc

SEQ ID NO: 10025786 - DNA, 22 bp, Homo sapiens
ttgtcaagtaaggctgacattt

SEQ ID NO: 10025787 - DNA, 23 bp, Homo sapiens
tcctgctgaaagctccagctggc

SEQ ID NO: 10025788 - DNA, 22 bp, Homo sapiens
ttattaggaactcaggattttt

SEQ ID NO: 10025789 - DNA, 22 bp, Homo sapiens
ttattaggaaaaggtcagatgt

SEQ ID NO: 10025790 - DNA, 22 bp, Homo sapiens
ttattaggttattctctgtact

SEQ ID NO: 10025791 - DNA, 22 bp, Homo sapiens
ttattaggtttacataaaggtt

SEQ ID NO: 10025792 - DNA, 22 bp, Homo sapiens
ttattagggtggtttatgttct

SEQ ID NO: 10025793 - DNA, 22 bp, Homo sapiens
ttatatgaactggactttagga

SEQ ID NO: 10025794 - DNA, 22 bp, Homo sapiens
ttatatatcttgatttgttcca

SEQ ID NO: 10025795 - DNA, 22 bp, Homo sapiens
ttcacagctaagagctaagtaa

SEQ ID NO: 10025796 - DNA, 21 bp, Homo sapiens
ttctctccatatgcccagccc

SEQ ID NO: 10025797 - DNA, 22 bp, Homo sapiens
ttcctgggtggtcctggtagag

SEQ ID NO: 10025798 - DNA, 19 bp, Homo sapiens
ttttccacagaaatatgtt

SEQ ID NO: 10025799 - DNA, 22 bp, Homo sapiens
ttttccacagcaccataagatt

SEQ ID NO: 10025800 - DNA, 22 bp, Homo sapiens
ttttcattgttactatgagcta

SEQ ID NO: 10025801 - DNA, 22 bp, Homo sapiens
acagaatattggttactgttgc

SEQ ID NO: 10025802 - DNA, 22 bp, Homo sapiens
acacatatgtggcaactgtaga

SEQ ID NO: 10025803 - DNA, 22 bp, Homo sapiens
acacatcagaaatatgaatgag

SEQ ID NO: 10025804 - DNA, 22 bp, Homo sapiens
acacatcatgccaagtttcacc

SEQ ID NO: 10025805 - DNA, 22 bp, Homo sapiens
acacatctcaggggacactctc

SEQ ID NO: 10025806 - DNA, 22 bp, Homo sapiens
agcaggcttgttatgtctgaga

SEQ ID NO: 10025807 - DNA, 22 bp, Homo sapiens
agcaggctttcaagagtcttct

SEQ ID NO: 10025808 - DNA, 22 bp, Homo sapiens
agcaggctttccacagaaggag

SEQ ID NO: 10025809 - DNA, 21 bp, Homo sapiens
agcaggctttggagtggggct

SEQ ID NO: 10025810 - DNA, 22 bp, Homo sapiens
agcaggcttggtccccagcctc

SEQ ID NO: 10025811 - DNA, 22 bp, Homo sapiens
acacacacaagcaggttgtgga

SEQ ID NO: 10025812 - DNA, 22 bp, Homo sapiens
agcaggtgtatataaggctgag

SEQ ID NO: 10025813 - DNA, 22 bp, Homo sapiens
agccagagattgagatgcaggc

SEQ ID NO: 10025814 - DNA, 22 bp, Homo sapiens
agccagagcagggaattggaca

SEQ ID NO: 10025815 - DNA, 22 bp, Homo sapiens
agagtgaagttcatcgtgcagc

SEQ ID NO: 10025816 - DNA, 22 bp, Homo sapiens
actgcactccagcctgggtgac

SEQ ID NO: 10025817 - DNA, 22 bp, Homo sapiens
aagtgtgggaagttgctaaaat

SEQ ID NO: 10025818 - DNA, 22 bp, Homo sapiens
aagtgtgttgactgaattgggg

SEQ ID NO: 10025819 - DNA, 22 bp, Homo sapiens
aagtgtgtcttgggaagggagg

SEQ ID NO: 10025820 - DNA, 22 bp, Homo sapiens
actggggagagtcatgccagca

SEQ ID NO: 10025821 - DNA, 22 bp, Homo sapiens
actggggaatggaactgggaat

SEQ ID NO: 10025822 - DNA, 22 bp, Homo sapiens
actggggactctggccttttga

SEQ ID NO: 10025823 - DNA, 22 bp, Homo sapiens
aatgaagccactgaagacaatc

SEQ ID NO: 10025824 - DNA, 22 bp, Homo sapiens
aatgaagccaggtagaagagaa

SEQ ID NO: 10025825 - DNA, 22 bp, Homo sapiens
aatgaagccagctgggatgcga

SEQ ID NO: 10025826 - DNA, 22 bp, Homo sapiens
aatgaagcaagctgctgtgttt

SEQ ID NO: 10025827 - DNA, 22 bp, Homo sapiens
aatgaagcagtccatctgctct

SEQ ID NO: 10025828 - DNA, 22 bp, Homo sapiens
aatgaagcagttttcatcaagt

SEQ ID NO: 10025829 - DNA, 22 bp, Homo sapiens
acttttatcaaggaagtgatct

SEQ ID NO: 10025830 - DNA, 22 bp, Homo sapiens
acatcccacagaaacatacata

SEQ ID NO: 10025831 - DNA, 22 bp, Homo sapiens
aagcttcctgaatgctcattta

SEQ ID NO: 10025832 - DNA, 22 bp, Homo sapiens
aaattagatatgtgtgagactc

SEQ ID NO: 10025833 - DNA, 22 bp, Homo sapiens
aaaggctatgagatagaagata

SEQ ID NO: 10025834 - DNA, 22 bp, Homo sapiens
aagagagagtgcgctcacagaa

SEQ ID NO: 10025835 - DNA, 23 bp, Homo sapiens
aaataggagtatctggatcatga

SEQ ID NO: 10025836 - DNA, 22 bp, Homo sapiens
aagaaggaagtgtggacatcac

SEQ ID NO: 10025837 - DNA, 22 bp, Homo sapiens
aagagagaactcccttcgccag

SEQ ID NO: 10025838 - DNA, 22 bp, Homo sapiens
aaatatttgtctgaggcggttg

SEQ ID NO: 10025839 - DNA, 22 bp, Homo sapiens
aaggccaggggctggcgcctcc

SEQ ID NO: 10025840 - DNA, 22 bp, Homo sapiens
aaggagaaggcatcattcaagt

SEQ ID NO: 10025841 - DNA, 22 bp, Homo sapiens
aaggagaagggtaatcaacaca

SEQ ID NO: 10025842 - DNA, 22 bp, Homo sapiens
acaaaagcactgcagagtaagc

SEQ ID NO: 10025843 - DNA, 22 bp, Homo sapiens
acaaatccagtgaactccagtg

SEQ ID NO: 10025844 - DNA, 22 bp, Homo sapiens
acacagagccaaaccatatcac

SEQ ID NO: 10025845 - DNA, 22 bp, Homo sapiens
acacatataccactgtaaatga

SEQ ID NO: 10025846 - DNA, 22 bp, Homo sapiens
acacatacatggggaagatgag

SEQ ID NO: 10025847 - DNA, 22 bp, Homo sapiens
acacataagcctaatcatctcc

SEQ ID NO: 10025848 - DNA, 20 bp, Homo sapiens
acacatatagcagcataaac

SEQ ID NO: 10025849 - DNA, 22 bp, Homo sapiens
acacataagaaactacaaagag

SEQ ID NO: 10025850 - DNA, 22 bp, Homo sapiens
acagactggcctgtctcgcacc

SEQ ID NO: 10025851 - DNA, 23 bp, Homo sapiens
acagagatcttgacttgtatgga

SEQ ID NO: 10025852 - DNA, 22 bp, Homo sapiens
acagaccaagtttccagcaggt

SEQ ID NO: 10025853 - DNA, 22 bp, Homo sapiens
acaggctctctattgagtgcag

SEQ ID NO: 10025854 - DNA, 22 bp, Homo sapiens
acaggctctcagccagttggca

SEQ ID NO: 10025855 - DNA, 22 bp, Homo sapiens
acaggctcgtgcgcgcacgtgt

SEQ ID NO: 10025856 - DNA, 22 bp, Homo sapiens
acaggctcagttcactggattt

SEQ ID NO: 10025857 - DNA, 22 bp, Homo sapiens
acaggctcacagtcatttcatt

SEQ ID NO: 10025858 - DNA, 21 bp, Homo sapiens
acaggctcacgatccatttct

SEQ ID NO: 10025859 - DNA, 23 bp, Homo sapiens
acaggcaataaagggagtctcca

SEQ ID NO: 10025860 - DNA, 22 bp, Homo sapiens
aggcaggtgttgggagacacca

SEQ ID NO: 10025861 - DNA, 22 bp, Homo sapiens
aggcagatggtaactgtgatat

SEQ ID NO: 10025862 - DNA, 22 bp, Homo sapiens
aggcagactcaatggctagata

SEQ ID NO: 10025863 - DNA, 22 bp, Homo sapiens
aggcagacttcctgcttggatc

SEQ ID NO: 10025864 - DNA, 22 bp, Homo sapiens
acatctgaggagaccagcctct

SEQ ID NO: 10025865 - DNA, 19 bp, Homo sapiens
aggctgtgagggaggactc

SEQ ID NO: 10025866 - DNA, 21 bp, Homo sapiens
aggctctcatccagggaccca

SEQ ID NO: 10025867 - DNA, 22 bp, Homo sapiens
agggctgaagttatggctgagc

SEQ ID NO: 10025868 - DNA, 22 bp, Homo sapiens
agaagcagctttcaaggtgatt

SEQ ID NO: 10025869 - DNA, 22 bp, Homo sapiens
atattaattatttacacatgag

SEQ ID NO: 10025870 - DNA, 22 bp, Homo sapiens
atatagaaggtgctatttacat

SEQ ID NO: 10025871 - DNA, 22 bp, Homo sapiens
atatagtaagcagtctgtaaat

SEQ ID NO: 10025872 - DNA, 22 bp, Homo sapiens
atacactactaagcacagattg

SEQ ID NO: 10025873 - DNA, 22 bp, Homo sapiens
atacacactgctatcctttttt

SEQ ID NO: 10025874 - DNA, 22 bp, Homo sapiens
agttgcagacgcagagatgttg

SEQ ID NO: 10025875 - DNA, 22 bp, Homo sapiens
atagaagtatcaagatcttgaa

SEQ ID NO: 10025876 - DNA, 22 bp, Homo sapiens
actttacaggcacttcaagtat

SEQ ID NO: 10025877 - DNA, 22 bp, Homo sapiens
actttagagaaatgtagaagta

SEQ ID NO: 10025878 - DNA, 22 bp, Homo sapiens
agtgctgtctccttcccccggg

SEQ ID NO: 10025879 - DNA, 22 bp, Homo sapiens
actgggctcccaggcttgtcat

SEQ ID NO: 10025880 - DNA, 23 bp, Homo sapiens
actgggctgaaatttttcatggc

SEQ ID NO: 10025881 - DNA, 22 bp, Homo sapiens
actggggagtggttttgggaag

SEQ ID NO: 10025882 - DNA, 22 bp, Homo sapiens
actggggagttgaagcactttc

SEQ ID NO: 10025883 - DNA, 22 bp, Homo sapiens
actggggattagggactcagtg

SEQ ID NO: 10025884 - DNA, 22 bp, Homo sapiens
agtaacatatagcacttttgga

SEQ ID NO: 10025885 - DNA, 22 bp, Homo sapiens
agtaacatctttgacatttgtt

SEQ ID NO: 10025886 - DNA, 20 bp, Homo sapiens
aggttcctttgtggagaatt

SEQ ID NO: 10025887 - DNA, 22 bp, Homo sapiens
aggtgcttggctcgtgcacaca

SEQ ID NO: 10025888 - DNA, 22 bp, Homo sapiens
agatgagaatttttagagtgct

SEQ ID NO: 10025889 - DNA, 22 bp, Homo sapiens
agaggccggccgagcccatggg

SEQ ID NO: 10025890 - DNA, 22 bp, Homo sapiens
attgttaataactattacattg

SEQ ID NO: 10025891 - DNA, 22 bp, Homo sapiens
attgtggtgtcagttataggca

SEQ ID NO: 10025892 - DNA, 22 bp, Homo sapiens
attgttaaagtaataaccatgg

SEQ ID NO: 10025893 - DNA, 22 bp, Homo sapiens
attgttaaactgaagcattact

SEQ ID NO: 10025894 - DNA, 22 bp, Homo sapiens
atgaccagccgagataaacaga

SEQ ID NO: 10025895 - DNA, 22 bp, Homo sapiens
atctgggggagctgctcatgga

SEQ ID NO: 10025896 - DNA, 22 bp, Homo sapiens
agagctaagaaacagaattgct

SEQ ID NO: 10025897 - DNA, 22 bp, Homo sapiens
caatttcttgttaattctcagg

SEQ ID NO: 10025898 - DNA, 22 bp, Homo sapiens
cacacagaaccgctcgccactt

SEQ ID NO: 10025899 - DNA, 22 bp, Homo sapiens
cacacatcttatcccagttatt

SEQ ID NO: 10025900 - DNA, 22 bp, Homo sapiens
cacacatcaacctagacattgt

SEQ ID NO: 10025901 - DNA, 22 bp, Homo sapiens
agcagacatggcttggatgtgg

SEQ ID NO: 10025902 - DNA, 22 bp, Homo sapiens
agcagagacatgaaatatgctt

SEQ ID NO: 10025903 - DNA, 22 bp, Homo sapiens
caagcttgtttctcctgggggt

SEQ ID NO: 10025904 - DNA, 22 bp, Homo sapiens
agcaggtgggatcaagctggca

SEQ ID NO: 10025905 - DNA, 18 bp, Homo sapiens
agcaggtggcgtctgcag

SEQ ID NO: 10025906 - DNA, 22 bp, Homo sapiens
agcaggtggacagaggaagaaa

SEQ ID NO: 10025907 - DNA, 22 bp, Homo sapiens
cacattgcagcttcttttggct

SEQ ID NO: 10025908 - DNA, 19 bp, Homo sapiens
agcaggctaggctgcctct

SEQ ID NO: 10025909 - DNA, 22 bp, Homo sapiens
agcaggctactcctgtgttcgt

SEQ ID NO: 10025910 - DNA, 22 bp, Homo sapiens
agcaggctaggaacctcactgc

SEQ ID NO: 10025911 - DNA, 22 bp, Homo sapiens
agcaggctaatcttgctgaaca

SEQ ID NO: 10025912 - DNA, 22 bp, Homo sapiens
agcaggctaagggacctgttta

SEQ ID NO: 10025913 - DNA, 22 bp, Homo sapiens
agcaggctaaataataatacat

SEQ ID NO: 10025914 - DNA, 22 bp, Homo sapiens
cactgcactccatcctgggaaa

SEQ ID NO: 10025915 - DNA, 20 bp, Homo sapiens
cagaggagtacatatgttca

SEQ ID NO: 10025916 - DNA, 17 bp, Homo sapiens
cagaggagctttggggg

SEQ ID NO: 10025917 - DNA, 22 bp, Homo sapiens
agcgctgtgggcgtgcgaggag

SEQ ID NO: 10025918 - DNA, 22 bp, Homo sapiens
cagcccaaagccccaggctaga

SEQ ID NO: 10025919 - DNA, 22 bp, Homo sapiens
cagcccaggtctctcttccagt

SEQ ID NO: 10025920 - DNA, 22 bp, Homo sapiens
cagcctcttgcactttgaaggc

SEQ ID NO: 10025921 - DNA, 22 bp, Homo sapiens
cagcctctgtggctgccacacc

SEQ ID NO: 10025922 - DNA, 22 bp, Homo sapiens
cagcctctgacaccacagtcgt

SEQ ID NO: 10025923 - DNA, 22 bp, Homo sapiens
cagcctctgagccttggcagat

SEQ ID NO: 10025924 - DNA, 22 bp, Homo sapiens
agctctggaagccctggtagtt

SEQ ID NO: 10025925 - DNA, 22 bp, Homo sapiens
gaacaaattggagaaatcagga

SEQ ID NO: 10025926 - DNA, 22 bp, Homo sapiens
gaatattttcagtacagatggt

SEQ ID NO: 10025927 - DNA, 22 bp, Homo sapiens
gaatatttttaaagggactaat

SEQ ID NO: 10025928 - DNA, 22 bp, Homo sapiens
gacacatagatctatctcactc

SEQ ID NO: 10025929 - DNA, 22 bp, Homo sapiens
gacacatatgcgtatagtttag

SEQ ID NO: 10025930 - DNA, 18 bp, Homo sapiens
gacacatccccaggcctc

SEQ ID NO: 10025931 - DNA, 22 bp, Homo sapiens
atgaaacagagtacttaatata

SEQ ID NO: 10025932 - DNA, 22 bp, Homo sapiens
ctttccccagtatatcattgcc

SEQ ID NO: 10025933 - DNA, 22 bp, Homo sapiens
atctggattctagatctagatc

SEQ ID NO: 10025934 - DNA, 22 bp, Homo sapiens
atgatcagggcagaagcagaag

SEQ ID NO: 10025935 - DNA, 22 bp, Homo sapiens
atgtttaaagggttgagaaata

SEQ ID NO: 10025936 - DNA, 22 bp, Homo sapiens
gataatattagaagatacaaat

SEQ ID NO: 10025937 - DNA, 22 bp, Homo sapiens
atgttggagtcgtaaggcatgg

SEQ ID NO: 10025938 - DNA, 22 bp, Homo sapiens
atgtcatgggccaaaaatagtt

SEQ ID NO: 10025939 - DNA, 22 bp, Homo sapiens
atgtcatgaggctagcccccaa

SEQ ID NO: 10025940 - DNA, 22 bp, Homo sapiens
atgtcatgaaatgctactaact

SEQ ID NO: 10025941 - DNA, 22 bp, Homo sapiens
gaggcagcggctcacagagaaa

SEQ ID NO: 10025942 - DNA, 22 bp, Homo sapiens
atgtgagggaaatcagtcagaa

SEQ ID NO: 10025943 - DNA, 22 bp, Homo sapiens
gagacatcataatgaagtttcc

SEQ ID NO: 10025944 - DNA, 22 bp, Homo sapiens
gagagtcatacagaccaatata

SEQ ID NO: 10025945 - DNA, 22 bp, Homo sapiens
gaggagaaattatccttggtgt

SEQ ID NO: 10025946 - DNA, 22 bp, Homo sapiens
gaggagaaatttggggacctga

SEQ ID NO: 10025947 - DNA, 22 bp, Homo sapiens
gaggagaagctaagaaacacag

SEQ ID NO: 10025948 - DNA, 22 bp, Homo sapiens
gaggagaagctattggaaggac

SEQ ID NO: 10025949 - DNA, 22 bp, Homo sapiens
gaggagaagggcacggagaaaa

SEQ ID NO: 10025950 - DNA, 22 bp, Homo sapiens
gaggagaatgcgcaccacatat

SEQ ID NO: 10025951 - DNA, 22 bp, Homo sapiens
atggtggtagaagcactatgtg

SEQ ID NO: 10025952 - DNA, 22 bp, Homo sapiens
atgggctgacaagacatgcata

SEQ ID NO: 10025953 - DNA, 22 bp, Homo sapiens
atgggctgagaatcaagaatat

SEQ ID NO: 10025954 - DNA, 22 bp, Homo sapiens
atgggctgactaatggtaaact

SEQ ID NO: 10025955 - DNA, 22 bp, Homo sapiens
atgggctgacccagtcgtggca

SEQ ID NO: 10025956 - DNA, 22 bp, Homo sapiens
atgggctgaggaagctcctgag

SEQ ID NO: 10025957 - DNA, 22 bp, Homo sapiens
atgggctgaggtgggatagaag

SEQ ID NO: 10025958 - DNA, 22 bp, Homo sapiens
atgggctgaaagagtaagctgt

SEQ ID NO: 10025959 - DNA, 22 bp, Homo sapiens
atgggctgtccattgctggctg

SEQ ID NO: 10025960 - DNA, 22 bp, Homo sapiens
atgggctgtcctagtccagccc

SEQ ID NO: 10025961 - DNA, 22 bp, Homo sapiens
atgggctggggaagctcactcc

SEQ ID NO: 10025962 - DNA, 20 bp, Homo sapiens
atgggctggttaggaagtgt

SEQ ID NO: 10025963 - DNA, 22 bp, Homo sapiens
atgggctgggaatacacagggg

SEQ ID NO: 10025964 - DNA, 22 bp, Homo sapiens
atgggctgggatctgagtgtca

SEQ ID NO: 10025965 - DNA, 22 bp, Homo sapiens
atgggctgcttggcttccaccc

SEQ ID NO: 10025966 - DNA, 22 bp, Homo sapiens
atgggctgcttctccagcacct

SEQ ID NO: 10025967 - DNA, 22 bp, Homo sapiens
atgggctggcagcctgaacagc

SEQ ID NO: 10025968 - DNA, 22 bp, Homo sapiens
atgggctggcctttcccgctct

SEQ ID NO: 10025969 - DNA, 22 bp, Homo sapiens
atgggctgtgaggtccggcagg

SEQ ID NO: 10025970 - DNA, 22 bp, Homo sapiens
atgggctgtgggaccctggacc

SEQ ID NO: 10025971 - DNA, 22 bp, Homo sapiens
atttttccatgatacttatctg

SEQ ID NO: 10025972 - DNA, 22 bp, Homo sapiens
caaacattcaagtacaagtctt

SEQ ID NO: 10025973 - DNA, 22 bp, Homo sapiens
gctcttgtcaaaaattagttga

SEQ ID NO: 10025974 - DNA, 22 bp, Homo sapiens
gctctttaattcattcatggat

SEQ ID NO: 10025975 - DNA, 22 bp, Homo sapiens
gctctttactgtgagggtggtc

SEQ ID NO: 10025976 - DNA, 22 bp, Homo sapiens
gctctttagtccaagccatgtc

SEQ ID NO: 10025977 - DNA, 22 bp, Homo sapiens
gctctttagcgggggccaggcc

SEQ ID NO: 10025978 - DNA, 23 bp, Homo sapiens
gctgactgtgaaattctggagct

SEQ ID NO: 10025979 - DNA, 22 bp, Homo sapiens
caaatactacgattcttgcagt

SEQ ID NO: 10025980 - DNA, 22 bp, Homo sapiens
gcagcagatgctttcatggaca

SEQ ID NO: 10025981 - DNA, 22 bp, Homo sapiens
attcacatgtgcttcttatcac

SEQ ID NO: 10025982 - DNA, 22 bp, Homo sapiens
attcaagctgaatggtgacaga

SEQ ID NO: 10025983 - DNA, 22 bp, Homo sapiens
gcagcgaggtgatgaaatagct

SEQ ID NO: 10025984 - DNA, 22 bp, Homo sapiens
attgacttccatagctacctgg

SEQ ID NO: 10025985 - DNA, 22 bp, Homo sapiens
gccaaagtacctagccctctgc

SEQ ID NO: 10025986 - DNA, 17 bp, Homo sapiens
gcatcacagataacacg

SEQ ID NO: 10025987 - DNA, 22 bp, Homo sapiens
caagtactttgaaaagttgaat

SEQ ID NO: 10025988 - DNA, 22 bp, Homo sapiens
caaggttccagaattatgctct

SEQ ID NO: 10025989 - DNA, 22 bp, Homo sapiens
ggaggccaaggaggagcttgcc

SEQ ID NO: 10025990 - DNA, 22 bp, Homo sapiens
cacacagatggtaagggaggga

SEQ ID NO: 10025991 - DNA, 22 bp, Homo sapiens
cacacagacagctctctgaaga

SEQ ID NO: 10025992 - DNA, 15 bp, Homo sapiens
cacacagacagcttg

SEQ ID NO: 10025993 - DNA, 22 bp, Homo sapiens
ggcaggtgcccagagagcacga

SEQ ID NO: 10025994 - DNA, 22 bp, Homo sapiens
cacctgtacagggccgggctgg

SEQ ID NO: 10025995 - DNA, 22 bp, Homo sapiens
cacctgtaatcccagcacttca

SEQ ID NO: 10025996 - DNA, 22 bp, Homo sapiens
cacatacttgtgtgtacatatg

SEQ ID NO: 10025997 - DNA, 22 bp, Homo sapiens
ggaggtggaggttgcaatgagc

SEQ ID NO: 10025998 - DNA, 22 bp, Homo sapiens
cacatacatacgtatgtataca

SEQ ID NO: 10025999 - DNA, 22 bp, Homo sapiens
cacatactgagaatcacaccca

SEQ ID NO: 10026000 - DNA, 22 bp, Homo sapiens
cacatacattcatgttactcta

SEQ ID NO: 10026001 - DNA, 22 bp, Homo sapiens
cacatacaaggcacactggagg

SEQ ID NO: 10026002 - DNA, 22 bp, Homo sapiens
cacataagaaatgaatatgaga

SEQ ID NO: 10026003 - DNA, 20 bp, Homo sapiens
cagctagtggtaggagtcgg

SEQ ID NO: 10026004 - DNA, 22 bp, Homo sapiens
cagctagtgagagaaaggacac

SEQ ID NO: 10026005 - DNA, 22 bp, Homo sapiens
cagcctgtctgggcagagtgga

SEQ ID NO: 10026006 - DNA, 22 bp, Homo sapiens
cagcctctttccacatcaggca

SEQ ID NO: 10026007 - DNA, 22 bp, Homo sapiens
cagcccaggccgacagttcctc

SEQ ID NO: 10026008 - DNA, 22 bp, Homo sapiens
cagaggcacaagaaagcaaggc

SEQ ID NO: 10026009 - DNA, 22 bp, Homo sapiens
cagaggggataacaggtgtaga

SEQ ID NO: 10026010 - DNA, 22 bp, Homo sapiens
ggtgacctcacctggtcccacc

SEQ ID NO: 10026011 - DNA, 22 bp, Homo sapiens
cagcacagtgaccagacccact

SEQ ID NO: 10026012 - DNA, 22 bp, Homo sapiens
cagaggcaaaagaggtggaggt

SEQ ID NO: 10026013 - DNA, 20 bp, Homo sapiens
cagaggcaaggagacttgga

SEQ ID NO: 10026014 - DNA, 22 bp, Homo sapiens
gggctgacaatctctttactta

SEQ ID NO: 10026015 - DNA, 22 bp, Homo sapiens
gggctgacaaccatctgacaag

SEQ ID NO: 10026016 - DNA, 22 bp, Homo sapiens
gggctgacagcacgccttctgt

SEQ ID NO: 10026017 - DNA, 22 bp, Homo sapiens
gggctgacaccacccaggcgca

SEQ ID NO: 10026018 - DNA, 17 bp, Homo sapiens
gggctgacagtggcctc

SEQ ID NO: 10026019 - DNA, 22 bp, Homo sapiens
gggctgacagtttcccctgaaa

SEQ ID NO: 10026020 - DNA, 22 bp, Homo sapiens
gggctgacatatttggtgctct

SEQ ID NO: 10026021 - DNA, 22 bp, Homo sapiens
gggctgaccaatgccttgcttt

SEQ ID NO: 10026022 - DNA, 22 bp, Homo sapiens
gggctgaccccacccctcactc

SEQ ID NO: 10026023 - DNA, 22 bp, Homo sapiens
gggctgacgaaggccatgtgtg

SEQ ID NO: 10026024 - DNA, 22 bp, Homo sapiens
gggctgactcaaccttgcaaag

SEQ ID NO: 10026025 - DNA, 22 bp, Homo sapiens
gggctgactcctattggatgaa

SEQ ID NO: 10026026 - DNA, 22 bp, Homo sapiens
gggctgactctgcactgagcca

SEQ ID NO: 10026027 - DNA, 22 bp, Homo sapiens
agggcccaggacagcatcaggg

SEQ ID NO: 10026028 - DNA, 22 bp, Homo sapiens
cctacattctctgagttttcct

SEQ ID NO: 10026029 - DNA, 22 bp, Homo sapiens
agggggtcgtccggaagacctg

SEQ ID NO: 10026030 - DNA, 22 bp, Homo sapiens
cctctgtgtcttggtttcaaga

SEQ ID NO: 10026031 - DNA, 22 bp, Homo sapiens
cccctgtgttgttcaagggtca

SEQ ID NO: 10026032 - DNA, 22 bp, Homo sapiens
agggacctgctcactgcctggc

SEQ ID NO: 10026033 - DNA, 22 bp, Homo sapiens
aggctttggaatcagagttctg

SEQ ID NO: 10026034 - DNA, 22 bp, Homo sapiens
aggctttggggcattctgtgtt

SEQ ID NO: 10026035 - DNA, 22 bp, Homo sapiens
aggctttgtacctggggtctta

SEQ ID NO: 10026036 - DNA, 19 bp, Homo sapiens
aggcttggctagatttact

SEQ ID NO: 10026037 - DNA, 22 bp, Homo sapiens
ccagccctgaaccctgctgcat

SEQ ID NO: 10026038 - DNA, 23 bp, Homo sapiens
ccagccctccaccagctctaggc

SEQ ID NO: 10026039 - DNA, 20 bp, Homo sapiens
aggctctgcctgcaggccca

SEQ ID NO: 10026040 - DNA, 22 bp, Homo sapiens
aggctgtgggagttgagagtct

SEQ ID NO: 10026041 - DNA, 22 bp, Homo sapiens
cccaccctgggctacacatcca

SEQ ID NO: 10026042 - DNA, 22 bp, Homo sapiens
aggctgtgacagggtcatggag

SEQ ID NO: 10026043 - DNA, 20 bp, Homo sapiens
cccacacccttcccacttgg

SEQ ID NO: 10026044 - DNA, 22 bp, Homo sapiens
cccacacatttttcacttaccg

SEQ ID NO: 10026045 - DNA, 18 bp, Homo sapiens
cccacacagcagtagctc

SEQ ID NO: 10026046 - DNA, 22 bp, Homo sapiens
cccacacaaatcatggggagaa

SEQ ID NO: 10026047 - DNA, 22 bp, Homo sapiens
cccaagttaatttgtagctgaa

SEQ ID NO: 10026048 - DNA, 22 bp, Homo sapiens
cccacacacatttatgatagga

SEQ ID NO: 10026049 - DNA, 22 bp, Homo sapiens
cccacacactggctgctgccaa

SEQ ID NO: 10026050 - DNA, 22 bp, Homo sapiens
aggaagtgggaagggtctgcca

SEQ ID NO: 10026051 - DNA, 22 bp, Homo sapiens
aggacagacctaggactggagc

SEQ ID NO: 10026052 - DNA, 22 bp, Homo sapiens
aggacagagccctagtttcata

SEQ ID NO: 10026053 - DNA, 22 bp, Homo sapiens
aggacagaatctatattcagtt

SEQ ID NO: 10026054 - DNA, 22 bp, Homo sapiens
aggaagtggataaaatagcttt

SEQ ID NO: 10026055 - DNA, 22 bp, Homo sapiens
aggacagagggaccagagccca

SEQ ID NO: 10026056 - DNA, 21 bp, Homo sapiens
aggacagatgtaggaataaag

SEQ ID NO: 10026057 - DNA, 22 bp, Homo sapiens
caggctcttttggtggcaagga

SEQ ID NO: 10026058 - DNA, 22 bp, Homo sapiens
agctttgggcagaagaggattc

SEQ ID NO: 10026059 - DNA, 22 bp, Homo sapiens
agctttggagactgactccatc

SEQ ID NO: 10026060 - DNA, 21 bp, Homo sapiens
agctttgaggctctggggccc

SEQ ID NO: 10026061 - DNA, 21 bp, Homo sapiens
agctttgaaagtgattcagtt

SEQ ID NO: 10026062 - DNA, 22 bp, Homo sapiens
caggagaaacataattttctgg

SEQ ID NO: 10026063 - DNA, 22 bp, Homo sapiens
caggagaaatgtggctgctacc

SEQ ID NO: 10026064 - DNA, 22 bp, Homo sapiens
aggcaagaacagacatgggagt

SEQ ID NO: 10026065 - DNA, 22 bp, Homo sapiens
aggcaactggttaagtaaattg

SEQ ID NO: 10026066 - DNA, 22 bp, Homo sapiens
aggcaactgtttgataatgttg

SEQ ID NO: 10026067 - DNA, 22 bp, Homo sapiens
aggcaactgagaggcccgtgtt

SEQ ID NO: 10026068 - DNA, 22 bp, Homo sapiens
aggcaacttttggggatgatgg

SEQ ID NO: 10026069 - DNA, 22 bp, Homo sapiens
aggcaacttgaccaggctttct

SEQ ID NO: 10026070 - DNA, 22 bp, Homo sapiens
aggcaacttgcatctcggcaag

SEQ ID NO: 10026071 - DNA, 20 bp, Homo sapiens
aggcaactcaagtttttgcc

SEQ ID NO: 10026072 - DNA, 22 bp, Homo sapiens
aggcaactaggcctctgcctca

SEQ ID NO: 10026073 - DNA, 17 bp, Homo sapiens
aggcaactagttccctc

SEQ ID NO: 10026074 - DNA, 22 bp, Homo sapiens
aggcaactcatcatgaaagact

SEQ ID NO: 10026075 - DNA, 22 bp, Homo sapiens
aggcaactctgaccttatgaag

SEQ ID NO: 10026076 - DNA, 22 bp, Homo sapiens
aggcaactgacagtttctgctt

SEQ ID NO: 10026077 - DNA, 22 bp, Homo sapiens
aggcaactgacagcatatcctg

SEQ ID NO: 10026078 - DNA, 21 bp, Homo sapiens
ccactcatgactccactcacc

SEQ ID NO: 10026079 - DNA, 22 bp, Homo sapiens
ccacatacaaatggggtgctgt

SEQ ID NO: 10026080 - DNA, 22 bp, Homo sapiens
ccacatcatggatacagttatg

SEQ ID NO: 10026081 - DNA, 22 bp, Homo sapiens
ccacagaccttggcttccacct

SEQ ID NO: 10026082 - DNA, 22 bp, Homo sapiens
catgagatttgggaggggccag

SEQ ID NO: 10026083 - DNA, 22 bp, Homo sapiens
cagtgtgtttcatgtaggtcct

SEQ ID NO: 10026084 - DNA, 22 bp, Homo sapiens
cataatatactacattgatgaa

SEQ ID NO: 10026085 - DNA, 17 bp, Homo sapiens
ctctggggacagttcta

SEQ ID NO: 10026086 - DNA, 22 bp, Homo sapiens
ctctggggaagcagccagctgg

SEQ ID NO: 10026087 - DNA, 22 bp, Homo sapiens
ctctgggctgccttttagctct

SEQ ID NO: 10026088 - DNA, 22 bp, Homo sapiens
ctccagagagtccagctctggg

SEQ ID NO: 10026089 - DNA, 22 bp, Homo sapiens
ctaggtgatccactgctctctt

SEQ ID NO: 10026090 - DNA, 22 bp, Homo sapiens
agtatgtcagagtgaaaatggt

SEQ ID NO: 10026091 - DNA, 22 bp, Homo sapiens
agtatgaattgctttgcctgta

SEQ ID NO: 10026092 - DNA, 23 bp, Homo sapiens
agtatgaattcattgttttagtt

SEQ ID NO: 10026093 - DNA, 19 bp, Homo sapiens
cgcaggcttcgggtcgctc

SEQ ID NO: 10026094 - DNA, 22 bp, Homo sapiens
cgcaggctggcgcggagtggca

SEQ ID NO: 10026095 - DNA, 22 bp, Homo sapiens
cgcaggctttagaatctgctac

SEQ ID NO: 10026096 - DNA, 22 bp, Homo sapiens
cgcaggctcggttcacagagca

SEQ ID NO: 10026097 - DNA, 22 bp, Homo sapiens
cgcaggctccggggtgccctgg

SEQ ID NO: 10026098 - DNA, 22 bp, Homo sapiens
cgcaggctgcagccaagaagag

SEQ ID NO: 10026099 - DNA, 22 bp, Homo sapiens
cctgggctttcaaaaccagcct

SEQ ID NO: 10026100 - DNA, 22 bp, Homo sapiens
cctgggctttcggcggcttcct

SEQ ID NO: 10026101 - DNA, 22 bp, Homo sapiens
cctgggcttctgtctagatgtt

SEQ ID NO: 10026102 - DNA, 22 bp, Homo sapiens
cctgggcttggttgttgagaac

SEQ ID NO: 10026103 - DNA, 22 bp, Homo sapiens
cctgggcttgcatctgtgctgg

SEQ ID NO: 10026104 - DNA, 20 bp, Homo sapiens
cctgggctccaggagccccg

SEQ ID NO: 10026105 - DNA, 22 bp, Homo sapiens
cctgggctcaagtgatggtccc

SEQ ID NO: 10026106 - DNA, 22 bp, Homo sapiens
cctgggctcacagccaaggctc

SEQ ID NO: 10026107 - DNA, 22 bp, Homo sapiens
cctgggctcaccatgccttgga

SEQ ID NO: 10026108 - DNA, 22 bp, Homo sapiens
cctgggctcaggcttgggcagc

SEQ ID NO: 10026109 - DNA, 22 bp, Homo sapiens
cctgggctccactccaagagca

SEQ ID NO: 10026110 - DNA, 22 bp, Homo sapiens
cctgggctcaagtgatcctcct

SEQ ID NO: 10026111 - DNA, 22 bp, Homo sapiens
aggtaggatgggtggagatgat

SEQ ID NO: 10026112 - DNA, 22 bp, Homo sapiens
cctgcagaggtcaggccagaaa

SEQ ID NO: 10026113 - DNA, 22 bp, Homo sapiens
cctgcagagccacgtgccagcg

SEQ ID NO: 10026114 - DNA, 21 bp, Homo sapiens
aggtcccaggtttgggcagca

SEQ ID NO: 10026115 - DNA, 22 bp, Homo sapiens
atacattcaaaggaaggataga

SEQ ID NO: 10026116 - DNA, 22 bp, Homo sapiens
agttatatgtgaaaacacgtat

SEQ ID NO: 10026117 - DNA, 22 bp, Homo sapiens
agttatattccatagattcaga

SEQ ID NO: 10026118 - DNA, 23 bp, Homo sapiens
ctgcagagaactgagggacagcc

SEQ ID NO: 10026119 - DNA, 22 bp, Homo sapiens
atattataagttatttcaagtt

SEQ ID NO: 10026120 - DNA, 22 bp, Homo sapiens
atattaggttggtgcaaaagta

SEQ ID NO: 10026121 - DNA, 22 bp, Homo sapiens
ctgggctgaaagtgttccttga

SEQ ID NO: 10026122 - DNA, 22 bp, Homo sapiens
ctgggctgagcctgggctgtgt

SEQ ID NO: 10026123 - DNA, 22 bp, Homo sapiens
atatgcagtctcttgcccttct

SEQ ID NO: 10026124 - DNA, 22 bp, Homo sapiens
ctgggctcacctgtggctggca

SEQ ID NO: 10026125 - DNA, 22 bp, Homo sapiens
atattgttgactataagagtaa

SEQ ID NO: 10026126 - DNA, 22 bp, Homo sapiens
atcactgttatctagaagcaca

SEQ ID NO: 10026127 - DNA, 22 bp, Homo sapiens
cttagaaggatgtttgctgttt

SEQ ID NO: 10026128 - DNA, 22 bp, Homo sapiens
cttcctcccccacacactcact

SEQ ID NO: 10026129 - DNA, 22 bp, Homo sapiens
cttcccactagtatcacagagc

SEQ ID NO: 10026130 - DNA, 17 bp, Homo sapiens
cttcccaccatctcctg

SEQ ID NO: 10026131 - DNA, 22 bp, Homo sapiens
cttcctctagcctagtaatgcc

SEQ ID NO: 10026132 - DNA, 22 bp, Homo sapiens
cttcctcctccatctcgaaggc

SEQ ID NO: 10026133 - DNA, 22 bp, Homo sapiens
cttcctccgaagaagttgctgg

SEQ ID NO: 10026134 - DNA, 22 bp, Homo sapiens
cttcctcccggcccatgctctg

SEQ ID NO: 10026135 - DNA, 22 bp, Homo sapiens
ctgtgggaacactgaggacttc

SEQ ID NO: 10026136 - DNA, 22 bp, Homo sapiens
atcctctgtggattacacctag

SEQ ID NO: 10026137 - DNA, 22 bp, Homo sapiens
taatatttctaccctgctgcct

SEQ ID NO: 10026138 - DNA, 22 bp, Homo sapiens
caggcagagttagagcaactgg

SEQ ID NO: 10026139 - DNA, 22 bp, Homo sapiens
taataattttaaagaaggctag

SEQ ID NO: 10026140 - DNA, 22 bp, Homo sapiens
caggcctcttccatgcagcagc

SEQ ID NO: 10026141 - DNA, 22 bp, Homo sapiens
tacattgctagaaatgtatttt

SEQ ID NO: 10026142 - DNA, 22 bp, Homo sapiens
cagtcacataggtatacacata

SEQ ID NO: 10026143 - DNA, 22 bp, Homo sapiens
tattttacatgacaggtgttta

SEQ ID NO: 10026144 - DNA, 22 bp, Homo sapiens
tattttacatgatccagagttg

SEQ ID NO: 10026145 - DNA, 22 bp, Homo sapiens
tattttactttaaagcgagaga

SEQ ID NO: 10026146 - DNA, 22 bp, Homo sapiens
tattattaaatggcagaatttt

SEQ ID NO: 10026147 - DNA, 19 bp, Homo sapiens
caggtggcgctctacaggg

SEQ ID NO: 10026148 - DNA, 22 bp, Homo sapiens
caggtggccagtactcaaggat

SEQ ID NO: 10026149 - DNA, 22 bp, Homo sapiens
cagggggtgcaggccctgtgac

SEQ ID NO: 10026150 - DNA, 22 bp, Homo sapiens
cattacatttcaaaatgtttcc

SEQ ID NO: 10026151 - DNA, 22 bp, Homo sapiens
tcccacattaccctgactgaca

SEQ ID NO: 10026152 - DNA, 22 bp, Homo sapiens
tcccacatgtgaatcctcaggt

SEQ ID NO: 10026153 - DNA, 22 bp, Homo sapiens
tccctctaaactgtaagattct

SEQ ID NO: 10026154 - DNA, 23 bp, Homo sapiens
tcctttaatgctggaatggctag

SEQ ID NO: 10026155 - DNA, 22 bp, Homo sapiens
tctaatcctatggtggggaggg

SEQ ID NO: 10026156 - DNA, 22 bp, Homo sapiens
tctaatccttgctacctgggtg

SEQ ID NO: 10026157 - DNA, 22 bp, Homo sapiens
ccagagaaccttgagctgtgag

SEQ ID NO: 10026158 - DNA, 22 bp, Homo sapiens
ccactgtattttggaagcagat

SEQ ID NO: 10026159 - DNA, 22 bp, Homo sapiens
ccactgtaagtttgaaaataac

SEQ ID NO: 10026160 - DNA, 22 bp, Homo sapiens
ccactgtagagatttgaatgcc

SEQ ID NO: 10026161 - DNA, 21 bp, Homo sapiens
ccactgtagactcattctgag

SEQ ID NO: 10026162 - DNA, 22 bp, Homo sapiens
ccactgtagttatgatgaagtt

SEQ ID NO: 10026163 - DNA, 22 bp, Homo sapiens
ccacactaaactgctcaaacca

SEQ ID NO: 10026164 - DNA, 19 bp, Homo sapiens
ccacacagtgtgcaattta

SEQ ID NO: 10026165 - DNA, 22 bp, Homo sapiens
ccacacagggggatgagttatt

SEQ ID NO: 10026166 - DNA, 22 bp, Homo sapiens
ccacacagtcagtttccaagaa

SEQ ID NO: 10026167 - DNA, 22 bp, Homo sapiens
ccacacagtcagtttccaagaa

SEQ ID NO: 10026168 - DNA, 22 bp, Homo sapiens
ccacactgtctaacaaggcata

SEQ ID NO: 10026169 - DNA, 18 bp, Homo sapiens
ccaaggcccctgctgggg

SEQ ID NO: 10026170 - DNA, 22 bp, Homo sapiens
cagttttcttgttatatttggg

SEQ ID NO: 10026171 - DNA, 22 bp, Homo sapiens
catctgctgttccttggactca

SEQ ID NO: 10026172 - DNA, 22 bp, Homo sapiens
catgaagcacagctctcttttt

SEQ ID NO: 10026173 - DNA, 22 bp, Homo sapiens
catgaagccctcatcagtctga

SEQ ID NO: 10026174 - DNA, 22 bp, Homo sapiens
catgaagcatgttttgtcatga

SEQ ID NO: 10026175 - DNA, 21 bp, Homo sapiens
catgaagccggttccctgttt

SEQ ID NO: 10026176 - DNA, 22 bp, Homo sapiens
catgaagctcttgcacctctag

SEQ ID NO: 10026177 - DNA, 22 bp, Homo sapiens
catgaagcttgaagcagtccac

SEQ ID NO: 10026178 - DNA, 21 bp, Homo sapiens
tgagaagtatgtcttcagcca

SEQ ID NO: 10026179 - DNA, 22 bp, Homo sapiens
ccagggggcttggtgaggccat

SEQ ID NO: 10026180 - DNA, 22 bp, Homo sapiens
tgaggcagaaattcctgttttc

SEQ ID NO: 10026181 - DNA, 22 bp, Homo sapiens
tctttgaaaagggagatagaaa

SEQ ID NO: 10026182 - DNA, 22 bp, Homo sapiens
tctttgaaaagatattcctcct

SEQ ID NO: 10026183 - DNA, 22 bp, Homo sapiens
ccaggctctgcgctggacatgg

SEQ ID NO: 10026184 - DNA, 22 bp, Homo sapiens
ccaggctctgtctggtcagaag

SEQ ID NO: 10026185 - DNA, 22 bp, Homo sapiens
ccaggctctgttccccgaggag

SEQ ID NO: 10026186 - DNA, 23 bp, Homo sapiens
ccaggctctttcacctgctattc

SEQ ID NO: 10026187 - DNA, 22 bp, Homo sapiens
ccaggctctgtgtgggctagag

SEQ ID NO: 10026188 - DNA, 22 bp, Homo sapiens
ccagctctgcatgtttcccttg

SEQ ID NO: 10026189 - DNA, 22 bp, Homo sapiens
ccagctctctttgaagcataaa

SEQ ID NO: 10026190 - DNA, 18 bp, Homo sapiens
tctggaacaacttcatgt

SEQ ID NO: 10026191 - DNA, 22 bp, Homo sapiens
ccagctctcagcgggagactca

SEQ ID NO: 10026192 - DNA, 22 bp, Homo sapiens
tctggggatgaggtccagtgat

SEQ ID NO: 10026193 - DNA, 22 bp, Homo sapiens
ccaggacctggagctctatgaa

SEQ ID NO: 10026194 - DNA, 21 bp, Homo sapiens
tctggcaggcacgggcccagc

SEQ ID NO: 10026195 - DNA, 22 bp, Homo sapiens
cctaggaacccccaggcttctg

SEQ ID NO: 10026196 - DNA, 22 bp, Homo sapiens
cccttcctcctcgcctgtcaga

SEQ ID NO: 10026197 - DNA, 22 bp, Homo sapiens
tgggctgcttctattggtggtc

SEQ ID NO: 10026198 - DNA, 22 bp, Homo sapiens
tgggagtggggcatagaaggta

SEQ ID NO: 10026199 - DNA, 22 bp, Homo sapiens
ccccttccttcctcagacagcc

SEQ ID NO: 10026200 - DNA, 22 bp, Homo sapiens
ccccacactctttacattcata

SEQ ID NO: 10026201 - DNA, 22 bp, Homo sapiens
ccccacacctgccgggcagcag

SEQ ID NO: 10026202 - DNA, 20 bp, Homo sapiens
ccccacactattgagcactt

SEQ ID NO: 10026203 - DNA, 19 bp, Homo sapiens
ccctcttgcacaaagcaaa

SEQ ID NO: 10026204 - DNA, 22 bp, Homo sapiens
ctattaggttggtgcaaaagta

SEQ ID NO: 10026205 - DNA, 22 bp, Homo sapiens
ctatgagaagaaaacaagatta

SEQ ID NO: 10026206 - DNA, 22 bp, Homo sapiens
cgcatacatagaaacacacaga

SEQ ID NO: 10026207 - DNA, 22 bp, Homo sapiens
ttaggaatattttctgagtagt

SEQ ID NO: 10026208 - DNA, 22 bp, Homo sapiens
ttaggaagtgtgtccagaagcg

SEQ ID NO: 10026209 - DNA, 22 bp, Homo sapiens
cgtatgaaatttttgacatttg

SEQ ID NO: 10026210 - DNA, 22 bp, Homo sapiens
tgtgtatacaacttataggagc

SEQ ID NO: 10026211 - DNA, 22 bp, Homo sapiens
cctgggctgttgcatcatcctt

SEQ ID NO: 10026212 - DNA, 22 bp, Homo sapiens
cctgggcttacgacctctgact

SEQ ID NO: 10026213 - DNA, 22 bp, Homo sapiens
cctgggctgtacctgtgcgcgg

SEQ ID NO: 10026214 - DNA, 21 bp, Homo sapiens
cctgggctgtggtttggagac

SEQ ID NO: 10026215 - DNA, 22 bp, Homo sapiens
cctgggctggagtacagcagtg

SEQ ID NO: 10026216 - DNA, 22 bp, Homo sapiens
cctgggctgggcgtctcatggg

SEQ ID NO: 10026217 - DNA, 22 bp, Homo sapiens
cctgggctctatcctgacccag

SEQ ID NO: 10026218 - DNA, 22 bp, Homo sapiens
cctgggctcgcgcacttcaccc

SEQ ID NO: 10026219 - DNA, 22 bp, Homo sapiens
cctgggctgaagtcaagtgtgg

SEQ ID NO: 10026220 - DNA, 16 bp, Homo sapiens
cctgggctctgttgga

SEQ ID NO: 10026221 - DNA, 22 bp, Homo sapiens
cctgggctctgtcagaattggg

SEQ ID NO: 10026222 - DNA, 22 bp, Homo sapiens
cctgggctctgaggagggagtc

SEQ ID NO: 10026223 - DNA, 22 bp, Homo sapiens
cctgggctgctcatggggatga

SEQ ID NO: 10026224 - DNA, 22 bp, Homo sapiens
cctgggctgcatgatggcattt

SEQ ID NO: 10026225 - DNA, 22 bp, Homo sapiens
ttagaattattgtttccttcta

SEQ ID NO: 10026226 - DNA, 20 bp, Homo sapiens
tttccactgtaatgtatgat

SEQ ID NO: 10026227 - DNA, 22 bp, Homo sapiens
tttaatattctgcattctcctt

SEQ ID NO: 10026228 - DNA, 22 bp, Homo sapiens
ctcccaagctgtgctgaactgt

SEQ ID NO: 10026229 - DNA, 23 bp, Homo sapiens
ttgtgggcagattccatggggag

SEQ ID NO: 10026230 - DNA, 19 bp, Homo sapiens
ctccaagttaagagggagg

SEQ ID NO: 10026231 - DNA, 22 bp, Homo sapiens
ctccaagtccgagggctctcaa

SEQ ID NO: 10026232 - DNA, 19 bp, Homo sapiens
ctccaagtgccaaggacag

SEQ ID NO: 10026233 - DNA, 22 bp, Homo sapiens
ctccaagtcggctgcagctgga

SEQ ID NO: 10026234 - DNA, 22 bp, Homo sapiens
ctccaagtatgttaaaatctaa

SEQ ID NO: 10026235 - DNA, 22 bp, Homo sapiens
ttgaaatactgcattgttcagt

SEQ ID NO: 10026236 - DNA, 22 bp, Homo sapiens
tttgtacacaggatgttataat

SEQ ID NO: 10026237 - DNA, 22 bp, Homo sapiens
ttttcacttaaggaatttcatg

SEQ ID NO: 10026238 - DNA, 20 bp, Homo sapiens
tttgcgaggccaaggcgggc

SEQ ID NO: 10026239 - DNA, 22 bp, Homo sapiens
ctctgcagattcatcccttcac

SEQ ID NO: 10026240 - DNA, 17 bp, Homo sapiens
ctctttataaagagtta

SEQ ID NO: 10026241 - DNA, 21 bp, Homo sapiens
ctctttatatagtaaagatat

SEQ ID NO: 10026242 - DNA, 22 bp, Homo sapiens
ctgagcctcctgcttctatttc

SEQ ID NO: 10026243 - DNA, 22 bp, Homo sapiens
ctgcaggcccccttcctggagt

SEQ ID NO: 10026244 - DNA, 22 bp, Homo sapiens
gacccatataggaccctccaaa

SEQ ID NO: 10026245 - DNA, 22 bp, Homo sapiens
gaccctgtttctacaaataatt

SEQ ID NO: 10026246 - DNA, 22 bp, Homo sapiens
gacacagaatttactcccgata

SEQ ID NO: 10026247 - DNA, 22 bp, Homo sapiens
gacacagacagttagaggtaat

SEQ ID NO: 10026248 - DNA, 22 bp, Homo sapiens
gacacagaaggtcacatgttca

SEQ ID NO: 10026249 - DNA, 22 bp, Homo sapiens
gaaatatttctcttgagcccct

SEQ ID NO: 10026250 - DNA, 21 bp, Homo sapiens
gaacatttgggttgtttctac

SEQ ID NO: 10026251 - DNA, 22 bp, Homo sapiens
gaggcagagaccttcaggacct

SEQ ID NO: 10026252 - DNA, 22 bp, Homo sapiens
gaggccaggaagcccaagatca

SEQ ID NO: 10026253 - DNA, 22 bp, Homo sapiens
gaggccagctacccaagggtca

SEQ ID NO: 10026254 - DNA, 22 bp, Homo sapiens
gaggccagcccctcttgaaggc

SEQ ID NO: 10026255 - DNA, 22 bp, Homo sapiens
gaggaggcacttgagcagatgt

SEQ ID NO: 10026256 - DNA, 22 bp, Homo sapiens
gagatcggtaaagagcatgcac

SEQ ID NO: 10026257 - DNA, 22 bp, Homo sapiens
gagatggaatctgtgtggaggg

SEQ ID NO: 10026258 - DNA, 22 bp, Homo sapiens
gagccagactgcctgaagctca

SEQ ID NO: 10026259 - DNA, 22 bp, Homo sapiens
gagccagaaaagctgcctgact

SEQ ID NO: 10026260 - DNA, 22 bp, Homo sapiens
ctgttgcatcatggctcttaat

SEQ ID NO: 10026261 - DNA, 22 bp, Homo sapiens
ctgtggctcattcttggtggca

SEQ ID NO: 10026262 - DNA, 22 bp, Homo sapiens
ctgtggctgcgtaggtctggca

SEQ ID NO: 10026263 - DNA, 22 bp, Homo sapiens
ctgggctgcagttcctggtcct

SEQ ID NO: 10026264 - DNA, 22 bp, Homo sapiens
ctgggctgcaggagtggggcaa

SEQ ID NO: 10026265 - DNA, 22 bp, Homo sapiens
ctgggctgcggtggtaggttgt

SEQ ID NO: 10026266 - DNA, 23 bp, Homo sapiens
ctgggctgcttgagtccctggct

SEQ ID NO: 10026267 - DNA, 22 bp, Homo sapiens
ctgggctgctgtccactagggt

SEQ ID NO: 10026268 - DNA, 22 bp, Homo sapiens
ctggggtgtgctcagagcaggg

SEQ ID NO: 10026269 - DNA, 22 bp, Homo sapiens
ctgggaggcagtctctctagaa

SEQ ID NO: 10026270 - DNA, 22 bp, Homo sapiens
ctggccagaggttcctctgccc

SEQ ID NO: 10026271 - DNA, 22 bp, Homo sapiens
ggtttcctgcattgggaaattt

SEQ ID NO: 10026272 - DNA, 22 bp, Homo sapiens
gtattagggccaaaggcaggaa

SEQ ID NO: 10026273 - DNA, 22 bp, Homo sapiens
gtattaggaggaacacaggcct

SEQ ID NO: 10026274 - DNA, 22 bp, Homo sapiens
gtattaggttggtgcaaaagta

SEQ ID NO: 10026275 - DNA, 22 bp, Homo sapiens
gtccaagagtcaagaagggggc

SEQ ID NO: 10026276 - DNA, 22 bp, Homo sapiens
gtccaagtcttccttcccaaac

SEQ ID NO: 10026277 - DNA, 22 bp, Homo sapiens
gtccaagtacatgtgtgtacat

SEQ ID NO: 10026278 - DNA, 22 bp, Homo sapiens
gtgctaggattacaggcatggg

SEQ ID NO: 10026279 - DNA, 22 bp, Homo sapiens
gtgcacagaaattggtaagact

SEQ ID NO: 10026280 - DNA, 17 bp, Homo sapiens
gtgaagagtcattgaat

SEQ ID NO: 10026281 - DNA, 22 bp, Homo sapiens
gggtaggcaaagcaatgacgtt

SEQ ID NO: 10026282 - DNA, 22 bp, Homo sapiens
ggggctgaacctggaggtggtc

SEQ ID NO: 10026283 - DNA, 22 bp, Homo sapiens
ggggctgatggaactcaggcct

SEQ ID NO: 10026284 - DNA, 22 bp, Homo sapiens
ggggctgagaattcagtctcgg

SEQ ID NO: 10026285 - DNA, 22 bp, Homo sapiens
ggggctgacgggcatgtggctt

SEQ ID NO: 10026286 - DNA, 22 bp, Homo sapiens
ggggctgagtcagtgggaagag

SEQ ID NO: 10026287 - DNA, 22 bp, Homo sapiens
gggctgcaatgcttcagttgtt

SEQ ID NO: 10026288 - DNA, 22 bp, Homo sapiens
ggtggcctgaattagctcaggg

SEQ ID NO: 10026289 - DNA, 22 bp, Homo sapiens
gggtggcactgataatgagacg

SEQ ID NO: 10026290 - DNA, 22 bp, Homo sapiens
gggtggcagctgttgccaaggt

SEQ ID NO: 10026291 - DNA, 22 bp, Homo sapiens
gggtggcaggattggcaggagt

SEQ ID NO: 10026292 - DNA, 22 bp, Homo sapiens
ggccagggggcttcagactcca

SEQ ID NO: 10026293 - DNA, 22 bp, Homo sapiens
ggcctcagggttgggcccatta

SEQ ID NO: 10026294 - DNA, 23 bp, Homo sapiens
ggcctcagtgatgatgggttaaa

SEQ ID NO: 10026295 - DNA, 22 bp, Homo sapiens
ggcctcagtgggccgctgcagg

SEQ ID NO: 10026296 - DNA, 22 bp, Homo sapiens
ggcctcagtttctccatgggtt

SEQ ID NO: 10026297 - DNA, 20 bp, Homo sapiens
ggcctcagtgtccttgtttg

SEQ ID NO: 10026298 - DNA, 22 bp, Homo sapiens
ggcctcagtttcttcaactgta

SEQ ID NO: 10026299 - DNA, 22 bp, Homo sapiens
ggcctcagggtcactctgtaga

SEQ ID NO: 10026300 - DNA, 18 bp, Homo sapiens
ggcctcagcctggccgga

SEQ ID NO: 10026301 - DNA, 23 bp, Homo sapiens
ggcctcagcgcacagaaactgct

SEQ ID NO: 10026302 - DNA, 22 bp, Homo sapiens
ggcctcagaggaggtgtgagtc

SEQ ID NO: 10026303 - DNA, 22 bp, Homo sapiens
ggcctcagagaaggctgtgcgg

SEQ ID NO: 10026304 - DNA, 21 bp, Homo sapiens
ggcctcagccacctggctctg

SEQ ID NO: 10026305 - DNA, 22 bp, Homo sapiens
ggcctcagaccggagctggcca

SEQ ID NO: 10026306 - DNA, 22 bp, Homo sapiens
ggagtgagcaaatagagatttg

SEQ ID NO: 10026307 - DNA, 22 bp, Homo sapiens
ggcaggagggcggacaatgacc

SEQ ID NO: 10026308 - DNA, 22 bp, Homo sapiens
gggcaaaacctgggcatcatga

SEQ ID NO: 10026309 - DNA, 22 bp, Homo sapiens
ggcttctgaaccaggccctgga

SEQ ID NO: 10026310 - DNA, 22 bp, Homo sapiens
ggcttctgagtgctctgctgtt

SEQ ID NO: 10026311 - DNA, 22 bp, Homo sapiens
ggcttctgctcagcctgcacgc

SEQ ID NO: 10026312 - DNA, 22 bp, Homo sapiens
ggcttctggtgggagcatgact

SEQ ID NO: 10026313 - DNA, 22 bp, Homo sapiens
ggcttctgtcctctggatctgt

SEQ ID NO: 10026314 - DNA, 22 bp, Homo sapiens
gcacatacccactgtcaagcac

SEQ ID NO: 10026315 - DNA, 22 bp, Homo sapiens
gcacatactgcaaagattacta

SEQ ID NO: 10026316 - DNA, 22 bp, Homo sapiens
gcacataactgaccacatctaa

SEQ ID NO: 10026317 - DNA, 22 bp, Homo sapiens
gcacataaagggcatgggaggt

SEQ ID NO: 10026318 - DNA, 22 bp, Homo sapiens
gcagaggaggacccaggaatta

SEQ ID NO: 10026319 - DNA, 19 bp, Homo sapiens
gcagagtggggtggagggt

SEQ ID NO: 10026320 - DNA, 22 bp, Homo sapiens
gaggccagggtaccatcaacat

SEQ ID NO: 10026321 - DNA, 22 bp, Homo sapiens
gcacacattcggattcttaacc

SEQ ID NO: 10026322 - DNA, 22 bp, Homo sapiens
gcacacatgcatgcacaggagt

SEQ ID NO: 10026323 - DNA, 22 bp, Homo sapiens
gcacacagtatatgctcattaa

SEQ ID NO: 10026324 - DNA, 22 bp, Homo sapiens
gcacacactgttttcctcacat

SEQ ID NO: 10026325 - DNA, 22 bp, Homo sapiens
gcacacagtagggattcaatga

SEQ ID NO: 10026326 - DNA, 22 bp, Homo sapiens
gcacacaggggagttctcagaa

SEQ ID NO: 10026327 - DNA, 22 bp, Homo sapiens
gcaggaagccttaccaagccca

SEQ ID NO: 10026328 - DNA, 22 bp, Homo sapiens
gcagcctccgcactgcgagtcc

SEQ ID NO: 10026329 - DNA, 22 bp, Homo sapiens
gccagctagaggctgcagtgca

SEQ ID NO: 10026330 - DNA, 22 bp, Homo sapiens
gccacatagaggaggatattaa

SEQ ID NO: 10026331 - DNA, 22 bp, Homo sapiens
gccaggggtgcccacccaagga

SEQ ID NO: 10026332 - DNA, 22 bp, Homo sapiens
gcccagctcctctgcagaccct

SEQ ID NO: 10026333 - DNA, 22 bp, Homo sapiens
gcccagcctccaagctccaagg

SEQ ID NO: 10026334 - DNA, 22 bp, Homo sapiens
gccccacagcctgcggtctcag

SEQ ID NO: 10026335 - DNA, 22 bp, Homo sapiens
gcccagctggcttccagcacat

SEQ ID NO: 10026336 - DNA, 22 bp, Homo sapiens
gcccagctgtctggcagggatg

SEQ ID NO: 10026337 - DNA, 22 bp, Homo sapiens
gcccagcttttcacttccacac

SEQ ID NO: 10026338 - DNA, 22 bp, Homo sapiens
gcccagctttttgaggcaggca

SEQ ID NO: 10026339 - DNA, 22 bp, Homo sapiens
gcctcctggcctttgctcctca

SEQ ID NO: 10026340 - DNA, 22 bp, Homo sapiens
gcctcctgggttcatgccattc

SEQ ID NO: 10026341 - DNA, 22 bp, Homo sapiens
gcctcctggaagtcacatgttt

SEQ ID NO: 10026342 - DNA, 22 bp, Homo sapiens
gctcctctattccccacatttt

SEQ ID NO: 10026343 - DNA, 22 bp, Homo sapiens
gctgctaagcgtttctgttcca

SEQ ID NO: 10026344 - DNA, 22 bp, Homo sapiens
ggaccaggccagcctccctgcg

SEQ ID NO: 10026345 - DNA, 22 bp, Homo sapiens
ggagacagtgacttagagactg

SEQ ID NO: 10026346 - DNA, 22 bp, Homo sapiens
ggaatcagaattaggatttgaa

SEQ ID NO: 10026347 - DNA, 22 bp, Homo sapiens
gctgggctggaaggccaaggca

SEQ ID NO: 10026348 - DNA, 22 bp, Homo sapiens
gctgggctgtagtttgctgacc

SEQ ID NO: 10026349 - DNA, 23 bp, Homo sapiens
gctgggcttactctttcagtgag

SEQ ID NO: 10026350 - DNA, 22 bp, Homo sapiens
gcttctggtgaggcctcaggaa

SEQ ID NO: 10026351 - DNA, 22 bp, Homo sapiens
gctgggcttctcaatgctgcct

SEQ ID NO: 10026352 - DNA, 19 bp, Homo sapiens
gctgggcttgggtttgtag

SEQ ID NO: 10026353 - DNA, 22 bp, Homo sapiens
gctggggagggcgtcaaggcca

SEQ ID NO: 10026354 - DNA, 22 bp, Homo sapiens
gctggggaggcagcagagaaca

SEQ ID NO: 10026355 - DNA, 22 bp, Homo sapiens
gctgtgggtaaacgctgagggt

SEQ ID NO: 10026356 - DNA, 22 bp, Homo sapiens
tacaaaggagtagagaaggctt

SEQ ID NO: 10026357 - DNA, 17 bp, Homo sapiens
tacaggagagcaggaac

SEQ ID NO: 10026358 - DNA, 22 bp, Homo sapiens
tacattcccccaattaccaatg

SEQ ID NO: 10026359 - DNA, 22 bp, Homo sapiens
tacattcctgttagcatctaag

SEQ ID NO: 10026360 - DNA, 22 bp, Homo sapiens
tacattccttcgtttagagatt

SEQ ID NO: 10026361 - DNA, 22 bp, Homo sapiens
tacattgaattttttagcatgt

SEQ ID NO: 10026362 - DNA, 22 bp, Homo sapiens
tacattgacttggattgttaga

SEQ ID NO: 10026363 - DNA, 22 bp, Homo sapiens
taaagggtaggttttactgtaa

SEQ ID NO: 10026364 - DNA, 23 bp, Homo sapiens
taaattacctttccagtgcaggg

SEQ ID NO: 10026365 - DNA, 22 bp, Homo sapiens
gttgcacaacttgaatggctgg

SEQ ID NO: 10026366 - DNA, 22 bp, Homo sapiens
gttgcacagttcctcaagcagg

SEQ ID NO: 10026367 - DNA, 22 bp, Homo sapiens
gttggtggatgtgggcagagca

SEQ ID NO: 10026368 - DNA, 22 bp, Homo sapiens
gttaaccaaggcaccaagtgta

SEQ ID NO: 10026369 - DNA, 22 bp, Homo sapiens
tatttataccaggtgatcggag

SEQ ID NO: 10026370 - DNA, 22 bp, Homo sapiens
tattcattatgaccaaatctag

SEQ ID NO: 10026371 - DNA, 22 bp, Homo sapiens
tattaggcatttgaggataaac

SEQ ID NO: 10026372 - DNA, 20 bp, Homo sapiens
tattaggaaggaggaaggaa

SEQ ID NO: 10026373 - DNA, 22 bp, Homo sapiens
tatacacatgtgtgtattcata

SEQ ID NO: 10026374 - DNA, 22 bp, Homo sapiens
taggtctgtgcagaggctgagc

SEQ ID NO: 10026375 - DNA, 22 bp, Homo sapiens
taggtctgtttgggaaatgtga

SEQ ID NO: 10026376 - DNA, 20 bp, Homo sapiens
tataaattcagagctttggt

SEQ ID NO: 10026377 - DNA, 22 bp, Homo sapiens
tagaaagtcaaaacactgtgtt

SEQ ID NO: 10026378 - DNA, 22 bp, Homo sapiens
tagaatgtgcaaatgtgcacac

SEQ ID NO: 10026379 - DNA, 22 bp, Homo sapiens
tagacacatcttcatccacaat

SEQ ID NO: 10026380 - DNA, 22 bp, Homo sapiens
tacttttctataggtttgaaat

SEQ ID NO: 10026381 - DNA, 22 bp, Homo sapiens
tcacacatgctaagccagagat

SEQ ID NO: 10026382 - DNA, 22 bp, Homo sapiens
tcacacatgagtaaatacaggg

SEQ ID NO: 10026383 - DNA, 22 bp, Homo sapiens
tcacagctattctcatgtattt

SEQ ID NO: 10026384 - DNA, 22 bp, Homo sapiens
tcaagtctcaatgtattatggt

SEQ ID NO: 10026385 - DNA, 22 bp, Homo sapiens
tcaagagaaggggaaatagact

SEQ ID NO: 10026386 - DNA, 22 bp, Homo sapiens
tcattatagagttgtattttag

SEQ ID NO: 10026387 - DNA, 22 bp, Homo sapiens
tcatggcacttagcacagtcct

SEQ ID NO: 10026388 - DNA, 22 bp, Homo sapiens
tcatataactggatattttcaa

SEQ ID NO: 10026389 - DNA, 22 bp, Homo sapiens
tcagctctaagttttatgcaaa

SEQ ID NO: 10026390 - DNA, 21 bp, Homo sapiens
tccccacatttctaaacagac

SEQ ID NO: 10026391 - DNA, 21 bp, Homo sapiens
tccccacatttctaaacagac

SEQ ID NO: 10026392 - DNA, 22 bp, Homo sapiens
tccccacatctctgcatcaggc

SEQ ID NO: 10026393 - DNA, 22 bp, Homo sapiens
tccccacagcagaagatctgag

SEQ ID NO: 10026394 - DNA, 22 bp, Homo sapiens
tccccacactttcactcctggc

SEQ ID NO: 10026395 - DNA, 22 bp, Homo sapiens
tccccacacagatacagagtag

SEQ ID NO: 10026396 - DNA, 22 bp, Homo sapiens
tccccaccccagaactactagg

SEQ ID NO: 10026397 - DNA, 22 bp, Homo sapiens
tcccacaggaaagtagacattg

SEQ ID NO: 10026398 - DNA, 21 bp, Homo sapiens
tccagctcttatgttcatgaa

SEQ ID NO: 10026399 - DNA, 22 bp, Homo sapiens
tcccacacttgaaacaaggctg

SEQ ID NO: 10026400 - DNA, 22 bp, Homo sapiens
tcccacactacacggttgttgg

SEQ ID NO: 10026401 - DNA, 22 bp, Homo sapiens
tcccacacctgtctattcctag

SEQ ID NO: 10026402 - DNA, 22 bp, Homo sapiens
tcccacacagcccgctcaccgg

SEQ ID NO: 10026403 - DNA, 22 bp, Homo sapiens
tttgtttagatggtaaatcagt

SEQ ID NO: 10026404 - DNA, 22 bp, Homo sapiens
tttctttatcctcctttgcaca

SEQ ID NO: 10026405 - DNA, 20 bp, Homo sapiens
ttttccttctgagtatgttg

SEQ ID NO: 10026406 - DNA, 22 bp, Homo sapiens
tttttcatgagactagaagtca

SEQ ID NO: 10026407 - DNA, 22 bp, Homo sapiens
ttttggaatgaggaacatccag

SEQ ID NO: 10026408 - DNA, 22 bp, Homo sapiens
tttcattttggttatgccataa

SEQ ID NO: 10026409 - DNA, 22 bp, Homo sapiens
tttcctcttatacagtgtttat

SEQ ID NO: 10026410 - DNA, 22 bp, Homo sapiens
tttctgtagtgtggtatgtagg

SEQ ID NO: 10026411 - DNA, 22 bp, Homo sapiens
tttctgtatttaaaagatctgg

SEQ ID NO: 10026412 - DNA, 20 bp, Homo sapiens
tttctgggtactctccctct

SEQ ID NO: 10026413 - DNA, 22 bp, Homo sapiens
tttctggcagcgggacaggggt

SEQ ID NO: 10026414 - DNA, 20 bp, Homo sapiens
ttgtttaaaggtgaagaggc

SEQ ID NO: 10026415 - DNA, 22 bp, Homo sapiens
ttgtttaagccacccaatctgt

SEQ ID NO: 10026416 - DNA, 22 bp, Homo sapiens
ttggttccttctgaaagtattg

SEQ ID NO: 10026417 - DNA, 22 bp, Homo sapiens
ttggggtgtgtgaaattatgtc

SEQ ID NO: 10026418 - DNA, 18 bp, Homo sapiens
ttggggtgaggccaggaa

SEQ ID NO: 10026419 - DNA, 22 bp, Homo sapiens
tttataacatttcttacctgtg

SEQ ID NO: 10026420 - DNA, 22 bp, Homo sapiens
tttagttttgatgaaaatgcca

SEQ ID NO: 10026421 - DNA, 22 bp, Homo sapiens
tttatataacagagactgctat

SEQ ID NO: 10026422 - DNA, 22 bp, Homo sapiens
tttattagtgcttgtatcactg

SEQ ID NO: 10026423 - DNA, 22 bp, Homo sapiens
tttattagattatcaaagaggt

SEQ ID NO: 10026424 - DNA, 22 bp, Homo sapiens
tttaccatacatcaaaatattt

SEQ ID NO: 10026425 - DNA, 22 bp, Homo sapiens
tttaccagtgttaaacaccagc

SEQ ID NO: 10026426 - DNA, 22 bp, Homo sapiens
tttaaaatcagatgggagttgg

SEQ ID NO: 10026427 - DNA, 22 bp, Homo sapiens
tttaaaatttagacctctccac

SEQ ID NO: 10026428 - DNA, 20 bp, Homo sapiens
ttcatgggagcaaagaggcc

SEQ ID NO: 10026429 - DNA, 20 bp, Homo sapiens
ttccacatctttgcacatgc

SEQ ID NO: 10026430 - DNA, 22 bp, Homo sapiens
ttcctctggggccaggccaaca

SEQ ID NO: 10026431 - DNA, 22 bp, Homo sapiens
ttgattaaaatgagacatcatt

SEQ ID NO: 10026432 - DNA, 22 bp, Homo sapiens
ttgaagcagagaaatacttgaa

SEQ ID NO: 10026433 - DNA, 22 bp, Homo sapiens
ttctttattagtttagtgagct

SEQ ID NO: 10026434 - DNA, 22 bp, Homo sapiens
ttctgggggccaggacagtggt

SEQ ID NO: 10026435 - DNA, 22 bp, Homo sapiens
ttctggggttatgggtgattct

SEQ ID NO: 10026436 - DNA, 22 bp, Homo sapiens
ttctgggggaatacagctatga

SEQ ID NO: 10026437 - DNA, 22 bp, Homo sapiens
ttctggggctaatacagaggtc

SEQ ID NO: 10026438 - DNA, 19 bp, Homo sapiens
ttctggggcctggccttgg

SEQ ID NO: 10026439 - DNA, 22 bp, Homo sapiens
ttctggggccccagtgtcctcg

SEQ ID NO: 10026440 - DNA, 22 bp, Homo sapiens
ttctggggccaattgccactgc

SEQ ID NO: 10026441 - DNA, 22 bp, Homo sapiens
ttctggggacataacagtaagc

SEQ ID NO: 10026442 - DNA, 22 bp, Homo sapiens
ttctcttttcaccagttgctaa

SEQ ID NO: 10026443 - DNA, 22 bp, Homo sapiens
ttctcttttagaggctccatga

SEQ ID NO: 10026444 - DNA, 22 bp, Homo sapiens
tgtttacaaggagtttatattg

SEQ ID NO: 10026445 - DNA, 22 bp, Homo sapiens
tgtttacaagccacttgttaag

SEQ ID NO: 10026446 - DNA, 22 bp, Homo sapiens
tgtttacagggtgattttacct

SEQ ID NO: 10026447 - DNA, 22 bp, Homo sapiens
tgtttacacttcaaggttaagg

SEQ ID NO: 10026448 - DNA, 22 bp, Homo sapiens
tgtggagactatagccataaca

SEQ ID NO: 10026449 - DNA, 22 bp, Homo sapiens
tgtggaggattctgatgccagc

SEQ ID NO: 10026450 - DNA, 22 bp, Homo sapiens
tgtggaggtttaagtaatggga

SEQ ID NO: 10026451 - DNA, 22 bp, Homo sapiens
ttacatattgtctattgttcaa

SEQ ID NO: 10026452 - DNA, 22 bp, Homo sapiens
ttacacaaagttagctcttgca

SEQ ID NO: 10026453 - DNA, 22 bp, Homo sapiens
ttaaatattttcagcagggtca

SEQ ID NO: 10026454 - DNA, 22 bp, Homo sapiens
atcctctgtggattacacctag

SEQ ID NO: 10026455 - DNA, 22 bp, Homo sapiens
atcagactcagaaatgacgtgg

SEQ ID NO: 10026456 - DNA, 22 bp, Homo sapiens
atcagactctgcattgcagtct

SEQ ID NO: 10026457 - DNA, 20 bp, Homo sapiens
atcagacttgcatttcagga

SEQ ID NO: 10026458 - DNA, 22 bp, Homo sapiens
cttcctctagcctagtaatgcc

SEQ ID NO: 10026459 - DNA, 17 bp, Homo sapiens
cttcccaccatctcctg

SEQ ID NO: 10026460 - DNA, 22 bp, Homo sapiens
cttcccactagtatcacagagc

SEQ ID NO: 10026461 - DNA, 22 bp, Homo sapiens
atcaacatgtcataaagtgaaa

SEQ ID NO: 10026462 - DNA, 22 bp, Homo sapiens
atcagaataattagatttcaga

SEQ ID NO: 10026463 - DNA, 22 bp, Homo sapiens
atatgccattagctagaaataa

SEQ ID NO: 10026464 - DNA, 22 bp, Homo sapiens
ctgcatccatgttgctgcaaag

SEQ ID NO: 10026465 - DNA, 22 bp, Homo sapiens
ataacagatgtgaagtgctaat

SEQ ID NO: 10026466 - DNA, 22 bp, Homo sapiens
ataaatgattcagcaggaaata

SEQ ID NO: 10026467 - DNA, 22 bp, Homo sapiens
ctgcctctcagcctgaccgcca

SEQ ID NO: 10026468 - DNA, 22 bp, Homo sapiens
atacattcaaaggaaggataga

SEQ ID NO: 10026469 - DNA, 22 bp, Homo sapiens
atacattcagcagtgctcatga

SEQ ID NO: 10026470 - DNA, 22 bp, Homo sapiens
atagatttgaatttaagacttg

SEQ ID NO: 10026471 - DNA, 22 bp, Homo sapiens
cctgcagatgtgggacagctgt

SEQ ID NO: 10026472 - DNA, 22 bp, Homo sapiens
cctgtgatggtgttacactgtt

SEQ ID NO: 10026473 - DNA, 22 bp, Homo sapiens
cctgtgatgctcttcctcatct

SEQ ID NO: 10026474 - DNA, 22 bp, Homo sapiens
agtcttatgtttgtgaagaact

SEQ ID NO: 10026475 - DNA, 22 bp, Homo sapiens
agtcttatgtgatttatctttc

SEQ ID NO: 10026476 - DNA, 22 bp, Homo sapiens
agtcttatggttaaatagatgc

SEQ ID NO: 10026477 - DNA, 22 bp, Homo sapiens
ctccctcaggccttagccctgc

SEQ ID NO: 10026478 - DNA, 22 bp, Homo sapiens
cataacatgtacatataaatgc

SEQ ID NO: 10026479 - DNA, 23 bp, Homo sapiens
aggatgtaggatgtatggcagag

SEQ ID NO: 10026480 - DNA, 22 bp, Homo sapiens
catcttcagtgattacctaaaa

SEQ ID NO: 10026481 - DNA, 22 bp, Homo sapiens
catcttcataaaggaactgcat

SEQ ID NO: 10026482 - DNA, 22 bp, Homo sapiens
catcttcattttgtccagtact

SEQ ID NO: 10026483 - DNA, 22 bp, Homo sapiens
aggatgggtcagctagagtcca

SEQ ID NO: 10026484 - DNA, 22 bp, Homo sapiens
catcttcacatatttccaatga

SEQ ID NO: 10026485 - DNA, 22 bp, Homo sapiens
ccacagaccttggcttccacct

SEQ ID NO: 10026486 - DNA, 22 bp, Homo sapiens
ccaatgatggtgcccacgatga

SEQ ID NO: 10026487 - DNA, 22 bp, Homo sapiens
ccacatcatggatacagttatg

SEQ ID NO: 10026488 - DNA, 22 bp, Homo sapiens
ccacatacaaatggggtgctgt

SEQ ID NO: 10026489 - DNA, 21 bp, Homo sapiens
ccactcatgactccactcacc

SEQ ID NO: 10026490 - DNA, 23 bp, Homo sapiens
ccactagcacctgttcaacttct

SEQ ID NO: 10026491 - DNA, 22 bp, Homo sapiens
aggcaagaaactttctgggaga

SEQ ID NO: 10026492 - DNA, 22 bp, Homo sapiens
catttcaaaagaattgccagaa

SEQ ID NO: 10026493 - DNA, 22 bp, Homo sapiens
catttcaatgccttcaacatag

SEQ ID NO: 10026494 - DNA, 22 bp, Homo sapiens
catttcacaaatggccacatca

SEQ ID NO: 10026495 - DNA, 22 bp, Homo sapiens
catttctcctgggtgataaatt

SEQ ID NO: 10026496 - DNA, 22 bp, Homo sapiens
caggatgggatgtagtgggccc

SEQ ID NO: 10026497 - DNA, 22 bp, Homo sapiens
caggcacacagcacatggcctg

SEQ ID NO: 10026498 - DNA, 22 bp, Homo sapiens
cccacacactggctgctgccaa

SEQ ID NO: 10026499 - DNA, 22 bp, Homo sapiens
cccacacacatttatgatagga

SEQ ID NO: 10026500 - DNA, 22 bp, Homo sapiens
cccacacaaatcatggggagaa

SEQ ID NO: 10026501 - DNA, 18 bp, Homo sapiens
cccacacagcagtagctc

SEQ ID NO: 10026502 - DNA, 22 bp, Homo sapiens
cccacacatttttcacttaccg

SEQ ID NO: 10026503 - DNA, 20 bp, Homo sapiens
cccacacccttcccacttgg

SEQ ID NO: 10026504 - DNA, 22 bp, Homo sapiens
cccaccctgggctacacatcca

SEQ ID NO: 10026505 - DNA, 22 bp, Homo sapiens
aggccctgacctgggagatcta

SEQ ID NO: 10026506 - DNA, 21 bp, Homo sapiens
agggaaagaaaatgagctaat

SEQ ID NO: 10026507 - DNA, 23 bp, Homo sapiens
agggaaagtagtaatggcctttg

SEQ ID NO: 10026508 - DNA, 22 bp, Homo sapiens
agggaccagcctgcccagggct

SEQ ID NO: 10026509 - DNA, 22 bp, Homo sapiens
agggaccacatcccctctgtgg

SEQ ID NO: 10026510 - DNA, 22 bp, Homo sapiens
cctctgtgtcctggtcattgaa

SEQ ID NO: 10026511 - DNA, 22 bp, Homo sapiens
aggggaaggccagcctgtagag

SEQ ID NO: 10026512 - DNA, 22 bp, Homo sapiens
aggggaatgggtagactgttga

SEQ ID NO: 10026513 - DNA, 19 bp, Homo sapiens
cctctgtgggagtcagtga

SEQ ID NO: 10026514 - DNA, 22 bp, Homo sapiens
cagcacagtgaccagacccact

SEQ ID NO: 10026515 - DNA, 22 bp, Homo sapiens
cagcacacagtgactcgcacct

SEQ ID NO: 10026516 - DNA, 22 bp, Homo sapiens
cagcaagagactgttctctaag

SEQ ID NO: 10026517 - DNA, 22 bp, Homo sapiens
cagcaagagttggggttgttgg

SEQ ID NO: 10026518 - DNA, 22 bp, Homo sapiens
cagcccaggccgacagttcctc

SEQ ID NO: 10026519 - DNA, 22 bp, Homo sapiens
gtctcttctttgccggtcctgc

SEQ ID NO: 10026520 - DNA, 22 bp, Homo sapiens
cagcaggacatggaggagtaaa

SEQ ID NO: 10026521 - DNA, 20 bp, Homo sapiens
cagcctgcatcatctgcagc

SEQ ID NO: 10026522 - DNA, 22 bp, Homo sapiens
cagcctgcatttgtatctgtat

SEQ ID NO: 10026523 - DNA, 22 bp, Homo sapiens
gtgccccagacacgcatgtggg

SEQ ID NO: 10026524 - DNA, 22 bp, Homo sapiens
cacataagaaatgaatatgaga

SEQ ID NO: 10026525 - DNA, 22 bp, Homo sapiens
cacatacaaggcacactggagg

SEQ ID NO: 10026526 - DNA, 22 bp, Homo sapiens
cacatacaaggcacactggagg

SEQ ID NO: 10026527 - DNA, 22 bp, Homo sapiens
cacatacattcatgttactcta

SEQ ID NO: 10026528 - DNA, 22 bp, Homo sapiens
cacatactgagaatcacaccca

SEQ ID NO: 10026529 - DNA, 22 bp, Homo sapiens
cacatacatacgtatgtataca

SEQ ID NO: 10026530 - DNA, 22 bp, Homo sapiens
cacatacttgtgtgtacatatg

SEQ ID NO: 10026531 - DNA, 22 bp, Homo sapiens
cagaaaataaacatttgtggaa

SEQ ID NO: 10026532 - DNA, 23 bp, Homo sapiens
cagaaataaactggtttgtagat

SEQ ID NO: 10026533 - DNA, 22 bp, Homo sapiens
ggcctgagcagacagcatgatg

SEQ ID NO: 10026534 - DNA, 15 bp, Homo sapiens
cacacagacagcttg

SEQ ID NO: 10026535 - DNA, 22 bp, Homo sapiens
cacacagacagctctctgaaga

SEQ ID NO: 10026536 - DNA, 22 bp, Homo sapiens
cacacagatggtaagggaggga

SEQ ID NO: 10026537 - DNA, 22 bp, Homo sapiens
cacaggaattagcagcctaaaa

SEQ ID NO: 10026538 - DNA, 21 bp, Homo sapiens
gctttctgtggactctgcacc

SEQ ID NO: 10026539 - DNA, 22 bp, Homo sapiens
gctttcttatttagaagatttg

SEQ ID NO: 10026540 - DNA, 22 bp, Homo sapiens
caaatgtaaattcttttgaagc

SEQ ID NO: 10026541 - DNA, 22 bp, Homo sapiens
caaatgtaattgcggtttttgc

SEQ ID NO: 10026542 - DNA, 17 bp, Homo sapiens
gcatcacagataacacg

SEQ ID NO: 10026543 - DNA, 22 bp, Homo sapiens
attgtcacttaaaagtgcatgt

SEQ ID NO: 10026544 - DNA, 22 bp, Homo sapiens
attctttcaaggaatagttatt

SEQ ID NO: 10026545 - DNA, 22 bp, Homo sapiens
attcagaaagttgtcatatttg

SEQ ID NO: 10026546 - DNA, 22 bp, Homo sapiens
attcagaaatagaaaatttgat

SEQ ID NO: 10026547 - DNA, 22 bp, Homo sapiens
attaggcactagaatgtcaatt

SEQ ID NO: 10026548 - DNA, 22 bp, Homo sapiens
attagtcagtatttgtttgcca

SEQ ID NO: 10026549 - DNA, 22 bp, Homo sapiens
gatttctagttcattatctatt

SEQ ID NO: 10026550 - DNA, 22 bp, Homo sapiens
gatttctacttgaacttgctaa

SEQ ID NO: 10026551 - DNA, 19 bp, Homo sapiens
gatttctacaaatgtcaga

SEQ ID NO: 10026552 - DNA, 22 bp, Homo sapiens
gatttcagtggctgtctcaaat

SEQ ID NO: 10026553 - DNA, 22 bp, Homo sapiens
gatttcagccctgggggtcatt

SEQ ID NO: 10026554 - DNA, 22 bp, Homo sapiens
gatttcagccccgctcccagct

SEQ ID NO: 10026555 - DNA, 22 bp, Homo sapiens
gatttcagaagcaagaggaggt

SEQ ID NO: 10026556 - DNA, 22 bp, Homo sapiens
caaatactacgattcttgcagt

SEQ ID NO: 10026557 - DNA, 22 bp, Homo sapiens
caaatactctggatgtgtttgt

SEQ ID NO: 10026558 - DNA, 22 bp, Homo sapiens
caaatgctactaataggcaagt

SEQ ID NO: 10026559 - DNA, 19 bp, Homo sapiens
gctgaaatcaaatttggaa

SEQ ID NO: 10026560 - DNA, 22 bp, Homo sapiens
caaaattgattgtggtgatggt

SEQ ID NO: 10026561 - DNA, 22 bp, Homo sapiens
caaaattctgcatttctaataa

SEQ ID NO: 10026562 - DNA, 22 bp, Homo sapiens
caaaatgtgagtcccacctcaa

SEQ ID NO: 10026563 - DNA, 22 bp, Homo sapiens
caaaatgttctggcacctttaa

SEQ ID NO: 10026564 - DNA, 22 bp, Homo sapiens
atttccagtgactctcacaggt

SEQ ID NO: 10026565 - DNA, 22 bp, Homo sapiens
atttccagtcctaatgatctgg

SEQ ID NO: 10026566 - DNA, 22 bp, Homo sapiens
atttccatacacccatttctga

SEQ ID NO: 10026567 - DNA, 22 bp, Homo sapiens
atggttaaattggttatttatg

SEQ ID NO: 10026568 - DNA, 22 bp, Homo sapiens
gagacatcataatgaagtttcc

SEQ ID NO: 10026569 - DNA, 19 bp, Homo sapiens
atgtctctgtagcacatac

SEQ ID NO: 10026570 - DNA, 22 bp, Homo sapiens
atgtctctttactcttagaacc

SEQ ID NO: 10026571 - DNA, 22 bp, Homo sapiens
atgtagaatggtgattggcagg

SEQ ID NO: 10026572 - DNA, 22 bp, Homo sapiens
atgtctctcaggtttaacttta

SEQ ID NO: 10026573 - DNA, 22 bp, Homo sapiens
atgttggagtcgtaaggcatgg

SEQ ID NO: 10026574 - DNA, 22 bp, Homo sapiens
atgttgtagcatatgaaatata

SEQ ID NO: 10026575 - DNA, 22 bp, Homo sapiens
atgtttaaagggttgagaaata

SEQ ID NO: 10026576 - DNA, 22 bp, Homo sapiens
atgtttaagaaagtcttccata

SEQ ID NO: 10026577 - DNA, 22 bp, Homo sapiens
gataatgtggatttattgtgat

SEQ ID NO: 10026578 - DNA, 22 bp, Homo sapiens
gataatgttaagtcataggcta

SEQ ID NO: 10026579 - DNA, 22 bp, Homo sapiens
gataatgtgccgataatttcta

SEQ ID NO: 10026580 - DNA, 22 bp, Homo sapiens
gataatgtaattttatgttcac

SEQ ID NO: 10026581 - DNA, 22 bp, Homo sapiens
atgtgtctgtgggcacacacac

SEQ ID NO: 10026582 - DNA, 20 bp, Homo sapiens
atgtgtcttagagcatcagg

SEQ ID NO: 10026583 - DNA, 22 bp, Homo sapiens
atgtgtcttctaagccaagcct

SEQ ID NO: 10026584 - DNA, 22 bp, Homo sapiens
atgtgtcttatttgattccaca

SEQ ID NO: 10026585 - DNA, 20 bp, Homo sapiens
atgtgtctgtaaacaactct

SEQ ID NO: 10026586 - DNA, 22 bp, Homo sapiens
atgtgtctggttattgacatgc

SEQ ID NO: 10026587 - DNA, 22 bp, Homo sapiens
atgtgtctctaaaatttagtaa

SEQ ID NO: 10026588 - DNA, 22 bp, Homo sapiens
atgtgtctctaccaatgcaatt

SEQ ID NO: 10026589 - DNA, 22 bp, Homo sapiens
atgtgtctgaccactgtattgg

SEQ ID NO: 10026590 - DNA, 22 bp, Homo sapiens
atgtgtctggcatggaaagtgt

SEQ ID NO: 10026591 - DNA, 17 bp, Homo sapiens
atgtgtctgagtgtcct

SEQ ID NO: 10026592 - DNA, 22 bp, Homo sapiens
atgtgtctgatggccctgaatt

SEQ ID NO: 10026593 - DNA, 17 bp, Homo sapiens
atgtgtctagtgcaacc

SEQ ID NO: 10026594 - DNA, 22 bp, Homo sapiens
atgtgtctaattccaggagcac

SEQ ID NO: 10026595 - DNA, 22 bp, Homo sapiens
atgatgaaatgataggtttgtt

SEQ ID NO: 10026596 - DNA, 22 bp, Homo sapiens
atgatgaaactaggaactagag

SEQ ID NO: 10026597 - DNA, 22 bp, Homo sapiens
atgatgaagagtaacaggctga

SEQ ID NO: 10026598 - DNA, 22 bp, Homo sapiens
gaaatagtacagcatagttctt

SEQ ID NO: 10026599 - DNA, 23 bp, Homo sapiens
gaaagtcaatatggtagctttga

SEQ ID NO: 10026600 - DNA, 22 bp, Homo sapiens
gaaaatgttagcttcatagtca

SEQ ID NO: 10026601 - DNA, 22 bp, Homo sapiens
atgaaaattgacagcggaagta

SEQ ID NO: 10026602 - DNA, 22 bp, Homo sapiens
atgaaaatgtacatgtgtataa

SEQ ID NO: 10026603 - DNA, 18 bp, Homo sapiens
gacacatccccaggcctc

SEQ ID NO: 10026604 - DNA, 22 bp, Homo sapiens
gacacatatgcgtatagtttag

SEQ ID NO: 10026605 - DNA, 22 bp, Homo sapiens
gacacatagatctatctcactc

SEQ ID NO: 10026606 - DNA, 22 bp, Homo sapiens
gactggaaagcctgtcctcaga

SEQ ID NO: 10026607 - DNA, 22 bp, Homo sapiens
cagcctctgagccttggcagat

SEQ ID NO: 10026608 - DNA, 22 bp, Homo sapiens
cagcctcttgcactttgaaggc

SEQ ID NO: 10026609 - DNA, 22 bp, Homo sapiens
cagcccaggtctctcttccagt

SEQ ID NO: 10026610 - DNA, 22 bp, Homo sapiens
cagcccaaagccccaggctaga

SEQ ID NO: 10026611 - DNA, 22 bp, Homo sapiens
agcctaggtttccgattctctt

SEQ ID NO: 10026612 - DNA, 22 bp, Homo sapiens
cactgcaacctccacctcctgg

SEQ ID NO: 10026613 - DNA, 22 bp, Homo sapiens
agcaggtgggatcaagctggca

SEQ ID NO: 10026614 - DNA, 22 bp, Homo sapiens
cacacatcaacctagacattgt

SEQ ID NO: 10026615 - DNA, 22 bp, Homo sapiens
cacacatcttatcccagttatt

SEQ ID NO: 10026616 - DNA, 22 bp, Homo sapiens
cacacagaaccgctcgccactt

SEQ ID NO: 10026617 - DNA, 22 bp, Homo sapiens
atgtgcatgcacttacatgtgt

SEQ ID NO: 10026618 - DNA, 19 bp, Homo sapiens
atgtgcatttgtgtgaggt

SEQ ID NO: 10026619 - DNA, 22 bp, Homo sapiens
atgggcatgcttctagttgaaa

SEQ ID NO: 10026620 - DNA, 22 bp, Homo sapiens
atgtaggattgagtgatagagg

SEQ ID NO: 10026621 - DNA, 22 bp, Homo sapiens
atctgtttaattcattttcaca

SEQ ID NO: 10026622 - DNA, 22 bp, Homo sapiens
atgcttccactgttctgctctc

SEQ ID NO: 10026623 - DNA, 22 bp, Homo sapiens
atgccagcctctaagcacttta

SEQ ID NO: 10026624 - DNA, 22 bp, Homo sapiens
atgccacttcattccagcctcg

SEQ ID NO: 10026625 - DNA, 22 bp, Homo sapiens
attgtgtcctcattgaccttca

SEQ ID NO: 10026626 - DNA, 22 bp, Homo sapiens
attgtatttgtacaagacatgt

SEQ ID NO: 10026627 - DNA, 22 bp, Homo sapiens
attgagcaatagtgtttgcagc

SEQ ID NO: 10026628 - DNA, 22 bp, Homo sapiens
attgagcagcttctctgccatc

SEQ ID NO: 10026629 - DNA, 22 bp, Homo sapiens
attgagcagacggcactttggc

SEQ ID NO: 10026630 - DNA, 22 bp, Homo sapiens
agaggccggccgagcccatggg

SEQ ID NO: 10026631 - DNA, 21 bp, Homo sapiens
attttgtacatagaatttgtc

SEQ ID NO: 10026632 - DNA, 22 bp, Homo sapiens
attttgtgggttctgctgatgt

SEQ ID NO: 10026633 - DNA, 22 bp, Homo sapiens
agcaatcaaataaatgtcctgg

SEQ ID NO: 10026634 - DNA, 22 bp, Homo sapiens
agcaatatttcagctagcaggt

SEQ ID NO: 10026635 - DNA, 22 bp, Homo sapiens
actcacaggactctgcatatag

SEQ ID NO: 10026636 - DNA, 23 bp, Homo sapiens
agtcagtgtaagtttggaatgca

SEQ ID NO: 10026637 - DNA, 22 bp, Homo sapiens
agttaatataagttttactgtt

SEQ ID NO: 10026638 - DNA, 22 bp, Homo sapiens
atagatgtctgacacagagaaa

SEQ ID NO: 10026639 - DNA, 23 bp, Homo sapiens
atagaagattattgcaacagtcc

SEQ ID NO: 10026640 - DNA, 20 bp, Homo sapiens
atacacttgcccagcttgtg

SEQ ID NO: 10026641 - DNA, 22 bp, Homo sapiens
atacacactgctatcctttttt

SEQ ID NO: 10026642 - DNA, 22 bp, Homo sapiens
atacactactaagcacagattg

SEQ ID NO: 10026643 - DNA, 22 bp, Homo sapiens
ataaggtatgaaaagtaaatgg

SEQ ID NO: 10026644 - DNA, 22 bp, Homo sapiens
ataaggtaagggtattgtcaga

SEQ ID NO: 10026645 - DNA, 22 bp, Homo sapiens
agaaagaacgcacttgtgctgc

SEQ ID NO: 10026646 - DNA, 22 bp, Homo sapiens
atatagtgagagattacagaag

SEQ ID NO: 10026647 - DNA, 22 bp, Homo sapiens
atattaatgagcaagtaagtga

SEQ ID NO: 10026648 - DNA, 22 bp, Homo sapiens
agaaatatgctgattagatgaa

SEQ ID NO: 10026649 - DNA, 22 bp, Homo sapiens
agaaatcacttagaggaagtga

SEQ ID NO: 10026650 - DNA, 22 bp, Homo sapiens
atcaagtgaagggctcttgaag

SEQ ID NO: 10026651 - DNA, 21 bp, Homo sapiens
atcaatgacctggcatgaggg

SEQ ID NO: 10026652 - DNA, 18 bp, Homo sapiens
atcaaggaggggaaggtc

SEQ ID NO: 10026653 - DNA, 22 bp, Homo sapiens
atcaatgttgggccaaagcaaa

SEQ ID NO: 10026654 - DNA, 22 bp, Homo sapiens
agaaatgttgaatacatcagga

SEQ ID NO: 10026655 - DNA, 22 bp, Homo sapiens
agaaatgtcaggaaagaagtcc

SEQ ID NO: 10026656 - DNA, 22 bp, Homo sapiens
agaaatgttgaatacacaaaat

SEQ ID NO: 10026657 - DNA, 22 bp, Homo sapiens
acatctgaggagaccagcctct

SEQ ID NO: 10026658 - DNA, 22 bp, Homo sapiens
acatctgaggagaccagcctct

SEQ ID NO: 10026659 - DNA, 22 bp, Homo sapiens
acatccatgttgtaatgttcct

SEQ ID NO: 10026660 - DNA, 22 bp, Homo sapiens
aggcagcaaagaaatgatgctg

SEQ ID NO: 10026661 - DNA, 22 bp, Homo sapiens
aggacttagaacattatgtact

SEQ ID NO: 10026662 - DNA, 22 bp, Homo sapiens
acaggacatgtaccaggtggtc

SEQ ID NO: 10026663 - DNA, 22 bp, Homo sapiens
acaggacaactcagcagccagc

SEQ ID NO: 10026664 - DNA, 22 bp, Homo sapiens
aggacacagtggtggggaaaag

SEQ ID NO: 10026665 - DNA, 22 bp, Homo sapiens
acagactggcctgtctcgcacc

SEQ ID NO: 10026666 - DNA, 22 bp, Homo sapiens
acacataagaaactacaaagag

SEQ ID NO: 10026667 - DNA, 22 bp, Homo sapiens
acacataagcctaatcatctcc

SEQ ID NO: 10026668 - DNA, 22 bp, Homo sapiens
acacatacatggggaagatgag

SEQ ID NO: 10026669 - DNA, 22 bp, Homo sapiens
acagccagcagagctgtttcct

SEQ ID NO: 10026670 - DNA, 22 bp, Homo sapiens
acacagagccaaaccatatcac

SEQ ID NO: 10026671 - DNA, 22 bp, Homo sapiens
acaatgtaggctgaaaaagctt

SEQ ID NO: 10026672 - DNA, 22 bp, Homo sapiens
acaatgtagagtaaaatatgtt

SEQ ID NO: 10026673 - DNA, 22 bp, Homo sapiens
acaaatccagtgaactccagtg

SEQ ID NO: 10026674 - DNA, 22 bp, Homo sapiens
acaaatgaacctgaaatctcag

SEQ ID NO: 10026675 - DNA, 22 bp, Homo sapiens
aagaacatttatgatggcattt

SEQ ID NO: 10026676 - DNA, 22 bp, Homo sapiens
aaggagggaaagcagtgcttct

SEQ ID NO: 10026677 - DNA, 22 bp, Homo sapiens
aaggagggttcccaggtcctgg

SEQ ID NO: 10026678 - DNA, 16 bp, Homo sapiens
aaggagggaagagaat

SEQ ID NO: 10026679 - DNA, 22 bp, Homo sapiens
aaggcccagcctggagcttgtt

SEQ ID NO: 10026680 - DNA, 22 bp, Homo sapiens
aaggcccagggattggaggtca

SEQ ID NO: 10026681 - DNA, 22 bp, Homo sapiens
aagtgcttagaagttgcattag

SEQ ID NO: 10026682 - DNA, 22 bp, Homo sapiens
aagtcttacagacaagctgaag

SEQ ID NO: 10026683 - DNA, 22 bp, Homo sapiens
aagtcttacataatagtttgga

SEQ ID NO: 10026684 - DNA, 22 bp, Homo sapiens
aagtcttacataaacaggaaat

SEQ ID NO: 10026685 - DNA, 22 bp, Homo sapiens
aagtcttagcaactatcgcttt

SEQ ID NO: 10026686 - DNA, 22 bp, Homo sapiens
aatgctgttctgagtctgcagg

SEQ ID NO: 10026687 - DNA, 22 bp, Homo sapiens
aatctgcataagcacagttgga

SEQ ID NO: 10026688 - DNA, 22 bp, Homo sapiens
aatgaacaaaatatgctttgca

SEQ ID NO: 10026689 - DNA, 22 bp, Homo sapiens
aatgcagaccagtatgaaaaac

SEQ ID NO: 10026690 - DNA, 22 bp, Homo sapiens
aataatgtctatggttccaaaa

SEQ ID NO: 10026691 - DNA, 22 bp, Homo sapiens
aataatgtctgctattttaaaa

SEQ ID NO: 10026692 - DNA, 23 bp, Homo sapiens
aataatgtcttgtgctctcactt

SEQ ID NO: 10026693 - DNA, 22 bp, Homo sapiens
aataatgtctttggcttgacca

SEQ ID NO: 10026694 - DNA, 22 bp, Homo sapiens
aataatgtaggatgataaatga

SEQ ID NO: 10026695 - DNA, 22 bp, Homo sapiens
aataatgtacatacatatttcg

SEQ ID NO: 10026696 - DNA, 22 bp, Homo sapiens
aatataattttattcctagagt

SEQ ID NO: 10026697 - DNA, 22 bp, Homo sapiens
aatatccaggtagatgtcttct

SEQ ID NO: 10026698 - DNA, 22 bp, Homo sapiens
aaatatttgtctgaggcggttg

SEQ ID NO: 10026699 - DNA, 22 bp, Homo sapiens
aaatcactgttattgatcttaa

SEQ ID NO: 10026700 - DNA, 22 bp, Homo sapiens
aaatgagtttcctcaatgtcct

SEQ ID NO: 10026701 - DNA, 22 bp, Homo sapiens
aaatcagagtctgattttaagg

SEQ ID NO: 10026702 - DNA, 22 bp, Homo sapiens
aaatgaacagttgcattctctg

SEQ ID NO: 10026703 - DNA, 22 bp, Homo sapiens
aaatcagacttgaattttcatc

SEQ ID NO: 10026704 - DNA, 22 bp, Homo sapiens
aaatgcttcacctcattaaact

SEQ ID NO: 10026705 - DNA, 22 bp, Homo sapiens
aagagagaactcccttcgccag

SEQ ID NO: 10026706 - DNA, 22 bp, Homo sapiens
aaatacataaaggttgtaccag

SEQ ID NO: 10026707 - DNA, 22 bp, Homo sapiens
aagagagagtgcgctcacagaa

SEQ ID NO: 10026708 - DNA, 22 bp, Homo sapiens
aaagtccagagggcacactgaa

SEQ ID NO: 10026709 - DNA, 22 bp, Homo sapiens
aaattccattatgataatttcg

SEQ ID NO: 10026710 - DNA, 22 bp, Homo sapiens
aaattccattatgataatttcg

SEQ ID NO: 10026711 - DNA, 22 bp, Homo sapiens
aaattggattttaaactgttgg

SEQ ID NO: 10026712 - DNA, 22 bp, Homo sapiens
aacatgaaacccaaacagaata

SEQ ID NO: 10026713 - DNA, 22 bp, Homo sapiens
aaaggaggccacatggctagga

SEQ ID NO: 10026714 - DNA, 22 bp, Homo sapiens
aaaatacacatactaggggaaa

SEQ ID NO: 10026715 - DNA, 22 bp, Homo sapiens
aaaatgagccatgaaccaacca

SEQ ID NO: 10026716 - DNA, 22 bp, Homo sapiens
aaaatactactgtcttcttccc

SEQ ID NO: 10026717 - DNA, 22 bp, Homo sapiens
aaaatgctgggaaagttggaat

SEQ ID NO: 10026718 - DNA, 22 bp, Homo sapiens
aaaatgctcatcagcgatggct

SEQ ID NO: 10026719 - DNA, 22 bp, Homo sapiens
aaaatgctatttcatggaggag

SEQ ID NO: 10026720 - DNA, 22 bp, Homo sapiens
aaaacattctgtgaactctcaa

SEQ ID NO: 10026721 - DNA, 22 bp, Homo sapiens
aaaacattgaattgcacactat

SEQ ID NO: 10026722 - DNA, 22 bp, Homo sapiens
aaaaatgaaacggctggttggc

SEQ ID NO: 10026723 - DNA, 22 bp, Homo sapiens
aaaaatgttatctactgtccga

SEQ ID NO: 10026724 - DNA, 22 bp, Homo sapiens
aaaagcagatctccaaagtcta

SEQ ID NO: 10026725 - DNA, 22 bp, Homo sapiens
aaaattgtcgaacagtagtaac

SEQ ID NO: 10026726 - DNA, 22 bp, Homo sapiens
aaagtcatacatggtgcttact

SEQ ID NO: 10026727 - DNA, 22 bp, Homo sapiens
aaagtcatgtttttgtttagca

SEQ ID NO: 10026728 - DNA, 22 bp, Homo sapiens
aaatgtctttcaatagagaaat

SEQ ID NO: 10026729 - DNA, 22 bp, Homo sapiens
aaacttagtagagttcatatta

SEQ ID NO: 10026730 - DNA, 22 bp, Homo sapiens
aaatgaactcaatgatctccca

SEQ ID NO: 10026731 - DNA, 22 bp, Homo sapiens
aaatgaacatcaagaatagcct

SEQ ID NO: 10026732 - DNA, 22 bp, Homo sapiens
aaatgacaataaaagtccatgc

SEQ ID NO: 10026733 - DNA, 22 bp, Homo sapiens
aaacttagatgtttttagagtt

SEQ ID NO: 10026734 - DNA, 22 bp, Homo sapiens
aaggaggcctggcagatgaaga

SEQ ID NO: 10026735 - DNA, 22 bp, Homo sapiens
aaggatgaacattaatacatca

SEQ ID NO: 10026736 - DNA, 22 bp, Homo sapiens
acatcccacagaaacatacata

SEQ ID NO: 10026737 - DNA, 22 bp, Homo sapiens
acatgaagtggtcagatcaaac

SEQ ID NO: 10026738 - DNA, 22 bp, Homo sapiens
acatttcagtaagtgttaattt

SEQ ID NO: 10026739 - DNA, 22 bp, Homo sapiens
acatttcagcgtgcatgacatg

SEQ ID NO: 10026740 - DNA, 22 bp, Homo sapiens
acatttcagattcatgaagtga

SEQ ID NO: 10026741 - DNA, 22 bp, Homo sapiens
actttgttgatgaaatagtttt

SEQ ID NO: 10026742 - DNA, 22 bp, Homo sapiens
aatgaagttctattcattttct

SEQ ID NO: 10026743 - DNA, 20 bp, Homo sapiens
aatgaagttattaatgatgt

SEQ ID NO: 10026744 - DNA, 21 bp, Homo sapiens
aatgaagtggctattttgagg

SEQ ID NO: 10026745 - DNA, 22 bp, Homo sapiens
aatgaagtgtttagaagtttta

SEQ ID NO: 10026746 - DNA, 22 bp, Homo sapiens
aatgaagtgttatttagtttca

SEQ ID NO: 10026747 - DNA, 22 bp, Homo sapiens
aataagtgagtttagcaagttt

SEQ ID NO: 10026748 - DNA, 22 bp, Homo sapiens
actcttgaaaatagatccacat

SEQ ID NO: 10026749 - DNA, 22 bp, Homo sapiens
aatttggttttaagagcatcag

SEQ ID NO: 10026750 - DNA, 23 bp, Homo sapiens
aatttggttgatgaaagcattgt

SEQ ID NO: 10026751 - DNA, 22 bp, Homo sapiens
aatttctaattgaatctctctt

SEQ ID NO: 10026752 - DNA, 18 bp, Homo sapiens
aatgctattgttataggg

SEQ ID NO: 10026753 - DNA, 22 bp, Homo sapiens
aatgctcaaaatgtttcatcta

SEQ ID NO: 10026754 - DNA, 22 bp, Homo sapiens
aatgtataatatttaatgcttt

SEQ ID NO: 10026755 - DNA, 22 bp, Homo sapiens
aatgtatgagcgtgaaagcact

SEQ ID NO: 10026756 - DNA, 22 bp, Homo sapiens
aatgtatgggtgagaaagttga

SEQ ID NO: 10026757 - DNA, 20 bp, Homo sapiens
aatgtatattttatgccagg

SEQ ID NO: 10026758 - DNA, 22 bp, Homo sapiens
aatgtatgtgtatatcaaatca

SEQ ID NO: 10026759 - DNA, 21 bp, Homo sapiens
aatgtatgtttatctcacagt

SEQ ID NO: 10026760 - DNA, 22 bp, Homo sapiens
agaggaatttctggaaggaggc

SEQ ID NO: 10026761 - DNA, 22 bp, Homo sapiens
acacacacaagcaggttgtgga

SEQ ID NO: 10026762 - DNA, 22 bp, Homo sapiens
acacatctcaggggacactctc

SEQ ID NO: 10026763 - DNA, 22 bp, Homo sapiens
acacatcatgccaagtttcacc

SEQ ID NO: 10026764 - DNA, 22 bp, Homo sapiens
acacatcagaaatatgaatgag

SEQ ID NO: 10026765 - DNA, 22 bp, Homo sapiens
tcccacacagcccgctcaccgg

SEQ ID NO: 10026766 - DNA, 22 bp, Homo sapiens
tcccacacctgtctattcctag

SEQ ID NO: 10026767 - DNA, 22 bp, Homo sapiens
tcccacactacacggttgttgg

SEQ ID NO: 10026768 - DNA, 22 bp, Homo sapiens
tcccacacttgaaacaaggctg

SEQ ID NO: 10026769 - DNA, 22 bp, Homo sapiens
tccagccaagggaggttactag

SEQ ID NO: 10026770 - DNA, 22 bp, Homo sapiens
tccagcctttctactcactgag

SEQ ID NO: 10026771 - DNA, 19 bp, Homo sapiens
tcattgattgtagttacat

SEQ ID NO: 10026772 - DNA, 22 bp, Homo sapiens
tcattgaatatggggccataca

SEQ ID NO: 10026773 - DNA, 22 bp, Homo sapiens
tcccacaggaaagtagacattg

SEQ ID NO: 10026774 - DNA, 23 bp, Homo sapiens
tcccattgagctctgagaactgc

SEQ ID NO: 10026775 - DNA, 22 bp, Homo sapiens
tcccagtgggaagcagcacgct

SEQ ID NO: 10026776 - DNA, 22 bp, Homo sapiens
tccccaccccagaactactagg

SEQ ID NO: 10026777 - DNA, 22 bp, Homo sapiens
tccccacacagatacagagtag

SEQ ID NO: 10026778 - DNA, 22 bp, Homo sapiens
tccccacactttcactcctggc

SEQ ID NO: 10026779 - DNA, 22 bp, Homo sapiens
tccccacagcagaagatctgag

SEQ ID NO: 10026780 - DNA, 22 bp, Homo sapiens
tccccacatctctgcatcaggc

SEQ ID NO: 10026781 - DNA, 21 bp, Homo sapiens
tccccacatttctaaacagac

SEQ ID NO: 10026782 - DNA, 22 bp, Homo sapiens
tcatagctaagctccagagtgc

SEQ ID NO: 10026783 - DNA, 22 bp, Homo sapiens
tcatataccagagagtttatat

SEQ ID NO: 10026784 - DNA, 22 bp, Homo sapiens
tcatggcacttagcacagtcct

SEQ ID NO: 10026785 - DNA, 22 bp, Homo sapiens
tcattagcagaagacagatgaa

SEQ ID NO: 10026786 - DNA, 22 bp, Homo sapiens
tcagtctcctttcctctagaca

SEQ ID NO: 10026787 - DNA, 22 bp, Homo sapiens
tcagtctctggggcttctgttt

SEQ ID NO: 10026788 - DNA, 18 bp, Homo sapiens
tcagggaagagaatatga

SEQ ID NO: 10026789 - DNA, 22 bp, Homo sapiens
tcagtgtaagttatgtagatgt

SEQ ID NO: 10026790 - DNA, 22 bp, Homo sapiens
tcaaggagacagaaagcaatgg

SEQ ID NO: 10026791 - DNA, 22 bp, Homo sapiens
tcaaggaaaagataacttgatg

SEQ ID NO: 10026792 - DNA, 22 bp, Homo sapiens
tcaagaaggagttatttattca

SEQ ID NO: 10026793 - DNA, 22 bp, Homo sapiens
tcaagtctcaatgtattatggt

SEQ ID NO: 10026794 - DNA, 22 bp, Homo sapiens
tcaaggagcccacagtctaatg

SEQ ID NO: 10026795 - DNA, 22 bp, Homo sapiens
tcaaggaggtgcttggcttcac

SEQ ID NO: 10026796 - DNA, 21 bp, Homo sapiens
tcaaggagtttctcttttcca

SEQ ID NO: 10026797 - DNA, 22 bp, Homo sapiens
tcaataactttgtttagcattg

SEQ ID NO: 10026798 - DNA, 22 bp, Homo sapiens
tcacaggataaggtggcatcac

SEQ ID NO: 10026799 - DNA, 22 bp, Homo sapiens
tcacacatgagtaaatacaggg

SEQ ID NO: 10026800 - DNA, 22 bp, Homo sapiens
tcacacatgctaagccagagat

SEQ ID NO: 10026801 - DNA, 22 bp, Homo sapiens
tcactgtgtcctttctgcgtag

SEQ ID NO: 10026802 - DNA, 22 bp, Homo sapiens
tcaccaagtccatatgcatcat

SEQ ID NO: 10026803 - DNA, 23 bp, Homo sapiens
tcagagaggccccctgcagagat

SEQ ID NO: 10026804 - DNA, 22 bp, Homo sapiens
tcagcaaggctgcattctcatc

SEQ ID NO: 10026805 - DNA, 22 bp, Homo sapiens
tcagcactgatgtttcagaaga

SEQ ID NO: 10026806 - DNA, 22 bp, Homo sapiens
tacttttagcctatttgattct

SEQ ID NO: 10026807 - DNA, 22 bp, Homo sapiens
tactttgtcatgctaagagtga

SEQ ID NO: 10026808 - DNA, 22 bp, Homo sapiens
tactttgtcattctaaccttcc

SEQ ID NO: 10026809 - DNA, 22 bp, Homo sapiens
tactttgtggagattaaaaata

SEQ ID NO: 10026810 - DNA, 22 bp, Homo sapiens
tactttgcagcttgataaaatg

SEQ ID NO: 10026811 - DNA, 22 bp, Homo sapiens
tacatttgggacaataagagaa

SEQ ID NO: 10026812 - DNA, 22 bp, Homo sapiens
tacatttgttatagaaatgaag

SEQ ID NO: 10026813 - DNA, 22 bp, Homo sapiens
tagacacatcttcatccacaat

SEQ ID NO: 10026814 - DNA, 22 bp, Homo sapiens
taggaaacaaagcttagcagga

SEQ ID NO: 10026815 - DNA, 22 bp, Homo sapiens
taggagggggaacaaggcatac

SEQ ID NO: 10026816 - DNA, 22 bp, Homo sapiens
taggagggttagagggaaatat

SEQ ID NO: 10026817 - DNA, 22 bp, Homo sapiens
tagctttagaaatattctcaga

SEQ ID NO: 10026818 - DNA, 22 bp, Homo sapiens
tagctttgcctgttaatcacaa

SEQ ID NO: 10026819 - DNA, 22 bp, Homo sapiens
tagcttttaagtcataacctca

SEQ ID NO: 10026820 - DNA, 22 bp, Homo sapiens
tagcagaagaaattcagagttg

SEQ ID NO: 10026821 - DNA, 21 bp, Homo sapiens
tatagtgtggatatgctgatg

SEQ ID NO: 10026822 - DNA, 22 bp, Homo sapiens
tattattatgcatagcatgaaa

SEQ ID NO: 10026823 - DNA, 22 bp, Homo sapiens
tattattatattggatgagact

SEQ ID NO: 10026824 - DNA, 22 bp, Homo sapiens
tattcttaattgctgagctgaa

SEQ ID NO: 10026825 - DNA, 22 bp, Homo sapiens
tatttataacagtgagaacggg

SEQ ID NO: 10026826 - DNA, 22 bp, Homo sapiens
tatttcaacgtatgaaaagctg

SEQ ID NO: 10026827 - DNA, 22 bp, Homo sapiens
tatttattggacagtgttgctg

SEQ ID NO: 10026828 - DNA, 22 bp, Homo sapiens
tatgtgcaaattaattgctaga

SEQ ID NO: 10026829 - DNA, 22 bp, Homo sapiens
tatgtgcaaaatgctagactag

SEQ ID NO: 10026830 - DNA, 22 bp, Homo sapiens
tatgtgtctgtcgtgcataaat

SEQ ID NO: 10026831 - DNA, 22 bp, Homo sapiens
tatgtgcatatgcatacacaca

SEQ ID NO: 10026832 - DNA, 22 bp, Homo sapiens
tatgtctttgtccatgtgcagt

SEQ ID NO: 10026833 - DNA, 22 bp, Homo sapiens
tatgtcttgtgtttgctaatct

SEQ ID NO: 10026834 - DNA, 23 bp, Homo sapiens
taaattacctttccagtgcaggg

SEQ ID NO: 10026835 - DNA, 22 bp, Homo sapiens
taaagtatattttttctcaata

SEQ ID NO: 10026836 - DNA, 22 bp, Homo sapiens
taaagtgctgggattataggcc

SEQ ID NO: 10026837 - DNA, 22 bp, Homo sapiens
taaagtgctggatttgagtaaa

SEQ ID NO: 10026838 - DNA, 22 bp, Homo sapiens
taaagtagcaagtttagactga

SEQ ID NO: 10026839 - DNA, 22 bp, Homo sapiens
taaagtagcgcctaactaatgt

SEQ ID NO: 10026840 - DNA, 22 bp, Homo sapiens
taaagggtaggttttactgtaa

SEQ ID NO: 10026841 - DNA, 18 bp, Homo sapiens
taaaattcaaggcagggt

SEQ ID NO: 10026842 - DNA, 22 bp, Homo sapiens
taaaattgcggtgaatatttcc

SEQ ID NO: 10026843 - DNA, 22 bp, Homo sapiens
taaaatgtagcttctaggctgg

SEQ ID NO: 10026844 - DNA, 21 bp, Homo sapiens
gttttctttgatagagggaag

SEQ ID NO: 10026845 - DNA, 22 bp, Homo sapiens
gttttcttcctgcaattggcat

SEQ ID NO: 10026846 - DNA, 21 bp, Homo sapiens
tacatttgagagctataagct

SEQ ID NO: 10026847 - DNA, 22 bp, Homo sapiens
tacatttggatgtgcttaagtg

SEQ ID NO: 10026848 - DNA, 22 bp, Homo sapiens
tacatttgctttgattttcagc

SEQ ID NO: 10026849 - DNA, 22 bp, Homo sapiens
tacattcctgttagcatctaag

SEQ ID NO: 10026850 - DNA, 22 bp, Homo sapiens
tacatctatactgatctacatt

SEQ ID NO: 10026851 - DNA, 22 bp, Homo sapiens
tacagatatgtatgcacttttt

SEQ ID NO: 10026852 - DNA, 22 bp, Homo sapiens
tacagatatagagatttataga

SEQ ID NO: 10026853 - DNA, 21 bp, Homo sapiens
tacagatgaggagaccaaggc

SEQ ID NO: 10026854 - DNA, 22 bp, Homo sapiens
tacaaaaaattgatactgacga

SEQ ID NO: 10026855 - DNA, 22 bp, Homo sapiens
tacaaagaggtaattgcatata

SEQ ID NO: 10026856 - DNA, 22 bp, Homo sapiens
taatggtatttgttgaaaaact

SEQ ID NO: 10026857 - DNA, 22 bp, Homo sapiens
taatgtaaacacagagacagaa

SEQ ID NO: 10026858 - DNA, 20 bp, Homo sapiens
gctttcaagcttgtcattgt

SEQ ID NO: 10026859 - DNA, 22 bp, Homo sapiens
gctgctaagcgtttctgttcca

SEQ ID NO: 10026860 - DNA, 22 bp, Homo sapiens
gctgcgccggatcccacgttcc

SEQ ID NO: 10026861 - DNA, 22 bp, Homo sapiens
gcctttatcagtttcatggctt

SEQ ID NO: 10026862 - DNA, 22 bp, Homo sapiens
gcctcctgaaaggaagagctcc

SEQ ID NO: 10026863 - DNA, 22 bp, Homo sapiens
gccccagctctgccacaactag

SEQ ID NO: 10026864 - DNA, 22 bp, Homo sapiens
gccccagccaaggtgacacgaa

SEQ ID NO: 10026865 - DNA, 22 bp, Homo sapiens
gccccacagcctgcggtctcag

SEQ ID NO: 10026866 - DNA, 22 bp, Homo sapiens
gcccagcctccaagctccaagg

SEQ ID NO: 10026867 - DNA, 22 bp, Homo sapiens
gccacatagaggaggatattaa

SEQ ID NO: 10026868 - DNA, 22 bp, Homo sapiens
gcatgcatctagatatgcagac

SEQ ID NO: 10026869 - DNA, 22 bp, Homo sapiens
gcagcctcaaactccccagctc

SEQ ID NO: 10026870 - DNA, 22 bp, Homo sapiens
gcacacaggggagttctcagaa

SEQ ID NO: 10026871 - DNA, 22 bp, Homo sapiens
gcacacagtagggattcaatga

SEQ ID NO: 10026872 - DNA, 22 bp, Homo sapiens
gcacacactgttttcctcacat

SEQ ID NO: 10026873 - DNA, 22 bp, Homo sapiens
gcacacagtatatgctcattaa

SEQ ID NO: 10026874 - DNA, 22 bp, Homo sapiens
gcacacatgcatgcacaggagt

SEQ ID NO: 10026875 - DNA, 22 bp, Homo sapiens
gcacacattcggattcttaacc

SEQ ID NO: 10026876 - DNA, 22 bp, Homo sapiens
gcaaagtattaagtattaagtt

SEQ ID NO: 10026877 - DNA, 22 bp, Homo sapiens
gcacataaagggcatgggaggt

SEQ ID NO: 10026878 - DNA, 22 bp, Homo sapiens
gcacataactgaccacatctaa

SEQ ID NO: 10026879 - DNA, 22 bp, Homo sapiens
gcacatactgcaaagattacta

SEQ ID NO: 10026880 - DNA, 22 bp, Homo sapiens
gcacatacccactgtcaagcac

SEQ ID NO: 10026881 - DNA, 23 bp, Homo sapiens
gggaccagctagggctgtgacct

SEQ ID NO: 10026882 - DNA, 22 bp, Homo sapiens
ggcaccagccacctatttctag

SEQ ID NO: 10026883 - DNA, 22 bp, Homo sapiens
ggagccagcagggtgacactga

SEQ ID NO: 10026884 - DNA, 22 bp, Homo sapiens
ggagtcacacaggaagaaggac

SEQ ID NO: 10026885 - DNA, 22 bp, Homo sapiens
ggcctgagtcacatcaggagag

SEQ ID NO: 10026886 - DNA, 19 bp, Homo sapiens
ggcctttcacctggatgct

SEQ ID NO: 10026887 - DNA, 22 bp, Homo sapiens
ggtgtgggaactacaggttttt

SEQ ID NO: 10026888 - DNA, 21 bp, Homo sapiens
ggtgtgggatggactgaacca

SEQ ID NO: 10026889 - DNA, 22 bp, Homo sapiens
gtgaagataaggatgctgcagt

SEQ ID NO: 10026890 - DNA, 22 bp, Homo sapiens
gtgcacatcgtgcaggtttgtt

SEQ ID NO: 10026891 - DNA, 22 bp, Homo sapiens
gtgcatatatgtgcagcatcaa

SEQ ID NO: 10026892 - DNA, 22 bp, Homo sapiens
gtgcatatgtgtgtatacaaac

SEQ ID NO: 10026893 - DNA, 22 bp, Homo sapiens
gtccccgacgtttggcttgatg

SEQ ID NO: 10026894 - DNA, 22 bp, Homo sapiens
ctgggtctggtgtcaggcgacg

SEQ ID NO: 10026895 - DNA, 22 bp, Homo sapiens
ctgtgtagagcggctgcgagcg

SEQ ID NO: 10026896 - DNA, 22 bp, Homo sapiens
ctgtgtctaatcttatacatca

SEQ ID NO: 10026897 - DNA, 22 bp, Homo sapiens
ctgtgtctaatcaggtcagtca

SEQ ID NO: 10026898 - DNA, 22 bp, Homo sapiens
ctgttgctctgaacaggtcttg

SEQ ID NO: 10026899 - DNA, 22 bp, Homo sapiens
ctgtgtctcgttaaagcattgg

SEQ ID NO: 10026900 - DNA, 22 bp, Homo sapiens
ctgtgtctcccaaggagggtca

SEQ ID NO: 10026901 - DNA, 22 bp, Homo sapiens
ctgtgtctcatccgcctctggc

SEQ ID NO: 10026902 - DNA, 22 bp, Homo sapiens
ctgtgtctgaataactctgtgt

SEQ ID NO: 10026903 - DNA, 22 bp, Homo sapiens
ctgtgtctgcctgggatccatt

SEQ ID NO: 10026904 - DNA, 22 bp, Homo sapiens
ctgtgtctctccttacaagact

SEQ ID NO: 10026905 - DNA, 22 bp, Homo sapiens
ctgtgtcttcaatgtactggga

SEQ ID NO: 10026906 - DNA, 22 bp, Homo sapiens
ctgtgtctgtggaatagcgaat

SEQ ID NO: 10026907 - DNA, 22 bp, Homo sapiens
ctgtgtcttcacatttgtgtgc

SEQ ID NO: 10026908 - DNA, 22 bp, Homo sapiens
ctgtgtcttctgcttacagtct

SEQ ID NO: 10026909 - DNA, 22 bp, Homo sapiens
ctgttaatggaggactacagga

SEQ ID NO: 10026910 - DNA, 22 bp, Homo sapiens
ctgttaattgtgaattttacat

SEQ ID NO: 10026911 - DNA, 22 bp, Homo sapiens
ctgtgagtcttcagcaagtgtt

SEQ ID NO: 10026912 - DNA, 22 bp, Homo sapiens
cttgcaaagtagctgagaggtt

SEQ ID NO: 10026913 - DNA, 22 bp, Homo sapiens
cttgtagacccctggactcacg

SEQ ID NO: 10026914 - DNA, 22 bp, Homo sapiens
cttgtatatagcatgagtttga

SEQ ID NO: 10026915 - DNA, 22 bp, Homo sapiens
gacctcgtgatccgccctcctt

SEQ ID NO: 10026916 - DNA, 22 bp, Homo sapiens
gacctcatgatccacctgcctt

SEQ ID NO: 10026917 - DNA, 22 bp, Homo sapiens
gacctctcaggaatctcacatg

SEQ ID NO: 10026918 - DNA, 22 bp, Homo sapiens
gagaattcttcaacaaagtatt

SEQ ID NO: 10026919 - DNA, 22 bp, Homo sapiens
gaggcaaggccgcacgtctcag

SEQ ID NO: 10026920 - DNA, 22 bp, Homo sapiens
gagctcttttgccagtcactgc

SEQ ID NO: 10026921 - DNA, 22 bp, Homo sapiens
gagcttttcttccagttaatga

SEQ ID NO: 10026922 - DNA, 20 bp, Homo sapiens
gaacatttggccatactgag

SEQ ID NO: 10026923 - DNA, 22 bp, Homo sapiens
gaaatcaaggctacattcaggt

SEQ ID NO: 10026924 - DNA, 22 bp, Homo sapiens
gaaatcaggatgatgttccaga

SEQ ID NO: 10026925 - DNA, 22 bp, Homo sapiens
gacacagaaggtcacatgttca

SEQ ID NO: 10026926 - DNA, 22 bp, Homo sapiens
gacacagacagttagaggtaat

SEQ ID NO: 10026927 - DNA, 22 bp, Homo sapiens
gacacagaatttactcccgata

SEQ ID NO: 10026928 - DNA, 22 bp, Homo sapiens
gacccatataggaccctccaaa

SEQ ID NO: 10026929 - DNA, 23 bp, Homo sapiens
gaagttctgttcagccagacaag

SEQ ID NO: 10026930 - DNA, 22 bp, Homo sapiens
ctgcactgagctctcccagccc

SEQ ID NO: 10026931 - DNA, 22 bp, Homo sapiens
ctctgccctcgcacatctgcca

SEQ ID NO: 10026932 - DNA, 19 bp, Homo sapiens
ctctgcctccctcctgggt

SEQ ID NO: 10026933 - DNA, 21 bp, Homo sapiens
ctctgcccagggcctcctgcc

SEQ ID NO: 10026934 - DNA, 22 bp, Homo sapiens
tttgctaatgcctctgaaatca

SEQ ID NO: 10026935 - DNA, 22 bp, Homo sapiens
tttgggaaatagtagaaaatgt

SEQ ID NO: 10026936 - DNA, 22 bp, Homo sapiens
tttgggaaatattgtgttcaag

SEQ ID NO: 10026937 - DNA, 20 bp, Homo sapiens
tttgggaaatgcaggtttca

SEQ ID NO: 10026938 - DNA, 22 bp, Homo sapiens
tttgggaacaatgaggatctga

SEQ ID NO: 10026939 - DNA, 22 bp, Homo sapiens
tttgggaagtttaaaataagta

SEQ ID NO: 10026940 - DNA, 22 bp, Homo sapiens
tttgggaattgtagctgtcttg

SEQ ID NO: 10026941 - DNA, 22 bp, Homo sapiens
tttgggaagaggaatctctgga

SEQ ID NO: 10026942 - DNA, 22 bp, Homo sapiens
tttgggaacttaattatgtctg

SEQ ID NO: 10026943 - DNA, 22 bp, Homo sapiens
tttgggaactggacttcctgct

SEQ ID NO: 10026944 - DNA, 22 bp, Homo sapiens
tttgggaagtgggagcaaggtg

SEQ ID NO: 10026945 - DNA, 23 bp, Homo sapiens
tttgggaagggagagagtaagca

SEQ ID NO: 10026946 - DNA, 22 bp, Homo sapiens
ttttaagaaatgtatgactgtc

SEQ ID NO: 10026947 - DNA, 22 bp, Homo sapiens
ctcatttaacagattaaaaagt

SEQ ID NO: 10026948 - DNA, 22 bp, Homo sapiens
ttgaaagtgatggggaagatgg

SEQ ID NO: 10026949 - DNA, 22 bp, Homo sapiens
ttgaaagttaggatttagctgg

SEQ ID NO: 10026950 - DNA, 22 bp, Homo sapiens
ttgaaagtctaggcttacagta

SEQ ID NO: 10026951 - DNA, 22 bp, Homo sapiens
ttgaaagtaataactttgttca

SEQ ID NO: 10026952 - DNA, 21 bp, Homo sapiens
ttgaaagtaaattcagcagct

SEQ ID NO: 10026953 - DNA, 22 bp, Homo sapiens
ctcacaggtcatgtggtggctt

SEQ ID NO: 10026954 - DNA, 22 bp, Homo sapiens
ctccacagcccctccagtggca

SEQ ID NO: 10026955 - DNA, 22 bp, Homo sapiens
ttgtgtaattagcaaacaaatc

SEQ ID NO: 10026956 - DNA, 22 bp, Homo sapiens
ttgtgtaaggctgattaggaag

SEQ ID NO: 10026957 - DNA, 22 bp, Homo sapiens
ttgtgtaatctcttccctgccc

SEQ ID NO: 10026958 - DNA, 22 bp, Homo sapiens
ttgtgtaagatgcaatatggta

SEQ ID NO: 10026959 - DNA, 22 bp, Homo sapiens
ttgtgtaacttgagcaaacaca

SEQ ID NO: 10026960 - DNA, 22 bp, Homo sapiens
ttgtgtaaatatctaaatgttt

SEQ ID NO: 10026961 - DNA, 22 bp, Homo sapiens
tttaatagggcccaatgagact

SEQ ID NO: 10026962 - DNA, 22 bp, Homo sapiens
tttcctaaggtagtgataattt

SEQ ID NO: 10026963 - DNA, 22 bp, Homo sapiens
tttcctaatcccaatgacattt

SEQ ID NO: 10026964 - DNA, 22 bp, Homo sapiens
ctctctctatgcgttgttccta

SEQ ID NO: 10026965 - DNA, 22 bp, Homo sapiens
ctctctgagtggctgtactttc

SEQ ID NO: 10026966 - DNA, 22 bp, Homo sapiens
tttatttaaagtcgtgtgttaa

SEQ ID NO: 10026967 - DNA, 23 bp, Homo sapiens
cctgtgtgcccttaattcacagc

SEQ ID NO: 10026968 - DNA, 22 bp, Homo sapiens
cctgtgcttcactcaacaagcc

SEQ ID NO: 10026969 - DNA, 22 bp, Homo sapiens
cctgtgccctcagcctggctct

SEQ ID NO: 10026970 - DNA, 22 bp, Homo sapiens
cctgtgctcccatagcttctgt

SEQ ID NO: 10026971 - DNA, 22 bp, Homo sapiens
tgtttagagtctctgtcaacat

SEQ ID NO: 10026972 - DNA, 22 bp, Homo sapiens
tgttcattagtggaagtaagtt

SEQ ID NO: 10026973 - DNA, 22 bp, Homo sapiens
tgttcattaaactactgtgtgg

SEQ ID NO: 10026974 - DNA, 22 bp, Homo sapiens
tgttcattctgtatatgctgta

SEQ ID NO: 10026975 - DNA, 22 bp, Homo sapiens
tgtgtataggttgtgctaatag

SEQ ID NO: 10026976 - DNA, 23 bp, Homo sapiens
tgtgtctgaggatatatgtgcat

SEQ ID NO: 10026977 - DNA, 22 bp, Homo sapiens
tgtgtctgaactagttgctctc

SEQ ID NO: 10026978 - DNA, 19 bp, Homo sapiens
tgtgtctctgtgtagcctg

SEQ ID NO: 10026979 - DNA, 22 bp, Homo sapiens
cgcatacatagaaacacacaga

SEQ ID NO: 10026980 - DNA, 22 bp, Homo sapiens
cgccccagccagttgagcggcg

SEQ ID NO: 10026981 - DNA, 22 bp, Homo sapiens
ctatgagaagaaaacaagatta

SEQ ID NO: 10026982 - DNA, 22 bp, Homo sapiens
ctatgtttatctgtatttctgt

SEQ ID NO: 10026983 - DNA, 22 bp, Homo sapiens
ctcaatgtagacctcaacatat

SEQ ID NO: 10026984 - DNA, 22 bp, Homo sapiens
ctcacagcagctctgcgagata

SEQ ID NO: 10026985 - DNA, 22 bp, Homo sapiens
ctaaatgacttccagtggttat

SEQ ID NO: 10026986 - DNA, 22 bp, Homo sapiens
tggagcaaattcaagctcatct

SEQ ID NO: 10026987 - DNA, 22 bp, Homo sapiens
tggaatggaaacaaactgagga

SEQ ID NO: 10026988 - DNA, 22 bp, Homo sapiens
tgctgtgttctcctgactcacc

SEQ ID NO: 10026989 - DNA, 18 bp, Homo sapiens
cccggctaatttttggta

SEQ ID NO: 10026990 - DNA, 20 bp, Homo sapiens
ccccacactattgagcactt

SEQ ID NO: 10026991 - DNA, 22 bp, Homo sapiens
ccccacacctgccgggcagcag

SEQ ID NO: 10026992 - DNA, 22 bp, Homo sapiens
ccccacactctttacattcata

SEQ ID NO: 10026993 - DNA, 22 bp, Homo sapiens
cctaaggaaagccaaagaggcc

SEQ ID NO: 10026994 - DNA, 22 bp, Homo sapiens
tctggtgtcagtattctttgaa

SEQ ID NO: 10026995 - DNA, 22 bp, Homo sapiens
tctgctttgaccttcttgatgc

SEQ ID NO: 10026996 - DNA, 22 bp, Homo sapiens
ccagctctctgcagaaaggact

SEQ ID NO: 10026997 - DNA, 22 bp, Homo sapiens
ccagctctgccaagcgtcagct

SEQ ID NO: 10026998 - DNA, 22 bp, Homo sapiens
ccagctctgcatgtttcccttg

SEQ ID NO: 10026999 - DNA, 22 bp, Homo sapiens
tgacataataatccaaacatac

SEQ ID NO: 10027000 - DNA, 22 bp, Homo sapiens
ccatgccatactggccacccgg

SEQ ID NO: 10027001 - DNA, 22 bp, Homo sapiens
ccatgccccaccaggacgctgc

SEQ ID NO: 10027002 - DNA, 22 bp, Homo sapiens
ccatgccccaatacaggacacc

SEQ ID NO: 10027003 - DNA, 22 bp, Homo sapiens
ccagtgttccagagagctgatg

SEQ ID NO: 10027004 - DNA, 22 bp, Homo sapiens
ccagtgttctggtgttcatttc

SEQ ID NO: 10027005 - DNA, 22 bp, Homo sapiens
ccattccatgtgctacacataa

SEQ ID NO: 10027006 - DNA, 22 bp, Homo sapiens
tgattcaagagagttggggtat

SEQ ID NO: 10027007 - DNA, 22 bp, Homo sapiens
tgattcaagattggttagctgt

SEQ ID NO: 10027008 - DNA, 23 bp, Homo sapiens
tgattttaaaaagtaagttatca

SEQ ID NO: 10027009 - DNA, 22 bp, Homo sapiens
catgcatgtcagggatcctgga

SEQ ID NO: 10027010 - DNA, 22 bp, Homo sapiens
catgcatgtttactacagtgac

SEQ ID NO: 10027011 - DNA, 22 bp, Homo sapiens
catctgctgctgaagccagcat

SEQ ID NO: 10027012 - DNA, 22 bp, Homo sapiens
tcagggattgcaaaattcatcc

SEQ ID NO: 10027013 - DNA, 22 bp, Homo sapiens
tcaatcataatgaagtgaagaa

SEQ ID NO: 10027014 - DNA, 22 bp, Homo sapiens
tcaatctagagattaaaatagg

SEQ ID NO: 10027015 - DNA, 22 bp, Homo sapiens
cagttcttggacactctggagt

SEQ ID NO: 10027016 - DNA, 22 bp, Homo sapiens
tcagagagtgcaaaatatagct

SEQ ID NO: 10027017 - DNA, 22 bp, Homo sapiens
cataatgtctgacacagtaaga

SEQ ID NO: 10027018 - DNA, 22 bp, Homo sapiens
cataatgtatgcattttccagc

SEQ ID NO: 10027019 - DNA, 22 bp, Homo sapiens
cataacatccttgctactttga

SEQ ID NO: 10027020 - DNA, 22 bp, Homo sapiens
cataatgttaatcttgactcca

SEQ ID NO: 10027021 - DNA, 22 bp, Homo sapiens
cataatgtgtgtcatacagact

SEQ ID NO: 10027022 - DNA, 22 bp, Homo sapiens
cataatgttgtaacacatagag

SEQ ID NO: 10027023 - DNA, 22 bp, Homo sapiens
ccaaggagtagagcaggaagct

SEQ ID NO: 10027024 - DNA, 22 bp, Homo sapiens
ccaaggaggccccaggtcagct

SEQ ID NO: 10027025 - DNA, 22 bp, Homo sapiens
ccaaggagcaaggctcaacaag

SEQ ID NO: 10027026 - DNA, 22 bp, Homo sapiens
ccaaggagaatgacaccatgga

SEQ ID NO: 10027027 - DNA, 22 bp, Homo sapiens
ccaaggagctgcaggcacttgt

SEQ ID NO: 10027028 - DNA, 22 bp, Homo sapiens
ccaaggagctcatattcttgtt

SEQ ID NO: 10027029 - DNA, 22 bp, Homo sapiens
ccaaggagcaagtttacacctg

SEQ ID NO: 10027030 - DNA, 20 bp, Homo sapiens
tcctaataacctgaagaaat

SEQ ID NO: 10027031 - DNA, 22 bp, Homo sapiens
ccacacagtcagtttccaagaa

SEQ ID NO: 10027032 - DNA, 22 bp, Homo sapiens
ccacacagggggatgagttatt

SEQ ID NO: 10027033 - DNA, 19 bp, Homo sapiens
ccacacagtgtgcaattta

SEQ ID NO: 10027034 - DNA, 22 bp, Homo sapiens
ccacactaaactgctcaaacca

SEQ ID NO: 10027035 - DNA, 22 bp, Homo sapiens
catttaatccatagaggaatgt

SEQ ID NO: 10027036 - DNA, 22 bp, Homo sapiens
cattgtcacccaaagctcatag

SEQ ID NO: 10027037 - DNA, 22 bp, Homo sapiens
tcccacatgtgaatcctcaggt

SEQ ID NO: 10027038 - DNA, 22 bp, Homo sapiens
tcccacattaccctgactgaca

SEQ ID NO: 10027039 - DNA, 22 bp, Homo sapiens
cattctatcttggactggatct

SEQ ID NO: 10027040 - DNA, 22 bp, Homo sapiens
taggagggccctgaaaatggca

SEQ ID NO: 10027041 - DNA, 22 bp, Homo sapiens
caggtatgaggacactgacagc

SEQ ID NO: 10027042 - DNA, 22 bp, Homo sapiens
tcaaaacaacactcaggtgtaa

SEQ ID NO: 10027043 - DNA, 22 bp, Homo sapiens
tcaaaacactattacctttaat

SEQ ID NO: 10027044 - DNA, 22 bp, Homo sapiens
cagtcacataggtatacacata

SEQ ID NO: 10027045 - DNA, 22 bp, Homo sapiens
tattttaaagtgaagggtcttg

SEQ ID NO: 10027046 - DNA, 22 bp, Homo sapiens
tagaaaatagggcctgtggagc

SEQ ID NO: 10027047 - DNA, 22 bp, Homo sapiens
tagaaaatccagtgtggggaga

SEQ ID NO: 10027048 - DNA, 22 bp, Homo sapiens
tagaaaatggccaagcaggact

SEQ ID NO: 10027049 - DNA, 22 bp, Homo sapiens
tagaaaatggccaagcaggact

SEQ ID NO: 10027050 - DNA, 22 bp, Homo sapiens
tagaaaatgttccactgccatt

SEQ ID NO: 10027051 - DNA, 22 bp, Homo sapiens
tagattcagatatttaggacaa

SEQ ID NO: 10027052 - DNA, 22 bp, Homo sapiens
taataattggctaaccctggga

SEQ ID NO: 10027053 - DNA, 22 bp, Homo sapiens
taatgtataacaaatactcatc

SEQ ID NO: 10027054 - DNA, 22 bp, Homo sapiens
taatgtactgatgggaagtggt

SEQ ID NO: 10027055 - DNA, 22 bp, Homo sapiens
taatgtacctccagatgttgta

SEQ ID NO: 10027056 - DNA, 22 bp, Homo sapiens
taatgtaaagaagatgtaggaa

SEQ ID NO: 10027057 - DNA, 22 bp, Homo sapiens
taatgtataacaaatactcatc

SEQ ID NO: 10027058 - DNA, 22 bp, Homo sapiens
taatgtcaaggtcattctagag

SEQ ID NO: 10027059 - DNA, 20 bp, Homo sapiens
taatgtcaaagtcacaaggt

SEQ ID NO: 10027060 - DNA, 22 bp, Homo sapiens
taatgtcaaggtgatagatttg

SEQ ID NO: 10027061 - DNA, 22 bp, Homo sapiens
ttaaatcaggcatcatttcagt

SEQ ID NO: 10027062 - DNA, 22 bp, Homo sapiens
ttaaatcagtaggctactcctt

SEQ ID NO: 10027063 - DNA, 22 bp, Homo sapiens
ttaaatgatgcatatcatttag

SEQ ID NO: 10027064 - DNA, 22 bp, Homo sapiens
ttaaatgtgatttcatttatgt

SEQ ID NO: 10027065 - DNA, 17 bp, Homo sapiens
tgttttctgctaccttt

SEQ ID NO: 10027066 - DNA, 22 bp, Homo sapiens
tgttttctgatggttaatgagt

SEQ ID NO: 10027067 - DNA, 22 bp, Homo sapiens
tgttttctgatggttaatgagt

SEQ ID NO: 10027068 - DNA, 22 bp, Homo sapiens
tgttttctgggtggaaggtact

SEQ ID NO: 10027069 - DNA, 22 bp, Homo sapiens
tgttttctgtgtagagatcaca

SEQ ID NO: 10027070 - DNA, 22 bp, Homo sapiens
tgttttcttcctaattgctcat

SEQ ID NO: 10027071 - DNA, 22 bp, Homo sapiens
tgtttttactgtgatccagaaa

SEQ ID NO: 10027072 - DNA, 22 bp, Homo sapiens
ttaagtatatccatttgactgg

SEQ ID NO: 10027073 - DNA, 22 bp, Homo sapiens
ttaagtcacttatctaaagaca

SEQ ID NO: 10027074 - DNA, 22 bp, Homo sapiens
ttaagtcatttctgattataga

SEQ ID NO: 10027075 - DNA, 22 bp, Homo sapiens
ttaattcttccggactgtgaaa

SEQ ID NO: 10027076 - DNA, 22 bp, Homo sapiens
ttaattttaacctgtttgtgtc

SEQ ID NO: 10027077 - DNA, 22 bp, Homo sapiens
ttaattttctcatctgtgaaat

SEQ ID NO: 10027078 - DNA, 22 bp, Homo sapiens
ttaattttgatgaggttcagtt

SEQ ID NO: 10027079 - DNA, 22 bp, Homo sapiens
ttaatttttatgtatagtgtgt

SEQ ID NO: 10027080 - DNA, 22 bp, Homo sapiens
ttacaggaggaaattggctaca

SEQ ID NO: 10027081 - DNA, 22 bp, Homo sapiens
ttagagattgtctagtattgtg

SEQ ID NO: 10027082 - DNA, 22 bp, Homo sapiens
ttagagaaaagcttgcttgctt

SEQ ID NO: 10027083 - DNA, 22 bp, Homo sapiens
ttactttatgtgatggattagt

SEQ ID NO: 10027084 - DNA, 22 bp, Homo sapiens
tgtggacgtcattaaagcagtg

SEQ ID NO: 10027085 - DNA, 22 bp, Homo sapiens
tgtgtcatgtgtgaggctccct

SEQ ID NO: 10027086 - DNA, 22 bp, Homo sapiens
tgtgtgaaggaatatatactca

SEQ ID NO: 10027087 - DNA, 22 bp, Homo sapiens
tgtgtgaatggattattctatt

SEQ ID NO: 10027088 - DNA, 22 bp, Homo sapiens
tgtgtgaggtggttctgagaag

SEQ ID NO: 10027089 - DNA, 22 bp, Homo sapiens
tgtgtgagtaaggctgagagag

SEQ ID NO: 10027090 - DNA, 22 bp, Homo sapiens
tgtttacaaggagaatttgagg

SEQ ID NO: 10027091 - DNA, 22 bp, Homo sapiens
tgtttaatttcacaaagttgac

SEQ ID NO: 10027092 - DNA, 22 bp, Homo sapiens
tgtttaattcaccatcatgttc

SEQ ID NO: 10027093 - DNA, 22 bp, Homo sapiens
tgtttaataattctatgatagt

SEQ ID NO: 10027094 - DNA, 22 bp, Homo sapiens
tgtttaatctataaaatggaga

SEQ ID NO: 10027095 - DNA, 22 bp, Homo sapiens
tgtttcaagcaatagcatttca

SEQ ID NO: 10027096 - DNA, 22 bp, Homo sapiens
tgtttcagagcactgggcttat

SEQ ID NO: 10027097 - DNA, 22 bp, Homo sapiens
tgtttcaggcttctgggatttt

SEQ ID NO: 10027098 - DNA, 22 bp, Homo sapiens
tgtttgaaagcacctacatttt

SEQ ID NO: 10027099 - DNA, 22 bp, Homo sapiens
tgttatcctcagctcacctcta

SEQ ID NO: 10027100 - DNA, 22 bp, Homo sapiens
tgttatgtgccacacttgaggg

SEQ ID NO: 10027101 - DNA, 22 bp, Homo sapiens
tgtgtttgggggagatgcattt

SEQ ID NO: 10027102 - DNA, 22 bp, Homo sapiens
tgtgttcaagattagttctagt

SEQ ID NO: 10027103 - DNA, 22 bp, Homo sapiens
tgtgttaatttattgcctcaga

SEQ ID NO: 10027104 - DNA, 21 bp, Homo sapiens
tgtgtgcatatgcatgtacat

SEQ ID NO: 10027105 - DNA, 22 bp, Homo sapiens
tgtgtgcagacagatattactt

SEQ ID NO: 10027106 - DNA, 22 bp, Homo sapiens
tgtgtgcaattcttaacataca

SEQ ID NO: 10027107 - DNA, 22 bp, Homo sapiens
ttctataagactcatatttctt

SEQ ID NO: 10027108 - DNA, 22 bp, Homo sapiens
ttctgttttagaaataagtagt

SEQ ID NO: 10027109 - DNA, 22 bp, Homo sapiens
ttctgtttgccatatatagtag

SEQ ID NO: 10027110 - DNA, 22 bp, Homo sapiens
ttcttgcctgccctgtgtcgta

SEQ ID NO: 10027111 - DNA, 22 bp, Homo sapiens
ttctttcactcaagaaggatct

SEQ ID NO: 10027112 - DNA, 22 bp, Homo sapiens
ttgattcatttattgagtgcct

SEQ ID NO: 10027113 - DNA, 22 bp, Homo sapiens
ttgattcatatagatatgcgtg

SEQ ID NO: 10027114 - DNA, 22 bp, Homo sapiens
ttgattcagagaagattggccc

SEQ ID NO: 10027115 - DNA, 20 bp, Homo sapiens
ttgcaaatatctattgattg

SEQ ID NO: 10027116 - DNA, 22 bp, Homo sapiens
ttgcaaatgtgaataattacac

SEQ ID NO: 10027117 - DNA, 22 bp, Homo sapiens
ttgcaaatgtttcataacagta

SEQ ID NO: 10027118 - DNA, 22 bp, Homo sapiens
ttgattttaaaatagtgacact

SEQ ID NO: 10027119 - DNA, 20 bp, Homo sapiens
ttccacatctttgcacatgc

SEQ ID NO: 10027120 - DNA, 22 bp, Homo sapiens
ttcctaatcacgaacattattt

SEQ ID NO: 10027121 - DNA, 22 bp, Homo sapiens
ttcctaatggcaaaacatgttt

SEQ ID NO: 10027122 - DNA, 20 bp, Homo sapiens
ttcatgggagcaaagaggcc

SEQ ID NO: 10027123 - DNA, 22 bp, Homo sapiens
tttaaaatttagacctctccac

SEQ ID NO: 10027124 - DNA, 22 bp, Homo sapiens
tttaaaatttagacctctccac

SEQ ID NO: 10027125 - DNA, 22 bp, Homo sapiens
tttaatgttcatctcaaaggat

SEQ ID NO: 10027126 - DNA, 22 bp, Homo sapiens
tttaaaatcagatgggagttgg

SEQ ID NO: 10027127 - DNA, 22 bp, Homo sapiens
tttacttttggtaaggtcattt

SEQ ID NO: 10027128 - DNA, 22 bp, Homo sapiens
tttattacaccaggttaactca

SEQ ID NO: 10027129 - DNA, 21 bp, Homo sapiens
tttattaacaactgtggacgt

SEQ ID NO: 10027130 - DNA, 22 bp, Homo sapiens
tttattaagatgcgaatgctga

SEQ ID NO: 10027131 - DNA, 23 bp, Homo sapiens
ttgcaaatttcagttagttcatg

SEQ ID NO: 10027132 - DNA, 22 bp, Homo sapiens
ttgcaacacaaagtttgattcc

SEQ ID NO: 10027133 - DNA, 22 bp, Homo sapiens
ttgcaatcaaaaagaagtacag

SEQ ID NO: 10027134 - DNA, 22 bp, Homo sapiens
ttgtgaatagtgccgcaataaa

SEQ ID NO: 10027135 - DNA, 22 bp, Homo sapiens
ttgttacatggacaactgtatg

SEQ ID NO: 10027136 - DNA, 22 bp, Homo sapiens
ttgtgtttctggccaagatgga

SEQ ID NO: 10027137 - DNA, 22 bp, Homo sapiens
ttgtgtttctgtgatatgtaaa

SEQ ID NO: 10027138 - DNA, 22 bp, Homo sapiens
ttgtgaatggtgccgcaataaa

SEQ ID NO: 10027139 - DNA, 22 bp, Homo sapiens
ttgttttaatgagggaggttga

SEQ ID NO: 10027140 - DNA, 22 bp, Homo sapiens
ttgtttcttcatttagaagctt

SEQ ID NO: 10027141 - DNA, 22 bp, Homo sapiens
tttctgtctgacatccctgcct

SEQ ID NO: 10027142 - DNA, 22 bp, Homo sapiens
tttcttatgagcaagactctat

SEQ ID NO: 10027143 - DNA, 22 bp, Homo sapiens
tttcttatggggtagtccttta

SEQ ID NO: 10027144 - DNA, 22 bp, Homo sapiens
tttcttatgtgcagagtgagta

SEQ ID NO: 10027145 - DNA, 22 bp, Homo sapiens
tttcttatggggtagtccttta

SEQ ID NO: 10027146 - DNA, 22 bp, Homo sapiens
tttctttatcatagcatctttg

SEQ ID NO: 10027147 - DNA, 22 bp, Homo sapiens
tttcattgtctacatatgacat

SEQ ID NO: 10027148 - DNA, 22 bp, Homo sapiens
tttcagaggaaatctcattgag

SEQ ID NO: 10027149 - DNA, 22 bp, Homo sapiens
tttcaaagacagccatatttgt

SEQ ID NO: 10027150 - DNA, 22 bp, Homo sapiens
tttctcatctggaaacagtgct

SEQ ID NO: 10027151 - DNA, 23 bp, Homo sapiens
tttctcatccagagagtcagtcc

SEQ ID NO: 10027152 - DNA, 22 bp, Homo sapiens
ttttgcaaagtacattatcagg

SEQ ID NO: 10027153 - DNA, 23 bp, Homo sapiens
ttttgcaataagtcactggaata

SEQ ID NO: 10027154 - DNA, 22 bp, Homo sapiens
tttttcattgcagcctctctcc

SEQ ID NO: 10027155 - DNA, 19 bp, Homo sapiens
ttttccttctcctcttaat

SEQ ID NO: 10027156 - DNA, 20 bp, Homo sapiens
ttttccttgttgccgctgct

SEQ ID NO: 10027157 - DNA, 22 bp, Homo sapiens
ttttttgtcttgaagaaatggt

SEQ ID NO: 10027158 - DNA, 22 bp, Homo sapiens
tttttctaatggcttaggatgt

SEQ ID NO: 10027159 - DNA, 22 bp, Homo sapiens
tttgcaaataccatgaaacttg

SEQ ID NO: 10027160 - DNA, 22 bp, Homo sapiens
tttgcaacagactcatcattga

SEQ ID NO: 10027161 - DNA, 22 bp, Homo sapiens
tttgcaatggtagttgttgctc

SEQ ID NO: 10027162 - DNA, 22 bp, Homo sapiens
tttgttttcaatgtgtcattca

SEQ ID NO: 10027163 - DNA, 22 bp, Homo sapiens
tttgttttgaactagctcagaa

SEQ ID NO: 10027164 - DNA, 22 bp, Homo sapiens
tttgttttcaatgtgtcattca

SEQ ID NO: 10027165 - DNA, 22 bp, Homo sapiens
tttgtcaaagatcagatgcttt

SEQ ID NO: 10027166 - DNA, 22 bp, Homo sapiens
tttgtataaattttgaggtgag

SEQ ID NO: 10027167 - DNA, 22 bp, Homo sapiens
atagggcctaaaaagtattgct

SEQ ID NO: 10027168 - DNA, 22 bp, Homo sapiens
atactttgctagtatcagtgtg

SEQ ID NO: 10027169 - DNA, 22 bp, Homo sapiens
ataatggccgggggctgaatgc

SEQ ID NO: 10027170 - DNA, 22 bp, Homo sapiens
ataatggtgaacaaaatgactc

SEQ ID NO: 10027171 - DNA, 22 bp, Homo sapiens
ataatgtaaggctccctacagt

SEQ ID NO: 10027172 - DNA, 21 bp, Homo sapiens
ataatgtacaaaaactgtctt

SEQ ID NO: 10027173 - DNA, 22 bp, Homo sapiens
ataatgtacaactgcttttaat

SEQ ID NO: 10027174 - DNA, 22 bp, Homo sapiens
ataatgtaggtatgtgtattta

SEQ ID NO: 10027175 - DNA, 22 bp, Homo sapiens
ataatgtaggctcctgggagaa

SEQ ID NO: 10027176 - DNA, 22 bp, Homo sapiens
ataatgtttgattgagcagata

SEQ ID NO: 10027177 - DNA, 22 bp, Homo sapiens
ataatgtttttgtataagcatg

SEQ ID NO: 10027178 - DNA, 22 bp, Homo sapiens
ataatgtgaagataatgcaaga

SEQ ID NO: 10027179 - DNA, 22 bp, Homo sapiens
atacatgactcacacattctgc

SEQ ID NO: 10027180 - DNA, 22 bp, Homo sapiens
agttttgaaatgaaatgtagtt

SEQ ID NO: 10027181 - DNA, 17 bp, Homo sapiens
agttttgatataatggc

SEQ ID NO: 10027182 - DNA, 22 bp, Homo sapiens
ataagtgttaggtaaacatctt

SEQ ID NO: 10027183 - DNA, 22 bp, Homo sapiens
ctgcctgcttaccatgcatcag

SEQ ID NO: 10027184 - DNA, 18 bp, Homo sapiens
agtgttaagtaagtagca

SEQ ID NO: 10027185 - DNA, 22 bp, Homo sapiens
agtgttaagagaaaattctgct

SEQ ID NO: 10027186 - DNA, 20 bp, Homo sapiens
agtttcagggagtcccatct

SEQ ID NO: 10027187 - DNA, 22 bp, Homo sapiens
agtttcttattcttagttatgt

SEQ ID NO: 10027188 - DNA, 22 bp, Homo sapiens
atattttcacagaacttgcaaa

SEQ ID NO: 10027189 - DNA, 22 bp, Homo sapiens
ctgtatttagttaaaatgctaa

SEQ ID NO: 10027190 - DNA, 22 bp, Homo sapiens
atatcaaacgaagttattttaa

SEQ ID NO: 10027191 - DNA, 22 bp, Homo sapiens
atatcaaagctagtggaaattt

SEQ ID NO: 10027192 - DNA, 21 bp, Homo sapiens
atatcacaaacatatggtctg

SEQ ID NO: 10027193 - DNA, 22 bp, Homo sapiens
atatattttgaatagcctctgt

SEQ ID NO: 10027194 - DNA, 22 bp, Homo sapiens
atctcccagccacagcattctt

SEQ ID NO: 10027195 - DNA, 22 bp, Homo sapiens
atctatttctgctaataacaat

SEQ ID NO: 10027196 - DNA, 22 bp, Homo sapiens
atcattagaccaaactagagct

SEQ ID NO: 10027197 - DNA, 22 bp, Homo sapiens
ctgtgtatgactccagagggta

SEQ ID NO: 10027198 - DNA, 19 bp, Homo sapiens
ctgagagatgcttcacaca

SEQ ID NO: 10027199 - DNA, 22 bp, Homo sapiens
ctgagaggaacatcttatgctt

SEQ ID NO: 10027200 - DNA, 22 bp, Homo sapiens
ctcttaaagcttccagtttcaa

SEQ ID NO: 10027201 - DNA, 22 bp, Homo sapiens
ctcttaaataacatcattgctt

SEQ ID NO: 10027202 - DNA, 22 bp, Homo sapiens
ctctgtttttcaatagttcttg

SEQ ID NO: 10027203 - DNA, 22 bp, Homo sapiens
ctcttaaaattacctttgcaaa

SEQ ID NO: 10027204 - DNA, 22 bp, Homo sapiens
agtctctcacagaggattctcc

SEQ ID NO: 10027205 - DNA, 20 bp, Homo sapiens
agtcatctcctctactgctt

SEQ ID NO: 10027206 - DNA, 17 bp, Homo sapiens
agggggaacctgggagg

SEQ ID NO: 10027207 - DNA, 22 bp, Homo sapiens
aggtgtgtataaacatacatat

SEQ ID NO: 10027208 - DNA, 22 bp, Homo sapiens
agtaatgtgcctgaaatacttg

SEQ ID NO: 10027209 - DNA, 22 bp, Homo sapiens
agtaatgtcccttaaatgtggt

SEQ ID NO: 10027210 - DNA, 22 bp, Homo sapiens
agtcagacacgttttccattag

SEQ ID NO: 10027211 - DNA, 22 bp, Homo sapiens
catagagtgatgtaaggtatgt

SEQ ID NO: 10027212 - DNA, 22 bp, Homo sapiens
catagaggctaaaattatttgg

SEQ ID NO: 10027213 - DNA, 22 bp, Homo sapiens
aggagggagcttaagccaggca

SEQ ID NO: 10027214 - DNA, 22 bp, Homo sapiens
aggagggagcactatatgggga

SEQ ID NO: 10027215 - DNA, 22 bp, Homo sapiens
cagtttcaggacatcccattac

SEQ ID NO: 10027216 - DNA, 22 bp, Homo sapiens
cagtggcgtgatctctgctcac

SEQ ID NO: 10027217 - DNA, 22 bp, Homo sapiens
aggacctggatcacagagatct

SEQ ID NO: 10027218 - DNA, 22 bp, Homo sapiens
aggacctgccaggtgcaaagca

SEQ ID NO: 10027219 - DNA, 22 bp, Homo sapiens
aggaccagaccgaactagctaa

SEQ ID NO: 10027220 - DNA, 22 bp, Homo sapiens
aggaccagaggccagagtcagc

SEQ ID NO: 10027221 - DNA, 22 bp, Homo sapiens
aggaccagcctccaggtctctt

SEQ ID NO: 10027222 - DNA, 22 bp, Homo sapiens
aggaccagtgagtctggcaagt

SEQ ID NO: 10027223 - DNA, 22 bp, Homo sapiens
aggaccagtatgagagcatctg

SEQ ID NO: 10027224 - DNA, 23 bp, Homo sapiens
aggaccaggttcccaaaagtcaa

SEQ ID NO: 10027225 - DNA, 22 bp, Homo sapiens
ccaagctacttaggagtctgag

SEQ ID NO: 10027226 - DNA, 22 bp, Homo sapiens
ccaaggagaaatgctgtgcttt

SEQ ID NO: 10027227 - DNA, 22 bp, Homo sapiens
aggagggatagaaaaatacttg

SEQ ID NO: 10027228 - DNA, 22 bp, Homo sapiens
agggccagagtacatcagggct

SEQ ID NO: 10027229 - DNA, 22 bp, Homo sapiens
ccctctctgacttctgaacttg

SEQ ID NO: 10027230 - DNA, 21 bp, Homo sapiens
aggctctgtgaatatgtttcc

SEQ ID NO: 10027231 - DNA, 22 bp, Homo sapiens
ccacaggatccaagggaaggca

SEQ ID NO: 10027232 - DNA, 22 bp, Homo sapiens
ccagctttctgggtggtttctg

SEQ ID NO: 10027233 - DNA, 22 bp, Homo sapiens
ccagcctcatcgcctgcctgtc

SEQ ID NO: 10027234 - DNA, 22 bp, Homo sapiens
gtcacacagggcctccaaatca

SEQ ID NO: 10027235 - DNA, 22 bp, Homo sapiens
gtacacactgtttgatcatttc

SEQ ID NO: 10027236 - DNA, 22 bp, Homo sapiens
gtacacactatgtattgtacac

SEQ ID NO: 10027237 - DNA, 22 bp, Homo sapiens
gtacacactatttaaagtgttt

SEQ ID NO: 10027238 - DNA, 21 bp, Homo sapiens
gtacacacaggtggatgggct

SEQ ID NO: 10027239 - DNA, 22 bp, Homo sapiens
cagaaaataaagtttctacgca

SEQ ID NO: 10027240 - DNA, 22 bp, Homo sapiens
cagaaaatagagtttctctgag

SEQ ID NO: 10027241 - DNA, 22 bp, Homo sapiens
cagaatttaagtggattattct

SEQ ID NO: 10027242 - DNA, 22 bp, Homo sapiens
gggttactgcttcaaaaaatta

SEQ ID NO: 10027243 - DNA, 20 bp, Homo sapiens
cacaactgtccacatgctcc

SEQ ID NO: 10027244 - DNA, 21 bp, Homo sapiens
cacacagtgatctatccacat

SEQ ID NO: 10027245 - DNA, 22 bp, Homo sapiens
cacacagtaggcactcattaat

SEQ ID NO: 10027246 - DNA, 22 bp, Homo sapiens
cacacaggagagtgctggaggt

SEQ ID NO: 10027247 - DNA, 22 bp, Homo sapiens
cacacaggatgaagcagcagaa

SEQ ID NO: 10027248 - DNA, 22 bp, Homo sapiens
caatactgagtttacattcatc

SEQ ID NO: 10027249 - DNA, 22 bp, Homo sapiens
caatagaaaactcaatacttaa

SEQ ID NO: 10027250 - DNA, 22 bp, Homo sapiens
caatcacaaagagacaagtgtc

SEQ ID NO: 10027251 - DNA, 22 bp, Homo sapiens
caatcagatatgtgacatattt

SEQ ID NO: 10027252 - DNA, 22 bp, Homo sapiens
caatcactgggatattggtgtg

SEQ ID NO: 10027253 - DNA, 22 bp, Homo sapiens
caatcactccacaatatggttc

SEQ ID NO: 10027254 - DNA, 22 bp, Homo sapiens
cacattcctggtgctcagcagc

SEQ ID NO: 10027255 - DNA, 22 bp, Homo sapiens
cactatttatacttcctgatcc

SEQ ID NO: 10027256 - DNA, 22 bp, Homo sapiens
cactgggagtacaaagaatggg

SEQ ID NO: 10027257 - DNA, 22 bp, Homo sapiens
gatggcaggtagtggtctcatc

SEQ ID NO: 10027258 - DNA, 22 bp, Homo sapiens
gcaccatgatggagcctcatta

SEQ ID NO: 10027259 - DNA, 22 bp, Homo sapiens
attatgtagctaaaaattgtgt

SEQ ID NO: 10027260 - DNA, 22 bp, Homo sapiens
attatgtatttggtatagtttg

SEQ ID NO: 10027261 - DNA, 22 bp, Homo sapiens
gcacacagctagattaccattc

SEQ ID NO: 10027262 - DNA, 22 bp, Homo sapiens
attgcaaaggtcccattcaaga

SEQ ID NO: 10027263 - DNA, 22 bp, Homo sapiens
attgcaaataactgtactgaat

SEQ ID NO: 10027264 - DNA, 22 bp, Homo sapiens
attccacagctacatcaatcta

SEQ ID NO: 10027265 - DNA, 22 bp, Homo sapiens
attccacacagtaatactcaat

SEQ ID NO: 10027266 - DNA, 22 bp, Homo sapiens
attcacaaaatgatatagatac

SEQ ID NO: 10027267 - DNA, 22 bp, Homo sapiens
atttggtgcctgggaaatctct

SEQ ID NO: 10027268 - DNA, 22 bp, Homo sapiens
atttgtaatttcttatctgtgt

SEQ ID NO: 10027269 - DNA, 22 bp, Homo sapiens
atttgtaacacgtgacaggttg

SEQ ID NO: 10027270 - DNA, 22 bp, Homo sapiens
atttgtaagctagagccatgat

SEQ ID NO: 10027271 - DNA, 22 bp, Homo sapiens
attttctaagcctgtcagactt

SEQ ID NO: 10027272 - DNA, 22 bp, Homo sapiens
attttcatggcttctgctcagt

SEQ ID NO: 10027273 - DNA, 22 bp, Homo sapiens
atttattacctcggagtttctg

SEQ ID NO: 10027274 - DNA, 22 bp, Homo sapiens
atttattatgggatttggcaca

SEQ ID NO: 10027275 - DNA, 22 bp, Homo sapiens
atttattaagcatctgctatgt

SEQ ID NO: 10027276 - DNA, 22 bp, Homo sapiens
atttccgagggtttgccaaggg

SEQ ID NO: 10027277 - DNA, 22 bp, Homo sapiens
atgtcagatgtttatctgattt

SEQ ID NO: 10027278 - DNA, 22 bp, Homo sapiens
atgtatttctatgtagtgaaga

SEQ ID NO: 10027279 - DNA, 22 bp, Homo sapiens
atgtatttactgagaaggaaac

SEQ ID NO: 10027280 - DNA, 22 bp, Homo sapiens
atgtatgtagtgtacatataca

SEQ ID NO: 10027281 - DNA, 22 bp, Homo sapiens
atgtatgtctgcatacacatac

SEQ ID NO: 10027282 - DNA, 22 bp, Homo sapiens
gaggaggggacagtacttgtgc

SEQ ID NO: 10027283 - DNA, 22 bp, Homo sapiens
gaggaggggcacttgtctccta

SEQ ID NO: 10027284 - DNA, 23 bp, Homo sapiens
gaggagggtcgtgctgtgttcct

SEQ ID NO: 10027285 - DNA, 22 bp, Homo sapiens
gaggagggcctggtgtcccttc

SEQ ID NO: 10027286 - DNA, 22 bp, Homo sapiens
gaggagggctttgttgatgtta

SEQ ID NO: 10027287 - DNA, 22 bp, Homo sapiens
gaggagggcagttcctctttta

SEQ ID NO: 10027288 - DNA, 22 bp, Homo sapiens
atggcagacgaggcagcagggg

SEQ ID NO: 10027289 - DNA, 22 bp, Homo sapiens
atggcagacctcctggccacaa

SEQ ID NO: 10027290 - DNA, 18 bp, Homo sapiens
atggcacagtctttccct

SEQ ID NO: 10027291 - DNA, 22 bp, Homo sapiens
atggatgagtccttgagacaca

SEQ ID NO: 10027292 - DNA, 22 bp, Homo sapiens
gagaatcatttacagaatgatt

SEQ ID NO: 10027293 - DNA, 22 bp, Homo sapiens
gagaatcatggcaacagaatga

SEQ ID NO: 10027294 - DNA, 22 bp, Homo sapiens
atgccactgcactccagcctag

SEQ ID NO: 10027295 - DNA, 22 bp, Homo sapiens
atgccactgcactccagcctgg

SEQ ID NO: 10027296 - DNA, 22 bp, Homo sapiens
atgccactgcacttcagcctgg

SEQ ID NO: 10027297 - DNA, 22 bp, Homo sapiens
gaaggaggctccccaaagtctg

SEQ ID NO: 10027298 - DNA, 22 bp, Homo sapiens
gaaggaggcgttagccctagga

SEQ ID NO: 10027299 - DNA, 22 bp, Homo sapiens
gaaggagggtgcggatctgagc

SEQ ID NO: 10027300 - DNA, 22 bp, Homo sapiens
gaaggaggtctgatacaatatg

SEQ ID NO: 10027301 - DNA, 22 bp, Homo sapiens
gaaggagggagcggcgcggatt

SEQ ID NO: 10027302 - DNA, 22 bp, Homo sapiens
gaaggaggtctgcattctacag

SEQ ID NO: 10027303 - DNA, 22 bp, Homo sapiens
gaaggaggtgtcagttggactg

SEQ ID NO: 10027304 - DNA, 22 bp, Homo sapiens
atgatgtaagggtaattgtcta

SEQ ID NO: 10027305 - DNA, 22 bp, Homo sapiens
atgatgtaatggaaagaacaga

SEQ ID NO: 10027306 - DNA, 22 bp, Homo sapiens
atgatgtaacataaagatgtct

SEQ ID NO: 10027307 - DNA, 22 bp, Homo sapiens
atgatgtagacaaaaatatgct

SEQ ID NO: 10027308 - DNA, 22 bp, Homo sapiens
atgatgtaccactttctcagtt

SEQ ID NO: 10027309 - DNA, 22 bp, Homo sapiens
atgatgtactagttaaatatta

SEQ ID NO: 10027310 - DNA, 22 bp, Homo sapiens
atgagctgtaaggtggcttcct

SEQ ID NO: 10027311 - DNA, 22 bp, Homo sapiens
atgacagaccctctaaagacaa

SEQ ID NO: 10027312 - DNA, 22 bp, Homo sapiens
atgacagaggattgtaaagagg

SEQ ID NO: 10027313 - DNA, 22 bp, Homo sapiens
atgagatgtgtctaatggaacc

SEQ ID NO: 10027314 - DNA, 22 bp, Homo sapiens
ctttctttcgaagacgtgatta

SEQ ID NO: 10027315 - DNA, 22 bp, Homo sapiens
aatgtcatttaaaataattctg

SEQ ID NO: 10027316 - DNA, 22 bp, Homo sapiens
aatgtgttcagttaaatgaact

SEQ ID NO: 10027317 - DNA, 22 bp, Homo sapiens
aatgtcattgagctccaatcct

SEQ ID NO: 10027318 - DNA, 22 bp, Homo sapiens
aatgttcattgattaaatgaat

SEQ ID NO: 10027319 - DNA, 22 bp, Homo sapiens
aatgttgcagagtgattgtcca

SEQ ID NO: 10027320 - DNA, 22 bp, Homo sapiens
aatgttcaaacagatcacttag

SEQ ID NO: 10027321 - DNA, 22 bp, Homo sapiens
aatgttcaaaagcatcagtgaa

SEQ ID NO: 10027322 - DNA, 22 bp, Homo sapiens
aatgttatttctgcatagtagt

SEQ ID NO: 10027323 - DNA, 22 bp, Homo sapiens
aatgttattgtcctttccaaaa

SEQ ID NO: 10027324 - DNA, 22 bp, Homo sapiens
aatgttcagaggacaatataaa

SEQ ID NO: 10027325 - DNA, 22 bp, Homo sapiens
aatgttcaacagatggatattt

SEQ ID NO: 10027326 - DNA, 22 bp, Homo sapiens
agcaagattgaggcttcctcag

SEQ ID NO: 10027327 - DNA, 22 bp, Homo sapiens
agcaagcacacttcatgtgaac

SEQ ID NO: 10027328 - DNA, 21 bp, Homo sapiens
agcaagcagaatccatctaga

SEQ ID NO: 10027329 - DNA, 22 bp, Homo sapiens
agcaagcagtgaagttgaatgt

SEQ ID NO: 10027330 - DNA, 22 bp, Homo sapiens
acaaatgtctacattgagaata

SEQ ID NO: 10027331 - DNA, 22 bp, Homo sapiens
acaaatgactatttggtacagg

SEQ ID NO: 10027332 - DNA, 22 bp, Homo sapiens
acaaatgactcaaacaccactt

SEQ ID NO: 10027333 - DNA, 19 bp, Homo sapiens
acaaatgatgttgcactga

SEQ ID NO: 10027334 - DNA, 22 bp, Homo sapiens
acaattctgatggtttcccagt

SEQ ID NO: 10027335 - DNA, 20 bp, Homo sapiens
acaatttcctcactatatgc

SEQ ID NO: 10027336 - DNA, 19 bp, Homo sapiens
acacatttgcacaatccac

SEQ ID NO: 10027337 - DNA, 22 bp, Homo sapiens
acacatttgcataatacctcat

SEQ ID NO: 10027338 - DNA, 22 bp, Homo sapiens
acacattttcaacactgtcaag

SEQ ID NO: 10027339 - DNA, 22 bp, Homo sapiens
acacattttctaacagggatca

SEQ ID NO: 10027340 - DNA, 23 bp, Homo sapiens
acactgtctcatggatagactgc

SEQ ID NO: 10027341 - DNA, 19 bp, Homo sapiens
acagaaattagttattttc

SEQ ID NO: 10027342 - DNA, 22 bp, Homo sapiens
acagaaattagcagtgagttta

SEQ ID NO: 10027343 - DNA, 22 bp, Homo sapiens
acagattcactgcactggccat

SEQ ID NO: 10027344 - DNA, 22 bp, Homo sapiens
agccattgttgtcttcatcttc

SEQ ID NO: 10027345 - DNA, 22 bp, Homo sapiens
aagtcaatttatgttctcagac

SEQ ID NO: 10027346 - DNA, 22 bp, Homo sapiens
aagtcaatcacatgcacactga

SEQ ID NO: 10027347 - DNA, 22 bp, Homo sapiens
aagtatgaatcaaagactatct

SEQ ID NO: 10027348 - DNA, 22 bp, Homo sapiens
accatgatgccactatgcagaa

SEQ ID NO: 10027349 - DNA, 22 bp, Homo sapiens
aaggctttgattccattgccct

SEQ ID NO: 10027350 - DNA, 22 bp, Homo sapiens
acatgtgtacatatatatgtgc

SEQ ID NO: 10027351 - DNA, 22 bp, Homo sapiens
aaggcaggatgggaaaagattt

SEQ ID NO: 10027352 - DNA, 22 bp, Homo sapiens
acagttcccgtcttgcacagct

SEQ ID NO: 10027353 - DNA, 22 bp, Homo sapiens
acagggcttagaaatctgttgc

SEQ ID NO: 10027354 - DNA, 22 bp, Homo sapiens
aataatgtttatttgtattctc

SEQ ID NO: 10027355 - DNA, 19 bp, Homo sapiens
aataatgttcatgagattg

SEQ ID NO: 10027356 - DNA, 22 bp, Homo sapiens
aataatgtgatagataagggaa

SEQ ID NO: 10027357 - DNA, 22 bp, Homo sapiens
aataatgtgtgctgcagtctta

SEQ ID NO: 10027358 - DNA, 22 bp, Homo sapiens
aataatgttatgtcattcttct

SEQ ID NO: 10027359 - DNA, 22 bp, Homo sapiens
aataatgttgacgatagtctta

SEQ ID NO: 10027360 - DNA, 22 bp, Homo sapiens
actgcctgtgtcccttcagtgc

SEQ ID NO: 10027361 - DNA, 22 bp, Homo sapiens
aataacttcagttcttacatta

SEQ ID NO: 10027362 - DNA, 22 bp, Homo sapiens
acttgttttatctgtcaataga

SEQ ID NO: 10027363 - DNA, 22 bp, Homo sapiens
acttgtttacaagcagttctga

SEQ ID NO: 10027364 - DNA, 22 bp, Homo sapiens
aatcaaaacctacagaggtaat

SEQ ID NO: 10027365 - DNA, 22 bp, Homo sapiens
aatgaacacgctggtggtgcaa

SEQ ID NO: 10027366 - DNA, 22 bp, Homo sapiens
aatgaacacatgtggtcagttt

SEQ ID NO: 10027367 - DNA, 22 bp, Homo sapiens
aatgaacagatacacataggca

SEQ ID NO: 10027368 - DNA, 22 bp, Homo sapiens
aatgaacaggtgaatgtcagat

SEQ ID NO: 10027369 - DNA, 22 bp, Homo sapiens
aatgaacagtgggtgaggtacc

SEQ ID NO: 10027370 - DNA, 22 bp, Homo sapiens
aatgaacatcaaatgcctacca

SEQ ID NO: 10027371 - DNA, 22 bp, Homo sapiens
aatgaacatggacaagttaata

SEQ ID NO: 10027372 - DNA, 22 bp, Homo sapiens
aatgaacatgggagtactaata

SEQ ID NO: 10027373 - DNA, 22 bp, Homo sapiens
aatgaacatgggagtactaata

SEQ ID NO: 10027374 - DNA, 22 bp, Homo sapiens
agaaatactaggaatattcata

SEQ ID NO: 10027375 - DNA, 22 bp, Homo sapiens
agaagggaactcagagatgatt

SEQ ID NO: 10027376 - DNA, 22 bp, Homo sapiens
aaagtagaacattttcttatct

SEQ ID NO: 10027377 - DNA, 22 bp, Homo sapiens
aaagtatgttgtggcttttaaa

SEQ ID NO: 10027378 - DNA, 22 bp, Homo sapiens
aaatcccagatagtaatgtatt

SEQ ID NO: 10027379 - DNA, 22 bp, Homo sapiens
aaatgtagttgaaaagttaagg

SEQ ID NO: 10027380 - DNA, 22 bp, Homo sapiens
aaatcagagtggttggtcatcc

SEQ ID NO: 10027381 - DNA, 23 bp, Homo sapiens
aaataggagtatctggatcatga

SEQ ID NO: 10027382 - DNA, 22 bp, Homo sapiens
aaattacagatcaccaatgcat

SEQ ID NO: 10027383 - DNA, 22 bp, Homo sapiens
aaattactttacactttcatct

SEQ ID NO: 10027384 - DNA, 22 bp, Homo sapiens
aaactgaggcccagagaggcag

SEQ ID NO: 10027385 - DNA, 21 bp, Homo sapiens
aaactgaccttgcctgagaca

SEQ ID NO: 10027386 - DNA, 22 bp, Homo sapiens
aaagaatagcctttgtccaaat

SEQ ID NO: 10027387 - DNA, 22 bp, Homo sapiens
aaacaatgaaattcattcttca

SEQ ID NO: 10027388 - DNA, 22 bp, Homo sapiens
aaactcaagtctatgaacaagg

SEQ ID NO: 10027389 - DNA, 22 bp, Homo sapiens
aaaatagttaacgttcagagta

SEQ ID NO: 10027390 - DNA, 22 bp, Homo sapiens
aaacacttcaaggacttctgtc

SEQ ID NO: 10027391 - DNA, 22 bp, Homo sapiens
aacaaatgtaaaatgcagatgc

SEQ ID NO: 10027392 - DNA, 22 bp, Homo sapiens
aacactagtctagaccagacca

SEQ ID NO: 10027393 - DNA, 22 bp, Homo sapiens
aacaaatggaacacaaatcttt

SEQ ID NO: 10027394 - DNA, 22 bp, Homo sapiens
aacaaatggaacacaaatcttt

SEQ ID NO: 10027395 - DNA, 22 bp, Homo sapiens
aaattctctaaagaaaacatga

SEQ ID NO: 10027396 - DNA, 22 bp, Homo sapiens
aaattctcaagtgatcctgttg

SEQ ID NO: 10027397 - DNA, 22 bp, Homo sapiens
aaattcctctgatcataagaat

SEQ ID NO: 10027398 - DNA, 22 bp, Homo sapiens
aaatgtgttcctttgctacaga

SEQ ID NO: 10027399 - DNA, 20 bp, Homo sapiens
aatataattctctgaattta

SEQ ID NO: 10027400 - DNA, 22 bp, Homo sapiens
aatataatgctgttttatgcca

SEQ ID NO: 10027401 - DNA, 22 bp, Homo sapiens
aactactaccacagtcaagaca

SEQ ID NO: 10027402 - DNA, 22 bp, Homo sapiens
aatcataattttgtgaatgtag

SEQ ID NO: 10027403 - DNA, 23 bp, Homo sapiens
aacttaatactgggataagatgc

SEQ ID NO: 10027404 - DNA, 22 bp, Homo sapiens
acaaggagaagaaattggtcat

SEQ ID NO: 10027405 - DNA, 22 bp, Homo sapiens
acaaggagagcacacatgggga

SEQ ID NO: 10027406 - DNA, 22 bp, Homo sapiens
acaaggaggatatgtttaaggg

SEQ ID NO: 10027407 - DNA, 22 bp, Homo sapiens
acaaggaggtctggggggccct

SEQ ID NO: 10027408 - DNA, 22 bp, Homo sapiens
aacttcaaatgtgactttgcat

SEQ ID NO: 10027409 - DNA, 22 bp, Homo sapiens
aagacagcactggcattttcaa

SEQ ID NO: 10027410 - DNA, 22 bp, Homo sapiens
aagatttcctggatgtaattcc

SEQ ID NO: 10027411 - DNA, 17 bp, Homo sapiens
aagatttcattagctga

SEQ ID NO: 10027412 - DNA, 22 bp, Homo sapiens
atttcacatctatctcagattt

SEQ ID NO: 10027413 - DNA, 22 bp, Homo sapiens
atttcacagcgtggttgactgc

SEQ ID NO: 10027414 - DNA, 22 bp, Homo sapiens
atttcacaaaccatcctgattt

SEQ ID NO: 10027415 - DNA, 22 bp, Homo sapiens
atttccagactttttccaggaa

SEQ ID NO: 10027416 - DNA, 22 bp, Homo sapiens
atttcctatggatacaggcaga

SEQ ID NO: 10027417 - DNA, 22 bp, Homo sapiens
caaaagtaattgtggttttcac

SEQ ID NO: 10027418 - DNA, 22 bp, Homo sapiens
caaaagtaattgcagtttttgc

SEQ ID NO: 10027419 - DNA, 23 bp, Homo sapiens
attattaaggacatggactttgt

SEQ ID NO: 10027420 - DNA, 22 bp, Homo sapiens
attataggcttgagccaccgtg

SEQ ID NO: 10027421 - DNA, 22 bp, Homo sapiens
atgtttatgttgggctatattt

SEQ ID NO: 10027422 - DNA, 22 bp, Homo sapiens
agagggaagatggtccaatctt

SEQ ID NO: 10027423 - DNA, 22 bp, Homo sapiens
agagggaacggatcccagcgcg

SEQ ID NO: 10027424 - DNA, 22 bp, Homo sapiens
agagggaaggacagatgtttca

SEQ ID NO: 10027425 - DNA, 18 bp, Homo sapiens
agagggaatcagttggat

SEQ ID NO: 10027426 - DNA, 22 bp, Homo sapiens
agagggaaatccaggagtgctt

SEQ ID NO: 10027427 - DNA, 18 bp, Homo sapiens
agagggaaagcaggctga

SEQ ID NO: 10027428 - DNA, 22 bp, Homo sapiens
agagggaaaaactcatgtcatt

SEQ ID NO: 10027429 - DNA, 17 bp, Homo sapiens
agagggaaaatgcggtt

SEQ ID NO: 10027430 - DNA, 22 bp, Homo sapiens
agagggaatgtgattgcaccat

SEQ ID NO: 10027431 - DNA, 22 bp, Homo sapiens
atggctagcaccgcgttgctgg

SEQ ID NO: 10027432 - DNA, 22 bp, Homo sapiens
atggccgcctgtccttcccgcc

SEQ ID NO: 10027433 - DNA, 22 bp, Homo sapiens
agagaagagcaatgataaattt

SEQ ID NO: 10027434 - DNA, 22 bp, Homo sapiens
atgtcaaatcagttttatcaga

SEQ ID NO: 10027435 - DNA, 22 bp, Homo sapiens
atgtgtaaaaagtgcttaatat

SEQ ID NO: 10027436 - DNA, 22 bp, Homo sapiens
atgtgtaaggcttctcctctct

SEQ ID NO: 10027437 - DNA, 22 bp, Homo sapiens
atgaaattgatcttgaactttt

SEQ ID NO: 10027438 - DNA, 22 bp, Homo sapiens
atgaaattgatcttgaactttt

SEQ ID NO: 10027439 - DNA, 22 bp, Homo sapiens
atgaacaacttgaagctccatg

SEQ ID NO: 10027440 - DNA, 22 bp, Homo sapiens
atgaaatttgctgctaagttcc

SEQ ID NO: 10027441 - DNA, 22 bp, Homo sapiens
agacaaattgggacattgtgtt

SEQ ID NO: 10027442 - DNA, 22 bp, Homo sapiens
agacaaatggagtatgagcaac

SEQ ID NO: 10027443 - DNA, 22 bp, Homo sapiens
atgcaactacccccaggatttt

SEQ ID NO: 10027444 - DNA, 22 bp, Homo sapiens
cagagggagtttctgaggttgc

SEQ ID NO: 10027445 - DNA, 22 bp, Homo sapiens
agcatagattctttcctttgcc

SEQ ID NO: 10027446 - DNA, 22 bp, Homo sapiens
agcatagatacattgagccaca

SEQ ID NO: 10027447 - DNA, 22 bp, Homo sapiens
caaatagtatgagcaatgattc

SEQ ID NO: 10027448 - DNA, 22 bp, Homo sapiens
cacctgagcaaccctgtgcggg

SEQ ID NO: 10027449 - DNA, 22 bp, Homo sapiens
cacctagcagaacagaggtgct

SEQ ID NO: 10027450 - DNA, 22 bp, Homo sapiens
cacacactggagcaaggagatg

SEQ ID NO: 10027451 - DNA, 22 bp, Homo sapiens
cacacactgttaatgtaggagt

SEQ ID NO: 10027452 - DNA, 22 bp, Homo sapiens
cacacactgacaccttatcttg

SEQ ID NO: 10027453 - DNA, 22 bp, Homo sapiens
cacacactcttcctggcaccta

SEQ ID NO: 10027454 - DNA, 22 bp, Homo sapiens
cacacacagttttgtattctgt

SEQ ID NO: 10027455 - DNA, 22 bp, Homo sapiens
cacaattttaatacacagtcaa

SEQ ID NO: 10027456 - DNA, 22 bp, Homo sapiens
cacagttagctccagtcttagc

SEQ ID NO: 10027457 - DNA, 22 bp, Homo sapiens
actttctaggtgctattgtgat

SEQ ID NO: 10027458 - DNA, 22 bp, Homo sapiens
actttctatggcttattatgag

SEQ ID NO: 10027459 - DNA, 22 bp, Homo sapiens
actttctattgtttagattctg

SEQ ID NO: 10027460 - DNA, 22 bp, Homo sapiens
actttcatttgtgaagactgta

SEQ ID NO: 10027461 - DNA, 22 bp, Homo sapiens
actttcatttgtaataaacttc

SEQ ID NO: 10027462 - DNA, 22 bp, Homo sapiens
actttcatgttggtgaagggtt

SEQ ID NO: 10027463 - DNA, 22 bp, Homo sapiens
atatgcttatgatgtctcaagt

SEQ ID NO: 10027464 - DNA, 22 bp, Homo sapiens
atatttcacgtaggttgttttc

SEQ ID NO: 10027465 - DNA, 22 bp, Homo sapiens
atcatccagtttttcagcctct

SEQ ID NO: 10027466 - DNA, 22 bp, Homo sapiens
atcatccactctgggtcaagtg

SEQ ID NO: 10027467 - DNA, 22 bp, Homo sapiens
atcatccactggagccggcagg

SEQ ID NO: 10027468 - DNA, 22 bp, Homo sapiens
atcgccaatggggaggaaagaa

SEQ ID NO: 10027469 - DNA, 22 bp, Homo sapiens
atactgtagaggcatagctagt

SEQ ID NO: 10027470 - DNA, 22 bp, Homo sapiens
atactgtaatacctaaatgaac

SEQ ID NO: 10027471 - DNA, 22 bp, Homo sapiens
atacatgttgtaccatatgttt

SEQ ID NO: 10027472 - DNA, 22 bp, Homo sapiens
atacatgttgagaaaatatctg

SEQ ID NO: 10027473 - DNA, 22 bp, Homo sapiens
atacatgttcgtgtacatgttc

SEQ ID NO: 10027474 - DNA, 22 bp, Homo sapiens
ataatgctgggagaaattgtta

SEQ ID NO: 10027475 - DNA, 22 bp, Homo sapiens
ataatgcatttagaataattca

SEQ ID NO: 10027476 - DNA, 22 bp, Homo sapiens
actgtgcattccccaacctgtg

SEQ ID NO: 10027477 - DNA, 22 bp, Homo sapiens
actgtatttttgaatcattgtg

SEQ ID NO: 10027478 - DNA, 22 bp, Homo sapiens
actgtattggttttctattgct

SEQ ID NO: 10027479 - DNA, 22 bp, Homo sapiens
agtaaaattaatggatcagaag

SEQ ID NO: 10027480 - DNA, 23 bp, Homo sapiens
actgctttattcatgaggctctc

SEQ ID NO: 10027481 - DNA, 22 bp, Homo sapiens
actctgtgccaggcactttggg

SEQ ID NO: 10027482 - DNA, 22 bp, Homo sapiens
actctgtcacctactcactgta

SEQ ID NO: 10027483 - DNA, 22 bp, Homo sapiens
agtgcataatgaaggagcttga

SEQ ID NO: 10027484 - DNA, 22 bp, Homo sapiens
agtgcataaaggaaaaactgaa

SEQ ID NO: 10027485 - DNA, 22 bp, Homo sapiens
agtgcatagctgcgaagcattt

SEQ ID NO: 10027486 - DNA, 22 bp, Homo sapiens
agtgcatagggggatgcacagc

SEQ ID NO: 10027487 - DNA, 22 bp, Homo sapiens
actgagctcttgactgggagtt

SEQ ID NO: 10027488 - DNA, 20 bp, Homo sapiens
actgagctgcatggagagga

SEQ ID NO: 10027489 - DNA, 22 bp, Homo sapiens
agtctttaacatttggagattg

SEQ ID NO: 10027490 - DNA, 22 bp, Homo sapiens
aggacacacagaatacaaatcc

SEQ ID NO: 10027491 - DNA, 22 bp, Homo sapiens
aggacacacaaagagtgagaac

SEQ ID NO: 10027492 - DNA, 22 bp, Homo sapiens
acaggaggggcatgaaagacgg

SEQ ID NO: 10027493 - DNA, 22 bp, Homo sapiens
aggatgaggctggacacttctt

SEQ ID NO: 10027494 - DNA, 22 bp, Homo sapiens
aggacacaggcaggaggagatc

SEQ ID NO: 10027495 - DNA, 22 bp, Homo sapiens
acccagcctacaaagctcacct

SEQ ID NO: 10027496 - DNA, 22 bp, Homo sapiens
acccagccatgttcagttctct

SEQ ID NO: 10027497 - DNA, 22 bp, Homo sapiens
accagccaccaccaggagatcg

SEQ ID NO: 10027498 - DNA, 22 bp, Homo sapiens
accagccagccacagtggctcc

SEQ ID NO: 10027499 - DNA, 22 bp, Homo sapiens
acatttgtatatatgcagcata

SEQ ID NO: 10027500 - DNA, 22 bp, Homo sapiens
aggcctcttgtcttcctcacat

SEQ ID NO: 10027501 - DNA, 22 bp, Homo sapiens
aggcctctgggtctcctctgac

SEQ ID NO: 10027502 - DNA, 22 bp, Homo sapiens
acatcacagtagttaagccaga

SEQ ID NO: 10027503 - DNA, 22 bp, Homo sapiens
acatcacagagcccagataaag

SEQ ID NO: 10027504 - DNA, 22 bp, Homo sapiens
acatcacacgccttccaggagg

SEQ ID NO: 10027505 - DNA, 22 bp, Homo sapiens
aggccaggcaacattctgaagt

SEQ ID NO: 10027506 - DNA, 22 bp, Homo sapiens
acatttcactgttcacagcagg

SEQ ID NO: 10027507 - DNA, 22 bp, Homo sapiens
tcccagcctggaccctgccagt

SEQ ID NO: 10027508 - DNA, 22 bp, Homo sapiens
tcccagcctgacagtgcatcaa

SEQ ID NO: 10027509 - DNA, 22 bp, Homo sapiens
tcctcagcaaacacttcactct

SEQ ID NO: 10027510 - DNA, 22 bp, Homo sapiens
tcctgaaattctggttgtcact

SEQ ID NO: 10027511 - DNA, 22 bp, Homo sapiens
tcctgaaatttgttttaattct

SEQ ID NO: 10027512 - DNA, 22 bp, Homo sapiens
tcacatactgaaagtccagtga

SEQ ID NO: 10027513 - DNA, 22 bp, Homo sapiens
tcacatgctactgagccagacc

SEQ ID NO: 10027514 - DNA, 22 bp, Homo sapiens
tcacatgctcacctaagccaca

SEQ ID NO: 10027515 - DNA, 22 bp, Homo sapiens
tcacatacactaggatattttt

SEQ ID NO: 10027516 - DNA, 23 bp, Homo sapiens
tcacataatccttcatccacagg

SEQ ID NO: 10027517 - DNA, 22 bp, Homo sapiens
tcacataaatttaccagatgat

SEQ ID NO: 10027518 - DNA, 22 bp, Homo sapiens
tcacataaattatacaatttca

SEQ ID NO: 10027519 - DNA, 22 bp, Homo sapiens
tcaacatataggcaacctgtaa

SEQ ID NO: 10027520 - DNA, 22 bp, Homo sapiens
tcaacagacatttttaagcact

SEQ ID NO: 10027521 - DNA, 22 bp, Homo sapiens
tcaaatgagtgactcacacagg

SEQ ID NO: 10027522 - DNA, 22 bp, Homo sapiens
tcaaatgaggctgatgaatgtg

SEQ ID NO: 10027523 - DNA, 22 bp, Homo sapiens
tcaactgatttagtctgtgcca

SEQ ID NO: 10027524 - DNA, 22 bp, Homo sapiens
tcactgcgctgactgctacgat

SEQ ID NO: 10027525 - DNA, 22 bp, Homo sapiens
tcactgcgcttcagcctgggtg

SEQ ID NO: 10027526 - DNA, 22 bp, Homo sapiens
tcagaagttgagatattcaggg

SEQ ID NO: 10027527 - DNA, 22 bp, Homo sapiens
tccaaggaagtcatttaaactg

SEQ ID NO: 10027528 - DNA, 22 bp, Homo sapiens
tccaaggaagtttgcactattg

SEQ ID NO: 10027529 - DNA, 22 bp, Homo sapiens
tccaaggacattgttctagttg

SEQ ID NO: 10027530 - DNA, 22 bp, Homo sapiens
tccaaggacgctggacccctgc

SEQ ID NO: 10027531 - DNA, 22 bp, Homo sapiens
tccaaggactaaattctagatt

SEQ ID NO: 10027532 - DNA, 22 bp, Homo sapiens
tccaaggactcttgtcagctgt

SEQ ID NO: 10027533 - DNA, 22 bp, Homo sapiens
tccaaggagcagtcttcaacct

SEQ ID NO: 10027534 - DNA, 22 bp, Homo sapiens
tccaaggaggagctggagattg

SEQ ID NO: 10027535 - DNA, 22 bp, Homo sapiens
tccaaggaggagctggagattg

SEQ ID NO: 10027536 - DNA, 22 bp, Homo sapiens
tccaaggactcttgtcagctgt

SEQ ID NO: 10027537 - DNA, 22 bp, Homo sapiens
tccaaggagcagatccagagga

SEQ ID NO: 10027538 - DNA, 22 bp, Homo sapiens
tccaaggagcagatccagagga

SEQ ID NO: 10027539 - DNA, 22 bp, Homo sapiens
tccaaggaggctttgacgtcca

SEQ ID NO: 10027540 - DNA, 22 bp, Homo sapiens
tccaaggagtcttaagttacat

SEQ ID NO: 10027541 - DNA, 22 bp, Homo sapiens
tccaatcatgagtctatactag

SEQ ID NO: 10027542 - DNA, 22 bp, Homo sapiens
tccaatgttcctgctttcagct

SEQ ID NO: 10027543 - DNA, 22 bp, Homo sapiens
tcattgttactgtttagttgcc

SEQ ID NO: 10027544 - DNA, 22 bp, Homo sapiens
tcagtcgtgtagaagttgatcc

SEQ ID NO: 10027545 - DNA, 22 bp, Homo sapiens
tcagtctcagcacctagtcaca

SEQ ID NO: 10027546 - DNA, 22 bp, Homo sapiens
tcagttaacaactatttattga

SEQ ID NO: 10027547 - DNA, 22 bp, Homo sapiens
tatgtaaagtagatggcaggta

SEQ ID NO: 10027548 - DNA, 22 bp, Homo sapiens
tatgctttacttttcattgtga

SEQ ID NO: 10027549 - DNA, 20 bp, Homo sapiens
tatgctttttataagattga

SEQ ID NO: 10027550 - DNA, 17 bp, Homo sapiens
tatgcttttcttctcca

SEQ ID NO: 10027551 - DNA, 22 bp, Homo sapiens
tatgaaatttaaacacagatca

SEQ ID NO: 10027552 - DNA, 20 bp, Homo sapiens
tatgaagatatgtgaacagc

SEQ ID NO: 10027553 - DNA, 22 bp, Homo sapiens
tcaaatgaagacagttgacttg

SEQ ID NO: 10027554 - DNA, 22 bp, Homo sapiens
tcaaagtaggggtaagccaggc

SEQ ID NO: 10027555 - DNA, 22 bp, Homo sapiens
tcaaagtaccagagtgaactga

SEQ ID NO: 10027556 - DNA, 22 bp, Homo sapiens
tcaaagtaaaagtatagagttt

SEQ ID NO: 10027557 - DNA, 22 bp, Homo sapiens
tcaaagaagtgcaaacctcatc

SEQ ID NO: 10027558 - DNA, 22 bp, Homo sapiens
tattttgttaataatccagtcc

SEQ ID NO: 10027559 - DNA, 22 bp, Homo sapiens
tattttgttttgtatccactgt

SEQ ID NO: 10027560 - DNA, 22 bp, Homo sapiens
tattttgtatttatgcaagaaa

SEQ ID NO: 10027561 - DNA, 22 bp, Homo sapiens
tattttctggacagtcttgctt

SEQ ID NO: 10027562 - DNA, 22 bp, Homo sapiens
tagatacaggctctctgagcct

SEQ ID NO: 10027563 - DNA, 22 bp, Homo sapiens
tagagaggccgcgggtcccctc

SEQ ID NO: 10027564 - DNA, 21 bp, Homo sapiens
tagagaaaagaagctgttcct

SEQ ID NO: 10027565 - DNA, 22 bp, Homo sapiens
tagagaaaagcagggatcagga

SEQ ID NO: 10027566 - DNA, 23 bp, Homo sapiens
tagctgtggcgtaaggctcagct

SEQ ID NO: 10027567 - DNA, 22 bp, Homo sapiens
tagttagcactcggtctgctct

SEQ ID NO: 10027568 - DNA, 22 bp, Homo sapiens
gtgtttctggggcattcatagt

SEQ ID NO: 10027569 - DNA, 22 bp, Homo sapiens
gttgaaatcctaaccccctagt

SEQ ID NO: 10027570 - DNA, 22 bp, Homo sapiens
gtttgcatgtattaagtcaata

SEQ ID NO: 10027571 - DNA, 22 bp, Homo sapiens
gtttgcaacatagtcctatgta

SEQ ID NO: 10027572 - DNA, 22 bp, Homo sapiens
gtttgcaaagatcattttctcc

SEQ ID NO: 10027573 - DNA, 22 bp, Homo sapiens
taaatgctatcgcataaaacct

SEQ ID NO: 10027574 - DNA, 22 bp, Homo sapiens
taaaagtaggaatgaaacgcat

SEQ ID NO: 10027575 - DNA, 22 bp, Homo sapiens
taaggaggcagtcattatcagg

SEQ ID NO: 10027576 - DNA, 22 bp, Homo sapiens
taaggaggttggtgggttggat

SEQ ID NO: 10027577 - DNA, 22 bp, Homo sapiens
taaggaggctgctgtgaagaaa

SEQ ID NO: 10027578 - DNA, 22 bp, Homo sapiens
taaggaggcgaggtggtgagca

SEQ ID NO: 10027579 - DNA, 22 bp, Homo sapiens
taaggagggggaatgattggca

SEQ ID NO: 10027580 - DNA, 22 bp, Homo sapiens
taaggaggtgcccactctcagg

SEQ ID NO: 10027581 - DNA, 22 bp, Homo sapiens
taatcgtatgtgtatcaaatca

SEQ ID NO: 10027582 - DNA, 22 bp, Homo sapiens
taattattctagtcacatagca

SEQ ID NO: 10027583 - DNA, 22 bp, Homo sapiens
taatttatgatgcaaagaaaag

SEQ ID NO: 10027584 - DNA, 22 bp, Homo sapiens
taattatttgaagacattagag

SEQ ID NO: 10027585 - DNA, 22 bp, Homo sapiens
tacacacatgcatttgccttat

SEQ ID NO: 10027586 - DNA, 22 bp, Homo sapiens
tacacacttactggagatgaag

SEQ ID NO: 10027587 - DNA, 22 bp, Homo sapiens
tacacacagaggccatgggatt

SEQ ID NO: 10027588 - DNA, 22 bp, Homo sapiens
tacacataggtctgaataaaaa

SEQ ID NO: 10027589 - DNA, 22 bp, Homo sapiens
tacacataggagggtaataaaa

SEQ ID NO: 10027590 - DNA, 22 bp, Homo sapiens
tacacaactgacaaccattctg

SEQ ID NO: 10027591 - DNA, 22 bp, Homo sapiens
taatttatttcaactgccaagg

SEQ ID NO: 10027592 - DNA, 22 bp, Homo sapiens
tactgaaaagccacaaggacca

SEQ ID NO: 10027593 - DNA, 18 bp, Homo sapiens
tactgtttaattgattac

SEQ ID NO: 10027594 - DNA, 22 bp, Homo sapiens
tactgtttgcagtttgcagtat

SEQ ID NO: 10027595 - DNA, 22 bp, Homo sapiens
tacagtcaacattgatgatgat

SEQ ID NO: 10027596 - DNA, 22 bp, Homo sapiens
tacatgtatgtgttaatatctg

SEQ ID NO: 10027597 - DNA, 21 bp, Homo sapiens
gggcagaggggcctcctgggt

SEQ ID NO: 10027598 - DNA, 22 bp, Homo sapiens
ggcccagcgaggccacctacag

SEQ ID NO: 10027599 - DNA, 18 bp, Homo sapiens
ggcctctggactggcagc

SEQ ID NO: 10027600 - DNA, 22 bp, Homo sapiens
ggctcactgcaacttccgcctc

SEQ ID NO: 10027601 - DNA, 18 bp, Homo sapiens
ggcagggaaaagataggg

SEQ ID NO: 10027602 - DNA, 22 bp, Homo sapiens
ggcagtgagaggtctcctggtc

SEQ ID NO: 10027603 - DNA, 22 bp, Homo sapiens
ggcaccttggctagtgatcaac

SEQ ID NO: 10027604 - DNA, 22 bp, Homo sapiens
gtcctctggcctttcccaggac

SEQ ID NO: 10027605 - DNA, 22 bp, Homo sapiens
gtcctctggaggtttttaggtg

SEQ ID NO: 10027606 - DNA, 23 bp, Homo sapiens
gtcctctggagagaaaggcagta

SEQ ID NO: 10027607 - DNA, 22 bp, Homo sapiens
gtcctctgggagccttgagcct

SEQ ID NO: 10027608 - DNA, 22 bp, Homo sapiens
gtcctctgggcagctgccccac

SEQ ID NO: 10027609 - DNA, 22 bp, Homo sapiens
gtcctctggaagatgagttctt

SEQ ID NO: 10027610 - DNA, 22 bp, Homo sapiens
gtcctctgcttcatgccctgat

SEQ ID NO: 10027611 - DNA, 22 bp, Homo sapiens
gtcctctgtccctggggcacgg

SEQ ID NO: 10027612 - DNA, 22 bp, Homo sapiens
gtcctctgtagggctgggccac

SEQ ID NO: 10027613 - DNA, 22 bp, Homo sapiens
gtcctctgggctttgagcagtc

SEQ ID NO: 10027614 - DNA, 22 bp, Homo sapiens
gtcctctggtgaaagcattccc

SEQ ID NO: 10027615 - DNA, 22 bp, Homo sapiens
gtccagccagctggtccttgcc

SEQ ID NO: 10027616 - DNA, 22 bp, Homo sapiens
gtccagcccttgcagcttcttt

SEQ ID NO: 10027617 - DNA, 22 bp, Homo sapiens
gtgagcatcttggcagatatga

SEQ ID NO: 10027618 - DNA, 22 bp, Homo sapiens
gtctaattcctgctcttactca

SEQ ID NO: 10027619 - DNA, 22 bp, Homo sapiens
gtgctgcatgacttgctcctga

SEQ ID NO: 10027620 - DNA, 22 bp, Homo sapiens
gtgctgcagagtctcgtgccgc

SEQ ID NO: 10027621 - DNA, 22 bp, Homo sapiens
gtgctgcagggcctcctgcacc

SEQ ID NO: 10027622 - DNA, 23 bp, Homo sapiens
gtgctgcaaaatcggccactgca

SEQ ID NO: 10027623 - DNA, 22 bp, Homo sapiens
gggcttatggagggctttgtac

SEQ ID NO: 10027624 - DNA, 22 bp, Homo sapiens
gtaatgtactgcagccagatgt

SEQ ID NO: 10027625 - DNA, 22 bp, Homo sapiens
gtaatttttagttcattctatc

SEQ ID NO: 10027626 - DNA, 22 bp, Homo sapiens
gtaattttggagtataacctgg

SEQ ID NO: 10027627 - DNA, 22 bp, Homo sapiens
ggtgcttctgggcatagcagga

SEQ ID NO: 10027628 - DNA, 22 bp, Homo sapiens
ggtccccgtggaggctggagcg

SEQ ID NO: 10027629 - DNA, 22 bp, Homo sapiens
gccaggctctcagtgactgccc

SEQ ID NO: 10027630 - DNA, 21 bp, Homo sapiens
gccatttcacacagacatttg

SEQ ID NO: 10027631 - DNA, 22 bp, Homo sapiens
gcccacacagcagatcctttgg

SEQ ID NO: 10027632 - DNA, 22 bp, Homo sapiens
gcccacaccatttattctttgt

SEQ ID NO: 10027633 - DNA, 22 bp, Homo sapiens
gcccacacaccagctcaggagg

SEQ ID NO: 10027634 - DNA, 19 bp, Homo sapiens
gcctcatttccacctcccc

SEQ ID NO: 10027635 - DNA, 22 bp, Homo sapiens
gcaaggagactgtagggccaag

SEQ ID NO: 10027636 - DNA, 22 bp, Homo sapiens
gcaaggagcacctttctggaac

SEQ ID NO: 10027637 - DNA, 22 bp, Homo sapiens
gcaaggagcctggaggtgagtg

SEQ ID NO: 10027638 - DNA, 22 bp, Homo sapiens
gcaaggaggctggtggaggaag

SEQ ID NO: 10027639 - DNA, 22 bp, Homo sapiens
gcacatttgccactgagctcct

SEQ ID NO: 10027640 - DNA, 21 bp, Homo sapiens
gcagccactgccttcaacaat

SEQ ID NO: 10027641 - DNA, 22 bp, Homo sapiens
gcagccactctcattccacgtg

SEQ ID NO: 10027642 - DNA, 22 bp, Homo sapiens
gcagccactagttttcctgttt

SEQ ID NO: 10027643 - DNA, 22 bp, Homo sapiens
gcagcaagaggtttctgttgac

SEQ ID NO: 10027644 - DNA, 22 bp, Homo sapiens
gctccctccatgaggcagaccg

SEQ ID NO: 10027645 - DNA, 22 bp, Homo sapiens
gctccctcatctgtgctgtttt

SEQ ID NO: 10027646 - DNA, 22 bp, Homo sapiens
gctctctccctaggcaagtgag

SEQ ID NO: 10027647 - DNA, 22 bp, Homo sapiens
gctctctcgtgaacaggtggtt

SEQ ID NO: 10027648 - DNA, 22 bp, Homo sapiens
gctctctcttggggattcagca

SEQ ID NO: 10027649 - DNA, 22 bp, Homo sapiens
ggagccaggcaatctgtacttt

SEQ ID NO: 10027650 - DNA, 22 bp, Homo sapiens
gcttttaattagttgcttccat

SEQ ID NO: 10027651 - DNA, 22 bp, Homo sapiens
gcttttgtggctgtcttcattg

SEQ ID NO: 10027652 - DNA, 22 bp, Homo sapiens
gctttagtttgtcactggcatt

SEQ ID NO: 10027653 - DNA, 23 bp, Homo sapiens
gctttatagttctcccaacatta

SEQ ID NO: 10027654 - DNA, 22 bp, Homo sapiens
gctgtctgctgtgcactgagca

SEQ ID NO: 10027655 - DNA, 22 bp, Homo sapiens
gctgtctggcatggcgtggctg

SEQ ID NO: 10027656 - DNA, 22 bp, Homo sapiens
gaggcctggtttgcatgagaat

SEQ ID NO: 10027657 - DNA, 22 bp, Homo sapiens
gaccttgtgatccacccgcctt

SEQ ID NO: 10027658 - DNA, 22 bp, Homo sapiens
gacctgtgcagtgactggtggc

SEQ ID NO: 10027659 - DNA, 22 bp, Homo sapiens
gacctgtgaccattctgggtag

SEQ ID NO: 10027660 - DNA, 22 bp, Homo sapiens
gacaaatgaatgatgaacacca

SEQ ID NO: 10027661 - DNA, 22 bp, Homo sapiens
gacaaatgaagtcactgacctt

SEQ ID NO: 10027662 - DNA, 22 bp, Homo sapiens
gacaaatgagtctcatacccgg

SEQ ID NO: 10027663 - DNA, 22 bp, Homo sapiens
gaatgtaagtgggcagaagaca

SEQ ID NO: 10027664 - DNA, 22 bp, Homo sapiens
gaagaatctgaggacagtcatt

SEQ ID NO: 10027665 - DNA, 22 bp, Homo sapiens
gagcaagaccctgggttctctc

SEQ ID NO: 10027666 - DNA, 22 bp, Homo sapiens
gagcaagactcactgcatcttg

SEQ ID NO: 10027667 - DNA, 22 bp, Homo sapiens
gagcaagatcctgtttttctat

SEQ ID NO: 10027668 - DNA, 19 bp, Homo sapiens
gactccaactttaagcatg

SEQ ID NO: 10027669 - DNA, 22 bp, Homo sapiens
gagaacaggctctggagtcaga

SEQ ID NO: 10027670 - DNA, 22 bp, Homo sapiens
cttgcttttgctgatgattaag

SEQ ID NO: 10027671 - DNA, 22 bp, Homo sapiens
ctttctctgtgtttcacatgct

SEQ ID NO: 10027672 - DNA, 22 bp, Homo sapiens
cttggagtcaataagatctaga

SEQ ID NO: 10027673 - DNA, 22 bp, Homo sapiens
gaaatgtctctggatttgcttt

SEQ ID NO: 10027674 - DNA, 22 bp, Homo sapiens
gaaaaatgagctgatgtcaggg

SEQ ID NO: 10027675 - DNA, 22 bp, Homo sapiens
gaaaaatgctccaaatctgtgg

SEQ ID NO: 10027676 - DNA, 22 bp, Homo sapiens
gaaactagatgtattagagatt

SEQ ID NO: 10027677 - DNA, 22 bp, Homo sapiens
gaaacttcttgtctcacagttc

SEQ ID NO: 10027678 - DNA, 22 bp, Homo sapiens
gaaacttgcctgaagtcaacca

SEQ ID NO: 10027679 - DNA, 20 bp, Homo sapiens
ctgggctcggtggccctggc

SEQ ID NO: 10027680 - DNA, 22 bp, Homo sapiens
ctgtgtgagcatcacttcagat

SEQ ID NO: 10027681 - DNA, 22 bp, Homo sapiens
ctgtgtctttcctactttgtgg

SEQ ID NO: 10027682 - DNA, 22 bp, Homo sapiens
ctgtgtcttgagtaattcggtg

SEQ ID NO: 10027683 - DNA, 22 bp, Homo sapiens
ctgtgtcttctgttttgaagtt

SEQ ID NO: 10027684 - DNA, 22 bp, Homo sapiens
ctgtctgttatctcaccagtcc

SEQ ID NO: 10027685 - DNA, 22 bp, Homo sapiens
ctcactgcaagctcagcctccc

SEQ ID NO: 10027686 - DNA, 22 bp, Homo sapiens
ctcactgcaacctctgcctccc

SEQ ID NO: 10027687 - DNA, 22 bp, Homo sapiens
ctcactgcaacctccgcctcct

SEQ ID NO: 10027688 - DNA, 22 bp, Homo sapiens
ctcagtctgtcttgtctgtgtt

SEQ ID NO: 10027689 - DNA, 19 bp, Homo sapiens
ctcagtctggctctgcctg

SEQ ID NO: 10027690 - DNA, 22 bp, Homo sapiens
ctcagtctcttgggctgtgaag

SEQ ID NO: 10027691 - DNA, 22 bp, Homo sapiens
ttgcataaagattttattgcat

SEQ ID NO: 10027692 - DNA, 22 bp, Homo sapiens
ttacataacggtatgaaaaatg

SEQ ID NO: 10027693 - DNA, 22 bp, Homo sapiens
ttacataactttaaaatgccgt

SEQ ID NO: 10027694 - DNA, 22 bp, Homo sapiens
ttatatttctggtagccttcag

SEQ ID NO: 10027695 - DNA, 22 bp, Homo sapiens
tgtcagatgattctcaggagac

SEQ ID NO: 10027696 - DNA, 22 bp, Homo sapiens
ttaagattttcttcagtattat

SEQ ID NO: 10027697 - DNA, 22 bp, Homo sapiens
cggagtcttgctatgttgccca

SEQ ID NO: 10027698 - DNA, 20 bp, Homo sapiens
ttcaaagtgtatgatatgca

SEQ ID NO: 10027699 - DNA, 22 bp, Homo sapiens
ttattgagtttacagctttaga

SEQ ID NO: 10027700 - DNA, 22 bp, Homo sapiens
cgctgataaacgtcacgttccc

SEQ ID NO: 10027701 - DNA, 22 bp, Homo sapiens
ctgctgtgagtggttcttgcct

SEQ ID NO: 10027702 - DNA, 22 bp, Homo sapiens
ctggagcaggcttgtcccagct

SEQ ID NO: 10027703 - DNA, 22 bp, Homo sapiens
ctgctgtcatagccatccctcc

SEQ ID NO: 10027704 - DNA, 22 bp, Homo sapiens
ctgctgtcgccgagctgcatgc

SEQ ID NO: 10027705 - DNA, 22 bp, Homo sapiens
ctgctctgttcccccatcatct

SEQ ID NO: 10027706 - DNA, 22 bp, Homo sapiens
ctgccttggccctagttcatgg

SEQ ID NO: 10027707 - DNA, 22 bp, Homo sapiens
ctgaggtcaggagttcaagctg

SEQ ID NO: 10027708 - DNA, 22 bp, Homo sapiens
tttgaaaatttaagtgctacac

SEQ ID NO: 10027709 - DNA, 22 bp, Homo sapiens
tttgaaaacttaatttggtcgt

SEQ ID NO: 10027710 - DNA, 22 bp, Homo sapiens
tttgcaaagaaattattgctgt

SEQ ID NO: 10027711 - DNA, 22 bp, Homo sapiens
ttttgctgcattgaagtcagat

SEQ ID NO: 10027712 - DNA, 21 bp, Homo sapiens
ttttgctgttttagaatgaga

SEQ ID NO: 10027713 - DNA, 22 bp, Homo sapiens
ctctgtgccagtctgcactcgg

SEQ ID NO: 10027714 - DNA, 22 bp, Homo sapiens
ctctgtgctcccatgctagtaa

SEQ ID NO: 10027715 - DNA, 22 bp, Homo sapiens
tttcattatacagcttcataaa

SEQ ID NO: 10027716 - DNA, 22 bp, Homo sapiens
tttcattagtatgacagcacgc

SEQ ID NO: 10027717 - DNA, 18 bp, Homo sapiens
ctctctttccactctttg

SEQ ID NO: 10027718 - DNA, 22 bp, Homo sapiens
ctctgaaagcaaaactagagaa

SEQ ID NO: 10027719 - DNA, 22 bp, Homo sapiens
ctctgaaagttagagaaaatag

SEQ ID NO: 10027720 - DNA, 22 bp, Homo sapiens
ctctgaaagagtttagtattat

SEQ ID NO: 10027721 - DNA, 22 bp, Homo sapiens
ctctctgtggtggctgtcccat

SEQ ID NO: 10027722 - DNA, 22 bp, Homo sapiens
tcttgtttctgtatataatgac

SEQ ID NO: 10027723 - DNA, 22 bp, Homo sapiens
tctttatttaagtctgttgtaa

SEQ ID NO: 10027724 - DNA, 22 bp, Homo sapiens
tgagagtctcagacctcctggt

SEQ ID NO: 10027725 - DNA, 22 bp, Homo sapiens
tgagagtctgttcctcttgcag

SEQ ID NO: 10027726 - DNA, 22 bp, Homo sapiens
tgaccaaagactttagatgttc

SEQ ID NO: 10027727 - DNA, 22 bp, Homo sapiens
tgaccaaaggtggtttatttgg

SEQ ID NO: 10027728 - DNA, 21 bp, Homo sapiens
cccaggaggctgagaagagca

SEQ ID NO: 10027729 - DNA, 22 bp, Homo sapiens
cccagcccccgagtgtctggaa

SEQ ID NO: 10027730 - DNA, 22 bp, Homo sapiens
cccagcatgcacgctgacactc

SEQ ID NO: 10027731 - DNA, 22 bp, Homo sapiens
cccagccagcctcttcccatat

SEQ ID NO: 10027732 - DNA, 21 bp, Homo sapiens
cccaggagaagaaaagatgca

SEQ ID NO: 10027733 - DNA, 22 bp, Homo sapiens
cccacactctgagaaatgctga

SEQ ID NO: 10027734 - DNA, 22 bp, Homo sapiens
cccacagggctgctgatggcag

SEQ ID NO: 10027735 - DNA, 22 bp, Homo sapiens
tgatgactatatatgactagtg

SEQ ID NO: 10027736 - DNA, 22 bp, Homo sapiens
ccagtgttcagtatgcattaag

SEQ ID NO: 10027737 - DNA, 22 bp, Homo sapiens
ccagtgttcataattttacact

SEQ ID NO: 10027738 - DNA, 22 bp, Homo sapiens
tgattcaaatattgtgtatgat

SEQ ID NO: 10027739 - DNA, 22 bp, Homo sapiens
ccatggagcgggtgagtgagtg

SEQ ID NO: 10027740 - DNA, 22 bp, Homo sapiens
ccatggcattttatgtgtctta

SEQ ID NO: 10027741 - DNA, 22 bp, Homo sapiens
cctccctccctcttatggttta

SEQ ID NO: 10027742 - DNA, 18 bp, Homo sapiens
cctccctcattttcccag

SEQ ID NO: 10027743 - DNA, 22 bp, Homo sapiens
tgcctccaccattgctcacttt

SEQ ID NO: 10027744 - DNA, 22 bp, Homo sapiens
tgctttattttaaatatgccat

SEQ ID NO: 10027745 - DNA, 22 bp, Homo sapiens
cctgacctccaagtggctctgg

SEQ ID NO: 10027746 - DNA, 22 bp, Homo sapiens
cctgcagaagagtccagctcat

SEQ ID NO: 10027747 - DNA, 22 bp, Homo sapiens
cctctttgactatagtagttaa

SEQ ID NO: 10027748 - DNA, 22 bp, Homo sapiens
cctctttgactctcaggtcttt

SEQ ID NO: 10027749 - DNA, 22 bp, Homo sapiens
cctctttgagattcagttttcc

SEQ ID NO: 10027750 - DNA, 22 bp, Homo sapiens
cctccctctttcagtcccacag

SEQ ID NO: 10027751 - DNA, 21 bp, Homo sapiens
tgtaagtttcatctgaattgg

SEQ ID NO: 10027752 - DNA, 22 bp, Homo sapiens
tgtaatataagcattaatagtt

SEQ ID NO: 10027753 - DNA, 22 bp, Homo sapiens
tgtcaacagatactagagagct

SEQ ID NO: 10027754 - DNA, 22 bp, Homo sapiens
ccagcattcacactggttcctt

SEQ ID NO: 10027755 - DNA, 22 bp, Homo sapiens
ccagccctgtttatgtgtcact

SEQ ID NO: 10027756 - DNA, 22 bp, Homo sapiens
tcctctctgcactggccctgcc

SEQ ID NO: 10027757 - DNA, 22 bp, Homo sapiens
tcggagctgtagatgaaaccct

SEQ ID NO: 10027758 - DNA, 22 bp, Homo sapiens
tctccacactttctctcccagg

SEQ ID NO: 10027759 - DNA, 18 bp, Homo sapiens
tctatatggacatagaga

SEQ ID NO: 10027760 - DNA, 16 bp, Homo sapiens
ccacctgcagctctca

SEQ ID NO: 10027761 - DNA, 22 bp, Homo sapiens
tctccctctcagatttattcac

SEQ ID NO: 10027762 - DNA, 22 bp, Homo sapiens
tctccctcattcctgcttccat

SEQ ID NO: 10027763 - DNA, 22 bp, Homo sapiens
tctccctctttgtctgctttgg

SEQ ID NO: 10027764 - DNA, 22 bp, Homo sapiens
tcccactgagcatatgcagatg

SEQ ID NO: 10027765 - DNA, 22 bp, Homo sapiens
tcccagccaggctctaccactt

SEQ ID NO: 10027766 - DNA, 22 bp, Homo sapiens
tcatcagtccttttcattatga

SEQ ID NO: 10027767 - DNA, 22 bp, Homo sapiens
tcatcagtgtccttatcactta

SEQ ID NO: 10027768 - DNA, 22 bp, Homo sapiens
tccacatagtcattaatttctg

SEQ ID NO: 10027769 - DNA, 22 bp, Homo sapiens
tagctatttagcccagataagt

SEQ ID NO: 10027770 - DNA, 22 bp, Homo sapiens
tatcatgtctggagatactttt

SEQ ID NO: 10027771 - DNA, 22 bp, Homo sapiens
tatcatgtccctaaagagagga

SEQ ID NO: 10027772 - DNA, 22 bp, Homo sapiens
tactatgtgaaaatactatagt

SEQ ID NO: 10027773 - DNA, 22 bp, Homo sapiens
tcacaggagattatgtgtgcta

SEQ ID NO: 10027774 - DNA, 22 bp, Homo sapiens
tcacaggaggaacctggcctgg

SEQ ID NO: 10027775 - DNA, 22 bp, Homo sapiens
tcacaggagagctgatgctggt

SEQ ID NO: 10027776 - DNA, 22 bp, Homo sapiens
tcacaacgcctctgcaaatcct

SEQ ID NO: 10027777 - DNA, 22 bp, Homo sapiens
tatttccaaaaaggccatattc

SEQ ID NO: 10027778 - DNA, 22 bp, Homo sapiens
tcagacttctactttgcagagc

SEQ ID NO: 10027779 - DNA, 22 bp, Homo sapiens
tcagacttcagtttttagttgt

SEQ ID NO: 10027780 - DNA, 21 bp, Homo sapiens
tcagacttgagctcttctaca

SEQ ID NO: 10027781 - DNA, 22 bp, Homo sapiens
tcagactttaaaggctaacagg

SEQ ID NO: 10027782 - DNA, 22 bp, Homo sapiens
tcagacttgcctttttataaaa

SEQ ID NO: 10027783 - DNA, 20 bp, Homo sapiens
tcagacttgattctatgcta

SEQ ID NO: 10027784 - DNA, 22 bp, Homo sapiens
cataaagttaagctgtaagtat

SEQ ID NO: 10027785 - DNA, 22 bp, Homo sapiens
ttttattggagtgataccaagc

SEQ ID NO: 10027786 - DNA, 22 bp, Homo sapiens
ttttctattcattgtctatggt

SEQ ID NO: 10027787 - DNA, 22 bp, Homo sapiens
ttttctcagctgcactgtatta

SEQ ID NO: 10027788 - DNA, 22 bp, Homo sapiens
ttttcttatgtgcagctatatg

SEQ ID NO: 10027789 - DNA, 22 bp, Homo sapiens
ttttcttatagagcttaaagtt

SEQ ID NO: 10027790 - DNA, 22 bp, Homo sapiens
ttttcttactgtctgtgatcct

SEQ ID NO: 10027791 - DNA, 22 bp, Homo sapiens
ttttcttaggtgctccaagtag

SEQ ID NO: 10027792 - DNA, 22 bp, Homo sapiens
ttttctgttacaaagtacagcg

SEQ ID NO: 10027793 - DNA, 22 bp, Homo sapiens
ttttctgtattattgtgcttca

SEQ ID NO: 10027794 - DNA, 22 bp, Homo sapiens
tttgtaaggctaaataatattc

SEQ ID NO: 10027795 - DNA, 22 bp, Homo sapiens
tttgtaagcaagttaacatttt

SEQ ID NO: 10027796 - DNA, 22 bp, Homo sapiens
tttgtaaatagcagtactcatg

SEQ ID NO: 10027797 - DNA, 22 bp, Homo sapiens
tttgttaaaatgcagattctgt

SEQ ID NO: 10027798 - DNA, 22 bp, Homo sapiens
tttgttaaggagtattgcttct

SEQ ID NO: 10027799 - DNA, 22 bp, Homo sapiens
tttggtattgcacactgtcttc

SEQ ID NO: 10027800 - DNA, 22 bp, Homo sapiens
tttgtaaaagcccaagctgtag

SEQ ID NO: 10027801 - DNA, 22 bp, Homo sapiens
tttgaaaaaggcctttggtatg

SEQ ID NO: 10027802 - DNA, 22 bp, Homo sapiens
tttttcatattcccctctctgg

SEQ ID NO: 10027803 - DNA, 22 bp, Homo sapiens
tttttagtagaggtgggtttca

SEQ ID NO: 10027804 - DNA, 22 bp, Homo sapiens
ttttcttatgtgcagctatatg

SEQ ID NO: 10027805 - DNA, 21 bp, Homo sapiens
ttctctccatatgcccagccc

SEQ ID NO: 10027806 - DNA, 22 bp, Homo sapiens
ttctctaagctggctgaggtct

SEQ ID NO: 10027807 - DNA, 22 bp, Homo sapiens
ttctgtaagggatttattctga

SEQ ID NO: 10027808 - DNA, 22 bp, Homo sapiens
ttcttatttcccccttcatcat

SEQ ID NO: 10027809 - DNA, 22 bp, Homo sapiens
ttcagtgtgaagcttctgaaag

SEQ ID NO: 10027810 - DNA, 23 bp, Homo sapiens
ttcatttaggagttcataagagc

SEQ ID NO: 10027811 - DNA, 22 bp, Homo sapiens
ttagctgactgtgtgatttggc

SEQ ID NO: 10027812 - DNA, 22 bp, Homo sapiens
ttaggaaatcactttgctcacc

SEQ ID NO: 10027813 - DNA, 22 bp, Homo sapiens
ttaggaaagtctcttggctggg

SEQ ID NO: 10027814 - DNA, 22 bp, Homo sapiens
ttaggaaagcattgtgtaaaag

SEQ ID NO: 10027815 - DNA, 22 bp, Homo sapiens
ttaggaaaatcatgagagatga

SEQ ID NO: 10027816 - DNA, 22 bp, Homo sapiens
ttaggaaaatgaaattacctgt

SEQ ID NO: 10027817 - DNA, 19 bp, Homo sapiens
ttaggaaaccactttcctt

SEQ ID NO: 10027818 - DNA, 22 bp, Homo sapiens
ttatataaagataacttttctt

SEQ ID NO: 10027819 - DNA, 22 bp, Homo sapiens
ttatatactgtggtagtactgt

SEQ ID NO: 10027820 - DNA, 23 bp, Homo sapiens
ttgtgtctacttcctatctaggg

SEQ ID NO: 10027821 - DNA, 22 bp, Homo sapiens
ttgtgtctaaataaggagacct

SEQ ID NO: 10027822 - DNA, 22 bp, Homo sapiens
ttgtgtctggaatgcgtggagc

SEQ ID NO: 10027823 - DNA, 22 bp, Homo sapiens
ttgtgtctggatttcagctttc

SEQ ID NO: 10027824 - DNA, 22 bp, Homo sapiens
ttgtgtctgggggagtgacatc

SEQ ID NO: 10027825 - DNA, 22 bp, Homo sapiens
ttgtaaactgctgcaggagtgc

SEQ ID NO: 10027826 - DNA, 22 bp, Homo sapiens
ttggccatctaagcccagccac

SEQ ID NO: 10027827 - DNA, 22 bp, Homo sapiens
ttgacaaaggaccttgctattt

SEQ ID NO: 10027828 - DNA, 22 bp, Homo sapiens
ttgacaaaaataacacagcata

SEQ ID NO: 10027829 - DNA, 22 bp, Homo sapiens
ttgcagaagcctgttgttcctg

SEQ ID NO: 10027830 - DNA, 22 bp, Homo sapiens
ttgcagaatacttattctgtat

SEQ ID NO: 10027831 - DNA, 22 bp, Homo sapiens
ttgcttatttgattaaatgtct

SEQ ID NO: 10027832 - DNA, 22 bp, Homo sapiens
ttgctgagagcgtgtcaacaag

SEQ ID NO: 10027833 - DNA, 22 bp, Homo sapiens
ttgcttatagagagtttcatac

SEQ ID NO: 10027834 - DNA, 19 bp, Homo sapiens
tttcagactcatctccagc

SEQ ID NO: 10027835 - DNA, 22 bp, Homo sapiens
tttcattatgttcctggaagag

SEQ ID NO: 10027836 - DNA, 21 bp, Homo sapiens
tttcattgaatgagataaggt

SEQ ID NO: 10027837 - DNA, 22 bp, Homo sapiens
tttcattgagactatagacatc

SEQ ID NO: 10027838 - DNA, 22 bp, Homo sapiens
tttattgagtatctactatgtg

SEQ ID NO: 10027839 - DNA, 23 bp, Homo sapiens
tttcaactcctgccattatttct

SEQ ID NO: 10027840 - DNA, 22 bp, Homo sapiens
tttaaatgtttaaaactcgtga

SEQ ID NO: 10027841 - DNA, 22 bp, Homo sapiens
ttgtgtcttaaagattaaatgg

SEQ ID NO: 10027842 - DNA, 22 bp, Homo sapiens
tttaatgtagcgtgaaatgatt

SEQ ID NO: 10027843 - DNA, 22 bp, Homo sapiens
tttaatgatagctgtttcacat

SEQ ID NO: 10027844 - DNA, 23 bp, Homo sapiens
tttaatgaccaatagaaggaaca

SEQ ID NO: 10027845 - DNA, 21 bp, Homo sapiens
tttaccacatggtcctcattt

SEQ ID NO: 10027846 - DNA, 21 bp, Homo sapiens
tttagcaagagtatagtgcat

SEQ ID NO: 10027847 - DNA, 22 bp, Homo sapiens
tttagcaagattgagccgtctt

SEQ ID NO: 10027848 - DNA, 22 bp, Homo sapiens
tttagatgctgtatgttatttc

SEQ ID NO: 10027849 - DNA, 22 bp, Homo sapiens
tttagatgctgtatgttatttc

SEQ ID NO: 10027850 - DNA, 22 bp, Homo sapiens
tttagagtccttgctcttattc

SEQ ID NO: 10027851 - DNA, 22 bp, Homo sapiens
tttagagttgagtattcattgg

SEQ ID NO: 10027852 - DNA, 22 bp, Homo sapiens
tttagagtcattttatattgac

SEQ ID NO: 10027853 - DNA, 21 bp, Homo sapiens
tttagagaatactcactattt

SEQ ID NO: 10027854 - DNA, 22 bp, Homo sapiens
tttagagaccctctgctatttt

SEQ ID NO: 10027855 - DNA, 22 bp, Homo sapiens
gaatgtaatagtcagtagaaca

SEQ ID NO: 10027856 - DNA, 16 bp, Homo sapiens
gaagcagagggtgttg

SEQ ID NO: 10027857 - DNA, 22 bp, Homo sapiens
atgccccagtgtgtgcttcctt

SEQ ID NO: 10027858 - DNA, 22 bp, Homo sapiens
atgccccaggaggtgccatcca

SEQ ID NO: 10027859 - DNA, 22 bp, Homo sapiens
gacccggctccaggcccagcag

SEQ ID NO: 10027860 - DNA, 22 bp, Homo sapiens
atgctttgatttggtttctcta

SEQ ID NO: 10027861 - DNA, 22 bp, Homo sapiens
gaacattcttgggcaagttact

SEQ ID NO: 10027862 - DNA, 22 bp, Homo sapiens
gaaaatgcctctggcattaaac

SEQ ID NO: 10027863 - DNA, 22 bp, Homo sapiens
gaacataactattgtgaatagt

SEQ ID NO: 10027864 - DNA, 22 bp, Homo sapiens
gaacataattaaatgtcctggg

SEQ ID NO: 10027865 - DNA, 21 bp, Homo sapiens
atgaatgatttctactcttaa

SEQ ID NO: 10027866 - DNA, 22 bp, Homo sapiens
atgaatgatttgtcagtcacag

SEQ ID NO: 10027867 - DNA, 22 bp, Homo sapiens
atgaatgattttatgtaaatga

SEQ ID NO: 10027868 - DNA, 22 bp, Homo sapiens
atgaatgagattaccaatgtga

SEQ ID NO: 10027869 - DNA, 22 bp, Homo sapiens
atgaatgagtgctaggtttgtc

SEQ ID NO: 10027870 - DNA, 22 bp, Homo sapiens
atgaatgagcttagaggctgac

SEQ ID NO: 10027871 - DNA, 22 bp, Homo sapiens
atgaatgatgcaaaagacactg

SEQ ID NO: 10027872 - DNA, 22 bp, Homo sapiens
atgaatgattaaagagtacagt

SEQ ID NO: 10027873 - DNA, 22 bp, Homo sapiens
atgaatgtacctgaaatagcct

SEQ ID NO: 10027874 - DNA, 22 bp, Homo sapiens
atgaatggatggggtcaagata

SEQ ID NO: 10027875 - DNA, 22 bp, Homo sapiens
atgaatgaaatacagagtactt

SEQ ID NO: 10027876 - DNA, 22 bp, Homo sapiens
atgaatgaataccatgcaacta

SEQ ID NO: 10027877 - DNA, 22 bp, Homo sapiens
atgaatgactgtctactttggg

SEQ ID NO: 10027878 - DNA, 17 bp, Homo sapiens
atgtaagaagaaagcag

SEQ ID NO: 10027879 - DNA, 22 bp, Homo sapiens
atgtaagactttaagaacctaa

SEQ ID NO: 10027880 - DNA, 18 bp, Homo sapiens
atgtcacagagggctgaa

SEQ ID NO: 10027881 - DNA, 22 bp, Homo sapiens
atgtcacagtgttgctggaagt

SEQ ID NO: 10027882 - DNA, 22 bp, Homo sapiens
atgtttcaccagcaaattacct

SEQ ID NO: 10027883 - DNA, 22 bp, Homo sapiens
gagggaaaggttaatacatgat

SEQ ID NO: 10027884 - DNA, 22 bp, Homo sapiens
gcccagccacagtcactttcat

SEQ ID NO: 10027885 - DNA, 22 bp, Homo sapiens
atttgcaaaggttaacagcagt

SEQ ID NO: 10027886 - DNA, 22 bp, Homo sapiens
atttgcaattactcatgtcatt

SEQ ID NO: 10027887 - DNA, 22 bp, Homo sapiens
atttgcacatagtattatcttt

SEQ ID NO: 10027888 - DNA, 22 bp, Homo sapiens
atttgcaattttactttgcagt

SEQ ID NO: 10027889 - DNA, 20 bp, Homo sapiens
atttgcatctgaataactta

SEQ ID NO: 10027890 - DNA, 22 bp, Homo sapiens
attttctagatagatgatgcat

SEQ ID NO: 10027891 - DNA, 22 bp, Homo sapiens
attgttttattaaatgagccct

SEQ ID NO: 10027892 - DNA, 23 bp, Homo sapiens
attgtttttggctctcagggaat

SEQ ID NO: 10027893 - DNA, 22 bp, Homo sapiens
attgttttgtttcccagtgact

SEQ ID NO: 10027894 - DNA, 22 bp, Homo sapiens
attgttttccaaagatgctgct

SEQ ID NO: 10027895 - DNA, 16 bp, Homo sapiens
attgttttcaattaga

SEQ ID NO: 10027896 - DNA, 22 bp, Homo sapiens
gcacacaggcagtttccagcca

SEQ ID NO: 10027897 - DNA, 22 bp, Homo sapiens
gcaactgaacatgtgtgtggcc

SEQ ID NO: 10027898 - DNA, 22 bp, Homo sapiens
gcaaaattaaacttagcatcat

SEQ ID NO: 10027899 - DNA, 22 bp, Homo sapiens
cactgtccctgtttcctggaaa

SEQ ID NO: 10027900 - DNA, 22 bp, Homo sapiens
cactgtccatgcttgctaaccc

SEQ ID NO: 10027901 - DNA, 22 bp, Homo sapiens
cactgtccaatagatacataat

SEQ ID NO: 10027902 - DNA, 22 bp, Homo sapiens
cactgattaagtctgctagagg

SEQ ID NO: 10027903 - DNA, 22 bp, Homo sapiens
cactgcccaggcacccatcttg

SEQ ID NO: 10027904 - DNA, 22 bp, Homo sapiens
cacatgcccagaacttctcatt

SEQ ID NO: 10027905 - DNA, 22 bp, Homo sapiens
ggccccaggcctttggtctggc

SEQ ID NO: 10027906 - DNA, 22 bp, Homo sapiens
caagtgcacacacatcctgtgc

SEQ ID NO: 10027907 - DNA, 22 bp, Homo sapiens
caatctataaatatcagtttcc

SEQ ID NO: 10027908 - DNA, 22 bp, Homo sapiens
gctggtgagattttatgtttcc

SEQ ID NO: 10027909 - DNA, 22 bp, Homo sapiens
ggaacactcagtaattcagata

SEQ ID NO: 10027910 - DNA, 22 bp, Homo sapiens
ggaaaattggcgcgtggggctg

SEQ ID NO: 10027911 - DNA, 22 bp, Homo sapiens
ggaaaatttccttcaaaatgtg

SEQ ID NO: 10027912 - DNA, 23 bp, Homo sapiens
gcttccagaagactcattgacat

SEQ ID NO: 10027913 - DNA, 22 bp, Homo sapiens
cacagagacagaagcacttatg

SEQ ID NO: 10027914 - DNA, 22 bp, Homo sapiens
ggacacaaaagtgaataaaata

SEQ ID NO: 10027915 - DNA, 22 bp, Homo sapiens
ggacacagacctttctgttcta

SEQ ID NO: 10027916 - DNA, 22 bp, Homo sapiens
cacagcctccttcagagagcat

SEQ ID NO: 10027917 - DNA, 22 bp, Homo sapiens
gtcctctgtgtaggctgcagac

SEQ ID NO: 10027918 - DNA, 22 bp, Homo sapiens
gtcctctgtttccatctgactt

SEQ ID NO: 10027919 - DNA, 22 bp, Homo sapiens
gtcctctgttagaaatgtgctt

SEQ ID NO: 10027920 - DNA, 22 bp, Homo sapiens
gtctttgctgtctttgctctca

SEQ ID NO: 10027921 - DNA, 22 bp, Homo sapiens
gtcttaaaatcagaggatatag

SEQ ID NO: 10027922 - DNA, 22 bp, Homo sapiens
gtgcatgcagtaagtgttttaa

SEQ ID NO: 10027923 - DNA, 22 bp, Homo sapiens
gtgcatgcacacatgtgtgagg

SEQ ID NO: 10027924 - DNA, 22 bp, Homo sapiens
gtgcatgcaaattactgtaaag

SEQ ID NO: 10027925 - DNA, 22 bp, Homo sapiens
gtgcatgctgcagtatgatttc

SEQ ID NO: 10027926 - DNA, 22 bp, Homo sapiens
gtgcatgccctaagatatttat

SEQ ID NO: 10027927 - DNA, 18 bp, Homo sapiens
gtgcatgcatgctctgcc

SEQ ID NO: 10027928 - DNA, 22 bp, Homo sapiens
gtgcatcaatttcccatgtgtc

SEQ ID NO: 10027929 - DNA, 18 bp, Homo sapiens
ccatttcatgattattac

SEQ ID NO: 10027930 - DNA, 22 bp, Homo sapiens
ccatttactagggagatctaga

SEQ ID NO: 10027931 - DNA, 22 bp, Homo sapiens
ccagacttcacccactttgctc

SEQ ID NO: 10027932 - DNA, 22 bp, Homo sapiens
ccagacctaagcatcagtgcat

SEQ ID NO: 10027933 - DNA, 22 bp, Homo sapiens
ccagctcttttggctgagtgag

SEQ ID NO: 10027934 - DNA, 22 bp, Homo sapiens
ccagctcttggtgcacttacat

SEQ ID NO: 10027935 - DNA, 22 bp, Homo sapiens
cccatgccttctgactcacagg

SEQ ID NO: 10027936 - DNA, 22 bp, Homo sapiens
cccatgagattctgaatttggc

SEQ ID NO: 10027937 - DNA, 22 bp, Homo sapiens
cctgagaggttggcctgtccag

SEQ ID NO: 10027938 - DNA, 22 bp, Homo sapiens
agctgaaaattagtgatagttt

SEQ ID NO: 10027939 - DNA, 20 bp, Homo sapiens
aggaaaaatggaaactggag

SEQ ID NO: 10027940 - DNA, 22 bp, Homo sapiens
cagggtttcaccatgttagcag

SEQ ID NO: 10027941 - DNA, 22 bp, Homo sapiens
catgtgtgacaaactgcctgca

SEQ ID NO: 10027942 - DNA, 22 bp, Homo sapiens
aggcactgacaattctggactg

SEQ ID NO: 10027943 - DNA, 22 bp, Homo sapiens
cagtgcttttttaccttccaac

SEQ ID NO: 10027944 - DNA, 22 bp, Homo sapiens
cagtctcttttcagctccatcc

SEQ ID NO: 10027945 - DNA, 22 bp, Homo sapiens
cagttctctttccactggaggc

SEQ ID NO: 10027946 - DNA, 22 bp, Homo sapiens
catcagaggtacttaatgaatg

SEQ ID NO: 10027947 - DNA, 22 bp, Homo sapiens
catcatgtctgcaggaatgtgt

SEQ ID NO: 10027948 - DNA, 22 bp, Homo sapiens
atattattctagctcttgtgtg

SEQ ID NO: 10027949 - DNA, 22 bp, Homo sapiens
atcaagaatgttcattcttcta

SEQ ID NO: 10027950 - DNA, 22 bp, Homo sapiens
ctgggtctccggcagcctcggg

SEQ ID NO: 10027951 - DNA, 22 bp, Homo sapiens
atcacaatgtacgttaaaatgt

SEQ ID NO: 10027952 - DNA, 22 bp, Homo sapiens
atcacagagattgcttttaaaa

SEQ ID NO: 10027953 - DNA, 22 bp, Homo sapiens
atcacagagctcccttccactg

SEQ ID NO: 10027954 - DNA, 22 bp, Homo sapiens
ctgtaacagatatcatttagca

SEQ ID NO: 10027955 - DNA, 22 bp, Homo sapiens
cttcttaatgacagattaaaat

SEQ ID NO: 10027956 - DNA, 22 bp, Homo sapiens
atctgtctggaggcctggcatg

SEQ ID NO: 10027957 - DNA, 22 bp, Homo sapiens
cttctgtgttaaatgagtcttt

SEQ ID NO: 10027958 - DNA, 19 bp, Homo sapiens
cttctgtgatacatcagtc

SEQ ID NO: 10027959 - DNA, 22 bp, Homo sapiens
cttatgctgagaatgaaagaat

SEQ ID NO: 10027960 - DNA, 22 bp, Homo sapiens
ctgtttctccacactcttccca

SEQ ID NO: 10027961 - DNA, 22 bp, Homo sapiens
cttaagaaattgcattctaatc

SEQ ID NO: 10027962 - DNA, 22 bp, Homo sapiens
cttagatgaagtcacagaaccc

SEQ ID NO: 10027963 - DNA, 22 bp, Homo sapiens
atagttttctatgcactgttat

SEQ ID NO: 10027964 - DNA, 20 bp, Homo sapiens
atacacatgcagacagatgc

SEQ ID NO: 10027965 - DNA, 22 bp, Homo sapiens
atacacatgtgtatgtgcatgc

SEQ ID NO: 10027966 - DNA, 22 bp, Homo sapiens
atacacattactttctgtctga

SEQ ID NO: 10027967 - DNA, 17 bp, Homo sapiens
atacatgtaaagtgctt

SEQ ID NO: 10027968 - DNA, 22 bp, Homo sapiens
atacatgtacataaatgtagca

SEQ ID NO: 10027969 - DNA, 22 bp, Homo sapiens
atacatgtgggtctaaacatat

SEQ ID NO: 10027970 - DNA, 22 bp, Homo sapiens
atacatgtgtgagcgaagatgt

SEQ ID NO: 10027971 - DNA, 22 bp, Homo sapiens
ctggcctcagagggtcatggtg

SEQ ID NO: 10027972 - DNA, 22 bp, Homo sapiens
ataaaagaagttttggtacttg

SEQ ID NO: 10027973 - DNA, 22 bp, Homo sapiens
ataaaagatcccttctgagctc

SEQ ID NO: 10027974 - DNA, 22 bp, Homo sapiens
ataaaaatgagggcggtagcta

SEQ ID NO: 10027975 - DNA, 22 bp, Homo sapiens
agttcttattttggaactgagg

SEQ ID NO: 10027976 - DNA, 22 bp, Homo sapiens
agttctcaggtcagctgagtct

SEQ ID NO: 10027977 - DNA, 22 bp, Homo sapiens
agttctcattgcatgagacaga

SEQ ID NO: 10027978 - DNA, 22 bp, Homo sapiens
ctgctattggaaggaggcatga

SEQ ID NO: 10027979 - DNA, 20 bp, Homo sapiens
ctgctcagaccaactcttct

SEQ ID NO: 10027980 - DNA, 19 bp, Homo sapiens
ctgctcaggtcagtctgtc

SEQ ID NO: 10027981 - DNA, 22 bp, Homo sapiens
ctgctcagcggaaggaagagcg

SEQ ID NO: 10027982 - DNA, 22 bp, Homo sapiens
ctgctgtgcatatttatctagg

SEQ ID NO: 10027983 - DNA, 22 bp, Homo sapiens
atacacatatgtgtgtatatgt

SEQ ID NO: 10027984 - DNA, 22 bp, Homo sapiens
atacacatgcacacatgtgtgt

SEQ ID NO: 10027985 - DNA, 22 bp, Homo sapiens
agttaaatgtcagtagcttaac

SEQ ID NO: 10027986 - DNA, 23 bp, Homo sapiens
ctcaccaagcgccgccgctgtgt

SEQ ID NO: 10027987 - DNA, 22 bp, Homo sapiens
agtgcattctctaattacaggt

SEQ ID NO: 10027988 - DNA, 22 bp, Homo sapiens
agtggaattgctgattgaaata

SEQ ID NO: 10027989 - DNA, 22 bp, Homo sapiens
ctaggaggcgggggctgcagta

SEQ ID NO: 10027990 - DNA, 22 bp, Homo sapiens
ctagctgacgggttgataggtg

SEQ ID NO: 10027991 - DNA, 22 bp, Homo sapiens
ctatatgcctgtgcagtctttg

SEQ ID NO: 10027992 - DNA, 22 bp, Homo sapiens
agtcaagtaggacctgttctag

SEQ ID NO: 10027993 - DNA, 22 bp, Homo sapiens
agtcaataaaagctttagattc

SEQ ID NO: 10027994 - DNA, 22 bp, Homo sapiens
agtcaatattcaagtgtaaata

SEQ ID NO: 10027995 - DNA, 22 bp, Homo sapiens
agtaaatgaaagcaattttaga

SEQ ID NO: 10027996 - DNA, 22 bp, Homo sapiens
ccttctctactcctgatgcatg

SEQ ID NO: 10027997 - DNA, 22 bp, Homo sapiens
ccttcattgcatctttaagaga

SEQ ID NO: 10027998 - DNA, 19 bp, Homo sapiens
ccttccagctccttttcag

SEQ ID NO: 10027999 - DNA, 22 bp, Homo sapiens
aggtcctggtcttgagtcttaa

SEQ ID NO: 10028000 - DNA, 22 bp, Homo sapiens
actgccaatggtagtttgatgg

SEQ ID NO: 10028001 - DNA, 22 bp, Homo sapiens
actgcctgcatccttagggtag

SEQ ID NO: 10028002 - DNA, 22 bp, Homo sapiens
actgagagtcaagatagcatgg

SEQ ID NO: 10028003 - DNA, 22 bp, Homo sapiens
actgagctccctgagggcaggc

SEQ ID NO: 10028004 - DNA, 22 bp, Homo sapiens
actctgaaccagagatcatacc

SEQ ID NO: 10028005 - DNA, 22 bp, Homo sapiens
actctgaatgtgcatgtaaatc

SEQ ID NO: 10028006 - DNA, 22 bp, Homo sapiens
actctgaaccaattcgcaatga

SEQ ID NO: 10028007 - DNA, 21 bp, Homo sapiens
actctgaaaattaatagttat

SEQ ID NO: 10028008 - DNA, 22 bp, Homo sapiens
agtgctcataaaaatgtgaaac

SEQ ID NO: 10028009 - DNA, 22 bp, Homo sapiens
actctcccttggagcctcaggc

SEQ ID NO: 10028010 - DNA, 22 bp, Homo sapiens
actctctcacagcttggctgat

SEQ ID NO: 10028011 - DNA, 22 bp, Homo sapiens
actctctcacacacgcctatat

SEQ ID NO: 10028012 - DNA, 22 bp, Homo sapiens
actctctctgatggaactttag

SEQ ID NO: 10028013 - DNA, 22 bp, Homo sapiens
agtcacttccagacacctgcct

SEQ ID NO: 10028014 - DNA, 22 bp, Homo sapiens
actccctctctagtccttgcaa

SEQ ID NO: 10028015 - DNA, 22 bp, Homo sapiens
ataaagtagccactggaaagct

SEQ ID NO: 10028016 - DNA, 22 bp, Homo sapiens
ataatttttgtttgatgtccaa

SEQ ID NO: 10028017 - DNA, 21 bp, Homo sapiens
actttaatatacatgaggagg

SEQ ID NO: 10028018 - DNA, 22 bp, Homo sapiens
atacatctagagtcataaaaac

SEQ ID NO: 10028019 - DNA, 22 bp, Homo sapiens
atccccacgatatagccaaagc

SEQ ID NO: 10028020 - DNA, 22 bp, Homo sapiens
atcccacacccctacaacatat

SEQ ID NO: 10028021 - DNA, 21 bp, Homo sapiens
agaaaaaccagcatgttttca

SEQ ID NO: 10028022 - DNA, 22 bp, Homo sapiens
atcaaaaccttgacttttaatg

SEQ ID NO: 10028023 - DNA, 21 bp, Homo sapiens
atatttctcataaggttatgg

SEQ ID NO: 10028024 - DNA, 17 bp, Homo sapiens
atcagtagcatatcaga

SEQ ID NO: 10028025 - DNA, 22 bp, Homo sapiens
agaaatcatgactaagagcagt

SEQ ID NO: 10028026 - DNA, 22 bp, Homo sapiens
agaaatcaggaacagtaaggag

SEQ ID NO: 10028027 - DNA, 22 bp, Homo sapiens
aggagggacaccaatatatgtt

SEQ ID NO: 10028028 - DNA, 22 bp, Homo sapiens
aggagggaataagaaagagtca

SEQ ID NO: 10028029 - DNA, 17 bp, Homo sapiens
aggagggaaatagcttg

SEQ ID NO: 10028030 - DNA, 22 bp, Homo sapiens
aggagggagatgcccatcctgg

SEQ ID NO: 10028031 - DNA, 22 bp, Homo sapiens
aggagggacctaggaatattgc

SEQ ID NO: 10028032 - DNA, 20 bp, Homo sapiens
aggagggacctggattggcg

SEQ ID NO: 10028033 - DNA, 21 bp, Homo sapiens
acatacataccttaccacctt

SEQ ID NO: 10028034 - DNA, 22 bp, Homo sapiens
acatacatatgtttaaatgcat

SEQ ID NO: 10028035 - DNA, 23 bp, Homo sapiens
acatacatggagataaagtgatg

SEQ ID NO: 10028036 - DNA, 23 bp, Homo sapiens
acatacatggagataaagtgatg

SEQ ID NO: 10028037 - DNA, 22 bp, Homo sapiens
acatacacatgaatatattttt

SEQ ID NO: 10028038 - DNA, 22 bp, Homo sapiens
acatacacaagcgtacatgaac

SEQ ID NO: 10028039 - DNA, 22 bp, Homo sapiens
acataaatttcactgttccgtg

SEQ ID NO: 10028040 - DNA, 22 bp, Homo sapiens
agctttgtgactttgagctagt

SEQ ID NO: 10028041 - DNA, 22 bp, Homo sapiens
agctttatgggagcttagataa

SEQ ID NO: 10028042 - DNA, 23 bp, Homo sapiens
agcttttaggtggaaatggcact

SEQ ID NO: 10028043 - DNA, 22 bp, Homo sapiens
aggaaactaacttatctttata

SEQ ID NO: 10028044 - DNA, 19 bp, Homo sapiens
aggaaactgtcttttccag

SEQ ID NO: 10028045 - DNA, 22 bp, Homo sapiens
aggaaactgatgttttttacaa

SEQ ID NO: 10028046 - DNA, 22 bp, Homo sapiens
acagccagtcatctcagcaggg

SEQ ID NO: 10028047 - DNA, 22 bp, Homo sapiens
accaaggaagaatctatttgag

SEQ ID NO: 10028048 - DNA, 22 bp, Homo sapiens
accaaggaagagattctcagtt

SEQ ID NO: 10028049 - DNA, 22 bp, Homo sapiens
accaaggagaaggtgcaagctt

SEQ ID NO: 10028050 - DNA, 22 bp, Homo sapiens
accaaggagacaaaggtgtatt

SEQ ID NO: 10028051 - DNA, 22 bp, Homo sapiens
accaaggagccacatacaacct

SEQ ID NO: 10028052 - DNA, 22 bp, Homo sapiens
accaaggagtttggtattttag

SEQ ID NO: 10028053 - DNA, 20 bp, Homo sapiens
accccacagagtccattgca

SEQ ID NO: 10028054 - DNA, 22 bp, Homo sapiens
accccagctctgagccacacca

SEQ ID NO: 10028055 - DNA, 20 bp, Homo sapiens
accccagcccctctatctga

SEQ ID NO: 10028056 - DNA, 19 bp, Homo sapiens
acattcccatcagcaatgt

SEQ ID NO: 10028057 - DNA, 22 bp, Homo sapiens
acattctagatatgttatattt

SEQ ID NO: 10028058 - DNA, 22 bp, Homo sapiens
acatacatgggattaaaaaatt

SEQ ID NO: 10028059 - DNA, 22 bp, Homo sapiens
attacagaaatatggtcaaaga

SEQ ID NO: 10028060 - DNA, 22 bp, Homo sapiens
agagtcccagggacactccaga

SEQ ID NO: 10028061 - DNA, 19 bp, Homo sapiens
agagtattgaatttgccct

SEQ ID NO: 10028062 - DNA, 21 bp, Homo sapiens
agatcattcttctgagcactt

SEQ ID NO: 10028063 - DNA, 22 bp, Homo sapiens
agcaactgttacaagaacaaca

SEQ ID NO: 10028064 - DNA, 22 bp, Homo sapiens
agacaaatttcctgcaatgaag

SEQ ID NO: 10028065 - DNA, 22 bp, Homo sapiens
atctgcttcctccttagggaaa

SEQ ID NO: 10028066 - DNA, 22 bp, Homo sapiens
agacctgtgatcacatggaatg

SEQ ID NO: 10028067 - DNA, 22 bp, Homo sapiens
agactttcttgacctagttaat

SEQ ID NO: 10028068 - DNA, 21 bp, Homo sapiens
agagagggagatgaaacatcc

SEQ ID NO: 10028069 - DNA, 22 bp, Homo sapiens
agagagggaatatttggggtat

SEQ ID NO: 10028070 - DNA, 22 bp, Homo sapiens
agagaattctggtgctaacaag

SEQ ID NO: 10028071 - DNA, 22 bp, Homo sapiens
agccagcccctgactgtgtcct

SEQ ID NO: 10028072 - DNA, 20 bp, Homo sapiens
agccagccacttcctgctcc

SEQ ID NO: 10028073 - DNA, 19 bp, Homo sapiens
agccagccagcaggtatgc

SEQ ID NO: 10028074 - DNA, 22 bp, Homo sapiens
agctagcctaggcagagtgcat

SEQ ID NO: 10028075 - DNA, 22 bp, Homo sapiens
cagcaagaacagcctgatgtgc

SEQ ID NO: 10028076 - DNA, 22 bp, Homo sapiens
cactgtgtcagagtatgatgat

SEQ ID NO: 10028077 - DNA, 22 bp, Homo sapiens
cactgtgtctggagtgagctgg

SEQ ID NO: 10028078 - DNA, 22 bp, Homo sapiens
agcactgtgatttataacattt

SEQ ID NO: 10028079 - DNA, 22 bp, Homo sapiens
cacagagcaggtgctgggaaga

SEQ ID NO: 10028080 - DNA, 21 bp, Homo sapiens
agaaaatggcgttttagattt

SEQ ID NO: 10028081 - DNA, 22 bp, Homo sapiens
agaaaattactccagagacaag

SEQ ID NO: 10028082 - DNA, 22 bp, Homo sapiens
aatcttcacagagaaaattagg

SEQ ID NO: 10028083 - DNA, 22 bp, Homo sapiens
aatctattccctttctgtaaaa

SEQ ID NO: 10028084 - DNA, 19 bp, Homo sapiens
actgtgctcgggaaccact

SEQ ID NO: 10028085 - DNA, 22 bp, Homo sapiens
acttatttcatggatcataatg

SEQ ID NO: 10028086 - DNA, 22 bp, Homo sapiens
aagtaaatatctgtttatagca

SEQ ID NO: 10028087 - DNA, 22 bp, Homo sapiens
aagtaaatgttggagctcaaat

SEQ ID NO: 10028088 - DNA, 21 bp, Homo sapiens
aagtaaatcagagaaataacc

SEQ ID NO: 10028089 - DNA, 22 bp, Homo sapiens
acctttatagcaacctggtgaa

SEQ ID NO: 10028090 - DNA, 22 bp, Homo sapiens
aagtgacataccttacatatgt

SEQ ID NO: 10028091 - DNA, 22 bp, Homo sapiens
aagtgacacatggcacttctat

SEQ ID NO: 10028092 - DNA, 22 bp, Homo sapiens
aagtgatgctacgactttgaca

SEQ ID NO: 10028093 - DNA, 22 bp, Homo sapiens
actgaccagatctttgagctta

SEQ ID NO: 10028094 - DNA, 22 bp, Homo sapiens
acataatgagctctttataaat

SEQ ID NO: 10028095 - DNA, 22 bp, Homo sapiens
acataatggacaataatgcatc

SEQ ID NO: 10028096 - DNA, 22 bp, Homo sapiens
acataatgaaatgcagaaatca

SEQ ID NO: 10028097 - DNA, 22 bp, Homo sapiens
acataagttatggataaaatgt

SEQ ID NO: 10028098 - DNA, 22 bp, Homo sapiens
acataagtgcacaataaatatt

SEQ ID NO: 10028099 - DNA, 23 bp, Homo sapiens
acatagaacagaatatatttgtg

SEQ ID NO: 10028100 - DNA, 22 bp, Homo sapiens
acattctatttcatcatgtcta

SEQ ID NO: 10028101 - DNA, 22 bp, Homo sapiens
acaggctgacttcctgccatgt

SEQ ID NO: 10028102 - DNA, 22 bp, Homo sapiens
acaggtcctcaagtcagctggg

SEQ ID NO: 10028103 - DNA, 22 bp, Homo sapiens
agcatccagcatcctatagaaa

SEQ ID NO: 10028104 - DNA, 19 bp, Homo sapiens
agcatccagtcatgggatc

SEQ ID NO: 10028105 - DNA, 22 bp, Homo sapiens
acacactggcccccagtactga

SEQ ID NO: 10028106 - DNA, 22 bp, Homo sapiens
acacactttaaattaaacctct

SEQ ID NO: 10028107 - DNA, 22 bp, Homo sapiens
acacactgttgctcatccaggc

SEQ ID NO: 10028108 - DNA, 22 bp, Homo sapiens
acacactgtaaggactatcact

SEQ ID NO: 10028109 - DNA, 22 bp, Homo sapiens
acacacatgcctttcctaagta

SEQ ID NO: 10028110 - DNA, 18 bp, Homo sapiens
acacacacacctgtgtat

SEQ ID NO: 10028111 - DNA, 21 bp, Homo sapiens
acacactgagttttccactgt

SEQ ID NO: 10028112 - DNA, 21 bp, Homo sapiens
acacactctgagtcttctatt

SEQ ID NO: 10028113 - DNA, 22 bp, Homo sapiens
acacactcaattgcataagcac

SEQ ID NO: 10028114 - DNA, 22 bp, Homo sapiens
acacacatggtattgttcagaa

SEQ ID NO: 10028115 - DNA, 22 bp, Homo sapiens
agcccaggtctggcccagcctg

SEQ ID NO: 10028116 - DNA, 22 bp, Homo sapiens
agagatatgctgcctaaattta

SEQ ID NO: 10028117 - DNA, 22 bp, Homo sapiens
aatgtataaccataggaaattt

SEQ ID NO: 10028118 - DNA, 22 bp, Homo sapiens
agacctctgctcccttcatggt

SEQ ID NO: 10028119 - DNA, 22 bp, Homo sapiens
agacctctacgtgcgtctcatc

SEQ ID NO: 10028120 - DNA, 22 bp, Homo sapiens
agacctctggatagatgtgagg

SEQ ID NO: 10028121 - DNA, 22 bp, Homo sapiens
aatgtactaataagcaacattt

SEQ ID NO: 10028122 - DNA, 22 bp, Homo sapiens
aatgtacactgaaagcctatca

SEQ ID NO: 10028123 - DNA, 22 bp, Homo sapiens
aatttcaagtggcatctttgat

SEQ ID NO: 10028124 - DNA, 22 bp, Homo sapiens
agatcggctttgcagacctcat

SEQ ID NO: 10028125 - DNA, 22 bp, Homo sapiens
agatgttttctaattctatatt

SEQ ID NO: 10028126 - DNA, 22 bp, Homo sapiens
aactgagcaccactgatgttat

SEQ ID NO: 10028127 - DNA, 22 bp, Homo sapiens
aacatttctgagaatatcagtt

SEQ ID NO: 10028128 - DNA, 22 bp, Homo sapiens
aacacataggcagagcatgaca

SEQ ID NO: 10028129 - DNA, 21 bp, Homo sapiens
aacacatccagagtatttgac

SEQ ID NO: 10028130 - DNA, 22 bp, Homo sapiens
aacacatatttatatatgcaca

SEQ ID NO: 10028131 - DNA, 22 bp, Homo sapiens
aacaaatgtgttttgtaattaa

SEQ ID NO: 10028132 - DNA, 22 bp, Homo sapiens
aagaaagtgggtaatatgattt

SEQ ID NO: 10028133 - DNA, 22 bp, Homo sapiens
aagaaataagacttctctgtcc

SEQ ID NO: 10028134 - DNA, 22 bp, Homo sapiens
aactttgtcttttatgcttaca

SEQ ID NO: 10028135 - DNA, 22 bp, Homo sapiens
aactttgtgtgtttaatatggc

SEQ ID NO: 10028136 - DNA, 22 bp, Homo sapiens
aaaggaggaatggagagatgct

SEQ ID NO: 10028137 - DNA, 22 bp, Homo sapiens
aaatatgtaaccaaggtgaagt

SEQ ID NO: 10028138 - DNA, 22 bp, Homo sapiens
aaactactggattagtaactta

SEQ ID NO: 10028139 - DNA, 23 bp, Homo sapiens
aaacttgctatggctgaaatcat

SEQ ID NO: 10028140 - DNA, 23 bp, Homo sapiens
aaacttgctatggctgaaatcat

SEQ ID NO: 10028141 - DNA, 22 bp, Homo sapiens
aaacttgagccaagggcttggg

SEQ ID NO: 10028142 - DNA, 22 bp, Homo sapiens
aaacattgttatgataaattac

SEQ ID NO: 10028143 - DNA, 22 bp, Homo sapiens
aaaccatggagtaagttcacat

SEQ ID NO: 10028144 - DNA, 19 bp, Homo sapiens
aaacacagatttcttacca

SEQ ID NO: 10028145 - DNA, 22 bp, Homo sapiens
aaacaactcggcaactgctttt

SEQ ID NO: 10028146 - DNA, 22 bp, Homo sapiens
aaaaagacttccaactcaggag

SEQ ID NO: 10028147 - DNA, 21 bp, Homo sapiens
aaaaatgaagttgttcaggaa

SEQ ID NO: 10028148 - DNA, 22 bp, Homo sapiens
aaaaatgaattcttcagtggca

SEQ ID NO: 10028149 - DNA, 22 bp, Homo sapiens
aaaaatgcttggacttaataaa

SEQ ID NO: 10028150 - DNA, 22 bp, Homo sapiens
aaaagtctgctctcatttcaga

SEQ ID NO: 10028151 - DNA, 22 bp, Homo sapiens
aaaagtctacaagcttcaacaa

SEQ ID NO: 10028152 - DNA, 22 bp, Homo sapiens
aatatttgcatcattagctatt

SEQ ID NO: 10028153 - DNA, 22 bp, Homo sapiens
aagttgctagtgcttttctgag

SEQ ID NO: 10028154 - DNA, 22 bp, Homo sapiens
aagttgctaaaggagttctttg

SEQ ID NO: 10028155 - DNA, 22 bp, Homo sapiens
aaattagtcggtttaggaattt

SEQ ID NO: 10028156 - DNA, 22 bp, Homo sapiens
aatgtcaaaggctatacattca

SEQ ID NO: 10028157 - DNA, 22 bp, Homo sapiens
aatgtcaagtagccaatgcttc

SEQ ID NO: 10028158 - DNA, 22 bp, Homo sapiens
aatgtcttgagaagagaaatct

SEQ ID NO: 10028159 - DNA, 22 bp, Homo sapiens
acaacttctcacagataaattt

SEQ ID NO: 10028160 - DNA, 22 bp, Homo sapiens
aattcaatctaagaaatgatca

SEQ ID NO: 10028161 - DNA, 22 bp, Homo sapiens
acacacaggtaaaggagcctgg

SEQ ID NO: 10028162 - DNA, 22 bp, Homo sapiens
acacacatgcatgcttgccatt

SEQ ID NO: 10028163 - DNA, 22 bp, Homo sapiens
acacacagagtttatacaggca

SEQ ID NO: 10028164 - DNA, 22 bp, Homo sapiens
acacacagcgcctaccatgtgc

SEQ ID NO: 10028165 - DNA, 22 bp, Homo sapiens
acacacagaaggaagccccact

SEQ ID NO: 10028166 - DNA, 23 bp, Homo sapiens
acacctgtgctgtagtcactaca

SEQ ID NO: 10028167 - DNA, 22 bp, Homo sapiens
acagaagaccaagaaagcttcc

SEQ ID NO: 10028168 - DNA, 22 bp, Homo sapiens
acagaagacagagtgttcatct

SEQ ID NO: 10028169 - DNA, 22 bp, Homo sapiens
acagaagagctggctctgtgct

SEQ ID NO: 10028170 - DNA, 22 bp, Homo sapiens
aagatttcttacttattgatgc

SEQ ID NO: 10028171 - DNA, 22 bp, Homo sapiens
ggcactgggtgagggtcactgg

SEQ ID NO: 10028172 - DNA, 22 bp, Homo sapiens
ggagcacaccgggagcttgcct

SEQ ID NO: 10028173 - DNA, 21 bp, Homo sapiens
gggagggatggaaatgatgtt

SEQ ID NO: 10028174 - DNA, 22 bp, Homo sapiens
gggagggattagttctgcctgg

SEQ ID NO: 10028175 - DNA, 22 bp, Homo sapiens
gggagggacacaaagagttccc

SEQ ID NO: 10028176 - DNA, 22 bp, Homo sapiens
gggagggagaggacagttctat

SEQ ID NO: 10028177 - DNA, 22 bp, Homo sapiens
gggagggaggtgatgcttggct

SEQ ID NO: 10028178 - DNA, 22 bp, Homo sapiens
gggagggatctgctaggcaatg

SEQ ID NO: 10028179 - DNA, 22 bp, Homo sapiens
gggagggaggtgctggttcacg

SEQ ID NO: 10028180 - DNA, 16 bp, Homo sapiens
gggagggagttggtgg

SEQ ID NO: 10028181 - DNA, 22 bp, Homo sapiens
gtcctctgcccaggtcaaggtt

SEQ ID NO: 10028182 - DNA, 22 bp, Homo sapiens
gtcctctgagggggctgcacgc

SEQ ID NO: 10028183 - DNA, 22 bp, Homo sapiens
gtcctctgatttctaggtatat

SEQ ID NO: 10028184 - DNA, 22 bp, Homo sapiens
gtcctctgactcagccttggga

SEQ ID NO: 10028185 - DNA, 22 bp, Homo sapiens
gtcctctgaaagatgaaccatg

SEQ ID NO: 10028186 - DNA, 22 bp, Homo sapiens
gtcctctgaagttgtgcaatgc

SEQ ID NO: 10028187 - DNA, 22 bp, Homo sapiens
gtcaatatcttggttgtactat

SEQ ID NO: 10028188 - DNA, 17 bp, Homo sapiens
gtcaatattgttgacag

SEQ ID NO: 10028189 - DNA, 22 bp, Homo sapiens
gtaatattcagctattgagttg

SEQ ID NO: 10028190 - DNA, 22 bp, Homo sapiens
gtaagtctgagtgtaattcaca

SEQ ID NO: 10028191 - DNA, 17 bp, Homo sapiens
gtaaggcttgcagatgc

SEQ ID NO: 10028192 - DNA, 22 bp, Homo sapiens
gtaaatcatggtcagaataaat

SEQ ID NO: 10028193 - DNA, 22 bp, Homo sapiens
gtctctctgctaggcctccagt

SEQ ID NO: 10028194 - DNA, 22 bp, Homo sapiens
gtctcgtcaatggcaggttccc

SEQ ID NO: 10028195 - DNA, 22 bp, Homo sapiens
gtgatacaaataaacatatgct

SEQ ID NO: 10028196 - DNA, 22 bp, Homo sapiens
gtgatgaagtaaatgttattta

SEQ ID NO: 10028197 - DNA, 22 bp, Homo sapiens
gggtccagaatgagaatgggct

SEQ ID NO: 10028198 - DNA, 22 bp, Homo sapiens
ggtcttgctatgttgcccaggc

SEQ ID NO: 10028199 - DNA, 20 bp, Homo sapiens
gcatccatatatgcatgtgt

SEQ ID NO: 10028200 - DNA, 22 bp, Homo sapiens
gcatgaaatgagcgaatataat

SEQ ID NO: 10028201 - DNA, 22 bp, Homo sapiens
gcatttgtacaaaatgcagtag

SEQ ID NO: 10028202 - DNA, 22 bp, Homo sapiens
gcatttccttgatggctaatga

SEQ ID NO: 10028203 - DNA, 22 bp, Homo sapiens
gcagtatctatgtgatgggttg

SEQ ID NO: 10028204 - DNA, 22 bp, Homo sapiens
gccaaggagacacggtgttgta

SEQ ID NO: 10028205 - DNA, 22 bp, Homo sapiens
gccaaggaaggcttcctggaag

SEQ ID NO: 10028206 - DNA, 22 bp, Homo sapiens
gccaaggataccagctgtgaga

SEQ ID NO: 10028207 - DNA, 21 bp, Homo sapiens
gccaaggaggctagagaacat

SEQ ID NO: 10028208 - DNA, 20 bp, Homo sapiens
gccaaggaggagaaacaggc

SEQ ID NO: 10028209 - DNA, 22 bp, Homo sapiens
gccagtcttcatattcatggtg

SEQ ID NO: 10028210 - DNA, 22 bp, Homo sapiens
gcaaatcaccacctagctggat

SEQ ID NO: 10028211 - DNA, 22 bp, Homo sapiens
gcactggattttgatctgcaag

SEQ ID NO: 10028212 - DNA, 17 bp, Homo sapiens
gcactcccccacctcct

SEQ ID NO: 10028213 - DNA, 22 bp, Homo sapiens
ggacctgttcttgggcagaact

SEQ ID NO: 10028214 - DNA, 20 bp, Homo sapiens
ggaccctgggttcttctgag

SEQ ID NO: 10028215 - DNA, 23 bp, Homo sapiens
ggacacatttatttcagaattca

SEQ ID NO: 10028216 - DNA, 22 bp, Homo sapiens
ggacacagtggaagacagcttg

SEQ ID NO: 10028217 - DNA, 22 bp, Homo sapiens
ggaaatcaaggggacaaattgt

SEQ ID NO: 10028218 - DNA, 20 bp, Homo sapiens
ggaaatcaccaggctccacc

SEQ ID NO: 10028219 - DNA, 22 bp, Homo sapiens
ggaaatcaagaagcagatgagt

SEQ ID NO: 10028220 - DNA, 22 bp, Homo sapiens
gcttccatctatgtcttcatca

SEQ ID NO: 10028221 - DNA, 22 bp, Homo sapiens
gctctcactttaggttggaccg

SEQ ID NO: 10028222 - DNA, 22 bp, Homo sapiens
gctctatgttgaccttcagtgg

SEQ ID NO: 10028223 - DNA, 22 bp, Homo sapiens
gccttattttactcaactgtaa

SEQ ID NO: 10028224 - DNA, 22 bp, Homo sapiens
gcctggtggacactgggcatca

SEQ ID NO: 10028225 - DNA, 22 bp, Homo sapiens
gcctggtggtatcctggcaaga

SEQ ID NO: 10028226 - DNA, 22 bp, Homo sapiens
gcctggtggtgtgctcaagtgg

SEQ ID NO: 10028227 - DNA, 22 bp, Homo sapiens
tcagcctcattttctgctctgt

SEQ ID NO: 10028228 - DNA, 22 bp, Homo sapiens
tcagccagtgccttgatcttgc

SEQ ID NO: 10028229 - DNA, 23 bp, Homo sapiens
tcagcctcttaggacttctcacc

SEQ ID NO: 10028230 - DNA, 21 bp, Homo sapiens
tcatatttctcttgctattgt

SEQ ID NO: 10028231 - DNA, 21 bp, Homo sapiens
tcatccaggtcctgcttcttc

SEQ ID NO: 10028232 - DNA, 22 bp, Homo sapiens
tcagttactcctttccttaggt

SEQ ID NO: 10028233 - DNA, 16 bp, Homo sapiens
tcacatacttccttgc

SEQ ID NO: 10028234 - DNA, 22 bp, Homo sapiens
tcacacacatttgctgtctgat

SEQ ID NO: 10028235 - DNA, 21 bp, Homo sapiens
tcacacacgtttccaagggca

SEQ ID NO: 10028236 - DNA, 22 bp, Homo sapiens
tcacacacatggatagtatttt

SEQ ID NO: 10028237 - DNA, 22 bp, Homo sapiens
tcacacacataatctaagatta

SEQ ID NO: 10028238 - DNA, 22 bp, Homo sapiens
tcacacagctgacagagccttt

SEQ ID NO: 10028239 - DNA, 22 bp, Homo sapiens
tcacacagctcctttccttagt

SEQ ID NO: 10028240 - DNA, 22 bp, Homo sapiens
tcaaaagtttcacatagagata

SEQ ID NO: 10028241 - DNA, 22 bp, Homo sapiens
tcactgggtaggacatgctgat

SEQ ID NO: 10028242 - DNA, 22 bp, Homo sapiens
tcactggggcccacatcaacat

SEQ ID NO: 10028243 - DNA, 22 bp, Homo sapiens
tcactggggagcactgacatgt

SEQ ID NO: 10028244 - DNA, 17 bp, Homo sapiens
tcactgggcctgctccc

SEQ ID NO: 10028245 - DNA, 22 bp, Homo sapiens
tcactacaacctccgcctcctg

SEQ ID NO: 10028246 - DNA, 22 bp, Homo sapiens
tcaccgaggctggagtgcagtg

SEQ ID NO: 10028247 - DNA, 22 bp, Homo sapiens
tcaccttgaatgcagcagcgtg

SEQ ID NO: 10028248 - DNA, 22 bp, Homo sapiens
tcacatgcagtcactgagcagg

SEQ ID NO: 10028249 - DNA, 22 bp, Homo sapiens
tcacatgccacagatgaggcaa

SEQ ID NO: 10028250 - DNA, 20 bp, Homo sapiens
tcagagagagggtgccactt

SEQ ID NO: 10028251 - DNA, 22 bp, Homo sapiens
tcccttctggcagcagtgtgag

SEQ ID NO: 10028252 - DNA, 22 bp, Homo sapiens
tcccacatatgcaatcctgaat

SEQ ID NO: 10028253 - DNA, 22 bp, Homo sapiens
tccagtcttcttgcagctacat

SEQ ID NO: 10028254 - DNA, 22 bp, Homo sapiens
tccacacacatttctatgtgca

SEQ ID NO: 10028255 - DNA, 22 bp, Homo sapiens
tcattaagattacgtgccagaa

SEQ ID NO: 10028256 - DNA, 22 bp, Homo sapiens
tcatgtttgagactaatttttc

SEQ ID NO: 10028257 - DNA, 20 bp, Homo sapiens
tcatgtgtgtcctacagaga

SEQ ID NO: 10028258 - DNA, 22 bp, Homo sapiens
tccacgtgagcttcgtgtgcag

SEQ ID NO: 10028259 - DNA, 22 bp, Homo sapiens
tatgtttagtatccattttcag

SEQ ID NO: 10028260 - DNA, 22 bp, Homo sapiens
tatgttgcaccaacctaataat

SEQ ID NO: 10028261 - DNA, 22 bp, Homo sapiens
tatgctgaatttggtttgctat

SEQ ID NO: 10028262 - DNA, 22 bp, Homo sapiens
tatgtttagtatccattttcag

SEQ ID NO: 10028263 - DNA, 22 bp, Homo sapiens
tatgtttatactttgatgtact

SEQ ID NO: 10028264 - DNA, 22 bp, Homo sapiens
tattcactgtaactcagcaata

SEQ ID NO: 10028265 - DNA, 22 bp, Homo sapiens
tatttgtatgtgtgtacatata

SEQ ID NO: 10028266 - DNA, 22 bp, Homo sapiens
tatttgtatttcatgcagtaaa

SEQ ID NO: 10028267 - DNA, 22 bp, Homo sapiens
tatttctaagagatatctgtac

SEQ ID NO: 10028268 - DNA, 20 bp, Homo sapiens
tatattttctctttggcctt

SEQ ID NO: 10028269 - DNA, 22 bp, Homo sapiens
tatgcataggtatctatactca

SEQ ID NO: 10028270 - DNA, 22 bp, Homo sapiens
tatactgtcgcattacactcac

SEQ ID NO: 10028271 - DNA, 22 bp, Homo sapiens
tatactgtaggtgcagaaagaa

SEQ ID NO: 10028272 - DNA, 22 bp, Homo sapiens
tatactctgagaaacgtgtcac

SEQ ID NO: 10028273 - DNA, 22 bp, Homo sapiens
tatacagaacattaagaactgt

SEQ ID NO: 10028274 - DNA, 20 bp, Homo sapiens
tatatgtgtacatacacaca

SEQ ID NO: 10028275 - DNA, 22 bp, Homo sapiens
tatatgctaatggtgccattcc

SEQ ID NO: 10028276 - DNA, 22 bp, Homo sapiens
tatatgctctgggatcctgaaa

SEQ ID NO: 10028277 - DNA, 22 bp, Homo sapiens
tatatgcatgcccatgtataca

SEQ ID NO: 10028278 - DNA, 22 bp, Homo sapiens
tatatgcagattttcatcatcg

SEQ ID NO: 10028279 - DNA, 22 bp, Homo sapiens
tagtgtatgataaaaaattctt

SEQ ID NO: 10028280 - DNA, 22 bp, Homo sapiens
tactttcttgttcctttcataa

SEQ ID NO: 10028281 - DNA, 22 bp, Homo sapiens
tactttctgtccttctgttaaa

SEQ ID NO: 10028282 - DNA, 22 bp, Homo sapiens
tagatgtagccactgctaaaag

SEQ ID NO: 10028283 - DNA, 22 bp, Homo sapiens
tagatgtaagcagaagaacagc

SEQ ID NO: 10028284 - DNA, 22 bp, Homo sapiens
tagattttacttctgtcattac

SEQ ID NO: 10028285 - DNA, 22 bp, Homo sapiens
tagattttaggagattttactg

SEQ ID NO: 10028286 - DNA, 21 bp, Homo sapiens
tagcagaaacagttcaggcca

SEQ ID NO: 10028287 - DNA, 22 bp, Homo sapiens
tagcaccaaacatatactcagt

SEQ ID NO: 10028288 - DNA, 22 bp, Homo sapiens
gtttcttaaatgtagcaggacc

SEQ ID NO: 10028289 - DNA, 22 bp, Homo sapiens
gtttctaaatgttctgagtttt

SEQ ID NO: 10028290 - DNA, 22 bp, Homo sapiens
gtttctatggtttatattactg

SEQ ID NO: 10028291 - DNA, 22 bp, Homo sapiens
gtgtgtttagcattagcagggg

SEQ ID NO: 10028292 - DNA, 22 bp, Homo sapiens
gtgttaattattggtgaataga

SEQ ID NO: 10028293 - DNA, 22 bp, Homo sapiens
taagataatccattataatgtt

SEQ ID NO: 10028294 - DNA, 22 bp, Homo sapiens
taagatggcagatgagcttgtt

SEQ ID NO: 10028295 - DNA, 22 bp, Homo sapiens
taactgtaatataaatatgagt

SEQ ID NO: 10028296 - DNA, 22 bp, Homo sapiens
taaatacagtcatttgagccat

SEQ ID NO: 10028297 - DNA, 22 bp, Homo sapiens
taatttctagggactaaggtgc

SEQ ID NO: 10028298 - DNA, 22 bp, Homo sapiens
tacacatccatgttttgacttt

SEQ ID NO: 10028299 - DNA, 22 bp, Homo sapiens
tacacatcccagactcccagga

SEQ ID NO: 10028300 - DNA, 22 bp, Homo sapiens
tacacatctctgtcagtagtga

SEQ ID NO: 10028301 - DNA, 22 bp, Homo sapiens
tacacatcactgtatctttcag

SEQ ID NO: 10028302 - DNA, 22 bp, Homo sapiens
taatgaggtgatgactaaggtc

SEQ ID NO: 10028303 - DNA, 22 bp, Homo sapiens
taatgaggcatttgagtcacct

SEQ ID NO: 10028304 - DNA, 22 bp, Homo sapiens
taatgaggcaagagtcatggct

SEQ ID NO: 10028305 - DNA, 22 bp, Homo sapiens
taatgaggaaatagagggaatg

SEQ ID NO: 10028306 - DNA, 22 bp, Homo sapiens
taatgctaacatcatatcactg

SEQ ID NO: 10028307 - DNA, 22 bp, Homo sapiens
taatttctaattcattttcagt

SEQ ID NO: 10028308 - DNA, 22 bp, Homo sapiens
tactgacacaaagccaatccct

SEQ ID NO: 10028309 - DNA, 22 bp, Homo sapiens
tacctgggcccaccagtgcctg

SEQ ID NO: 10028310 - DNA, 22 bp, Homo sapiens
tactgagctggtccactgaggt

SEQ ID NO: 10028311 - DNA, 22 bp, Homo sapiens
tacataattaatctttaagttc

SEQ ID NO: 10028312 - DNA, 22 bp, Homo sapiens
ccttcttctgtgtggcccaaga

SEQ ID NO: 10028313 - DNA, 22 bp, Homo sapiens
cgatgaatatttaacgctgtga

SEQ ID NO: 10028314 - DNA, 22 bp, Homo sapiens
cgcaactcagcaacttaactgc

SEQ ID NO: 10028315 - DNA, 22 bp, Homo sapiens
ttatgtaagtggagtcatatag

SEQ ID NO: 10028316 - DNA, 22 bp, Homo sapiens
ttatgtaatttgtttgctcttc

SEQ ID NO: 10028317 - DNA, 22 bp, Homo sapiens
ttattattgtggttgcattatc

SEQ ID NO: 10028318 - DNA, 22 bp, Homo sapiens
ttcaaaacaatctgtttgcatt

SEQ ID NO: 10028319 - DNA, 22 bp, Homo sapiens
ttcaaaacagctagatattgga

SEQ ID NO: 10028320 - DNA, 22 bp, Homo sapiens
tggttcctcaagcgctggcggc

SEQ ID NO: 10028321 - DNA, 22 bp, Homo sapiens
tgttgctgtatgaataggaagg

SEQ ID NO: 10028322 - DNA, 22 bp, Homo sapiens
tgtttctagagaaaatatttac

SEQ ID NO: 10028323 - DNA, 22 bp, Homo sapiens
tgtttctaggtcaataattttt

SEQ ID NO: 10028324 - DNA, 22 bp, Homo sapiens
cctgtggaggctgctcagctgg

SEQ ID NO: 10028325 - DNA, 22 bp, Homo sapiens
ttaatgaaacattgactatgat

SEQ ID NO: 10028326 - DNA, 22 bp, Homo sapiens
ttaatgaaaggcagtttggaac

SEQ ID NO: 10028327 - DNA, 22 bp, Homo sapiens
ttaatgaatgtgtgctaacgtt

SEQ ID NO: 10028328 - DNA, 22 bp, Homo sapiens
ttaatgatacctatgttaattt

SEQ ID NO: 10028329 - DNA, 22 bp, Homo sapiens
tgttttctattacctgagattg

SEQ ID NO: 10028330 - DNA, 22 bp, Homo sapiens
ttaatatgttgaaatttattag

SEQ ID NO: 10028331 - DNA, 22 bp, Homo sapiens
ttaatatacaattttacgggct

SEQ ID NO: 10028332 - DNA, 22 bp, Homo sapiens
ttcttcatctgtaagataagca

SEQ ID NO: 10028333 - DNA, 22 bp, Homo sapiens
ctcactgcaagctctgcctcca

SEQ ID NO: 10028334 - DNA, 22 bp, Homo sapiens
ctcactgcaagctccgcctccc

SEQ ID NO: 10028335 - DNA, 22 bp, Homo sapiens
ctcactgcaagctctgcctccc

SEQ ID NO: 10028336 - DNA, 22 bp, Homo sapiens
ttcttaagtttagcaacttgtg

SEQ ID NO: 10028337 - DNA, 22 bp, Homo sapiens
ttcttaagaaaccatcacattc

SEQ ID NO: 10028338 - DNA, 22 bp, Homo sapiens
ttcttaagaggaacatttttgt

SEQ ID NO: 10028339 - DNA, 22 bp, Homo sapiens
ttcttaagcacctaaaaagtgg

SEQ ID NO: 10028340 - DNA, 22 bp, Homo sapiens
ttcttaagcagtttggcatgtt

SEQ ID NO: 10028341 - DNA, 22 bp, Homo sapiens
ttcttaagcgtatgataatgaa

SEQ ID NO: 10028342 - DNA, 22 bp, Homo sapiens
ttcttaagtatttcagagactg

SEQ ID NO: 10028343 - DNA, 22 bp, Homo sapiens
ttcttaaagaggcaaaacacag

SEQ ID NO: 10028344 - DNA, 22 bp, Homo sapiens
ctcagccccaattctccccatt

SEQ ID NO: 10028345 - DNA, 22 bp, Homo sapiens
ttgatttttccagcttctagag

SEQ ID NO: 10028346 - DNA, 22 bp, Homo sapiens
ttgatcaaatcagctactgagg

SEQ ID NO: 10028347 - DNA, 22 bp, Homo sapiens
ttgcactttatagaaacttttg

SEQ ID NO: 10028348 - DNA, 22 bp, Homo sapiens
ttgctgagtctgaattcatact

SEQ ID NO: 10028349 - DNA, 22 bp, Homo sapiens
ttgctgagtgaccaataaatat

SEQ ID NO: 10028350 - DNA, 22 bp, Homo sapiens
ttgctggtaaagtctttatcgg

SEQ ID NO: 10028351 - DNA, 22 bp, Homo sapiens
ttgctggagtagaaaacttaac

SEQ ID NO: 10028352 - DNA, 22 bp, Homo sapiens
ttgctggacatgaatcagatat

SEQ ID NO: 10028353 - DNA, 22 bp, Homo sapiens
ttccacattccttacattcata

SEQ ID NO: 10028354 - DNA, 22 bp, Homo sapiens
ttccaaattaaaatgtacaatg

SEQ ID NO: 10028355 - DNA, 22 bp, Homo sapiens
ttccaaattaaaatgtacaatg

SEQ ID NO: 10028356 - DNA, 20 bp, Homo sapiens
cgggacactcaagctctggg

SEQ ID NO: 10028357 - DNA, 22 bp, Homo sapiens
cgtcattgtcctggacttgcaa

SEQ ID NO: 10028358 - DNA, 22 bp, Homo sapiens
ttctcatgtaaatgccatcatc

SEQ ID NO: 10028359 - DNA, 22 bp, Homo sapiens
ttctcctttgtaattctcatcc

SEQ ID NO: 10028360 - DNA, 22 bp, Homo sapiens
tttcttcttgatttaaacaggg

SEQ ID NO: 10028361 - DNA, 22 bp, Homo sapiens
tttcttaaatatttgcaggaca

SEQ ID NO: 10028362 - DNA, 22 bp, Homo sapiens
ttgtttaatatcgtgaagtact

SEQ ID NO: 10028363 - DNA, 22 bp, Homo sapiens
ctcgtgatccgcccacctcagc

SEQ ID NO: 10028364 - DNA, 22 bp, Homo sapiens
ctgctgctgagaatgcctcagg

SEQ ID NO: 10028365 - DNA, 22 bp, Homo sapiens
ctgctgctcagtgtcatcatgt

SEQ ID NO: 10028366 - DNA, 22 bp, Homo sapiens
ctgctctgaagccaggattctg

SEQ ID NO: 10028367 - DNA, 22 bp, Homo sapiens
ctgctgccggcgagcctccctt

SEQ ID NO: 10028368 - DNA, 22 bp, Homo sapiens
ctgcctgcactgcctggctcca

SEQ ID NO: 10028369 - DNA, 22 bp, Homo sapiens
ctgagagatcaagccacaggat

SEQ ID NO: 10028370 - DNA, 22 bp, Homo sapiens
gaatctgaactccttgcggtga

SEQ ID NO: 10028371 - DNA, 22 bp, Homo sapiens
gaatctcaggggagttactgga

SEQ ID NO: 10028372 - DNA, 22 bp, Homo sapiens
gacacttcacctttcccagcct

SEQ ID NO: 10028373 - DNA, 22 bp, Homo sapiens
gaatgacgccctgtggtcactt

SEQ ID NO: 10028374 - DNA, 22 bp, Homo sapiens
gaccaggctagttcagagcttc

SEQ ID NO: 10028375 - DNA, 21 bp, Homo sapiens
gactctctagtgctgtccagt

SEQ ID NO: 10028376 - DNA, 22 bp, Homo sapiens
gagacctcttggtatcgctagg

SEQ ID NO: 10028377 - DNA, 22 bp, Homo sapiens
gagactttaaaaaacattaaga

SEQ ID NO: 10028378 - DNA, 22 bp, Homo sapiens
cttctataaactgtgatctttc

SEQ ID NO: 10028379 - DNA, 22 bp, Homo sapiens
cttagtttctgtttctgattaa

SEQ ID NO: 10028380 - DNA, 22 bp, Homo sapiens
cttcattggcttccatagatgc

SEQ ID NO: 10028381 - DNA, 22 bp, Homo sapiens
ctgtgctttcaaaagaagggtt

SEQ ID NO: 10028382 - DNA, 22 bp, Homo sapiens
ctgtgcttccaggatggcagct

SEQ ID NO: 10028383 - DNA, 21 bp, Homo sapiens
ctgtgcttcttcctaagccag

SEQ ID NO: 10028384 - DNA, 22 bp, Homo sapiens
ctgtgcttgacagtgggaagca

SEQ ID NO: 10028385 - DNA, 22 bp, Homo sapiens
ctgtgctttcgagatgtgatct

SEQ ID NO: 10028386 - DNA, 22 bp, Homo sapiens
cttacacagtctggcacttctt

SEQ ID NO: 10028387 - DNA, 22 bp, Homo sapiens
gaaaatttagaactgaacttct

SEQ ID NO: 10028388 - DNA, 22 bp, Homo sapiens
gaaaatacttcagtgttctggc

SEQ ID NO: 10028389 - DNA, 21 bp, Homo sapiens
ctttgcaagatgtctatgaaa

SEQ ID NO: 10028390 - DNA, 19 bp, Homo sapiens
ctttgcaaagccctgtgta

SEQ ID NO: 10028391 - DNA, 22 bp, Homo sapiens
ctgctgtgttcctcctgcatct

SEQ ID NO: 10028392 - DNA, 22 bp, Homo sapiens
ctgctgtgttgccagtgtcacc

SEQ ID NO: 10028393 - DNA, 22 bp, Homo sapiens
ctgctgtgttagcaggtttagt

SEQ ID NO: 10028394 - DNA, 22 bp, Homo sapiens
ctgctgtgcagacagactctct

SEQ ID NO: 10028395 - DNA, 22 bp, Homo sapiens
ctgctgtgttgccagtgtcacc

SEQ ID NO: 10028396 - DNA, 22 bp, Homo sapiens
ctgctgttccacctctgaatgc

SEQ ID NO: 10028397 - DNA, 22 bp, Homo sapiens
ctgggcttctccccctggcaga

SEQ ID NO: 10028398 - DNA, 22 bp, Homo sapiens
ctgggctttgaagccaggctgc

SEQ ID NO: 10028399 - DNA, 22 bp, Homo sapiens
ctggtgatcttgggcaagtcac

SEQ ID NO: 10028400 - DNA, 22 bp, Homo sapiens
ctggtgattacaatgatgacaa

SEQ ID NO: 10028401 - DNA, 22 bp, Homo sapiens
ctgtgcttcagagtcagtgctg

SEQ ID NO: 10028402 - DNA, 22 bp, Homo sapiens
ctgtataaccccatgcgactgt

SEQ ID NO: 10028403 - DNA, 22 bp, Homo sapiens
tacacagaacctggtgtacagt

SEQ ID NO: 10028404 - DNA, 22 bp, Homo sapiens
tacacagatatgtgatcaatca

SEQ ID NO: 10028405 - DNA, 22 bp, Homo sapiens
tacacagactcttcaattcaga

SEQ ID NO: 10028406 - DNA, 22 bp, Homo sapiens
tacacagatttcagtatcatca

SEQ ID NO: 10028407 - DNA, 22 bp, Homo sapiens
cagggcatgaggtgtgcttctc

SEQ ID NO: 10028408 - DNA, 22 bp, Homo sapiens
tagcataatttgtagaaaatca

SEQ ID NO: 10028409 - DNA, 22 bp, Homo sapiens
tacctattagaatgctttcagc

SEQ ID NO: 10028410 - DNA, 22 bp, Homo sapiens
tatgaagaagttctgtgaaatg

SEQ ID NO: 10028411 - DNA, 22 bp, Homo sapiens
tatgaagatatatctgatctct

SEQ ID NO: 10028412 - DNA, 22 bp, Homo sapiens
tatgaagaagacaaatgacact

SEQ ID NO: 10028413 - DNA, 22 bp, Homo sapiens
tatgaagaaatctttgaaaatc

SEQ ID NO: 10028414 - DNA, 22 bp, Homo sapiens
tcacacatttctcaagtgtagg

SEQ ID NO: 10028415 - DNA, 20 bp, Homo sapiens
tcacacatggtaagctatga

SEQ ID NO: 10028416 - DNA, 22 bp, Homo sapiens
tcacaccttttagaattactat

SEQ ID NO: 10028417 - DNA, 22 bp, Homo sapiens
tattcccagcctctttctatct

SEQ ID NO: 10028418 - DNA, 22 bp, Homo sapiens
tattcccattccacttatcaag

SEQ ID NO: 10028419 - DNA, 22 bp, Homo sapiens
cagtcccatgagcccagaacat

SEQ ID NO: 10028420 - DNA, 22 bp, Homo sapiens
cagtcttatcctgaaaacaaca

SEQ ID NO: 10028421 - DNA, 22 bp, Homo sapiens
cagtcttagaggtgactgtgga

SEQ ID NO: 10028422 - DNA, 22 bp, Homo sapiens
cagtctctaaatcaatctgaat

SEQ ID NO: 10028423 - DNA, 22 bp, Homo sapiens
cagtctctcagctttcagctgt

SEQ ID NO: 10028424 - DNA, 23 bp, Homo sapiens
cagtctctccccggacagcaaaa

SEQ ID NO: 10028425 - DNA, 22 bp, Homo sapiens
ccaccccaaatgaagacctctc

SEQ ID NO: 10028426 - DNA, 20 bp, Homo sapiens
tcctgtgtgtctcatcaacc

SEQ ID NO: 10028427 - DNA, 22 bp, Homo sapiens
tcctgtgtgtcagatgcacagt

SEQ ID NO: 10028428 - DNA, 22 bp, Homo sapiens
tcctgtgtcaattcctcattct

SEQ ID NO: 10028429 - DNA, 22 bp, Homo sapiens
tcctgtgttcaagtcattcatt

SEQ ID NO: 10028430 - DNA, 22 bp, Homo sapiens
tctcagtgtgttttctctcaga

SEQ ID NO: 10028431 - DNA, 22 bp, Homo sapiens
tctatacaagtttcactttgac

SEQ ID NO: 10028432 - DNA, 22 bp, Homo sapiens
catttctacagcttcttcagaa

SEQ ID NO: 10028433 - DNA, 22 bp, Homo sapiens
catttctagggatcataaagta

SEQ ID NO: 10028434 - DNA, 22 bp, Homo sapiens
catttcacagtatattcaaaat

SEQ ID NO: 10028435 - DNA, 22 bp, Homo sapiens
tcatcacatgtgtagtcatccc

SEQ ID NO: 10028436 - DNA, 22 bp, Homo sapiens
tcatcacatatgtcatgatttg

SEQ ID NO: 10028437 - DNA, 22 bp, Homo sapiens
tcatcacaattttatgaccctc

SEQ ID NO: 10028438 - DNA, 17 bp, Homo sapiens
catccgtgagctcggca

SEQ ID NO: 10028439 - DNA, 17 bp, Homo sapiens
catccgtgagctcggca

SEQ ID NO: 10028440 - DNA, 22 bp, Homo sapiens
cattacaaccccaaattacaaa

SEQ ID NO: 10028441 - DNA, 22 bp, Homo sapiens
cattaagtatttcagttactgt

SEQ ID NO: 10028442 - DNA, 22 bp, Homo sapiens
cattaagtctgttaactggaga

SEQ ID NO: 10028443 - DNA, 19 bp, Homo sapiens
catgtgtcaatactgtacc

SEQ ID NO: 10028444 - DNA, 22 bp, Homo sapiens
tgctctgatggggtggacatag

SEQ ID NO: 10028445 - DNA, 22 bp, Homo sapiens
tgctcaggaaataatgtctgtg

SEQ ID NO: 10028446 - DNA, 22 bp, Homo sapiens
tggcacagtcctgggtgcctgc

SEQ ID NO: 10028447 - DNA, 22 bp, Homo sapiens
cctgcctgcagaaagtatctcc

SEQ ID NO: 10028448 - DNA, 22 bp, Homo sapiens
cctgcctcaggactctgcatat

SEQ ID NO: 10028449 - DNA, 22 bp, Homo sapiens
cctgagtgcttccagagtcatg

SEQ ID NO: 10028450 - DNA, 22 bp, Homo sapiens
ccatacacacaccaaatttgta

SEQ ID NO: 10028451 - DNA, 17 bp, Homo sapiens
ccatactgacatattga

SEQ ID NO: 10028452 - DNA, 22 bp, Homo sapiens
ccatagagtacctctgtgtgag

SEQ ID NO: 10028453 - DNA, 22 bp, Homo sapiens
ccatcacagtccccatcgtgat

SEQ ID NO: 10028454 - DNA, 22 bp, Homo sapiens
tgagtctcggtttcccctccaa

SEQ ID NO: 10028455 - DNA, 21 bp, Homo sapiens
tgagtctctcagcttcaggta

SEQ ID NO: 10028456 - DNA, 22 bp, Homo sapiens
tgagtctctgcactaaggagag

SEQ ID NO: 10028457 - DNA, 22 bp, Homo sapiens
tgagtctcaggtttcccgtgcc

SEQ ID NO: 10028458 - DNA, 22 bp, Homo sapiens
tgagtctcgaaatgcaggaaag

SEQ ID NO: 10028459 - DNA, 22 bp, Homo sapiens
tgcagagagacccctgggccag

SEQ ID NO: 10028460 - DNA, 22 bp, Homo sapiens
tgcagagagatcctcagggttt

SEQ ID NO: 10028461 - DNA, 22 bp, Homo sapiens
tgcagagaagaggacagttcta

SEQ ID NO: 10028462 - DNA, 22 bp, Homo sapiens
tgcactccaggctgggtgacag

SEQ ID NO: 10028463 - DNA, 22 bp, Homo sapiens
tgcaatcaggtaccatttgatt

SEQ ID NO: 10028464 - DNA, 22 bp, Homo sapiens
cccaaggacacgggcagggaca

SEQ ID NO: 10028465 - DNA, 22 bp, Homo sapiens
cccaaggaataggatcccagga

SEQ ID NO: 10028466 - DNA, 22 bp, Homo sapiens
cccaaggaagacgcttgtgata

SEQ ID NO: 10028467 - DNA, 16 bp, Homo sapiens
cccaaggagctccagg

SEQ ID NO: 10028468 - DNA, 22 bp, Homo sapiens
tgcaggcagggccagcgtgagg

SEQ ID NO: 10028469 - DNA, 22 bp, Homo sapiens
ccaggaggctcttgtccctggt

SEQ ID NO: 10028470 - DNA, 22 bp, Homo sapiens
tcttacatatacgtcatttagt

SEQ ID NO: 10028471 - DNA, 22 bp, Homo sapiens
ccaggcttcaggagtggtttcc

SEQ ID NO: 10028472 - DNA, 22 bp, Homo sapiens
tgaaatgagcatttattcttta

SEQ ID NO: 10028473 - DNA, 22 bp, Homo sapiens
tgaaatgagataatttaagtgc

SEQ ID NO: 10028474 - DNA, 22 bp, Homo sapiens
tttgggaaagtgtcttttgtat

SEQ ID NO: 10028475 - DNA, 22 bp, Homo sapiens
tttctataactggactggattg

SEQ ID NO: 10028476 - DNA, 22 bp, Homo sapiens
tttctatagctttcttgggagt

SEQ ID NO: 10028477 - DNA, 22 bp, Homo sapiens
tttctataaaaagtgctaggat

SEQ ID NO: 10028478 - DNA, 22 bp, Homo sapiens
tttctagtcagccatatctagt

SEQ ID NO: 10028479 - DNA, 22 bp, Homo sapiens
tttctagtcctcatgcatcatt

SEQ ID NO: 10028480 - DNA, 22 bp, Homo sapiens
tttctagtctcgatctcttaat

SEQ ID NO: 10028481 - DNA, 22 bp, Homo sapiens
tttgaaatatgtgtcttttgaa

SEQ ID NO: 10028482 - DNA, 22 bp, Homo sapiens
tttgaaattaagatattgtcca

SEQ ID NO: 10028483 - DNA, 22 bp, Homo sapiens
tttgaaattggctcattggttt

SEQ ID NO: 10028484 - DNA, 19 bp, Homo sapiens
ttttccttctatatgtttc

SEQ ID NO: 10028485 - DNA, 18 bp, Homo sapiens
ttttccttccaccttgaa

SEQ ID NO: 10028486 - DNA, 22 bp, Homo sapiens
tttgtcttatccaatctctcag

SEQ ID NO: 10028487 - DNA, 22 bp, Homo sapiens
ttatttaatgtgatctgaagag

SEQ ID NO: 10028488 - DNA, 22 bp, Homo sapiens
ttatttaaaagtggtaagattc

SEQ ID NO: 10028489 - DNA, 22 bp, Homo sapiens
ttatgtttgagtatatgactca

SEQ ID NO: 10028490 - DNA, 22 bp, Homo sapiens
ttatgttttaagtgtgtatctt

SEQ ID NO: 10028491 - DNA, 22 bp, Homo sapiens
ttatgtttgagtatatgactca

SEQ ID NO: 10028492 - DNA, 22 bp, Homo sapiens
ttattttctcctcagaaagtgg

SEQ ID NO: 10028493 - DNA, 21 bp, Homo sapiens
ttcaaaatggtgtgtttgtct

SEQ ID NO: 10028494 - DNA, 22 bp, Homo sapiens
ttagttcatagaatgtaacagg

SEQ ID NO: 10028495 - DNA, 22 bp, Homo sapiens
ttagttaattgactatgttgca

SEQ ID NO: 10028496 - DNA, 22 bp, Homo sapiens
ttcaatatgatattagctgtgg

SEQ ID NO: 10028497 - DNA, 22 bp, Homo sapiens
ttcatagagcagctcactgaat

SEQ ID NO: 10028498 - DNA, 22 bp, Homo sapiens
ttccaagagctttaattgttga

SEQ ID NO: 10028499 - DNA, 22 bp, Homo sapiens
ttccaacaatgtgttattgttc

SEQ ID NO: 10028500 - DNA, 22 bp, Homo sapiens
ttccatatttgtgtggcaaaag

SEQ ID NO: 10028501 - DNA, 22 bp, Homo sapiens
ttgaaaatggtaagcatgatat

SEQ ID NO: 10028502 - DNA, 20 bp, Homo sapiens
ttctctttgggtccagagaa

SEQ ID NO: 10028503 - DNA, 22 bp, Homo sapiens
ttctaaatggggatcctttctg

SEQ ID NO: 10028504 - DNA, 22 bp, Homo sapiens
ttctaaagtgcaatctgacaga

SEQ ID NO: 10028505 - DNA, 22 bp, Homo sapiens
ttcggcttgggtatttctcagg

SEQ ID NO: 10028506 - DNA, 22 bp, Homo sapiens
ttctaaacttcaattctaaatt

SEQ ID NO: 10028507 - DNA, 22 bp, Homo sapiens
ttctaaaataagtttatctggt

SEQ ID NO: 10028508 - DNA, 22 bp, Homo sapiens
ttccctcctatgcccactgaaa

SEQ ID NO: 10028509 - DNA, 20 bp, Homo sapiens
tttcaagtcagcaattctca

SEQ ID NO: 10028510 - DNA, 22 bp, Homo sapiens
tttctaaggccagagactgctg

SEQ ID NO: 10028511 - DNA, 22 bp, Homo sapiens
tttctaaaatagattttatggt

SEQ ID NO: 10028512 - DNA, 22 bp, Homo sapiens
tttcataagggtttctagactt

SEQ ID NO: 10028513 - DNA, 22 bp, Homo sapiens
tttcataatagtgcagtttgtt

SEQ ID NO: 10028514 - DNA, 22 bp, Homo sapiens
ttgtttaaaatgtagcaagaaa

SEQ ID NO: 10028515 - DNA, 22 bp, Homo sapiens
tttacagatgaggaaactgaga

SEQ ID NO: 10028516 - DNA, 22 bp, Homo sapiens
tttaagagctagtatgtcattt

SEQ ID NO: 10028517 - DNA, 22 bp, Homo sapiens
tttaggaagtttcagataggaa

SEQ ID NO: 10028518 - DNA, 22 bp, Homo sapiens
tttaggaatagctgacaatctt

SEQ ID NO: 10028519 - DNA, 22 bp, Homo sapiens
ttgcttgatgcttatatacttg

SEQ ID NO: 10028520 - DNA, 22 bp, Homo sapiens
ttgctttagaatctgcttctgg

SEQ ID NO: 10028521 - DNA, 22 bp, Homo sapiens
ttgcctgattagtctcagattg

SEQ ID NO: 10028522 - DNA, 22 bp, Homo sapiens
ttgctagataatctcacacact

SEQ ID NO: 10028523 - DNA, 22 bp, Homo sapiens
ttgctaatttgtataatgaaaa

SEQ ID NO: 10028524 - DNA, 22 bp, Homo sapiens
ttgctaataaagtttttatgtg

SEQ ID NO: 10028525 - DNA, 21 bp, Homo sapiens
ttgcattttaagtttactgct

SEQ ID NO: 10028526 - DNA, 22 bp, Homo sapiens
ttgcatttttagatgcttctgt

SEQ ID NO: 10028527 - DNA, 22 bp, Homo sapiens
ttgcatttgatcttgggttctc

SEQ ID NO: 10028528 - DNA, 19 bp, Homo sapiens
ttgcatttcatgtttgatt

SEQ ID NO: 10028529 - DNA, 23 bp, Homo sapiens
ttgggaaatagttaagacatgag

SEQ ID NO: 10028530 - DNA, 22 bp, Homo sapiens
ttgggaaattactctgctagga

SEQ ID NO: 10028531 - DNA, 22 bp, Homo sapiens
ttgtagatggcttatttctgtg

SEQ ID NO: 10028532 - DNA, 22 bp, Homo sapiens
ttgtagatataaattttattgt

SEQ ID NO: 10028533 - DNA, 22 bp, Homo sapiens
ttgttattattactaagtcttc

SEQ ID NO: 10028534 - DNA, 22 bp, Homo sapiens
ttgttcatggttgtaagtttga

SEQ ID NO: 10028535 - DNA, 22 bp, Homo sapiens
ttgtgcaatagttttctcatga

SEQ ID NO: 10028536 - DNA, 22 bp, Homo sapiens
cccagcctggtgcactgtgggg

SEQ ID NO: 10028537 - DNA, 22 bp, Homo sapiens
aggcttattttaggtctctctt

SEQ ID NO: 10028538 - DNA, 22 bp, Homo sapiens
aggcttattaatatgattctgc

SEQ ID NO: 10028539 - DNA, 22 bp, Homo sapiens
agggaaggaggccatgtgtccc

SEQ ID NO: 10028540 - DNA, 22 bp, Homo sapiens
agggaatccatctatcttcatt

SEQ ID NO: 10028541 - DNA, 22 bp, Homo sapiens
agggaatgctccgtataaatct

SEQ ID NO: 10028542 - DNA, 22 bp, Homo sapiens
cctctctcagcttgctgcaact

SEQ ID NO: 10028543 - DNA, 22 bp, Homo sapiens
cctctctccaagggaaatccta

SEQ ID NO: 10028544 - DNA, 21 bp, Homo sapiens
cctctctcattgtaatgaagt

SEQ ID NO: 10028545 - DNA, 22 bp, Homo sapiens
ccagttctaaacataaagctaa

SEQ ID NO: 10028546 - DNA, 22 bp, Homo sapiens
cagctttgtggccttgacctcg

SEQ ID NO: 10028547 - DNA, 22 bp, Homo sapiens
cagctttggagtgtgagtgctg

SEQ ID NO: 10028548 - DNA, 22 bp, Homo sapiens
cagctttgtctgattcctcttt

SEQ ID NO: 10028549 - DNA, 22 bp, Homo sapiens
cattcccacgtgttctttgctt

SEQ ID NO: 10028550 - DNA, 21 bp, Homo sapiens
cattaagtaccagggcactgt

SEQ ID NO: 10028551 - DNA, 22 bp, Homo sapiens
catgcctgtaatcccagcactt

SEQ ID NO: 10028552 - DNA, 19 bp, Homo sapiens
aggaaggaacctgagtctg

SEQ ID NO: 10028553 - DNA, 22 bp, Homo sapiens
aggactgacttttgccatgaaa

SEQ ID NO: 10028554 - DNA, 22 bp, Homo sapiens
aggacagcccttgagagcacat

SEQ ID NO: 10028555 - DNA, 22 bp, Homo sapiens
cagtctctttatccaccaagcc

SEQ ID NO: 10028556 - DNA, 22 bp, Homo sapiens
cagtctcttgcttcattagttg

SEQ ID NO: 10028557 - DNA, 22 bp, Homo sapiens
cagtctctgtcatctcatggga

SEQ ID NO: 10028558 - DNA, 22 bp, Homo sapiens
cagtctctggtgagttgacagt

SEQ ID NO: 10028559 - DNA, 22 bp, Homo sapiens
cagtctctcttgtagtgcagct

SEQ ID NO: 10028560 - DNA, 23 bp, Homo sapiens
cctctctccctgtttggcaaata

SEQ ID NO: 10028561 - DNA, 22 bp, Homo sapiens
cctctctccaattttcacctca

SEQ ID NO: 10028562 - DNA, 22 bp, Homo sapiens
cctctctctgcatctggagggc

SEQ ID NO: 10028563 - DNA, 22 bp, Homo sapiens
cctctctctcctgcacacacac

SEQ ID NO: 10028564 - DNA, 22 bp, Homo sapiens
cctctctccttcctttgccaaa

SEQ ID NO: 10028565 - DNA, 22 bp, Homo sapiens
cctgcccaggagtctctctgtg

SEQ ID NO: 10028566 - DNA, 22 bp, Homo sapiens
ccttgctcaagctagtgacggg

SEQ ID NO: 10028567 - DNA, 22 bp, Homo sapiens
cggccgcagcagtgtcggccca

SEQ ID NO: 10028568 - DNA, 22 bp, Homo sapiens
cggctcactgcagctccgcctc

SEQ ID NO: 10028569 - DNA, 22 bp, Homo sapiens
cctttgtaccttaaatcctgtg

SEQ ID NO: 10028570 - DNA, 22 bp, Homo sapiens
ctcctgaggggacaggactcat

SEQ ID NO: 10028571 - DNA, 22 bp, Homo sapiens
ctctgtctatcccattctgtgc

SEQ ID NO: 10028572 - DNA, 22 bp, Homo sapiens
ctctgtcctccacctgctttca

SEQ ID NO: 10028573 - DNA, 22 bp, Homo sapiens
ctctggacctcagctacagact

SEQ ID NO: 10028574 - DNA, 22 bp, Homo sapiens
ctcagctctttatactagctgt

SEQ ID NO: 10028575 - DNA, 22 bp, Homo sapiens
ctcagcctgtgaagagcagagg

SEQ ID NO: 10028576 - DNA, 22 bp, Homo sapiens
agtgacaacaagttgactagaa

SEQ ID NO: 10028577 - DNA, 22 bp, Homo sapiens
atatgagtttcccacttctgga

SEQ ID NO: 10028578 - DNA, 19 bp, Homo sapiens
atatatgtatacaatgtgg

SEQ ID NO: 10028579 - DNA, 22 bp, Homo sapiens
atatgttttgtgcttcattggt

SEQ ID NO: 10028580 - DNA, 22 bp, Homo sapiens
atatgtttcagtattcaagtca

SEQ ID NO: 10028581 - DNA, 22 bp, Homo sapiens
atatgtttttggaaagaacaca

SEQ ID NO: 10028582 - DNA, 22 bp, Homo sapiens
atatttctctcagacatggaag

SEQ ID NO: 10028583 - DNA, 20 bp, Homo sapiens
atatttcttaagaactttca

SEQ ID NO: 10028584 - DNA, 22 bp, Homo sapiens
atatttctgggggtgtgtttct

SEQ ID NO: 10028585 - DNA, 20 bp, Homo sapiens
atatgtgtacgtgtatacat

SEQ ID NO: 10028586 - DNA, 22 bp, Homo sapiens
atataatacaacctgctaagtg

SEQ ID NO: 10028587 - DNA, 22 bp, Homo sapiens
atcatttttaagagactcttct

SEQ ID NO: 10028588 - DNA, 22 bp, Homo sapiens
atcatgttgctcaaaattaaac

SEQ ID NO: 10028589 - DNA, 22 bp, Homo sapiens
ctgtcctccagacgacagtccc

SEQ ID NO: 10028590 - DNA, 22 bp, Homo sapiens
atcacatatttaagaaacatgt

SEQ ID NO: 10028591 - DNA, 18 bp, Homo sapiens
ctgggtctccaggctgcc

SEQ ID NO: 10028592 - DNA, 22 bp, Homo sapiens
atcatgtaccctaaaaatggaa

SEQ ID NO: 10028593 - DNA, 22 bp, Homo sapiens
atcatgtacttgacaaatatgt

SEQ ID NO: 10028594 - DNA, 22 bp, Homo sapiens
ctgtctgttttaccttctccag

SEQ ID NO: 10028595 - DNA, 22 bp, Homo sapiens
ctgtcttttactatcatttact

SEQ ID NO: 10028596 - DNA, 22 bp, Homo sapiens
ctgtgagttcattgtgccacct

SEQ ID NO: 10028597 - DNA, 19 bp, Homo sapiens
agttcttgtcctgtctgtt

SEQ ID NO: 10028598 - DNA, 22 bp, Homo sapiens
agttgcttccctattcttagca

SEQ ID NO: 10028599 - DNA, 22 bp, Homo sapiens
agttgtaagagacagatataaa

SEQ ID NO: 10028600 - DNA, 22 bp, Homo sapiens
ctgagggtcaacttgattgtat

SEQ ID NO: 10028601 - DNA, 20 bp, Homo sapiens
ataaaataactgccacaaga

SEQ ID NO: 10028602 - DNA, 22 bp, Homo sapiens
ataatcaaagtcctatgacatc

SEQ ID NO: 10028603 - DNA, 22 bp, Homo sapiens
ataatatttgcattactgtgat

SEQ ID NO: 10028604 - DNA, 22 bp, Homo sapiens
ctgctctgcaaggcacagtgat

SEQ ID NO: 10028605 - DNA, 22 bp, Homo sapiens
ctgctcagtaatagtcctatct

SEQ ID NO: 10028606 - DNA, 22 bp, Homo sapiens
atacagaatactaattcctgag

SEQ ID NO: 10028607 - DNA, 22 bp, Homo sapiens
cagccaagaaccacagacccag

SEQ ID NO: 10028608 - DNA, 22 bp, Homo sapiens
gtatgaaaattgtaaagttctt

SEQ ID NO: 10028609 - DNA, 22 bp, Homo sapiens
gggacaatggaggcctctctcc

SEQ ID NO: 10028610 - DNA, 22 bp, Homo sapiens
gggaaagaccttcctggggtgt

SEQ ID NO: 10028611 - DNA, 22 bp, Homo sapiens
gggaaagaagaagagccatttt

SEQ ID NO: 10028612 - DNA, 22 bp, Homo sapiens
cacactgtcaggtaaataacac

SEQ ID NO: 10028613 - DNA, 22 bp, Homo sapiens
ggcactgggagaggtgagacgg

SEQ ID NO: 10028614 - DNA, 22 bp, Homo sapiens
ggcactgggaatgcagtgatga

SEQ ID NO: 10028615 - DNA, 22 bp, Homo sapiens
ggcactggaaggatcatgtgag

SEQ ID NO: 10028616 - DNA, 22 bp, Homo sapiens
ggcactggaagtcccattgtct

SEQ ID NO: 10028617 - DNA, 22 bp, Homo sapiens
cacccacatggaaattcacagt

SEQ ID NO: 10028618 - DNA, 22 bp, Homo sapiens
cacccacattccatcactctgc

SEQ ID NO: 10028619 - DNA, 22 bp, Homo sapiens
caccctgaggccacccagacct

SEQ ID NO: 10028620 - DNA, 22 bp, Homo sapiens
caccctgactggccctgcagga

SEQ ID NO: 10028621 - DNA, 22 bp, Homo sapiens
caccctgaaggctggccctgac

SEQ ID NO: 10028622 - DNA, 22 bp, Homo sapiens
ggctatgtggtcatataagata

SEQ ID NO: 10028623 - DNA, 22 bp, Homo sapiens
cactgccacctgcatgccctga

SEQ ID NO: 10028624 - DNA, 22 bp, Homo sapiens
ggctcaatgcaacttctgcctc

SEQ ID NO: 10028625 - DNA, 22 bp, Homo sapiens
caagatatgtcctgttactaag

SEQ ID NO: 10028626 - DNA, 22 bp, Homo sapiens
caaggaggaagatgcaggggac

SEQ ID NO: 10028627 - DNA, 22 bp, Homo sapiens
caacctgatgaattgaatttaa

SEQ ID NO: 10028628 - DNA, 22 bp, Homo sapiens
caacctgacaagactatgagta

SEQ ID NO: 10028629 - DNA, 22 bp, Homo sapiens
cacaactttaggaaccacattc

SEQ ID NO: 10028630 - DNA, 21 bp, Homo sapiens
ggaaaattccatacacccacg

SEQ ID NO: 10028631 - DNA, 21 bp, Homo sapiens
ggaaaattcagagtgcaattt

SEQ ID NO: 10028632 - DNA, 22 bp, Homo sapiens
cacaatgtatatgtatatcaaa

SEQ ID NO: 10028633 - DNA, 22 bp, Homo sapiens
cacacatttcagatgctacaat

SEQ ID NO: 10028634 - DNA, 20 bp, Homo sapiens
caaggcagaccagagtgagt

SEQ ID NO: 10028635 - DNA, 22 bp, Homo sapiens
caaggaggcagtgggacttgaa

SEQ ID NO: 10028636 - DNA, 22 bp, Homo sapiens
attgacaatctactatgttctg

SEQ ID NO: 10028637 - DNA, 22 bp, Homo sapiens
attctcaaaacataacttcact

SEQ ID NO: 10028638 - DNA, 22 bp, Homo sapiens
attcttaattgccatgctgtat

SEQ ID NO: 10028639 - DNA, 22 bp, Homo sapiens
attcttaattccaaagactgag

SEQ ID NO: 10028640 - DNA, 22 bp, Homo sapiens
attaatatacactgttagcatg

SEQ ID NO: 10028641 - DNA, 22 bp, Homo sapiens
attaatatcccccgccgttctg

SEQ ID NO: 10028642 - DNA, 22 bp, Homo sapiens
attaatatgagaaagtggcaga

SEQ ID NO: 10028643 - DNA, 22 bp, Homo sapiens
attaatatgagaaagtggcaga

SEQ ID NO: 10028644 - DNA, 22 bp, Homo sapiens
attaatgagcttctgcactcat

SEQ ID NO: 10028645 - DNA, 22 bp, Homo sapiens
attaatgaaactttggttaagc

SEQ ID NO: 10028646 - DNA, 22 bp, Homo sapiens
attaatattggttcattagctg

SEQ ID NO: 10028647 - DNA, 22 bp, Homo sapiens
atgtttttcataccagtgttgg

SEQ ID NO: 10028648 - DNA, 22 bp, Homo sapiens
atgtttttgagatacaaacaga

SEQ ID NO: 10028649 - DNA, 22 bp, Homo sapiens
atgtgttttggtaatttctgct

SEQ ID NO: 10028650 - DNA, 22 bp, Homo sapiens
atgtgtttataattactcaatc

SEQ ID NO: 10028651 - DNA, 22 bp, Homo sapiens
atgtgtttgtacctttaaatat

SEQ ID NO: 10028652 - DNA, 20 bp, Homo sapiens
atgttttataaaagaacggg

SEQ ID NO: 10028653 - DNA, 22 bp, Homo sapiens
atgttttatgttccactcaagg

SEQ ID NO: 10028654 - DNA, 22 bp, Homo sapiens
atgttttatgcttcagatgagg

SEQ ID NO: 10028655 - DNA, 22 bp, Homo sapiens
atgttttattaccaacttgtac

SEQ ID NO: 10028656 - DNA, 22 bp, Homo sapiens
gcgcactgggcgcacgcgtagg

SEQ ID NO: 10028657 - DNA, 22 bp, Homo sapiens
gcctctcctcttaataccatta

SEQ ID NO: 10028658 - DNA, 22 bp, Homo sapiens
gcctctctccttggcttgcagt

SEQ ID NO: 10028659 - DNA, 22 bp, Homo sapiens
gcctctctctacccagtatgat

SEQ ID NO: 10028660 - DNA, 22 bp, Homo sapiens
gcctctctcgggcttgtagcgg

SEQ ID NO: 10028661 - DNA, 22 bp, Homo sapiens
atttctataggaggacagtatt

SEQ ID NO: 10028662 - DNA, 22 bp, Homo sapiens
atttcctagggtagatgtcaca

SEQ ID NO: 10028663 - DNA, 22 bp, Homo sapiens
atttcctagcctctcttgcagt

SEQ ID NO: 10028664 - DNA, 21 bp, Homo sapiens
atttcagaaatattggtggga

SEQ ID NO: 10028665 - DNA, 22 bp, Homo sapiens
atttattatgggatttggctca

SEQ ID NO: 10028666 - DNA, 22 bp, Homo sapiens
atttaatgggtagacattgtta

SEQ ID NO: 10028667 - DNA, 22 bp, Homo sapiens
atgccactgcgctctagcctgg

SEQ ID NO: 10028668 - DNA, 22 bp, Homo sapiens
atgccactgcgctccagcctgg

SEQ ID NO: 10028669 - DNA, 22 bp, Homo sapiens
gagaggaactcccagtgcctgg

SEQ ID NO: 10028670 - DNA, 22 bp, Homo sapiens
gagccagggagggtctggtata

SEQ ID NO: 10028671 - DNA, 22 bp, Homo sapiens
gagccaggcaccttctgtgttg

SEQ ID NO: 10028672 - DNA, 22 bp, Homo sapiens
gagccaggcccgtacttgctgt

SEQ ID NO: 10028673 - DNA, 22 bp, Homo sapiens
atgtagaaagttattgtcactg

SEQ ID NO: 10028674 - DNA, 22 bp, Homo sapiens
atgtctttggctttgacatggc

SEQ ID NO: 10028675 - DNA, 22 bp, Homo sapiens
atgtgtattgagcacctactgc

SEQ ID NO: 10028676 - DNA, 22 bp, Homo sapiens
atgtgtcttgcggcagttggta

SEQ ID NO: 10028677 - DNA, 22 bp, Homo sapiens
atgtgtcttgagggggatggag

SEQ ID NO: 10028678 - DNA, 22 bp, Homo sapiens
atgtgtgtatatatagtcattt

SEQ ID NO: 10028679 - DNA, 22 bp, Homo sapiens
cttttcatgagtctgttatggg

SEQ ID NO: 10028680 - DNA, 22 bp, Homo sapiens
atctttgtttgtctctgaggtg

SEQ ID NO: 10028681 - DNA, 22 bp, Homo sapiens
cttgtgtatatatagtaactta

SEQ ID NO: 10028682 - DNA, 22 bp, Homo sapiens
cttgtaaaaggtacattatgct

SEQ ID NO: 10028683 - DNA, 22 bp, Homo sapiens
cttgcctttgtcttcaaaggct

SEQ ID NO: 10028684 - DNA, 22 bp, Homo sapiens
cttgctgagataaatgctgtct

SEQ ID NO: 10028685 - DNA, 18 bp, Homo sapiens
cttgctgagggcctcatt

SEQ ID NO: 10028686 - DNA, 22 bp, Homo sapiens
atctagattaggtataagagct

SEQ ID NO: 10028687 - DNA, 22 bp, Homo sapiens
atgcagaatgagttcacgatct

SEQ ID NO: 10028688 - DNA, 22 bp, Homo sapiens
atgcagaaggagccatgcttgc

SEQ ID NO: 10028689 - DNA, 20 bp, Homo sapiens
atgattttgcactaacttca

SEQ ID NO: 10028690 - DNA, 22 bp, Homo sapiens
agacacataggaccacactgtg

SEQ ID NO: 10028691 - DNA, 22 bp, Homo sapiens
agaatgtaagaatgcaaagatt

SEQ ID NO: 10028692 - DNA, 20 bp, Homo sapiens
agaatgctttttgcattgca

SEQ ID NO: 10028693 - DNA, 22 bp, Homo sapiens
agaatgctaaatggattcttct

SEQ ID NO: 10028694 - DNA, 22 bp, Homo sapiens
agaagaatacttgatgttcatg

SEQ ID NO: 10028695 - DNA, 22 bp, Homo sapiens
agaagaatttctctcatgattt

SEQ ID NO: 10028696 - DNA, 22 bp, Homo sapiens
agaaggctaaagaaacagattg

SEQ ID NO: 10028697 - DNA, 22 bp, Homo sapiens
atggcagagggattgaacagct

SEQ ID NO: 10028698 - DNA, 22 bp, Homo sapiens
atggcagatggctggagcaggt

SEQ ID NO: 10028699 - DNA, 22 bp, Homo sapiens
atgttttaccctttgcacaaac

SEQ ID NO: 10028700 - DNA, 22 bp, Homo sapiens
attaaagtgaagttctcagatg

SEQ ID NO: 10028701 - DNA, 22 bp, Homo sapiens
atgtgtgtacacacgtgactct

SEQ ID NO: 10028702 - DNA, 22 bp, Homo sapiens
atgtgtctttgagactctgcta

SEQ ID NO: 10028703 - DNA, 18 bp, Homo sapiens
atgtgtctttcttgtttg

SEQ ID NO: 10028704 - DNA, 22 bp, Homo sapiens
atgtgtctttcaaggtatagaa

SEQ ID NO: 10028705 - DNA, 22 bp, Homo sapiens
atgtgtcttggagttttaatgt

SEQ ID NO: 10028706 - DNA, 22 bp, Homo sapiens
attctgtatggggaaactagag

SEQ ID NO: 10028707 - DNA, 18 bp, Homo sapiens
atttaatgaactgaaagc

SEQ ID NO: 10028708 - DNA, 18 bp, Homo sapiens
atttaatgaactgaaagc

SEQ ID NO: 10028709 - DNA, 23 bp, Homo sapiens
atttaatgctgagttgaatgtta

SEQ ID NO: 10028710 - DNA, 22 bp, Homo sapiens
atttattattgtggttacttct

SEQ ID NO: 10028711 - DNA, 22 bp, Homo sapiens
agatgggcgcgctgctctgatg

SEQ ID NO: 10028712 - DNA, 22 bp, Homo sapiens
agatggtagactatggaacgta

SEQ ID NO: 10028713 - DNA, 22 bp, Homo sapiens
atttccagaccaggtctcaccc

SEQ ID NO: 10028714 - DNA, 22 bp, Homo sapiens
atttgcttcctaatactcatat

SEQ ID NO: 10028715 - DNA, 22 bp, Homo sapiens
atttgcttcatagatctgtgga

SEQ ID NO: 10028716 - DNA, 20 bp, Homo sapiens
atttgcttaccttgtttcta

SEQ ID NO: 10028717 - DNA, 22 bp, Homo sapiens
cagacagagtcttcccatcagt

SEQ ID NO: 10028718 - DNA, 22 bp, Homo sapiens
agcccagctttgaaccatatca

SEQ ID NO: 10028719 - DNA, 22 bp, Homo sapiens
cagaagctttgctcataaccat

SEQ ID NO: 10028720 - DNA, 22 bp, Homo sapiens
agccaggatggtctcgatcggc

SEQ ID NO: 10028721 - DNA, 22 bp, Homo sapiens
cagaagaatggtgtctgagctc

SEQ ID NO: 10028722 - DNA, 23 bp, Homo sapiens
cagaaatctgaaatctagaaatg

SEQ ID NO: 10028723 - DNA, 22 bp, Homo sapiens
cagcaggaggtgagatgtgacc

SEQ ID NO: 10028724 - DNA, 22 bp, Homo sapiens
cacatccctggagttacccagt

SEQ ID NO: 10028725 - DNA, 22 bp, Homo sapiens
agcaggtgatgtgagtctggaa

SEQ ID NO: 10028726 - DNA, 22 bp, Homo sapiens
agcataagttggtacagccact

SEQ ID NO: 10028727 - DNA, 22 bp, Homo sapiens
cacaggaggcaatggtaagatt

SEQ ID NO: 10028728 - DNA, 22 bp, Homo sapiens
caatgaacacagcaatttcata

SEQ ID NO: 10028729 - DNA, 22 bp, Homo sapiens
attttctatgttgtaattgtta

SEQ ID NO: 10028730 - DNA, 22 bp, Homo sapiens
attttctattctgctggtttag

SEQ ID NO: 10028731 - DNA, 22 bp, Homo sapiens
agcagacaattgcctggatgga

SEQ ID NO: 10028732 - DNA, 22 bp, Homo sapiens
caactgagaaatattgctgacg

SEQ ID NO: 10028733 - DNA, 22 bp, Homo sapiens
caatgaaattgagatccagaga

SEQ ID NO: 10028734 - DNA, 22 bp, Homo sapiens
acatgacttttctcttccagag

SEQ ID NO: 10028735 - DNA, 22 bp, Homo sapiens
acatgcaaatgtgcatgcatgt

SEQ ID NO: 10028736 - DNA, 22 bp, Homo sapiens
acccacacctccgtatatcact

SEQ ID NO: 10028737 - DNA, 22 bp, Homo sapiens
acccacacatctctaattcagt

SEQ ID NO: 10028738 - DNA, 22 bp, Homo sapiens
agggaatgtagcaagatgccaa

SEQ ID NO: 10028739 - DNA, 22 bp, Homo sapiens
acatttgtcttctttcagatta

SEQ ID NO: 10028740 - DNA, 22 bp, Homo sapiens
acagttaattaacattaagggg

SEQ ID NO: 10028741 - DNA, 22 bp, Homo sapiens
acagttaaatatttctactggg

SEQ ID NO: 10028742 - DNA, 22 bp, Homo sapiens
acaggctgggcgcttcctgcgg

SEQ ID NO: 10028743 - DNA, 19 bp, Homo sapiens
aggaatggaattaattctg

SEQ ID NO: 10028744 - DNA, 22 bp, Homo sapiens
agctttatcttcacctgggaat

SEQ ID NO: 10028745 - DNA, 22 bp, Homo sapiens
atatatttgagaatattcatga

SEQ ID NO: 10028746 - DNA, 22 bp, Homo sapiens
atatatttactctcctgttgca

SEQ ID NO: 10028747 - DNA, 22 bp, Homo sapiens
atatatttgagaatattcatga

SEQ ID NO: 10028748 - DNA, 22 bp, Homo sapiens
agaaaatttaaagagacacaca

SEQ ID NO: 10028749 - DNA, 22 bp, Homo sapiens
agaaaatttattcatgttagtt

SEQ ID NO: 10028750 - DNA, 22 bp, Homo sapiens
agaaaattagattttactgtgt

SEQ ID NO: 10028751 - DNA, 22 bp, Homo sapiens
atataatagtttcataaaggct

SEQ ID NO: 10028752 - DNA, 22 bp, Homo sapiens
actttgtaatagtttaaggtca

SEQ ID NO: 10028753 - DNA, 19 bp, Homo sapiens
atcattgatcttcacccct

SEQ ID NO: 10028754 - DNA, 22 bp, Homo sapiens
atcattgagattttttacaact

SEQ ID NO: 10028755 - DNA, 22 bp, Homo sapiens
atcattgaaatgtagtttcatc

SEQ ID NO: 10028756 - DNA, 22 bp, Homo sapiens
actgtgtcctatttccttgaca

SEQ ID NO: 10028757 - DNA, 22 bp, Homo sapiens
actgtgtcctcatgtggcagaa

SEQ ID NO: 10028758 - DNA, 22 bp, Homo sapiens
acctggtgggagataattgaat

SEQ ID NO: 10028759 - DNA, 22 bp, Homo sapiens
acctgtgtctcctctgtgttct

SEQ ID NO: 10028760 - DNA, 22 bp, Homo sapiens
acctgtgtttctgtagtggtca

SEQ ID NO: 10028761 - DNA, 22 bp, Homo sapiens
agtctctgcatgatgcagcaca

SEQ ID NO: 10028762 - DNA, 22 bp, Homo sapiens
agtctctgctggttgtgcctat

SEQ ID NO: 10028763 - DNA, 20 bp, Homo sapiens
agtctctgtagtgcctgaga

SEQ ID NO: 10028764 - DNA, 22 bp, Homo sapiens
actgctgagagcaatcccaaac

SEQ ID NO: 10028765 - DNA, 22 bp, Homo sapiens
actgcaacctccgcctgccagg

SEQ ID NO: 10028766 - DNA, 22 bp, Homo sapiens
actgcaacctccacctcctggg

SEQ ID NO: 10028767 - DNA, 22 bp, Homo sapiens
aagatatgaggtcacctgctgg

SEQ ID NO: 10028768 - DNA, 22 bp, Homo sapiens
aaatactgctgctattcctttt

SEQ ID NO: 10028769 - DNA, 22 bp, Homo sapiens
aaagtgacaaccatttattaag

SEQ ID NO: 10028770 - DNA, 22 bp, Homo sapiens
aagaacatgaacacaatgttta

SEQ ID NO: 10028771 - DNA, 22 bp, Homo sapiens
aagaacatgagttatgatgatt

SEQ ID NO: 10028772 - DNA, 22 bp, Homo sapiens
aaagatttaagaataatttgtg

SEQ ID NO: 10028773 - DNA, 22 bp, Homo sapiens
aaagaaatagatggcatttaaa

SEQ ID NO: 10028774 - DNA, 22 bp, Homo sapiens
aaatagttagccctgcatatat

SEQ ID NO: 10028775 - DNA, 20 bp, Homo sapiens
aaacattcatgtacaagtga

SEQ ID NO: 10028776 - DNA, 22 bp, Homo sapiens
aaacattccatatataccttgt

SEQ ID NO: 10028777 - DNA, 22 bp, Homo sapiens
aaacattccatttctatgtaag

SEQ ID NO: 10028778 - DNA, 22 bp, Homo sapiens
aaacacattttaggaaaatcta

SEQ ID NO: 10028779 - DNA, 22 bp, Homo sapiens
aaaattcattcctcagactgcc

SEQ ID NO: 10028780 - DNA, 22 bp, Homo sapiens
aaaattctgtcattaaattgtg

SEQ ID NO: 10028781 - DNA, 18 bp, Homo sapiens
aaaaagtgctcaggccta

SEQ ID NO: 10028782 - DNA, 22 bp, Homo sapiens
aaaactacatttgacattttgt

SEQ ID NO: 10028783 - DNA, 22 bp, Homo sapiens
aacacagatcaaaatatttcct

SEQ ID NO: 10028784 - DNA, 22 bp, Homo sapiens
aacagaatagttgatgtacagt

SEQ ID NO: 10028785 - DNA, 21 bp, Homo sapiens
aaattcacctagtaaaacttc

SEQ ID NO: 10028786 - DNA, 23 bp, Homo sapiens
aacctagactacttactatgtgg

SEQ ID NO: 10028787 - DNA, 22 bp, Homo sapiens
aatgaacaaatggtgctgcttg

SEQ ID NO: 10028788 - DNA, 22 bp, Homo sapiens
aatgaacaacactgaaggaaga

SEQ ID NO: 10028789 - DNA, 22 bp, Homo sapiens
aatgaattgcagtactgacttg

SEQ ID NO: 10028790 - DNA, 22 bp, Homo sapiens
aacatcttgtccttagattaaa

SEQ ID NO: 10028791 - DNA, 22 bp, Homo sapiens
aacatctacagtgagatgttag

SEQ ID NO: 10028792 - DNA, 22 bp, Homo sapiens
aagactttcaaacctatgtttg

SEQ ID NO: 10028793 - DNA, 22 bp, Homo sapiens
aagacttgaccaggttgaaggc

SEQ ID NO: 10028794 - DNA, 22 bp, Homo sapiens
aatttcagggtgaatggactga

SEQ ID NO: 10028795 - DNA, 22 bp, Homo sapiens
aatttcagtatgaagtttcaca

SEQ ID NO: 10028796 - DNA, 22 bp, Homo sapiens
aatttcagttgctaataagttc

SEQ ID NO: 10028797 - DNA, 22 bp, Homo sapiens
aatttcagcaacgggagcctag

SEQ ID NO: 10028798 - DNA, 22 bp, Homo sapiens
aatttcagaccatttgcaatta

SEQ ID NO: 10028799 - DNA, 22 bp, Homo sapiens
aatttcagatattaaagaatga

SEQ ID NO: 10028800 - DNA, 22 bp, Homo sapiens
aatttcagaggtagagattcta

SEQ ID NO: 10028801 - DNA, 22 bp, Homo sapiens
aagaaaatcagttctggtcagt

SEQ ID NO: 10028802 - DNA, 22 bp, Homo sapiens
aattctcaggtaaaagttaagt

SEQ ID NO: 10028803 - DNA, 22 bp, Homo sapiens
aagaaattaatgtgccattact

SEQ ID NO: 10028804 - DNA, 22 bp, Homo sapiens
acacatcttagactgaaatatg

SEQ ID NO: 10028805 - DNA, 22 bp, Homo sapiens
acacattcatgagtgcatgcac

SEQ ID NO: 10028806 - DNA, 22 bp, Homo sapiens
acacatttacatgtttacgtat

SEQ ID NO: 10028807 - DNA, 22 bp, Homo sapiens
acacatttatggatcgcagaaa

SEQ ID NO: 10028808 - DNA, 22 bp, Homo sapiens
aagcaagtacaatagcaagtac

SEQ ID NO: 10028809 - DNA, 22 bp, Homo sapiens
aagatgtgtccattctttgctc

SEQ ID NO: 10028810 - DNA, 22 bp, Homo sapiens
acagtcttgctgtatggtcagg

SEQ ID NO: 10028811 - DNA, 19 bp, Homo sapiens
acatatgtggatatacatg

SEQ ID NO: 10028812 - DNA, 22 bp, Homo sapiens
acatatgtgcttatatccatga

SEQ ID NO: 10028813 - DNA, 22 bp, Homo sapiens
accgagttagccaggatggtct

SEQ ID NO: 10028814 - DNA, 22 bp, Homo sapiens
accctgatggccagattgtgga

SEQ ID NO: 10028815 - DNA, 22 bp, Homo sapiens
acatttgttcagggctgaggaa

SEQ ID NO: 10028816 - DNA, 22 bp, Homo sapiens
acatttgtgcacatgtgcatgg

SEQ ID NO: 10028817 - DNA, 22 bp, Homo sapiens
acatttcatgttttccagagca

SEQ ID NO: 10028818 - DNA, 23 bp, Homo sapiens
acatttcatataaaagggatcag

SEQ ID NO: 10028819 - DNA, 22 bp, Homo sapiens
acattgtttggaggagtgagag

SEQ ID NO: 10028820 - DNA, 22 bp, Homo sapiens
agaaattcaattctaattagct

SEQ ID NO: 10028821 - DNA, 22 bp, Homo sapiens
agaaattctaagcatcaatagc

SEQ ID NO: 10028822 - DNA, 22 bp, Homo sapiens
agaacaatgaggtatggatgga

SEQ ID NO: 10028823 - DNA, 22 bp, Homo sapiens
aatcagaaagaggtcatgttgc

SEQ ID NO: 10028824 - DNA, 22 bp, Homo sapiens
aatatagttctggtattgttaa

SEQ ID NO: 10028825 - DNA, 22 bp, Homo sapiens
aatagtagtcgccttttgtaag

SEQ ID NO: 10028826 - DNA, 20 bp, Homo sapiens
acgtggccaccagtggctta

SEQ ID NO: 10028827 - DNA, 22 bp, Homo sapiens
aagtcgtggcaggcttgcacga

SEQ ID NO: 10028828 - DNA, 22 bp, Homo sapiens
acgtgcaggatctggttggcga

SEQ ID NO: 10028829 - DNA, 22 bp, Homo sapiens
actctcccacgttcgactctaa

SEQ ID NO: 10028830 - DNA, 22 bp, Homo sapiens
actgaggttattgcaataaaat

SEQ ID NO: 10028831 - DNA, 22 bp, Homo sapiens
actgaggtctatcatgagccag

SEQ ID NO: 10028832 - DNA, 22 bp, Homo sapiens
actctcccttatctaactttac

SEQ ID NO: 10028833 - DNA, 22 bp, Homo sapiens
actctccctgctatccacttcc

SEQ ID NO: 10028834 - DNA, 22 bp, Homo sapiens
aatggcagaggcaaagatggta

SEQ ID NO: 10028835 - DNA, 22 bp, Homo sapiens
aatggcactttataaatgttaa

SEQ ID NO: 10028836 - DNA, 22 bp, Homo sapiens
aatgtaaaatatcttgtacttg

SEQ ID NO: 10028837 - DNA, 23 bp, Homo sapiens
aatgggtgcaactatccatgaca

SEQ ID NO: 10028838 - DNA, 22 bp, Homo sapiens
acaaagtaagggctaatgagca

SEQ ID NO: 10028839 - DNA, 22 bp, Homo sapiens
acaaagtaggaagattagctga

SEQ ID NO: 10028840 - DNA, 22 bp, Homo sapiens
acaaagtagtcaaagtagatga

SEQ ID NO: 10028841 - DNA, 22 bp, Homo sapiens
aattgcaaattcagacttaaga

SEQ ID NO: 10028842 - DNA, 22 bp, Homo sapiens
aattgacagaaagtttacgagg

SEQ ID NO: 10028843 - DNA, 22 bp, Homo sapiens
agataacatttattgaatgtaa

SEQ ID NO: 10028844 - DNA, 22 bp, Homo sapiens
acactcaccctcccactgcctg

SEQ ID NO: 10028845 - DNA, 22 bp, Homo sapiens
acactctgtaatgtcacactcc

SEQ ID NO: 10028846 - DNA, 22 bp, Homo sapiens
acactgagattttcctgacacc

SEQ ID NO: 10028847 - DNA, 22 bp, Homo sapiens
acactgagttttaccaggcaca

SEQ ID NO: 10028848 - DNA, 22 bp, Homo sapiens
acactgagtattgagtagggta

SEQ ID NO: 10028849 - DNA, 22 bp, Homo sapiens
acactgagcttccaagatgggg

SEQ ID NO: 10028850 - DNA, 21 bp, Homo sapiens
acacagaggcatcatcacttt

SEQ ID NO: 10028851 - DNA, 22 bp, Homo sapiens
acacagatgcattacacatcta

SEQ ID NO: 10028852 - DNA, 22 bp, Homo sapiens
acacagagtttgacacatggga

SEQ ID NO: 10028853 - DNA, 22 bp, Homo sapiens
agcctctctttattcccagcta

SEQ ID NO: 10028854 - DNA, 22 bp, Homo sapiens
agcctctcttatcccttcaaag

SEQ ID NO: 10028855 - DNA, 22 bp, Homo sapiens
agcctctcactgtcaccctccc

SEQ ID NO: 10028856 - DNA, 22 bp, Homo sapiens
agcctctcatgttctcccccag

SEQ ID NO: 10028857 - DNA, 22 bp, Homo sapiens
agcctctccagagcctggcaga

SEQ ID NO: 10028858 - DNA, 22 bp, Homo sapiens
gcttcctgtccctcagccatga

SEQ ID NO: 10028859 - DNA, 22 bp, Homo sapiens
ggaactgaatgtctcggtataa

SEQ ID NO: 10028860 - DNA, 22 bp, Homo sapiens
ggcacagagctttgtcccagtt

SEQ ID NO: 10028861 - DNA, 22 bp, Homo sapiens
ggagggaaccttggctggattg

SEQ ID NO: 10028862 - DNA, 22 bp, Homo sapiens
ggagggaagtgagttctcagct

SEQ ID NO: 10028863 - DNA, 22 bp, Homo sapiens
ggagggaatgtctagcattctt

SEQ ID NO: 10028864 - DNA, 22 bp, Homo sapiens
ggcttcctggggcctcctgcaa

SEQ ID NO: 10028865 - DNA, 22 bp, Homo sapiens
ggcttcctttcactaccctcag

SEQ ID NO: 10028866 - DNA, 22 bp, Homo sapiens
ggcttcctaatactccctacac

SEQ ID NO: 10028867 - DNA, 22 bp, Homo sapiens
ggcttcctgggcatgtgttcta

SEQ ID NO: 10028868 - DNA, 22 bp, Homo sapiens
ggccttgcttgggttatatgcc

SEQ ID NO: 10028869 - DNA, 22 bp, Homo sapiens
ggcccagcctcagacatgccct

SEQ ID NO: 10028870 - DNA, 22 bp, Homo sapiens
ggccccagttcactcctggccg

SEQ ID NO: 10028871 - DNA, 20 bp, Homo sapiens
gggtccaggactctgaattt

SEQ ID NO: 10028872 - DNA, 22 bp, Homo sapiens
gggaccaggtcagggctctgac

SEQ ID NO: 10028873 - DNA, 22 bp, Homo sapiens
gggagggaaggaccttatgaat

SEQ ID NO: 10028874 - DNA, 22 bp, Homo sapiens
gggagggaaggtacctgtgtga

SEQ ID NO: 10028875 - DNA, 22 bp, Homo sapiens
gggagggaaggaggcgccgtgt

SEQ ID NO: 10028876 - DNA, 22 bp, Homo sapiens
gggagggaaagcttgatctgtc

SEQ ID NO: 10028877 - DNA, 23 bp, Homo sapiens
gggcccagcacaggacctggcag

SEQ ID NO: 10028878 - DNA, 22 bp, Homo sapiens
gtgtaatgttgtcagcatcatc

SEQ ID NO: 10028879 - DNA, 22 bp, Homo sapiens
gttattttatctctgagaggtt

SEQ ID NO: 10028880 - DNA, 22 bp, Homo sapiens
gttattttcattggctcagact

SEQ ID NO: 10028881 - DNA, 22 bp, Homo sapiens
gtgtgcaagggcatgtacattg

SEQ ID NO: 10028882 - DNA, 22 bp, Homo sapiens
gtgtgtaatgcttattgtgctt

SEQ ID NO: 10028883 - DNA, 22 bp, Homo sapiens
gtgtgtaaacctccaatctggg

SEQ ID NO: 10028884 - DNA, 22 bp, Homo sapiens
gtgtgtaagtctcctcttcccg

SEQ ID NO: 10028885 - DNA, 22 bp, Homo sapiens
gtgtcacatggtttactgcagc

SEQ ID NO: 10028886 - DNA, 22 bp, Homo sapiens
gtgtctcttttcagactcttca

SEQ ID NO: 10028887 - DNA, 22 bp, Homo sapiens
gttgttttgcaggatccttaca

SEQ ID NO: 10028888 - DNA, 22 bp, Homo sapiens
gttgtttttgttctctatagct

SEQ ID NO: 10028889 - DNA, 22 bp, Homo sapiens
taaatgaagaaatggagattgt

SEQ ID NO: 10028890 - DNA, 22 bp, Homo sapiens
taaatgagggctgacatgattg

SEQ ID NO: 10028891 - DNA, 22 bp, Homo sapiens
taaatcagtttctcttattggt

SEQ ID NO: 10028892 - DNA, 22 bp, Homo sapiens
taaatcagtagatatggtatag

SEQ ID NO: 10028893 - DNA, 22 bp, Homo sapiens
taaatcagggagtcatctgcga

SEQ ID NO: 10028894 - DNA, 22 bp, Homo sapiens
taaatcagcctttgctatttta

SEQ ID NO: 10028895 - DNA, 22 bp, Homo sapiens
taaatcttgtggcaatgcttct

SEQ ID NO: 10028896 - DNA, 22 bp, Homo sapiens
taaatgaaagggtttaatttat

SEQ ID NO: 10028897 - DNA, 22 bp, Homo sapiens
gtggccctggagttgtgacact

SEQ ID NO: 10028898 - DNA, 23 bp, Homo sapiens
gtgcgccaggacaacctgacgga

SEQ ID NO: 10028899 - DNA, 22 bp, Homo sapiens
gtgctacatggtagtgtagtta

SEQ ID NO: 10028900 - DNA, 22 bp, Homo sapiens
gtggaacatgtccatatacatt

SEQ ID NO: 10028901 - DNA, 22 bp, Homo sapiens
gtacacacaatctctggtcagt

SEQ ID NO: 10028902 - DNA, 20 bp, Homo sapiens
gtatataaccatagtgacta

SEQ ID NO: 10028903 - DNA, 22 bp, Homo sapiens
gtatactcatgtctcagaggac

SEQ ID NO: 10028904 - DNA, 22 bp, Homo sapiens
gtatactcaacctgcctagaat

SEQ ID NO: 10028905 - DNA, 22 bp, Homo sapiens
gtcagctctcttatccatgagg

SEQ ID NO: 10028906 - DNA, 22 bp, Homo sapiens
gtatgtgtaagtatgccacctt

SEQ ID NO: 10028907 - DNA, 19 bp, Homo sapiens
gtctctgctccagggtctc

SEQ ID NO: 10028908 - DNA, 22 bp, Homo sapiens
gtctctgctctagagtctgtga

SEQ ID NO: 10028909 - DNA, 22 bp, Homo sapiens
gcctgcctcaaaatcccagttc

SEQ ID NO: 10028910 - DNA, 22 bp, Homo sapiens
gcctggtgtccagaggcgagtg

SEQ ID NO: 10028911 - DNA, 22 bp, Homo sapiens
gcctgtgtggatgcgccggtgc

SEQ ID NO: 10028912 - DNA, 22 bp, Homo sapiens
gcctctgcaccagtactgtgcc

SEQ ID NO: 10028913 - DNA, 22 bp, Homo sapiens
gccaggctgctggctgctgtcc

SEQ ID NO: 10028914 - DNA, 22 bp, Homo sapiens
gctgaaatgccttgtaaatatt

SEQ ID NO: 10028915 - DNA, 22 bp, Homo sapiens
gctgaactacatgaagttgccg

SEQ ID NO: 10028916 - DNA, 22 bp, Homo sapiens
gcaggacagacccaagcagtct

SEQ ID NO: 10028917 - DNA, 16 bp, Homo sapiens
gcacacacatcaatga

SEQ ID NO: 10028918 - DNA, 22 bp, Homo sapiens
gcacacacatgtgagtacatgc

SEQ ID NO: 10028919 - DNA, 22 bp, Homo sapiens
gcacccaggccggcgactgcag

SEQ ID NO: 10028920 - DNA, 22 bp, Homo sapiens
gcaccctgagtgttcagctcca

SEQ ID NO: 10028921 - DNA, 22 bp, Homo sapiens
gcagaaatatgatgcataaagg

SEQ ID NO: 10028922 - DNA, 22 bp, Homo sapiens
gcaaactgcattctatagcttg

SEQ ID NO: 10028923 - DNA, 22 bp, Homo sapiens
gattttcatgataaacttgtga

SEQ ID NO: 10028924 - DNA, 22 bp, Homo sapiens
gattttcattatagctagtttc

SEQ ID NO: 10028925 - DNA, 22 bp, Homo sapiens
gatttgtagcttttcagtctgt

SEQ ID NO: 10028926 - DNA, 22 bp, Homo sapiens
gatgcctgcatttcaggagagt

SEQ ID NO: 10028927 - DNA, 22 bp, Homo sapiens
gattatgttcgactttagaaat

SEQ ID NO: 10028928 - DNA, 22 bp, Homo sapiens
gatgtgtttccaggatttgttt

SEQ ID NO: 10028929 - DNA, 22 bp, Homo sapiens
gattgagtctgaggatgctgca

SEQ ID NO: 10028930 - DNA, 22 bp, Homo sapiens
gaggagggagaattaggcttaa

SEQ ID NO: 10028931 - DNA, 22 bp, Homo sapiens
gaggagggagctggaagctctt

SEQ ID NO: 10028932 - DNA, 23 bp, Homo sapiens
gaggagggtctgacaagtgtagc

SEQ ID NO: 10028933 - DNA, 22 bp, Homo sapiens
gaggagggttggccttaggtag

SEQ ID NO: 10028934 - DNA, 22 bp, Homo sapiens
gagtttctgattcagtctgtgt

SEQ ID NO: 10028935 - DNA, 22 bp, Homo sapiens
gagtcttaggcaaaaataatgg

SEQ ID NO: 10028936 - DNA, 22 bp, Homo sapiens
gatcattggcctttctgcagtg

SEQ ID NO: 10028937 - DNA, 20 bp, Homo sapiens
gatacacagcacagagggcc

SEQ ID NO: 10028938 - DNA, 22 bp, Homo sapiens
gatgaaattgttttgatacttt

SEQ ID NO: 10028939 - DNA, 22 bp, Homo sapiens
gatgaagtcagttagtgggaaa

SEQ ID NO: 10028940 - DNA, 22 bp, Homo sapiens
gatgaatgtgggtcaagtacct

SEQ ID NO: 10028941 - DNA, 22 bp, Homo sapiens
gatgaatgagctgtgcacatta

SEQ ID NO: 10028942 - DNA, 21 bp, Homo sapiens
gatgaatgtcctgaccagaac

SEQ ID NO: 10028943 - DNA, 22 bp, Homo sapiens
gatgaatgatggcttgtttctg

SEQ ID NO: 10028944 - DNA, 22 bp, Homo sapiens
ctttgtaagtctttctccaaga

SEQ ID NO: 10028945 - DNA, 22 bp, Homo sapiens
ctttatatattcccaggctgcc

SEQ ID NO: 10028946 - DNA, 22 bp, Homo sapiens
cttctctcggtgcatccctcac

SEQ ID NO: 10028947 - DNA, 22 bp, Homo sapiens
gaaatacaaatgcctagatcct

SEQ ID NO: 10028948 - DNA, 22 bp, Homo sapiens
gaacctgagcgggcagcaagcg

SEQ ID NO: 10028949 - DNA, 22 bp, Homo sapiens
gaactgagttttctgcctggac

SEQ ID NO: 10028950 - DNA, 22 bp, Homo sapiens
gaactgagatttttgtctggct

SEQ ID NO: 10028951 - DNA, 19 bp, Homo sapiens
gaactgaggtctgaggctt

SEQ ID NO: 10028952 - DNA, 22 bp, Homo sapiens
gaaagttcacacatccacatgg

SEQ ID NO: 10028953 - DNA, 22 bp, Homo sapiens
gaaaagtaaacactaggggtca

SEQ ID NO: 10028954 - DNA, 22 bp, Homo sapiens
gacacagatatctctgagatta

SEQ ID NO: 10028955 - DNA, 22 bp, Homo sapiens
gacacagagctcacagtctcct

SEQ ID NO: 10028956 - DNA, 22 bp, Homo sapiens
gacacagagggcaccagatatg

SEQ ID NO: 10028957 - DNA, 22 bp, Homo sapiens
gagaaaatgtcagacttggtcg

SEQ ID NO: 10028958 - DNA, 22 bp, Homo sapiens
gagaaaatcttgggtcaagaat

SEQ ID NO: 10028959 - DNA, 22 bp, Homo sapiens
gagaaaatagcatgtgtagtat

SEQ ID NO: 10028960 - DNA, 22 bp, Homo sapiens
gacccagcttaagtcacatgtt

SEQ ID NO: 10028961 - DNA, 22 bp, Homo sapiens
tggcacagggcttggtcgctca

SEQ ID NO: 10028962 - DNA, 22 bp, Homo sapiens
tggatgaacagttttggagaga

SEQ ID NO: 10028963 - DNA, 22 bp, Homo sapiens
cctcggctgggccttggccact

SEQ ID NO: 10028964 - DNA, 22 bp, Homo sapiens
cctctgtaatgattcactgaat

SEQ ID NO: 10028965 - DNA, 22 bp, Homo sapiens
cctctacttaccactcagccag

SEQ ID NO: 10028966 - DNA, 22 bp, Homo sapiens
cctctctcttgtagtccctgcc

SEQ ID NO: 10028967 - DNA, 20 bp, Homo sapiens
cctctctgcatgctccctga

SEQ ID NO: 10028968 - DNA, 22 bp, Homo sapiens
cctctctgtaagggtccctccc

SEQ ID NO: 10028969 - DNA, 22 bp, Homo sapiens
cctctctgtgtggcctctccat

SEQ ID NO: 10028970 - DNA, 22 bp, Homo sapiens
cccccaaagtttgcacggataa

SEQ ID NO: 10028971 - DNA, 22 bp, Homo sapiens
tgccaatctttgtgataattgc

SEQ ID NO: 10028972 - DNA, 22 bp, Homo sapiens
cctgggtgaaatctctcctgca

SEQ ID NO: 10028973 - DNA, 22 bp, Homo sapiens
tgtgtctgtgtatacacggcat

SEQ ID NO: 10028974 - DNA, 22 bp, Homo sapiens
tgtctttatgcacactgacttg

SEQ ID NO: 10028975 - DNA, 22 bp, Homo sapiens
tgtaaacatatgtatgtatgta

SEQ ID NO: 10028976 - DNA, 23 bp, Homo sapiens
tgtaaacatcaccccctggagtt

SEQ ID NO: 10028977 - DNA, 22 bp, Homo sapiens
tgtaaagaaagacgcagagtta

SEQ ID NO: 10028978 - DNA, 22 bp, Homo sapiens
tgtatgtgtatgtacatatgca

SEQ ID NO: 10028979 - DNA, 22 bp, Homo sapiens
tgtaaacagccccatggagagc

SEQ ID NO: 10028980 - DNA, 22 bp, Homo sapiens
tgtaaacataccagagccaagt

SEQ ID NO: 10028981 - DNA, 22 bp, Homo sapiens
cctggctcctgcctctgcaggg

SEQ ID NO: 10028982 - DNA, 21 bp, Homo sapiens
tgtcattaatcgctatagaag

SEQ ID NO: 10028983 - DNA, 22 bp, Homo sapiens
tgtccatacctttacctgtgta

SEQ ID NO: 10028984 - DNA, 22 bp, Homo sapiens
ctatttgcttgtctagcatcta

SEQ ID NO: 10028985 - DNA, 22 bp, Homo sapiens
ctatttctgcctaatgacctgt

SEQ ID NO: 10028986 - DNA, 19 bp, Homo sapiens
ttgacgttgtggaattaac

SEQ ID NO: 10028987 - DNA, 22 bp, Homo sapiens
ctattttcattcttacattgtc

SEQ ID NO: 10028988 - DNA, 22 bp, Homo sapiens
ttcccacagtgttgaatcctct

SEQ ID NO: 10028989 - DNA, 22 bp, Homo sapiens
ttcccacattctttacattcat

SEQ ID NO: 10028990 - DNA, 22 bp, Homo sapiens
ttcccacagagattacattgaa

SEQ ID NO: 10028991 - DNA, 22 bp, Homo sapiens
ctaatgtaatgatatgttgaat

SEQ ID NO: 10028992 - DNA, 22 bp, Homo sapiens
ctaatgtaaagcatttgttcag

SEQ ID NO: 10028993 - DNA, 22 bp, Homo sapiens
ctaatgtaaaacagacttgcat

SEQ ID NO: 10028994 - DNA, 22 bp, Homo sapiens
ctaattttcccaaggccttcta

SEQ ID NO: 10028995 - DNA, 22 bp, Homo sapiens
ctaatttttgttctgcattgaa

SEQ ID NO: 10028996 - DNA, 22 bp, Homo sapiens
ctaatgtatcatggctctcagc

SEQ ID NO: 10028997 - DNA, 22 bp, Homo sapiens
ctcctctgtattgattgggact

SEQ ID NO: 10028998 - DNA, 22 bp, Homo sapiens
ctcctctgggtcctggtggcca

SEQ ID NO: 10028999 - DNA, 22 bp, Homo sapiens
tttaaatttagaagaaacactg

SEQ ID NO: 10029000 - DNA, 19 bp, Homo sapiens
ctctcactcgccacatcct

SEQ ID NO: 10029001 - DNA, 22 bp, Homo sapiens
ctctccccacaccctctgcatg

SEQ ID NO: 10029002 - DNA, 22 bp, Homo sapiens
ctctcctccaacagccctgccg

SEQ ID NO: 10029003 - DNA, 22 bp, Homo sapiens
ttgttaaagatgcagattccat

SEQ ID NO: 10029004 - DNA, 22 bp, Homo sapiens
ttgttaaaatgcatattctggt

SEQ ID NO: 10029005 - DNA, 22 bp, Homo sapiens
ttgcttttgtgtgctctctgga

SEQ ID NO: 10029006 - DNA, 22 bp, Homo sapiens
ctcatcaccacatataacaaag

SEQ ID NO: 10029007 - DNA, 22 bp, Homo sapiens
ctcatccatgaccgtgtttccc

SEQ ID NO: 10029008 - DNA, 22 bp, Homo sapiens
ctgctttgaggggctctgtata

SEQ ID NO: 10029009 - DNA, 22 bp, Homo sapiens
ctgctttgcatagctgccagag

SEQ ID NO: 10029010 - DNA, 18 bp, Homo sapiens
ctgctttgccttcattcc

SEQ ID NO: 10029011 - DNA, 22 bp, Homo sapiens
ctgctttggcagaagtcagcta

SEQ ID NO: 10029012 - DNA, 22 bp, Homo sapiens
ctggacacaaacatctcctctg

SEQ ID NO: 10029013 - DNA, 19 bp, Homo sapiens
ctggacacactctattgct

SEQ ID NO: 10029014 - DNA, 22 bp, Homo sapiens
ctggcctggggggacacatccc

SEQ ID NO: 10029015 - DNA, 22 bp, Homo sapiens
ctggcctggagcctctgggtgg

SEQ ID NO: 10029016 - DNA, 22 bp, Homo sapiens
ctgcctcctggctgatgggtag

SEQ ID NO: 10029017 - DNA, 22 bp, Homo sapiens
ctgcctgcgttgcctcgtgcct

SEQ ID NO: 10029018 - DNA, 22 bp, Homo sapiens
ctgcctcctcacgtccacagtg

SEQ ID NO: 10029019 - DNA, 22 bp, Homo sapiens
ctgatgaatggctcctgagtgg

SEQ ID NO: 10029020 - DNA, 22 bp, Homo sapiens
tttttaagctcctttgatgtca

SEQ ID NO: 10029021 - DNA, 22 bp, Homo sapiens
tttgtgaacaaacatgaagatg

SEQ ID NO: 10029022 - DNA, 19 bp, Homo sapiens
gtgggacagacattacata

SEQ ID NO: 10029023 - DNA, 21 bp, Homo sapiens
cagcccagcccattgacagtg

SEQ ID NO: 10029024 - DNA, 22 bp, Homo sapiens
cagcccagccttgtctctttat

SEQ ID NO: 10029025 - DNA, 22 bp, Homo sapiens
gtggcactggggtctagctggc

SEQ ID NO: 10029026 - DNA, 22 bp, Homo sapiens
gtgtacatgagaaatcaacttt

SEQ ID NO: 10029027 - DNA, 22 bp, Homo sapiens
gtttcctgcgtgtgccactcat

SEQ ID NO: 10029028 - DNA, 22 bp, Homo sapiens
gtgtgtctcccaagaaggccca

SEQ ID NO: 10029029 - DNA, 22 bp, Homo sapiens
gtgtgtcttgaccaggatcgga

SEQ ID NO: 10029030 - DNA, 22 bp, Homo sapiens
gtgtgtctttataagaagaggg

SEQ ID NO: 10029031 - DNA, 21 bp, Homo sapiens
gtgtgtctaatgtagtggaaa

SEQ ID NO: 10029032 - DNA, 22 bp, Homo sapiens
gtgtgtctttcatttcatgagg

SEQ ID NO: 10029033 - DNA, 22 bp, Homo sapiens
cagctttgagagttgcatttta

SEQ ID NO: 10029034 - DNA, 22 bp, Homo sapiens
taagatttttaaaatgtcctca

SEQ ID NO: 10029035 - DNA, 22 bp, Homo sapiens
taacagaaaggggacagaaata

SEQ ID NO: 10029036 - DNA, 22 bp, Homo sapiens
caggatgatgagtagagtgtga

SEQ ID NO: 10029037 - DNA, 22 bp, Homo sapiens
caggatggtctcgatctcctga

SEQ ID NO: 10029038 - DNA, 22 bp, Homo sapiens
caggatcttttaatgtctccag

SEQ ID NO: 10029039 - DNA, 22 bp, Homo sapiens
caggatgagaggcccagggaag

SEQ ID NO: 10029040 - DNA, 22 bp, Homo sapiens
taactttgataagaatcaggga

SEQ ID NO: 10029041 - DNA, 21 bp, Homo sapiens
taacttttgtgcctatcttgt

SEQ ID NO: 10029042 - DNA, 22 bp, Homo sapiens
taattgtaaagtagtagtacag

SEQ ID NO: 10029043 - DNA, 22 bp, Homo sapiens
taaatcaagaatatcagcttgt

SEQ ID NO: 10029044 - DNA, 22 bp, Homo sapiens
taaatgtgaccttcattttata

SEQ ID NO: 10029045 - DNA, 20 bp, Homo sapiens
caggagggacatttcagcat

SEQ ID NO: 10029046 - DNA, 22 bp, Homo sapiens
caggagggggtggagtttcgcc

SEQ ID NO: 10029047 - DNA, 22 bp, Homo sapiens
caggagggcccgagactcttcc

SEQ ID NO: 10029048 - DNA, 23 bp, Homo sapiens
caggagggaatgaagttagacaa

SEQ ID NO: 10029049 - DNA, 22 bp, Homo sapiens
caggagggtgtggaaaactggg

SEQ ID NO: 10029050 - DNA, 22 bp, Homo sapiens
gttttcttcctgcaattggcat

SEQ ID NO: 10029051 - DNA, 22 bp, Homo sapiens
taaaatcaccaaaagcaggtgg

SEQ ID NO: 10029052 - DNA, 22 bp, Homo sapiens
taaaatcaccaaaagcaggtgg

SEQ ID NO: 10029053 - DNA, 22 bp, Homo sapiens
taaaatgacttcctccaacatc

SEQ ID NO: 10029054 - DNA, 22 bp, Homo sapiens
taaaatagcatgtgcagtgaaa

SEQ ID NO: 10029055 - DNA, 21 bp, Homo sapiens
gtttgtaaggcactgtgttct

SEQ ID NO: 10029056 - DNA, 22 bp, Homo sapiens
gtttgtaagcagtctgcttgtg

SEQ ID NO: 10029057 - DNA, 22 bp, Homo sapiens
catgatctggtcctactgtggg

SEQ ID NO: 10029058 - DNA, 22 bp, Homo sapiens
catcacaggtcctgatgacatt

SEQ ID NO: 10029059 - DNA, 22 bp, Homo sapiens
catcacagaaataaacatacct

SEQ ID NO: 10029060 - DNA, 22 bp, Homo sapiens
catataatgtttgaagatgtgg

SEQ ID NO: 10029061 - DNA, 20 bp, Homo sapiens
tcagctctgtgcctgggatg

SEQ ID NO: 10029062 - DNA, 22 bp, Homo sapiens
catacatttatacacatctatg

SEQ ID NO: 10029063 - DNA, 22 bp, Homo sapiens
tcagaagtcccagaattcacat

SEQ ID NO: 10029064 - DNA, 22 bp, Homo sapiens
tcagaagtcccttgcatcttag

SEQ ID NO: 10029065 - DNA, 22 bp, Homo sapiens
tcagaagtaggagacattcttg

SEQ ID NO: 10029066 - DNA, 22 bp, Homo sapiens
tcagaagtactgtgctacaata

SEQ ID NO: 10029067 - DNA, 22 bp, Homo sapiens
tataatgttttccatggactga

SEQ ID NO: 10029068 - DNA, 22 bp, Homo sapiens
tataatctggttttattaagag

SEQ ID NO: 10029069 - DNA, 22 bp, Homo sapiens
tatctatgtgctctgacctctc

SEQ ID NO: 10029070 - DNA, 22 bp, Homo sapiens
tatggctaattctttactgacc

SEQ ID NO: 10029071 - DNA, 22 bp, Homo sapiens
tatctcattttattgcaaatgt

SEQ ID NO: 10029072 - DNA, 22 bp, Homo sapiens
tatgtgtatgtacatacataca

SEQ ID NO: 10029073 - DNA, 19 bp, Homo sapiens
tatttacttcttgattgca

SEQ ID NO: 10029074 - DNA, 22 bp, Homo sapiens
tatttagaatgcgtgtacgtgt

SEQ ID NO: 10029075 - DNA, 19 bp, Homo sapiens
ccagcccacagtgactttc

SEQ ID NO: 10029076 - DNA, 21 bp, Homo sapiens
ccagcccagctgtgtcccagc

SEQ ID NO: 10029077 - DNA, 19 bp, Homo sapiens
tctgcctctggtcaggctc

SEQ ID NO: 10029078 - DNA, 22 bp, Homo sapiens
tctgcctcgctaacagcagcca

SEQ ID NO: 10029079 - DNA, 22 bp, Homo sapiens
tctgcgccaccttgtgcttgtg

SEQ ID NO: 10029080 - DNA, 22 bp, Homo sapiens
ccactgccgatgttccatcttg

SEQ ID NO: 10029081 - DNA, 22 bp, Homo sapiens
ccactgccagctttgtcctccc

SEQ ID NO: 10029082 - DNA, 22 bp, Homo sapiens
ccacacagataagtgttttcta

SEQ ID NO: 10029083 - DNA, 22 bp, Homo sapiens
ccaatttcctgccagtaccttc

SEQ ID NO: 10029084 - DNA, 23 bp, Homo sapiens
catttgatcctcacaataaatgg

SEQ ID NO: 10029085 - DNA, 22 bp, Homo sapiens
tcttgctgttacagaattaaca

SEQ ID NO: 10029086 - DNA, 22 bp, Homo sapiens
tcttccagatacttcctgactt

SEQ ID NO: 10029087 - DNA, 22 bp, Homo sapiens
tcttccagaatgcattctcttt

SEQ ID NO: 10029088 - DNA, 22 bp, Homo sapiens
tcttcagtgaatggcaagatct

SEQ ID NO: 10029089 - DNA, 22 bp, Homo sapiens
tcttcagtgcatgttacctata

SEQ ID NO: 10029090 - DNA, 18 bp, Homo sapiens
tcttccagcttctggagg

SEQ ID NO: 10029091 - DNA, 22 bp, Homo sapiens
tctgtgcctgcttccccaccca

SEQ ID NO: 10029092 - DNA, 22 bp, Homo sapiens
tctgtgccacctctccagtgtc

SEQ ID NO: 10029093 - DNA, 22 bp, Homo sapiens
tctgttgcaatgtgcatggtga

SEQ ID NO: 10029094 - DNA, 17 bp, Homo sapiens
tctgtttctcctttctt

SEQ ID NO: 10029095 - DNA, 22 bp, Homo sapiens
tctgttttgcataatgttcttt

SEQ ID NO: 10029096 - DNA, 22 bp, Homo sapiens
tctgtttcttggctagcctctt

SEQ ID NO: 10029097 - DNA, 22 bp, Homo sapiens
tcttaaagccaagcataaacca

SEQ ID NO: 10029098 - DNA, 22 bp, Homo sapiens
tcttaaagcagcttgtaaaatg

SEQ ID NO: 10029099 - DNA, 22 bp, Homo sapiens
tctgtagtaggttgtagttctt

SEQ ID NO: 10029100 - DNA, 22 bp, Homo sapiens
tctgtatcgtaatcatgtctgg

SEQ ID NO: 10029101 - DNA, 22 bp, Homo sapiens
tctgtatctaattttacagtag

SEQ ID NO: 10029102 - DNA, 18 bp, Homo sapiens
tctgctgctgcgtcctgc

SEQ ID NO: 10029103 - DNA, 22 bp, Homo sapiens
tctgctgttgccatgagtaata

SEQ ID NO: 10029104 - DNA, 22 bp, Homo sapiens
tctggaccaagtcctgtggtga

SEQ ID NO: 10029105 - DNA, 22 bp, Homo sapiens
tctggaccctgggctgtgattt

SEQ ID NO: 10029106 - DNA, 22 bp, Homo sapiens
tctgacattttgagaatgacat

SEQ ID NO: 10029107 - DNA, 22 bp, Homo sapiens
tctgacattagattaattggaa

SEQ ID NO: 10029108 - DNA, 22 bp, Homo sapiens
tctgcaaactggctcttactgc

SEQ ID NO: 10029109 - DNA, 22 bp, Homo sapiens
tctgattagagcattcttgagt

SEQ ID NO: 10029110 - DNA, 23 bp, Homo sapiens
tctcatttcccttgatctatctt

SEQ ID NO: 10029111 - DNA, 22 bp, Homo sapiens
tctcatgttttacctgtcctca

SEQ ID NO: 10029112 - DNA, 22 bp, Homo sapiens
tctcatgtattgccctggtgtg

SEQ ID NO: 10029113 - DNA, 22 bp, Homo sapiens
tctcatgtgattcccgtgcatg

SEQ ID NO: 10029114 - DNA, 22 bp, Homo sapiens
tctcagtgacactcttcataca

SEQ ID NO: 10029115 - DNA, 22 bp, Homo sapiens
tctcatcttcattgtctcccat

SEQ ID NO: 10029116 - DNA, 22 bp, Homo sapiens
tctcatctgcgagctctgccag

SEQ ID NO: 10029117 - DNA, 22 bp, Homo sapiens
tctcatctagactctgcccttg

SEQ ID NO: 10029118 - DNA, 22 bp, Homo sapiens
tctcatctcaaattgtaatccc

SEQ ID NO: 10029119 - DNA, 22 bp, Homo sapiens
tctcactgatttgagaccaagg

SEQ ID NO: 10029120 - DNA, 22 bp, Homo sapiens
tctcactgggtcacagcagagg

SEQ ID NO: 10029121 - DNA, 22 bp, Homo sapiens
tctcccagaagtcctcagtaca

SEQ ID NO: 10029122 - DNA, 22 bp, Homo sapiens
tctcccagtggtgcagaaagca

SEQ ID NO: 10029123 - DNA, 22 bp, Homo sapiens
tctcccaggcaggagtgcagtg

SEQ ID NO: 10029124 - DNA, 20 bp, Homo sapiens
tctcccaggctcagggaaga

SEQ ID NO: 10029125 - DNA, 22 bp, Homo sapiens
tctcccagaggatcccagtgga

SEQ ID NO: 10029126 - DNA, 22 bp, Homo sapiens
tctcccagtcctctgtgcttac

SEQ ID NO: 10029127 - DNA, 22 bp, Homo sapiens
tctcccaggctggagtgcagtg

SEQ ID NO: 10029128 - DNA, 22 bp, Homo sapiens
tctcccaggtcatacacagaga

SEQ ID NO: 10029129 - DNA, 22 bp, Homo sapiens
tctcctgctcagaacagcctca

SEQ ID NO: 10029130 - DNA, 22 bp, Homo sapiens
tctcctgcagtcagcagtctca

SEQ ID NO: 10029131 - DNA, 22 bp, Homo sapiens
tctcgatctcctgaccttgtga

SEQ ID NO: 10029132 - DNA, 20 bp, Homo sapiens
tctcgcactcggagcagccg

SEQ ID NO: 10029133 - DNA, 22 bp, Homo sapiens
tctcgctctgtcgcccaggctg

SEQ ID NO: 10029134 - DNA, 17 bp, Homo sapiens
tctctttccctttctgc

SEQ ID NO: 10029135 - DNA, 22 bp, Homo sapiens
tctctttgaccctttagctcca

SEQ ID NO: 10029136 - DNA, 22 bp, Homo sapiens
tctctttgtctgctcttagttg

SEQ ID NO: 10029137 - DNA, 22 bp, Homo sapiens
tctctgctctgtgcctcagttt

SEQ ID NO: 10029138 - DNA, 22 bp, Homo sapiens
tctctcttgtcaccccatctgc

SEQ ID NO: 10029139 - DNA, 22 bp, Homo sapiens
tctctctgccaactcacagcca

SEQ ID NO: 10029140 - DNA, 22 bp, Homo sapiens
tctctcactggtgcctctgttg

SEQ ID NO: 10029141 - DNA, 22 bp, Homo sapiens
tctctctcagccattacagaac

SEQ ID NO: 10029142 - DNA, 22 bp, Homo sapiens
tctctctcctagtttttagtgg

SEQ ID NO: 10029143 - DNA, 22 bp, Homo sapiens
taagaacagtagaacagtaggt

SEQ ID NO: 10029144 - DNA, 22 bp, Homo sapiens
taagaatattgggaatggatgg

SEQ ID NO: 10029145 - DNA, 21 bp, Homo sapiens
tcctgtaagcttgggtggctc

SEQ ID NO: 10029146 - DNA, 22 bp, Homo sapiens
tcctggtgtaatggtaagcatg

SEQ ID NO: 10029147 - DNA, 22 bp, Homo sapiens
tcgccatcgtcggacacagtga

SEQ ID NO: 10029148 - DNA, 22 bp, Homo sapiens
tcgtgctcctggtgaggctctg

SEQ ID NO: 10029149 - DNA, 19 bp, Homo sapiens
tcctttctgttcctgagat

SEQ ID NO: 10029150 - DNA, 22 bp, Homo sapiens
tctagcatgggaaaatcacagc

SEQ ID NO: 10029151 - DNA, 22 bp, Homo sapiens
tctaccatgtgctgtgcattgg

SEQ ID NO: 10029152 - DNA, 22 bp, Homo sapiens
tgagtagagaattcagctaagg

SEQ ID NO: 10029153 - DNA, 22 bp, Homo sapiens
tgagggaatcctcacatcaatc

SEQ ID NO: 10029154 - DNA, 22 bp, Homo sapiens
tgagggaatattgatagatccg

SEQ ID NO: 10029155 - DNA, 22 bp, Homo sapiens
tgagatttggaaaatttgatat

SEQ ID NO: 10029156 - DNA, 22 bp, Homo sapiens
tgagattttcagcatcacttca

SEQ ID NO: 10029157 - DNA, 22 bp, Homo sapiens
tgagagatgaagttagttgttc

SEQ ID NO: 10029158 - DNA, 22 bp, Homo sapiens
tgagagattgctgtatgttttg

SEQ ID NO: 10029159 - DNA, 22 bp, Homo sapiens
tgagagatgaactctgatatgt

SEQ ID NO: 10029160 - DNA, 22 bp, Homo sapiens
tgagaacacattcgtgccctac

SEQ ID NO: 10029161 - DNA, 22 bp, Homo sapiens
tgagccaggagtttgaggctgt

SEQ ID NO: 10029162 - DNA, 22 bp, Homo sapiens
tgagcagtggctcctgctggac

SEQ ID NO: 10029163 - DNA, 22 bp, Homo sapiens
tgagcatagcccttctagtgtt

SEQ ID NO: 10029164 - DNA, 22 bp, Homo sapiens
tgagcaagacccggcctctgcc

SEQ ID NO: 10029165 - DNA, 23 bp, Homo sapiens
tgagctgagtgagttggcctggg

SEQ ID NO: 10029166 - DNA, 22 bp, Homo sapiens
tgagcttcaaagttggatctga

SEQ ID NO: 10029167 - DNA, 21 bp, Homo sapiens
tgactgaggcttcttcacaca

SEQ ID NO: 10029168 - DNA, 22 bp, Homo sapiens
tgactgaaggactagattgatt

SEQ ID NO: 10029169 - DNA, 22 bp, Homo sapiens
tgactacaacctccacctcccg

SEQ ID NO: 10029170 - DNA, 22 bp, Homo sapiens
tgaatgaatgaattaatagagt

SEQ ID NO: 10029171 - DNA, 22 bp, Homo sapiens
tgaatgaatcctaacaaagaca

SEQ ID NO: 10029172 - DNA, 22 bp, Homo sapiens
tgaatgtaggtctaatatccca

SEQ ID NO: 10029173 - DNA, 17 bp, Homo sapiens
tgaaatcagcacccagg

SEQ ID NO: 10029174 - DNA, 22 bp, Homo sapiens
tgaaatcatcaaaagagccatt

SEQ ID NO: 10029175 - DNA, 22 bp, Homo sapiens
tgaaagttattactgatgatgt

SEQ ID NO: 10029176 - DNA, 22 bp, Homo sapiens
tgaaatgtttgtatataaggtc

SEQ ID NO: 10029177 - DNA, 22 bp, Homo sapiens
tgaaatgtctttgcaattgaaa

SEQ ID NO: 10029178 - DNA, 22 bp, Homo sapiens
tgaacctggggctgttgctggt

SEQ ID NO: 10029179 - DNA, 22 bp, Homo sapiens
tctttgtttgtactgttagaat

SEQ ID NO: 10029180 - DNA, 19 bp, Homo sapiens
tctttgtacaagtctctgc

SEQ ID NO: 10029181 - DNA, 22 bp, Homo sapiens
tgaaaattgttgtacttgataa

SEQ ID NO: 10029182 - DNA, 22 bp, Homo sapiens
tgaaaattgttgtacttgataa

SEQ ID NO: 10029183 - DNA, 22 bp, Homo sapiens
tgaaaatttccatcagttatat

SEQ ID NO: 10029184 - DNA, 22 bp, Homo sapiens
tgaaaattcatctcatagcaga

SEQ ID NO: 10029185 - DNA, 22 bp, Homo sapiens
tgaaaattctcaggctcacccc

SEQ ID NO: 10029186 - DNA, 22 bp, Homo sapiens
tgaaaattaagcagatgaatga

SEQ ID NO: 10029187 - DNA, 22 bp, Homo sapiens
tctttttatattgacaaaaggt

SEQ ID NO: 10029188 - DNA, 22 bp, Homo sapiens
tgccatccttgaggaagggcaa

SEQ ID NO: 10029189 - DNA, 18 bp, Homo sapiens
tgccatccccagtcaagt

SEQ ID NO: 10029190 - DNA, 20 bp, Homo sapiens
tgccccaggcctgcacctgc

SEQ ID NO: 10029191 - DNA, 22 bp, Homo sapiens
tgccccagactctgctcacctc

SEQ ID NO: 10029192 - DNA, 22 bp, Homo sapiens
tgcccaggctggagtacagtgg

SEQ ID NO: 10029193 - DNA, 22 bp, Homo sapiens
tgccctgctgtggctctgccca

SEQ ID NO: 10029194 - DNA, 22 bp, Homo sapiens
tgcccctctcctgtgatccaag

SEQ ID NO: 10029195 - DNA, 22 bp, Homo sapiens
tgcctccctctctgccactgga

SEQ ID NO: 10029196 - DNA, 23 bp, Homo sapiens
tgcctctgcctccctagtctgca

SEQ ID NO: 10029197 - DNA, 22 bp, Homo sapiens
tgcctctctaacccatgcccaa

SEQ ID NO: 10029198 - DNA, 22 bp, Homo sapiens
tgcctccctctctgccactgga

SEQ ID NO: 10029199 - DNA, 22 bp, Homo sapiens
tgcctctgtgggcagagctgcc

SEQ ID NO: 10029200 - DNA, 22 bp, Homo sapiens
tgcatttgttaccttattgcag

SEQ ID NO: 10029201 - DNA, 22 bp, Homo sapiens
tgcattctgacttagttaatat

SEQ ID NO: 10029202 - DNA, 22 bp, Homo sapiens
tgcattgcctctattcattata

SEQ ID NO: 10029203 - DNA, 22 bp, Homo sapiens
tgcatgcacgtatctgcgtgtg

SEQ ID NO: 10029204 - DNA, 22 bp, Homo sapiens
tgcatgtgtcgggcctgtgcta

SEQ ID NO: 10029205 - DNA, 22 bp, Homo sapiens
tgcatgtgtttgccacagtgag

SEQ ID NO: 10029206 - DNA, 23 bp, Homo sapiens
tgcatgtgaattcatacttgttt

SEQ ID NO: 10029207 - DNA, 22 bp, Homo sapiens
tgcacccatagcacacactcct

SEQ ID NO: 10029208 - DNA, 22 bp, Homo sapiens
tgcagaaaccaattcaagtaag

SEQ ID NO: 10029209 - DNA, 22 bp, Homo sapiens
tgcagaaacagtcattaatgta

SEQ ID NO: 10029210 - DNA, 22 bp, Homo sapiens
tgcagaaataaagatattatca

SEQ ID NO: 10029211 - DNA, 22 bp, Homo sapiens
tgcagaaattcagaaagcataa

SEQ ID NO: 10029212 - DNA, 22 bp, Homo sapiens
tgcagagaaaactcctgggtac

SEQ ID NO: 10029213 - DNA, 21 bp, Homo sapiens
tgcagagatttttacttgtct

SEQ ID NO: 10029214 - DNA, 22 bp, Homo sapiens
tgcaagaaacatattccacaag

SEQ ID NO: 10029215 - DNA, 23 bp, Homo sapiens
tgcaactgtgtcagaagttagaa

SEQ ID NO: 10029216 - DNA, 22 bp, Homo sapiens
tgcaagaattgtataccctcat

SEQ ID NO: 10029217 - DNA, 22 bp, Homo sapiens
tgcaagaatgacccatctaccc

SEQ ID NO: 10029218 - DNA, 22 bp, Homo sapiens
tgcaatctcggcactttgggag

SEQ ID NO: 10029219 - DNA, 22 bp, Homo sapiens
tgatttcaagccagggggcgtt

SEQ ID NO: 10029220 - DNA, 22 bp, Homo sapiens
tgatattttatgagctttcata

SEQ ID NO: 10029221 - DNA, 22 bp, Homo sapiens
tgatgaataaacttgagagtca

SEQ ID NO: 10029222 - DNA, 22 bp, Homo sapiens
tgatgaataaccttgagcatat

SEQ ID NO: 10029223 - DNA, 17 bp, Homo sapiens
tgatgcaaagtcagctg

SEQ ID NO: 10029224 - DNA, 22 bp, Homo sapiens
tgattcctgtgcttattccagt

SEQ ID NO: 10029225 - DNA, 23 bp, Homo sapiens
tgattgaaagcctgagaaagctg

SEQ ID NO: 10029226 - DNA, 22 bp, Homo sapiens
tgattctttgaccaaaaaattg

SEQ ID NO: 10029227 - DNA, 18 bp, Homo sapiens
tgattcaagttgccctcc

SEQ ID NO: 10029228 - DNA, 22 bp, Homo sapiens
tgattcaattatctgatgcttt

SEQ ID NO: 10029229 - DNA, 22 bp, Homo sapiens
tgattcaataggaattgagtag

SEQ ID NO: 10029230 - DNA, 22 bp, Homo sapiens
tgtggccttgcagcctggaggt

SEQ ID NO: 10029231 - DNA, 23 bp, Homo sapiens
tgtggaacgccataggagcacga

SEQ ID NO: 10029232 - DNA, 22 bp, Homo sapiens
tgtgtcaagtggaatttcaggg

SEQ ID NO: 10029233 - DNA, 22 bp, Homo sapiens
tgtgtcaagacatttagtcatt

SEQ ID NO: 10029234 - DNA, 22 bp, Homo sapiens
tgtgttaacactgcatgataat

SEQ ID NO: 10029235 - DNA, 22 bp, Homo sapiens
tgtgttaagtatttgatacact

SEQ ID NO: 10029236 - DNA, 22 bp, Homo sapiens
tgtgttaaggtgcatctagtgc

SEQ ID NO: 10029237 - DNA, 22 bp, Homo sapiens
tgtgttaattccacaaacattc

SEQ ID NO: 10029238 - DNA, 22 bp, Homo sapiens
ttaaaatgcagattctgattca

SEQ ID NO: 10029239 - DNA, 22 bp, Homo sapiens
tgttttaagggtcaactgtcac

SEQ ID NO: 10029240 - DNA, 22 bp, Homo sapiens
tgttttaagagcgcactttata

SEQ ID NO: 10029241 - DNA, 22 bp, Homo sapiens
tgttttaatctcccattgctct

SEQ ID NO: 10029242 - DNA, 22 bp, Homo sapiens
tgtttattgagtgcctactata

SEQ ID NO: 10029243 - DNA, 22 bp, Homo sapiens
tgtttaaatagaacatactgca

SEQ ID NO: 10029244 - DNA, 21 bp, Homo sapiens
tgttgttttatggctatgaat

SEQ ID NO: 10029245 - DNA, 22 bp, Homo sapiens
tgtcttaatatgtgcattctgt

SEQ ID NO: 10029246 - DNA, 19 bp, Homo sapiens
tgtcttaattaactcagag

SEQ ID NO: 10029247 - DNA, 22 bp, Homo sapiens
tgtcttaagaaattgcatttgt

SEQ ID NO: 10029248 - DNA, 22 bp, Homo sapiens
tgtcttattccttctgttcagc

SEQ ID NO: 10029249 - DNA, 22 bp, Homo sapiens
tgtcttatggcatgtccactgg

SEQ ID NO: 10029250 - DNA, 22 bp, Homo sapiens
tgtctctagggcaatgtgaact

SEQ ID NO: 10029251 - DNA, 22 bp, Homo sapiens
tgtgcaaagtgtacaaattaat

SEQ ID NO: 10029252 - DNA, 21 bp, Homo sapiens
tgtgacctccctctatctttc

SEQ ID NO: 10029253 - DNA, 22 bp, Homo sapiens
tgtgaaatgaagataattcttg

SEQ ID NO: 10029254 - DNA, 19 bp, Homo sapiens
tgtgacatcactgggcagc

SEQ ID NO: 10029255 - DNA, 22 bp, Homo sapiens
tgtgctctgaagagtgcatgtc

SEQ ID NO: 10029256 - DNA, 22 bp, Homo sapiens
tgtgcatattactacctactcc

SEQ ID NO: 10029257 - DNA, 22 bp, Homo sapiens
ttccagccatggtttccctatg

SEQ ID NO: 10029258 - DNA, 22 bp, Homo sapiens
ttccagcccgcgacttgttcag

SEQ ID NO: 10029259 - DNA, 22 bp, Homo sapiens
ttcattaagtataaaatgtggt

SEQ ID NO: 10029260 - DNA, 22 bp, Homo sapiens
ttatttcttgtctatgtagcca

SEQ ID NO: 10029261 - DNA, 22 bp, Homo sapiens
ttcactgccaactaacatggaa

SEQ ID NO: 10029262 - DNA, 22 bp, Homo sapiens
ttcactgctacatccaggtgcc

SEQ ID NO: 10029263 - DNA, 22 bp, Homo sapiens
ttaataaagtatgaattggaaa

SEQ ID NO: 10029264 - DNA, 22 bp, Homo sapiens
ttaatgtatggggttgagatga

SEQ ID NO: 10029265 - DNA, 22 bp, Homo sapiens
ttaattaaattcatgagcattg

SEQ ID NO: 10029266 - DNA, 22 bp, Homo sapiens
ttatgatttgccacagattggt

SEQ ID NO: 10029267 - DNA, 22 bp, Homo sapiens
ttatatgtttctgtttggaggc

SEQ ID NO: 10029268 - DNA, 22 bp, Homo sapiens
ttagatgtgcaggacttttatc

SEQ ID NO: 10029269 - DNA, 22 bp, Homo sapiens
ttagatgtggacttatgttatt

SEQ ID NO: 10029270 - DNA, 22 bp, Homo sapiens
ttagatgtggctatatgatcgt

SEQ ID NO: 10029271 - DNA, 22 bp, Homo sapiens
ttagatcattttagctaaatgg

SEQ ID NO: 10029272 - DNA, 22 bp, Homo sapiens
ttagatcaatagttctcaactc

SEQ ID NO: 10029273 - DNA, 19 bp, Homo sapiens
ttagatcattaccatgagg

SEQ ID NO: 10029274 - DNA, 23 bp, Homo sapiens
tgggcttctgagaaagcacctaa

SEQ ID NO: 10029275 - DNA, 22 bp, Homo sapiens
tgggcttctggagtggggcaga

SEQ ID NO: 10029276 - DNA, 22 bp, Homo sapiens
tgggttcagatcccagctctgt

SEQ ID NO: 10029277 - DNA, 20 bp, Homo sapiens
tgtatttaatgaaggctttt

SEQ ID NO: 10029278 - DNA, 22 bp, Homo sapiens
tgtatttatattagaatggttg

SEQ ID NO: 10029279 - DNA, 18 bp, Homo sapiens
tgtagagccaggtttgcc

SEQ ID NO: 10029280 - DNA, 22 bp, Homo sapiens
tggtcctggaaggtcctgaggg

SEQ ID NO: 10029281 - DNA, 22 bp, Homo sapiens
tggtcctgccccgtgcacagag

SEQ ID NO: 10029282 - DNA, 22 bp, Homo sapiens
tggtggacaccgcagccatgaa

SEQ ID NO: 10029283 - DNA, 22 bp, Homo sapiens
tggtggacctggcattgaacct

SEQ ID NO: 10029284 - DNA, 22 bp, Homo sapiens
tgtaaataatgcatgtaaatca

SEQ ID NO: 10029285 - DNA, 22 bp, Homo sapiens
tggtgtaatcagtttctagctc

SEQ ID NO: 10029286 - DNA, 22 bp, Homo sapiens
tggtgtctgcactccctggcgt

SEQ ID NO: 10029287 - DNA, 22 bp, Homo sapiens
tgtaaattgaaggaaatttgtg

SEQ ID NO: 10029288 - DNA, 22 bp, Homo sapiens
tgtaagaaaacctgtacaaaga

SEQ ID NO: 10029289 - DNA, 22 bp, Homo sapiens
tgtaagaacaactgtcaaatgt

SEQ ID NO: 10029290 - DNA, 22 bp, Homo sapiens
tgtaagatatgagtacatgtaa

SEQ ID NO: 10029291 - DNA, 22 bp, Homo sapiens
tgtacaaagttaaacctatata

SEQ ID NO: 10029292 - DNA, 22 bp, Homo sapiens
tgtacagaggtgtacatatgat

SEQ ID NO: 10029293 - DNA, 20 bp, Homo sapiens
tggagggattgttggcaaat

SEQ ID NO: 10029294 - DNA, 22 bp, Homo sapiens
tggagggatacaaagatgaaaa

SEQ ID NO: 10029295 - DNA, 22 bp, Homo sapiens
tggagggaacaaaggagtccca

SEQ ID NO: 10029296 - DNA, 22 bp, Homo sapiens
tggagggaacccaggctgctct

SEQ ID NO: 10029297 - DNA, 22 bp, Homo sapiens
tggactgagcttgagagggttg

SEQ ID NO: 10029298 - DNA, 22 bp, Homo sapiens
tggactgaagttacagatgaca

SEQ ID NO: 10029299 - DNA, 19 bp, Homo sapiens
tggaatcagcaagaatatt

SEQ ID NO: 10029300 - DNA, 22 bp, Homo sapiens
tggaacaagacagcatagagct

SEQ ID NO: 10029301 - DNA, 22 bp, Homo sapiens
tgctttgtgtttgaatagataa

SEQ ID NO: 10029302 - DNA, 22 bp, Homo sapiens
tgctttgtgtacacaagaatca

SEQ ID NO: 10029303 - DNA, 22 bp, Homo sapiens
tgcttctgtttcattgatctta

SEQ ID NO: 10029304 - DNA, 22 bp, Homo sapiens
tgcttctggaaacagtggctgt

SEQ ID NO: 10029305 - DNA, 22 bp, Homo sapiens
tgcttcatgcttctgacaatag

SEQ ID NO: 10029306 - DNA, 22 bp, Homo sapiens
tgcttcattaaaacaatatttt

SEQ ID NO: 10029307 - DNA, 22 bp, Homo sapiens
tgcttccagcatccctggcctg

SEQ ID NO: 10029308 - DNA, 22 bp, Homo sapiens
tgcttcatgaggtagtggcagt

SEQ ID NO: 10029309 - DNA, 22 bp, Homo sapiens
tgcttatttgaatttattctca

SEQ ID NO: 10029310 - DNA, 22 bp, Homo sapiens
tgcttatttaggtagatattaa

SEQ ID NO: 10029311 - DNA, 22 bp, Homo sapiens
tgctgtgaggttgagaaggaag

SEQ ID NO: 10029312 - DNA, 19 bp, Homo sapiens
tgctggaacatcagtagct

SEQ ID NO: 10029313 - DNA, 22 bp, Homo sapiens
tgctctgtattctatggcagtt

SEQ ID NO: 10029314 - DNA, 22 bp, Homo sapiens
tgctctagagctattggcttcc

SEQ ID NO: 10029315 - DNA, 22 bp, Homo sapiens
tgctcagtcctaccttggctcc

SEQ ID NO: 10029316 - DNA, 22 bp, Homo sapiens
tgctatctctatatccatttat

SEQ ID NO: 10029317 - DNA, 22 bp, Homo sapiens
tgctatacatgtacatattagt

SEQ ID NO: 10029318 - DNA, 22 bp, Homo sapiens
tgctatacggagcatcttcagg

SEQ ID NO: 10029319 - DNA, 22 bp, Homo sapiens
tgcgccatgtgctctcggccct

SEQ ID NO: 10029320 - DNA, 22 bp, Homo sapiens
tgcctggctgggctgctcatgg

SEQ ID NO: 10029321 - DNA, 22 bp, Homo sapiens
tgcgatggcgtagacaaatccc

SEQ ID NO: 10029322 - DNA, 22 bp, Homo sapiens
tgccttgccactgctcttaatg

SEQ ID NO: 10029323 - DNA, 22 bp, Homo sapiens
tgccttgcgggcgtttctgttg

SEQ ID NO: 10029324 - DNA, 22 bp, Homo sapiens
tgccttgcggtgtatttctggg

SEQ ID NO: 10029325 - DNA, 22 bp, Homo sapiens
tgccttgctggatgtcagtttt

SEQ ID NO: 10029326 - DNA, 22 bp, Homo sapiens
tggccacagcctctgccagttc

SEQ ID NO: 10029327 - DNA, 22 bp, Homo sapiens
tggccacatgcgtctgtgaggc

SEQ ID NO: 10029328 - DNA, 22 bp, Homo sapiens
tggccacttggcatgtgtgcca

SEQ ID NO: 10029329 - DNA, 22 bp, Homo sapiens
tggcctcttaaggatgacacaa

SEQ ID NO: 10029330 - DNA, 20 bp, Homo sapiens
tggcctctgagatgccacgg

SEQ ID NO: 10029331 - DNA, 22 bp, Homo sapiens
tggcagagtcatcacatctgga

SEQ ID NO: 10029332 - DNA, 22 bp, Homo sapiens
tggcagagaacacacatgattc

SEQ ID NO: 10029333 - DNA, 22 bp, Homo sapiens
tggcagagaacacggctgatct

SEQ ID NO: 10029334 - DNA, 22 bp, Homo sapiens
tggcagagagactctccttgat

SEQ ID NO: 10029335 - DNA, 22 bp, Homo sapiens
tggcagagagagtgcagtcgac

SEQ ID NO: 10029336 - DNA, 22 bp, Homo sapiens
tggcagagcccagactccagtc

SEQ ID NO: 10029337 - DNA, 22 bp, Homo sapiens
tggcaatttcagaaaatagaat

SEQ ID NO: 10029338 - DNA, 22 bp, Homo sapiens
tggcgtctctcataagtatgtg

SEQ ID NO: 10029339 - DNA, 22 bp, Homo sapiens
tggcctgtggcacgtgctccat

SEQ ID NO: 10029340 - DNA, 22 bp, Homo sapiens
tggctgtgtgccaggctgtctg

SEQ ID NO: 10029341 - DNA, 22 bp, Homo sapiens
tggcttccgccgcgggcctcgg

SEQ ID NO: 10029342 - DNA, 17 bp, Homo sapiens
tggcttccctgggccac

SEQ ID NO: 10029343 - DNA, 22 bp, Homo sapiens
tggcttcctgcatggatcctct

SEQ ID NO: 10029344 - DNA, 22 bp, Homo sapiens
acagatgagttagaataggcag

SEQ ID NO: 10029345 - DNA, 20 bp, Homo sapiens
acagagactgagacacttgc

SEQ ID NO: 10029346 - DNA, 22 bp, Homo sapiens
acactttatcaatattcaaaaa

SEQ ID NO: 10029347 - DNA, 22 bp, Homo sapiens
acacagaggcatgacagtggct

SEQ ID NO: 10029348 - DNA, 22 bp, Homo sapiens
acacagagtttgacacatggga

SEQ ID NO: 10029349 - DNA, 22 bp, Homo sapiens
acacattaacctttgaaattct

SEQ ID NO: 10029350 - DNA, 22 bp, Homo sapiens
agataagtactgttattattgc

SEQ ID NO: 10029351 - DNA, 22 bp, Homo sapiens
acaagagattatctacagatga

SEQ ID NO: 10029352 - DNA, 19 bp, Homo sapiens
aattctgtttcagcagatc

SEQ ID NO: 10029353 - DNA, 22 bp, Homo sapiens
acaaagtaggtcatcaaagctc

SEQ ID NO: 10029354 - DNA, 22 bp, Homo sapiens
acaaagtagtcaaagtagatga

SEQ ID NO: 10029355 - DNA, 23 bp, Homo sapiens
acaaagtaattcctgcttccaaa

SEQ ID NO: 10029356 - DNA, 22 bp, Homo sapiens
acaaagtaagggctaatgagca

SEQ ID NO: 10029357 - DNA, 22 bp, Homo sapiens
acaaagtaggaagattagctga

SEQ ID NO: 10029358 - DNA, 22 bp, Homo sapiens
aatggcagaatgggccagaagc

SEQ ID NO: 10029359 - DNA, 22 bp, Homo sapiens
aatggcagaggcaaagatggta

SEQ ID NO: 10029360 - DNA, 22 bp, Homo sapiens
aatacagaggaaacatttaata

SEQ ID NO: 10029361 - DNA, 22 bp, Homo sapiens
actataaaaggataaaccagaa

SEQ ID NO: 10029362 - DNA, 22 bp, Homo sapiens
acctaaatctacctcatgtttt

SEQ ID NO: 10029363 - DNA, 22 bp, Homo sapiens
aatatagaatcactttccttca

SEQ ID NO: 10029364 - DNA, 22 bp, Homo sapiens
aatactagttattaaagctttt

SEQ ID NO: 10029365 - DNA, 22 bp, Homo sapiens
actttcttggtcccatgtttga

SEQ ID NO: 10029366 - DNA, 22 bp, Homo sapiens
actttcttcttatgcattaagg

SEQ ID NO: 10029367 - DNA, 22 bp, Homo sapiens
actttcttctactacttggaga

SEQ ID NO: 10029368 - DNA, 22 bp, Homo sapiens
actttcttaggctgtataaatg

SEQ ID NO: 10029369 - DNA, 22 bp, Homo sapiens
actttcttatccatgatctcac

SEQ ID NO: 10029370 - DNA, 22 bp, Homo sapiens
actttaaaaagagccttctaac

SEQ ID NO: 10029371 - DNA, 22 bp, Homo sapiens
aatcagaatttattgaatcttt

SEQ ID NO: 10029372 - DNA, 22 bp, Homo sapiens
acattgtttgagaatacagatg

SEQ ID NO: 10029373 - DNA, 22 bp, Homo sapiens
acatttctcttgatgtctctat

SEQ ID NO: 10029374 - DNA, 22 bp, Homo sapiens
acatttcttccctttagcagaa

SEQ ID NO: 10029375 - DNA, 22 bp, Homo sapiens
acattttacaccaagacttctt

SEQ ID NO: 10029376 - DNA, 22 bp, Homo sapiens
aaggcagagattagcagaatga

SEQ ID NO: 10029377 - DNA, 16 bp, Homo sapiens
acagtgtctcaagcac

SEQ ID NO: 10029378 - DNA, 17 bp, Homo sapiens
acagtgtctatgaaatg

SEQ ID NO: 10029379 - DNA, 22 bp, Homo sapiens
aagctctgtagctcatgtgata

SEQ ID NO: 10029380 - DNA, 22 bp, Homo sapiens
aagcattttgccacttgaagtt

SEQ ID NO: 10029381 - DNA, 22 bp, Homo sapiens
aagcattttgttttaagaatga

SEQ ID NO: 10029382 - DNA, 22 bp, Homo sapiens
aagcatttttcacagcaacagc

SEQ ID NO: 10029383 - DNA, 22 bp, Homo sapiens
aagcattttagataaagcatca

SEQ ID NO: 10029384 - DNA, 22 bp, Homo sapiens
aagcatttttgaaatggtagga

SEQ ID NO: 10029385 - DNA, 22 bp, Homo sapiens
acacatgaaataatattatgca

SEQ ID NO: 10029386 - DNA, 22 bp, Homo sapiens
aagagcaggacagaatcagaac

SEQ ID NO: 10029387 - DNA, 22 bp, Homo sapiens
acacatgataagaaagtttaaa

SEQ ID NO: 10029388 - DNA, 22 bp, Homo sapiens
aagcagctggaagagtaagatg

SEQ ID NO: 10029389 - DNA, 21 bp, Homo sapiens
aagcagcttaataaagtatgt

SEQ ID NO: 10029390 - DNA, 22 bp, Homo sapiens
acagcagagccagtggctctag

SEQ ID NO: 10029391 - DNA, 22 bp, Homo sapiens
aagcagaggtagggtgtgcagt

SEQ ID NO: 10029392 - DNA, 22 bp, Homo sapiens
aagaaatgtgaatattgaatag

SEQ ID NO: 10029393 - DNA, 22 bp, Homo sapiens
aattctcaggtaaaagttaagt

SEQ ID NO: 10029394 - DNA, 22 bp, Homo sapiens
aattctcaggaatttcatctgt

SEQ ID NO: 10029395 - DNA, 20 bp, Homo sapiens
aagaaacttgaaagtacaag

SEQ ID NO: 10029396 - DNA, 22 bp, Homo sapiens
aagaaactgaaagtggcttcat

SEQ ID NO: 10029397 - DNA, 22 bp, Homo sapiens
aagaaaacaatgacttgccagc

SEQ ID NO: 10029398 - DNA, 21 bp, Homo sapiens
aatttcagacccattttgcct

SEQ ID NO: 10029399 - DNA, 22 bp, Homo sapiens
acacaaagctattgagtgtcat

SEQ ID NO: 10029400 - DNA, 20 bp, Homo sapiens
acacaaagcaatggagtaca

SEQ ID NO: 10029401 - DNA, 22 bp, Homo sapiens
acacaaagttggatgacaaaat

SEQ ID NO: 10029402 - DNA, 22 bp, Homo sapiens
aagagcaagtgggtagtgaagc

SEQ ID NO: 10029403 - DNA, 20 bp, Homo sapiens
aatacatgagcacactttca

SEQ ID NO: 10029404 - DNA, 22 bp, Homo sapiens
aactacttgactgacagattca

SEQ ID NO: 10029405 - DNA, 22 bp, Homo sapiens
aaattattcaaaaagctgtgtt

SEQ ID NO: 10029406 - DNA, 23 bp, Homo sapiens
aaattattgctcttcaattgcct

SEQ ID NO: 10029407 - DNA, 22 bp, Homo sapiens
aaattattttcagaatggagaa

SEQ ID NO: 10029408 - DNA, 22 bp, Homo sapiens
aaattattatgcccctctataa

SEQ ID NO: 10029409 - DNA, 22 bp, Homo sapiens
aaggcagatataaagactagag

SEQ ID NO: 10029410 - DNA, 22 bp, Homo sapiens
aaatgtcagaaaacatggagtg

SEQ ID NO: 10029411 - DNA, 22 bp, Homo sapiens
aaatgtcaaggtgatagatgca

SEQ ID NO: 10029412 - DNA, 22 bp, Homo sapiens
aaatgcatgtatgtaatatgct

SEQ ID NO: 10029413 - DNA, 22 bp, Homo sapiens
aacacagatcaaaatatttcct

SEQ ID NO: 10029414 - DNA, 22 bp, Homo sapiens
aacacagaagtgccaagagcca

SEQ ID NO: 10029415 - DNA, 22 bp, Homo sapiens
aaaacccttctgcagactctga

SEQ ID NO: 10029416 - DNA, 22 bp, Homo sapiens
aaaaggcagtgcaagagagggt

SEQ ID NO: 10029417 - DNA, 22 bp, Homo sapiens
aaaaggcagtgcaagagagggt

SEQ ID NO: 10029418 - DNA, 22 bp, Homo sapiens
aaaaagatgtcctgaagtttag

SEQ ID NO: 10029419 - DNA, 17 bp, Homo sapiens
aaaattctgtaaagagg

SEQ ID NO: 10029420 - DNA, 22 bp, Homo sapiens
aaacatggccattcagactgtg

SEQ ID NO: 10029421 - DNA, 22 bp, Homo sapiens
aaacttcattttcaactgcaaa

SEQ ID NO: 10029422 - DNA, 22 bp, Homo sapiens
aaagaaatacctttctcagctt

SEQ ID NO: 10029423 - DNA, 22 bp, Homo sapiens
aaagaaatagatggcatttaaa

SEQ ID NO: 10029424 - DNA, 22 bp, Homo sapiens
aaagaacaaatgatatatggtt

SEQ ID NO: 10029425 - DNA, 22 bp, Homo sapiens
aaagaaacctatcagccacatg

SEQ ID NO: 10029426 - DNA, 22 bp, Homo sapiens
aaagactaagaagagtattatt

SEQ ID NO: 10029427 - DNA, 22 bp, Homo sapiens
aaagagcaagctgagatttgaa

SEQ ID NO: 10029428 - DNA, 22 bp, Homo sapiens
aaagcagaactgagagagctgg

SEQ ID NO: 10029429 - DNA, 22 bp, Homo sapiens
aaagcactttgagactgacagg

SEQ ID NO: 10029430 - DNA, 22 bp, Homo sapiens
aacataaatttgaagtggcaaa

SEQ ID NO: 10029431 - DNA, 22 bp, Homo sapiens
aaagcagaggttgcagtgagct

SEQ ID NO: 10029432 - DNA, 22 bp, Homo sapiens
aaagcctcccaggttatgagta

SEQ ID NO: 10029433 - DNA, 23 bp, Homo sapiens
aaaggcaggcctaggacatattg

SEQ ID NO: 10029434 - DNA, 22 bp, Homo sapiens
aaaggcaggactgcagcatagg

SEQ ID NO: 10029435 - DNA, 22 bp, Homo sapiens
aaaggcagtgggtatgtggatc

SEQ ID NO: 10029436 - DNA, 22 bp, Homo sapiens
aaaggcagagttgttggaggca

SEQ ID NO: 10029437 - DNA, 22 bp, Homo sapiens
aaaggcagagttgttggaggca

SEQ ID NO: 10029438 - DNA, 22 bp, Homo sapiens
aaagtgcaaggattacaggcat

SEQ ID NO: 10029439 - DNA, 22 bp, Homo sapiens
aaagtttacagtgcacatgggt

SEQ ID NO: 10029440 - DNA, 22 bp, Homo sapiens
aaagtttaggctttgaaaccag

SEQ ID NO: 10029441 - DNA, 22 bp, Homo sapiens
aaagttttagaactaggaagca

SEQ ID NO: 10029442 - DNA, 22 bp, Homo sapiens
aagatcaagtgtactttatgta

SEQ ID NO: 10029443 - DNA, 22 bp, Homo sapiens
aagattaaaggggagacaagct

SEQ ID NO: 10029444 - DNA, 22 bp, Homo sapiens
actgcaacacctcctgggttca

SEQ ID NO: 10029445 - DNA, 22 bp, Homo sapiens
actgcacaaggcctggacacac

SEQ ID NO: 10029446 - DNA, 21 bp, Homo sapiens
actgcacactatgtgaattga

SEQ ID NO: 10029447 - DNA, 22 bp, Homo sapiens
actgcacagaaccttagaatat

SEQ ID NO: 10029448 - DNA, 22 bp, Homo sapiens
actgcacagaagaaactatcaa

SEQ ID NO: 10029449 - DNA, 20 bp, Homo sapiens
agggtggggacgttctgact

SEQ ID NO: 10029450 - DNA, 22 bp, Homo sapiens
agggtggggtgctacatcttta

SEQ ID NO: 10029451 - DNA, 22 bp, Homo sapiens
actaaagaagccaaagttttct

SEQ ID NO: 10029452 - DNA, 22 bp, Homo sapiens
accttaaaggccgaagtaaaga

SEQ ID NO: 10029453 - DNA, 22 bp, Homo sapiens
acttctttcacaatgtttctag

SEQ ID NO: 10029454 - DNA, 22 bp, Homo sapiens
agtttacccactgttgaaatta

SEQ ID NO: 10029455 - DNA, 22 bp, Homo sapiens
agtttacttgaatgatgaattc

SEQ ID NO: 10029456 - DNA, 22 bp, Homo sapiens
agtttcccttgcaaacccattt

SEQ ID NO: 10029457 - DNA, 22 bp, Homo sapiens
actgtaaaggtgattagaagtt

SEQ ID NO: 10029458 - DNA, 22 bp, Homo sapiens
actgtaaattacataagaacag

SEQ ID NO: 10029459 - DNA, 22 bp, Homo sapiens
atcatttacaaactcagcattg

SEQ ID NO: 10029460 - DNA, 22 bp, Homo sapiens
atcatttacaatgaaagcctga

SEQ ID NO: 10029461 - DNA, 22 bp, Homo sapiens
atcatttagtggggcattggaa

SEQ ID NO: 10029462 - DNA, 22 bp, Homo sapiens
atcatttatgccccaattagat

SEQ ID NO: 10029463 - DNA, 22 bp, Homo sapiens
agaaaataaattgatggtggaa

SEQ ID NO: 10029464 - DNA, 22 bp, Homo sapiens
atatgaaaatgttttagctgta

SEQ ID NO: 10029465 - DNA, 22 bp, Homo sapiens
agaaacagaagggaaagctttt

SEQ ID NO: 10029466 - DNA, 22 bp, Homo sapiens
acagtacaagcaatgcattttt

SEQ ID NO: 10029467 - DNA, 22 bp, Homo sapiens
acagggagtctgaggggatagt

SEQ ID NO: 10029468 - DNA, 18 bp, Homo sapiens
acagggatggggtaagtg

SEQ ID NO: 10029469 - DNA, 22 bp, Homo sapiens
acatttttattcatcaaagcag

SEQ ID NO: 10029470 - DNA, 22 bp, Homo sapiens
aggctggatttatggggacttc

SEQ ID NO: 10029471 - DNA, 22 bp, Homo sapiens
accctcaacaaattcactctat

SEQ ID NO: 10029472 - DNA, 22 bp, Homo sapiens
aggcaggggagctggaagggta

SEQ ID NO: 10029473 - DNA, 22 bp, Homo sapiens
acatggcaaaagggactttaca

SEQ ID NO: 10029474 - DNA, 22 bp, Homo sapiens
aggctatttccactcttctcat

SEQ ID NO: 10029475 - DNA, 22 bp, Homo sapiens
acatttaagttaaaacctcagt

SEQ ID NO: 10029476 - DNA, 22 bp, Homo sapiens
acatttaacctttgaggaactg

SEQ ID NO: 10029477 - DNA, 19 bp, Homo sapiens
acatttaaattcagatctc

SEQ ID NO: 10029478 - DNA, 22 bp, Homo sapiens
acatttaaccaaactgtttaat

SEQ ID NO: 10029479 - DNA, 22 bp, Homo sapiens
acatttacagtgctagacaatc

SEQ ID NO: 10029480 - DNA, 19 bp, Homo sapiens
acatttagaatgtacttgc

SEQ ID NO: 10029481 - DNA, 22 bp, Homo sapiens
aggctgagggctcctgagggca

SEQ ID NO: 10029482 - DNA, 22 bp, Homo sapiens
aggctgaggctttccttggaga

SEQ ID NO: 10029483 - DNA, 22 bp, Homo sapiens
aggctgagtttctcattctcgc

SEQ ID NO: 10029484 - DNA, 22 bp, Homo sapiens
caatgaaagcaactgcctataa

SEQ ID NO: 10029485 - DNA, 22 bp, Homo sapiens
caaggcaggcagttcacttgag

SEQ ID NO: 10029486 - DNA, 22 bp, Homo sapiens
attttctattctgctggtttag

SEQ ID NO: 10029487 - DNA, 22 bp, Homo sapiens
agcacaaaaacattcccagagt

SEQ ID NO: 10029488 - DNA, 22 bp, Homo sapiens
caaatgatccttgcaagctgtg

SEQ ID NO: 10029489 - DNA, 22 bp, Homo sapiens
agcctttaacacttcacattga

SEQ ID NO: 10029490 - DNA, 22 bp, Homo sapiens
agccaggatggtctcgatcggc

SEQ ID NO: 10029491 - DNA, 22 bp, Homo sapiens
agccaggatggtctcgatcggc

SEQ ID NO: 10029492 - DNA, 20 bp, Homo sapiens
agcaaacaggctccaccaga

SEQ ID NO: 10029493 - DNA, 22 bp, Homo sapiens
agcaaacagtgtgctaagaaat

SEQ ID NO: 10029494 - DNA, 22 bp, Homo sapiens
agatttcaggttggggcagaag

SEQ ID NO: 10029495 - DNA, 22 bp, Homo sapiens
agatttcagatgctcggcagtt

SEQ ID NO: 10029496 - DNA, 19 bp, Homo sapiens
agatggggaagagtgtgag

SEQ ID NO: 10029497 - DNA, 22 bp, Homo sapiens
agatgaaagatttttatagaga

SEQ ID NO: 10029498 - DNA, 22 bp, Homo sapiens
atttagtaagtacttgttgaat

SEQ ID NO: 10029499 - DNA, 22 bp, Homo sapiens
atttagacatgtatctgatagc

SEQ ID NO: 10029500 - DNA, 22 bp, Homo sapiens
atttagacaccagcttgtaagg

SEQ ID NO: 10029501 - DNA, 18 bp, Homo sapiens
atttaatgaactgaaagc

SEQ ID NO: 10029502 - DNA, 19 bp, Homo sapiens
attcttctcaaatatccat

SEQ ID NO: 10029503 - DNA, 22 bp, Homo sapiens
attcagcattggcaccatggat

SEQ ID NO: 10029504 - DNA, 22 bp, Homo sapiens
attcagcattcattatgcgcca

SEQ ID NO: 10029505 - DNA, 22 bp, Homo sapiens
attcagattcctaggtttcatt

SEQ ID NO: 10029506 - DNA, 22 bp, Homo sapiens
attcagcaaacatttattatct

SEQ ID NO: 10029507 - DNA, 22 bp, Homo sapiens
attcagcacaatttggccaata

SEQ ID NO: 10029508 - DNA, 22 bp, Homo sapiens
attcagcaagctatgggacagg

SEQ ID NO: 10029509 - DNA, 22 bp, Homo sapiens
attagcacataagaggtatagg

SEQ ID NO: 10029510 - DNA, 22 bp, Homo sapiens
attagcatattaaatagtcatt

SEQ ID NO: 10029511 - DNA, 22 bp, Homo sapiens
attagcaaggttcatgagaaga

SEQ ID NO: 10029512 - DNA, 22 bp, Homo sapiens
atggagtttggggtcaaatact

SEQ ID NO: 10029513 - DNA, 22 bp, Homo sapiens
atggctggtgatactggagtga

SEQ ID NO: 10029514 - DNA, 22 bp, Homo sapiens
atggaaaagggtctttcatttc

SEQ ID NO: 10029515 - DNA, 22 bp, Homo sapiens
atggaaaaggctgatttcatta

SEQ ID NO: 10029516 - DNA, 19 bp, Homo sapiens
atggaaaattgtactcaat

SEQ ID NO: 10029517 - DNA, 19 bp, Homo sapiens
atggaaaatgccagactga

SEQ ID NO: 10029518 - DNA, 20 bp, Homo sapiens
atgtaaaagacagggagtag

SEQ ID NO: 10029519 - DNA, 20 bp, Homo sapiens
atgtaaaattataaggctga

SEQ ID NO: 10029520 - DNA, 20 bp, Homo sapiens
atgtaaaattataaggctga

SEQ ID NO: 10029521 - DNA, 22 bp, Homo sapiens
agaatagttttacttttctatg

SEQ ID NO: 10029522 - DNA, 22 bp, Homo sapiens
atctttaaagacatgtgaactt

SEQ ID NO: 10029523 - DNA, 22 bp, Homo sapiens
agacacatcttaggttgtcagg

SEQ ID NO: 10029524 - DNA, 22 bp, Homo sapiens
atgaagcaattagaaacttgaa

SEQ ID NO: 10029525 - DNA, 22 bp, Homo sapiens
atgaagcagatttattactcac

SEQ ID NO: 10029526 - DNA, 22 bp, Homo sapiens
gaaagcaagttgactgcagaat

SEQ ID NO: 10029527 - DNA, 22 bp, Homo sapiens
atctacatgttgatttaaagaa

SEQ ID NO: 10029528 - DNA, 22 bp, Homo sapiens
atcttccttcactttctcccac

SEQ ID NO: 10029529 - DNA, 22 bp, Homo sapiens
atgaaataaatacccacacata

SEQ ID NO: 10029530 - DNA, 22 bp, Homo sapiens
atctttttactaacactgctta

SEQ ID NO: 10029531 - DNA, 22 bp, Homo sapiens
atctttttatctgtttggaaca

SEQ ID NO: 10029532 - DNA, 22 bp, Homo sapiens
atgtgtcaggtacactcattag

SEQ ID NO: 10029533 - DNA, 22 bp, Homo sapiens
atgtctttataaatgtataatg

SEQ ID NO: 10029534 - DNA, 22 bp, Homo sapiens
gaggccagggtaccatcaacat

SEQ ID NO: 10029535 - DNA, 22 bp, Homo sapiens
atggctggcactggcctgggtt

SEQ ID NO: 10029536 - DNA, 22 bp, Homo sapiens
atgccacttcattccagcctcg

SEQ ID NO: 10029537 - DNA, 21 bp, Homo sapiens
atggaaaaacaggtagagcat

SEQ ID NO: 10029538 - DNA, 22 bp, Homo sapiens
atgccactgcgctccagcctgg

SEQ ID NO: 10029539 - DNA, 22 bp, Homo sapiens
gacagcaaagcagagccaaggc

SEQ ID NO: 10029540 - DNA, 22 bp, Homo sapiens
gacagcaacactcaattctgca

SEQ ID NO: 10029541 - DNA, 22 bp, Homo sapiens
atttaattaatcatggtgaatt

SEQ ID NO: 10029542 - DNA, 22 bp, Homo sapiens
atttaatttggagagagaaacc

SEQ ID NO: 10029543 - DNA, 22 bp, Homo sapiens
atttaatttatagatgtggata

SEQ ID NO: 10029544 - DNA, 22 bp, Homo sapiens
atttactctggctggaatacaa

SEQ ID NO: 10029545 - DNA, 22 bp, Homo sapiens
gccaggaggcttaactggacag

SEQ ID NO: 10029546 - DNA, 22 bp, Homo sapiens
atttcagaatgtcctaatttag

SEQ ID NO: 10029547 - DNA, 22 bp, Homo sapiens
atttcagactgtgttggaaaat

SEQ ID NO: 10029548 - DNA, 21 bp, Homo sapiens
atttcagagcacacaagtaaa

SEQ ID NO: 10029549 - DNA, 22 bp, Homo sapiens
atttcagagaatgaacctaatc

SEQ ID NO: 10029550 - DNA, 22 bp, Homo sapiens
atttcagagctttgcagctaat

SEQ ID NO: 10029551 - DNA, 22 bp, Homo sapiens
atttcagattcagaaatgtagg

SEQ ID NO: 10029552 - DNA, 22 bp, Homo sapiens
atttcagattcgagaggaagtg

SEQ ID NO: 10029553 - DNA, 22 bp, Homo sapiens
atttccttcatcagcctatcct

SEQ ID NO: 10029554 - DNA, 22 bp, Homo sapiens
atttccttgcaagtttctgtaa

SEQ ID NO: 10029555 - DNA, 16 bp, Homo sapiens
atttccttgtgagttt

SEQ ID NO: 10029556 - DNA, 22 bp, Homo sapiens
atttccttcccagatttggttc

SEQ ID NO: 10029557 - DNA, 22 bp, Homo sapiens
atttccttcggacagtttgggt

SEQ ID NO: 10029558 - DNA, 22 bp, Homo sapiens
atttccttgcaacttaggcatg

SEQ ID NO: 10029559 - DNA, 22 bp, Homo sapiens
atttcctttgcaaagactgtgc

SEQ ID NO: 10029560 - DNA, 22 bp, Homo sapiens
atttcagattcgagaggaagtg

SEQ ID NO: 10029561 - DNA, 22 bp, Homo sapiens
atttcaggccaccagatgtctt

SEQ ID NO: 10029562 - DNA, 22 bp, Homo sapiens
caaactctcccactcactctga

SEQ ID NO: 10029563 - DNA, 22 bp, Homo sapiens
caaacttactgtgtttaaagag

SEQ ID NO: 10029564 - DNA, 22 bp, Homo sapiens
caaactttgcaaaacttacagt

SEQ ID NO: 10029565 - DNA, 22 bp, Homo sapiens
attaaatggtggtcattcattt

SEQ ID NO: 10029566 - DNA, 22 bp, Homo sapiens
attattcttatgtcatcatggc

SEQ ID NO: 10029567 - DNA, 22 bp, Homo sapiens
attgcacttcagcctgggtgac

SEQ ID NO: 10029568 - DNA, 22 bp, Homo sapiens
attgcactccggcctgggtgac

SEQ ID NO: 10029569 - DNA, 22 bp, Homo sapiens
attctacacctctctcatttag

SEQ ID NO: 10029570 - DNA, 22 bp, Homo sapiens
attctactcattgatctatata

SEQ ID NO: 10029571 - DNA, 22 bp, Homo sapiens
attctactgcttggaatatctt

SEQ ID NO: 10029572 - DNA, 22 bp, Homo sapiens
attatttacagtgtgctcgaag

SEQ ID NO: 10029573 - DNA, 22 bp, Homo sapiens
attatttatcctcttggtctat

SEQ ID NO: 10029574 - DNA, 22 bp, Homo sapiens
attatttagaaatcgattgaaa

SEQ ID NO: 10029575 - DNA, 22 bp, Homo sapiens
cacaagtggctggggaaaggga

SEQ ID NO: 10029576 - DNA, 21 bp, Homo sapiens
ggaaaattcagagtgcaattt

SEQ ID NO: 10029577 - DNA, 22 bp, Homo sapiens
ggaaaatgggaacctgaagcca

SEQ ID NO: 10029578 - DNA, 22 bp, Homo sapiens
cacaaggttctgtaaaatcaaa

SEQ ID NO: 10029579 - DNA, 22 bp, Homo sapiens
cacaaagtgggtggaaaactaa

SEQ ID NO: 10029580 - DNA, 22 bp, Homo sapiens
cacaaaggagaatgtcagcata

SEQ ID NO: 10029581 - DNA, 22 bp, Homo sapiens
caaagtatatttcatagtctca

SEQ ID NO: 10029582 - DNA, 22 bp, Homo sapiens
caaagtaactgcctttccaatt

SEQ ID NO: 10029583 - DNA, 22 bp, Homo sapiens
caaagtaatttggagatatata

SEQ ID NO: 10029584 - DNA, 22 bp, Homo sapiens
gctgcagagtgatgaagtgggg

SEQ ID NO: 10029585 - DNA, 22 bp, Homo sapiens
gctgcagtgagccaagatcgtg

SEQ ID NO: 10029586 - DNA, 22 bp, Homo sapiens
cactgcactccagcttgggtga

SEQ ID NO: 10029587 - DNA, 22 bp, Homo sapiens
cagacaggctagccagactcac

SEQ ID NO: 10029588 - DNA, 22 bp, Homo sapiens
cagacaggcaggtgagagctcc

SEQ ID NO: 10029589 - DNA, 22 bp, Homo sapiens
cagacaggagactggatcatgg

SEQ ID NO: 10029590 - DNA, 22 bp, Homo sapiens
cagacaggaattctggcgtggt

SEQ ID NO: 10029591 - DNA, 17 bp, Homo sapiens
cagacaggctgtcaccc

SEQ ID NO: 10029592 - DNA, 22 bp, Homo sapiens
cagacagggccctgtgatggta

SEQ ID NO: 10029593 - DNA, 22 bp, Homo sapiens
cagacagggacctcgctccaga

SEQ ID NO: 10029594 - DNA, 22 bp, Homo sapiens
ggggaacaccgggcagaggcgc

SEQ ID NO: 10029595 - DNA, 22 bp, Homo sapiens
cagcagagcttatgttgggtca

SEQ ID NO: 10029596 - DNA, 22 bp, Homo sapiens
gtattttaagtgactactaggt

SEQ ID NO: 10029597 - DNA, 22 bp, Homo sapiens
gtattttactgctcaaagctct

SEQ ID NO: 10029598 - DNA, 22 bp, Homo sapiens
atacagaagttttccacttatt

SEQ ID NO: 10029599 - DNA, 22 bp, Homo sapiens
atacagaattcactacagtttc

SEQ ID NO: 10029600 - DNA, 22 bp, Homo sapiens
atacagatcccacagcatgtga

SEQ ID NO: 10029601 - DNA, 22 bp, Homo sapiens
atacagatgcttgctcgtgact

SEQ ID NO: 10029602 - DNA, 22 bp, Homo sapiens
ctgcttcttttgggtaattgat

SEQ ID NO: 10029603 - DNA, 17 bp, Homo sapiens
ataaaggcaagtattat

SEQ ID NO: 10029604 - DNA, 22 bp, Homo sapiens
ataaaggccaaaatttgcattt

SEQ ID NO: 10029605 - DNA, 22 bp, Homo sapiens
ctgtctttttagagagtaggat

SEQ ID NO: 10029606 - DNA, 18 bp, Homo sapiens
ctgtcttttttctctcca

SEQ ID NO: 10029607 - DNA, 22 bp, Homo sapiens
ctgtcttttcttctcattgatg

SEQ ID NO: 10029608 - DNA, 22 bp, Homo sapiens
ctgtctttggtcctgtctgtta

SEQ ID NO: 10029609 - DNA, 22 bp, Homo sapiens
ctgtcttttcatactttccctc

SEQ ID NO: 10029610 - DNA, 22 bp, Homo sapiens
ctgtcttttactatcatttact

SEQ ID NO: 10029611 - DNA, 22 bp, Homo sapiens
ctgtcttctaccttcaacctcc

SEQ ID NO: 10029612 - DNA, 22 bp, Homo sapiens
ctgtcttctcctttgtttcagg

SEQ ID NO: 10029613 - DNA, 22 bp, Homo sapiens
atcacatatttaagaaacatgt

SEQ ID NO: 10029614 - DNA, 22 bp, Homo sapiens
atataaagtgtttagaaagctg

SEQ ID NO: 10029615 - DNA, 22 bp, Homo sapiens
atatatacaactagattaaaag

SEQ ID NO: 10029616 - DNA, 22 bp, Homo sapiens
ctgggcacaggggagcagagtc

SEQ ID NO: 10029617 - DNA, 22 bp, Homo sapiens
agtgacaagagctaggcttttt

SEQ ID NO: 10029618 - DNA, 22 bp, Homo sapiens
cgggttcacgccattctcctgc

SEQ ID NO: 10029619 - DNA, 22 bp, Homo sapiens
ctcaaactgtgcttgtaaattc

SEQ ID NO: 10029620 - DNA, 22 bp, Homo sapiens
agtgggagaatgaataagggcc

SEQ ID NO: 10029621 - DNA, 17 bp, Homo sapiens
ctctgtacaggaaagag

SEQ ID NO: 10029622 - DNA, 22 bp, Homo sapiens
ctctgtacctggcatagcaacc

SEQ ID NO: 10029623 - DNA, 22 bp, Homo sapiens
agtggtggagccaggaaatgtg

SEQ ID NO: 10029624 - DNA, 20 bp, Homo sapiens
ctcttagtactgttcctggt

SEQ ID NO: 10029625 - DNA, 22 bp, Homo sapiens
ctcttcttgtctctggttagaa

SEQ ID NO: 10029626 - DNA, 22 bp, Homo sapiens
ctcttcttggcccccatgaggg

SEQ ID NO: 10029627 - DNA, 22 bp, Homo sapiens
ctcttctttagtccagaccatc

SEQ ID NO: 10029628 - DNA, 22 bp, Homo sapiens
ctccttctcctcgggaggccag

SEQ ID NO: 10029629 - DNA, 22 bp, Homo sapiens
ctccttctgaggctctgggttc

SEQ ID NO: 10029630 - DNA, 22 bp, Homo sapiens
ctccttttcctactcatactat

SEQ ID NO: 10029631 - DNA, 22 bp, Homo sapiens
ctccttctgggcctggcagtgg

SEQ ID NO: 10029632 - DNA, 22 bp, Homo sapiens
ctctccttgaggcttggacttc

SEQ ID NO: 10029633 - DNA, 22 bp, Homo sapiens
ccttttatatggctcatcacag

SEQ ID NO: 10029634 - DNA, 22 bp, Homo sapiens
ccttttatactctgtcctctgg

SEQ ID NO: 10029635 - DNA, 22 bp, Homo sapiens
cggctcactgcagctccgcctc

SEQ ID NO: 10029636 - DNA, 22 bp, Homo sapiens
cgctccaagcttgatgggacca

SEQ ID NO: 10029637 - DNA, 23 bp, Homo sapiens
agggtgagcaagctatggagacc

SEQ ID NO: 10029638 - DNA, 22 bp, Homo sapiens
aggagaaaacagtgttttgcct

SEQ ID NO: 10029639 - DNA, 22 bp, Homo sapiens
aggagaggggtaggattaattt

SEQ ID NO: 10029640 - DNA, 22 bp, Homo sapiens
catgcagatgtcatgaggcatg

SEQ ID NO: 10029641 - DNA, 21 bp, Homo sapiens
aggcagcaggatccagggaca

SEQ ID NO: 10029642 - DNA, 22 bp, Homo sapiens
agcttaaactctttgaagttat

SEQ ID NO: 10029643 - DNA, 22 bp, Homo sapiens
aggctgagccacggggctggct

SEQ ID NO: 10029644 - DNA, 22 bp, Homo sapiens
aggcatttttattgtccttaaa

SEQ ID NO: 10029645 - DNA, 22 bp, Homo sapiens
aggcattttctgtatggacaga

SEQ ID NO: 10029646 - DNA, 22 bp, Homo sapiens
aggcatttgagtccatgggtga

SEQ ID NO: 10029647 - DNA, 22 bp, Homo sapiens
aggcaggttggtgagaagactg

SEQ ID NO: 10029648 - DNA, 22 bp, Homo sapiens
agggccagggaagctgtatttt

SEQ ID NO: 10029649 - DNA, 22 bp, Homo sapiens
aggctgtgtggtcatggtggct

SEQ ID NO: 10029650 - DNA, 22 bp, Homo sapiens
aggctgtgtttaagtggtaatg

SEQ ID NO: 10029651 - DNA, 19 bp, Homo sapiens
aggctgtttgttaataaag

SEQ ID NO: 10029652 - DNA, 22 bp, Homo sapiens
ccaaagtctggagcagcagagc

SEQ ID NO: 10029653 - DNA, 19 bp, Homo sapiens
catttagaagtacatatta

SEQ ID NO: 10029654 - DNA, 22 bp, Homo sapiens
ccacaaagttgctgagtttctg

SEQ ID NO: 10029655 - DNA, 22 bp, Homo sapiens
ccacaaagaatgggggaagcat

SEQ ID NO: 10029656 - DNA, 21 bp, Homo sapiens
ccaaatagcctccattaacag

SEQ ID NO: 10029657 - DNA, 22 bp, Homo sapiens
tctgtcttcttcattgcctata

SEQ ID NO: 10029658 - DNA, 22 bp, Homo sapiens
tctgtcttggccagccatctgg

SEQ ID NO: 10029659 - DNA, 22 bp, Homo sapiens
tctgtcttagcatctttgctca

SEQ ID NO: 10029660 - DNA, 22 bp, Homo sapiens
tctctcttcagagataccttgc

SEQ ID NO: 10029661 - DNA, 22 bp, Homo sapiens
tctctcttcatgcttttagaat

SEQ ID NO: 10029662 - DNA, 19 bp, Homo sapiens
cagtgctgttcattcagtg

SEQ ID NO: 10029663 - DNA, 22 bp, Homo sapiens
cagtgctgttgggcccagagag

SEQ ID NO: 10029664 - DNA, 18 bp, Homo sapiens
cagtgctgttaacagtga

SEQ ID NO: 10029665 - DNA, 22 bp, Homo sapiens
cagtgctgttaataaacacaaa

SEQ ID NO: 10029666 - DNA, 22 bp, Homo sapiens
tcagaaatactatcagcttttg

SEQ ID NO: 10029667 - DNA, 22 bp, Homo sapiens
tcagaaattttctcagtagttc

SEQ ID NO: 10029668 - DNA, 22 bp, Homo sapiens
tatggcatttagaaatgtcaga

SEQ ID NO: 10029669 - DNA, 22 bp, Homo sapiens
tatacagatatctaagatgtaa

SEQ ID NO: 10029670 - DNA, 22 bp, Homo sapiens
cagggtggaagctgtagagtgg

SEQ ID NO: 10029671 - DNA, 22 bp, Homo sapiens
catacattttgcatatttacca

SEQ ID NO: 10029672 - DNA, 21 bp, Homo sapiens
catgtcttccacactgtagta

SEQ ID NO: 10029673 - DNA, 22 bp, Homo sapiens
catgtcttgccctgattagtag

SEQ ID NO: 10029674 - DNA, 22 bp, Homo sapiens
tcattttcacacataaatagca

SEQ ID NO: 10029675 - DNA, 19 bp, Homo sapiens
gtttggcagcaaatcagac

SEQ ID NO: 10029676 - DNA, 18 bp, Homo sapiens
gtttggcataactgatgc

SEQ ID NO: 10029677 - DNA, 22 bp, Homo sapiens
caggaagctgagctgcactgca

SEQ ID NO: 10029678 - DNA, 22 bp, Homo sapiens
taaaccaagtgtccatattagt

SEQ ID NO: 10029679 - DNA, 22 bp, Homo sapiens
taaactactaggatgaattttt

SEQ ID NO: 10029680 - DNA, 22 bp, Homo sapiens
taaactactgggcaaggacagg

SEQ ID NO: 10029681 - DNA, 22 bp, Homo sapiens
caggagtgcaggtggtgaggca

SEQ ID NO: 10029682 - DNA, 18 bp, Homo sapiens
taaatatatttccccctt

SEQ ID NO: 10029683 - DNA, 22 bp, Homo sapiens
taaagcatgtttcagtaaggtt

SEQ ID NO: 10029684 - DNA, 22 bp, Homo sapiens
caggagagatatgagtccccac

SEQ ID NO: 10029685 - DNA, 22 bp, Homo sapiens
taaagcagtgcaaaagcgtttt

SEQ ID NO: 10029686 - DNA, 22 bp, Homo sapiens
taatttacagagatacagtcag

SEQ ID NO: 10029687 - DNA, 22 bp, Homo sapiens
taattgtatggagaaggctgca

SEQ ID NO: 10029688 - DNA, 17 bp, Homo sapiens
caggcagacatgtaagc

SEQ ID NO: 10029689 - DNA, 22 bp, Homo sapiens
caggcagaaggaagtaccaggc

SEQ ID NO: 10029690 - DNA, 22 bp, Homo sapiens
tacagtaacatgttgtacaagc

SEQ ID NO: 10029691 - DNA, 22 bp, Homo sapiens
tacagggtattcaagggtagtt

SEQ ID NO: 10029692 - DNA, 22 bp, Homo sapiens
taacatttaaatttttcacata

SEQ ID NO: 10029693 - DNA, 22 bp, Homo sapiens
taagattacagtgagaaataaa

SEQ ID NO: 10029694 - DNA, 22 bp, Homo sapiens
caggcagaaagtattctgtgta

SEQ ID NO: 10029695 - DNA, 22 bp, Homo sapiens
cagctttacctttaggagtaac

SEQ ID NO: 10029696 - DNA, 19 bp, Homo sapiens
gtttccttgggtgtaggga

SEQ ID NO: 10029697 - DNA, 22 bp, Homo sapiens
gtttcctttaatagtgatattg

SEQ ID NO: 10029698 - DNA, 22 bp, Homo sapiens
caggaacaatcttactactatt

SEQ ID NO: 10029699 - DNA, 22 bp, Homo sapiens
tttgtctttcccctcctcattg

SEQ ID NO: 10029700 - DNA, 22 bp, Homo sapiens
ctctgggcaggaccagtggacc

SEQ ID NO: 10029701 - DNA, 22 bp, Homo sapiens
ctctttttcagccttaccaaag

SEQ ID NO: 10029702 - DNA, 22 bp, Homo sapiens
tttttaatgcagtctgagacat

SEQ ID NO: 10029703 - DNA, 22 bp, Homo sapiens
ctggacagaagtggctgggcag

SEQ ID NO: 10029704 - DNA, 22 bp, Homo sapiens
ttggccacactcactagagccc

SEQ ID NO: 10029705 - DNA, 22 bp, Homo sapiens
ttggaaaacttacacagagctg

SEQ ID NO: 10029706 - DNA, 22 bp, Homo sapiens
ttgttaaaactccattggtttg

SEQ ID NO: 10029707 - DNA, 22 bp, Homo sapiens
tttaaattatagttaatgtctg

SEQ ID NO: 10029708 - DNA, 22 bp, Homo sapiens
tttaaaaggcagcttcttttgt

SEQ ID NO: 10029709 - DNA, 22 bp, Homo sapiens
tttacatgtaatgttatacaaa

SEQ ID NO: 10029710 - DNA, 22 bp, Homo sapiens
ttccttcctggggatttatcat

SEQ ID NO: 10029711 - DNA, 22 bp, Homo sapiens
ttccttcctgtcttccttactg

SEQ ID NO: 10029712 - DNA, 22 bp, Homo sapiens
ttccttcctcctccagttctgg

SEQ ID NO: 10029713 - DNA, 22 bp, Homo sapiens
ttcccttcctcactctacttgt

SEQ ID NO: 10029714 - DNA, 22 bp, Homo sapiens
ttcagaaaaagaccattgcaat

SEQ ID NO: 10029715 - DNA, 22 bp, Homo sapiens
ttcagaaacagagtgagtgagt

SEQ ID NO: 10029716 - DNA, 22 bp, Homo sapiens
ttcattctgcagttctcagctc

SEQ ID NO: 10029717 - DNA, 19 bp, Homo sapiens
ttcattctcttattgttgt

SEQ ID NO: 10029718 - DNA, 22 bp, Homo sapiens
ttcagaaaggctgtgccagcca

SEQ ID NO: 10029719 - DNA, 22 bp, Homo sapiens
ctattttcattcttacattgtc

SEQ ID NO: 10029720 - DNA, 22 bp, Homo sapiens
ctattttctgtctctatagagt

SEQ ID NO: 10029721 - DNA, 22 bp, Homo sapiens
ttcttgttctcctcatttagag

SEQ ID NO: 10029722 - DNA, 22 bp, Homo sapiens
ttcctttcccttgcttctgtgc

SEQ ID NO: 10029723 - DNA, 22 bp, Homo sapiens
ttccttctaatattctgcctgt

SEQ ID NO: 10029724 - DNA, 22 bp, Homo sapiens
ttcctttcacgttttaatgcac

SEQ ID NO: 10029725 - DNA, 22 bp, Homo sapiens
ttccttttcttaaacatatgtg

SEQ ID NO: 10029726 - DNA, 22 bp, Homo sapiens
ttccttttcttatgcatcatta

SEQ ID NO: 10029727 - DNA, 22 bp, Homo sapiens
tgtcattaaaatgcttctcaaa

SEQ ID NO: 10029728 - DNA, 22 bp, Homo sapiens
tgtcattatgaggattacaata

SEQ ID NO: 10029729 - DNA, 22 bp, Homo sapiens
tgtctattcccccacctccgtt

SEQ ID NO: 10029730 - DNA, 22 bp, Homo sapiens
tgtaaacatgctgaggctggag

SEQ ID NO: 10029731 - DNA, 22 bp, Homo sapiens
tgtctttagttttactgtctgg

SEQ ID NO: 10029732 - DNA, 22 bp, Homo sapiens
tgtctttctatctctagattta

SEQ ID NO: 10029733 - DNA, 20 bp, Homo sapiens
tgtctgtatgcagtcatata

SEQ ID NO: 10029734 - DNA, 22 bp, Homo sapiens
tgtctttagccagcagtcttct

SEQ ID NO: 10029735 - DNA, 22 bp, Homo sapiens
tgtctttagccacttgcctctt

SEQ ID NO: 10029736 - DNA, 22 bp, Homo sapiens
tgtctttacttagaagttcagg

SEQ ID NO: 10029737 - DNA, 22 bp, Homo sapiens
cctgggcctatcctagaaccaa

SEQ ID NO: 10029738 - DNA, 22 bp, Homo sapiens
cccagcgagtttgccggtgaac

SEQ ID NO: 10029739 - DNA, 22 bp, Homo sapiens
cctctcttggccgcagtcttct

SEQ ID NO: 10029740 - DNA, 23 bp, Homo sapiens
tggctgaggtccaggtagtttca

SEQ ID NO: 10029741 - DNA, 22 bp, Homo sapiens
tggctgaggtaactatgaataa

SEQ ID NO: 10029742 - DNA, 22 bp, Homo sapiens
tggctgagggggctctgctcag

SEQ ID NO: 10029743 - DNA, 22 bp, Homo sapiens
tggctgagggggcagttcagga

SEQ ID NO: 10029744 - DNA, 22 bp, Homo sapiens
tggcagattctggttgatactt

SEQ ID NO: 10029745 - DNA, 22 bp, Homo sapiens
gaagttcaaaagacagatttga

SEQ ID NO: 10029746 - DNA, 22 bp, Homo sapiens
gaagttcaggtgggaattgagc

SEQ ID NO: 10029747 - DNA, 22 bp, Homo sapiens
gaagttcactggctacattcca

SEQ ID NO: 10029748 - DNA, 23 bp, Homo sapiens
gaactgttgatgaatagaatata

SEQ ID NO: 10029749 - DNA, 22 bp, Homo sapiens
gaactgtttttaagtcctaaga

SEQ ID NO: 10029750 - DNA, 22 bp, Homo sapiens
gaactgtttctggtgaaagagt

SEQ ID NO: 10029751 - DNA, 22 bp, Homo sapiens
gaaagtttataggttatataat

SEQ ID NO: 10029752 - DNA, 22 bp, Homo sapiens
gaaatacaaagccagccatttt

SEQ ID NO: 10029753 - DNA, 22 bp, Homo sapiens
gaaagtttcttcattaagatgt

SEQ ID NO: 10029754 - DNA, 22 bp, Homo sapiens
gaaagttttcatatataccaaa

SEQ ID NO: 10029755 - DNA, 22 bp, Homo sapiens
gaaataacagctctggaagagt

SEQ ID NO: 10029756 - DNA, 22 bp, Homo sapiens
gaaatacaaatgcctagatcct

SEQ ID NO: 10029757 - DNA, 22 bp, Homo sapiens
gaaatacaattttgtcccagct

SEQ ID NO: 10029758 - DNA, 22 bp, Homo sapiens
ctggctggttactatttctggt

SEQ ID NO: 10029759 - DNA, 22 bp, Homo sapiens
cttcttttgaagggcgttgtgt

SEQ ID NO: 10029760 - DNA, 22 bp, Homo sapiens
cttgaaatccagatttcagagg

SEQ ID NO: 10029761 - DNA, 22 bp, Homo sapiens
cttcttttacaggtcttgggtt

SEQ ID NO: 10029762 - DNA, 22 bp, Homo sapiens
cttctttgtgcctattggtgac

SEQ ID NO: 10029763 - DNA, 22 bp, Homo sapiens
cttctttgttctgttgtctcac

SEQ ID NO: 10029764 - DNA, 22 bp, Homo sapiens
cttctttcttttgatcacaggt

SEQ ID NO: 10029765 - DNA, 22 bp, Homo sapiens
cttctttccttcctccagtggc

SEQ ID NO: 10029766 - DNA, 22 bp, Homo sapiens
cttctttcccaggcatgtttta

SEQ ID NO: 10029767 - DNA, 22 bp, Homo sapiens
cttctttagggatctcttgctg

SEQ ID NO: 10029768 - DNA, 22 bp, Homo sapiens
cttctttactttctagaaataa

SEQ ID NO: 10029769 - DNA, 22 bp, Homo sapiens
ctttggcagcctctgctattga

SEQ ID NO: 10029770 - DNA, 22 bp, Homo sapiens
ctttagaatttgatataatcaa

SEQ ID NO: 10029771 - DNA, 22 bp, Homo sapiens
gatgaaatccagatcacaggtg

SEQ ID NO: 10029772 - DNA, 22 bp, Homo sapiens
gagtctaagtagaatgtgaaaa

SEQ ID NO: 10029773 - DNA, 21 bp, Homo sapiens
gagtgggacatgggagtggtt

SEQ ID NO: 10029774 - DNA, 22 bp, Homo sapiens
gataaaagaggaaatttgttca

SEQ ID NO: 10029775 - DNA, 22 bp, Homo sapiens
gataaagcaaggatgactgaag

SEQ ID NO: 10029776 - DNA, 22 bp, Homo sapiens
gagttaaaaatgcctccatgga

SEQ ID NO: 10029777 - DNA, 21 bp, Homo sapiens
gagtgtcagcaagaggtttgg

SEQ ID NO: 10029778 - DNA, 22 bp, Homo sapiens
gagtgtcacagggtaattgttt

SEQ ID NO: 10029779 - DNA, 22 bp, Homo sapiens
gagtgtcagtgcctggcttgtt

SEQ ID NO: 10029780 - DNA, 22 bp, Homo sapiens
gaggcagaggttgcagtgagct

SEQ ID NO: 10029781 - DNA, 22 bp, Homo sapiens
gaggaggcttccgggaggcacg

SEQ ID NO: 10029782 - DNA, 22 bp, Homo sapiens
gagataaatttttgataaatat

SEQ ID NO: 10029783 - DNA, 22 bp, Homo sapiens
gagataaagctaccatgttgat

SEQ ID NO: 10029784 - DNA, 22 bp, Homo sapiens
gaggtggtggtggaggcatagc

SEQ ID NO: 10029785 - DNA, 22 bp, Homo sapiens
gattcactcatattttacgttt

SEQ ID NO: 10029786 - DNA, 22 bp, Homo sapiens
gatggggttttgccaggctggt

SEQ ID NO: 10029787 - DNA, 22 bp, Homo sapiens
gatttcaagcccccagagattc

SEQ ID NO: 10029788 - DNA, 21 bp, Homo sapiens
gattttaaagagactgccaca

SEQ ID NO: 10029789 - DNA, 22 bp, Homo sapiens
gcacaaagatgaatacagaatg

SEQ ID NO: 10029790 - DNA, 22 bp, Homo sapiens
gcacaaaggtggaaggaggaag

SEQ ID NO: 10029791 - DNA, 22 bp, Homo sapiens
gccagcaaagcaagttgtcagc

SEQ ID NO: 10029792 - DNA, 22 bp, Homo sapiens
gccagatttacagatttgccct

SEQ ID NO: 10029793 - DNA, 19 bp, Homo sapiens
gcaggtgtgaatccgtaga

SEQ ID NO: 10029794 - DNA, 22 bp, Homo sapiens
gctcttctcagattgtacactc

SEQ ID NO: 10029795 - DNA, 22 bp, Homo sapiens
gctgagccacaggcagtgcact

SEQ ID NO: 10029796 - DNA, 22 bp, Homo sapiens
gccagtgggtagttggagctgg

SEQ ID NO: 10029797 - DNA, 22 bp, Homo sapiens
gccgggttcaagccattctcct

SEQ ID NO: 10029798 - DNA, 22 bp, Homo sapiens
gtccttctcaaatcctgtgttt

SEQ ID NO: 10029799 - DNA, 22 bp, Homo sapiens
gtccttcttttcatccctggtt

SEQ ID NO: 10029800 - DNA, 22 bp, Homo sapiens
gtacatttactgatgaaaagta

SEQ ID NO: 10029801 - DNA, 22 bp, Homo sapiens
gtaaagcaggtagttgggacac

SEQ ID NO: 10029802 - DNA, 22 bp, Homo sapiens
ggtgagggtaaatataggcaaa

SEQ ID NO: 10029803 - DNA, 22 bp, Homo sapiens
ggtgaggggagagtgaaagaaa

SEQ ID NO: 10029804 - DNA, 23 bp, Homo sapiens
ggtggtggtgagtcacgggctca

SEQ ID NO: 10029805 - DNA, 22 bp, Homo sapiens
ggtgtcaaattattgagtttca

SEQ ID NO: 10029806 - DNA, 22 bp, Homo sapiens
ggtgtcaatgctcccaccttgg

SEQ ID NO: 10029807 - DNA, 22 bp, Homo sapiens
ggtgtcaaaataccatttcagg

SEQ ID NO: 10029808 - DNA, 22 bp, Homo sapiens
gtgaaggccgtccttggggact

SEQ ID NO: 10029809 - DNA, 22 bp, Homo sapiens
gtggattacaagacagttgaga

SEQ ID NO: 10029810 - DNA, 22 bp, Homo sapiens
gtggctggtttcctgcatgcaa

SEQ ID NO: 10029811 - DNA, 22 bp, Homo sapiens
gtggctgggctccgagcggctt

SEQ ID NO: 10029812 - DNA, 22 bp, Homo sapiens
gtggcccaggcttggcgctggc

SEQ ID NO: 10029813 - DNA, 22 bp, Homo sapiens
taagaaatttagttatagaatg

SEQ ID NO: 10029814 - DNA, 22 bp, Homo sapiens
taacagcagggttacaggcatt

SEQ ID NO: 10029815 - DNA, 22 bp, Homo sapiens
taacagagttgtacagttacgt

SEQ ID NO: 10029816 - DNA, 22 bp, Homo sapiens
gtttaataatgttgaattacta

SEQ ID NO: 10029817 - DNA, 22 bp, Homo sapiens
taaagcttgtattgcaatattt

SEQ ID NO: 10029818 - DNA, 22 bp, Homo sapiens
taaagctgaaatgattatgaca

SEQ ID NO: 10029819 - DNA, 22 bp, Homo sapiens
taaagcagtatgatggaaggat

SEQ ID NO: 10029820 - DNA, 22 bp, Homo sapiens
taaagcaggtgctcagtgacca

SEQ ID NO: 10029821 - DNA, 22 bp, Homo sapiens
gtgtccagagccgggctgaatg

SEQ ID NO: 10029822 - DNA, 22 bp, Homo sapiens
gtgtgcaagggcatgtacattg

SEQ ID NO: 10029823 - DNA, 19 bp, Homo sapiens
gttcaaacactgattcagc

SEQ ID NO: 10029824 - DNA, 21 bp, Homo sapiens
gttattttaagtgagctttgc

SEQ ID NO: 10029825 - DNA, 22 bp, Homo sapiens
gttctctatcattagtgaattt

SEQ ID NO: 10029826 - DNA, 18 bp, Homo sapiens
gtggggtgttgtgaggat

SEQ ID NO: 10029827 - DNA, 20 bp, Homo sapiens
gggcagatgtttttatgttg

SEQ ID NO: 10029828 - DNA, 18 bp, Homo sapiens
gggcagcacagcagcctc

SEQ ID NO: 10029829 - DNA, 22 bp, Homo sapiens
gggatggggagctggaaagggg

SEQ ID NO: 10029830 - DNA, 22 bp, Homo sapiens
gggatggctgcctgcatcagga

SEQ ID NO: 10029831 - DNA, 22 bp, Homo sapiens
gggatggctcaaaggagtcagg

SEQ ID NO: 10029832 - DNA, 22 bp, Homo sapiens
gggaggctggctctggccacag

SEQ ID NO: 10029833 - DNA, 22 bp, Homo sapiens
gggaggctgccatccttcagga

SEQ ID NO: 10029834 - DNA, 22 bp, Homo sapiens
gggaggctctgctcagcccccg

SEQ ID NO: 10029835 - DNA, 22 bp, Homo sapiens
gggaggctcagtggtgtcctct

SEQ ID NO: 10029836 - DNA, 22 bp, Homo sapiens
gggggctgtcctgtgcattgta

SEQ ID NO: 10029837 - DNA, 20 bp, Homo sapiens
gggtgagatgtaggagaggg

SEQ ID NO: 10029838 - DNA, 22 bp, Homo sapiens
gggctgagagctggaatctgag

SEQ ID NO: 10029839 - DNA, 22 bp, Homo sapiens
gggctgagaattcagctttcct

SEQ ID NO: 10029840 - DNA, 23 bp, Homo sapiens
gggaccaggcccttcctggtttg

SEQ ID NO: 10029841 - DNA, 22 bp, Homo sapiens
ggctgatgagcttagctagaga

SEQ ID NO: 10029842 - DNA, 22 bp, Homo sapiens
ggctgcaaataacaactagctt

SEQ ID NO: 10029843 - DNA, 22 bp, Homo sapiens
ggctgagttgagaggattactt

SEQ ID NO: 10029844 - DNA, 22 bp, Homo sapiens
ggaggctgaggcccctcacagg

SEQ ID NO: 10029845 - DNA, 22 bp, Homo sapiens
ggaggctgagaagtccaagatc

SEQ ID NO: 10029846 - DNA, 22 bp, Homo sapiens
ggaggtggtggcagtgacaatt

SEQ ID NO: 10029847 - DNA, 22 bp, Homo sapiens
ggaggtggcctgaaaatgtggc

SEQ ID NO: 10029848 - DNA, 23 bp, Homo sapiens
ggcagagagcatggctggggccc

SEQ ID NO: 10029849 - DNA, 22 bp, Homo sapiens
ggagtgggaacaatgacatggt

SEQ ID NO: 10029850 - DNA, 22 bp, Homo sapiens
gctgggccagagcagcagcact

SEQ ID NO: 10029851 - DNA, 22 bp, Homo sapiens
ggaagtaacattctgtctttcc

SEQ ID NO: 10029852 - DNA, 22 bp, Homo sapiens
ggaatatagccagtaacagtca

SEQ ID NO: 10029853 - DNA, 22 bp, Homo sapiens
ggaggcagaatagagtgtgggt

SEQ ID NO: 10029854 - DNA, 22 bp, Homo sapiens
tgggaggcaggtaggtgatgat

SEQ ID NO: 10029855 - DNA, 22 bp, Homo sapiens
tggctgaggttatgctggttgt

SEQ ID NO: 10029856 - DNA, 22 bp, Homo sapiens
tggctgagggcactatgaagcc

SEQ ID NO: 10029857 - DNA, 22 bp, Homo sapiens
tggctgaggagggtcttctggt

SEQ ID NO: 10029858 - DNA, 22 bp, Homo sapiens
tggctgaggcacagctgccgcc

SEQ ID NO: 10029859 - DNA, 22 bp, Homo sapiens
tggctgagctgcagcgtggctt

SEQ ID NO: 10029860 - DNA, 23 bp, Homo sapiens
tggctgagcccactatcttggcc

SEQ ID NO: 10029861 - DNA, 22 bp, Homo sapiens
tggctgagccacttgttcagat

SEQ ID NO: 10029862 - DNA, 22 bp, Homo sapiens
tggctgagagtcatcctgtgtg

SEQ ID NO: 10029863 - DNA, 22 bp, Homo sapiens
tggctgagaagttctggtggga

SEQ ID NO: 10029864 - DNA, 22 bp, Homo sapiens
tggcacttccgtctgccttgtg

SEQ ID NO: 10029865 - DNA, 22 bp, Homo sapiens
tggcaggatctttgagagtgaa

SEQ ID NO: 10029866 - DNA, 20 bp, Homo sapiens
tggcaggaatagggccagag

SEQ ID NO: 10029867 - DNA, 22 bp, Homo sapiens
tggccactcctccctgcaggct

SEQ ID NO: 10029868 - DNA, 23 bp, Homo sapiens
tggcatttctatactggcaagtg

SEQ ID NO: 10029869 - DNA, 22 bp, Homo sapiens
tggcatttcctcagtgctcaga

SEQ ID NO: 10029870 - DNA, 22 bp, Homo sapiens
tggcatttcagtattttcataa

SEQ ID NO: 10029871 - DNA, 22 bp, Homo sapiens
tggcatttagaaaacaacatgt

SEQ ID NO: 10029872 - DNA, 22 bp, Homo sapiens
tggcagttattaatcaagtctt

SEQ ID NO: 10029873 - DNA, 22 bp, Homo sapiens
tggcagtttcatgtgattcaac

SEQ ID NO: 10029874 - DNA, 22 bp, Homo sapiens
tgcgatgcaacagcttggcgga

SEQ ID NO: 10029875 - DNA, 22 bp, Homo sapiens
tgccttttatggctagcctcag

SEQ ID NO: 10029876 - DNA, 22 bp, Homo sapiens
tgcttcttactcatatgctgat

SEQ ID NO: 10029877 - DNA, 16 bp, Homo sapiens
tgcttcttttgcatca

SEQ ID NO: 10029878 - DNA, 22 bp, Homo sapiens
tgcttctttatgatgtatgatt

SEQ ID NO: 10029879 - DNA, 22 bp, Homo sapiens
tgcttcttcctccatgtgttct

SEQ ID NO: 10029880 - DNA, 22 bp, Homo sapiens
tgctttaagagattgttagtac

SEQ ID NO: 10029881 - DNA, 22 bp, Homo sapiens
tgctttaagacactaagtttga

SEQ ID NO: 10029882 - DNA, 21 bp, Homo sapiens
tgctttctaaaaatactattg

SEQ ID NO: 10029883 - DNA, 22 bp, Homo sapiens
tgctttctgctcttgtccacac

SEQ ID NO: 10029884 - DNA, 22 bp, Homo sapiens
tgctttttgcaccctttgccgt

SEQ ID NO: 10029885 - DNA, 22 bp, Homo sapiens
tgctttttagtactgtcttatt

SEQ ID NO: 10029886 - DNA, 22 bp, Homo sapiens
tggaaacagatcataactaagc

SEQ ID NO: 10029887 - DNA, 22 bp, Homo sapiens
tggaaaatcaggggacattgat

SEQ ID NO: 10029888 - DNA, 22 bp, Homo sapiens
tggaaaatatttaggtgaatga

SEQ ID NO: 10029889 - DNA, 22 bp, Homo sapiens
tggaaaatcaggggacattgat

SEQ ID NO: 10029890 - DNA, 22 bp, Homo sapiens
tggaaaattagtagtgaaaggc

SEQ ID NO: 10029891 - DNA, 22 bp, Homo sapiens
tggaaacaaagtcataagctca

SEQ ID NO: 10029892 - DNA, 19 bp, Homo sapiens
tggaaaatggattgaatca

SEQ ID NO: 10029893 - DNA, 22 bp, Homo sapiens
tggaaaatgtgactattctaaa

SEQ ID NO: 10029894 - DNA, 22 bp, Homo sapiens
tggaacaagacagcatagagct

SEQ ID NO: 10029895 - DNA, 22 bp, Homo sapiens
tggaacaacatgctggaaaatt

SEQ ID NO: 10029896 - DNA, 22 bp, Homo sapiens
tggaaatttatcaagatataca

SEQ ID NO: 10029897 - DNA, 22 bp, Homo sapiens
tggaaatagctccagttaagca

SEQ ID NO: 10029898 - DNA, 23 bp, Homo sapiens
tggaataataaggtacattaaca

SEQ ID NO: 10029899 - DNA, 22 bp, Homo sapiens
tggaataaggaatctttcagaa

SEQ ID NO: 10029900 - DNA, 22 bp, Homo sapiens
tggaataactcaccaaggtcat

SEQ ID NO: 10029901 - DNA, 22 bp, Homo sapiens
tggaataaaatgtcagttctta

SEQ ID NO: 10029902 - DNA, 22 bp, Homo sapiens
tggaataaagcagctttagttc

SEQ ID NO: 10029903 - DNA, 22 bp, Homo sapiens
tggacaacatagtgagacctca

SEQ ID NO: 10029904 - DNA, 22 bp, Homo sapiens
tggaattttgtattagctttga

SEQ ID NO: 10029905 - DNA, 22 bp, Homo sapiens
tggaggctggtttctgctgagg

SEQ ID NO: 10029906 - DNA, 22 bp, Homo sapiens
tggaggctgtgtgcatgagacc

SEQ ID NO: 10029907 - DNA, 22 bp, Homo sapiens
tggataaaacgttctgaaaaac

SEQ ID NO: 10029908 - DNA, 22 bp, Homo sapiens
tgtacagactgtatttacaagt

SEQ ID NO: 10029909 - DNA, 22 bp, Homo sapiens
tgtacaaattcattgaactgta

SEQ ID NO: 10029910 - DNA, 22 bp, Homo sapiens
tgtaacaaaataccttggattg

SEQ ID NO: 10029911 - DNA, 22 bp, Homo sapiens
tgtaacaaatacccttgaagtt

SEQ ID NO: 10029912 - DNA, 22 bp, Homo sapiens
tgtaacaacatttgatttttag

SEQ ID NO: 10029913 - DNA, 21 bp, Homo sapiens
tgtaacaaaatactgcagatt

SEQ ID NO: 10029914 - DNA, 23 bp, Homo sapiens
tgtaacaattcccagcctttgcc

SEQ ID NO: 10029915 - DNA, 23 bp, Homo sapiens
tgtaacaatttcatatacatgca

SEQ ID NO: 10029916 - DNA, 22 bp, Homo sapiens
tgtaaaaccaaatcaatctagt

SEQ ID NO: 10029917 - DNA, 22 bp, Homo sapiens
tggttttagagtatattcaggg

SEQ ID NO: 10029918 - DNA, 22 bp, Homo sapiens
tggtttgtttgttcatgtaaaa

SEQ ID NO: 10029919 - DNA, 22 bp, Homo sapiens
tggtgccaagcatgaggactct

SEQ ID NO: 10029920 - DNA, 22 bp, Homo sapiens
tgtcaaagatgtctttgaaaat

SEQ ID NO: 10029921 - DNA, 22 bp, Homo sapiens
tgtcaaagcaaggattaaatgt

SEQ ID NO: 10029922 - DNA, 22 bp, Homo sapiens
tgtcaaacaccaacatttctcc

SEQ ID NO: 10029923 - DNA, 22 bp, Homo sapiens
tgtccaggtggcctctgctgct

SEQ ID NO: 10029924 - DNA, 22 bp, Homo sapiens
tgtccttttggctgtctatggt

SEQ ID NO: 10029925 - DNA, 22 bp, Homo sapiens
tgtcatctcactgatatagatg

SEQ ID NO: 10029926 - DNA, 20 bp, Homo sapiens
tgtcatttatttatcaaatg

SEQ ID NO: 10029927 - DNA, 22 bp, Homo sapiens
tgggtgggagcgccctgtctgg

SEQ ID NO: 10029928 - DNA, 16 bp, Homo sapiens
tgggtgggaggagcgg

SEQ ID NO: 10029929 - DNA, 21 bp, Homo sapiens
tgggtgggcagagtctcttca

SEQ ID NO: 10029930 - DNA, 22 bp, Homo sapiens
tggggtggaacccttctgctgg

SEQ ID NO: 10029931 - DNA, 22 bp, Homo sapiens
tggggaggatatgtgagttatt

SEQ ID NO: 10029932 - DNA, 23 bp, Homo sapiens
tggggagggaagtcatttctgta

SEQ ID NO: 10029933 - DNA, 22 bp, Homo sapiens
tggggaggttcgggaatcttgt

SEQ ID NO: 10029934 - DNA, 22 bp, Homo sapiens
tggggaggtaacaatttcaggc

SEQ ID NO: 10029935 - DNA, 22 bp, Homo sapiens
tggggatgtaaatgaggtgata

SEQ ID NO: 10029936 - DNA, 23 bp, Homo sapiens
tgggatggattcaccagtgtgct

SEQ ID NO: 10029937 - DNA, 22 bp, Homo sapiens
tgggcaagtatcggactctgag

SEQ ID NO: 10029938 - DNA, 21 bp, Homo sapiens
tgggatgggtctgggaccagc

SEQ ID NO: 10029939 - DNA, 22 bp, Homo sapiens
ttagataatgtagagatatgag

SEQ ID NO: 10029940 - DNA, 22 bp, Homo sapiens
ttagaactgaagaagattaagg

SEQ ID NO: 10029941 - DNA, 22 bp, Homo sapiens
ttacattttgcacagatgtccc

SEQ ID NO: 10029942 - DNA, 22 bp, Homo sapiens
ttagatgactgaaaagagcaca

SEQ ID NO: 10029943 - DNA, 22 bp, Homo sapiens
ttagatgaccaagctcggaacg

SEQ ID NO: 10029944 - DNA, 22 bp, Homo sapiens
ttagcagatttcatgtacattt

SEQ ID NO: 10029945 - DNA, 22 bp, Homo sapiens
ttattcttcttctcttgccagg

SEQ ID NO: 10029946 - DNA, 23 bp, Homo sapiens
ttacaactatttgccatgttgtt

SEQ ID NO: 10029947 - DNA, 22 bp, Homo sapiens
ttaatacactatatgatcacat

SEQ ID NO: 10029948 - DNA, 22 bp, Homo sapiens
ttaatacagaagcaagacactg

SEQ ID NO: 10029949 - DNA, 22 bp, Homo sapiens
ttaataaagtatgaattggaaa

SEQ ID NO: 10029950 - DNA, 22 bp, Homo sapiens
ttaatacaagcatatgcacaca

SEQ ID NO: 10029951 - DNA, 22 bp, Homo sapiens
ttaaaccatagtttaacataag

SEQ ID NO: 10029952 - DNA, 23 bp, Homo sapiens
ttaaacttcagtgcagaacactc

SEQ ID NO: 10029953 - DNA, 21 bp, Homo sapiens
ttacagaatccatgggaagtc

SEQ ID NO: 10029954 - DNA, 22 bp, Homo sapiens
ttacagaatgtgccatttggtc

SEQ ID NO: 10029955 - DNA, 22 bp, Homo sapiens
ttacagcacagtgcttttactg

SEQ ID NO: 10029956 - DNA, 22 bp, Homo sapiens
ttacatttcccccttggaggct

SEQ ID NO: 10029957 - DNA, 22 bp, Homo sapiens
ttacatttggctatgtcctcta

SEQ ID NO: 10029958 - DNA, 22 bp, Homo sapiens
ttacattttagttaacctgtga

SEQ ID NO: 10029959 - DNA, 22 bp, Homo sapiens
ttcagcagtttctgagaagcaa

SEQ ID NO: 10029960 - DNA, 20 bp, Homo sapiens
ttatttctcattctcctact

SEQ ID NO: 10029961 - DNA, 22 bp, Homo sapiens
ttatttctactattttgcctga

SEQ ID NO: 10029962 - DNA, 23 bp, Homo sapiens
ttcattcaaaaggaaaagtcatg

SEQ ID NO: 10029963 - DNA, 22 bp, Homo sapiens
ttcattcttgtctttgtatagt

SEQ ID NO: 10029964 - DNA, 22 bp, Homo sapiens
tgtgcaatcatattttaaaatg

SEQ ID NO: 10029965 - DNA, 22 bp, Homo sapiens
tgtgatcaggtgatcatgtgag

SEQ ID NO: 10029966 - DNA, 22 bp, Homo sapiens
tgtgatcattgctaacatccat

SEQ ID NO: 10029967 - DNA, 22 bp, Homo sapiens
tgtctttttactatgttcaatc

SEQ ID NO: 10029968 - DNA, 22 bp, Homo sapiens
tgttctttcagttagacacagt

SEQ ID NO: 10029969 - DNA, 22 bp, Homo sapiens
tgttctttgctgttgatgtaga

SEQ ID NO: 10029970 - DNA, 22 bp, Homo sapiens
tgttctttgccagtgatttaat

SEQ ID NO: 10029971 - DNA, 22 bp, Homo sapiens
tgttctttggcttcctttccgt

SEQ ID NO: 10029972 - DNA, 22 bp, Homo sapiens
tgttttaatctcccattgctct

SEQ ID NO: 10029973 - DNA, 22 bp, Homo sapiens
ttaaaaccatcagctgtaagat

SEQ ID NO: 10029974 - DNA, 22 bp, Homo sapiens
tgttttttccttatgcaatctg

SEQ ID NO: 10029975 - DNA, 22 bp, Homo sapiens
ttaaacagacagtaaatgaaac

SEQ ID NO: 10029976 - DNA, 22 bp, Homo sapiens
tgtgtgtgtaaaagcatttata

SEQ ID NO: 10029977 - DNA, 22 bp, Homo sapiens
tgtgtcaaggcatcagcccagc

SEQ ID NO: 10029978 - DNA, 22 bp, Homo sapiens
tgtgtcaagtggaatttcaggg

SEQ ID NO: 10029979 - DNA, 22 bp, Homo sapiens
tgtgtcaattttcattcctact

SEQ ID NO: 10029980 - DNA, 22 bp, Homo sapiens
tgtgtcaaattgttttacacag

SEQ ID NO: 10029981 - DNA, 22 bp, Homo sapiens
tgtgtcaacaacagccttggat

SEQ ID NO: 10029982 - DNA, 22 bp, Homo sapiens
tgtgtcaaagtgtggagtattt

SEQ ID NO: 10029983 - DNA, 22 bp, Homo sapiens
tgtgtcaacctgtggccgggtg

SEQ ID NO: 10029984 - DNA, 22 bp, Homo sapiens
tgtgtcaagacatttagtcatt

SEQ ID NO: 10029985 - DNA, 22 bp, Homo sapiens
tgtgtcaatttatgtcattcat

SEQ ID NO: 10029986 - DNA, 22 bp, Homo sapiens
tgtgtcaaagtcaggtgtcact

SEQ ID NO: 10029987 - DNA, 22 bp, Homo sapiens
tgattaaaatttaacttagtta

SEQ ID NO: 10029988 - DNA, 22 bp, Homo sapiens
tgatatgtaactactccttata

SEQ ID NO: 10029989 - DNA, 22 bp, Homo sapiens
tgatttcaagtagtgacatgct

SEQ ID NO: 10029990 - DNA, 22 bp, Homo sapiens
tgatttcatagtatatacatga

SEQ ID NO: 10029991 - DNA, 22 bp, Homo sapiens
tgcaaactgggatactattcaa

SEQ ID NO: 10029992 - DNA, 22 bp, Homo sapiens
tgcaaactgggacactattcaa

SEQ ID NO: 10029993 - DNA, 23 bp, Homo sapiens
tgcaacaatgaggaaagctactg

SEQ ID NO: 10029994 - DNA, 22 bp, Homo sapiens
tgcatttaagaaaacatgagtc

SEQ ID NO: 10029995 - DNA, 22 bp, Homo sapiens
tgcatttaactagaatattaat

SEQ ID NO: 10029996 - DNA, 22 bp, Homo sapiens
tgcatttacctggaggtcattt

SEQ ID NO: 10029997 - DNA, 18 bp, Homo sapiens
tgcatttagtacatctag

SEQ ID NO: 10029998 - DNA, 22 bp, Homo sapiens
tgcatttagttatgagaaaaac

SEQ ID NO: 10029999 - DNA, 22 bp, Homo sapiens
tgcattttacttacctgttagt

SEQ ID NO: 10030000 - DNA, 22 bp, Homo sapiens
tgcattttcttccaccaatatc

SEQ ID NO: 10030001 - DNA, 22 bp, Homo sapiens
tgcatttttgaggttaactcaa

SEQ ID NO: 10030002 - DNA, 22 bp, Homo sapiens
tgcatttagttttaataaagga

SEQ ID NO: 10030003 - DNA, 22 bp, Homo sapiens
tgcatttatttgaattgatcta

SEQ ID NO: 10030004 - DNA, 22 bp, Homo sapiens
tgcctcttggagcctttcctct

SEQ ID NO: 10030005 - DNA, 22 bp, Homo sapiens
tctttttttcctgtgcagagct

SEQ ID NO: 10030006 - DNA, 22 bp, Homo sapiens
tgaaaaactttaatccataaag

SEQ ID NO: 10030007 - DNA, 22 bp, Homo sapiens
tctttgctgagtacatctccaa

SEQ ID NO: 10030008 - DNA, 22 bp, Homo sapiens
tctttgtttgtactgttagaat

SEQ ID NO: 10030009 - DNA, 22 bp, Homo sapiens
tctttgtttgcctttatcaaga

SEQ ID NO: 10030010 - DNA, 20 bp, Homo sapiens
tctttgttaattttatctcc

SEQ ID NO: 10030011 - DNA, 22 bp, Homo sapiens
tctttgttattgctttatctat

SEQ ID NO: 10030012 - DNA, 22 bp, Homo sapiens
tgaactgtggccagtaattaat

SEQ ID NO: 10030013 - DNA, 22 bp, Homo sapiens
tgaacaaatggaaataaccagt

SEQ ID NO: 10030014 - DNA, 22 bp, Homo sapiens
tgaaattccaggagagttaaaa

SEQ ID NO: 10030015 - DNA, 22 bp, Homo sapiens
tgaagcaggcattgactgatga

SEQ ID NO: 10030016 - DNA, 22 bp, Homo sapiens
tgaagaatgttgcagtgagcat

SEQ ID NO: 10030017 - DNA, 22 bp, Homo sapiens
tgaaatcatctgccaataagtt

SEQ ID NO: 10030018 - DNA, 23 bp, Homo sapiens
tgaaagcaatgggtctatagtat

SEQ ID NO: 10030019 - DNA, 22 bp, Homo sapiens
tgaaatacacaaatttagtaag

SEQ ID NO: 10030020 - DNA, 22 bp, Homo sapiens
tgaatgagtcaatcatttagct

SEQ ID NO: 10030021 - DNA, 22 bp, Homo sapiens
tgacaaacagggagtttgctca

SEQ ID NO: 10030022 - DNA, 23 bp, Homo sapiens
tgaattttggcatattctgaaat

SEQ ID NO: 10030023 - DNA, 20 bp, Homo sapiens
tgacaaagtcccttcttttc

SEQ ID NO: 10030024 - DNA, 22 bp, Homo sapiens
tgaagcagttctcagaagtggg

SEQ ID NO: 10030025 - DNA, 22 bp, Homo sapiens
tgaagctgtaggcatgggcagc

SEQ ID NO: 10030026 - DNA, 22 bp, Homo sapiens
tgaagctgtccttgataggggc

SEQ ID NO: 10030027 - DNA, 22 bp, Homo sapiens
tgaagctgtgggcagtggagcc

SEQ ID NO: 10030028 - DNA, 22 bp, Homo sapiens
tgaagctggaagttaggtagac

SEQ ID NO: 10030029 - DNA, 22 bp, Homo sapiens
tgacatttaatccctaaatatt

SEQ ID NO: 10030030 - DNA, 21 bp, Homo sapiens
tgacatttccaatataaagcc

SEQ ID NO: 10030031 - DNA, 22 bp, Homo sapiens
tgacatttatcttctacaatga

SEQ ID NO: 10030032 - DNA, 22 bp, Homo sapiens
tgacatttatcaaagaaatggt

SEQ ID NO: 10030033 - DNA, 22 bp, Homo sapiens
tgacatttgagcatacatgtaa

SEQ ID NO: 10030034 - DNA, 22 bp, Homo sapiens
tgacatttgagagagatataca

SEQ ID NO: 10030035 - DNA, 22 bp, Homo sapiens
tgacagggacagtggagatgga

SEQ ID NO: 10030036 - DNA, 22 bp, Homo sapiens
tgagctgacacccaatcatact

SEQ ID NO: 10030037 - DNA, 21 bp, Homo sapiens
tgagcccttgcctcagagccc

SEQ ID NO: 10030038 - DNA, 22 bp, Homo sapiens
tgagccagtctctcagaaccct

SEQ ID NO: 10030039 - DNA, 22 bp, Homo sapiens
tgagcattggatcaaatgactt

SEQ ID NO: 10030040 - DNA, 22 bp, Homo sapiens
tgagacaataaggctgagaagc

SEQ ID NO: 10030041 - DNA, 22 bp, Homo sapiens
tgagacaacctaattaaacacc

SEQ ID NO: 10030042 - DNA, 19 bp, Homo sapiens
tgagacagaagatgagcct

SEQ ID NO: 10030043 - DNA, 22 bp, Homo sapiens
tgagacagcagtcagggaaata

SEQ ID NO: 10030044 - DNA, 22 bp, Homo sapiens
tgagacagtcaccaggcaggcc

SEQ ID NO: 10030045 - DNA, 22 bp, Homo sapiens
tgagacagttctgcagctgggt

SEQ ID NO: 10030046 - DNA, 22 bp, Homo sapiens
tgagacagggtcttgctctgtt

SEQ ID NO: 10030047 - DNA, 22 bp, Homo sapiens
tgagacagggtcttgctctgtt

SEQ ID NO: 10030048 - DNA, 22 bp, Homo sapiens
tgagacagcccttctgcacagg

SEQ ID NO: 10030049 - DNA, 19 bp, Homo sapiens
tgagatttcttaggtgatt

SEQ ID NO: 10030050 - DNA, 22 bp, Homo sapiens
tgagatgtaaggtatgcttact

SEQ ID NO: 10030051 - DNA, 23 bp, Homo sapiens
tctacccacactgctctagaagg

SEQ ID NO: 10030052 - DNA, 22 bp, Homo sapiens
tctacattttctttatgtacat

SEQ ID NO: 10030053 - DNA, 22 bp, Homo sapiens
tctacttctccttcatttccca

SEQ ID NO: 10030054 - DNA, 22 bp, Homo sapiens
tctagatgtactgctgaagagt

SEQ ID NO: 10030055 - DNA, 22 bp, Homo sapiens
tctagctgccccgaggcagggt

SEQ ID NO: 10030056 - DNA, 22 bp, Homo sapiens
tctacattccttttataatatc

SEQ ID NO: 10030057 - DNA, 22 bp, Homo sapiens
tctacattttaacaagatgccc

SEQ ID NO: 10030058 - DNA, 19 bp, Homo sapiens
tctaacctccccttcagtt

SEQ ID NO: 10030059 - DNA, 22 bp, Homo sapiens
tctattttgtttccagctctac

SEQ ID NO: 10030060 - DNA, 22 bp, Homo sapiens
tctcaaactgtgtattataatt

SEQ ID NO: 10030061 - DNA, 22 bp, Homo sapiens
tctcaaactaacaatgattata

SEQ ID NO: 10030062 - DNA, 22 bp, Homo sapiens
tctcaaactacactgtaaattg

SEQ ID NO: 10030063 - DNA, 22 bp, Homo sapiens
tctattttatactcaaatcttc

SEQ ID NO: 10030064 - DNA, 22 bp, Homo sapiens
tctatttaccaaatgtagttcc

SEQ ID NO: 10030065 - DNA, 22 bp, Homo sapiens
tctattacttaccactaattca

SEQ ID NO: 10030066 - DNA, 22 bp, Homo sapiens
tctatctcccttattcctggcc

SEQ ID NO: 10030067 - DNA, 17 bp, Homo sapiens
tcctttctttacctgtt

SEQ ID NO: 10030068 - DNA, 22 bp, Homo sapiens
tcctttctgtctttactctgga

SEQ ID NO: 10030069 - DNA, 22 bp, Homo sapiens
tcctttctgggcctcagtgact

SEQ ID NO: 10030070 - DNA, 18 bp, Homo sapiens
tcctttctccctcatctt

SEQ ID NO: 10030071 - DNA, 22 bp, Homo sapiens
tcctttctccttccgacttcat

SEQ ID NO: 10030072 - DNA, 22 bp, Homo sapiens
tcctttctcccaggttagttgt

SEQ ID NO: 10030073 - DNA, 22 bp, Homo sapiens
tcctttctccagctggcattgt

SEQ ID NO: 10030074 - DNA, 22 bp, Homo sapiens
tcctttttctcacacaacgaac

SEQ ID NO: 10030075 - DNA, 22 bp, Homo sapiens
tccttttctctagtaagcttta

SEQ ID NO: 10030076 - DNA, 22 bp, Homo sapiens
tcgtgatctgtccacctcggcc

SEQ ID NO: 10030077 - DNA, 22 bp, Homo sapiens
tcgttcttgtcagtttataaag

SEQ ID NO: 10030078 - DNA, 22 bp, Homo sapiens
tcgcccaggctggaagtgcagt

SEQ ID NO: 10030079 - DNA, 22 bp, Homo sapiens
tctaaactacgtcaaaactagt

SEQ ID NO: 10030080 - DNA, 22 bp, Homo sapiens
tctaaactctgcaatttacggt

SEQ ID NO: 10030081 - DNA, 22 bp, Homo sapiens
tctaaagatgtttattgacata

SEQ ID NO: 10030082 - DNA, 21 bp, Homo sapiens
tccttctctatgattgtctga

SEQ ID NO: 10030083 - DNA, 22 bp, Homo sapiens
tccttctctggtttttactgta

SEQ ID NO: 10030084 - DNA, 22 bp, Homo sapiens
tccttcctggggtctctgctgc

SEQ ID NO: 10030085 - DNA, 21 bp, Homo sapiens
tccttccttgaggtcctttcc

SEQ ID NO: 10030086 - DNA, 22 bp, Homo sapiens
tccttcttcatgaagatatatg

SEQ ID NO: 10030087 - DNA, 22 bp, Homo sapiens
tccttcttccctggtttgcatc

SEQ ID NO: 10030088 - DNA, 22 bp, Homo sapiens
tccttctttcacctcatagtca

SEQ ID NO: 10030089 - DNA, 22 bp, Homo sapiens
tccttctttccccctagtcatt

SEQ ID NO: 10030090 - DNA, 22 bp, Homo sapiens
tccttctttgacaagtggcaga

SEQ ID NO: 10030091 - DNA, 22 bp, Homo sapiens
tcctgtctcagtgtatttgcag

SEQ ID NO: 10030092 - DNA, 22 bp, Homo sapiens
tcctgcttccttgtctttagac

SEQ ID NO: 10030093 - DNA, 23 bp, Homo sapiens
taagaacagacaagcatttacat

SEQ ID NO: 10030094 - DNA, 22 bp, Homo sapiens
tctctcttgtcaccccatctgc

SEQ ID NO: 10030095 - DNA, 22 bp, Homo sapiens
tctctctttttaatcatgtaat

SEQ ID NO: 10030096 - DNA, 22 bp, Homo sapiens
tctctttctttgtatgtctatt

SEQ ID NO: 10030097 - DNA, 22 bp, Homo sapiens
tctctttctcaaaatgtaagca

SEQ ID NO: 10030098 - DNA, 17 bp, Homo sapiens
tctctttccctttctgc

SEQ ID NO: 10030099 - DNA, 23 bp, Homo sapiens
tctctttcaagagcttaatgtgc

SEQ ID NO: 10030100 - DNA, 22 bp, Homo sapiens
tctctttctatatgtgagtctt

SEQ ID NO: 10030101 - DNA, 18 bp, Homo sapiens
tctctttcctcagtggag

SEQ ID NO: 10030102 - DNA, 22 bp, Homo sapiens
tctcttcttgtgttttcctgcc

SEQ ID NO: 10030103 - DNA, 22 bp, Homo sapiens
tctcttccttgacctattgtaa

SEQ ID NO: 10030104 - DNA, 22 bp, Homo sapiens
tctcttctaacactagaaattc

SEQ ID NO: 10030105 - DNA, 22 bp, Homo sapiens
tctcttccagtggctttgattt

SEQ ID NO: 10030106 - DNA, 19 bp, Homo sapiens
tctcttctccctggtttta

SEQ ID NO: 10030107 - DNA, 22 bp, Homo sapiens
tctcttctgacctagccttgga

SEQ ID NO: 10030108 - DNA, 22 bp, Homo sapiens
tctcttctgaaacctgtcttta

SEQ ID NO: 10030109 - DNA, 22 bp, Homo sapiens
tctcttcttgattttcactgga

SEQ ID NO: 10030110 - DNA, 22 bp, Homo sapiens
tctcgatctcctgaccttgtga

SEQ ID NO: 10030111 - DNA, 22 bp, Homo sapiens
tctcctttgaaagttaggactg

SEQ ID NO: 10030112 - DNA, 22 bp, Homo sapiens
tctcctttaagatttcctcagg

SEQ ID NO: 10030113 - DNA, 22 bp, Homo sapiens
tctcgctctgtcgcccaggctg

SEQ ID NO: 10030114 - DNA, 23 bp, Homo sapiens
tctcatttcccttgatctatctt

SEQ ID NO: 10030115 - DNA, 22 bp, Homo sapiens
tctccaaatagttatatttaga

SEQ ID NO: 10030116 - DNA, 22 bp, Homo sapiens
tctgtacaaaggctatttggag

SEQ ID NO: 10030117 - DNA, 23 bp, Homo sapiens
tctgtacaattgagaagagaaca

SEQ ID NO: 10030118 - DNA, 18 bp, Homo sapiens
tctgtccttccattcttc

SEQ ID NO: 10030119 - DNA, 22 bp, Homo sapiens
tctgtttcttcttctgttatat

SEQ ID NO: 10030120 - DNA, 22 bp, Homo sapiens
tctgttttgcataatgttcttt

SEQ ID NO: 10030121 - DNA, 22 bp, Homo sapiens
tcttatcttatacctaacagcc

SEQ ID NO: 10030122 - DNA, 22 bp, Homo sapiens
tctgttcttgtccccacttcag

SEQ ID NO: 10030123 - DNA, 22 bp, Homo sapiens
tctgttcttgcttttctccaac

SEQ ID NO: 10030124 - DNA, 22 bp, Homo sapiens
tcttcctttcattcatgtgtta

SEQ ID NO: 10030125 - DNA, 22 bp, Homo sapiens
tcttccttttgtaccttctgaa

SEQ ID NO: 10030126 - DNA, 22 bp, Homo sapiens
tcttccttgctccttgtcactt

SEQ ID NO: 10030127 - DNA, 22 bp, Homo sapiens
tcttccttgccttgcttcatca

SEQ ID NO: 10030128 - DNA, 22 bp, Homo sapiens
tcttccttctttgatgacaagg

SEQ ID NO: 10030129 - DNA, 22 bp, Homo sapiens
tcttccttcgcccttgctgttt

SEQ ID NO: 10030130 - DNA, 22 bp, Homo sapiens
tcttccttaaatgtttggtaga

SEQ ID NO: 10030131 - DNA, 22 bp, Homo sapiens
tcttcttttatttcaagggtgt

SEQ ID NO: 10030132 - DNA, 22 bp, Homo sapiens
tcttctttggatgaaagaatat

SEQ ID NO: 10030133 - DNA, 22 bp, Homo sapiens
tcttctttgaatcatagtgacc

SEQ ID NO: 10030134 - DNA, 22 bp, Homo sapiens
tcttctttttgtcccacagaat

SEQ ID NO: 10030135 - DNA, 20 bp, Homo sapiens
tcttctgttgccttgttctg

SEQ ID NO: 10030136 - DNA, 22 bp, Homo sapiens
tcttcttaaagtatgttctctt

SEQ ID NO: 10030137 - DNA, 22 bp, Homo sapiens
tcttcttatgtgccattatctc

SEQ ID NO: 10030138 - DNA, 22 bp, Homo sapiens
tcttctttatgtcatatgccag

SEQ ID NO: 10030139 - DNA, 22 bp, Homo sapiens
tcttcagttgtcatactgcctt

SEQ ID NO: 10030140 - DNA, 22 bp, Homo sapiens
tcttcagtatttggataacatt

SEQ ID NO: 10030141 - DNA, 22 bp, Homo sapiens
tctttacttgtgtattgtatat

SEQ ID NO: 10030142 - DNA, 22 bp, Homo sapiens
tctttctagtggcctctattct

SEQ ID NO: 10030143 - DNA, 22 bp, Homo sapiens
tctttcttaaataggtggattg

SEQ ID NO: 10030144 - DNA, 22 bp, Homo sapiens
tctttcttacaaagaaaacggt

SEQ ID NO: 10030145 - DNA, 22 bp, Homo sapiens
tctttctggttatgtatagaga

SEQ ID NO: 10030146 - DNA, 22 bp, Homo sapiens
tctttcctgtaactgctgttca

SEQ ID NO: 10030147 - DNA, 22 bp, Homo sapiens
tctttctacattttatatgctt

SEQ ID NO: 10030148 - DNA, 22 bp, Homo sapiens
tctttctagtggcctctattct

SEQ ID NO: 10030149 - DNA, 22 bp, Homo sapiens
tctttctacatcatttgcttct

SEQ ID NO: 10030150 - DNA, 22 bp, Homo sapiens
tctttctacatcatttgcttct

SEQ ID NO: 10030151 - DNA, 22 bp, Homo sapiens
tctttccttagaataattcttt

SEQ ID NO: 10030152 - DNA, 22 bp, Homo sapiens
tctttcctctgagctcctgtag

SEQ ID NO: 10030153 - DNA, 22 bp, Homo sapiens
tctttcccttagaacattaaca

SEQ ID NO: 10030154 - DNA, 19 bp, Homo sapiens
tctttcatttctagctctg

SEQ ID NO: 10030155 - DNA, 19 bp, Homo sapiens
tctttagtcacatttttat

SEQ ID NO: 10030156 - DNA, 22 bp, Homo sapiens
tctttagtaatgtagcagttta

SEQ ID NO: 10030157 - DNA, 22 bp, Homo sapiens
tctttagtgaccatctcattct

SEQ ID NO: 10030158 - DNA, 22 bp, Homo sapiens
tctttagttttctaggttctat

SEQ ID NO: 10030159 - DNA, 22 bp, Homo sapiens
acagaagaccaagaaagcttcc

SEQ ID NO: 10030160 - DNA, 22 bp, Homo sapiens
aagatagcttggaaaagtacag

SEQ ID NO: 10030161 - DNA, 22 bp, Homo sapiens
aagatacatcaaagcaaattgg

SEQ ID NO: 10030162 - DNA, 22 bp, Homo sapiens
aagcaaaaggttacacttctgg

SEQ ID NO: 10030163 - DNA, 22 bp, Homo sapiens
aagagtgtgaggttgtgctttt

SEQ ID NO: 10030164 - DNA, 22 bp, Homo sapiens
aattagcatttcccatataaat

SEQ ID NO: 10030165 - DNA, 22 bp, Homo sapiens
aagacaacagagatgacagact

SEQ ID NO: 10030166 - DNA, 22 bp, Homo sapiens
aattcacaaaaccagattgctt

SEQ ID NO: 10030167 - DNA, 22 bp, Homo sapiens
aattcacaaaagttagatccat

SEQ ID NO: 10030168 - DNA, 22 bp, Homo sapiens
acaactctcagttaaataaaga

SEQ ID NO: 10030169 - DNA, 22 bp, Homo sapiens
acaacaaaatcactagtcttcc

SEQ ID NO: 10030170 - DNA, 22 bp, Homo sapiens
aagacaatcctggacagtcagc

SEQ ID NO: 10030171 - DNA, 22 bp, Homo sapiens
aaattagtcatgttgtattact

SEQ ID NO: 10030172 - DNA, 22 bp, Homo sapiens
aaattattataggcagagctga

SEQ ID NO: 10030173 - DNA, 22 bp, Homo sapiens
aaattattacaagctagttggc

SEQ ID NO: 10030174 - DNA, 22 bp, Homo sapiens
aaatttaaaaagcagcattgca

SEQ ID NO: 10030175 - DNA, 22 bp, Homo sapiens
aagctttaagtgtcagtcagcc

SEQ ID NO: 10030176 - DNA, 22 bp, Homo sapiens
aagctttagagatgagttcctt

SEQ ID NO: 10030177 - DNA, 22 bp, Homo sapiens
aagctttatgatctctcagcta

SEQ ID NO: 10030178 - DNA, 22 bp, Homo sapiens
aagctttatgacttggagacag

SEQ ID NO: 10030179 - DNA, 22 bp, Homo sapiens
aagccagttagcacatcattgc

SEQ ID NO: 10030180 - DNA, 19 bp, Homo sapiens
aacaagtaggaatggaaga

SEQ ID NO: 10030181 - DNA, 22 bp, Homo sapiens
aagggagaggagggtcttgttg

SEQ ID NO: 10030182 - DNA, 20 bp, Homo sapiens
aacaatctagaagctattct

SEQ ID NO: 10030183 - DNA, 22 bp, Homo sapiens
aagtttgcggggaaagaacaca

SEQ ID NO: 10030184 - DNA, 22 bp, Homo sapiens
aactcattctaagtataccaaa

SEQ ID NO: 10030185 - DNA, 22 bp, Homo sapiens
aaaagtctctctgagtaaaagt

SEQ ID NO: 10030186 - DNA, 22 bp, Homo sapiens
aaatagaattaactagctactg

SEQ ID NO: 10030187 - DNA, 22 bp, Homo sapiens
aaatactgtagataatagagtt

SEQ ID NO: 10030188 - DNA, 22 bp, Homo sapiens
aaatgcagctgggcatgagagg

SEQ ID NO: 10030189 - DNA, 21 bp, Homo sapiens
aaatccaaacactagtccaca

SEQ ID NO: 10030190 - DNA, 22 bp, Homo sapiens
aaagcaatagagggtaagactg

SEQ ID NO: 10030191 - DNA, 22 bp, Homo sapiens
aaagcaatcagattcagatgtc

SEQ ID NO: 10030192 - DNA, 22 bp, Homo sapiens
aaatacagattccagggtctta

SEQ ID NO: 10030193 - DNA, 22 bp, Homo sapiens
aaagtgcattcgaaagtccatc

SEQ ID NO: 10030194 - DNA, 19 bp, Homo sapiens
aagcatggtgcctcacctc

SEQ ID NO: 10030195 - DNA, 22 bp, Homo sapiens
aagcatggtggatgatacagtg

SEQ ID NO: 10030196 - DNA, 22 bp, Homo sapiens
aagcaactccctcctcattttt

SEQ ID NO: 10030197 - DNA, 22 bp, Homo sapiens
aaatgggcctggaaagaggatg

SEQ ID NO: 10030198 - DNA, 22 bp, Homo sapiens
aacacattgccagagatcagca

SEQ ID NO: 10030199 - DNA, 22 bp, Homo sapiens
aacaatgtgaagtgctgttcag

SEQ ID NO: 10030200 - DNA, 22 bp, Homo sapiens
aactgaaatcaatcagtgattc

SEQ ID NO: 10030201 - DNA, 22 bp, Homo sapiens
aactatttttggagctaactct

SEQ ID NO: 10030202 - DNA, 22 bp, Homo sapiens
agattagcctaaaaatgtatag

SEQ ID NO: 10030203 - DNA, 22 bp, Homo sapiens
agattagcttgtgtacaaaggt

SEQ ID NO: 10030204 - DNA, 21 bp, Homo sapiens
agattataaagaaccttctta

SEQ ID NO: 10030205 - DNA, 22 bp, Homo sapiens
agaggtggccatgggcgctgga

SEQ ID NO: 10030206 - DNA, 22 bp, Homo sapiens
agagtaaagtacttggaatacc

SEQ ID NO: 10030207 - DNA, 22 bp, Homo sapiens
aatttcaaagctcactggcata

SEQ ID NO: 10030208 - DNA, 22 bp, Homo sapiens
aatttcaaactaataggaacca

SEQ ID NO: 10030209 - DNA, 22 bp, Homo sapiens
aatgtaaacagcaagagaaggg

SEQ ID NO: 10030210 - DNA, 22 bp, Homo sapiens
agaagtttgttatgtaaacaaa

SEQ ID NO: 10030211 - DNA, 22 bp, Homo sapiens
agaataaatgctacctatcaca

SEQ ID NO: 10030212 - DNA, 22 bp, Homo sapiens
aatgaaacatatttaggaataa

SEQ ID NO: 10030213 - DNA, 22 bp, Homo sapiens
aatgaaaattggaccctagaac

SEQ ID NO: 10030214 - DNA, 22 bp, Homo sapiens
aatgctttgagggaagatgaaa

SEQ ID NO: 10030215 - DNA, 22 bp, Homo sapiens
aatgctttttgcgaaatgtgca

SEQ ID NO: 10030216 - DNA, 22 bp, Homo sapiens
aattatgtagccatatgaaaca

SEQ ID NO: 10030217 - DNA, 22 bp, Homo sapiens
aattatgtgcttgcttgtttcc

SEQ ID NO: 10030218 - DNA, 22 bp, Homo sapiens
aattatgtggaagaggattaaa

SEQ ID NO: 10030219 - DNA, 22 bp, Homo sapiens
agcatttaatcctacatagatc

SEQ ID NO: 10030220 - DNA, 22 bp, Homo sapiens
agcatttaagggtggatacagg

SEQ ID NO: 10030221 - DNA, 22 bp, Homo sapiens
agcatttaagcttctgcaaagc

SEQ ID NO: 10030222 - DNA, 22 bp, Homo sapiens
agcactttgggagataaagctg

SEQ ID NO: 10030223 - DNA, 22 bp, Homo sapiens
agatttctgtcaccttctatgc

SEQ ID NO: 10030224 - DNA, 22 bp, Homo sapiens
acaggcagagaactcagccaga

SEQ ID NO: 10030225 - DNA, 20 bp, Homo sapiens
acagatgaggaaaatgaagt

SEQ ID NO: 10030226 - DNA, 22 bp, Homo sapiens
acataagtgcacaataaatatt

SEQ ID NO: 10030227 - DNA, 22 bp, Homo sapiens
acataagttatggataaaatgt

SEQ ID NO: 10030228 - DNA, 22 bp, Homo sapiens
acataatggacaataatgcatc

SEQ ID NO: 10030229 - DNA, 18 bp, Homo sapiens
aataaagcaggatttctc

SEQ ID NO: 10030230 - DNA, 20 bp, Homo sapiens
aataaagcaacgagcgagct

SEQ ID NO: 10030231 - DNA, 22 bp, Homo sapiens
aataaagcacttgggttggtaa

SEQ ID NO: 10030232 - DNA, 22 bp, Homo sapiens
aataaagcagggtccttgcact

SEQ ID NO: 10030233 - DNA, 22 bp, Homo sapiens
aataaagcatgaggcatttatc

SEQ ID NO: 10030234 - DNA, 22 bp, Homo sapiens
aataaagtagcgtttaaggtgc

SEQ ID NO: 10030235 - DNA, 22 bp, Homo sapiens
aataaagcctgtctctttagag

SEQ ID NO: 10030236 - DNA, 22 bp, Homo sapiens
aataacagaaacttgagcatca

SEQ ID NO: 10030237 - DNA, 22 bp, Homo sapiens
aataacagagtcttcaagatag

SEQ ID NO: 10030238 - DNA, 22 bp, Homo sapiens
actcatctgccattcctgtacc

SEQ ID NO: 10030239 - DNA, 18 bp, Homo sapiens
aagtaacagaagagcaca

SEQ ID NO: 10030240 - DNA, 22 bp, Homo sapiens
accttcttccaccaaaaacgtc

SEQ ID NO: 10030241 - DNA, 22 bp, Homo sapiens
aataactggcacatatcacata

SEQ ID NO: 10030242 - DNA, 22 bp, Homo sapiens
aataacagtgccatgaaattga

SEQ ID NO: 10030243 - DNA, 22 bp, Homo sapiens
aataacagggttgatttgcaat

SEQ ID NO: 10030244 - DNA, 22 bp, Homo sapiens
aataacaggctcatcagatgct

SEQ ID NO: 10030245 - DNA, 22 bp, Homo sapiens
aatactgtctttcacagatatt

SEQ ID NO: 10030246 - DNA, 22 bp, Homo sapiens
aatctcaaagatggccagaaga

SEQ ID NO: 10030247 - DNA, 23 bp, Homo sapiens
agaaaccactgaagagatccagt

SEQ ID NO: 10030248 - DNA, 22 bp, Homo sapiens
agaaaataatttcttggctggt

SEQ ID NO: 10030249 - DNA, 22 bp, Homo sapiens
agcatggacagtggcagcagtg

SEQ ID NO: 10030250 - DNA, 22 bp, Homo sapiens
agcagtgaaacagctgcatatg

SEQ ID NO: 10030251 - DNA, 22 bp, Homo sapiens
agcagggaggtctagcacgtgg

SEQ ID NO: 10030252 - DNA, 22 bp, Homo sapiens
cacagcaatagctaactgatac

SEQ ID NO: 10030253 - DNA, 22 bp, Homo sapiens
cacagcaagagctaaatgacca

SEQ ID NO: 10030254 - DNA, 22 bp, Homo sapiens
cacagcaaaggcttcggctgat

SEQ ID NO: 10030255 - DNA, 22 bp, Homo sapiens
agcagcttgaggctggattcca

SEQ ID NO: 10030256 - DNA, 20 bp, Homo sapiens
cagcaactttggactgagtt

SEQ ID NO: 10030257 - DNA, 22 bp, Homo sapiens
agccagcatgaagacagaggcc

SEQ ID NO: 10030258 - DNA, 22 bp, Homo sapiens
agccagcatcccttcagtctcc

SEQ ID NO: 10030259 - DNA, 22 bp, Homo sapiens
agccagcagggcttagaggaca

SEQ ID NO: 10030260 - DNA, 22 bp, Homo sapiens
agccagcacggcgccatggagt

SEQ ID NO: 10030261 - DNA, 22 bp, Homo sapiens
cagagacattaagtgccatgat

SEQ ID NO: 10030262 - DNA, 22 bp, Homo sapiens
cagagacatccatgttagttgg

SEQ ID NO: 10030263 - DNA, 22 bp, Homo sapiens
agagagggaatatttggggtat

SEQ ID NO: 10030264 - DNA, 22 bp, Homo sapiens
agagctgaaaaagctgacccgg

SEQ ID NO: 10030265 - DNA, 22 bp, Homo sapiens
atgcctttggcattatttcttg

SEQ ID NO: 10030266 - DNA, 22 bp, Homo sapiens
atgccttttcgggtacttctct

SEQ ID NO: 10030267 - DNA, 22 bp, Homo sapiens
atgcctttctggtgttcttcct

SEQ ID NO: 10030268 - DNA, 22 bp, Homo sapiens
atgaagcagttaaggtgcatga

SEQ ID NO: 10030269 - DNA, 19 bp, Homo sapiens
atgaagcattgtttttgta

SEQ ID NO: 10030270 - DNA, 22 bp, Homo sapiens
atgaagcattacaggatgacag

SEQ ID NO: 10030271 - DNA, 22 bp, Homo sapiens
agacaactagaaaactagacag

SEQ ID NO: 10030272 - DNA, 20 bp, Homo sapiens
agcaagagtaaggacagcga

SEQ ID NO: 10030273 - DNA, 22 bp, Homo sapiens
caaagataatcacagaataccc

SEQ ID NO: 10030274 - DNA, 22 bp, Homo sapiens
attttcagaacattcattcact

SEQ ID NO: 10030275 - DNA, 22 bp, Homo sapiens
agcaacacgcagtagtatacga

SEQ ID NO: 10030276 - DNA, 22 bp, Homo sapiens
agatcagacacggcttgtgacg

SEQ ID NO: 10030277 - DNA, 22 bp, Homo sapiens
acattcatgtcccacttctagc

SEQ ID NO: 10030278 - DNA, 22 bp, Homo sapiens
agctgctgtgtgctcaggcagg

SEQ ID NO: 10030279 - DNA, 23 bp, Homo sapiens
acatacataagcaccacattttg

SEQ ID NO: 10030280 - DNA, 22 bp, Homo sapiens
acagggtggggatggtgagctt

SEQ ID NO: 10030281 - DNA, 22 bp, Homo sapiens
acagggtgactttgtgacagat

SEQ ID NO: 10030282 - DNA, 22 bp, Homo sapiens
atcagtgtttcaaatgtaatct

SEQ ID NO: 10030283 - DNA, 22 bp, Homo sapiens
agaaagcactctgtcttttacc

SEQ ID NO: 10030284 - DNA, 22 bp, Homo sapiens
agaaagcagcatttatgatctc

SEQ ID NO: 10030285 - DNA, 22 bp, Homo sapiens
agaaagcatctccattgtaggt

SEQ ID NO: 10030286 - DNA, 22 bp, Homo sapiens
agaaagcacagcgggtccattt

SEQ ID NO: 10030287 - DNA, 22 bp, Homo sapiens
agaaagcaccctgcactttctg

SEQ ID NO: 10030288 - DNA, 22 bp, Homo sapiens
atcccatagggttatcataggg

SEQ ID NO: 10030289 - DNA, 22 bp, Homo sapiens
atacatcatttcccatcaatcg

SEQ ID NO: 10030290 - DNA, 22 bp, Homo sapiens
atacatcatgctccatatattt

SEQ ID NO: 10030291 - DNA, 22 bp, Homo sapiens
actttacaaactcctcactgtt

SEQ ID NO: 10030292 - DNA, 22 bp, Homo sapiens
actttacaatatcctgtgactt

SEQ ID NO: 10030293 - DNA, 22 bp, Homo sapiens
atacatcacctatatattcaca

SEQ ID NO: 10030294 - DNA, 22 bp, Homo sapiens
atacatcaatttcttagttatc

SEQ ID NO: 10030295 - DNA, 22 bp, Homo sapiens
actttaaaactgatcatcagag

SEQ ID NO: 10030296 - DNA, 21 bp, Homo sapiens
ataaagttttacaggaatgca

SEQ ID NO: 10030297 - DNA, 22 bp, Homo sapiens
agttttatggctcaacctaata

SEQ ID NO: 10030298 - DNA, 22 bp, Homo sapiens
agttttatgtagacaattcatt

SEQ ID NO: 10030299 - DNA, 22 bp, Homo sapiens
agtactgtcagcagggtgttga

SEQ ID NO: 10030300 - DNA, 22 bp, Homo sapiens
agtatacagtaatgacatatct

SEQ ID NO: 10030301 - DNA, 22 bp, Homo sapiens
aggtgagaaaacgagggttgca

SEQ ID NO: 10030302 - DNA, 22 bp, Homo sapiens
agtgctatcgagttctaatgct

SEQ ID NO: 10030303 - DNA, 22 bp, Homo sapiens
actgcatttggtaaagtcaaga

SEQ ID NO: 10030304 - DNA, 22 bp, Homo sapiens
agtgaagctaacctgctgattt

SEQ ID NO: 10030305 - DNA, 23 bp, Homo sapiens
agtgaagctggttagtgatgacc

SEQ ID NO: 10030306 - DNA, 22 bp, Homo sapiens
agtgaagccccgatgcgttttg

SEQ ID NO: 10030307 - DNA, 22 bp, Homo sapiens
agtgaagcctgctgaaagtggc

SEQ ID NO: 10030308 - DNA, 22 bp, Homo sapiens
actgcacagatgaagctgtaaa

SEQ ID NO: 10030309 - DNA, 22 bp, Homo sapiens
actgcccattatggtagtcact

SEQ ID NO: 10030310 - DNA, 22 bp, Homo sapiens
actgcccagaagagatgaaagt

SEQ ID NO: 10030311 - DNA, 22 bp, Homo sapiens
actgggcctgtacagagaaaac

SEQ ID NO: 10030312 - DNA, 22 bp, Homo sapiens
actgggccagatcagagcaact

SEQ ID NO: 10030313 - DNA, 22 bp, Homo sapiens
aggtgcagcatgagtccaacgg

SEQ ID NO: 10030314 - DNA, 22 bp, Homo sapiens
ccttcattcagctatagcatcc

SEQ ID NO: 10030315 - DNA, 22 bp, Homo sapiens
agggtgggctagactcttcccc

SEQ ID NO: 10030316 - DNA, 22 bp, Homo sapiens
aggtcagacagggtgtctttct

SEQ ID NO: 10030317 - DNA, 22 bp, Homo sapiens
agtaaacagtaggaactgagaa

SEQ ID NO: 10030318 - DNA, 22 bp, Homo sapiens
agtaaataacagagaaaatggg

SEQ ID NO: 10030319 - DNA, 22 bp, Homo sapiens
agtaaagcagagttgcagtaca

SEQ ID NO: 10030320 - DNA, 22 bp, Homo sapiens
agtagcattctccctctacact

SEQ ID NO: 10030321 - DNA, 22 bp, Homo sapiens
agtagccaacttttcttagact

SEQ ID NO: 10030322 - DNA, 22 bp, Homo sapiens
agtagccaccaaccatgtgtgg

SEQ ID NO: 10030323 - DNA, 22 bp, Homo sapiens
agtaacaagtgccaacgttaga

SEQ ID NO: 10030324 - DNA, 22 bp, Homo sapiens
agtaacaaatagctgcctttaa

SEQ ID NO: 10030325 - DNA, 22 bp, Homo sapiens
agtaacaaatgcatctgggcat

SEQ ID NO: 10030326 - DNA, 22 bp, Homo sapiens
ctatatttcttggctttaaaca

SEQ ID NO: 10030327 - DNA, 22 bp, Homo sapiens
ctatcttttgttcattttgagt

SEQ ID NO: 10030328 - DNA, 22 bp, Homo sapiens
ctaggaaatgaatacagtacac

SEQ ID NO: 10030329 - DNA, 22 bp, Homo sapiens
ctaggaaagacacagagagttt

SEQ ID NO: 10030330 - DNA, 22 bp, Homo sapiens
agtgccaaggtattaatttata

SEQ ID NO: 10030331 - DNA, 22 bp, Homo sapiens
agtctcaagtgttagtattatt

SEQ ID NO: 10030332 - DNA, 22 bp, Homo sapiens
agtgaaaacctaatcatgcagt

SEQ ID NO: 10030333 - DNA, 22 bp, Homo sapiens
agtgaaatagcatttatgaagc

SEQ ID NO: 10030334 - DNA, 22 bp, Homo sapiens
agtgtcaatgccaacagtatat

SEQ ID NO: 10030335 - DNA, 22 bp, Homo sapiens
agtgtcaatgctctgttaaaaa

SEQ ID NO: 10030336 - DNA, 22 bp, Homo sapiens
agtgtcaagtacatggtagtga

SEQ ID NO: 10030337 - DNA, 22 bp, Homo sapiens
agtgtcaataatttctttttgg

SEQ ID NO: 10030338 - DNA, 22 bp, Homo sapiens
agtgtcaagtgaggagggaaag

SEQ ID NO: 10030339 - DNA, 22 bp, Homo sapiens
agtgtcaaggttgagaaaccct

SEQ ID NO: 10030340 - DNA, 22 bp, Homo sapiens
agtgtcaattctcaaatctcgg

SEQ ID NO: 10030341 - DNA, 22 bp, Homo sapiens
agtgtcaactgtctacagggag

SEQ ID NO: 10030342 - DNA, 22 bp, Homo sapiens
agtgtcaactcggaataaggat

SEQ ID NO: 10030343 - DNA, 22 bp, Homo sapiens
agtgtcaaattaaataatctgg

SEQ ID NO: 10030344 - DNA, 22 bp, Homo sapiens
agtgtcaaatgtgtgccaagct

SEQ ID NO: 10030345 - DNA, 22 bp, Homo sapiens
agtgtcaaatcagcatctgggt

SEQ ID NO: 10030346 - DNA, 22 bp, Homo sapiens
agtggtcaaagactagatttca

SEQ ID NO: 10030347 - DNA, 19 bp, Homo sapiens
atacacatacgtaaactga

SEQ ID NO: 10030348 - DNA, 22 bp, Homo sapiens
ataaagctatttttaattctgt

SEQ ID NO: 10030349 - DNA, 22 bp, Homo sapiens
ataaaaatgagggcggtagcta

SEQ ID NO: 10030350 - DNA, 22 bp, Homo sapiens
ataaaaaggacagatgtggtct

SEQ ID NO: 10030351 - DNA, 22 bp, Homo sapiens
ataaaacttattagaattgtgt

SEQ ID NO: 10030352 - DNA, 22 bp, Homo sapiens
ataaagaggatgtatttacagc

SEQ ID NO: 10030353 - DNA, 22 bp, Homo sapiens
ataaagcatctagtctgtcact

SEQ ID NO: 10030354 - DNA, 22 bp, Homo sapiens
ataaagcatgcttgtttggaga

SEQ ID NO: 10030355 - DNA, 22 bp, Homo sapiens
ataaagcatactttgtatgact

SEQ ID NO: 10030356 - DNA, 22 bp, Homo sapiens
ataaagctaagacttacatgaa

SEQ ID NO: 10030357 - DNA, 22 bp, Homo sapiens
ataaagcaaataggactattgc

SEQ ID NO: 10030358 - DNA, 22 bp, Homo sapiens
atacatgatcactgtattataa

SEQ ID NO: 10030359 - DNA, 20 bp, Homo sapiens
atacacatgcagacagatgc

SEQ ID NO: 10030360 - DNA, 22 bp, Homo sapiens
atataaagagcttagtatagtg

SEQ ID NO: 10030361 - DNA, 22 bp, Homo sapiens
atatacaggtggtatgtgtaaa

SEQ ID NO: 10030362 - DNA, 22 bp, Homo sapiens
atatacagggagaaacagctta

SEQ ID NO: 10030363 - DNA, 22 bp, Homo sapiens
cttagatgaagtcacagaaccc

SEQ ID NO: 10030364 - DNA, 22 bp, Homo sapiens
cttagcaagaatcagctgctgg

SEQ ID NO: 10030365 - DNA, 22 bp, Homo sapiens
cttaataataggtgaggctatg

SEQ ID NO: 10030366 - DNA, 22 bp, Homo sapiens
atcatacagaacctgagcactt

SEQ ID NO: 10030367 - DNA, 22 bp, Homo sapiens
cttccttccacaccttcagaat

SEQ ID NO: 10030368 - DNA, 22 bp, Homo sapiens
atctccttggtctcgttccagg

SEQ ID NO: 10030369 - DNA, 22 bp, Homo sapiens
atctgtgagtatttttgtttat

SEQ ID NO: 10030370 - DNA, 22 bp, Homo sapiens
ctgtaacagatatcatttagca

SEQ ID NO: 10030371 - DNA, 22 bp, Homo sapiens
aggaggctgcaaccctgaggcc

SEQ ID NO: 10030372 - DNA, 22 bp, Homo sapiens
aggaggctggttcaggccatat

SEQ ID NO: 10030373 - DNA, 22 bp, Homo sapiens
catattttagttgctgaacagc

SEQ ID NO: 10030374 - DNA, 22 bp, Homo sapiens
catgtgtccacccttgaacaca

SEQ ID NO: 10030375 - DNA, 22 bp, Homo sapiens
cagggtttcaccatgttagcag

SEQ ID NO: 10030376 - DNA, 22 bp, Homo sapiens
aggaaaaataaggcagcagggc

SEQ ID NO: 10030377 - DNA, 22 bp, Homo sapiens
aggaaaatggaccagagttgtt

SEQ ID NO: 10030378 - DNA, 22 bp, Homo sapiens
caggctggagttcagtggtgtg

SEQ ID NO: 10030379 - DNA, 22 bp, Homo sapiens
caggctgtgaaactgagatgcg

SEQ ID NO: 10030380 - DNA, 22 bp, Homo sapiens
agctttcagttactaatgaagg

SEQ ID NO: 10030381 - DNA, 22 bp, Homo sapiens
caggaaatgctatcatagctga

SEQ ID NO: 10030382 - DNA, 22 bp, Homo sapiens
caggcagagtcagattagactt

SEQ ID NO: 10030383 - DNA, 20 bp, Homo sapiens
caggcagaggatgctgacca

SEQ ID NO: 10030384 - DNA, 22 bp, Homo sapiens
aggggtgaaggcccgataggag

SEQ ID NO: 10030385 - DNA, 22 bp, Homo sapiens
aggggaggcagcgataaacctg

SEQ ID NO: 10030386 - DNA, 22 bp, Homo sapiens
aggctggagcaagggggcatat

SEQ ID NO: 10030387 - DNA, 22 bp, Homo sapiens
aggctggagtgctggagtgctg

SEQ ID NO: 10030388 - DNA, 22 bp, Homo sapiens
aggctggagtgcaatggcgtga

SEQ ID NO: 10030389 - DNA, 22 bp, Homo sapiens
aggctgaggatcgtactttcca

SEQ ID NO: 10030390 - DNA, 22 bp, Homo sapiens
gtctttcttaaacaacagaaca

SEQ ID NO: 10030391 - DNA, 22 bp, Homo sapiens
gtctttcttaattcaagtgctt

SEQ ID NO: 10030392 - DNA, 22 bp, Homo sapiens
gtctttctgctgcacggactgc

SEQ ID NO: 10030393 - DNA, 22 bp, Homo sapiens
gtctttctctggaacagtaaaa

SEQ ID NO: 10030394 - DNA, 22 bp, Homo sapiens
gtctttctatgcatagagcaga

SEQ ID NO: 10030395 - DNA, 22 bp, Homo sapiens
gtctttctgccatgtgaagaga

SEQ ID NO: 10030396 - DNA, 22 bp, Homo sapiens
gtctttcttcagagcttggact

SEQ ID NO: 10030397 - DNA, 22 bp, Homo sapiens
cagcagtctgtttcaacaggtc

SEQ ID NO: 10030398 - DNA, 22 bp, Homo sapiens
gggggaggtgaatgcaataagg

SEQ ID NO: 10030399 - DNA, 22 bp, Homo sapiens
ggggtgagctgggcctgtgcct

SEQ ID NO: 10030400 - DNA, 22 bp, Homo sapiens
ggaggagacagtaaaaagcacg

SEQ ID NO: 10030401 - DNA, 22 bp, Homo sapiens
ggacagcacagctcttgacaac

SEQ ID NO: 10030402 - DNA, 22 bp, Homo sapiens
cacagcaaagacactctcaact

SEQ ID NO: 10030403 - DNA, 22 bp, Homo sapiens
caatggaagaatctgacctgca

SEQ ID NO: 10030404 - DNA, 22 bp, Homo sapiens
caaatttaagttagaaagcaat

SEQ ID NO: 10030405 - DNA, 22 bp, Homo sapiens
ggccactttcatagcaagtgtg

SEQ ID NO: 10030406 - DNA, 22 bp, Homo sapiens
cacatttttactgccaacttaa

SEQ ID NO: 10030407 - DNA, 19 bp, Homo sapiens
cacattttgagtctgagat

SEQ ID NO: 10030408 - DNA, 22 bp, Homo sapiens
atgtttctagttgtatgtcact

SEQ ID NO: 10030409 - DNA, 22 bp, Homo sapiens
attgtttacactaacttcataa

SEQ ID NO: 10030410 - DNA, 22 bp, Homo sapiens
attttgaaaagcatttgagtaa

SEQ ID NO: 10030411 - DNA, 23 bp, Homo sapiens
attttaaccttgactaacatgca

SEQ ID NO: 10030412 - DNA, 22 bp, Homo sapiens
caaatgaagtccaaagggctta

SEQ ID NO: 10030413 - DNA, 22 bp, Homo sapiens
gagggaaacagatgggttgtgg

SEQ ID NO: 10030414 - DNA, 22 bp, Homo sapiens
gagttaaatattttctgaagtt

SEQ ID NO: 10030415 - DNA, 23 bp, Homo sapiens
gagtgcagaatagacatgcagtg

SEQ ID NO: 10030416 - DNA, 22 bp, Homo sapiens
atgtttctaaaacttgcatggc

SEQ ID NO: 10030417 - DNA, 22 bp, Homo sapiens
atgtcacagtgttgctggaagt

SEQ ID NO: 10030418 - DNA, 22 bp, Homo sapiens
atgtaactgaaggaaatgcatg

SEQ ID NO: 10030419 - DNA, 22 bp, Homo sapiens
atgtaacaggcacgggtggata

SEQ ID NO: 10030420 - DNA, 22 bp, Homo sapiens
atgtaacaggtgaagctctgag

SEQ ID NO: 10030421 - DNA, 22 bp, Homo sapiens
gagaggctctgaggactggggt

SEQ ID NO: 10030422 - DNA, 22 bp, Homo sapiens
atgaagcagcgttgtagagtga

SEQ ID NO: 10030423 - DNA, 22 bp, Homo sapiens
atgaagcaggcacagcttcagg

SEQ ID NO: 10030424 - DNA, 21 bp, Homo sapiens
gactttcttaccagatttttg

SEQ ID NO: 10030425 - DNA, 22 bp, Homo sapiens
gactttcttgcagaaatattcc

SEQ ID NO: 10030426 - DNA, 22 bp, Homo sapiens
gacagtgtgaacatctaatagt

SEQ ID NO: 10030427 - DNA, 22 bp, Homo sapiens
gacagtgttacaatttaatgga

SEQ ID NO: 10030428 - DNA, 22 bp, Homo sapiens
gacagtgtttgtataattcctg

SEQ ID NO: 10030429 - DNA, 22 bp, Homo sapiens
tcttttgtgattcttcagttac

SEQ ID NO: 10030430 - DNA, 17 bp, Homo sapiens
tgaaacaccaagactgt

SEQ ID NO: 10030431 - DNA, 22 bp, Homo sapiens
tcttttcttcttaatggttaat

SEQ ID NO: 10030432 - DNA, 22 bp, Homo sapiens
tcttttcttgcattattgcact

SEQ ID NO: 10030433 - DNA, 22 bp, Homo sapiens
tcttttctgtaactcagtgtct

SEQ ID NO: 10030434 - DNA, 22 bp, Homo sapiens
tctgttcaagactgaggtgaca

SEQ ID NO: 10030435 - DNA, 22 bp, Homo sapiens
tctgttcttaaagcattcttgc

SEQ ID NO: 10030436 - DNA, 22 bp, Homo sapiens
tctgttccatgttttgttccat

SEQ ID NO: 10030437 - DNA, 22 bp, Homo sapiens
tgcaggactttcagtgctcaaa

SEQ ID NO: 10030438 - DNA, 22 bp, Homo sapiens
tgggtgggagcaccctgtctgg

SEQ ID NO: 10030439 - DNA, 22 bp, Homo sapiens
tggtaattaatttgataggttc

SEQ ID NO: 10030440 - DNA, 22 bp, Homo sapiens
tggcatttctgttagactctca

SEQ ID NO: 10030441 - DNA, 22 bp, Homo sapiens
tggcatttgggctggcttttct

SEQ ID NO: 10030442 - DNA, 22 bp, Homo sapiens
tggcattttagacatgatggtg

SEQ ID NO: 10030443 - DNA, 22 bp, Homo sapiens
tgggacaggaggcctctggaga

SEQ ID NO: 10030444 - DNA, 22 bp, Homo sapiens
tggcaggaaaaacattggagat

SEQ ID NO: 10030445 - DNA, 22 bp, Homo sapiens
cccttctttgtaataaagatta

SEQ ID NO: 10030446 - DNA, 19 bp, Homo sapiens
catgtgtcaatactgtacc

SEQ ID NO: 10030447 - DNA, 22 bp, Homo sapiens
catcatactgtttacactcaaa

SEQ ID NO: 10030448 - DNA, 22 bp, Homo sapiens
tcagtgtcttctctttcctacc

SEQ ID NO: 10030449 - DNA, 22 bp, Homo sapiens
tcagtgtgcacgatacagattg

SEQ ID NO: 10030450 - DNA, 22 bp, Homo sapiens
tcacttatgccagctctggaag

SEQ ID NO: 10030451 - DNA, 22 bp, Homo sapiens
catttccttcctgctgctcctc

SEQ ID NO: 10030452 - DNA, 22 bp, Homo sapiens
ccaaattaaatcatacagacag

SEQ ID NO: 10030453 - DNA, 21 bp, Homo sapiens
tctataactatagtgacagat

SEQ ID NO: 10030454 - DNA, 22 bp, Homo sapiens
ccagatgtccctctcaggtttg

SEQ ID NO: 10030455 - DNA, 22 bp, Homo sapiens
cagtagcaggcactcagcacgt

SEQ ID NO: 10030456 - DNA, 22 bp, Homo sapiens
tcaaagcttagataatttcttt

SEQ ID NO: 10030457 - DNA, 22 bp, Homo sapiens
tcactgcaacctccgcctgctg

SEQ ID NO: 10030458 - DNA, 22 bp, Homo sapiens
tcactgcaagctccacctcccg

SEQ ID NO: 10030459 - DNA, 22 bp, Homo sapiens
tatattcaatgattagtatcag

SEQ ID NO: 10030460 - DNA, 22 bp, Homo sapiens
tagtaacagatttatacagtct

SEQ ID NO: 10030461 - DNA, 22 bp, Homo sapiens
tagaaacaagtttctctttggg

SEQ ID NO: 10030462 - DNA, 22 bp, Homo sapiens
cagggagaggcctctgttgccc

SEQ ID NO: 10030463 - DNA, 22 bp, Homo sapiens
cagggagaggctggtggagtaa

SEQ ID NO: 10030464 - DNA, 22 bp, Homo sapiens
cagggagatcttggctcctggt

SEQ ID NO: 10030465 - DNA, 22 bp, Homo sapiens
tagcatcagccacaccttgtac

SEQ ID NO: 10030466 - DNA, 22 bp, Homo sapiens
tacacagactcttcaattcaga

SEQ ID NO: 10030467 - DNA, 22 bp, Homo sapiens
tacagagaataataggacaggt

SEQ ID NO: 10030468 - DNA, 22 bp, Homo sapiens
tacagacatttactccactcct

SEQ ID NO: 10030469 - DNA, 22 bp, Homo sapiens
tacagacattcaattttgaccc

SEQ ID NO: 10030470 - DNA, 22 bp, Homo sapiens
tacagccatcatgtatgtatat

SEQ ID NO: 10030471 - DNA, 20 bp, Homo sapiens
ctgtacatcaccaaggtgac

SEQ ID NO: 10030472 - DNA, 22 bp, Homo sapiens
cttttcctattgattctgttac

SEQ ID NO: 10030473 - DNA, 22 bp, Homo sapiens
cttgtctttatttcatattcca

SEQ ID NO: 10030474 - DNA, 22 bp, Homo sapiens
cttgtgcatttcattcctcagg

SEQ ID NO: 10030475 - DNA, 22 bp, Homo sapiens
cttctcttggtagttcttgttg

SEQ ID NO: 10030476 - DNA, 22 bp, Homo sapiens
cttacagtacttctaatatgat

SEQ ID NO: 10030477 - DNA, 22 bp, Homo sapiens
cttacattaagtaagagattga

SEQ ID NO: 10030478 - DNA, 22 bp, Homo sapiens
cttagcaagcattcaagtgcct

SEQ ID NO: 10030479 - DNA, 22 bp, Homo sapiens
cttagcaatttaactgactcta

SEQ ID NO: 10030480 - DNA, 22 bp, Homo sapiens
cttaaattttcatctacaagaa

SEQ ID NO: 10030481 - DNA, 19 bp, Homo sapiens
cttcattcttcagcttttg

SEQ ID NO: 10030482 - DNA, 22 bp, Homo sapiens
cttctattcactggtcacagtt

SEQ ID NO: 10030483 - DNA, 22 bp, Homo sapiens
cttccttcaatataatttttac

SEQ ID NO: 10030484 - DNA, 20 bp, Homo sapiens
cttccttttccttcgtcaaa

SEQ ID NO: 10030485 - DNA, 22 bp, Homo sapiens
cttcctttccccaatcatatcg

SEQ ID NO: 10030486 - DNA, 18 bp, Homo sapiens
gagagggatccctcagga

SEQ ID NO: 10030487 - DNA, 22 bp, Homo sapiens
gagagaaatgtgcagtttgggc

SEQ ID NO: 10030488 - DNA, 22 bp, Homo sapiens
gacagcaagagacagagcatcc

SEQ ID NO: 10030489 - DNA, 21 bp, Homo sapiens
gacagcaactgtagtcctctt

SEQ ID NO: 10030490 - DNA, 22 bp, Homo sapiens
gacagcaatgacggggcagctg

SEQ ID NO: 10030491 - DNA, 22 bp, Homo sapiens
gaagcagtatcctgacagcacc

SEQ ID NO: 10030492 - DNA, 22 bp, Homo sapiens
gaagcagtttctgtaatgaaat

SEQ ID NO: 10030493 - DNA, 22 bp, Homo sapiens
gaaggcaggtttttcaaaactg

SEQ ID NO: 10030494 - DNA, 22 bp, Homo sapiens
gaaggcaggcttctgattaggt

SEQ ID NO: 10030495 - DNA, 22 bp, Homo sapiens
gaggcaggccctgaatgagtca

SEQ ID NO: 10030496 - DNA, 22 bp, Homo sapiens
gaggcagggtgttgattacaga

SEQ ID NO: 10030497 - DNA, 22 bp, Homo sapiens
gaggctgaagtgtacatgggtg

SEQ ID NO: 10030498 - DNA, 22 bp, Homo sapiens
tttttctagaccttaaaggcca

SEQ ID NO: 10030499 - DNA, 22 bp, Homo sapiens
tttttctagctcaaagattcta

SEQ ID NO: 10030500 - DNA, 22 bp, Homo sapiens
ttttcctgggctttctgtgtaa

SEQ ID NO: 10030501 - DNA, 22 bp, Homo sapiens
ttttctcaggtgcttatctaag

SEQ ID NO: 10030502 - DNA, 19 bp, Homo sapiens
ttttcctgcctcattgttt

SEQ ID NO: 10030503 - DNA, 22 bp, Homo sapiens
ctgcatatgagaataggagaaa

SEQ ID NO: 10030504 - DNA, 22 bp, Homo sapiens
tttcaaataccataaacctaat

SEQ ID NO: 10030505 - DNA, 22 bp, Homo sapiens
tttcaaagttgggaattgtaat

SEQ ID NO: 10030506 - DNA, 22 bp, Homo sapiens
tttcaaagtcaatatcattacc

SEQ ID NO: 10030507 - DNA, 22 bp, Homo sapiens
ttgtttaagccacccaatctgt

SEQ ID NO: 10030508 - DNA, 22 bp, Homo sapiens
ctcccttctgagccttttgtta

SEQ ID NO: 10030509 - DNA, 22 bp, Homo sapiens
tttcttaatttgagttccacta

SEQ ID NO: 10030510 - DNA, 22 bp, Homo sapiens
tttcttatactatattgtcatc

SEQ ID NO: 10030511 - DNA, 22 bp, Homo sapiens
tttcttcttgatttaaacaggg

SEQ ID NO: 10030512 - DNA, 22 bp, Homo sapiens
tttcttctttcccagtgatggg

SEQ ID NO: 10030513 - DNA, 22 bp, Homo sapiens
tttcttctgtttgtagttacac

SEQ ID NO: 10030514 - DNA, 22 bp, Homo sapiens
tttctctggcattaggtataaa

SEQ ID NO: 10030515 - DNA, 22 bp, Homo sapiens
tttctctagctattcattaaat

SEQ ID NO: 10030516 - DNA, 22 bp, Homo sapiens
tttctcacccaagagttatttt

SEQ ID NO: 10030517 - DNA, 22 bp, Homo sapiens
ctctatttatggcatctttatg

SEQ ID NO: 10030518 - DNA, 22 bp, Homo sapiens
ttctccttgttcccttcaattg

SEQ ID NO: 10030519 - DNA, 22 bp, Homo sapiens
ttctccttgaaaagctgcatct

SEQ ID NO: 10030520 - DNA, 22 bp, Homo sapiens
ttctccttcctggttttcaggc

SEQ ID NO: 10030521 - DNA, 22 bp, Homo sapiens
ttctccttattcatagttgtct

SEQ ID NO: 10030522 - DNA, 22 bp, Homo sapiens
ttctcatatgcactctatttga

SEQ ID NO: 10030523 - DNA, 22 bp, Homo sapiens
ttctatttcttaatcttggctg

SEQ ID NO: 10030524 - DNA, 22 bp, Homo sapiens
ttctatttttgtggaactgtag

SEQ ID NO: 10030525 - DNA, 22 bp, Homo sapiens
ctacattaaattggcttactta

SEQ ID NO: 10030526 - DNA, 22 bp, Homo sapiens
ttctaccagaccccagacttgt

SEQ ID NO: 10030527 - DNA, 22 bp, Homo sapiens
ttcctttttacataatcacatt

SEQ ID NO: 10030528 - DNA, 22 bp, Homo sapiens
ttccttttgcaaggtcctctag

SEQ ID NO: 10030529 - DNA, 22 bp, Homo sapiens
ctaaattatttgcacattagag

SEQ ID NO: 10030530 - DNA, 22 bp, Homo sapiens
ctaaattatcatgagaattatg

SEQ ID NO: 10030531 - DNA, 22 bp, Homo sapiens
cgtcccgggttcacgccattct

SEQ ID NO: 10030532 - DNA, 22 bp, Homo sapiens
ctaaatgatggatttaaacttt

SEQ ID NO: 10030533 - DNA, 22 bp, Homo sapiens
ttcttacaaacaagatcattga

SEQ ID NO: 10030534 - DNA, 22 bp, Homo sapiens
ttctcttttgtgatgtgagatg

SEQ ID NO: 10030535 - DNA, 22 bp, Homo sapiens
ttaagctatacattgttagagt

SEQ ID NO: 10030536 - DNA, 22 bp, Homo sapiens
ttaaaagtctgatgatttacat

SEQ ID NO: 10030537 - DNA, 22 bp, Homo sapiens
ttaatcctcacaattacctcag

SEQ ID NO: 10030538 - DNA, 19 bp, Homo sapiens
ttaatcctttcatcagctg

SEQ ID NO: 10030539 - DNA, 19 bp, Homo sapiens
tgtttcttcctccatctga

SEQ ID NO: 10030540 - DNA, 17 bp, Homo sapiens
cctttcttcccagaggg

SEQ ID NO: 10030541 - DNA, 22 bp, Homo sapiens
cctttcttgctaagagtttatg

SEQ ID NO: 10030542 - DNA, 22 bp, Homo sapiens
cctttcttgcttagtggctcat

SEQ ID NO: 10030543 - DNA, 22 bp, Homo sapiens
cctttcttttatccaccagcca

SEQ ID NO: 10030544 - DNA, 22 bp, Homo sapiens
cgatgggggcagtgttacattg

SEQ ID NO: 10030545 - DNA, 22 bp, Homo sapiens
ccttcttaaacatcattttggc

SEQ ID NO: 10030546 - DNA, 22 bp, Homo sapiens
ccttcttgaggtagcacattct

SEQ ID NO: 10030547 - DNA, 22 bp, Homo sapiens
ccttcttcaccagtttacctga

SEQ ID NO: 10030548 - DNA, 22 bp, Homo sapiens
ccttctgtctccctcatattga

SEQ ID NO: 10030549 - DNA, 21 bp, Homo sapiens
ccttctcttgcttcagcttca

SEQ ID NO: 10030550 - DNA, 23 bp, Homo sapiens
ttacagaaagtatgcttttgttt

SEQ ID NO: 10030551 - DNA, 22 bp, Homo sapiens
ttacagaactgtcttgaaattt

SEQ ID NO: 10030552 - DNA, 22 bp, Homo sapiens
cctttaaatggatgttcaactg

SEQ ID NO: 10030553 - DNA, 19 bp, Homo sapiens
ccttgtttggtctttgagc

SEQ ID NO: 10030554 - DNA, 22 bp, Homo sapiens
tacatacaagcattcaatttta

SEQ ID NO: 10030555 - DNA, 22 bp, Homo sapiens
tacattcatggtgacttgtatg

SEQ ID NO: 10030556 - DNA, 22 bp, Homo sapiens
tactggaaggctggaagtcagg

SEQ ID NO: 10030557 - DNA, 22 bp, Homo sapiens
tactgtaatcagggcttaggta

SEQ ID NO: 10030558 - DNA, 22 bp, Homo sapiens
taccttctctagatctttattc

SEQ ID NO: 10030559 - DNA, 22 bp, Homo sapiens
taatttctaattcattttcagt

SEQ ID NO: 10030560 - DNA, 22 bp, Homo sapiens
taagttaaccctgttaatagat

SEQ ID NO: 10030561 - DNA, 22 bp, Homo sapiens
taattttccactctgtttatct

SEQ ID NO: 10030562 - DNA, 22 bp, Homo sapiens
tacaatgtaattctgattatgt

SEQ ID NO: 10030563 - DNA, 22 bp, Homo sapiens
taaagtttgtagcaattgatat

SEQ ID NO: 10030564 - DNA, 22 bp, Homo sapiens
taaagtttatttgaacatctct

SEQ ID NO: 10030565 - DNA, 22 bp, Homo sapiens
gttttataattgcttcataaga

SEQ ID NO: 10030566 - DNA, 22 bp, Homo sapiens
gttttataggctgttgctatat

SEQ ID NO: 10030567 - DNA, 22 bp, Homo sapiens
taacacaaaagaatatgtgtgt

SEQ ID NO: 10030568 - DNA, 22 bp, Homo sapiens
taaatacagtcatttgagccat

SEQ ID NO: 10030569 - DNA, 22 bp, Homo sapiens
taacaatacccattctaattac

SEQ ID NO: 10030570 - DNA, 22 bp, Homo sapiens
taagataatccattataatgtt

SEQ ID NO: 10030571 - DNA, 22 bp, Homo sapiens
taagataaggaacattctgtga

SEQ ID NO: 10030572 - DNA, 22 bp, Homo sapiens
taagataataagtatgtctatg

SEQ ID NO: 10030573 - DNA, 22 bp, Homo sapiens
taagataataccatgggccagg

SEQ ID NO: 10030574 - DNA, 22 bp, Homo sapiens
taagaaatttagttatagaatg

SEQ ID NO: 10030575 - DNA, 22 bp, Homo sapiens
gtgttaaatgcaatcacatgca

SEQ ID NO: 10030576 - DNA, 22 bp, Homo sapiens
gtttcctttttctgccctcaat

SEQ ID NO: 10030577 - DNA, 22 bp, Homo sapiens
gtttccttttggaattagagct

SEQ ID NO: 10030578 - DNA, 22 bp, Homo sapiens
gtttcctttgccagtaaatggg

SEQ ID NO: 10030579 - DNA, 22 bp, Homo sapiens
gtttcctttctattgccttgat

SEQ ID NO: 10030580 - DNA, 22 bp, Homo sapiens
gtttctcttaacacataaagta

SEQ ID NO: 10030581 - DNA, 22 bp, Homo sapiens
gtttagatttcatgaagacact

SEQ ID NO: 10030582 - DNA, 22 bp, Homo sapiens
tagcacatctggcgcttatagg

SEQ ID NO: 10030583 - DNA, 22 bp, Homo sapiens
tagcacatacataatagataga

SEQ ID NO: 10030584 - DNA, 22 bp, Homo sapiens
tagcatttggcaccagttattt

SEQ ID NO: 10030585 - DNA, 22 bp, Homo sapiens
tagccatcttcccaccccatct

SEQ ID NO: 10030586 - DNA, 22 bp, Homo sapiens
tagattttaggagattttactg

SEQ ID NO: 10030587 - DNA, 22 bp, Homo sapiens
tagattttgcatttctaacaag

SEQ ID NO: 10030588 - DNA, 22 bp, Homo sapiens
tagattttgcatttctaacaag

SEQ ID NO: 10030589 - DNA, 22 bp, Homo sapiens
tagcaaaaaaactggcatctcc

SEQ ID NO: 10030590 - DNA, 22 bp, Homo sapiens
tactttctgtccttctgttaaa

SEQ ID NO: 10030591 - DNA, 22 bp, Homo sapiens
tactttcttgttcctttcataa

SEQ ID NO: 10030592 - DNA, 22 bp, Homo sapiens
tactttctttctgatccttatg

SEQ ID NO: 10030593 - DNA, 22 bp, Homo sapiens
tagaatctggaaggggctattc

SEQ ID NO: 10030594 - DNA, 23 bp, Homo sapiens
tagaatctgtatttctgcagttc

SEQ ID NO: 10030595 - DNA, 22 bp, Homo sapiens
tagtggatgttcagagatttga

SEQ ID NO: 10030596 - DNA, 22 bp, Homo sapiens
tagtggatgggtaaagtatttt

SEQ ID NO: 10030597 - DNA, 22 bp, Homo sapiens
tagtaaaagtttagttgaaagt

SEQ ID NO: 10030598 - DNA, 22 bp, Homo sapiens
taggctaaaacagtttgtttca

SEQ ID NO: 10030599 - DNA, 22 bp, Homo sapiens
tatattacctgcctgatctata

SEQ ID NO: 10030600 - DNA, 22 bp, Homo sapiens
tagtgtcagggagtgataaatg

SEQ ID NO: 10030601 - DNA, 22 bp, Homo sapiens
tagtgtcaaacagggattagaa

SEQ ID NO: 10030602 - DNA, 22 bp, Homo sapiens
tagtgtcaggagggaaatgcaa

SEQ ID NO: 10030603 - DNA, 22 bp, Homo sapiens
tagtgtcagagaatcttggttt

SEQ ID NO: 10030604 - DNA, 22 bp, Homo sapiens
tatctttattatgtctatctgc

SEQ ID NO: 10030605 - DNA, 22 bp, Homo sapiens
tatttctaagagatatctgtac

SEQ ID NO: 10030606 - DNA, 22 bp, Homo sapiens
tatttcctgtggatacttttag

SEQ ID NO: 10030607 - DNA, 22 bp, Homo sapiens
tatttcagggggtacaagaaga

SEQ ID NO: 10030608 - DNA, 22 bp, Homo sapiens
tatttgtgagactgactgaagt

SEQ ID NO: 10030609 - DNA, 19 bp, Homo sapiens
tatttcaggctcagagtct

SEQ ID NO: 10030610 - DNA, 21 bp, Homo sapiens
tatttcagaagagtctcagag

SEQ ID NO: 10030611 - DNA, 22 bp, Homo sapiens
tatttcaagaacttctatccat

SEQ ID NO: 10030612 - DNA, 21 bp, Homo sapiens
tatgttagtgatgtttgtagg

SEQ ID NO: 10030613 - DNA, 22 bp, Homo sapiens
tccagaaaattttacagtgcct

SEQ ID NO: 10030614 - DNA, 21 bp, Homo sapiens
tcagaactggtgcagatgaat

SEQ ID NO: 10030615 - DNA, 20 bp, Homo sapiens
tcacctaaaccagcagtttc

SEQ ID NO: 10030616 - DNA, 22 bp, Homo sapiens
tcactacaacctccgcctcctg

SEQ ID NO: 10030617 - DNA, 22 bp, Homo sapiens
tcacacagctgctctgttttat

SEQ ID NO: 10030618 - DNA, 22 bp, Homo sapiens
tcaatgtctctttctaaaatgt

SEQ ID NO: 10030619 - DNA, 22 bp, Homo sapiens
tcaattaagaggctaagttact

SEQ ID NO: 10030620 - DNA, 22 bp, Homo sapiens
tcacatccattaagttagaatt

SEQ ID NO: 10030621 - DNA, 22 bp, Homo sapiens
tcacacataaaaagaagactag

SEQ ID NO: 10030622 - DNA, 22 bp, Homo sapiens
tcagtgcatcacagaactttgt

SEQ ID NO: 10030623 - DNA, 22 bp, Homo sapiens
gccttcttcttgcaagggaatg

SEQ ID NO: 10030624 - DNA, 22 bp, Homo sapiens
gccttctttaaaggacgggata

SEQ ID NO: 10030625 - DNA, 22 bp, Homo sapiens
gctgtgaaacctcagtgatagt

SEQ ID NO: 10030626 - DNA, 22 bp, Homo sapiens
gctgtgaagaacctagtgaacc

SEQ ID NO: 10030627 - DNA, 22 bp, Homo sapiens
gctgtgaacatgcacatggagt

SEQ ID NO: 10030628 - DNA, 22 bp, Homo sapiens
gctgtgaagaggccactgcatg

SEQ ID NO: 10030629 - DNA, 22 bp, Homo sapiens
gctgtgaattattcttaactgg

SEQ ID NO: 10030630 - DNA, 22 bp, Homo sapiens
gctgtgaatctgaagactaaaa

SEQ ID NO: 10030631 - DNA, 22 bp, Homo sapiens
gccaggatgactatacaacagc

SEQ ID NO: 10030632 - DNA, 22 bp, Homo sapiens
gcattttaataagattcatagg

SEQ ID NO: 10030633 - DNA, 22 bp, Homo sapiens
gcatttctgtgcatacacatga

SEQ ID NO: 10030634 - DNA, 22 bp, Homo sapiens
ggtgaattctaggagatctgac

SEQ ID NO: 10030635 - DNA, 22 bp, Homo sapiens
ggtgggatgcctctggagaagt

SEQ ID NO: 10030636 - DNA, 22 bp, Homo sapiens
ggtaataaaattgtgtcaaaca

SEQ ID NO: 10030637 - DNA, 22 bp, Homo sapiens
ggtaacaaccctacaaatccac

SEQ ID NO: 10030638 - DNA, 22 bp, Homo sapiens
ggtaacaaggccgatagaaaca

SEQ ID NO: 10030639 - DNA, 22 bp, Homo sapiens
ggggatggtgggaaggcaatct

SEQ ID NO: 10030640 - DNA, 22 bp, Homo sapiens
ggggatggaatgtagtagtgat

SEQ ID NO: 10030641 - DNA, 22 bp, Homo sapiens
gggctggggctcaataatttgt

SEQ ID NO: 10030642 - DNA, 22 bp, Homo sapiens
gggtattaaaatgaaggagaaa

SEQ ID NO: 10030643 - DNA, 22 bp, Homo sapiens
gtcttctttaacctactaaagc

SEQ ID NO: 10030644 - DNA, 22 bp, Homo sapiens
gtcttcttttcagtctgcttgt

SEQ ID NO: 10030645 - DNA, 22 bp, Homo sapiens
gtcaacaattccagtttttact

SEQ ID NO: 10030646 - DNA, 22 bp, Homo sapiens
gtcaacaagtagttttcttcca

SEQ ID NO: 10030647 - DNA, 22 bp, Homo sapiens
gtcaacaaggtttgcttatctt

SEQ ID NO: 10030648 - DNA, 22 bp, Homo sapiens
gtcatttaaaagggaacacatg

SEQ ID NO: 10030649 - DNA, 22 bp, Homo sapiens
gtcatttaggtctgtcagaaat

SEQ ID NO: 10030650 - DNA, 22 bp, Homo sapiens
gtcatttatcatcagaagtcat

SEQ ID NO: 10030651 - DNA, 22 bp, Homo sapiens
gtcatttattctggtcaattca

SEQ ID NO: 10030652 - DNA, 22 bp, Homo sapiens
ggctggactttctgctgggctc

SEQ ID NO: 10030653 - DNA, 22 bp, Homo sapiens
ggagatggctggcaggtagatg

SEQ ID NO: 10030654 - DNA, 22 bp, Homo sapiens
ggatgaggtagatgaacaaggg

SEQ ID NO: 10030655 - DNA, 22 bp, Homo sapiens
ggcactgccccctgcccaggac

SEQ ID NO: 10030656 - DNA, 22 bp, Homo sapiens
ggatttgggcttgcagcagagc

SEQ ID NO: 10030657 - DNA, 22 bp, Homo sapiens
ggcagcagggtctagattgatg

SEQ ID NO: 10030658 - DNA, 17 bp, Homo sapiens
ggcagggtgctgggtat

SEQ ID NO: 10030659 - DNA, 22 bp, Homo sapiens
ttggctggtaagccaaatgaaa

SEQ ID NO: 10030660 - DNA, 22 bp, Homo sapiens
ttggctggtttcaagaaggcat

SEQ ID NO: 10030661 - DNA, 22 bp, Homo sapiens
ttgcctattgttcttacatgtt

SEQ ID NO: 10030662 - DNA, 18 bp, Homo sapiens
ttgcttcttttctctagg

SEQ ID NO: 10030663 - DNA, 22 bp, Homo sapiens
ttgcttcttagatattcctctc

SEQ ID NO: 10030664 - DNA, 22 bp, Homo sapiens
ttgcttctggaactttctgttc

SEQ ID NO: 10030665 - DNA, 23 bp, Homo sapiens
ttgcttctgtgcaattcagtact

SEQ ID NO: 10030666 - DNA, 22 bp, Homo sapiens
tttatgtcaaaactacagttgg

SEQ ID NO: 10030667 - DNA, 16 bp, Homo sapiens
tttatttactagtgtt

SEQ ID NO: 10030668 - DNA, 22 bp, Homo sapiens
tttaagatcatttgtattatcc

SEQ ID NO: 10030669 - DNA, 22 bp, Homo sapiens
tttaaccagtttacaaagaatt

SEQ ID NO: 10030670 - DNA, 22 bp, Homo sapiens
tttaacttagaagagatatcct

SEQ ID NO: 10030671 - DNA, 22 bp, Homo sapiens
ttgttcttgtctttgccttcac

SEQ ID NO: 10030672 - DNA, 22 bp, Homo sapiens
ttgttcttccatcatccctcag

SEQ ID NO: 10030673 - DNA, 22 bp, Homo sapiens
ttgtttaaaagaaatcatagaa

SEQ ID NO: 10030674 - DNA, 22 bp, Homo sapiens
tttcatcttatttgtctacatc

SEQ ID NO: 10030675 - DNA, 22 bp, Homo sapiens
tttatttataagccacttgctg

SEQ ID NO: 10030676 - DNA, 21 bp, Homo sapiens
tttatttatataggacacatg

SEQ ID NO: 10030677 - DNA, 22 bp, Homo sapiens
tttatttatccttctggattgc

SEQ ID NO: 10030678 - DNA, 22 bp, Homo sapiens
ttctctttgacattattcaggt

SEQ ID NO: 10030679 - DNA, 22 bp, Homo sapiens
ttctctttatgtatttagtggg

SEQ ID NO: 10030680 - DNA, 23 bp, Homo sapiens
ttctctttagatttacattactc

SEQ ID NO: 10030681 - DNA, 22 bp, Homo sapiens
ttctcttcccactttctgtatt

SEQ ID NO: 10030682 - DNA, 22 bp, Homo sapiens
ttctttttggatagctgatgaa

SEQ ID NO: 10030683 - DNA, 23 bp, Homo sapiens
ttgaaagattgctaagtaaaaat

SEQ ID NO: 10030684 - DNA, 22 bp, Homo sapiens
ttcttcctcacactctcaccca

SEQ ID NO: 10030685 - DNA, 19 bp, Homo sapiens
ttcttctacctctaccact

SEQ ID NO: 10030686 - DNA, 22 bp, Homo sapiens
ttctttttaaagtgtgtatgca

SEQ ID NO: 10030687 - DNA, 22 bp, Homo sapiens
ttctttcttggggaacacactc

SEQ ID NO: 10030688 - DNA, 22 bp, Homo sapiens
ttctttcttctcaggctgggta

SEQ ID NO: 10030689 - DNA, 22 bp, Homo sapiens
ttctttctttgtagtcctgaac

SEQ ID NO: 10030690 - DNA, 22 bp, Homo sapiens
ttctttgcccatgtttcctaag

SEQ ID NO: 10030691 - DNA, 22 bp, Homo sapiens
ttcttcttcaagtgctgcattc

SEQ ID NO: 10030692 - DNA, 22 bp, Homo sapiens
ttcttcttctggctgcacctgg

SEQ ID NO: 10030693 - DNA, 22 bp, Homo sapiens
ttctttcttagcaatctatggt

SEQ ID NO: 10030694 - DNA, 22 bp, Homo sapiens
ttctttctcagtgggcagatac

SEQ ID NO: 10030695 - DNA, 22 bp, Homo sapiens
ttctttctcaacatgaatgttt

SEQ ID NO: 10030696 - DNA, 22 bp, Homo sapiens
ttctttctcactctttaggaag

SEQ ID NO: 10030697 - DNA, 19 bp, Homo sapiens
ttccatctatcttcttact

SEQ ID NO: 10030698 - DNA, 22 bp, Homo sapiens
ttccatctttcagctttgttgg

SEQ ID NO: 10030699 - DNA, 22 bp, Homo sapiens
ttcagaaatcgagtttcatgtc

SEQ ID NO: 10030700 - DNA, 22 bp, Homo sapiens
ttagtgtctggctatatttaaa

SEQ ID NO: 10030701 - DNA, 22 bp, Homo sapiens
ttagtgtctcacctaaaatctg

SEQ ID NO: 10030702 - DNA, 22 bp, Homo sapiens
ttagtgtccagagtttttatta

SEQ ID NO: 10030703 - DNA, 22 bp, Homo sapiens
ttagtgtctacctttatctaaa

SEQ ID NO: 10030704 - DNA, 19 bp, Homo sapiens
tcctccttacttcctcttg

SEQ ID NO: 10030705 - DNA, 22 bp, Homo sapiens
tcctccttgttcttttgcctac

SEQ ID NO: 10030706 - DNA, 22 bp, Homo sapiens
tcctccttgtattctatttcac

SEQ ID NO: 10030707 - DNA, 18 bp, Homo sapiens
tcctcctttggccttttc

SEQ ID NO: 10030708 - DNA, 22 bp, Homo sapiens
tcctccttgttttcctgtttac

SEQ ID NO: 10030709 - DNA, 22 bp, Homo sapiens
ttatggcaagggttttaatttg

SEQ ID NO: 10030710 - DNA, 22 bp, Homo sapiens
ttattttctcctcagaaagtgg

SEQ ID NO: 10030711 - DNA, 22 bp, Homo sapiens
ttatgttatgctatttcagata

SEQ ID NO: 10030712 - DNA, 22 bp, Homo sapiens
ttatgttttatggctatatcat

SEQ ID NO: 10030713 - DNA, 22 bp, Homo sapiens
ttatttaaaagtggtaagattc

SEQ ID NO: 10030714 - DNA, 22 bp, Homo sapiens
ttatttaatgtgatctgaagag

SEQ ID NO: 10030715 - DNA, 22 bp, Homo sapiens
ttatttaattttctcactcaga

SEQ ID NO: 10030716 - DNA, 22 bp, Homo sapiens
ttatttaggaggaaactgaggt

SEQ ID NO: 10030717 - DNA, 22 bp, Homo sapiens
tttgtctataaattactactgc

SEQ ID NO: 10030718 - DNA, 19 bp, Homo sapiens
tttgtgcagcaacattaat

SEQ ID NO: 10030719 - DNA, 22 bp, Homo sapiens
tttgtgcagataggagacaatc

SEQ ID NO: 10030720 - DNA, 22 bp, Homo sapiens
tttgtgcaggtgtgtcagatcg

SEQ ID NO: 10030721 - DNA, 22 bp, Homo sapiens
ttttacacctcagatgagcaga

SEQ ID NO: 10030722 - DNA, 22 bp, Homo sapiens
ttttacttaattcttggtcatg

SEQ ID NO: 10030723 - DNA, 18 bp, Homo sapiens
ttttccttccaccttgaa

SEQ ID NO: 10030724 - DNA, 22 bp, Homo sapiens
ttttccttcatatcccttatgt

SEQ ID NO: 10030725 - DNA, 22 bp, Homo sapiens
ttttccttctagagcagatttc

SEQ ID NO: 10030726 - DNA, 22 bp, Homo sapiens
ttttccttaacagagggagaaa

SEQ ID NO: 10030727 - DNA, 22 bp, Homo sapiens
ttttccttagcttctctgcgag

SEQ ID NO: 10030728 - DNA, 22 bp, Homo sapiens
ttttccttcacctcttgagcct

SEQ ID NO: 10030729 - DNA, 22 bp, Homo sapiens
tttctatatgaggagctaaagt

SEQ ID NO: 10030730 - DNA, 22 bp, Homo sapiens
tttgtcatcccttttgaaactg

SEQ ID NO: 10030731 - DNA, 22 bp, Homo sapiens
tttggccaggtctggaaacagt

SEQ ID NO: 10030732 - DNA, 22 bp, Homo sapiens
tttggccacttcatagatcatt

SEQ ID NO: 10030733 - DNA, 22 bp, Homo sapiens
tttggccatatctatactcagc

SEQ ID NO: 10030734 - DNA, 22 bp, Homo sapiens
aggctgagaaagtgggaagatg

SEQ ID NO: 10030735 - DNA, 22 bp, Homo sapiens
aggctgagactgtgcattagtg

SEQ ID NO: 10030736 - DNA, 22 bp, Homo sapiens
aggctgagctggcccttgaaat

SEQ ID NO: 10030737 - DNA, 22 bp, Homo sapiens
aggctgaggagggatgttgctt

SEQ ID NO: 10030738 - DNA, 22 bp, Homo sapiens
acatttcttttcatctctatat

SEQ ID NO: 10030739 - DNA, 22 bp, Homo sapiens
acagtaaacaatgcagcaaatt

SEQ ID NO: 10030740 - DNA, 22 bp, Homo sapiens
acagtctacttgagcttgtata

SEQ ID NO: 10030741 - DNA, 23 bp, Homo sapiens
acagtgtctgctgcaagatatct

SEQ ID NO: 10030742 - DNA, 22 bp, Homo sapiens
acagtgtgtcctaaaggtctgg

SEQ ID NO: 10030743 - DNA, 22 bp, Homo sapiens
acaggcaggcttcggccagagc

SEQ ID NO: 10030744 - DNA, 22 bp, Homo sapiens
agtctttacatgtgttatatat

SEQ ID NO: 10030745 - DNA, 22 bp, Homo sapiens
actggaaattgagaggtcactg

SEQ ID NO: 10030746 - DNA, 21 bp, Homo sapiens
agtggggtctctgtggaggcc

SEQ ID NO: 10030747 - DNA, 22 bp, Homo sapiens
agtaaacagaaagcaagatgat

SEQ ID NO: 10030748 - DNA, 21 bp, Homo sapiens
agtatttcttcatgtccttgc

SEQ ID NO: 10030749 - DNA, 22 bp, Homo sapiens
agtcaaacaaatgtttattgag

SEQ ID NO: 10030750 - DNA, 22 bp, Homo sapiens
ataatgaatcagcatagggtga

SEQ ID NO: 10030751 - DNA, 22 bp, Homo sapiens
atacagatgttgaatgttatat

SEQ ID NO: 10030752 - DNA, 22 bp, Homo sapiens
atacagcagcccttgctttgca

SEQ ID NO: 10030753 - DNA, 22 bp, Homo sapiens
atacagctttctttcacatgag

SEQ ID NO: 10030754 - DNA, 22 bp, Homo sapiens
acttctgtatgtcctgcattca

SEQ ID NO: 10030755 - DNA, 22 bp, Homo sapiens
atacatgttgtaccatatgttt

SEQ ID NO: 10030756 - DNA, 22 bp, Homo sapiens
atacattagaatctggtactca

SEQ ID NO: 10030757 - DNA, 22 bp, Homo sapiens
actttagtaaacttatgttact

SEQ ID NO: 10030758 - DNA, 22 bp, Homo sapiens
actttagtctgtttcattatct

SEQ ID NO: 10030759 - DNA, 22 bp, Homo sapiens
atattctctgctgcttttgtgt

SEQ ID NO: 10030760 - DNA, 22 bp, Homo sapiens
actttctattcccacagagata

SEQ ID NO: 10030761 - DNA, 22 bp, Homo sapiens
actttctatggcttattatgag

SEQ ID NO: 10030762 - DNA, 22 bp, Homo sapiens
actttctaggtgctattgtgat

SEQ ID NO: 10030763 - DNA, 22 bp, Homo sapiens
actttctaggtctcagtccttt

SEQ ID NO: 10030764 - DNA, 22 bp, Homo sapiens
actttctaaaattgctagcact

SEQ ID NO: 10030765 - DNA, 22 bp, Homo sapiens
agcagctgatcaaagcacttat

SEQ ID NO: 10030766 - DNA, 22 bp, Homo sapiens
cactgcacttcagcctgggtga

SEQ ID NO: 10030767 - DNA, 22 bp, Homo sapiens
agcatacaggtctgaaacagct

SEQ ID NO: 10030768 - DNA, 22 bp, Homo sapiens
cactgctacctctgcctcccgg

SEQ ID NO: 10030769 - DNA, 22 bp, Homo sapiens
agcacagttggtaaaattgtta

SEQ ID NO: 10030770 - DNA, 22 bp, Homo sapiens
agcaaacattcagcagattggc

SEQ ID NO: 10030771 - DNA, 22 bp, Homo sapiens
caacagaggagtggcctgatcc

SEQ ID NO: 10030772 - DNA, 20 bp, Homo sapiens
caacagaggggtctggagta

SEQ ID NO: 10030773 - DNA, 22 bp, Homo sapiens
caatttttgtacttatagtact

SEQ ID NO: 10030774 - DNA, 22 bp, Homo sapiens
cagaaatattccaagtactgca

SEQ ID NO: 10030775 - DNA, 22 bp, Homo sapiens
cagaaatatcagttgaaagtgc

SEQ ID NO: 10030776 - DNA, 22 bp, Homo sapiens
cagacaggtagggacagaacat

SEQ ID NO: 10030777 - DNA, 22 bp, Homo sapiens
cagacaggaagttcagaagaaa

SEQ ID NO: 10030778 - DNA, 22 bp, Homo sapiens
cagacagggtgggtttctgggc

SEQ ID NO: 10030779 - DNA, 22 bp, Homo sapiens
cagcatcaacattctcagctct

SEQ ID NO: 10030780 - DNA, 22 bp, Homo sapiens
agacagctatcaacaactttct

SEQ ID NO: 10030781 - DNA, 22 bp, Homo sapiens
agacagcatgatacatgatgct

SEQ ID NO: 10030782 - DNA, 22 bp, Homo sapiens
agacaaaggattaatgatgatg

SEQ ID NO: 10030783 - DNA, 22 bp, Homo sapiens
atgaaatttgctgctaagttcc

SEQ ID NO: 10030784 - DNA, 22 bp, Homo sapiens
atgaaagcaacttatttgagat

SEQ ID NO: 10030785 - DNA, 22 bp, Homo sapiens
agaagtttggtcctataaactc

SEQ ID NO: 10030786 - DNA, 22 bp, Homo sapiens
atggggtgagactaggattaaa

SEQ ID NO: 10030787 - DNA, 22 bp, Homo sapiens
atggggtgcatgcagattggga

SEQ ID NO: 10030788 - DNA, 22 bp, Homo sapiens
agagaagacttacagccacagt

SEQ ID NO: 10030789 - DNA, 22 bp, Homo sapiens
agaccaaagaaaacacatctgg

SEQ ID NO: 10030790 - DNA, 22 bp, Homo sapiens
agagagttgaggaagcaacact

SEQ ID NO: 10030791 - DNA, 21 bp, Homo sapiens
agagacagagaaagtaacatt

SEQ ID NO: 10030792 - DNA, 22 bp, Homo sapiens
attgataaattgcaatggggct

SEQ ID NO: 10030793 - DNA, 22 bp, Homo sapiens
agaggcagcagtcatactacag

SEQ ID NO: 10030794 - DNA, 22 bp, Homo sapiens
attcatgtggggagccttctgt

SEQ ID NO: 10030795 - DNA, 22 bp, Homo sapiens
attcatttaggtattcacttac

SEQ ID NO: 10030796 - DNA, 22 bp, Homo sapiens
atgtttatgacctccataagga

SEQ ID NO: 10030797 - DNA, 22 bp, Homo sapiens
atgtttatgcaaacatgtgagt

SEQ ID NO: 10030798 - DNA, 22 bp, Homo sapiens
agaggagaatccgtttccttgc

SEQ ID NO: 10030799 - DNA, 18 bp, Homo sapiens
atttggcagatgatgaac

SEQ ID NO: 10030800 - DNA, 20 bp, Homo sapiens
atttggcatagtttaagcaa

SEQ ID NO: 10030801 - DNA, 22 bp, Homo sapiens
atttggcatagagtatcattct

SEQ ID NO: 10030802 - DNA, 22 bp, Homo sapiens
atttggcaaaaattagcagtag

SEQ ID NO: 10030803 - DNA, 22 bp, Homo sapiens
atttctctgcctcagcttctgc

SEQ ID NO: 10030804 - DNA, 22 bp, Homo sapiens
atttccttcagtgtttaatact

SEQ ID NO: 10030805 - DNA, 22 bp, Homo sapiens
atttcacaaagaacagatgcag

SEQ ID NO: 10030806 - DNA, 22 bp, Homo sapiens
agataaacccaacttaatgaag

SEQ ID NO: 10030807 - DNA, 22 bp, Homo sapiens
aagatttactagcataatagct

SEQ ID NO: 10030808 - DNA, 22 bp, Homo sapiens
aagatttactttctttgtaata

SEQ ID NO: 10030809 - DNA, 22 bp, Homo sapiens
aagatttaccactttattcaag

SEQ ID NO: 10030810 - DNA, 22 bp, Homo sapiens
acacagtaccccaaggctgggc

SEQ ID NO: 10030811 - DNA, 22 bp, Homo sapiens
aagcatttcaatataatattca

SEQ ID NO: 10030812 - DNA, 22 bp, Homo sapiens
aagcatttcaggtagagatatt

SEQ ID NO: 10030813 - DNA, 22 bp, Homo sapiens
aagcatttctgtttatctatcg

SEQ ID NO: 10030814 - DNA, 22 bp, Homo sapiens
aagcatttggttctgaagactc

SEQ ID NO: 10030815 - DNA, 23 bp, Homo sapiens
aagcatggttcacagttagtact

SEQ ID NO: 10030816 - DNA, 22 bp, Homo sapiens
aagcatttatagataagaattt

SEQ ID NO: 10030817 - DNA, 22 bp, Homo sapiens
aagacaggaaaagctccaggcc

SEQ ID NO: 10030818 - DNA, 22 bp, Homo sapiens
aagacaggaacatagcaaatcc

SEQ ID NO: 10030819 - DNA, 22 bp, Homo sapiens
aagaataacacttaggttttgc

SEQ ID NO: 10030820 - DNA, 23 bp, Homo sapiens
aagaataaatgacattaaaggtg

SEQ ID NO: 10030821 - DNA, 22 bp, Homo sapiens
aacttcatgtaatttaaaacag

SEQ ID NO: 10030822 - DNA, 22 bp, Homo sapiens
aagaaatcagaaaagcattcgt

SEQ ID NO: 10030823 - DNA, 22 bp, Homo sapiens
aagaaagcattagacaggcatt

SEQ ID NO: 10030824 - DNA, 22 bp, Homo sapiens
acaaagatgtttaaagcattta

SEQ ID NO: 10030825 - DNA, 22 bp, Homo sapiens
acaaagataagtcagaaagtca

SEQ ID NO: 10030826 - DNA, 22 bp, Homo sapiens
acaaagattcatttgcattatt

SEQ ID NO: 10030827 - DNA, 20 bp, Homo sapiens
acaaagactggaaaagcaag

SEQ ID NO: 10030828 - DNA, 22 bp, Homo sapiens
aacttaaacccactcatgtaga

SEQ ID NO: 10030829 - DNA, 22 bp, Homo sapiens
aactgtgtgttttgctattagt

SEQ ID NO: 10030830 - DNA, 22 bp, Homo sapiens
aactgttgcttgtaatatgtgc

SEQ ID NO: 10030831 - DNA, 22 bp, Homo sapiens
aactgttgtcatatggtcttaa

SEQ ID NO: 10030832 - DNA, 22 bp, Homo sapiens
aactgttggaggattattttgc

SEQ ID NO: 10030833 - DNA, 22 bp, Homo sapiens
aactacattgtcctttctgaag

SEQ ID NO: 10030834 - DNA, 22 bp, Homo sapiens
aactacatcaccctatttctgt

SEQ ID NO: 10030835 - DNA, 22 bp, Homo sapiens
aactacatagaaattagtattt

SEQ ID NO: 10030836 - DNA, 22 bp, Homo sapiens
aactacagctcttgtctttctg

SEQ ID NO: 10030837 - DNA, 22 bp, Homo sapiens
aaccaattaatagataggaaac

SEQ ID NO: 10030838 - DNA, 22 bp, Homo sapiens
aacatttttaagaccaagtgct

SEQ ID NO: 10030839 - DNA, 22 bp, Homo sapiens
aaattgaatttgggaaacattg

SEQ ID NO: 10030840 - DNA, 22 bp, Homo sapiens
aacaaagatgggtgggaaagag

SEQ ID NO: 10030841 - DNA, 22 bp, Homo sapiens
aacaaagaagactggttatttt

SEQ ID NO: 10030842 - DNA, 22 bp, Homo sapiens
aacaaagtagctgctgttctta

SEQ ID NO: 10030843 - DNA, 22 bp, Homo sapiens
aaattgcattcaggatgcagga

SEQ ID NO: 10030844 - DNA, 22 bp, Homo sapiens
aaattgcaggtaggtgggtgat

SEQ ID NO: 10030845 - DNA, 22 bp, Homo sapiens
aacaaagtgtacttccatactg

SEQ ID NO: 10030846 - DNA, 22 bp, Homo sapiens
aacaaatgacctgatttcttcc

SEQ ID NO: 10030847 - DNA, 22 bp, Homo sapiens
aacactaatgggagaacaaccc

SEQ ID NO: 10030848 - DNA, 22 bp, Homo sapiens
aacactgagaacaatacagagt

SEQ ID NO: 10030849 - DNA, 22 bp, Homo sapiens
aacagcagttacttttgcatca

SEQ ID NO: 10030850 - DNA, 22 bp, Homo sapiens
aaaaatacttcacttctgggtg

SEQ ID NO: 10030851 - DNA, 22 bp, Homo sapiens
aaaaacctttcccatactaaga

SEQ ID NO: 10030852 - DNA, 22 bp, Homo sapiens
aaaatctaagtagcgagtaagg

SEQ ID NO: 10030853 - DNA, 22 bp, Homo sapiens
aaaatctcattatcaggaaggg

SEQ ID NO: 10030854 - DNA, 21 bp, Homo sapiens
aaactgaggcttcaagcagtg

SEQ ID NO: 10030855 - DNA, 22 bp, Homo sapiens
aaactctttccacgattacttt

SEQ ID NO: 10030856 - DNA, 20 bp, Homo sapiens
aaattactgccacacatttc

SEQ ID NO: 10030857 - DNA, 22 bp, Homo sapiens
aaaggtagtacttctagaaggg

SEQ ID NO: 10030858 - DNA, 22 bp, Homo sapiens
aaactctcttttcttcagtagg

SEQ ID NO: 10030859 - DNA, 22 bp, Homo sapiens
aaatccatcaaatcttctagaa

SEQ ID NO: 10030860 - DNA, 22 bp, Homo sapiens
aaatagaattggaagcagagtt

SEQ ID NO: 10030861 - DNA, 22 bp, Homo sapiens
aaataacagtcagggacaacat

SEQ ID NO: 10030862 - DNA, 22 bp, Homo sapiens
aaataacttggtttcatcagag

SEQ ID NO: 10030863 - DNA, 22 bp, Homo sapiens
aaataagtagtttagtgttgtg

SEQ ID NO: 10030864 - DNA, 22 bp, Homo sapiens
aagcatgggaatcccacagggt

SEQ ID NO: 10030865 - DNA, 22 bp, Homo sapiens
aagcatggctgttctagctata

SEQ ID NO: 10030866 - DNA, 22 bp, Homo sapiens
aagcatggcctctccgctcccc

SEQ ID NO: 10030867 - DNA, 22 bp, Homo sapiens
aagcatggagcaatagaatgac

SEQ ID NO: 10030868 - DNA, 22 bp, Homo sapiens
aagcatgggaggcctggaggag

SEQ ID NO: 10030869 - DNA, 20 bp, Homo sapiens
aagcatggtcaaaacttatg

SEQ ID NO: 10030870 - DNA, 22 bp, Homo sapiens
aaatggcaggctctttgctagt

SEQ ID NO: 10030871 - DNA, 22 bp, Homo sapiens
aaatcctaataatgcactagtg

SEQ ID NO: 10030872 - DNA, 22 bp, Homo sapiens
aaatgcaggttcttgagccaag

SEQ ID NO: 10030873 - DNA, 22 bp, Homo sapiens
aaatgcatcagctcataagaga

SEQ ID NO: 10030874 - DNA, 22 bp, Homo sapiens
aaatgcagctgggcatgagagg

SEQ ID NO: 10030875 - DNA, 22 bp, Homo sapiens
aaatgcaggaaattatgctttt

SEQ ID NO: 10030876 - DNA, 23 bp, Homo sapiens
aaatgcacagtattgatttttaa

SEQ ID NO: 10030877 - DNA, 22 bp, Homo sapiens
aaagtatatttacttactgtga

SEQ ID NO: 10030878 - DNA, 22 bp, Homo sapiens
aaagtgggaacaatggagagtg

SEQ ID NO: 10030879 - DNA, 22 bp, Homo sapiens
aaagtacatgtttggccatttg

SEQ ID NO: 10030880 - DNA, 22 bp, Homo sapiens
aaagtacaaatgttctagccat

SEQ ID NO: 10030881 - DNA, 22 bp, Homo sapiens
aactaaatctggcatttagagc

SEQ ID NO: 10030882 - DNA, 22 bp, Homo sapiens
aaagctttgtaaataaacaggt

SEQ ID NO: 10030883 - DNA, 22 bp, Homo sapiens
aaagcttttcagtatgttcatg

SEQ ID NO: 10030884 - DNA, 22 bp, Homo sapiens
aaagcttttgttttcgtaactg

SEQ ID NO: 10030885 - DNA, 22 bp, Homo sapiens
aaaggtttgcatggaatttacc

SEQ ID NO: 10030886 - DNA, 22 bp, Homo sapiens
aaagatcaatagataaagctac

SEQ ID NO: 10030887 - DNA, 22 bp, Homo sapiens
aaagataatgtttccttattct

SEQ ID NO: 10030888 - DNA, 22 bp, Homo sapiens
aacagcaatagcactattcatt

SEQ ID NO: 10030889 - DNA, 22 bp, Homo sapiens
aaagctcttatgtaaacagaaa

SEQ ID NO: 10030890 - DNA, 22 bp, Homo sapiens
aacagcaagggcggggtcaaga

SEQ ID NO: 10030891 - DNA, 19 bp, Homo sapiens
aacagcaacttcctagtca

SEQ ID NO: 10030892 - DNA, 22 bp, Homo sapiens
aaagctttgctggaaggaagag

SEQ ID NO: 10030893 - DNA, 22 bp, Homo sapiens
aaagctcttttccaagtattga

SEQ ID NO: 10030894 - DNA, 22 bp, Homo sapiens
aatgagcaaatgaagacgctgt

SEQ ID NO: 10030895 - DNA, 22 bp, Homo sapiens
agaaatactgcctaagactgta

SEQ ID NO: 10030896 - DNA, 20 bp, Homo sapiens
agaaatactttggtataatg

SEQ ID NO: 10030897 - DNA, 18 bp, Homo sapiens
agaaataccagtattgga

SEQ ID NO: 10030898 - DNA, 20 bp, Homo sapiens
agaaatacatgcatgcatga

SEQ ID NO: 10030899 - DNA, 22 bp, Homo sapiens
agaaatacaaagtactaagata

SEQ ID NO: 10030900 - DNA, 22 bp, Homo sapiens
aatcaagaataagttgtaaagc

SEQ ID NO: 10030901 - DNA, 19 bp, Homo sapiens
acttcttttcaacacagga

SEQ ID NO: 10030902 - DNA, 22 bp, Homo sapiens
acttgaaacatctttaaatgta

SEQ ID NO: 10030903 - DNA, 22 bp, Homo sapiens
acttcttttcaaatcatgcaaa

SEQ ID NO: 10030904 - DNA, 21 bp, Homo sapiens
aatacagaaatgagtagttgc

SEQ ID NO: 10030905 - DNA, 22 bp, Homo sapiens
aagtttactgtccctggaaact

SEQ ID NO: 10030906 - DNA, 22 bp, Homo sapiens
aagtttagtattagggaaaagt

SEQ ID NO: 10030907 - DNA, 22 bp, Homo sapiens
aataatagttgcaaagtgttta

SEQ ID NO: 10030908 - DNA, 22 bp, Homo sapiens
aataatgtgatagataagggaa

SEQ ID NO: 10030909 - DNA, 22 bp, Homo sapiens
aagtcagagcaactgagacatt

SEQ ID NO: 10030910 - DNA, 22 bp, Homo sapiens
aagtcagagatgccaaagatta

SEQ ID NO: 10030911 - DNA, 22 bp, Homo sapiens
aagtcagaaaacagagcaatta

SEQ ID NO: 10030912 - DNA, 22 bp, Homo sapiens
aagtcagaccttgttgatagct

SEQ ID NO: 10030913 - DNA, 22 bp, Homo sapiens
acagtacagctgaaactttagt

SEQ ID NO: 10030914 - DNA, 22 bp, Homo sapiens
aagcttgtcagtgcaattttac

SEQ ID NO: 10030915 - DNA, 22 bp, Homo sapiens
aagctttaaggaattttatgga

SEQ ID NO: 10030916 - DNA, 22 bp, Homo sapiens
aaggcagggaaagtggattagg

SEQ ID NO: 10030917 - DNA, 22 bp, Homo sapiens
aaggcaggatgggaaaagattt

SEQ ID NO: 10030918 - DNA, 22 bp, Homo sapiens
acagtataactccatgccaccc

SEQ ID NO: 10030919 - DNA, 22 bp, Homo sapiens
aagggagaaaacttgtggctta

SEQ ID NO: 10030920 - DNA, 22 bp, Homo sapiens
aagtaacagcatcaagtctcaa

SEQ ID NO: 10030921 - DNA, 22 bp, Homo sapiens
aagtacgtgcctccacttgtgt

SEQ ID NO: 10030922 - DNA, 22 bp, Homo sapiens
aagtacagccttcattctcatg

SEQ ID NO: 10030923 - DNA, 22 bp, Homo sapiens
acagataaaagttgtttaaaat

SEQ ID NO: 10030924 - DNA, 22 bp, Homo sapiens
acagagcataatgtctagcaca

SEQ ID NO: 10030925 - DNA, 22 bp, Homo sapiens
acagcaaaagacaagaacttaa

SEQ ID NO: 10030926 - DNA, 22 bp, Homo sapiens
acagcaaaggacgaacactctg

SEQ ID NO: 10030927 - DNA, 22 bp, Homo sapiens
acagcaaatggttttctgtctg

SEQ ID NO: 10030928 - DNA, 21 bp, Homo sapiens
acagcaagccttcacatgagt

SEQ ID NO: 10030929 - DNA, 22 bp, Homo sapiens
acagaaattctgggacagaaaa

SEQ ID NO: 10030930 - DNA, 22 bp, Homo sapiens
acagaaattgctaatagctcat

SEQ ID NO: 10030931 - DNA, 22 bp, Homo sapiens
agcagtgtgaaatgatttaagg

SEQ ID NO: 10030932 - DNA, 19 bp, Homo sapiens
agcagtgtagaagtgttcc

SEQ ID NO: 10030933 - DNA, 22 bp, Homo sapiens
acagaaagataggcacaaggtc

SEQ ID NO: 10030934 - DNA, 20 bp, Homo sapiens
agcagtgtttcttgactcta

SEQ ID NO: 10030935 - DNA, 22 bp, Homo sapiens
acaccaaagtagaattaatgta

SEQ ID NO: 10030936 - DNA, 19 bp, Homo sapiens
acaaatgatgttgcactga

SEQ ID NO: 10030937 - DNA, 22 bp, Homo sapiens
acaaatgattttccaagccagt

SEQ ID NO: 10030938 - DNA, 22 bp, Homo sapiens
acaaactaaaattctttattga

SEQ ID NO: 10030939 - DNA, 22 bp, Homo sapiens
agatggggctcagtgtggaggc

SEQ ID NO: 10030940 - DNA, 22 bp, Homo sapiens
agatggggcagaatggagccat

SEQ ID NO: 10030941 - DNA, 22 bp, Homo sapiens
acaagtttatttgattagaaca

SEQ ID NO: 10030942 - DNA, 22 bp, Homo sapiens
acaagttaccaaaaaagattca

SEQ ID NO: 10030943 - DNA, 22 bp, Homo sapiens
agatggggctgaaagttccaat

SEQ ID NO: 10030944 - DNA, 22 bp, Homo sapiens
acaatgtagaggctgaaagcaa

SEQ ID NO: 10030945 - DNA, 22 bp, Homo sapiens
aattagttcaatggatgataga

SEQ ID NO: 10030946 - DNA, 22 bp, Homo sapiens
agacagggtgatcgcttgagcc

SEQ ID NO: 10030947 - DNA, 19 bp, Homo sapiens
ctttgcttgtttctgtgtc

SEQ ID NO: 10030948 - DNA, 22 bp, Homo sapiens
ctttttactctgttgtctcagc

SEQ ID NO: 10030949 - DNA, 22 bp, Homo sapiens
ctttttatagctatgtcctatg

SEQ ID NO: 10030950 - DNA, 22 bp, Homo sapiens
ctttttatagctatgtcctatg

SEQ ID NO: 10030951 - DNA, 22 bp, Homo sapiens
ctttattctgcaaattgccttg

SEQ ID NO: 10030952 - DNA, 22 bp, Homo sapiens
ctttacttcagcaagctttcct

SEQ ID NO: 10030953 - DNA, 22 bp, Homo sapiens
atctttctatggtactttctcc

SEQ ID NO: 10030954 - DNA, 22 bp, Homo sapiens
atctttctccatatacatcttt

SEQ ID NO: 10030955 - DNA, 22 bp, Homo sapiens
atctttctatttctaaaaacta

SEQ ID NO: 10030956 - DNA, 22 bp, Homo sapiens
atctttcttatttgaagaaaga

SEQ ID NO: 10030957 - DNA, 22 bp, Homo sapiens
atctttctctgcactatacaat

SEQ ID NO: 10030958 - DNA, 22 bp, Homo sapiens
gaagcctgtggataggggcatc

SEQ ID NO: 10030959 - DNA, 22 bp, Homo sapiens
atgccactgcactccagcctgg

SEQ ID NO: 10030960 - DNA, 22 bp, Homo sapiens
gaagtacaaaggacatggaaac

SEQ ID NO: 10030961 - DNA, 22 bp, Homo sapiens
gagacaggatttaaccaaagct

SEQ ID NO: 10030962 - DNA, 22 bp, Homo sapiens
gagacaggccaggtggtactta

SEQ ID NO: 10030963 - DNA, 22 bp, Homo sapiens
gagacaggcagctagtgggtca

SEQ ID NO: 10030964 - DNA, 22 bp, Homo sapiens
atgtcacttttgagactaggtt

SEQ ID NO: 10030965 - DNA, 19 bp, Homo sapiens
atgtcactcatgttccctg

SEQ ID NO: 10030966 - DNA, 22 bp, Homo sapiens
atgtcacttttctccctgctgg

SEQ ID NO: 10030967 - DNA, 22 bp, Homo sapiens
atgtcactgtgaggcagctgtc

SEQ ID NO: 10030968 - DNA, 22 bp, Homo sapiens
atgtcactccagggacacaggt

SEQ ID NO: 10030969 - DNA, 22 bp, Homo sapiens
atttcttcaggttcttctagga

SEQ ID NO: 10030970 - DNA, 22 bp, Homo sapiens
gccatcatcaagaatgtacagc

SEQ ID NO: 10030971 - DNA, 22 bp, Homo sapiens
atttagtttaggaaaagtaggt

SEQ ID NO: 10030972 - DNA, 22 bp, Homo sapiens
attttcatcatgggtttaacat

SEQ ID NO: 10030973 - DNA, 22 bp, Homo sapiens
attttcctctggtttccccaga

SEQ ID NO: 10030974 - DNA, 22 bp, Homo sapiens
attttcctccatgtgagcagtt

SEQ ID NO: 10030975 - DNA, 22 bp, Homo sapiens
atttcttccattgcctcttcaa

SEQ ID NO: 10030976 - DNA, 22 bp, Homo sapiens
attcacaaaatgatatagatac

SEQ ID NO: 10030977 - DNA, 22 bp, Homo sapiens
attcatttgctattgtgtatgg

SEQ ID NO: 10030978 - DNA, 22 bp, Homo sapiens
attgcactccagcctgggggac

SEQ ID NO: 10030979 - DNA, 22 bp, Homo sapiens
attgcactccagcctgggtgac

SEQ ID NO: 10030980 - DNA, 22 bp, Homo sapiens
attcttttgtcctagcttgata

SEQ ID NO: 10030981 - DNA, 22 bp, Homo sapiens
attcttttcccaactgctttaa

SEQ ID NO: 10030982 - DNA, 22 bp, Homo sapiens
attataggcttgagccaccgtg

SEQ ID NO: 10030983 - DNA, 22 bp, Homo sapiens
gagtggggcccactgctgggtg

SEQ ID NO: 10030984 - DNA, 22 bp, Homo sapiens
gattctgagctggtgttttacg

SEQ ID NO: 10030985 - DNA, 22 bp, Homo sapiens
cactgcactccagcctgggtga

SEQ ID NO: 10030986 - DNA, 22 bp, Homo sapiens
cactgcactccagcctgggaga

SEQ ID NO: 10030987 - DNA, 22 bp, Homo sapiens
cactgcactccagcctgggtca

SEQ ID NO: 10030988 - DNA, 21 bp, Homo sapiens
cactccacttagaacagggtt

SEQ ID NO: 10030989 - DNA, 22 bp, Homo sapiens
ggcagatgctggcttctgctgt

SEQ ID NO: 10030990 - DNA, 22 bp, Homo sapiens
cacagggttgttctgaggattc

SEQ ID NO: 10030991 - DNA, 22 bp, Homo sapiens
cacaaatggttgtagacattaa

SEQ ID NO: 10030992 - DNA, 22 bp, Homo sapiens
ggacattatagcttccagattg

SEQ ID NO: 10030993 - DNA, 22 bp, Homo sapiens
cacaaatgactgaaacgactgt

SEQ ID NO: 10030994 - DNA, 22 bp, Homo sapiens
caagctctgggatgcagacatc

SEQ ID NO: 10030995 - DNA, 22 bp, Homo sapiens
caactttagcaatgttagtata

SEQ ID NO: 10030996 - DNA, 22 bp, Homo sapiens
caagaaattctgttcagatagc

SEQ ID NO: 10030997 - DNA, 22 bp, Homo sapiens
caaagtatgaaccagtttctct

SEQ ID NO: 10030998 - DNA, 22 bp, Homo sapiens
caaagtgagttataaacatctt

SEQ ID NO: 10030999 - DNA, 20 bp, Homo sapiens
gggtgtgggcccggccaggc

SEQ ID NO: 10031000 - DNA, 22 bp, Homo sapiens
cagacacacaagcaatctaagt

SEQ ID NO: 10031001 - DNA, 22 bp, Homo sapiens
cagcaaaagccagcataagctc

SEQ ID NO: 10031002 - DNA, 20 bp, Homo sapiens
cagattctccactaacatat

SEQ ID NO: 10031003 - DNA, 22 bp, Homo sapiens
cagcaaagcaggctcctagaac

SEQ ID NO: 10031004 - DNA, 22 bp, Homo sapiens
gtattttacttacgcatgactt

SEQ ID NO: 10031005 - DNA, 22 bp, Homo sapiens
gtcacagcctcaatcccatctg

SEQ ID NO: 10031006 - DNA, 22 bp, Homo sapiens
ccagagaaaggtttgattcatt

SEQ ID NO: 10031007 - DNA, 22 bp, Homo sapiens
ccagcagagggcgcttcacacc

SEQ ID NO: 10031008 - DNA, 22 bp, Homo sapiens
ccagcagagctcaaacttcctg

SEQ ID NO: 10031009 - DNA, 19 bp, Homo sapiens
ccagcagaagccactcctg

SEQ ID NO: 10031010 - DNA, 22 bp, Homo sapiens
ccagggtggaggctggatggag

SEQ ID NO: 10031011 - DNA, 20 bp, Homo sapiens
aggctgagggtgattgtgtc

SEQ ID NO: 10031012 - DNA, 22 bp, Homo sapiens
aggctgaggtaggaggatcgct

SEQ ID NO: 10031013 - DNA, 22 bp, Homo sapiens
aggctgaggggcgagggaccct

SEQ ID NO: 10031014 - DNA, 22 bp, Homo sapiens
aggctgagtcaagttagggtga

SEQ ID NO: 10031015 - DNA, 22 bp, Homo sapiens
aggctgaggtgtgctgtgatcg

SEQ ID NO: 10031016 - DNA, 22 bp, Homo sapiens
aggctggctggcaggggacaca

SEQ ID NO: 10031017 - DNA, 22 bp, Homo sapiens
agggccagagtctgtgtagata

SEQ ID NO: 10031018 - DNA, 17 bp, Homo sapiens
aggggagagtgggaaga

SEQ ID NO: 10031019 - DNA, 22 bp, Homo sapiens
catggattcgggaaggtcagta

SEQ ID NO: 10031020 - DNA, 22 bp, Homo sapiens
ccaagataagagacaagattta

SEQ ID NO: 10031021 - DNA, 19 bp, Homo sapiens
aggcagcaggccagggatg

SEQ ID NO: 10031022 - DNA, 22 bp, Homo sapiens
cattaaacaaccttgaatcaat

SEQ ID NO: 10031023 - DNA, 18 bp, Homo sapiens
cagtggtgctgggatgtg

SEQ ID NO: 10031024 - DNA, 22 bp, Homo sapiens
catatttatagatctggcattt

SEQ ID NO: 10031025 - DNA, 22 bp, Homo sapiens
catattctgttggtcacataga

SEQ ID NO: 10031026 - DNA, 22 bp, Homo sapiens
ctacagaaacctttttcataca

SEQ ID NO: 10031027 - DNA, 22 bp, Homo sapiens
agtcagtgtcaacaggaagtag

SEQ ID NO: 10031028 - DNA, 22 bp, Homo sapiens
agggtgcgttctatgagaatct

SEQ ID NO: 10031029 - DNA, 20 bp, Homo sapiens
agtggggagtcaggagtgcc

SEQ ID NO: 10031030 - DNA, 22 bp, Homo sapiens
ctgaagcaggcctacttcattg

SEQ ID NO: 10031031 - DNA, 22 bp, Homo sapiens
ctgagaaaggacctcaaacagg

SEQ ID NO: 10031032 - DNA, 23 bp, Homo sapiens
ctgaagcaatatcccctcacttc

SEQ ID NO: 10031033 - DNA, 22 bp, Homo sapiens
agtggctggtctaaggtcacag

SEQ ID NO: 10031034 - DNA, 22 bp, Homo sapiens
agtggctggcataggaacagac

SEQ ID NO: 10031035 - DNA, 19 bp, Homo sapiens
ctgtgtcacatttatgaaa

SEQ ID NO: 10031036 - DNA, 22 bp, Homo sapiens
ctgtttattacgtaattaatat

SEQ ID NO: 10031037 - DNA, 22 bp, Homo sapiens
cttcattaaccaaaatgcaata

SEQ ID NO: 10031038 - DNA, 22 bp, Homo sapiens
cttcagaatgggactgtgtttg

SEQ ID NO: 10031039 - DNA, 22 bp, Homo sapiens
atccttctacctaggactattt

SEQ ID NO: 10031040 - DNA, 22 bp, Homo sapiens
atccttctaagagggacgtatg

SEQ ID NO: 10031041 - DNA, 22 bp, Homo sapiens
atccttcttctgctagtgtcta

SEQ ID NO: 10031042 - DNA, 22 bp, Homo sapiens
atccttctccagtcgtattttt

SEQ ID NO: 10031043 - DNA, 22 bp, Homo sapiens
atccttctccaaaactggctcc

SEQ ID NO: 10031044 - DNA, 22 bp, Homo sapiens
atccttcttcaaagagggaaaa

SEQ ID NO: 10031045 - DNA, 17 bp, Homo sapiens
atccttctgttctttct

SEQ ID NO: 10031046 - DNA, 22 bp, Homo sapiens
ctgggccatgggccagcgaggc

SEQ ID NO: 10031047 - DNA, 22 bp, Homo sapiens
atattttcactgaaccaaagta

SEQ ID NO: 10031048 - DNA, 22 bp, Homo sapiens
agtttatttttgataagtcttg

SEQ ID NO: 10031049 - DNA, 17 bp, Homo sapiens
agtttatttagccttct

SEQ ID NO: 10031050 - DNA, 21 bp, Homo sapiens
agttttctgagttataaaata

SEQ ID NO: 10031051 - DNA, 22 bp, Homo sapiens
atacatgactcacacattctgc

SEQ ID NO: 10031052 - DNA, 22 bp, Homo sapiens
atacatgacagcatagcatcct

SEQ ID NO: 10031053 - DNA, 22 bp, Homo sapiens
atacatgaggctcatttatgtc

SEQ ID NO: 10031054 - DNA, 21 bp, Homo sapiens
atacagaaggcagactctctc

SEQ ID NO: 10031055 - DNA, 22 bp, Homo sapiens
atacagaagaactatagccact

SEQ ID NO: 10031056 - DNA, 22 bp, Homo sapiens
atacagaagacccctccgtcat

SEQ ID NO: 10031057 - DNA, 21 bp, Homo sapiens
atacagaaggtggcaaagtac

SEQ ID NO: 10031058 - DNA, 22 bp, Homo sapiens
ataattctccaatttttgttgt

SEQ ID NO: 10031059 - DNA, 22 bp, Homo sapiens
atacagaactctcagttgtata

SEQ ID NO: 10031060 - DNA, 22 bp, Homo sapiens
atagacacatgttattatactt

SEQ ID NO: 10031061 - DNA, 22 bp, Homo sapiens
cagttaaagtgcttatcacaga

SEQ ID NO: 10031062 - DNA, 22 bp, Homo sapiens
cagtttaacctatccattatgt

SEQ ID NO: 10031063 - DNA, 22 bp, Homo sapiens
tcagcagatgatttccatacaa

SEQ ID NO: 10031064 - DNA, 22 bp, Homo sapiens
tcagagaacacagaggtgatgt

SEQ ID NO: 10031065 - DNA, 22 bp, Homo sapiens
cagtgtctcccccaggttctgt

SEQ ID NO: 10031066 - DNA, 21 bp, Homo sapiens
tatttctttgactctctccct

SEQ ID NO: 10031067 - DNA, 22 bp, Homo sapiens
tcacaaatattttaacagtagg

SEQ ID NO: 10031068 - DNA, 22 bp, Homo sapiens
cagtgaagtttaaagtgtagat

SEQ ID NO: 10031069 - DNA, 22 bp, Homo sapiens
cagtgaagttctactgaatggt

SEQ ID NO: 10031070 - DNA, 22 bp, Homo sapiens
cagtgaagtgtggacgtcacca

SEQ ID NO: 10031071 - DNA, 22 bp, Homo sapiens
caggctggagtgcagtggtgcc

SEQ ID NO: 10031072 - DNA, 22 bp, Homo sapiens
caggctggagtgagtgtagtgg

SEQ ID NO: 10031073 - DNA, 19 bp, Homo sapiens
tagataagaggtgatagga

SEQ ID NO: 10031074 - DNA, 22 bp, Homo sapiens
tagaccaagacaggaagtaaca

SEQ ID NO: 10031075 - DNA, 22 bp, Homo sapiens
tagctttaagatgagatgtgga

SEQ ID NO: 10031076 - DNA, 22 bp, Homo sapiens
cattatattacagcactgttaa

SEQ ID NO: 10031077 - DNA, 22 bp, Homo sapiens
tctcaaatttgttagataaaat

SEQ ID NO: 10031078 - DNA, 22 bp, Homo sapiens
tctcaagcttgttggtatgttt

SEQ ID NO: 10031079 - DNA, 22 bp, Homo sapiens
ccacatttggagaagatacttt

SEQ ID NO: 10031080 - DNA, 22 bp, Homo sapiens
tctctgcaactacatcttaggg

SEQ ID NO: 10031081 - DNA, 22 bp, Homo sapiens
tctctgcatccccagggctctc

SEQ ID NO: 10031082 - DNA, 23 bp, Homo sapiens
tctctgcatgtcctgagcacatc

SEQ ID NO: 10031083 - DNA, 22 bp, Homo sapiens
ccagcagagtatcaatgtattt

SEQ ID NO: 10031084 - DNA, 22 bp, Homo sapiens
tgtcaagctctggacatttgag

SEQ ID NO: 10031085 - DNA, 22 bp, Homo sapiens
tgtcaagagtgcacacatctgc

SEQ ID NO: 10031086 - DNA, 22 bp, Homo sapiens
ccggctactcgggaggctgacg

SEQ ID NO: 10031087 - DNA, 22 bp, Homo sapiens
tgattagctgaagaatatgctg

SEQ ID NO: 10031088 - DNA, 22 bp, Homo sapiens
tgcagcatgcaggagaggctct

SEQ ID NO: 10031089 - DNA, 22 bp, Homo sapiens
tgcagcattgaaatagctaggc

SEQ ID NO: 10031090 - DNA, 22 bp, Homo sapiens
tgacatttttgtacaaagtcag

SEQ ID NO: 10031091 - DNA, 22 bp, Homo sapiens
ccagggtggggtccaggaacca

SEQ ID NO: 10031092 - DNA, 22 bp, Homo sapiens
ccagggtgggaggctgaaggcg

SEQ ID NO: 10031093 - DNA, 22 bp, Homo sapiens
tctttatttaagtctgttgtaa

SEQ ID NO: 10031094 - DNA, 22 bp, Homo sapiens
tctttatttaagtctgttgtaa

SEQ ID NO: 10031095 - DNA, 22 bp, Homo sapiens
tctttattttatgcttgtgcaa

SEQ ID NO: 10031096 - DNA, 22 bp, Homo sapiens
tctttcaaagctgtagtagatt

SEQ ID NO: 10031097 - DNA, 22 bp, Homo sapiens
tgaaagcatatgctaaagacca

SEQ ID NO: 10031098 - DNA, 22 bp, Homo sapiens
tgaagctttcctgtggtcagga

SEQ ID NO: 10031099 - DNA, 18 bp, Homo sapiens
ctctctttccactctttg

SEQ ID NO: 10031100 - DNA, 22 bp, Homo sapiens
tttctacagtactgatttcata

SEQ ID NO: 10031101 - DNA, 22 bp, Homo sapiens
tttctacaacacttctgaatct

SEQ ID NO: 10031102 - DNA, 22 bp, Homo sapiens
tttatggcacacaaatatcaaa

SEQ ID NO: 10031103 - DNA, 19 bp, Homo sapiens
tttgaaagagttttattgg

SEQ ID NO: 10031104 - DNA, 22 bp, Homo sapiens
ctgagccaaaaagcagagcttg

SEQ ID NO: 10031105 - DNA, 22 bp, Homo sapiens
ctggagcaggtttaggagtccc

SEQ ID NO: 10031106 - DNA, 22 bp, Homo sapiens
ctggagccggaccagggacggt

SEQ ID NO: 10031107 - DNA, 22 bp, Homo sapiens
cctttttctgagttgtagcttc

SEQ ID NO: 10031108 - DNA, 22 bp, Homo sapiens
ccttttctaggatgctttatag

SEQ ID NO: 10031109 - DNA, 22 bp, Homo sapiens
cggagtcttgctatgttgccca

SEQ ID NO: 10031110 - DNA, 22 bp, Homo sapiens
ttaaatttctacgtgatccagg

SEQ ID NO: 10031111 - DNA, 22 bp, Homo sapiens
ttaagcaacacacattaattat

SEQ ID NO: 10031112 - DNA, 22 bp, Homo sapiens
ttatatttctggtagccttcag

SEQ ID NO: 10031113 - DNA, 22 bp, Homo sapiens
ttatcattgtcgcagtctaatt

SEQ ID NO: 10031114 - DNA, 22 bp, Homo sapiens
ttctttctggggtccttcggct

SEQ ID NO: 10031115 - DNA, 22 bp, Homo sapiens
ttctttctgtcatggtgtactg

SEQ ID NO: 10031116 - DNA, 22 bp, Homo sapiens
ttctttctctactagcagagct

SEQ ID NO: 10031117 - DNA, 22 bp, Homo sapiens
ttctttctctccacaaggcttg

SEQ ID NO: 10031118 - DNA, 22 bp, Homo sapiens
ttctttctctgtaaaaggaaaa

SEQ ID NO: 10031119 - DNA, 21 bp, Homo sapiens
ttctttctgaatctgaagtat

SEQ ID NO: 10031120 - DNA, 22 bp, Homo sapiens
ttctttctgggaagagttcaga

SEQ ID NO: 10031121 - DNA, 22 bp, Homo sapiens
ttctttctgaatacagttgagt

SEQ ID NO: 10031122 - DNA, 22 bp, Homo sapiens
cgtgtacagtctatcttttttc

SEQ ID NO: 10031123 - DNA, 22 bp, Homo sapiens
cgttcttttcatatttacatgg

SEQ ID NO: 10031124 - DNA, 22 bp, Homo sapiens
ctagaaagatacttaaatcaag

SEQ ID NO: 10031125 - DNA, 22 bp, Homo sapiens
ttctatttccagtccttcagag

SEQ ID NO: 10031126 - DNA, 22 bp, Homo sapiens
ctgtgaacaatagcagcatctt

SEQ ID NO: 10031127 - DNA, 22 bp, Homo sapiens
ctgtgagggcagggaccagagg

SEQ ID NO: 10031128 - DNA, 22 bp, Homo sapiens
ctggagccttcaccaggggaaa

SEQ ID NO: 10031129 - DNA, 22 bp, Homo sapiens
gaaactgtgaggatcttaactt

SEQ ID NO: 10031130 - DNA, 22 bp, Homo sapiens
gaaactgtgatcgtgttctggg

SEQ ID NO: 10031131 - DNA, 22 bp, Homo sapiens
gaaactgtatgtagtttttggg

SEQ ID NO: 10031132 - DNA, 22 bp, Homo sapiens
cttttttaaggtagctcctcct

SEQ ID NO: 10031133 - DNA, 22 bp, Homo sapiens
ctttttctaatcataattgtct

SEQ ID NO: 10031134 - DNA, 20 bp, Homo sapiens
ctttttctccagctctgagc

SEQ ID NO: 10031135 - DNA, 22 bp, Homo sapiens
ctttttctgatgttccatgatt

SEQ ID NO: 10031136 - DNA, 22 bp, Homo sapiens
ctttttcttctaggtgtgcctg

SEQ ID NO: 10031137 - DNA, 22 bp, Homo sapiens
ctttggcacagtgtttactagc

SEQ ID NO: 10031138 - DNA, 22 bp, Homo sapiens
gaaagacatagttgcaagatgg

SEQ ID NO: 10031139 - DNA, 22 bp, Homo sapiens
gaaatacagaaagggctgaatg

SEQ ID NO: 10031140 - DNA, 22 bp, Homo sapiens
gaaattcaccttttacgtggcc

SEQ ID NO: 10031141 - DNA, 22 bp, Homo sapiens
gaaattcaaataagatatgtag

SEQ ID NO: 10031142 - DNA, 22 bp, Homo sapiens
gaaattcaggacaaagactctt

SEQ ID NO: 10031143 - DNA, 22 bp, Homo sapiens
ctttccttaataagcaggtata

SEQ ID NO: 10031144 - DNA, 22 bp, Homo sapiens
ctttccttctcgtggttctcac

SEQ ID NO: 10031145 - DNA, 23 bp, Homo sapiens
ctttcctttctttgacacccagc

SEQ ID NO: 10031146 - DNA, 22 bp, Homo sapiens
cttgctttatctggtttctcat

SEQ ID NO: 10031147 - DNA, 22 bp, Homo sapiens
cttgcttctgctgcactatcct

SEQ ID NO: 10031148 - DNA, 22 bp, Homo sapiens
cttcttctctacatcctttgat

SEQ ID NO: 10031149 - DNA, 22 bp, Homo sapiens
gagaagaacttgggcaaagtca

SEQ ID NO: 10031150 - DNA, 22 bp, Homo sapiens
gaattacataataaaatgagag

SEQ ID NO: 10031151 - DNA, 22 bp, Homo sapiens
gacaaagagaagtaacagtacc

SEQ ID NO: 10031152 - DNA, 22 bp, Homo sapiens
gaatttaaggaccaagcatttt

SEQ ID NO: 10031153 - DNA, 22 bp, Homo sapiens
gaccttgtgatccacccgcctt

SEQ ID NO: 10031154 - DNA, 22 bp, Homo sapiens
gagtaaaagatgaggcagtaga

SEQ ID NO: 10031155 - DNA, 22 bp, Homo sapiens
ggacaggggcgtggggattgtt

SEQ ID NO: 10031156 - DNA, 22 bp, Homo sapiens
gctctgtatcttacaacagggt

SEQ ID NO: 10031157 - DNA, 22 bp, Homo sapiens
gcaatacagaagagtggcaagg

SEQ ID NO: 10031158 - DNA, 22 bp, Homo sapiens
gccacttgtgtaagcgcctgtc

SEQ ID NO: 10031159 - DNA, 21 bp, Homo sapiens
gcagtttatgtaatatgcact

SEQ ID NO: 10031160 - DNA, 22 bp, Homo sapiens
gcatttatttctttactgcatc

SEQ ID NO: 10031161 - DNA, 22 bp, Homo sapiens
gcatttaaatttgaacttcaga

SEQ ID NO: 10031162 - DNA, 22 bp, Homo sapiens
ggtggtggagccagctgggagt

SEQ ID NO: 10031163 - DNA, 22 bp, Homo sapiens
ggggtgggagtgccatccttga

SEQ ID NO: 10031164 - DNA, 20 bp, Homo sapiens
gggtgaggatggagaatttg

SEQ ID NO: 10031165 - DNA, 22 bp, Homo sapiens
gtgcagcaaagtttgagatata

SEQ ID NO: 10031166 - DNA, 22 bp, Homo sapiens
gtctatatattgcttgaataat

SEQ ID NO: 10031167 - DNA, 22 bp, Homo sapiens
gtgagcatatatgtaatcgttt

SEQ ID NO: 10031168 - DNA, 22 bp, Homo sapiens
gtgagcatgtagtaatctggag

SEQ ID NO: 10031169 - DNA, 22 bp, Homo sapiens
gtctttttattatagagtggag

SEQ ID NO: 10031170 - DNA, 22 bp, Homo sapiens
gtcttttttacaccttacatca

SEQ ID NO: 10031171 - DNA, 22 bp, Homo sapiens
gtctttctatgatgaactgttg

SEQ ID NO: 10031172 - DNA, 21 bp, Homo sapiens
gtctttctacctctatgtggc

SEQ ID NO: 10031173 - DNA, 22 bp, Homo sapiens
gtcagaaaacttccctttgagt

SEQ ID NO: 10031174 - DNA, 22 bp, Homo sapiens
gtcagaaaccagtcaaacaaga

SEQ ID NO: 10031175 - DNA, 21 bp, Homo sapiens
gtcaaactggggtacatttgt

SEQ ID NO: 10031176 - DNA, 22 bp, Homo sapiens
ggaggatgagctacgaggagct

SEQ ID NO: 10031177 - DNA, 22 bp, Homo sapiens
ggcagatggggtgacaagagag

SEQ ID NO: 10031178 - DNA, 22 bp, Homo sapiens
ggcagcaagtggtgggagactt

SEQ ID NO: 10031179 - DNA, 22 bp, Homo sapiens
ggctcactgcaacttccgcctc

SEQ ID NO: 10031180 - DNA, 22 bp, Homo sapiens
ggccagcagtatatagctaatt

SEQ ID NO: 10031181 - DNA, 22 bp, Homo sapiens
ggccagcagtcacagggtcaga

SEQ ID NO: 10031182 - DNA, 22 bp, Homo sapiens
ggccagcagacctcagggactc

SEQ ID NO: 10031183 - DNA, 21 bp, Homo sapiens
ggccagcagcgtccactgtgg

SEQ ID NO: 10031184 - DNA, 22 bp, Homo sapiens
tacatgcattggatggcaatag

SEQ ID NO: 10031185 - DNA, 22 bp, Homo sapiens
tacatgaatgtttcaatattgt

SEQ ID NO: 10031186 - DNA, 22 bp, Homo sapiens
tacatgcaatgaggattctagt

SEQ ID NO: 10031187 - DNA, 20 bp, Homo sapiens
tacagacatgacaataatgg

SEQ ID NO: 10031188 - DNA, 22 bp, Homo sapiens
tacagacagtttttcagatatt

SEQ ID NO: 10031189 - DNA, 22 bp, Homo sapiens
tacagagatactctagatcaaa

SEQ ID NO: 10031190 - DNA, 22 bp, Homo sapiens
tacttaaaaattatcaaagtgg

SEQ ID NO: 10031191 - DNA, 22 bp, Homo sapiens
tacttaaaactgatagaatctc

SEQ ID NO: 10031192 - DNA, 22 bp, Homo sapiens
tacttaaataattgctgctatt

SEQ ID NO: 10031193 - DNA, 22 bp, Homo sapiens
tactacatacagaatttagaga

SEQ ID NO: 10031194 - DNA, 22 bp, Homo sapiens
tacaaccatagacatatactag

SEQ ID NO: 10031195 - DNA, 22 bp, Homo sapiens
tacaagaaggaaaactagcaat

SEQ ID NO: 10031196 - DNA, 22 bp, Homo sapiens
tacacatacattgcttacaagg

SEQ ID NO: 10031197 - DNA, 22 bp, Homo sapiens
taattcagtgttcacttggaca

SEQ ID NO: 10031198 - DNA, 22 bp, Homo sapiens
taattattgtctgaagagttat

SEQ ID NO: 10031199 - DNA, 22 bp, Homo sapiens
taattcctagaaattattctca

SEQ ID NO: 10031200 - DNA, 22 bp, Homo sapiens
taattctagattgacattttga

SEQ ID NO: 10031201 - DNA, 22 bp, Homo sapiens
taatctagaacatatgagagca

SEQ ID NO: 10031202 - DNA, 22 bp, Homo sapiens
taatctctctaagtttccattt

SEQ ID NO: 10031203 - DNA, 22 bp, Homo sapiens
taatctagtcccacatggaatt

SEQ ID NO: 10031204 - DNA, 22 bp, Homo sapiens
taatataccaaactgtaatttt

SEQ ID NO: 10031205 - DNA, 20 bp, Homo sapiens
taaatgcatgaatgtaaggc

SEQ ID NO: 10031206 - DNA, 22 bp, Homo sapiens
taaagcaatgaaagttttgcag

SEQ ID NO: 10031207 - DNA, 22 bp, Homo sapiens
taaagcaagacacacccatagc

SEQ ID NO: 10031208 - DNA, 23 bp, Homo sapiens
taaagcaaagtcaagtgcactcc

SEQ ID NO: 10031209 - DNA, 22 bp, Homo sapiens
taaagcaaggaatagagtagtc

SEQ ID NO: 10031210 - DNA, 22 bp, Homo sapiens
taacatgatttgctatttagat

SEQ ID NO: 10031211 - DNA, 22 bp, Homo sapiens
gtgtttctggggcattcatagt

SEQ ID NO: 10031212 - DNA, 22 bp, Homo sapiens
gttaacaggaactagggctatg

SEQ ID NO: 10031213 - DNA, 22 bp, Homo sapiens
gttatttaactttgtagcatgg

SEQ ID NO: 10031214 - DNA, 22 bp, Homo sapiens
gttatttataaggtgtaactcc

SEQ ID NO: 10031215 - DNA, 22 bp, Homo sapiens
tagatcagagttcaggaagttt

SEQ ID NO: 10031216 - DNA, 22 bp, Homo sapiens
tagacaggagtcaggctagaat

SEQ ID NO: 10031217 - DNA, 22 bp, Homo sapiens
tagacaggaaacattaggatgg

SEQ ID NO: 10031218 - DNA, 22 bp, Homo sapiens
tagaactgctctcatacttgct

SEQ ID NO: 10031219 - DNA, 22 bp, Homo sapiens
tagaactggaattttgtggttt

SEQ ID NO: 10031220 - DNA, 22 bp, Homo sapiens
tagcaactgctctattctagga

SEQ ID NO: 10031221 - DNA, 22 bp, Homo sapiens
tagcaactgcctttactatatt

SEQ ID NO: 10031222 - DNA, 22 bp, Homo sapiens
tattttctggacagtcttgctt

SEQ ID NO: 10031223 - DNA, 22 bp, Homo sapiens
tattttctggggagagtgaacc

SEQ ID NO: 10031224 - DNA, 22 bp, Homo sapiens
tatttcttgttattctcgttga

SEQ ID NO: 10031225 - DNA, 22 bp, Homo sapiens
tatttgaaggcatacattttga

SEQ ID NO: 10031226 - DNA, 22 bp, Homo sapiens
tatttaagatgtgtcataaaga

SEQ ID NO: 10031227 - DNA, 22 bp, Homo sapiens
tcaaagtaagattgttgaagct

SEQ ID NO: 10031228 - DNA, 22 bp, Homo sapiens
tcaaagtcacaactctctaatt

SEQ ID NO: 10031229 - DNA, 22 bp, Homo sapiens
tcaaagtccttgctttttctgt

SEQ ID NO: 10031230 - DNA, 22 bp, Homo sapiens
tcaaagtctctgcttctgtaac

SEQ ID NO: 10031231 - DNA, 22 bp, Homo sapiens
tcaaatctcactctgcatttct

SEQ ID NO: 10031232 - DNA, 22 bp, Homo sapiens
tcaaatatgtgatagaagctaa

SEQ ID NO: 10031233 - DNA, 23 bp, Homo sapiens
tatctttttcaatgttggaaata

SEQ ID NO: 10031234 - DNA, 22 bp, Homo sapiens
tatcagatagtagatatttagc

SEQ ID NO: 10031235 - DNA, 22 bp, Homo sapiens
tatcagcaggccaaagctgcaa

SEQ ID NO: 10031236 - DNA, 22 bp, Homo sapiens
tataaagaaggcacagcaagac

SEQ ID NO: 10031237 - DNA, 22 bp, Homo sapiens
tataaagaagtgtaaacaggaa

SEQ ID NO: 10031238 - DNA, 22 bp, Homo sapiens
tataaagctgactcatgaaact

SEQ ID NO: 10031239 - DNA, 22 bp, Homo sapiens
tcatcttaggtgatgagacagt

SEQ ID NO: 10031240 - DNA, 22 bp, Homo sapiens
tcatacatcttgtatatctatc

SEQ ID NO: 10031241 - DNA, 22 bp, Homo sapiens
tcatacatcttgtatatctatc

SEQ ID NO: 10031242 - DNA, 22 bp, Homo sapiens
tcatttaaaatgtaccaggatt

SEQ ID NO: 10031243 - DNA, 22 bp, Homo sapiens
tcatttaatagcttttgtcttt

SEQ ID NO: 10031244 - DNA, 22 bp, Homo sapiens
tcatttaattggttttgctcgt

SEQ ID NO: 10031245 - DNA, 22 bp, Homo sapiens
tcatttaataatttttgagtag

SEQ ID NO: 10031246 - DNA, 22 bp, Homo sapiens
tcatttctctgagtctgataat

SEQ ID NO: 10031247 - DNA, 22 bp, Homo sapiens
tcatttctattgctactgtctg

SEQ ID NO: 10031248 - DNA, 22 bp, Homo sapiens
tcatttcagatgcatttagaat

SEQ ID NO: 10031249 - DNA, 21 bp, Homo sapiens
tcatttttattgctaccttgc

SEQ ID NO: 10031250 - DNA, 22 bp, Homo sapiens
tcatttttctcttacacgtaga

SEQ ID NO: 10031251 - DNA, 23 bp, Homo sapiens
tccaaactcaagacattaataag

SEQ ID NO: 10031252 - DNA, 22 bp, Homo sapiens
tcactgcaacctccacctcctg

SEQ ID NO: 10031253 - DNA, 22 bp, Homo sapiens
tcactgcaacctccacctcccg

SEQ ID NO: 10031254 - DNA, 22 bp, Homo sapiens
tcaactcacaagaatgagcaag

SEQ ID NO: 10031255 - DNA, 23 bp, Homo sapiens
tcacataatccttcatccacagg

SEQ ID NO: 10031256 - DNA, 22 bp, Homo sapiens
tcacatttctgattataccaaa

SEQ ID NO: 10031257 - DNA, 22 bp, Homo sapiens
tcagatgtccttccagagattt

SEQ ID NO: 10031258 - DNA, 22 bp, Homo sapiens
tcagcaaatacttattgagcgc

SEQ ID NO: 10031259 - DNA, 22 bp, Homo sapiens
tcagcaaaggcaattcattatt

SEQ ID NO: 10031260 - DNA, 22 bp, Homo sapiens
tcagcaaaggaccagcacaggc

SEQ ID NO: 10031261 - DNA, 22 bp, Homo sapiens
tcagcaaaggaccagcacaggc

SEQ ID NO: 10031262 - DNA, 22 bp, Homo sapiens
tcagcaaacattgattggactt

SEQ ID NO: 10031263 - DNA, 22 bp, Homo sapiens
tcaggaattttgttctgtatcc

SEQ ID NO: 10031264 - DNA, 22 bp, Homo sapiens
tcctctttctcaacattagtta

SEQ ID NO: 10031265 - DNA, 22 bp, Homo sapiens
tcctctttaaatgcttttatct

SEQ ID NO: 10031266 - DNA, 22 bp, Homo sapiens
tcctcttctaagctcattcagg

SEQ ID NO: 10031267 - DNA, 22 bp, Homo sapiens
tccattcttttgctgtcttcct

SEQ ID NO: 10031268 - DNA, 22 bp, Homo sapiens
tttatattgggagtcgttttga

SEQ ID NO: 10031269 - DNA, 22 bp, Homo sapiens
tttatattgtaaaaatggttct

SEQ ID NO: 10031270 - DNA, 22 bp, Homo sapiens
tttatattgggagtcgttttga

SEQ ID NO: 10031271 - DNA, 22 bp, Homo sapiens
tttatctattgtattgttgatg

SEQ ID NO: 10031272 - DNA, 22 bp, Homo sapiens
tttaaggcaatatagaattcat

SEQ ID NO: 10031273 - DNA, 22 bp, Homo sapiens
tttaagcacagggataaagtta

SEQ ID NO: 10031274 - DNA, 22 bp, Homo sapiens
tttaagctaatgtcataattag

SEQ ID NO: 10031275 - DNA, 22 bp, Homo sapiens
tttaagctgtggcattaattct

SEQ ID NO: 10031276 - DNA, 22 bp, Homo sapiens
tttaagattcagtaaggcaaac

SEQ ID NO: 10031277 - DNA, 22 bp, Homo sapiens
tttaagcaagttgacatagcat

SEQ ID NO: 10031278 - DNA, 22 bp, Homo sapiens
tttaaagagaatgtgaaggagt

SEQ ID NO: 10031279 - DNA, 22 bp, Homo sapiens
tttaaacctatctaagaaatag

SEQ ID NO: 10031280 - DNA, 22 bp, Homo sapiens
tttaaactgttgattttatgaa

SEQ ID NO: 10031281 - DNA, 17 bp, Homo sapiens
tttaaactactacaagg

SEQ ID NO: 10031282 - DNA, 17 bp, Homo sapiens
tttaaactactacaagg

SEQ ID NO: 10031283 - DNA, 22 bp, Homo sapiens
tttaaatgcagacgttgattca

SEQ ID NO: 10031284 - DNA, 23 bp, Homo sapiens
tttcacaatgagcattacagaat

SEQ ID NO: 10031285 - DNA, 22 bp, Homo sapiens
tttattctataggcattaagca

SEQ ID NO: 10031286 - DNA, 22 bp, Homo sapiens
tttcagactgctgtgtgaaact

SEQ ID NO: 10031287 - DNA, 21 bp, Homo sapiens
tttcagacctatctttgaagg

SEQ ID NO: 10031288 - DNA, 22 bp, Homo sapiens
tttcacctcagtctttttatat

SEQ ID NO: 10031289 - DNA, 22 bp, Homo sapiens
ttgctgaaaacaggtcatcagg

SEQ ID NO: 10031290 - DNA, 22 bp, Homo sapiens
ttgcattatttaatgagactct

SEQ ID NO: 10031291 - DNA, 22 bp, Homo sapiens
ttggaaaatgaggcacagagag

SEQ ID NO: 10031292 - DNA, 22 bp, Homo sapiens
ttggccatgacaggacaggaag

SEQ ID NO: 10031293 - DNA, 22 bp, Homo sapiens
ttgtaacatcaccatcaaaatc

SEQ ID NO: 10031294 - DNA, 22 bp, Homo sapiens
ttgtaacacttttctattaata

SEQ ID NO: 10031295 - DNA, 22 bp, Homo sapiens
ttgtaacaaagacactccaaaa

SEQ ID NO: 10031296 - DNA, 22 bp, Homo sapiens
ttgtaacaatctgtcataaatg

SEQ ID NO: 10031297 - DNA, 22 bp, Homo sapiens
ttattatagattatgcaagatt

SEQ ID NO: 10031298 - DNA, 22 bp, Homo sapiens
ttcaaactagttaaaagtcaga

SEQ ID NO: 10031299 - DNA, 22 bp, Homo sapiens
ttcaaactagttaaaagtcaga

SEQ ID NO: 10031300 - DNA, 22 bp, Homo sapiens
ttcaaactatgacttcagctac

SEQ ID NO: 10031301 - DNA, 22 bp, Homo sapiens
ttcaaactcacactagggagac

SEQ ID NO: 10031302 - DNA, 22 bp, Homo sapiens
ttcaaactgaggagaggatggc

SEQ ID NO: 10031303 - DNA, 22 bp, Homo sapiens
ttcaaactctgagtagttctgc

SEQ ID NO: 10031304 - DNA, 22 bp, Homo sapiens
ttcatttaatttgtgtattaac

SEQ ID NO: 10031305 - DNA, 22 bp, Homo sapiens
ttcatttaatttgtgtattaac

SEQ ID NO: 10031306 - DNA, 22 bp, Homo sapiens
ttcattgtactttaagagatgc

SEQ ID NO: 10031307 - DNA, 22 bp, Homo sapiens
ttcaaactgtgtaatttataaa

SEQ ID NO: 10031308 - DNA, 20 bp, Homo sapiens
ttctttgttccttacatttg

SEQ ID NO: 10031309 - DNA, 22 bp, Homo sapiens
ttctttgttgtactttcctaca

SEQ ID NO: 10031310 - DNA, 22 bp, Homo sapiens
ttcttttcggcctgtgagaagg

SEQ ID NO: 10031311 - DNA, 22 bp, Homo sapiens
ttcttttcttggcaggagtaga

SEQ ID NO: 10031312 - DNA, 22 bp, Homo sapiens
ttcttttctttaggcattgtgt

SEQ ID NO: 10031313 - DNA, 22 bp, Homo sapiens
ttctgtctctgtgtttacatta

SEQ ID NO: 10031314 - DNA, 23 bp, Homo sapiens
ttctgtcttgctgtcagctttct

SEQ ID NO: 10031315 - DNA, 22 bp, Homo sapiens
ttctgtctgtaaacttctcaat

SEQ ID NO: 10031316 - DNA, 19 bp, Homo sapiens
ttcttagtctcatgcatga

SEQ ID NO: 10031317 - DNA, 22 bp, Homo sapiens
ttcttagtgttcaagtagcgct

SEQ ID NO: 10031318 - DNA, 22 bp, Homo sapiens
ttcttagttcaactaaaattta

SEQ ID NO: 10031319 - DNA, 21 bp, Homo sapiens
ttcttagtaactatcttccac

SEQ ID NO: 10031320 - DNA, 22 bp, Homo sapiens
ttcttagtagcatagctatatt

SEQ ID NO: 10031321 - DNA, 22 bp, Homo sapiens
ttcttagtggtagtcatctttg

SEQ ID NO: 10031322 - DNA, 20 bp, Homo sapiens
ttcttagtagagcatgtatt

SEQ ID NO: 10031323 - DNA, 22 bp, Homo sapiens
ttcttagtccatccctcctttg

SEQ ID NO: 10031324 - DNA, 22 bp, Homo sapiens
ttctctgacccccttaaatatt

SEQ ID NO: 10031325 - DNA, 22 bp, Homo sapiens
ttccttgtgagggctctcttcc

SEQ ID NO: 10031326 - DNA, 22 bp, Homo sapiens
ttccttgtaagacctatttttg

SEQ ID NO: 10031327 - DNA, 22 bp, Homo sapiens
ttccttctggaggctccagggg

SEQ ID NO: 10031328 - DNA, 22 bp, Homo sapiens
ttccttctggagcccggggagc

SEQ ID NO: 10031329 - DNA, 22 bp, Homo sapiens
ttccttctggaagcttcagggg

SEQ ID NO: 10031330 - DNA, 18 bp, Homo sapiens
ttccttctgatgtatatg

SEQ ID NO: 10031331 - DNA, 22 bp, Homo sapiens
ttccttcttccagaggctgccc

SEQ ID NO: 10031332 - DNA, 22 bp, Homo sapiens
ttccttcttccaaacccatcat

SEQ ID NO: 10031333 - DNA, 22 bp, Homo sapiens
ttccttcttcctttagtaacca

SEQ ID NO: 10031334 - DNA, 22 bp, Homo sapiens
ttccttcttgtaatgatctgcc

SEQ ID NO: 10031335 - DNA, 22 bp, Homo sapiens
ttccttcttcattgtgttacag

SEQ ID NO: 10031336 - DNA, 22 bp, Homo sapiens
ttccttcttttacaccataaat

SEQ ID NO: 10031337 - DNA, 22 bp, Homo sapiens
ttccttctttgtggtagaaagt

SEQ ID NO: 10031338 - DNA, 22 bp, Homo sapiens
tttttatatgaaggatagtgcg

SEQ ID NO: 10031339 - DNA, 22 bp, Homo sapiens
tttttataccacctctcactta

SEQ ID NO: 10031340 - DNA, 22 bp, Homo sapiens
tttcttttccaatatccctact

SEQ ID NO: 10031341 - DNA, 22 bp, Homo sapiens
tttcttttacagtgtggctatt

SEQ ID NO: 10031342 - DNA, 22 bp, Homo sapiens
tttctttgttgttatcacatca

SEQ ID NO: 10031343 - DNA, 21 bp, Homo sapiens
tttctttctggctctcacagt

SEQ ID NO: 10031344 - DNA, 22 bp, Homo sapiens
tttcccttgttccttcctctga

SEQ ID NO: 10031345 - DNA, 22 bp, Homo sapiens
tttcctctaaacgcatttgctt

SEQ ID NO: 10031346 - DNA, 22 bp, Homo sapiens
tttgcttttgtgctctagtggt

SEQ ID NO: 10031347 - DNA, 22 bp, Homo sapiens
tttgctttgggaggttgtctgg

SEQ ID NO: 10031348 - DNA, 22 bp, Homo sapiens
tttgctttcttgattcagatta

SEQ ID NO: 10031349 - DNA, 22 bp, Homo sapiens
ttttaatactgctattgtagga

SEQ ID NO: 10031350 - DNA, 22 bp, Homo sapiens
ttttaaactgcagaatttagaa

SEQ ID NO: 10031351 - DNA, 22 bp, Homo sapiens
ttttaaactgcagaatttagaa

SEQ ID NO: 10031352 - DNA, 22 bp, Homo sapiens
ttttaaaggctgtatgaccaag

SEQ ID NO: 10031353 - DNA, 22 bp, Homo sapiens
ttttcttactgtctgtgatcct

SEQ ID NO: 10031354 - DNA, 22 bp, Homo sapiens
ttttcttaggtgctccaagtag

SEQ ID NO: 10031355 - DNA, 22 bp, Homo sapiens
acacaagggcctatagtgtatt

SEQ ID NO: 10031356 - DNA, 22 bp, Homo sapiens
acacaagaataatgatgaaggt

SEQ ID NO: 10031357 - DNA, 22 bp, Homo sapiens
acacacaactcattgtgtaata

SEQ ID NO: 10031358 - DNA, 22 bp, Homo sapiens
acacttaacttctgagaataaa

SEQ ID NO: 10031359 - DNA, 22 bp, Homo sapiens
acacttaagcatgaagtataaa

SEQ ID NO: 10031360 - DNA, 22 bp, Homo sapiens
agcatttacctcaatgcatctg

SEQ ID NO: 10031361 - DNA, 22 bp, Homo sapiens
agcatttaattacagtttaatt

SEQ ID NO: 10031362 - DNA, 22 bp, Homo sapiens
acagaacttggaacttttcaca

SEQ ID NO: 10031363 - DNA, 22 bp, Homo sapiens
acagcagaccactactagtagg

SEQ ID NO: 10031364 - DNA, 21 bp, Homo sapiens
aattacagatggaattacaga

SEQ ID NO: 10031365 - DNA, 22 bp, Homo sapiens
agacatggagaaggagccagtg

SEQ ID NO: 10031366 - DNA, 22 bp, Homo sapiens
agagaaatggggtaatctttca

SEQ ID NO: 10031367 - DNA, 22 bp, Homo sapiens
agagtgtaccaaatatcctaca

SEQ ID NO: 10031368 - DNA, 22 bp, Homo sapiens
acaaagtatttttaggtttgta

SEQ ID NO: 10031369 - DNA, 22 bp, Homo sapiens
agagttcagaaagtgcaggttt

SEQ ID NO: 10031370 - DNA, 22 bp, Homo sapiens
acaaagtgtgcggagcccaggg

SEQ ID NO: 10031371 - DNA, 22 bp, Homo sapiens
acaaagtgctgacattacaggc

SEQ ID NO: 10031372 - DNA, 22 bp, Homo sapiens
acaaagttattctttcagagga

SEQ ID NO: 10031373 - DNA, 22 bp, Homo sapiens
acaagtttcattgtttagaacc

SEQ ID NO: 10031374 - DNA, 22 bp, Homo sapiens
acaatagaaataattaagcaca

SEQ ID NO: 10031375 - DNA, 22 bp, Homo sapiens
agcacacaggacttgattcatg

SEQ ID NO: 10031376 - DNA, 22 bp, Homo sapiens
actcttcttgctgctcattaat

SEQ ID NO: 10031377 - DNA, 22 bp, Homo sapiens
aagttttattggctatagcact

SEQ ID NO: 10031378 - DNA, 20 bp, Homo sapiens
aagttttctccaaatacagt

SEQ ID NO: 10031379 - DNA, 22 bp, Homo sapiens
aagtttttggtagagaaaagta

SEQ ID NO: 10031380 - DNA, 22 bp, Homo sapiens
aatagcaaatgctcatttgaaa

SEQ ID NO: 10031381 - DNA, 22 bp, Homo sapiens
aatagcagttaaaaatcagccc

SEQ ID NO: 10031382 - DNA, 22 bp, Homo sapiens
agaactctgaacactgtctgga

SEQ ID NO: 10031383 - DNA, 20 bp, Homo sapiens
agaactgttgtttgggtcct

SEQ ID NO: 10031384 - DNA, 22 bp, Homo sapiens
aatgccttcccatttatacttt

SEQ ID NO: 10031385 - DNA, 21 bp, Homo sapiens
aatgcattaacataaagctga

SEQ ID NO: 10031386 - DNA, 22 bp, Homo sapiens
aatagtaaaagatacagctaat

SEQ ID NO: 10031387 - DNA, 22 bp, Homo sapiens
aatctagagttcccagcataaa

SEQ ID NO: 10031388 - DNA, 22 bp, Homo sapiens
aatctagattcggatcaaaggg

SEQ ID NO: 10031389 - DNA, 22 bp, Homo sapiens
aatctacatagagatcaaatga

SEQ ID NO: 10031390 - DNA, 22 bp, Homo sapiens
aagggagacagttgtgtgagga

SEQ ID NO: 10031391 - DNA, 22 bp, Homo sapiens
acatgcatgtgaatatggacac

SEQ ID NO: 10031392 - DNA, 22 bp, Homo sapiens
acatgacagtgactttataaga

SEQ ID NO: 10031393 - DNA, 22 bp, Homo sapiens
aagctgtgaaatctctagtgca

SEQ ID NO: 10031394 - DNA, 22 bp, Homo sapiens
aaactgttgtggtttatcatta

SEQ ID NO: 10031395 - DNA, 22 bp, Homo sapiens
aaataaaggtccactttagggc

SEQ ID NO: 10031396 - DNA, 22 bp, Homo sapiens
aaataaactgaagcacagagag

SEQ ID NO: 10031397 - DNA, 22 bp, Homo sapiens
aaatacaatttcaggctgtaat

SEQ ID NO: 10031398 - DNA, 22 bp, Homo sapiens
aaatacagagttgcttaaaagc

SEQ ID NO: 10031399 - DNA, 22 bp, Homo sapiens
aaatacagagttatggacctca

SEQ ID NO: 10031400 - DNA, 21 bp, Homo sapiens
aaatacagaaacttgttttca

SEQ ID NO: 10031401 - DNA, 22 bp, Homo sapiens
aaatacagatagatttaaccca

SEQ ID NO: 10031402 - DNA, 21 bp, Homo sapiens
aaatacagatgcaaatctgtt

SEQ ID NO: 10031403 - DNA, 22 bp, Homo sapiens
aaacttattttatcacagttca

SEQ ID NO: 10031404 - DNA, 22 bp, Homo sapiens
aaacttcagtgaatgacttatg

SEQ ID NO: 10031405 - DNA, 22 bp, Homo sapiens
aaagttttattcaagcattagt

SEQ ID NO: 10031406 - DNA, 22 bp, Homo sapiens
aaagttttctgccttcattaga

SEQ ID NO: 10031407 - DNA, 22 bp, Homo sapiens
aaagttttgttgattgtggaat

SEQ ID NO: 10031408 - DNA, 22 bp, Homo sapiens
aaagtacagccacatccaagta

SEQ ID NO: 10031409 - DNA, 23 bp, Homo sapiens
aaagctctgctgcatgtagaata

SEQ ID NO: 10031410 - DNA, 22 bp, Homo sapiens
aaagctcttaatgagattatcc

SEQ ID NO: 10031411 - DNA, 22 bp, Homo sapiens
aaaagcagatctccaaagtcta

SEQ ID NO: 10031412 - DNA, 22 bp, Homo sapiens
aaaagcaggtactcagcttggg

SEQ ID NO: 10031413 - DNA, 22 bp, Homo sapiens
aaaagcagtttatagtcagttg

SEQ ID NO: 10031414 - DNA, 22 bp, Homo sapiens
aaaacaggagttttggtaggct

SEQ ID NO: 10031415 - DNA, 22 bp, Homo sapiens
aaaaatctatgactgcttctcc

SEQ ID NO: 10031416 - DNA, 18 bp, Homo sapiens
aaaatgcaggcgacatgg

SEQ ID NO: 10031417 - DNA, 22 bp, Homo sapiens
aaaagtttgtgcaaacactcag

SEQ ID NO: 10031418 - DNA, 22 bp, Homo sapiens
aaagcatttcatgtctagaaag

SEQ ID NO: 10031419 - DNA, 21 bp, Homo sapiens
aaagcagttcttcctgcctct

SEQ ID NO: 10031420 - DNA, 22 bp, Homo sapiens
aaagcagtctcagacttaagca

SEQ ID NO: 10031421 - DNA, 22 bp, Homo sapiens
aaagcagtatgaaaggcaataa

SEQ ID NO: 10031422 - DNA, 22 bp, Homo sapiens
aaagcagtagttttcaaatagt

SEQ ID NO: 10031423 - DNA, 22 bp, Homo sapiens
aaattcagttttaataatcact

SEQ ID NO: 10031424 - DNA, 19 bp, Homo sapiens
aaagttctgactgtagagc

SEQ ID NO: 10031425 - DNA, 22 bp, Homo sapiens
aaagggaggggcgataagccgg

SEQ ID NO: 10031426 - DNA, 22 bp, Homo sapiens
aaatatagcaattatgcctact

SEQ ID NO: 10031427 - DNA, 22 bp, Homo sapiens
aaatataatttctgcctcaata

SEQ ID NO: 10031428 - DNA, 22 bp, Homo sapiens
aaatatagtgacacttatagtc

SEQ ID NO: 10031429 - DNA, 22 bp, Homo sapiens
aaatatagtaaatgcatagttc

SEQ ID NO: 10031430 - DNA, 22 bp, Homo sapiens
aaatacagtgtgtgttctttga

SEQ ID NO: 10031431 - DNA, 22 bp, Homo sapiens
aaatacagtggcagcagataat

SEQ ID NO: 10031432 - DNA, 22 bp, Homo sapiens
aaatacaggagtttggacttct

SEQ ID NO: 10031433 - DNA, 22 bp, Homo sapiens
aaatacagtggcagcagataat

SEQ ID NO: 10031434 - DNA, 22 bp, Homo sapiens
aaatacagattctgactcagag

SEQ ID NO: 10031435 - DNA, 22 bp, Homo sapiens
aaatacagattcttgtgtctat

SEQ ID NO: 10031436 - DNA, 22 bp, Homo sapiens
aaatacagcagactcctgttgt

SEQ ID NO: 10031437 - DNA, 22 bp, Homo sapiens
aaatacagcagactcctgttgt

SEQ ID NO: 10031438 - DNA, 19 bp, Homo sapiens
aaatacagcagctgtttcc

SEQ ID NO: 10031439 - DNA, 22 bp, Homo sapiens
aaatcagagtctgattttaagg

SEQ ID NO: 10031440 - DNA, 22 bp, Homo sapiens
aatatctagcctttagcagctt

SEQ ID NO: 10031441 - DNA, 22 bp, Homo sapiens
aatacagaggggtcacaattca

SEQ ID NO: 10031442 - DNA, 22 bp, Homo sapiens
aatacagaggcttccagtaaaa

SEQ ID NO: 10031443 - DNA, 22 bp, Homo sapiens
aatacagatggcatgtgaagat

SEQ ID NO: 10031444 - DNA, 22 bp, Homo sapiens
aatacagatattcagtggtact

SEQ ID NO: 10031445 - DNA, 22 bp, Homo sapiens
aatgaaactgtatatagactgt

SEQ ID NO: 10031446 - DNA, 22 bp, Homo sapiens
aatgtaaagttgggcacaaatg

SEQ ID NO: 10031447 - DNA, 22 bp, Homo sapiens
aatgtaaacagcaagagaaggg

SEQ ID NO: 10031448 - DNA, 22 bp, Homo sapiens
aactttacactgctttacatga

SEQ ID NO: 10031449 - DNA, 22 bp, Homo sapiens
aactttaaggctataaattatg

SEQ ID NO: 10031450 - DNA, 22 bp, Homo sapiens
aagtcttttgctaagagtaatg

SEQ ID NO: 10031451 - DNA, 22 bp, Homo sapiens
aagtctttcataagtctcttat

SEQ ID NO: 10031452 - DNA, 23 bp, Homo sapiens
aagtaacagggataatagcagtt

SEQ ID NO: 10031453 - DNA, 22 bp, Homo sapiens
aagtaacatgggaacatctgaa

SEQ ID NO: 10031454 - DNA, 22 bp, Homo sapiens
aagtaacatctgaacatgatgt

SEQ ID NO: 10031455 - DNA, 22 bp, Homo sapiens
aaatggcaacagaagggagttc

SEQ ID NO: 10031456 - DNA, 22 bp, Homo sapiens
acaaatgaacatataagcttga

SEQ ID NO: 10031457 - DNA, 22 bp, Homo sapiens
acaaatgaatcatacataatgt

SEQ ID NO: 10031458 - DNA, 22 bp, Homo sapiens
acaaatgaacctgaaatctcag

SEQ ID NO: 10031459 - DNA, 22 bp, Homo sapiens
aagaatctctctactttattac

SEQ ID NO: 10031460 - DNA, 22 bp, Homo sapiens
acacagagcaaatcatgacaga

SEQ ID NO: 10031461 - DNA, 22 bp, Homo sapiens
acacagagcaaatcatgacaga

SEQ ID NO: 10031462 - DNA, 17 bp, Homo sapiens
acacagagattaacaca

SEQ ID NO: 10031463 - DNA, 22 bp, Homo sapiens
acagcagggggagctgttggac

SEQ ID NO: 10031464 - DNA, 22 bp, Homo sapiens
aagcagtgataagagctaccat

SEQ ID NO: 10031465 - DNA, 22 bp, Homo sapiens
aagcagtgatgcatacagctgt

SEQ ID NO: 10031466 - DNA, 22 bp, Homo sapiens
aagatacacgttgtattgaata

SEQ ID NO: 10031467 - DNA, 23 bp, Homo sapiens
acagaaatcatttgtaaggtacc

SEQ ID NO: 10031468 - DNA, 22 bp, Homo sapiens
acagaaatatagaaggtaggaa

SEQ ID NO: 10031469 - DNA, 23 bp, Homo sapiens
acagaaagttctgctggacagag

SEQ ID NO: 10031470 - DNA, 22 bp, Homo sapiens
acagcagtttagaggacagcca

SEQ ID NO: 10031471 - DNA, 22 bp, Homo sapiens
acagtgaaaattctattgattt

SEQ ID NO: 10031472 - DNA, 22 bp, Homo sapiens
acagtgaataagacatgtgctt

SEQ ID NO: 10031473 - DNA, 22 bp, Homo sapiens
acagtgaatccaaattcctacc

SEQ ID NO: 10031474 - DNA, 22 bp, Homo sapiens
acagtgaatgcccaagaaaagt

SEQ ID NO: 10031475 - DNA, 22 bp, Homo sapiens
aggcagattttctttactcagt

SEQ ID NO: 10031476 - DNA, 22 bp, Homo sapiens
aggcagatgtgattaatttcct

SEQ ID NO: 10031477 - DNA, 22 bp, Homo sapiens
aggcagatgtgtcttctaaaat

SEQ ID NO: 10031478 - DNA, 22 bp, Homo sapiens
aggcagattaggattaggaaat

SEQ ID NO: 10031479 - DNA, 22 bp, Homo sapiens
aggcagatcagtacagggttaa

SEQ ID NO: 10031480 - DNA, 22 bp, Homo sapiens
aggcagatgggcgtctataaat

SEQ ID NO: 10031481 - DNA, 22 bp, Homo sapiens
aggcagatgggagctggaagtt

SEQ ID NO: 10031482 - DNA, 22 bp, Homo sapiens
aggcagatatttcagttcacat

SEQ ID NO: 10031483 - DNA, 22 bp, Homo sapiens
aggggtgatttgggacaggaca

SEQ ID NO: 10031484 - DNA, 22 bp, Homo sapiens
aggggtgacacatatcagtgca

SEQ ID NO: 10031485 - DNA, 22 bp, Homo sapiens
accagagactctttctagtcct

SEQ ID NO: 10031486 - DNA, 22 bp, Homo sapiens
agggaggcattagctactgcga

SEQ ID NO: 10031487 - DNA, 22 bp, Homo sapiens
aggctatttccactcttctcat

SEQ ID NO: 10031488 - DNA, 19 bp, Homo sapiens
aggctgtgagggaggactc

SEQ ID NO: 10031489 - DNA, 22 bp, Homo sapiens
accagaaaggaataatagaatt

SEQ ID NO: 10031490 - DNA, 22 bp, Homo sapiens
acatttctccctgcatgcctgc

SEQ ID NO: 10031491 - DNA, 22 bp, Homo sapiens
agaaatgttacagttgttattt

SEQ ID NO: 10031492 - DNA, 22 bp, Homo sapiens
agaaatgtcaagtgttcttgtt

SEQ ID NO: 10031493 - DNA, 22 bp, Homo sapiens
agaagcaggcagatttcagctc

SEQ ID NO: 10031494 - DNA, 22 bp, Homo sapiens
agaaatgcctacgagataggga

SEQ ID NO: 10031495 - DNA, 23 bp, Homo sapiens
agaaagtttgtgccttgtgacac

SEQ ID NO: 10031496 - DNA, 22 bp, Homo sapiens
atatagcacttgttttgcatgt

SEQ ID NO: 10031497 - DNA, 22 bp, Homo sapiens
atatagaatacacagggaaagt

SEQ ID NO: 10031498 - DNA, 22 bp, Homo sapiens
ataagctgtactctataaatgt

SEQ ID NO: 10031499 - DNA, 20 bp, Homo sapiens
atacacattcatagaaaaat

SEQ ID NO: 10031500 - DNA, 22 bp, Homo sapiens
ataacagacttagagttacaag

SEQ ID NO: 10031501 - DNA, 22 bp, Homo sapiens
agttcagagtaaatgttgaagg

SEQ ID NO: 10031502 - DNA, 22 bp, Homo sapiens
atagaagcaagaacagaatgga

SEQ ID NO: 10031503 - DNA, 22 bp, Homo sapiens
actttagaaaaggaacagagga

SEQ ID NO: 10031504 - DNA, 23 bp, Homo sapiens
agaaaagcttggacacatggcct

SEQ ID NO: 10031505 - DNA, 22 bp, Homo sapiens
agttacatataagaagacagac

SEQ ID NO: 10031506 - DNA, 22 bp, Homo sapiens
agttacatgtgaatagaaagta

SEQ ID NO: 10031507 - DNA, 22 bp, Homo sapiens
agtgtgtccagaaatctgtatt

SEQ ID NO: 10031508 - DNA, 22 bp, Homo sapiens
agtgggagccagcagcttgggg

SEQ ID NO: 10031509 - DNA, 22 bp, Homo sapiens
agtgggaggcggctgacgggcg

SEQ ID NO: 10031510 - DNA, 22 bp, Homo sapiens
agtgggagcggcagtcggggac

SEQ ID NO: 10031511 - DNA, 22 bp, Homo sapiens
caaacattgctaccagaggttt

SEQ ID NO: 10031512 - DNA, 22 bp, Homo sapiens
caaacatttaggaggagggagg

SEQ ID NO: 10031513 - DNA, 22 bp, Homo sapiens
caaacattttaaataagggata

SEQ ID NO: 10031514 - DNA, 22 bp, Homo sapiens
caaagttttagtaaacatatat

SEQ ID NO: 10031515 - DNA, 22 bp, Homo sapiens
attttgtgaaccctcaagcaat

SEQ ID NO: 10031516 - DNA, 22 bp, Homo sapiens
attttttatataccaaggtggg

SEQ ID NO: 10031517 - DNA, 22 bp, Homo sapiens
agcaataacagaaaactttcct

SEQ ID NO: 10031518 - DNA, 22 bp, Homo sapiens
attttttcccagttagccagga

SEQ ID NO: 10031519 - DNA, 22 bp, Homo sapiens
atttctttctggccacggtttt

SEQ ID NO: 10031520 - DNA, 22 bp, Homo sapiens
atttcttttcaagagggtgctt

SEQ ID NO: 10031521 - DNA, 22 bp, Homo sapiens
agatgtttgtgcagtggcatgc

SEQ ID NO: 10031522 - DNA, 22 bp, Homo sapiens
agatttaaatttgctacaattc

SEQ ID NO: 10031523 - DNA, 22 bp, Homo sapiens
attattttatgtgcggcctgat

SEQ ID NO: 10031524 - DNA, 22 bp, Homo sapiens
attaataaaataccactttgtt

SEQ ID NO: 10031525 - DNA, 22 bp, Homo sapiens
attctaagtcttgttcacattc

SEQ ID NO: 10031526 - DNA, 19 bp, Homo sapiens
attcttctcttcctgctgt

SEQ ID NO: 10031527 - DNA, 22 bp, Homo sapiens
attcttctgcctactttcatcc

SEQ ID NO: 10031528 - DNA, 22 bp, Homo sapiens
attgagcaggcaaagtatcata

SEQ ID NO: 10031529 - DNA, 22 bp, Homo sapiens
attgagcacaaacgttactaga

SEQ ID NO: 10031530 - DNA, 22 bp, Homo sapiens
agatacaaggcagagatgtgca

SEQ ID NO: 10031531 - DNA, 22 bp, Homo sapiens
atgccactgcactccagcctag

SEQ ID NO: 10031532 - DNA, 22 bp, Homo sapiens
agagaaaagagttcaggctttg

SEQ ID NO: 10031533 - DNA, 22 bp, Homo sapiens
caatttttaaactatgaagttg

SEQ ID NO: 10031534 - DNA, 22 bp, Homo sapiens
cacagaaaggctcaaatcccaa

SEQ ID NO: 10031535 - DNA, 22 bp, Homo sapiens
cactgaaatcgaaaaatgtagg

SEQ ID NO: 10031536 - DNA, 22 bp, Homo sapiens
cactaagatttaaagtattagt

SEQ ID NO: 10031537 - DNA, 19 bp, Homo sapiens
cactaagatgagatatagc

SEQ ID NO: 10031538 - DNA, 22 bp, Homo sapiens
cacatgaacatgctggaaaagc

SEQ ID NO: 10031539 - DNA, 22 bp, Homo sapiens
cactgcaacctccacctcctgg

SEQ ID NO: 10031540 - DNA, 22 bp, Homo sapiens
cactgcactccagcccgggcaa

SEQ ID NO: 10031541 - DNA, 22 bp, Homo sapiens
cactgcactccatcctgggaaa

SEQ ID NO: 10031542 - DNA, 22 bp, Homo sapiens
agcatttatttcttagaaattg

SEQ ID NO: 10031543 - DNA, 22 bp, Homo sapiens
agcatttatgactaatgtaaaa

SEQ ID NO: 10031544 - DNA, 22 bp, Homo sapiens
agcatttatttcttagaaattg

SEQ ID NO: 10031545 - DNA, 22 bp, Homo sapiens
agcatttagttagtaaatgttt

SEQ ID NO: 10031546 - DNA, 22 bp, Homo sapiens
agcatttatagcccctatcatc

SEQ ID NO: 10031547 - DNA, 22 bp, Homo sapiens
agcatttaggagaatttgagaa

SEQ ID NO: 10031548 - DNA, 22 bp, Homo sapiens
cagatgaactaggctgcacttg

SEQ ID NO: 10031549 - DNA, 22 bp, Homo sapiens
agccctgggctgtagataagca

SEQ ID NO: 10031550 - DNA, 22 bp, Homo sapiens
cagcatggtgccagtgagtcca

SEQ ID NO: 10031551 - DNA, 22 bp, Homo sapiens
agcgccactgcactccagcctg

SEQ ID NO: 10031552 - DNA, 22 bp, Homo sapiens
cagcatcatactacctaaatga

SEQ ID NO: 10031553 - DNA, 22 bp, Homo sapiens
atgaaaatgtacatgtgtataa

SEQ ID NO: 10031554 - DNA, 22 bp, Homo sapiens
cttcttgtgcactctctatgta

SEQ ID NO: 10031555 - DNA, 22 bp, Homo sapiens
cttcttgtgcccatacgttaga

SEQ ID NO: 10031556 - DNA, 22 bp, Homo sapiens
cttcttgtcaatttgccattgt

SEQ ID NO: 10031557 - DNA, 22 bp, Homo sapiens
cttcttgtcagtgatttcttcc

SEQ ID NO: 10031558 - DNA, 22 bp, Homo sapiens
cttcttgttttagccctcatac

SEQ ID NO: 10031559 - DNA, 18 bp, Homo sapiens
cttcttgtttgatttggg

SEQ ID NO: 10031560 - DNA, 22 bp, Homo sapiens
cttctttaccaagagatagagt

SEQ ID NO: 10031561 - DNA, 22 bp, Homo sapiens
ctttcttcaacctcattctgca

SEQ ID NO: 10031562 - DNA, 22 bp, Homo sapiens
ctttcttcaagctggtctcaat

SEQ ID NO: 10031563 - DNA, 22 bp, Homo sapiens
ctttcttcatcaagtgccacgt

SEQ ID NO: 10031564 - DNA, 22 bp, Homo sapiens
gaaacattgtgttctacagatt

SEQ ID NO: 10031565 - DNA, 20 bp, Homo sapiens
gaaatacttacccaactgtt

SEQ ID NO: 10031566 - DNA, 22 bp, Homo sapiens
gaaatacaggaatgccacacag

SEQ ID NO: 10031567 - DNA, 22 bp, Homo sapiens
gaaatacagttgggaggaggta

SEQ ID NO: 10031568 - DNA, 22 bp, Homo sapiens
atgttctttgtgattctgagct

SEQ ID NO: 10031569 - DNA, 22 bp, Homo sapiens
atgttcttatcattctttcgga

SEQ ID NO: 10031570 - DNA, 22 bp, Homo sapiens
gagttcagtagttatagtctag

SEQ ID NO: 10031571 - DNA, 22 bp, Homo sapiens
atgttgtacattctatgggttt

SEQ ID NO: 10031572 - DNA, 22 bp, Homo sapiens
atgtccttctcctcttacctgc

SEQ ID NO: 10031573 - DNA, 22 bp, Homo sapiens
atggcattaggaccatgagcct

SEQ ID NO: 10031574 - DNA, 22 bp, Homo sapiens
atggcattcacatttccagaga

SEQ ID NO: 10031575 - DNA, 22 bp, Homo sapiens
atggccaccatctctaaaacac

SEQ ID NO: 10031576 - DNA, 22 bp, Homo sapiens
atggcatttatgttgacaatgg

SEQ ID NO: 10031577 - DNA, 22 bp, Homo sapiens
atggcattgctgtgctccactg

SEQ ID NO: 10031578 - DNA, 22 bp, Homo sapiens
atggcatttgaccgctttgtgg

SEQ ID NO: 10031579 - DNA, 22 bp, Homo sapiens
atggcatttttagacagtcctt

SEQ ID NO: 10031580 - DNA, 22 bp, Homo sapiens
atggccaagaatatttctcaac

SEQ ID NO: 10031581 - DNA, 22 bp, Homo sapiens
atggctggcatccaggtgggct

SEQ ID NO: 10031582 - DNA, 22 bp, Homo sapiens
atttggaatggtctggcatttg

SEQ ID NO: 10031583 - DNA, 22 bp, Homo sapiens
caaacattcaagtacaagtctt

SEQ ID NO: 10031584 - DNA, 22 bp, Homo sapiens
caaacattcagatgcaatggta

SEQ ID NO: 10031585 - DNA, 22 bp, Homo sapiens
atttttctctcacacttaccag

SEQ ID NO: 10031586 - DNA, 22 bp, Homo sapiens
atttttgtatccccagctcctg

SEQ ID NO: 10031587 - DNA, 22 bp, Homo sapiens
attagtattcagtttataacac

SEQ ID NO: 10031588 - DNA, 22 bp, Homo sapiens
attagcttatcacacaagctgc

SEQ ID NO: 10031589 - DNA, 22 bp, Homo sapiens
attagtgtggaccctaatttaa

SEQ ID NO: 10031590 - DNA, 22 bp, Homo sapiens
attcagaaagcaagtgctgggt

SEQ ID NO: 10031591 - DNA, 22 bp, Homo sapiens
attcagaattttggggagctaa

SEQ ID NO: 10031592 - DNA, 22 bp, Homo sapiens
attcagaatggcaaacttctag

SEQ ID NO: 10031593 - DNA, 22 bp, Homo sapiens
attcagaattgtgggcagtaca

SEQ ID NO: 10031594 - DNA, 22 bp, Homo sapiens
attgataaattgcaatggggct

SEQ ID NO: 10031595 - DNA, 16 bp, Homo sapiens
gcagtgtgtttaatag

SEQ ID NO: 10031596 - DNA, 22 bp, Homo sapiens
gcagtgtgtctggagtacatgg

SEQ ID NO: 10031597 - DNA, 22 bp, Homo sapiens
gcagtgtgtagagtttaggaaa

SEQ ID NO: 10031598 - DNA, 22 bp, Homo sapiens
caaatgtaaattcttttgaagc

SEQ ID NO: 10031599 - DNA, 22 bp, Homo sapiens
gctttcttatttagaagatttg

SEQ ID NO: 10031600 - DNA, 22 bp, Homo sapiens
gctttcttcatactcaagcatc

SEQ ID NO: 10031601 - DNA, 22 bp, Homo sapiens
gctttcttttcaagaatgtatt

SEQ ID NO: 10031602 - DNA, 22 bp, Homo sapiens
gctttcttgctgcatggtggct

SEQ ID NO: 10031603 - DNA, 22 bp, Homo sapiens
gctttcttggttctgcaggggc

SEQ ID NO: 10031604 - DNA, 22 bp, Homo sapiens
gctttcttagtgtgttaattgg

SEQ ID NO: 10031605 - DNA, 22 bp, Homo sapiens
caataaagaagatttttgcaat

SEQ ID NO: 10031606 - DNA, 22 bp, Homo sapiens
caagtttacaatgtgtatgtgt

SEQ ID NO: 10031607 - DNA, 22 bp, Homo sapiens
caagtacaaaatgatatttagt

SEQ ID NO: 10031608 - DNA, 22 bp, Homo sapiens
caagtttaaggcactgataagt

SEQ ID NO: 10031609 - DNA, 22 bp, Homo sapiens
cacagatgaagtaaacaactct

SEQ ID NO: 10031610 - DNA, 22 bp, Homo sapiens
cacagagttgaatattgacatt

SEQ ID NO: 10031611 - DNA, 22 bp, Homo sapiens
cacagaggtgatagtggtcaag

SEQ ID NO: 10031612 - DNA, 22 bp, Homo sapiens
cacagaagtgtgtataactctt

SEQ ID NO: 10031613 - DNA, 22 bp, Homo sapiens
cacagaggaatgcatcagcaga

SEQ ID NO: 10031614 - DNA, 22 bp, Homo sapiens
cacagaggaaaggcagttggta

SEQ ID NO: 10031615 - DNA, 22 bp, Homo sapiens
cactttaactcacatttcagct

SEQ ID NO: 10031616 - DNA, 22 bp, Homo sapiens
cagaaataaagtggacagagta

SEQ ID NO: 10031617 - DNA, 22 bp, Homo sapiens
cagaaagcttaggcaagttgga

SEQ ID NO: 10031618 - DNA, 22 bp, Homo sapiens
cagaaagcttggtacaatatgc

SEQ ID NO: 10031619 - DNA, 22 bp, Homo sapiens
cagaaagccaactccaactgtc

SEQ ID NO: 10031620 - DNA, 22 bp, Homo sapiens
cagaaagccgacttacaatgga

SEQ ID NO: 10031621 - DNA, 22 bp, Homo sapiens
cacatttagaggttagcatggt

SEQ ID NO: 10031622 - DNA, 22 bp, Homo sapiens
cacataagaaatgaatatgaga

SEQ ID NO: 10031623 - DNA, 22 bp, Homo sapiens
ggaggtgaggccgtagggtgtg

SEQ ID NO: 10031624 - DNA, 22 bp, Homo sapiens
ggcattctaggccaaaatcagg

SEQ ID NO: 10031625 - DNA, 22 bp, Homo sapiens
ggcattatctgagcacgtaata

SEQ ID NO: 10031626 - DNA, 22 bp, Homo sapiens
cagcaaaggtagaagcacagga

SEQ ID NO: 10031627 - DNA, 22 bp, Homo sapiens
gggctgaggggtatctcatggg

SEQ ID NO: 10031628 - DNA, 22 bp, Homo sapiens
cagacccaggatccaaatgttg

SEQ ID NO: 10031629 - DNA, 22 bp, Homo sapiens
cagacagggtcctgtccgtcac

SEQ ID NO: 10031630 - DNA, 22 bp, Homo sapiens
cagactgggagtcaggaagaag

SEQ ID NO: 10031631 - DNA, 22 bp, Homo sapiens
gggcagcagttgccctaatcaa

SEQ ID NO: 10031632 - DNA, 22 bp, Homo sapiens
gggcagcatgaggaccctcatc

SEQ ID NO: 10031633 - DNA, 22 bp, Homo sapiens
cctcctttcctgttttcctgag

SEQ ID NO: 10031634 - DNA, 22 bp, Homo sapiens
agggggtgaatgtctgtctaca

SEQ ID NO: 10031635 - DNA, 22 bp, Homo sapiens
agggggtgggaagtctagaatc

SEQ ID NO: 10031636 - DNA, 22 bp, Homo sapiens
agggggtgtctctgattgggtt

SEQ ID NO: 10031637 - DNA, 22 bp, Homo sapiens
aggctgtgcattttggagggcc

SEQ ID NO: 10031638 - DNA, 22 bp, Homo sapiens
aggctgtggtgctgaaggaggg

SEQ ID NO: 10031639 - DNA, 22 bp, Homo sapiens
aggctgtgggacagttaggaga

SEQ ID NO: 10031640 - DNA, 22 bp, Homo sapiens
caggcagagtgaggtggtctaa

SEQ ID NO: 10031641 - DNA, 22 bp, Homo sapiens
cagtaaaagatggaaatagaat

SEQ ID NO: 10031642 - DNA, 22 bp, Homo sapiens
cagtaactgatgtgatcaaacg

SEQ ID NO: 10031643 - DNA, 22 bp, Homo sapiens
catttactgtaaaagattctct

SEQ ID NO: 10031644 - DNA, 22 bp, Homo sapiens
catttgaaacctggaatctacc

SEQ ID NO: 10031645 - DNA, 22 bp, Homo sapiens
aggcaggagtgaccctgacagg

SEQ ID NO: 10031646 - DNA, 22 bp, Homo sapiens
catcttctgggacttctcagtt

SEQ ID NO: 10031647 - DNA, 22 bp, Homo sapiens
catgagcataaatcagtcacga

SEQ ID NO: 10031648 - DNA, 22 bp, Homo sapiens
cagtgttccctgaacatatgtt

SEQ ID NO: 10031649 - DNA, 22 bp, Homo sapiens
ctcattgcaacctccgcctccc

SEQ ID NO: 10031650 - DNA, 22 bp, Homo sapiens
agtacacagaattctacttgtt

SEQ ID NO: 10031651 - DNA, 21 bp, Homo sapiens
ctacagaatcgagcattctgg

SEQ ID NO: 10031652 - DNA, 22 bp, Homo sapiens
agtatttcctggcttatctgct

SEQ ID NO: 10031653 - DNA, 22 bp, Homo sapiens
ctacatttgttctatagctttt

SEQ ID NO: 10031654 - DNA, 22 bp, Homo sapiens
ctacattttaataagctgctta

SEQ ID NO: 10031655 - DNA, 22 bp, Homo sapiens
ctacattttgtgattatgaaat

SEQ ID NO: 10031656 - DNA, 22 bp, Homo sapiens
ctacattttgtgattatgaaat

SEQ ID NO: 10031657 - DNA, 22 bp, Homo sapiens
ctacatttcccagctgccttcc

SEQ ID NO: 10031658 - DNA, 22 bp, Homo sapiens
ctacatttggagagtataggaa

SEQ ID NO: 10031659 - DNA, 22 bp, Homo sapiens
ctacatttgttcaaataagctg

SEQ ID NO: 10031660 - DNA, 22 bp, Homo sapiens
ctacatttttcaccgagcctct

SEQ ID NO: 10031661 - DNA, 22 bp, Homo sapiens
atactacaatcataattgtaca

SEQ ID NO: 10031662 - DNA, 22 bp, Homo sapiens
atactacatactatgtaaacat

SEQ ID NO: 10031663 - DNA, 22 bp, Homo sapiens
ctggctggccatgtagagatga

SEQ ID NO: 10031664 - DNA, 22 bp, Homo sapiens
atacagtataactaataaaccc

SEQ ID NO: 10031665 - DNA, 17 bp, Homo sapiens
atacagtttattttaca

SEQ ID NO: 10031666 - DNA, 22 bp, Homo sapiens
ctggagaagtactgagacattt

SEQ ID NO: 10031667 - DNA, 22 bp, Homo sapiens
ctggagaagccaaactagtcac

SEQ ID NO: 10031668 - DNA, 22 bp, Homo sapiens
ctggagaattctatgaaatatt

SEQ ID NO: 10031669 - DNA, 22 bp, Homo sapiens
ataacagatgcttcagcataaa

SEQ ID NO: 10031670 - DNA, 22 bp, Homo sapiens
ctgcattactaacaaactccca

SEQ ID NO: 10031671 - DNA, 22 bp, Homo sapiens
atatgccagctccaagtaagag

SEQ ID NO: 10031672 - DNA, 22 bp, Homo sapiens
atattcttcttgttcagactat

SEQ ID NO: 10031673 - DNA, 22 bp, Homo sapiens
atcagaaaatacccagtgttta

SEQ ID NO: 10031674 - DNA, 22 bp, Homo sapiens
atcaaagtgatttgtaaacagg

SEQ ID NO: 10031675 - DNA, 22 bp, Homo sapiens
atatttaactggtcccaatata

SEQ ID NO: 10031676 - DNA, 23 bp, Homo sapiens
atcaaactggtgagaatgtcagt

SEQ ID NO: 10031677 - DNA, 22 bp, Homo sapiens
cttcttattaatccttctctgt

SEQ ID NO: 10031678 - DNA, 22 bp, Homo sapiens
cttcttgcaattttcatcttat

SEQ ID NO: 10031679 - DNA, 20 bp, Homo sapiens
atcagacttttaggaacata

SEQ ID NO: 10031680 - DNA, 22 bp, Homo sapiens
taatcacatcagggtaaatggg

SEQ ID NO: 10031681 - DNA, 22 bp, Homo sapiens
taatcacaattcagatgtctta

SEQ ID NO: 10031682 - DNA, 22 bp, Homo sapiens
taatcacagaaacagactgttt

SEQ ID NO: 10031683 - DNA, 22 bp, Homo sapiens
taatacagacaacttgccaaat

SEQ ID NO: 10031684 - DNA, 22 bp, Homo sapiens
caggcagagttagagcaactgg

SEQ ID NO: 10031685 - DNA, 22 bp, Homo sapiens
caggcagagttagtgatttagg

SEQ ID NO: 10031686 - DNA, 22 bp, Homo sapiens
caggcagagttagagcaactgg

SEQ ID NO: 10031687 - DNA, 22 bp, Homo sapiens
tagaaacaaagacctgggtgct

SEQ ID NO: 10031688 - DNA, 22 bp, Homo sapiens
tacattgtgttaaaacagaaga

SEQ ID NO: 10031689 - DNA, 22 bp, Homo sapiens
cagtcacttacaaaaatataat

SEQ ID NO: 10031690 - DNA, 22 bp, Homo sapiens
cagtcacttacaaaaatataat

SEQ ID NO: 10031691 - DNA, 22 bp, Homo sapiens
tcaacaaatacttaaagcagag

SEQ ID NO: 10031692 - DNA, 22 bp, Homo sapiens
cagggtttctgttgagaagtcc

SEQ ID NO: 10031693 - DNA, 22 bp, Homo sapiens
tattatcatgttaattagtggg

SEQ ID NO: 10031694 - DNA, 22 bp, Homo sapiens
tagctttaaaaatcatcaaagc

SEQ ID NO: 10031695 - DNA, 22 bp, Homo sapiens
cattcttctcccttaccttcca

SEQ ID NO: 10031696 - DNA, 22 bp, Homo sapiens
cattgttatagcattacacacc

SEQ ID NO: 10031697 - DNA, 22 bp, Homo sapiens
cattgttaattggtatcttaca

SEQ ID NO: 10031698 - DNA, 22 bp, Homo sapiens
catttaaaggttgtgggtaaaa

SEQ ID NO: 10031699 - DNA, 22 bp, Homo sapiens
ccagagaaccttgagctgtgag

SEQ ID NO: 10031700 - DNA, 22 bp, Homo sapiens
ccagagaaagtgaagcaaatgt

SEQ ID NO: 10031701 - DNA, 22 bp, Homo sapiens
ccagagaagtcttgcctggatt

SEQ ID NO: 10031702 - DNA, 22 bp, Homo sapiens
ccagagaaggtggagcttgtgt

SEQ ID NO: 10031703 - DNA, 22 bp, Homo sapiens
ccagagaattttagacaaaaat

SEQ ID NO: 10031704 - DNA, 22 bp, Homo sapiens
tctaagctagtggctcatgtga

SEQ ID NO: 10031705 - DNA, 22 bp, Homo sapiens
cataattactgatatgctgatt

SEQ ID NO: 10031706 - DNA, 22 bp, Homo sapiens
catagaatatgtgtgattgtta

SEQ ID NO: 10031707 - DNA, 17 bp, Homo sapiens
cataaaacagttctatt

SEQ ID NO: 10031708 - DNA, 22 bp, Homo sapiens
tcagtcaggttctgatttctgg

SEQ ID NO: 10031709 - DNA, 22 bp, Homo sapiens
catgcattacaattgcatagta

SEQ ID NO: 10031710 - DNA, 22 bp, Homo sapiens
catgaccaaaatcattacactg

SEQ ID NO: 10031711 - DNA, 22 bp, Homo sapiens
tgattttattgaaacttcactt

SEQ ID NO: 10031712 - DNA, 22 bp, Homo sapiens
tgcacacatgtttacaagcatc

SEQ ID NO: 10031713 - DNA, 22 bp, Homo sapiens
tgagacgaagtcttgctctgtt

SEQ ID NO: 10031714 - DNA, 22 bp, Homo sapiens
tgagacgaagtcttgctctgtt

SEQ ID NO: 10031715 - DNA, 22 bp, Homo sapiens
tctttctttatcacctgatatg

SEQ ID NO: 10031716 - DNA, 22 bp, Homo sapiens
tctttcttattatgctcaatgt

SEQ ID NO: 10031717 - DNA, 22 bp, Homo sapiens
tctttcttctttcatagtgtga

SEQ ID NO: 10031718 - DNA, 22 bp, Homo sapiens
tctttcttcagccctgtaagat

SEQ ID NO: 10031719 - DNA, 22 bp, Homo sapiens
tctttcttcctggagcccaaca

SEQ ID NO: 10031720 - DNA, 22 bp, Homo sapiens
tctttcttgcaaggatgcagga

SEQ ID NO: 10031721 - DNA, 22 bp, Homo sapiens
tctttcttggtataaagcaggg

SEQ ID NO: 10031722 - DNA, 22 bp, Homo sapiens
tctttcttgtgggtgccctttt

SEQ ID NO: 10031723 - DNA, 22 bp, Homo sapiens
tctttcttggtattctgagcta

SEQ ID NO: 10031724 - DNA, 22 bp, Homo sapiens
tctttcttattagccattgttc

SEQ ID NO: 10031725 - DNA, 22 bp, Homo sapiens
cctaacatatgtaaaggtcttt

SEQ ID NO: 10031726 - DNA, 21 bp, Homo sapiens
cccttcttactcaagctcatt

SEQ ID NO: 10031727 - DNA, 21 bp, Homo sapiens
cccttcttgggtcaaagtata

SEQ ID NO: 10031728 - DNA, 22 bp, Homo sapiens
cctcttctaccatttacatttt

SEQ ID NO: 10031729 - DNA, 22 bp, Homo sapiens
tgggccatttttggaagactgg

SEQ ID NO: 10031730 - DNA, 22 bp, Homo sapiens
tggggaggaagtcagatttcag

SEQ ID NO: 10031731 - DNA, 20 bp, Homo sapiens
ctactttaggcactgagaat

SEQ ID NO: 10031732 - DNA, 22 bp, Homo sapiens
ctactttacctccatcagactg

SEQ ID NO: 10031733 - DNA, 22 bp, Homo sapiens
ctactttaattttctgcagaga

SEQ ID NO: 10031734 - DNA, 22 bp, Homo sapiens
ttctcctttgtaattctcatcc

SEQ ID NO: 10031735 - DNA, 22 bp, Homo sapiens
ctacatttcatccagggagagc

SEQ ID NO: 10031736 - DNA, 22 bp, Homo sapiens
ctacatttacacagttaggctt

SEQ ID NO: 10031737 - DNA, 22 bp, Homo sapiens
ctcacagatgctgtgggtcagg

SEQ ID NO: 10031738 - DNA, 19 bp, Homo sapiens
ctagattatggaatgctgc

SEQ ID NO: 10031739 - DNA, 17 bp, Homo sapiens
cctttctctttcatctc

SEQ ID NO: 10031740 - DNA, 19 bp, Homo sapiens
cctttcagaacagaagcca

SEQ ID NO: 10031741 - DNA, 22 bp, Homo sapiens
cctttctaagatactgcaactt

SEQ ID NO: 10031742 - DNA, 22 bp, Homo sapiens
ttcatcttgatggcttcctaat

SEQ ID NO: 10031743 - DNA, 17 bp, Homo sapiens
cctgtcttgtttctgcc

SEQ ID NO: 10031744 - DNA, 22 bp, Homo sapiens
ttaaagctgtagagttacttgc

SEQ ID NO: 10031745 - DNA, 22 bp, Homo sapiens
ttaaagctggcgttacagtttg

SEQ ID NO: 10031746 - DNA, 22 bp, Homo sapiens
ccttcctttcagggctatgcct

SEQ ID NO: 10031747 - DNA, 22 bp, Homo sapiens
ccttcctttgcatcatttctag

SEQ ID NO: 10031748 - DNA, 22 bp, Homo sapiens
tttatttaaagtcgtgtgttaa

SEQ ID NO: 10031749 - DNA, 22 bp, Homo sapiens
tttatttaccttatgtcctcca

SEQ ID NO: 10031750 - DNA, 22 bp, Homo sapiens
tttaatcaggcaaagcataata

SEQ ID NO: 10031751 - DNA, 22 bp, Homo sapiens
tttccttgcctcctgtccttct

SEQ ID NO: 10031752 - DNA, 22 bp, Homo sapiens
tttcctatgatattctatgtgt

SEQ ID NO: 10031753 - DNA, 22 bp, Homo sapiens
tttaatatctcacacttccatg

SEQ ID NO: 10031754 - DNA, 22 bp, Homo sapiens
tttaatatttctttcctgaagc

SEQ ID NO: 10031755 - DNA, 22 bp, Homo sapiens
tttaagttccttttcaacaact

SEQ ID NO: 10031756 - DNA, 22 bp, Homo sapiens
ttgtctttcccagcttctagag

SEQ ID NO: 10031757 - DNA, 22 bp, Homo sapiens
ttgtctttggaaatttaatgtt

SEQ ID NO: 10031758 - DNA, 22 bp, Homo sapiens
ttctttctgtccataatgagac

SEQ ID NO: 10031759 - DNA, 22 bp, Homo sapiens
ttcttttcctgtggctcatcca

SEQ ID NO: 10031760 - DNA, 22 bp, Homo sapiens
ttcttttcctacacagcgattt

SEQ ID NO: 10031761 - DNA, 22 bp, Homo sapiens
ttcttttcccaatattttgctg

SEQ ID NO: 10031762 - DNA, 18 bp, Homo sapiens
ttcttttcatgtgatctc

SEQ ID NO: 10031763 - DNA, 22 bp, Homo sapiens
ctcatttactcatctgcaaaac

SEQ ID NO: 10031764 - DNA, 22 bp, Homo sapiens
ctcatttactgtagaacagtta

SEQ ID NO: 10031765 - DNA, 22 bp, Homo sapiens
ctcatttactactcatgtgacc

SEQ ID NO: 10031766 - DNA, 22 bp, Homo sapiens
ctcatttaacagattaaaaagt

SEQ ID NO: 10031767 - DNA, 22 bp, Homo sapiens
ctcatttacctttgcaatcaag

SEQ ID NO: 10031768 - DNA, 22 bp, Homo sapiens
ctcatttacactatgggaacta

SEQ ID NO: 10031769 - DNA, 22 bp, Homo sapiens
ctcatttatgtaatgattaagg

SEQ ID NO: 10031770 - DNA, 22 bp, Homo sapiens
ttttaagttaatataattgagg

SEQ ID NO: 10031771 - DNA, 22 bp, Homo sapiens
ctcttcttgctagactgagtgc

SEQ ID NO: 10031772 - DNA, 22 bp, Homo sapiens
ctcttcttggaatgctgactgt

SEQ ID NO: 10031773 - DNA, 22 bp, Homo sapiens
ctcttcttgcctgatgaggcag

SEQ ID NO: 10031774 - DNA, 22 bp, Homo sapiens
ctcttcttgaaagaggaattca

SEQ ID NO: 10031775 - DNA, 22 bp, Homo sapiens
ctcttagttttttcctcatgaa

SEQ ID NO: 10031776 - DNA, 22 bp, Homo sapiens
ctgcaccacagcctgaggcagc

SEQ ID NO: 10031777 - DNA, 22 bp, Homo sapiens
ctgcacagtggacagtgaagat

SEQ ID NO: 10031778 - DNA, 19 bp, Homo sapiens
ctctttccattgtatttgc

SEQ ID NO: 10031779 - DNA, 22 bp, Homo sapiens
ctctttctcgccgcccgcagtc

SEQ ID NO: 10031780 - DNA, 22 bp, Homo sapiens
ctctttctcattgtcagcagaa

SEQ ID NO: 10031781 - DNA, 18 bp, Homo sapiens
ctctttctttggcacaaa

SEQ ID NO: 10031782 - DNA, 22 bp, Homo sapiens
ctctttctgattcgctgggacc

SEQ ID NO: 10031783 - DNA, 22 bp, Homo sapiens
ctctttctggaaggcagagtgg

SEQ ID NO: 10031784 - DNA, 22 bp, Homo sapiens
gaagcttgaacagggccaggct

SEQ ID NO: 10031785 - DNA, 18 bp, Homo sapiens
gaatactgagagcacaaa

SEQ ID NO: 10031786 - DNA, 22 bp, Homo sapiens
gaccctgtttctacaaataatt

SEQ ID NO: 10031787 - DNA, 22 bp, Homo sapiens
gacagggtccaaaggcagggga

SEQ ID NO: 10031788 - DNA, 22 bp, Homo sapiens
ctttcagaagtatattctggaa

SEQ ID NO: 10031789 - DNA, 22 bp, Homo sapiens
ctttcagaagccggaagggcag

SEQ ID NO: 10031790 - DNA, 22 bp, Homo sapiens
ctttcagaagaggacctttcca

SEQ ID NO: 10031791 - DNA, 22 bp, Homo sapiens
gaaatcattagcaaagatatgt

SEQ ID NO: 10031792 - DNA, 22 bp, Homo sapiens
gaaatgcataatcttagtagat

SEQ ID NO: 10031793 - DNA, 22 bp, Homo sapiens
gaggcagaagttgcagtgagca

SEQ ID NO: 10031794 - DNA, 22 bp, Homo sapiens
gaggccagcgcgcagcactttt

SEQ ID NO: 10031795 - DNA, 22 bp, Homo sapiens
gagccaggggtcagctccgagg

SEQ ID NO: 10031796 - DNA, 20 bp, Homo sapiens
gagatggacagatgaagggg

SEQ ID NO: 10031797 - DNA, 22 bp, Homo sapiens
gagattataagatagagtcatt

SEQ ID NO: 10031798 - DNA, 22 bp, Homo sapiens
cttgtattcttccacttaagat

SEQ ID NO: 10031799 - DNA, 22 bp, Homo sapiens
cttgtattgctgttttgcatct

SEQ ID NO: 10031800 - DNA, 22 bp, Homo sapiens
cttgtagaattgaaatggtctc

SEQ ID NO: 10031801 - DNA, 22 bp, Homo sapiens
cttgccatcttgagttttgtta

SEQ ID NO: 10031802 - DNA, 22 bp, Homo sapiens
cttatttactgatccacagatg

SEQ ID NO: 10031803 - DNA, 22 bp, Homo sapiens
cttatttatgtctgtctctaat

SEQ ID NO: 10031804 - DNA, 22 bp, Homo sapiens
cttatttaatgagggttagaat

SEQ ID NO: 10031805 - DNA, 22 bp, Homo sapiens
ctgggccagaccttgtggtctt

SEQ ID NO: 10031806 - DNA, 22 bp, Homo sapiens
ctgggccagatccagcctcaca

SEQ ID NO: 10031807 - DNA, 22 bp, Homo sapiens
ctgggccactccagatgcccac

SEQ ID NO: 10031808 - DNA, 22 bp, Homo sapiens
ctgggccacatcagatgaagac

SEQ ID NO: 10031809 - DNA, 22 bp, Homo sapiens
ctgggccacaagcctgtgtgat

SEQ ID NO: 10031810 - DNA, 22 bp, Homo sapiens
ctgggaggcaccgcgtcgtgct

SEQ ID NO: 10031811 - DNA, 22 bp, Homo sapiens
ctgggaaattgacactgataaa

SEQ ID NO: 10031812 - DNA, 23 bp, Homo sapiens
gtatttcagcattctcagttaaa

SEQ ID NO: 10031813 - DNA, 22 bp, Homo sapiens
gtatttcacatatggatatgct

SEQ ID NO: 10031814 - DNA, 20 bp, Homo sapiens
gtacattttcaggaggggat

SEQ ID NO: 10031815 - DNA, 22 bp, Homo sapiens
gtacattttgaggttaaaacaa

SEQ ID NO: 10031816 - DNA, 22 bp, Homo sapiens
gtacattttactttgtttgaat

SEQ ID NO: 10031817 - DNA, 22 bp, Homo sapiens
gtacatttctcttgttcttatt

SEQ ID NO: 10031818 - DNA, 22 bp, Homo sapiens
gtacatttctcccaacactaaa

SEQ ID NO: 10031819 - DNA, 22 bp, Homo sapiens
gtacatttcatttaaatgatgt

SEQ ID NO: 10031820 - DNA, 22 bp, Homo sapiens
gtacatttcagtttccttaaga

SEQ ID NO: 10031821 - DNA, 22 bp, Homo sapiens
gtacatttatttttgcagcata

SEQ ID NO: 10031822 - DNA, 22 bp, Homo sapiens
gtaaaacctgcttttcaacacc

SEQ ID NO: 10031823 - DNA, 22 bp, Homo sapiens
gtacatttaggattcattgaaa

SEQ ID NO: 10031824 - DNA, 22 bp, Homo sapiens
gtgaagcagggaaggaaaggat

SEQ ID NO: 10031825 - DNA, 22 bp, Homo sapiens
ggtgtgggccctgatgtcagca

SEQ ID NO: 10031826 - DNA, 22 bp, Homo sapiens
ggtgttggaacatggtgagatt

SEQ ID NO: 10031827 - DNA, 22 bp, Homo sapiens
gggctgagggccaattcctact

SEQ ID NO: 10031828 - DNA, 22 bp, Homo sapiens
gggctgaggctaccactggtct

SEQ ID NO: 10031829 - DNA, 22 bp, Homo sapiens
gggtaggatggtagaagggacc

SEQ ID NO: 10031830 - DNA, 22 bp, Homo sapiens
ggggtggggttactcattgtgc

SEQ ID NO: 10031831 - DNA, 22 bp, Homo sapiens
ggggtgggcgtgcagggacacc

SEQ ID NO: 10031832 - DNA, 22 bp, Homo sapiens
ggctttaaggagtaaaaatgcc

SEQ ID NO: 10031833 - DNA, 22 bp, Homo sapiens
gggaggaatgcaacttatttag

SEQ ID NO: 10031834 - DNA, 21 bp, Homo sapiens
gcagactgccctgctgtcccc

SEQ ID NO: 10031835 - DNA, 22 bp, Homo sapiens
gcaaagacaaattagaactcct

SEQ ID NO: 10031836 - DNA, 22 bp, Homo sapiens
gcagatgttcgcgttaatgcat

SEQ ID NO: 10031837 - DNA, 22 bp, Homo sapiens
gcagtgaatctggcaagaattt

SEQ ID NO: 10031838 - DNA, 22 bp, Homo sapiens
gctttctacaccaagtatgtgc

SEQ ID NO: 10031839 - DNA, 22 bp, Homo sapiens
gctttctaatctatttccttac

SEQ ID NO: 10031840 - DNA, 22 bp, Homo sapiens
gctttctaggcagagatgactg

SEQ ID NO: 10031841 - DNA, 20 bp, Homo sapiens
gctttctatgagatggactg

SEQ ID NO: 10031842 - DNA, 22 bp, Homo sapiens
ggaagcagcctgaagccaaggg

SEQ ID NO: 10031843 - DNA, 22 bp, Homo sapiens
gcttctttccttgggctggaac

SEQ ID NO: 10031844 - DNA, 22 bp, Homo sapiens
gcttctttggcaaccctgacat

SEQ ID NO: 10031845 - DNA, 20 bp, Homo sapiens
gcttcttttctggcccatga

SEQ ID NO: 10031846 - DNA, 22 bp, Homo sapiens
taatactgtaacttggtgggtc

SEQ ID NO: 10031847 - DNA, 22 bp, Homo sapiens
taatactgggaaatacttgggt

SEQ ID NO: 10031848 - DNA, 22 bp, Homo sapiens
taatactgctgtgcttgagttg

SEQ ID NO: 10031849 - DNA, 22 bp, Homo sapiens
taatgtttttctcaacattgct

SEQ ID NO: 10031850 - DNA, 22 bp, Homo sapiens
taatgtttccagtctatgatgg

SEQ ID NO: 10031851 - DNA, 22 bp, Homo sapiens
tacaaagaggcagctccatttt

SEQ ID NO: 10031852 - DNA, 22 bp, Homo sapiens
tacaaagaggtaattgcatata

SEQ ID NO: 10031853 - DNA, 20 bp, Homo sapiens
tacaaagaatgaggttcagg

SEQ ID NO: 10031854 - DNA, 20 bp, Homo sapiens
tacaaagagcccctctcttc

SEQ ID NO: 10031855 - DNA, 22 bp, Homo sapiens
tacaaactgttattattattgt

SEQ ID NO: 10031856 - DNA, 22 bp, Homo sapiens
tacaaactccgaagtttgtacc

SEQ ID NO: 10031857 - DNA, 22 bp, Homo sapiens
tacaaactctttatatttcata

SEQ ID NO: 10031858 - DNA, 22 bp, Homo sapiens
tacaaagagtttggtctctaga

SEQ ID NO: 10031859 - DNA, 22 bp, Homo sapiens
tacaaagataaaatctcaccat

SEQ ID NO: 10031860 - DNA, 22 bp, Homo sapiens
tacaaagatagtgttagagtaa

SEQ ID NO: 10031861 - DNA, 22 bp, Homo sapiens
tacaaagatggaaggttatgtt

SEQ ID NO: 10031862 - DNA, 22 bp, Homo sapiens
taaggcttcttggaatactgca

SEQ ID NO: 10031863 - DNA, 22 bp, Homo sapiens
taatactgaaaggagtatcagc

SEQ ID NO: 10031864 - DNA, 22 bp, Homo sapiens
taatactgactaaagatatcaa

SEQ ID NO: 10031865 - DNA, 22 bp, Homo sapiens
taatacagtttccaagccagct

SEQ ID NO: 10031866 - DNA, 22 bp, Homo sapiens
taatacagatacaaaggaggac

SEQ ID NO: 10031867 - DNA, 22 bp, Homo sapiens
tacagcaaagaaaccctcagtc

SEQ ID NO: 10031868 - DNA, 22 bp, Homo sapiens
tacagcaataatgacaccgctc

SEQ ID NO: 10031869 - DNA, 23 bp, Homo sapiens
tacagcaaggacaacataggtgg

SEQ ID NO: 10031870 - DNA, 22 bp, Homo sapiens
tacagcaagacagaccgctcaa

SEQ ID NO: 10031871 - DNA, 21 bp, Homo sapiens
tacagcaacggaggttttcta

SEQ ID NO: 10031872 - DNA, 22 bp, Homo sapiens
tacagcaatggttctaagagtc

SEQ ID NO: 10031873 - DNA, 22 bp, Homo sapiens
tacagcaatgctacaagatgac

SEQ ID NO: 10031874 - DNA, 22 bp, Homo sapiens
tacagcaatgcctgaaatagta

SEQ ID NO: 10031875 - DNA, 22 bp, Homo sapiens
tacagaaattgccaccagctct

SEQ ID NO: 10031876 - DNA, 22 bp, Homo sapiens
tacagaaatcacatcgctttga

SEQ ID NO: 10031877 - DNA, 20 bp, Homo sapiens
tacagaaacaggacttttgg

SEQ ID NO: 10031878 - DNA, 22 bp, Homo sapiens
tacactttttactacagattct

SEQ ID NO: 10031879 - DNA, 20 bp, Homo sapiens
tacaaattttccatgtttcc

SEQ ID NO: 10031880 - DNA, 22 bp, Homo sapiens
tacatcatgtaagcagaatcat

SEQ ID NO: 10031881 - DNA, 22 bp, Homo sapiens
tacatcattttggagatgagca

SEQ ID NO: 10031882 - DNA, 22 bp, Homo sapiens
tacatctttgtctatgaccagc

SEQ ID NO: 10031883 - DNA, 19 bp, Homo sapiens
tacaggcagtttctacaat

SEQ ID NO: 10031884 - DNA, 22 bp, Homo sapiens
tacagtaagatgaaatagcaat

SEQ ID NO: 10031885 - DNA, 22 bp, Homo sapiens
taaacaagctggactgataagt

SEQ ID NO: 10031886 - DNA, 22 bp, Homo sapiens
taaagtaatccttcataaggag

SEQ ID NO: 10031887 - DNA, 22 bp, Homo sapiens
taaccaataaccaataagatac

SEQ ID NO: 10031888 - DNA, 22 bp, Homo sapiens
taaccagacagaaacagctaga

SEQ ID NO: 10031889 - DNA, 22 bp, Homo sapiens
gtgctcaataaatgtttataga

SEQ ID NO: 10031890 - DNA, 22 bp, Homo sapiens
gtttcagaggtgttcattttca

SEQ ID NO: 10031891 - DNA, 22 bp, Homo sapiens
gtttcagactattctgtttctg

SEQ ID NO: 10031892 - DNA, 22 bp, Homo sapiens
gtttcagatatatttgtactta

SEQ ID NO: 10031893 - DNA, 22 bp, Homo sapiens
gtttcagatttggtttcagaag

SEQ ID NO: 10031894 - DNA, 22 bp, Homo sapiens
tattagcacaaagcaaggtatt

SEQ ID NO: 10031895 - DNA, 22 bp, Homo sapiens
tatgtacacatacacttgtaat

SEQ ID NO: 10031896 - DNA, 22 bp, Homo sapiens
tatttctaagctgtaagtctga

SEQ ID NO: 10031897 - DNA, 22 bp, Homo sapiens
tatttctcagcattttacatcc

SEQ ID NO: 10031898 - DNA, 22 bp, Homo sapiens
tatttctcttcaaaattgatgt

SEQ ID NO: 10031899 - DNA, 22 bp, Homo sapiens
tatttaattagtgattgtagag

SEQ ID NO: 10031900 - DNA, 22 bp, Homo sapiens
tattctcagtgctataagtaga

SEQ ID NO: 10031901 - DNA, 22 bp, Homo sapiens
tattctcattagtctgtattcc

SEQ ID NO: 10031902 - DNA, 22 bp, Homo sapiens
tattctcagcaacacacatgga

SEQ ID NO: 10031903 - DNA, 22 bp, Homo sapiens
tattctcagtgctataagtaga

SEQ ID NO: 10031904 - DNA, 22 bp, Homo sapiens
tattattatgcatagcatgaaa

SEQ ID NO: 10031905 - DNA, 22 bp, Homo sapiens
tatacacatcctccaaagatag

SEQ ID NO: 10031906 - DNA, 22 bp, Homo sapiens
tatacacacctccaaagcagga

SEQ ID NO: 10031907 - DNA, 22 bp, Homo sapiens
tatacacaggaatctgtgaaaa

SEQ ID NO: 10031908 - DNA, 22 bp, Homo sapiens
tagcagaaccagtcagtgagcc

SEQ ID NO: 10031909 - DNA, 22 bp, Homo sapiens
tagcagcatttttgtagagtat

SEQ ID NO: 10031910 - DNA, 22 bp, Homo sapiens
tagctttaatgagttggtaaga

SEQ ID NO: 10031911 - DNA, 22 bp, Homo sapiens
tagctttaccatagaagagtat

SEQ ID NO: 10031912 - DNA, 22 bp, Homo sapiens
tagggagaaacaccaatttatt

SEQ ID NO: 10031913 - DNA, 22 bp, Homo sapiens
tagacacatcttcatccacaat

SEQ ID NO: 10031914 - DNA, 22 bp, Homo sapiens
tagaatgtggaggtaacagact

SEQ ID NO: 10031915 - DNA, 22 bp, Homo sapiens
tacattttctaggggaccaaga

SEQ ID NO: 10031916 - DNA, 22 bp, Homo sapiens
tagaaacattcagttgcagtcc

SEQ ID NO: 10031917 - DNA, 22 bp, Homo sapiens
tagaaacatgttctgttctgtt

SEQ ID NO: 10031918 - DNA, 22 bp, Homo sapiens
tagaaacaatgacatgcttgta

SEQ ID NO: 10031919 - DNA, 22 bp, Homo sapiens
tcagcaaggctgcattctcatc

SEQ ID NO: 10031920 - DNA, 22 bp, Homo sapiens
tcagagcacttggctcatggca

SEQ ID NO: 10031921 - DNA, 22 bp, Homo sapiens
tcagaaaataactgttagtttg

SEQ ID NO: 10031922 - DNA, 22 bp, Homo sapiens
tcagacagcttgggataactga

SEQ ID NO: 10031923 - DNA, 22 bp, Homo sapiens
tcagagaagacatcattgtgaa

SEQ ID NO: 10031924 - DNA, 22 bp, Homo sapiens
tcacttcttcagctttccttga

SEQ ID NO: 10031925 - DNA, 20 bp, Homo sapiens
tcacttcttccttttgtcta

SEQ ID NO: 10031926 - DNA, 22 bp, Homo sapiens
tcactgaatgcagatacgtgac

SEQ ID NO: 10031927 - DNA, 22 bp, Homo sapiens
tcacacatgagtaaatacaggg

SEQ ID NO: 10031928 - DNA, 22 bp, Homo sapiens
tcacaagatacagttagaagca

SEQ ID NO: 10031929 - DNA, 22 bp, Homo sapiens
tcacaaagtgaagtgtgtcatg

SEQ ID NO: 10031930 - DNA, 22 bp, Homo sapiens
tcacaaagggagggatagctgg

SEQ ID NO: 10031931 - DNA, 22 bp, Homo sapiens
tcacaaagagaattgtgggtgt

SEQ ID NO: 10031932 - DNA, 22 bp, Homo sapiens
tcacaaagctttgataagcaga

SEQ ID NO: 10031933 - DNA, 22 bp, Homo sapiens
tcacaaaggatgatgaattctg

SEQ ID NO: 10031934 - DNA, 22 bp, Homo sapiens
tcaataaaattgttttcctatc

SEQ ID NO: 10031935 - DNA, 22 bp, Homo sapiens
tatttcttgagactcgtcttcc

SEQ ID NO: 10031936 - DNA, 22 bp, Homo sapiens
tatttcttcgggattcaagcta

SEQ ID NO: 10031937 - DNA, 22 bp, Homo sapiens
tcagtgtcatcacttaatataa

SEQ ID NO: 10031938 - DNA, 22 bp, Homo sapiens
tcagtgtcagtcttttagatat

SEQ ID NO: 10031939 - DNA, 19 bp, Homo sapiens
tcagtgtccctgttaatat

SEQ ID NO: 10031940 - DNA, 22 bp, Homo sapiens
tcagtgtccataaataaagttt

SEQ ID NO: 10031941 - DNA, 22 bp, Homo sapiens
tcagtgtcccgtctcttaactc

SEQ ID NO: 10031942 - DNA, 22 bp, Homo sapiens
tcagtgcacagagatttttgtt

SEQ ID NO: 10031943 - DNA, 22 bp, Homo sapiens
tcagtgcacccaattctctcca

SEQ ID NO: 10031944 - DNA, 23 bp, Homo sapiens
tcagtgcaaaaataggattttgg

SEQ ID NO: 10031945 - DNA, 22 bp, Homo sapiens
tcattacagtgtttatatgtct

SEQ ID NO: 10031946 - DNA, 22 bp, Homo sapiens
tcattataaacatatgctaaag

SEQ ID NO: 10031947 - DNA, 22 bp, Homo sapiens
tcattatttgctttagttatgt

SEQ ID NO: 10031948 - DNA, 22 bp, Homo sapiens
tcaggagtgataccatttgtca

SEQ ID NO: 10031949 - DNA, 19 bp, Homo sapiens
tcaggcagttattcacaaa

SEQ ID NO: 10031950 - DNA, 22 bp, Homo sapiens
tttgttctgaaaatcttccctt

SEQ ID NO: 10031951 - DNA, 22 bp, Homo sapiens
tttgtttacaaaaataagcagt

SEQ ID NO: 10031952 - DNA, 22 bp, Homo sapiens
ttttaaactatagctggatgct

SEQ ID NO: 10031953 - DNA, 22 bp, Homo sapiens
tttgttttcaatgtgtcattca

SEQ ID NO: 10031954 - DNA, 22 bp, Homo sapiens
tttgcagatgagaaaactgtgg

SEQ ID NO: 10031955 - DNA, 22 bp, Homo sapiens
tttctttcaattctcctaatgc

SEQ ID NO: 10031956 - DNA, 22 bp, Homo sapiens
tttctttccatacatattgcta

SEQ ID NO: 10031957 - DNA, 22 bp, Homo sapiens
tttggcaagcgagtactttctg

SEQ ID NO: 10031958 - DNA, 22 bp, Homo sapiens
tttggcaaagatggctagctgt

SEQ ID NO: 10031959 - DNA, 22 bp, Homo sapiens
tttttctactgcccacattgta

SEQ ID NO: 10031960 - DNA, 20 bp, Homo sapiens
ttttccttgttgccgctgct

SEQ ID NO: 10031961 - DNA, 22 bp, Homo sapiens
ttttcctttcatcaggacaaag

SEQ ID NO: 10031962 - DNA, 22 bp, Homo sapiens
ttttcctttgaaaggtgagggc

SEQ ID NO: 10031963 - DNA, 19 bp, Homo sapiens
ttttccttctcctcttaat

SEQ ID NO: 10031964 - DNA, 20 bp, Homo sapiens
ttttccttctgagtatgttg

SEQ ID NO: 10031965 - DNA, 22 bp, Homo sapiens
ttttccttctgatactccattt

SEQ ID NO: 10031966 - DNA, 19 bp, Homo sapiens
ttttccttctatatgtttc

SEQ ID NO: 10031967 - DNA, 22 bp, Homo sapiens
ttttatctacctatgctcattt

SEQ ID NO: 10031968 - DNA, 22 bp, Homo sapiens
ttttcctttgattcccagatgt

SEQ ID NO: 10031969 - DNA, 22 bp, Homo sapiens
ttttcctttggaagatgcatat

SEQ ID NO: 10031970 - DNA, 23 bp, Homo sapiens
ttttcctttggacaggctgtatt

SEQ ID NO: 10031971 - DNA, 22 bp, Homo sapiens
ttttctaatttagttaccctcc

SEQ ID NO: 10031972 - DNA, 22 bp, Homo sapiens
ttttcttctacctgctgtccaa

SEQ ID NO: 10031973 - DNA, 22 bp, Homo sapiens
tttttccttaggggttactcac

SEQ ID NO: 10031974 - DNA, 22 bp, Homo sapiens
ttttggcagccacatgcacttg

SEQ ID NO: 10031975 - DNA, 22 bp, Homo sapiens
ttttggcagattacttaatatg

SEQ ID NO: 10031976 - DNA, 22 bp, Homo sapiens
tttccttctcagggagcttcaa

SEQ ID NO: 10031977 - DNA, 22 bp, Homo sapiens
tttccttccttgctagcctgag

SEQ ID NO: 10031978 - DNA, 22 bp, Homo sapiens
tttccttcctaaggtgaagcaa

SEQ ID NO: 10031979 - DNA, 22 bp, Homo sapiens
tttccttccctggatgagaagt

SEQ ID NO: 10031980 - DNA, 22 bp, Homo sapiens
tttccttccaggttcctaaggc

SEQ ID NO: 10031981 - DNA, 22 bp, Homo sapiens
tttccttcatcatctgagagct

SEQ ID NO: 10031982 - DNA, 22 bp, Homo sapiens
tttcaaagagttgtaaattact

SEQ ID NO: 10031983 - DNA, 22 bp, Homo sapiens
tttcctcttcttcccatgtcat

SEQ ID NO: 10031984 - DNA, 22 bp, Homo sapiens
tttctttaggctgtgttgccaa

SEQ ID NO: 10031985 - DNA, 22 bp, Homo sapiens
tttctttatcatagcatctttg

SEQ ID NO: 10031986 - DNA, 20 bp, Homo sapiens
tttcttgtcggctgttgctg

SEQ ID NO: 10031987 - DNA, 22 bp, Homo sapiens
tttcttccttaccttactagag

SEQ ID NO: 10031988 - DNA, 22 bp, Homo sapiens
tttcttcctggattcctacttc

SEQ ID NO: 10031989 - DNA, 22 bp, Homo sapiens
tttcttcctatgtatcttgctg

SEQ ID NO: 10031990 - DNA, 21 bp, Homo sapiens
tttcttcccttggcttctgag

SEQ ID NO: 10031991 - DNA, 22 bp, Homo sapiens
tttcttctcgacaccttatccc

SEQ ID NO: 10031992 - DNA, 22 bp, Homo sapiens
tttcttctccatggcaggtcct

SEQ ID NO: 10031993 - DNA, 22 bp, Homo sapiens
tttcttctatgtgtgatatttt

SEQ ID NO: 10031994 - DNA, 22 bp, Homo sapiens
tttcttcagagagagctttccc

SEQ ID NO: 10031995 - DNA, 22 bp, Homo sapiens
tttcttcattcaccttcacccc

SEQ ID NO: 10031996 - DNA, 22 bp, Homo sapiens
tttcttccaaaggcacgttctc

SEQ ID NO: 10031997 - DNA, 22 bp, Homo sapiens
tttctgtattttgtcataacct

SEQ ID NO: 10031998 - DNA, 22 bp, Homo sapiens
tttctgtcatagttatctttgt

SEQ ID NO: 10031999 - DNA, 22 bp, Homo sapiens
tttctgtaagtggcaaataatg

SEQ ID NO: 10032000 - DNA, 20 bp, Homo sapiens
tttctgtaaggcattaatct

SEQ ID NO: 10032001 - DNA, 22 bp, Homo sapiens
tttctcttgcgatatgctacac

SEQ ID NO: 10032002 - DNA, 22 bp, Homo sapiens
tttctctttcaatctgcagtac

SEQ ID NO: 10032003 - DNA, 22 bp, Homo sapiens
tttctctagctattcattaaat

SEQ ID NO: 10032004 - DNA, 22 bp, Homo sapiens
tttctccttgtgtctcctttga

SEQ ID NO: 10032005 - DNA, 22 bp, Homo sapiens
ttgttttattctgcaatttccc

SEQ ID NO: 10032006 - DNA, 22 bp, Homo sapiens
ttgtttaaagaacttctgactt

SEQ ID NO: 10032007 - DNA, 22 bp, Homo sapiens
ttgtccttcttcattcagtccc

SEQ ID NO: 10032008 - DNA, 23 bp, Homo sapiens
ttgtccttctgaaatatatctgg

SEQ ID NO: 10032009 - DNA, 22 bp, Homo sapiens
ttgtccttccagactcttccac

SEQ ID NO: 10032010 - DNA, 22 bp, Homo sapiens
tttatataacagagactgctat

SEQ ID NO: 10032011 - DNA, 22 bp, Homo sapiens
tttagttttgatgaaaatgcca

SEQ ID NO: 10032012 - DNA, 22 bp, Homo sapiens
tttagttttgatgaaaatgcca

SEQ ID NO: 10032013 - DNA, 22 bp, Homo sapiens
tttattatccagtgttgtcatg

SEQ ID NO: 10032014 - DNA, 22 bp, Homo sapiens
tttcaaacttaaatacctttcc

SEQ ID NO: 10032015 - DNA, 20 bp, Homo sapiens
tttcaaactgcacctttgct

SEQ ID NO: 10032016 - DNA, 22 bp, Homo sapiens
tttcaaacatatcttcattact

SEQ ID NO: 10032017 - DNA, 22 bp, Homo sapiens
tttatttcttagtttgccacag

SEQ ID NO: 10032018 - DNA, 23 bp, Homo sapiens
tttatttatttaggctgagggat

SEQ ID NO: 10032019 - DNA, 22 bp, Homo sapiens
tttactttctcaagtatatagg

SEQ ID NO: 10032020 - DNA, 22 bp, Homo sapiens
tttacttctgcatttcccctag

SEQ ID NO: 10032021 - DNA, 22 bp, Homo sapiens
tttaattatatctgggcagtta

SEQ ID NO: 10032022 - DNA, 22 bp, Homo sapiens
tttaattaggaaatgggcaggg

SEQ ID NO: 10032023 - DNA, 22 bp, Homo sapiens
ttcctctttctctgtgctatgt

SEQ ID NO: 10032024 - DNA, 20 bp, Homo sapiens
ttcctgtcctctctttcagg

SEQ ID NO: 10032025 - DNA, 22 bp, Homo sapiens
ttccttctaattttacacctga

SEQ ID NO: 10032026 - DNA, 22 bp, Homo sapiens
ttccttctagagcttgtttagg

SEQ ID NO: 10032027 - DNA, 22 bp, Homo sapiens
ttccttctctgtggggaaggca

SEQ ID NO: 10032028 - DNA, 22 bp, Homo sapiens
ttccttctccagaacttctagg

SEQ ID NO: 10032029 - DNA, 22 bp, Homo sapiens
ttccttctcagccctcgaggat

SEQ ID NO: 10032030 - DNA, 22 bp, Homo sapiens
ttccttctattcagctccaaga

SEQ ID NO: 10032031 - DNA, 22 bp, Homo sapiens
ttccttctagcccaagtattgg

SEQ ID NO: 10032032 - DNA, 22 bp, Homo sapiens
ttccttctgaagcctttgtgtt

SEQ ID NO: 10032033 - DNA, 22 bp, Homo sapiens
ttgatttatagaatgttcaagc

SEQ ID NO: 10032034 - DNA, 22 bp, Homo sapiens
ttctttattgagacttcattgt

SEQ ID NO: 10032035 - DNA, 19 bp, Homo sapiens
ttctttccacatcttctct

SEQ ID NO: 10032036 - DNA, 22 bp, Homo sapiens
ttctttatcagttactcatagg

SEQ ID NO: 10032037 - DNA, 22 bp, Homo sapiens
ttctttatgcttctgtttaggc

SEQ ID NO: 10032038 - DNA, 22 bp, Homo sapiens
ttgagcccaggaggcctgggtg

SEQ ID NO: 10032039 - DNA, 22 bp, Homo sapiens
ttcttgctcaatgtctgtttaa

SEQ ID NO: 10032040 - DNA, 18 bp, Homo sapiens
ttctttaattcagtttga

SEQ ID NO: 10032041 - DNA, 22 bp, Homo sapiens
ttctttaccactactcttccaa

SEQ ID NO: 10032042 - DNA, 20 bp, Homo sapiens
ttctttacgacctttctgca

SEQ ID NO: 10032043 - DNA, 22 bp, Homo sapiens
ttcttctttcctataattaatt

SEQ ID NO: 10032044 - DNA, 22 bp, Homo sapiens
ttcttctttccaattacatggt

SEQ ID NO: 10032045 - DNA, 22 bp, Homo sapiens
ttcttacagccctattactaaa

SEQ ID NO: 10032046 - DNA, 22 bp, Homo sapiens
ttcttctttatctcagtatcct

SEQ ID NO: 10032047 - DNA, 21 bp, Homo sapiens
ttcttcttggactgttttggc

SEQ ID NO: 10032048 - DNA, 22 bp, Homo sapiens
ttcttcttgtctgccctcacat

SEQ ID NO: 10032049 - DNA, 22 bp, Homo sapiens
ttctcttttcaccagttgctaa

SEQ ID NO: 10032050 - DNA, 21 bp, Homo sapiens
tgtgttttaatgatattctgt

SEQ ID NO: 10032051 - DNA, 22 bp, Homo sapiens
tgtgttttatctattgtatctt

SEQ ID NO: 10032052 - DNA, 22 bp, Homo sapiens
tgttatttgggaaagttgtaca

SEQ ID NO: 10032053 - DNA, 22 bp, Homo sapiens
tgtttcttgggtgctcacatca

SEQ ID NO: 10032054 - DNA, 22 bp, Homo sapiens
ttactgaaagtatacatttctg

SEQ ID NO: 10032055 - DNA, 22 bp, Homo sapiens
ttactgaaggtggatagtgagt

SEQ ID NO: 10032056 - DNA, 22 bp, Homo sapiens
ttacattttggggtaaggataa

SEQ ID NO: 10032057 - DNA, 22 bp, Homo sapiens
ttacttcttacaaaagaaatat

SEQ ID NO: 10032058 - DNA, 22 bp, Homo sapiens
ttactttagatcatactgtgtg

SEQ ID NO: 10032059 - DNA, 22 bp, Homo sapiens
ttaattctagtttaacacttag

SEQ ID NO: 10032060 - DNA, 22 bp, Homo sapiens
ttaatttatgtccaaaccagat

SEQ ID NO: 10032061 - DNA, 22 bp, Homo sapiens
ttaatttatacataatcacagg

SEQ ID NO: 10032062 - DNA, 22 bp, Homo sapiens
ttaaggctgtaagatacattca

SEQ ID NO: 10032063 - DNA, 22 bp, Homo sapiens
ttaaagcagtttgtatacatgg

SEQ ID NO: 10032064 - DNA, 22 bp, Homo sapiens
tgtttttcaaatattgctctgt

SEQ ID NO: 10032065 - DNA, 22 bp, Homo sapiens
tgttttctgatggttaatgagt

SEQ ID NO: 10032066 - DNA, 22 bp, Homo sapiens
ttaaattttagaaacagactct

SEQ ID NO: 10032067 - DNA, 22 bp, Homo sapiens
ttaacacatatttatcaattgc

SEQ ID NO: 10032068 - DNA, 22 bp, Homo sapiens
ttaacacagggggagacaaagt

SEQ ID NO: 10032069 - DNA, 22 bp, Homo sapiens
ttaaatctgttctcatgtctgt

SEQ ID NO: 10032070 - DNA, 22 bp, Homo sapiens
ctgtggctaggaagctgtggga

SEQ ID NO: 10032071 - DNA, 22 bp, Homo sapiens
atcctgggcagttttgagtgct

SEQ ID NO: 10032072 - DNA, 22 bp, Homo sapiens
atctgcagaggacaggcgagga

SEQ ID NO: 10032073 - DNA, 22 bp, Homo sapiens
atctgcaggaatgtgtgcagag

SEQ ID NO: 10032074 - DNA, 22 bp, Homo sapiens
atctgagctccgcctcctgtca

SEQ ID NO: 10032075 - DNA, 22 bp, Homo sapiens
cttccaggtgctggcctggcct

SEQ ID NO: 10032076 - DNA, 22 bp, Homo sapiens
cttagagatgggttttacttag

SEQ ID NO: 10032077 - DNA, 22 bp, Homo sapiens
atatttaactggtcccaatata

SEQ ID NO: 10032078 - DNA, 22 bp, Homo sapiens
atatttaaacagggtaccaata

SEQ ID NO: 10032079 - DNA, 22 bp, Homo sapiens
atattgtactagggttacatgt

SEQ ID NO: 10032080 - DNA, 22 bp, Homo sapiens
ctgggctcttctcaccctgttt

SEQ ID NO: 10032081 - DNA, 22 bp, Homo sapiens
ctgggctctggggtcccggtgc

SEQ ID NO: 10032082 - DNA, 22 bp, Homo sapiens
ctgggctctgcggtgtcgctct

SEQ ID NO: 10032083 - DNA, 22 bp, Homo sapiens
atattacataaacatgagtgaa

SEQ ID NO: 10032084 - DNA, 22 bp, Homo sapiens
ctgggctcacctgtggctggca

SEQ ID NO: 10032085 - DNA, 20 bp, Homo sapiens
ctgggctcaagtgatcctcc

SEQ ID NO: 10032086 - DNA, 22 bp, Homo sapiens
ctgggcctggggctgttgagag

SEQ ID NO: 10032087 - DNA, 22 bp, Homo sapiens
ctgcatcctaacctccatgcag

SEQ ID NO: 10032088 - DNA, 22 bp, Homo sapiens
ctgcatcctggaaatagctaag

SEQ ID NO: 10032089 - DNA, 22 bp, Homo sapiens
agttattactctttaacatatt

SEQ ID NO: 10032090 - DNA, 22 bp, Homo sapiens
ctgctgatgacctcaaactctt

SEQ ID NO: 10032091 - DNA, 22 bp, Homo sapiens
ctgctgatgtaagccatgctct

SEQ ID NO: 10032092 - DNA, 22 bp, Homo sapiens
ctgctgatcgaatcagtcaccc

SEQ ID NO: 10032093 - DNA, 22 bp, Homo sapiens
ctgctgatcagggcaaagcaaa

SEQ ID NO: 10032094 - DNA, 22 bp, Homo sapiens
ctggaatgggagtcagacagag

SEQ ID NO: 10032095 - DNA, 22 bp, Homo sapiens
ctggaatgaagctatgtacatt

SEQ ID NO: 10032096 - DNA, 22 bp, Homo sapiens
atacagtgccccttttcacatg

SEQ ID NO: 10032097 - DNA, 22 bp, Homo sapiens
atacagtgaatacttacagtgt

SEQ ID NO: 10032098 - DNA, 22 bp, Homo sapiens
atacagtgtactatttagcagt

SEQ ID NO: 10032099 - DNA, 22 bp, Homo sapiens
ctggctccatccttgagctctg

SEQ ID NO: 10032100 - DNA, 22 bp, Homo sapiens
ctggctccattactcagcatct

SEQ ID NO: 10032101 - DNA, 22 bp, Homo sapiens
ctggctcccatgagctctcacg

SEQ ID NO: 10032102 - DNA, 22 bp, Homo sapiens
atactacaatcataattgtaca

SEQ ID NO: 10032103 - DNA, 22 bp, Homo sapiens
ctggcccagtctcagagtgtca

SEQ ID NO: 10032104 - DNA, 22 bp, Homo sapiens
ctggcccatggtgagctctggg

SEQ ID NO: 10032105 - DNA, 22 bp, Homo sapiens
ctacatttttcaccgagcctct

SEQ ID NO: 10032106 - DNA, 22 bp, Homo sapiens
ctacccagagtgaatctcttaa

SEQ ID NO: 10032107 - DNA, 22 bp, Homo sapiens
ctacccagcacctaggctgcct

SEQ ID NO: 10032108 - DNA, 22 bp, Homo sapiens
ctacccaggctggagtgcagta

SEQ ID NO: 10032109 - DNA, 22 bp, Homo sapiens
ctacccagatccaggatggcta

SEQ ID NO: 10032110 - DNA, 22 bp, Homo sapiens
ctacattttaataagctgctta

SEQ ID NO: 10032111 - DNA, 22 bp, Homo sapiens
agtccactgccccagctcctcg

SEQ ID NO: 10032112 - DNA, 22 bp, Homo sapiens
agtccagggctctctgtgggat

SEQ ID NO: 10032113 - DNA, 22 bp, Homo sapiens
cgcagggatttcaaggggcctt

SEQ ID NO: 10032114 - DNA, 22 bp, Homo sapiens
aggtttgtttatgtatcattgg

SEQ ID NO: 10032115 - DNA, 22 bp, Homo sapiens
cctgtgacccttccagtctact

SEQ ID NO: 10032116 - DNA, 19 bp, Homo sapiens
cctgtgactatctttgtaa

SEQ ID NO: 10032117 - DNA, 22 bp, Homo sapiens
cctgtgacgtgtctcctggcac

SEQ ID NO: 10032118 - DNA, 18 bp, Homo sapiens
cctgtgacagaggcatca

SEQ ID NO: 10032119 - DNA, 22 bp, Homo sapiens
cctgtgactctgtctgatggtc

SEQ ID NO: 10032120 - DNA, 22 bp, Homo sapiens
aggtggggagtatatgtaattg

SEQ ID NO: 10032121 - DNA, 22 bp, Homo sapiens
aggtggggcccaccaatttgca

SEQ ID NO: 10032122 - DNA, 22 bp, Homo sapiens
cctgtgccaaaatctaggcagt

SEQ ID NO: 10032123 - DNA, 22 bp, Homo sapiens
cctgggctcaggcttgggcagc

SEQ ID NO: 10032124 - DNA, 22 bp, Homo sapiens
cctgggctcaccatgccttgga

SEQ ID NO: 10032125 - DNA, 20 bp, Homo sapiens
cctgggctccaggagccccg

SEQ ID NO: 10032126 - DNA, 22 bp, Homo sapiens
cctgggcttggttgttgagaac

SEQ ID NO: 10032127 - DNA, 22 bp, Homo sapiens
cctgcagaggtcaggccagaaa

SEQ ID NO: 10032128 - DNA, 22 bp, Homo sapiens
aggtagggggtttgggaactgc

SEQ ID NO: 10032129 - DNA, 22 bp, Homo sapiens
aggtccctaatcatttcacttt

SEQ ID NO: 10032130 - DNA, 22 bp, Homo sapiens
aggtccctacttatctgaaggc

SEQ ID NO: 10032131 - DNA, 21 bp, Homo sapiens
aggtccctaattaattgacct

SEQ ID NO: 10032132 - DNA, 22 bp, Homo sapiens
aggtccctgagtcagcggcgct

SEQ ID NO: 10032133 - DNA, 22 bp, Homo sapiens
aggtccctcgcacatgcagggt

SEQ ID NO: 10032134 - DNA, 19 bp, Homo sapiens
aggtccctccctcgaggct

SEQ ID NO: 10032135 - DNA, 22 bp, Homo sapiens
aggtccctaggagagtaggaag

SEQ ID NO: 10032136 - DNA, 22 bp, Homo sapiens
aggtccctcagaggcctcaccg

SEQ ID NO: 10032137 - DNA, 22 bp, Homo sapiens
aggtccctgcagcagactgcca

SEQ ID NO: 10032138 - DNA, 23 bp, Homo sapiens
aggtccctgagtcttcaaaggat

SEQ ID NO: 10032139 - DNA, 22 bp, Homo sapiens
aggtccctgcaaagctattcag

SEQ ID NO: 10032140 - DNA, 22 bp, Homo sapiens
aggtccctgggacagggcgatt

SEQ ID NO: 10032141 - DNA, 22 bp, Homo sapiens
aggtccctggtaattgacacac

SEQ ID NO: 10032142 - DNA, 22 bp, Homo sapiens
aggtccctggctagcactggaa

SEQ ID NO: 10032143 - DNA, 19 bp, Homo sapiens
aggtccctgtcacctctca

SEQ ID NO: 10032144 - DNA, 23 bp, Homo sapiens
cctggcacacagttgacatggaa

SEQ ID NO: 10032145 - DNA, 22 bp, Homo sapiens
ctcattgcaacctccgcctccc

SEQ ID NO: 10032146 - DNA, 22 bp, Homo sapiens
ctcatggagggagtgctcttcc

SEQ ID NO: 10032147 - DNA, 22 bp, Homo sapiens
ctcatgcccagagccactgttg

SEQ ID NO: 10032148 - DNA, 22 bp, Homo sapiens
agtcctggacttggagtcaggg

SEQ ID NO: 10032149 - DNA, 22 bp, Homo sapiens
agtcttatggttaaatagatgc

SEQ ID NO: 10032150 - DNA, 22 bp, Homo sapiens
ctcattgcccagatccccacag

SEQ ID NO: 10032151 - DNA, 22 bp, Homo sapiens
agtcttatgtttgtgaagaact

SEQ ID NO: 10032152 - DNA, 22 bp, Homo sapiens
ctccagctgagtaagaacacta

SEQ ID NO: 10032153 - DNA, 22 bp, Homo sapiens
ctccagcttccctcagctgtgg

SEQ ID NO: 10032154 - DNA, 22 bp, Homo sapiens
ctccagcttctgcccagagact

SEQ ID NO: 10032155 - DNA, 22 bp, Homo sapiens
ctccagctttttcccagttggc

SEQ ID NO: 10032156 - DNA, 22 bp, Homo sapiens
ctccaggaaaatagggaatgag

SEQ ID NO: 10032157 - DNA, 22 bp, Homo sapiens
ctccaggaaagcctgaggcccg

SEQ ID NO: 10032158 - DNA, 22 bp, Homo sapiens
ctccctcagaggagcacctgtt

SEQ ID NO: 10032159 - DNA, 22 bp, Homo sapiens
ctccctctcaccggagccctgg

SEQ ID NO: 10032160 - DNA, 22 bp, Homo sapiens
ctcccaggttgattctttccct

SEQ ID NO: 10032161 - DNA, 19 bp, Homo sapiens
agtggcagatctggaagta

SEQ ID NO: 10032162 - DNA, 19 bp, Homo sapiens
agtggcagatctggaagta

SEQ ID NO: 10032163 - DNA, 22 bp, Homo sapiens
agtggcagagtgcactcaggca

SEQ ID NO: 10032164 - DNA, 22 bp, Homo sapiens
agtggcagaagccaagtctgca

SEQ ID NO: 10032165 - DNA, 22 bp, Homo sapiens
agtggcagagtgcactcaggca

SEQ ID NO: 10032166 - DNA, 22 bp, Homo sapiens
agtggcagaggttgactgcagt

SEQ ID NO: 10032167 - DNA, 22 bp, Homo sapiens
ctctgggctgccttttagctct

SEQ ID NO: 10032168 - DNA, 19 bp, Homo sapiens
ctctgggctgcatcttggt

SEQ ID NO: 10032169 - DNA, 20 bp, Homo sapiens
ctctgggctgcgttgcaaac

SEQ ID NO: 10032170 - DNA, 22 bp, Homo sapiens
ctctgggcttacctgcttcctg

SEQ ID NO: 10032171 - DNA, 22 bp, Homo sapiens
ctctgggcttcaagtcagattt

SEQ ID NO: 10032172 - DNA, 22 bp, Homo sapiens
ctctgggcttcctttgtgggtt

SEQ ID NO: 10032173 - DNA, 21 bp, Homo sapiens
ctctgggacatttcttagcag

SEQ ID NO: 10032174 - DNA, 22 bp, Homo sapiens
ctctgggaaagattgtgcaggc

SEQ ID NO: 10032175 - DNA, 22 bp, Homo sapiens
ctctgggcttgttgacctgcac

SEQ ID NO: 10032176 - DNA, 22 bp, Homo sapiens
ctctgctcaccagccatgtgat

SEQ ID NO: 10032177 - DNA, 22 bp, Homo sapiens
ctctgcctgtgtcgccaccaca

SEQ ID NO: 10032178 - DNA, 22 bp, Homo sapiens
ctctggcttctaccttgcagtt

SEQ ID NO: 10032179 - DNA, 22 bp, Homo sapiens
ctctgcctgcccaccgacccat

SEQ ID NO: 10032180 - DNA, 22 bp, Homo sapiens
ctctgcctgccactgttcaggc

SEQ ID NO: 10032181 - DNA, 22 bp, Homo sapiens
ctgactttgacttggtcattga

SEQ ID NO: 10032182 - DNA, 21 bp, Homo sapiens
cagtgtggtgaccagggtctc

SEQ ID NO: 10032183 - DNA, 23 bp, Homo sapiens
aggatgtaggatgtatggcagag

SEQ ID NO: 10032184 - DNA, 22 bp, Homo sapiens
ccacagtttcttcatctataaa

SEQ ID NO: 10032185 - DNA, 22 bp, Homo sapiens
ccacagttattcatttgtgaca

SEQ ID NO: 10032186 - DNA, 22 bp, Homo sapiens
aggcaagaacagacatgggagt

SEQ ID NO: 10032187 - DNA, 22 bp, Homo sapiens
aggcaacttttggggatgatgg

SEQ ID NO: 10032188 - DNA, 22 bp, Homo sapiens
aggcaagcattgggaacagggc

SEQ ID NO: 10032189 - DNA, 22 bp, Homo sapiens
aggcaagcccccagtgaggctc

SEQ ID NO: 10032190 - DNA, 22 bp, Homo sapiens
aggcaagcatttaaccactcat

SEQ ID NO: 10032191 - DNA, 22 bp, Homo sapiens
aggcaagcgcagaagcggagga

SEQ ID NO: 10032192 - DNA, 22 bp, Homo sapiens
aggcaagctgcagagagtcctt

SEQ ID NO: 10032193 - DNA, 22 bp, Homo sapiens
cagtaaagcatgtatgtcttca

SEQ ID NO: 10032194 - DNA, 22 bp, Homo sapiens
aggacagagggaccagagccca

SEQ ID NO: 10032195 - DNA, 22 bp, Homo sapiens
aggacagacctaggactggagc

SEQ ID NO: 10032196 - DNA, 22 bp, Homo sapiens
cagggcagtaacgggaacatct

SEQ ID NO: 10032197 - DNA, 22 bp, Homo sapiens
agctttgcatactttgggctgt

SEQ ID NO: 10032198 - DNA, 22 bp, Homo sapiens
aggaaaggcctttgcatttggt

SEQ ID NO: 10032199 - DNA, 22 bp, Homo sapiens
aggaagagcccgggtgacataa

SEQ ID NO: 10032200 - DNA, 22 bp, Homo sapiens
aggaagagcattcacatggtag

SEQ ID NO: 10032201 - DNA, 22 bp, Homo sapiens
caggcagagtgaggtggtctaa

SEQ ID NO: 10032202 - DNA, 22 bp, Homo sapiens
caggcagcctgcggtctgcaca

SEQ ID NO: 10032203 - DNA, 22 bp, Homo sapiens
caggcagccttctcgtctcaca

SEQ ID NO: 10032204 - DNA, 22 bp, Homo sapiens
caggcagcgctcgtggcctggc

SEQ ID NO: 10032205 - DNA, 22 bp, Homo sapiens
caggcagcgtcctgcttcctgt

SEQ ID NO: 10032206 - DNA, 22 bp, Homo sapiens
caggcagctagatttataacaa

SEQ ID NO: 10032207 - DNA, 22 bp, Homo sapiens
caggcagctcaaccttgggagc

SEQ ID NO: 10032208 - DNA, 22 bp, Homo sapiens
caggcagctcgatgccttgttg

SEQ ID NO: 10032209 - DNA, 22 bp, Homo sapiens
caggcaggtcagtgaagaagga

SEQ ID NO: 10032210 - DNA, 22 bp, Homo sapiens
agcttcctgttgagagagggag

SEQ ID NO: 10032211 - DNA, 22 bp, Homo sapiens
agcttcctgatgcaagagggct

SEQ ID NO: 10032212 - DNA, 22 bp, Homo sapiens
agcttcccaaggttggaaggtt

SEQ ID NO: 10032213 - DNA, 18 bp, Homo sapiens
agcttccctctgagaggg

SEQ ID NO: 10032214 - DNA, 22 bp, Homo sapiens
agcttccattaactgctacact

SEQ ID NO: 10032215 - DNA, 22 bp, Homo sapiens
caggagaaatgtggctgctacc

SEQ ID NO: 10032216 - DNA, 22 bp, Homo sapiens
cagctgttcttgggacagacag

SEQ ID NO: 10032217 - DNA, 22 bp, Homo sapiens
caggacctaactcacctgtctc

SEQ ID NO: 10032218 - DNA, 22 bp, Homo sapiens
cagctgttcacatttccaaaac

SEQ ID NO: 10032219 - DNA, 22 bp, Homo sapiens
cagctgttcggggctggcatgt

SEQ ID NO: 10032220 - DNA, 22 bp, Homo sapiens
cagctgttactctgagtaaatg

SEQ ID NO: 10032221 - DNA, 21 bp, Homo sapiens
cccacggaatgatgaggcact

SEQ ID NO: 10032222 - DNA, 17 bp, Homo sapiens
cccacggaggtgtgaaa

SEQ ID NO: 10032223 - DNA, 20 bp, Homo sapiens
aggctctgcctgcaggccca

SEQ ID NO: 10032224 - DNA, 22 bp, Homo sapiens
aggctctgggaagcagtgagtt

SEQ ID NO: 10032225 - DNA, 20 bp, Homo sapiens
ccaggcctgggcctgctcta

SEQ ID NO: 10032226 - DNA, 22 bp, Homo sapiens
ccaggccttccagtacgcagaa

SEQ ID NO: 10032227 - DNA, 22 bp, Homo sapiens
ccaggtggtgaaagtgggccct

SEQ ID NO: 10032228 - DNA, 22 bp, Homo sapiens
aggccctgacctgggagatcta

SEQ ID NO: 10032229 - DNA, 22 bp, Homo sapiens
aggccctgcccagagctcctcg

SEQ ID NO: 10032230 - DNA, 23 bp, Homo sapiens
aggccctgcctgtccctcttttt

SEQ ID NO: 10032231 - DNA, 22 bp, Homo sapiens
aggccctgcccagtgccacaag

SEQ ID NO: 10032232 - DNA, 22 bp, Homo sapiens
aggccctgcggaaatgatcatt

SEQ ID NO: 10032233 - DNA, 22 bp, Homo sapiens
ccagccagctgcccttggggcc

SEQ ID NO: 10032234 - DNA, 22 bp, Homo sapiens
ccagagtctatgagtcctcatt

SEQ ID NO: 10032235 - DNA, 19 bp, Homo sapiens
aggcaggtgcagaggtccc

SEQ ID NO: 10032236 - DNA, 22 bp, Homo sapiens
aggcaggtcccctggaaggcac

SEQ ID NO: 10032237 - DNA, 22 bp, Homo sapiens
ccaggcaccatgttcttaggac

SEQ ID NO: 10032238 - DNA, 22 bp, Homo sapiens
ccaggcacggtggctcatgcct

SEQ ID NO: 10032239 - DNA, 22 bp, Homo sapiens
ccaggcactcagagactgggac

SEQ ID NO: 10032240 - DNA, 22 bp, Homo sapiens
ccaggcactgctcgaggtgcta

SEQ ID NO: 10032241 - DNA, 22 bp, Homo sapiens
ccaggcactggctgggttcttt

SEQ ID NO: 10032242 - DNA, 21 bp, Homo sapiens
aggccctggaggtcagagaaa

SEQ ID NO: 10032243 - DNA, 22 bp, Homo sapiens
aggccctgctgaggcctccctc

SEQ ID NO: 10032244 - DNA, 22 bp, Homo sapiens
aggccctggacactcaagccgg

SEQ ID NO: 10032245 - DNA, 22 bp, Homo sapiens
aggccctgctttccagagctca

SEQ ID NO: 10032246 - DNA, 22 bp, Homo sapiens
agggggtgtctctgattgggtt

SEQ ID NO: 10032247 - DNA, 22 bp, Homo sapiens
agggggtgcccagatgaaggat

SEQ ID NO: 10032248 - DNA, 22 bp, Homo sapiens
cctgagtcccctcattcactct

SEQ ID NO: 10032249 - DNA, 22 bp, Homo sapiens
cctgagtctgtgttttcctaag

SEQ ID NO: 10032250 - DNA, 21 bp, Homo sapiens
cctgagtccctgttacagaca

SEQ ID NO: 10032251 - DNA, 22 bp, Homo sapiens
cctgagtcccataatgttgcca

SEQ ID NO: 10032252 - DNA, 22 bp, Homo sapiens
cctgagtcccctcattcactct

SEQ ID NO: 10032253 - DNA, 22 bp, Homo sapiens
cctcagggtcatcctagtaata

SEQ ID NO: 10032254 - DNA, 22 bp, Homo sapiens
ccctggccagggcacagggagg

SEQ ID NO: 10032255 - DNA, 22 bp, Homo sapiens
agggacagtctactgttcactg

SEQ ID NO: 10032256 - DNA, 22 bp, Homo sapiens
agggagcttctggcctcagcct

SEQ ID NO: 10032257 - DNA, 22 bp, Homo sapiens
agggagcttccgaactacagct

SEQ ID NO: 10032258 - DNA, 21 bp, Homo sapiens
agggagctggccacacagcct

SEQ ID NO: 10032259 - DNA, 22 bp, Homo sapiens
agggagctgagctgtgagcagc

SEQ ID NO: 10032260 - DNA, 22 bp, Homo sapiens
cccaggaaatcaggctttctag

SEQ ID NO: 10032261 - DNA, 22 bp, Homo sapiens
cccaggaactccagagctcctc

SEQ ID NO: 10032262 - DNA, 22 bp, Homo sapiens
cccaggaagaaattctgatttg

SEQ ID NO: 10032263 - DNA, 22 bp, Homo sapiens
cccaggaacctaccagctcgag

SEQ ID NO: 10032264 - DNA, 22 bp, Homo sapiens
cccaggaacagggctcagaccc

SEQ ID NO: 10032265 - DNA, 22 bp, Homo sapiens
cccaggaacagcacagaacagc

SEQ ID NO: 10032266 - DNA, 22 bp, Homo sapiens
cccaggaaatgaacttctgatt

SEQ ID NO: 10032267 - DNA, 22 bp, Homo sapiens
cccaggaaatgggctcttgcct

SEQ ID NO: 10032268 - DNA, 22 bp, Homo sapiens
cccaggaagagtgagtggcatt

SEQ ID NO: 10032269 - DNA, 22 bp, Homo sapiens
cccaggaagaggggtcaggtgt

SEQ ID NO: 10032270 - DNA, 22 bp, Homo sapiens
cccaggaatgagcaggcagggg

SEQ ID NO: 10032271 - DNA, 22 bp, Homo sapiens
cccaggaagtggaggttgcagt

SEQ ID NO: 10032272 - DNA, 22 bp, Homo sapiens
cccctgggtccaggcttctctg

SEQ ID NO: 10032273 - DNA, 21 bp, Homo sapiens
cccctgggagccctgtcagta

SEQ ID NO: 10032274 - DNA, 22 bp, Homo sapiens
cccctggggatcagctggaatt

SEQ ID NO: 10032275 - DNA, 22 bp, Homo sapiens
ccctgaggatagggcaggaccc

SEQ ID NO: 10032276 - DNA, 22 bp, Homo sapiens
ccctgaggggcttactttgccc

SEQ ID NO: 10032277 - DNA, 22 bp, Homo sapiens
ccctgaggggagtggtgaggtg

SEQ ID NO: 10032278 - DNA, 22 bp, Homo sapiens
ccctgagtcatcattgcggaag

SEQ ID NO: 10032279 - DNA, 22 bp, Homo sapiens
ccctgagttagtacagttgagt

SEQ ID NO: 10032280 - DNA, 22 bp, Homo sapiens
ccctgaggccctcctggggtct

SEQ ID NO: 10032281 - DNA, 22 bp, Homo sapiens
ccctgaggcacaggccacgtat

SEQ ID NO: 10032282 - DNA, 22 bp, Homo sapiens
ccctgaggcaaaggctagagtt

SEQ ID NO: 10032283 - DNA, 22 bp, Homo sapiens
cccaggtggcagaagctgcagt

SEQ ID NO: 10032284 - DNA, 22 bp, Homo sapiens
cccaggtgctgcgtgaagcctc

SEQ ID NO: 10032285 - DNA, 21 bp, Homo sapiens
agggagctttaggtagaagtt

SEQ ID NO: 10032286 - DNA, 22 bp, Homo sapiens
cccctgagattctggcttggga

SEQ ID NO: 10032287 - DNA, 22 bp, Homo sapiens
agggcagaagtacagacactta

SEQ ID NO: 10032288 - DNA, 22 bp, Homo sapiens
gggcagcataacaatcactgaa

SEQ ID NO: 10032289 - DNA, 22 bp, Homo sapiens
gggcagcattctgtgggcaggt

SEQ ID NO: 10032290 - DNA, 22 bp, Homo sapiens
cagagacaggaatcagctgcag

SEQ ID NO: 10032291 - DNA, 22 bp, Homo sapiens
gggcagtggttacacagctgag

SEQ ID NO: 10032292 - DNA, 20 bp, Homo sapiens
gggcagtggcgctatctcag

SEQ ID NO: 10032293 - DNA, 22 bp, Homo sapiens
cagacctgggtccctggcctgt

SEQ ID NO: 10032294 - DNA, 19 bp, Homo sapiens
cagacctgtccagcctgtg

SEQ ID NO: 10032295 - DNA, 22 bp, Homo sapiens
cagacctgaggagcactgagcc

SEQ ID NO: 10032296 - DNA, 21 bp, Homo sapiens
cagaccctctagaggccacct

SEQ ID NO: 10032297 - DNA, 22 bp, Homo sapiens
cagaggcacaagaaagcaaggc

SEQ ID NO: 10032298 - DNA, 20 bp, Homo sapiens
cagaggcaaggagacttgga

SEQ ID NO: 10032299 - DNA, 22 bp, Homo sapiens
cagaggcaaaagaggtggaggt

SEQ ID NO: 10032300 - DNA, 22 bp, Homo sapiens
cagaggattccctagtgacctg

SEQ ID NO: 10032301 - DNA, 22 bp, Homo sapiens
cagaggatgatctggcctctct

SEQ ID NO: 10032302 - DNA, 22 bp, Homo sapiens
cagagctgggatcccatgggcg

SEQ ID NO: 10032303 - DNA, 22 bp, Homo sapiens
cagagcctctgccctgggcact

SEQ ID NO: 10032304 - DNA, 19 bp, Homo sapiens
cagagcctcagagctagaa

SEQ ID NO: 10032305 - DNA, 22 bp, Homo sapiens
gggctctgtgttctagctctcg

SEQ ID NO: 10032306 - DNA, 22 bp, Homo sapiens
gggcagtgtcgaggtctggtcc

SEQ ID NO: 10032307 - DNA, 22 bp, Homo sapiens
ggtgacagttccggaggtacag

SEQ ID NO: 10032308 - DNA, 22 bp, Homo sapiens
cagagggaaaaggggagtaata

SEQ ID NO: 10032309 - DNA, 22 bp, Homo sapiens
ggtcagtgcctatcatgtgggc

SEQ ID NO: 10032310 - DNA, 22 bp, Homo sapiens
ggtcagtgtttcatctgtgaaa

SEQ ID NO: 10032311 - DNA, 23 bp, Homo sapiens
gtgctgtgagccccttggcctcc

SEQ ID NO: 10032312 - DNA, 20 bp, Homo sapiens
gtgcccagttggtgacagac

SEQ ID NO: 10032313 - DNA, 18 bp, Homo sapiens
gtgctgtgggcagtggcc

SEQ ID NO: 10032314 - DNA, 22 bp, Homo sapiens
gtgctgtgtgatccatgctggc

SEQ ID NO: 10032315 - DNA, 22 bp, Homo sapiens
cagccctgaaacaacctcctct

SEQ ID NO: 10032316 - DNA, 22 bp, Homo sapiens
cagccctgcagctggatctcac

SEQ ID NO: 10032317 - DNA, 22 bp, Homo sapiens
cagccctgctgacactgtctga

SEQ ID NO: 10032318 - DNA, 22 bp, Homo sapiens
cagctacacgtgcccctggggt

SEQ ID NO: 10032319 - DNA, 22 bp, Homo sapiens
cagctactcctcccatgacttc

SEQ ID NO: 10032320 - DNA, 22 bp, Homo sapiens
cagctagcttccctgcagtgct

SEQ ID NO: 10032321 - DNA, 22 bp, Homo sapiens
cagctagctaagaaggccagag

SEQ ID NO: 10032322 - DNA, 22 bp, Homo sapiens
cagcagctgatggggaagtgat

SEQ ID NO: 10032323 - DNA, 22 bp, Homo sapiens
cagcaccttccttaactccagg

SEQ ID NO: 10032324 - DNA, 22 bp, Homo sapiens
cagcacctgctcttagacacgg

SEQ ID NO: 10032325 - DNA, 22 bp, Homo sapiens
cagcaggctctgagtggctgcc

SEQ ID NO: 10032326 - DNA, 22 bp, Homo sapiens
cagcaggctctgagtggctgcc

SEQ ID NO: 10032327 - DNA, 22 bp, Homo sapiens
gtcatcttaaggactgctatag

SEQ ID NO: 10032328 - DNA, 22 bp, Homo sapiens
gtccctgggtctaaggcagtaa

SEQ ID NO: 10032329 - DNA, 22 bp, Homo sapiens
gtccctgggggtttaggactca

SEQ ID NO: 10032330 - DNA, 22 bp, Homo sapiens
gtccctgggtagctcagtggct

SEQ ID NO: 10032331 - DNA, 19 bp, Homo sapiens
gtccctgggcagaggcacc

SEQ ID NO: 10032332 - DNA, 22 bp, Homo sapiens
gtccctgggaaaggagagggca

SEQ ID NO: 10032333 - DNA, 22 bp, Homo sapiens
gtccctggggaatcagctggag

SEQ ID NO: 10032334 - DNA, 22 bp, Homo sapiens
gtccctggatctgggacagctg

SEQ ID NO: 10032335 - DNA, 22 bp, Homo sapiens
cagccaggcccccgagtcgttg

SEQ ID NO: 10032336 - DNA, 22 bp, Homo sapiens
cagccaggcctggtgaccaaag

SEQ ID NO: 10032337 - DNA, 22 bp, Homo sapiens
gtctgtctcctgggtgcgcacc

SEQ ID NO: 10032338 - DNA, 22 bp, Homo sapiens
gtctgtgcagttactagctggt

SEQ ID NO: 10032339 - DNA, 22 bp, Homo sapiens
ggccgctctccggtgtggatct

SEQ ID NO: 10032340 - DNA, 22 bp, Homo sapiens
caccttcagaatgctccaggca

SEQ ID NO: 10032341 - DNA, 21 bp, Homo sapiens
ggccctggttacgcctcctct

SEQ ID NO: 10032342 - DNA, 22 bp, Homo sapiens
ggccactgctctccagcctggg

SEQ ID NO: 10032343 - DNA, 22 bp, Homo sapiens
ggccactgcctccgccatggct

SEQ ID NO: 10032344 - DNA, 22 bp, Homo sapiens
ggccactgtcctctagcccaga

SEQ ID NO: 10032345 - DNA, 22 bp, Homo sapiens
cacagtgtgggcatggtgcctg

SEQ ID NO: 10032346 - DNA, 22 bp, Homo sapiens
cacagttttatcttatactgat

SEQ ID NO: 10032347 - DNA, 22 bp, Homo sapiens
cacagtttggttttgctgtaat

SEQ ID NO: 10032348 - DNA, 22 bp, Homo sapiens
cacagtgttccagagcagtggt

SEQ ID NO: 10032349 - DNA, 22 bp, Homo sapiens
cacagttttgtcttggtttcca

SEQ ID NO: 10032350 - DNA, 22 bp, Homo sapiens
cacagttttgcccagggcttct

SEQ ID NO: 10032351 - DNA, 22 bp, Homo sapiens
cacatttaattggtttagggtg

SEQ ID NO: 10032352 - DNA, 22 bp, Homo sapiens
ggcaggcaggagcgtgcttggg

SEQ ID NO: 10032353 - DNA, 22 bp, Homo sapiens
ggcaggcatcatgtggtcatta

SEQ ID NO: 10032354 - DNA, 22 bp, Homo sapiens
ggctctgggttctgcaatgcgt

SEQ ID NO: 10032355 - DNA, 18 bp, Homo sapiens
ggctccagtcttcagtgg

SEQ ID NO: 10032356 - DNA, 22 bp, Homo sapiens
ggctccaggtgcatgccaggct

SEQ ID NO: 10032357 - DNA, 22 bp, Homo sapiens
ggcctgaggcaatagtcagaca

SEQ ID NO: 10032358 - DNA, 22 bp, Homo sapiens
ggcctgtgtcctccttgccctg

SEQ ID NO: 10032359 - DNA, 22 bp, Homo sapiens
ggcctgtggctttggcgtctaa

SEQ ID NO: 10032360 - DNA, 20 bp, Homo sapiens
cacagagtcttgcagcgttc

SEQ ID NO: 10032361 - DNA, 22 bp, Homo sapiens
cacagagtggaggcttggcctg

SEQ ID NO: 10032362 - DNA, 22 bp, Homo sapiens
cacagataaggatgttaatttt

SEQ ID NO: 10032363 - DNA, 22 bp, Homo sapiens
cacagatagaccttatgagatt

SEQ ID NO: 10032364 - DNA, 22 bp, Homo sapiens
ggagcccttctattccatggag

SEQ ID NO: 10032365 - DNA, 22 bp, Homo sapiens
ggaggcaggaaagacaggttca

SEQ ID NO: 10032366 - DNA, 22 bp, Homo sapiens
cacaggaatataagtttgagtt

SEQ ID NO: 10032367 - DNA, 22 bp, Homo sapiens
caagtaaagaatcacatttctt

SEQ ID NO: 10032368 - DNA, 22 bp, Homo sapiens
caagtaaacaatatgtgattca

SEQ ID NO: 10032369 - DNA, 22 bp, Homo sapiens
caagtttgtgttctatcattct

SEQ ID NO: 10032370 - DNA, 22 bp, Homo sapiens
gctttgccacattcttcacatt

SEQ ID NO: 10032371 - DNA, 22 bp, Homo sapiens
gctttgccttgaactctcatgt

SEQ ID NO: 10032372 - DNA, 22 bp, Homo sapiens
gctttgcctcttctccttccag

SEQ ID NO: 10032373 - DNA, 22 bp, Homo sapiens
gctttgcctgtagcattggcct

SEQ ID NO: 10032374 - DNA, 22 bp, Homo sapiens
gctttgcctgccatatggggtc

SEQ ID NO: 10032375 - DNA, 22 bp, Homo sapiens
gctggaggaggaagtgtgaggg

SEQ ID NO: 10032376 - DNA, 22 bp, Homo sapiens
gcagtgttaccttgggctggtt

SEQ ID NO: 10032377 - DNA, 22 bp, Homo sapiens
gcagtgttacttggagtactaa

SEQ ID NO: 10032378 - DNA, 22 bp, Homo sapiens
gcagtgttaatgcgagtgttca

SEQ ID NO: 10032379 - DNA, 22 bp, Homo sapiens
gcagtgttacctcttcagtggg

SEQ ID NO: 10032380 - DNA, 22 bp, Homo sapiens
gcagtgttaaacaactgctgct

SEQ ID NO: 10032381 - DNA, 22 bp, Homo sapiens
gcatatgatcacgtgtgtcggt

SEQ ID NO: 10032382 - DNA, 22 bp, Homo sapiens
attccttgtatatctacatgca

SEQ ID NO: 10032383 - DNA, 22 bp, Homo sapiens
attccttggcattctggacttg

SEQ ID NO: 10032384 - DNA, 22 bp, Homo sapiens
attccttgggaattattgaatg

SEQ ID NO: 10032385 - DNA, 22 bp, Homo sapiens
attccttgggctgccttattat

SEQ ID NO: 10032386 - DNA, 22 bp, Homo sapiens
gcagctgccttcagctggatgg

SEQ ID NO: 10032387 - DNA, 22 bp, Homo sapiens
gcagctgctggagggaggcagg

SEQ ID NO: 10032388 - DNA, 22 bp, Homo sapiens
attccttgctctcatcaacctt

SEQ ID NO: 10032389 - DNA, 22 bp, Homo sapiens
attccttggaacagatgcgaag

SEQ ID NO: 10032390 - DNA, 22 bp, Homo sapiens
attccttgcacatcagatagtt

SEQ ID NO: 10032391 - DNA, 19 bp, Homo sapiens
gcagctgcttgaaaagaaa

SEQ ID NO: 10032392 - DNA, 22 bp, Homo sapiens
gcagatgcttggcactgacagt

SEQ ID NO: 10032393 - DNA, 22 bp, Homo sapiens
gcagcagagctttgtcctggct

SEQ ID NO: 10032394 - DNA, 22 bp, Homo sapiens
attagtgttcttatcttctagg

SEQ ID NO: 10032395 - DNA, 22 bp, Homo sapiens
attagtgtctgtgaataattct

SEQ ID NO: 10032396 - DNA, 22 bp, Homo sapiens
attagtgtacatctcacacgca

SEQ ID NO: 10032397 - DNA, 22 bp, Homo sapiens
attagaaaccaagaggcaggct

SEQ ID NO: 10032398 - DNA, 22 bp, Homo sapiens
attagaaaaactcaagggctct

SEQ ID NO: 10032399 - DNA, 22 bp, Homo sapiens
caaaatgcatctgagaccaggc

SEQ ID NO: 10032400 - DNA, 22 bp, Homo sapiens
caaatgcatgagaaataagagg

SEQ ID NO: 10032401 - DNA, 17 bp, Homo sapiens
gctgaccctggagaagt

SEQ ID NO: 10032402 - DNA, 22 bp, Homo sapiens
gcctggattccttgtttctcag

SEQ ID NO: 10032403 - DNA, 22 bp, Homo sapiens
gcctgaagtttcatgcctctat

SEQ ID NO: 10032404 - DNA, 22 bp, Homo sapiens
gcctgaagaacagctgtgagga

SEQ ID NO: 10032405 - DNA, 19 bp, Homo sapiens
gcctctgagggcaggacac

SEQ ID NO: 10032406 - DNA, 22 bp, Homo sapiens
atggcttggcaccatctccttg

SEQ ID NO: 10032407 - DNA, 22 bp, Homo sapiens
gagagaggcctccatgtactga

SEQ ID NO: 10032408 - DNA, 22 bp, Homo sapiens
atggagggtgtcagagagcgaa

SEQ ID NO: 10032409 - DNA, 21 bp, Homo sapiens
atggagggaccagggaagcag

SEQ ID NO: 10032410 - DNA, 22 bp, Homo sapiens
atggagggtggtaagacagaga

SEQ ID NO: 10032411 - DNA, 22 bp, Homo sapiens
gaggcagcatctatggtgggaa

SEQ ID NO: 10032412 - DNA, 22 bp, Homo sapiens
atggtggctcatgcatgcaatc

SEQ ID NO: 10032413 - DNA, 22 bp, Homo sapiens
atggtggtgaagagcacagtga

SEQ ID NO: 10032414 - DNA, 22 bp, Homo sapiens
gaggcagcattcgcatagacag

SEQ ID NO: 10032415 - DNA, 22 bp, Homo sapiens
gaggcagcatggtaccttggag

SEQ ID NO: 10032416 - DNA, 22 bp, Homo sapiens
gaggcagcctcagtggacctcg

SEQ ID NO: 10032417 - DNA, 22 bp, Homo sapiens
gaggcagccagaggttctcatt

SEQ ID NO: 10032418 - DNA, 22 bp, Homo sapiens
gaggcagcggctcacagagaaa

SEQ ID NO: 10032419 - DNA, 22 bp, Homo sapiens
gaggcagcgggtcaggaccgtg

SEQ ID NO: 10032420 - DNA, 22 bp, Homo sapiens
gaggtggcctcaagcagtcttc

SEQ ID NO: 10032421 - DNA, 22 bp, Homo sapiens
gaggtggccagagtcaagagcc

SEQ ID NO: 10032422 - DNA, 22 bp, Homo sapiens
atgatgctgtttatcatatact

SEQ ID NO: 10032423 - DNA, 22 bp, Homo sapiens
cttcttgtcaatttgccattgt

SEQ ID NO: 10032424 - DNA, 22 bp, Homo sapiens
atctggccctctcagccctgtt

SEQ ID NO: 10032425 - DNA, 22 bp, Homo sapiens
gacggcagaaactcatgaggtc

SEQ ID NO: 10032426 - DNA, 22 bp, Homo sapiens
gaccctggagccgtctgaggca

SEQ ID NO: 10032427 - DNA, 22 bp, Homo sapiens
gaccctggagttagtcctgtgt

SEQ ID NO: 10032428 - DNA, 22 bp, Homo sapiens
gaccctggcagataccgtcaca

SEQ ID NO: 10032429 - DNA, 22 bp, Homo sapiens
gacacagtttttctcacggtgg

SEQ ID NO: 10032430 - DNA, 19 bp, Homo sapiens
gacacagttggttcctttg

SEQ ID NO: 10032431 - DNA, 22 bp, Homo sapiens
gacatttatgaaggagatatgc

SEQ ID NO: 10032432 - DNA, 22 bp, Homo sapiens
gacatttattggattttacgag

SEQ ID NO: 10032433 - DNA, 22 bp, Homo sapiens
cagcatggacccatcgctgagt

SEQ ID NO: 10032434 - DNA, 22 bp, Homo sapiens
agcgcctgcaccactctgcggc

SEQ ID NO: 10032435 - DNA, 22 bp, Homo sapiens
agcgagggaggtctgaggacag

SEQ ID NO: 10032436 - DNA, 22 bp, Homo sapiens
cagcccaggtctctcttccagt

SEQ ID NO: 10032437 - DNA, 22 bp, Homo sapiens
cagcctctaagcacagcctctc

SEQ ID NO: 10032438 - DNA, 22 bp, Homo sapiens
cagcctctgacaccacagtcgt

SEQ ID NO: 10032439 - DNA, 22 bp, Homo sapiens
cagcgtctcgttgtgggcctcg

SEQ ID NO: 10032440 - DNA, 22 bp, Homo sapiens
agctctggaagccctggtagtt

SEQ ID NO: 10032441 - DNA, 22 bp, Homo sapiens
cagctgccccgctggctgacca

SEQ ID NO: 10032442 - DNA, 22 bp, Homo sapiens
cagctgcccctccagggctggg

SEQ ID NO: 10032443 - DNA, 22 bp, Homo sapiens
cagctgccccgctggctgacca

SEQ ID NO: 10032444 - DNA, 18 bp, Homo sapiens
cagctgccagctcatgga

SEQ ID NO: 10032445 - DNA, 22 bp, Homo sapiens
cagctgccatgacatgtcctgc

SEQ ID NO: 10032446 - DNA, 22 bp, Homo sapiens
cagctggcaagtggagcagggt

SEQ ID NO: 10032447 - DNA, 22 bp, Homo sapiens
cagctggcagaacctgcatcca

SEQ ID NO: 10032448 - DNA, 22 bp, Homo sapiens
agccctgaagctggccatgtcc

SEQ ID NO: 10032449 - DNA, 22 bp, Homo sapiens
cagagccataaaggtgaaagag

SEQ ID NO: 10032450 - DNA, 22 bp, Homo sapiens
cagagccatccaggtgcctgtt

SEQ ID NO: 10032451 - DNA, 22 bp, Homo sapiens
agcatttatcttttgtttgagt

SEQ ID NO: 10032452 - DNA, 22 bp, Homo sapiens
agcatttaggagaatttgagaa

SEQ ID NO: 10032453 - DNA, 22 bp, Homo sapiens
cactgcaacctccacctcctgg

SEQ ID NO: 10032454 - DNA, 22 bp, Homo sapiens
cactttgcctcttacctgtggt

SEQ ID NO: 10032455 - DNA, 22 bp, Homo sapiens
agcattttctgagagtatagat

SEQ ID NO: 10032456 - DNA, 22 bp, Homo sapiens
cactgggctttgtagttagcat

SEQ ID NO: 10032457 - DNA, 22 bp, Homo sapiens
cactaattaacacgtcgtctct

SEQ ID NO: 10032458 - DNA, 22 bp, Homo sapiens
agcaggtgggatcaagctggca

SEQ ID NO: 10032459 - DNA, 22 bp, Homo sapiens
agcaggtggccacgaggaggag

SEQ ID NO: 10032460 - DNA, 22 bp, Homo sapiens
cacagctgccatgcagtcagtg

SEQ ID NO: 10032461 - DNA, 22 bp, Homo sapiens
agcagagaagacacaggcttca

SEQ ID NO: 10032462 - DNA, 21 bp, Homo sapiens
caattactatgaaccagttga

SEQ ID NO: 10032463 - DNA, 22 bp, Homo sapiens
agagaacaaattaaaggtggtt

SEQ ID NO: 10032464 - DNA, 22 bp, Homo sapiens
atgctgatgctgcttttgccct

SEQ ID NO: 10032465 - DNA, 22 bp, Homo sapiens
atgccacttcattccagcctcg

SEQ ID NO: 10032466 - DNA, 22 bp, Homo sapiens
atgccagacattaacgactatg

SEQ ID NO: 10032467 - DNA, 22 bp, Homo sapiens
agacagttgatatactataaaa

SEQ ID NO: 10032468 - DNA, 22 bp, Homo sapiens
atctgggagacccttgcgggaa

SEQ ID NO: 10032469 - DNA, 22 bp, Homo sapiens
atgattgaaaatgacattgcca

SEQ ID NO: 10032470 - DNA, 18 bp, Homo sapiens
atgggaggggccaagaga

SEQ ID NO: 10032471 - DNA, 22 bp, Homo sapiens
agagaacatattttgtatgatt

SEQ ID NO: 10032472 - DNA, 22 bp, Homo sapiens
agagaacagtgttttgaaggag

SEQ ID NO: 10032473 - DNA, 22 bp, Homo sapiens
agagaagacttacagccacagt

SEQ ID NO: 10032474 - DNA, 22 bp, Homo sapiens
attgagaatatgatttagtata

SEQ ID NO: 10032475 - DNA, 22 bp, Homo sapiens
agaggaacccagacagggcttt

SEQ ID NO: 10032476 - DNA, 19 bp, Homo sapiens
agaggcctcagcagctggc

SEQ ID NO: 10032477 - DNA, 22 bp, Homo sapiens
agatttatgtggtcacactcag

SEQ ID NO: 10032478 - DNA, 22 bp, Homo sapiens
agatgatggccatgtcctctcc

SEQ ID NO: 10032479 - DNA, 21 bp, Homo sapiens
agatgaggatactgaggccta

SEQ ID NO: 10032480 - DNA, 23 bp, Homo sapiens
agatgaggcttctccatgttggt

SEQ ID NO: 10032481 - DNA, 22 bp, Homo sapiens
caaataagaaccacaggggagt

SEQ ID NO: 10032482 - DNA, 22 bp, Homo sapiens
caaataagcaattccattcttc

SEQ ID NO: 10032483 - DNA, 22 bp, Homo sapiens
agtggcagagccaagatatgat

SEQ ID NO: 10032484 - DNA, 22 bp, Homo sapiens
agtggcagagccaagtagagcc

SEQ ID NO: 10032485 - DNA, 22 bp, Homo sapiens
agtggcagacagagacagtacc

SEQ ID NO: 10032486 - DNA, 22 bp, Homo sapiens
agtgagagtattaatgtgaact

SEQ ID NO: 10032487 - DNA, 22 bp, Homo sapiens
agtgtgtactcatatacttcca

SEQ ID NO: 10032488 - DNA, 22 bp, Homo sapiens
agtgtctttcatatcctccatc

SEQ ID NO: 10032489 - DNA, 22 bp, Homo sapiens
agtgtctgtgctttgcagcaaa

SEQ ID NO: 10032490 - DNA, 22 bp, Homo sapiens
agttacaaccatgacacaagca

SEQ ID NO: 10032491 - DNA, 22 bp, Homo sapiens
actcagcttcctacagctagaa

SEQ ID NO: 10032492 - DNA, 22 bp, Homo sapiens
actcagctgatgaagcacaagt

SEQ ID NO: 10032493 - DNA, 22 bp, Homo sapiens
actcagctcaggagctggctgg

SEQ ID NO: 10032494 - DNA, 22 bp, Homo sapiens
actcagagttttacccagagac

SEQ ID NO: 10032495 - DNA, 22 bp, Homo sapiens
actcagaggcagctgctcaccc

SEQ ID NO: 10032496 - DNA, 22 bp, Homo sapiens
actcagaggaccaaaaggaaag

SEQ ID NO: 10032497 - DNA, 18 bp, Homo sapiens
actctgggacctgttatt

SEQ ID NO: 10032498 - DNA, 22 bp, Homo sapiens
agtccaggcattccagccattc

SEQ ID NO: 10032499 - DNA, 22 bp, Homo sapiens
agtccaggaaaataagctaggt

SEQ ID NO: 10032500 - DNA, 22 bp, Homo sapiens
agtccaggcaagttgttgtgta

SEQ ID NO: 10032501 - DNA, 22 bp, Homo sapiens
actctgggctgttaggagctgt

SEQ ID NO: 10032502 - DNA, 20 bp, Homo sapiens
actctggggctcattagggg

SEQ ID NO: 10032503 - DNA, 22 bp, Homo sapiens
actctggggtgatgtctctgag

SEQ ID NO: 10032504 - DNA, 22 bp, Homo sapiens
actctgggtcctgccattcact

SEQ ID NO: 10032505 - DNA, 22 bp, Homo sapiens
actctgggttctttcacttgac

SEQ ID NO: 10032506 - DNA, 22 bp, Homo sapiens
agtcctgggtgtgcaaggcaga

SEQ ID NO: 10032507 - DNA, 22 bp, Homo sapiens
actcagagcctcgagggactgc

SEQ ID NO: 10032508 - DNA, 22 bp, Homo sapiens
actcagagcagagcagcctgag

SEQ ID NO: 10032509 - DNA, 22 bp, Homo sapiens
aggtggggaaaccagcgatccc

SEQ ID NO: 10032510 - DNA, 22 bp, Homo sapiens
aggtggagaagagatgggcagt

SEQ ID NO: 10032511 - DNA, 22 bp, Homo sapiens
aggtgcagtggctcatgcctgt

SEQ ID NO: 10032512 - DNA, 22 bp, Homo sapiens
agaaaaggattgatggatcaga

SEQ ID NO: 10032513 - DNA, 22 bp, Homo sapiens
atagtgtcagaaaatcataaga

SEQ ID NO: 10032514 - DNA, 22 bp, Homo sapiens
agttgcagacgcagagatgttg

SEQ ID NO: 10032515 - DNA, 22 bp, Homo sapiens
atacacagccattatgaattag

SEQ ID NO: 10032516 - DNA, 22 bp, Homo sapiens
agaaagtttgtttttatccata

SEQ ID NO: 10032517 - DNA, 22 bp, Homo sapiens
agaaagttttgtgctatatatg

SEQ ID NO: 10032518 - DNA, 23 bp, Homo sapiens
atcctgctgatggccctccagga

SEQ ID NO: 10032519 - DNA, 22 bp, Homo sapiens
aggctgcttcaatggataagat

SEQ ID NO: 10032520 - DNA, 22 bp, Homo sapiens
aggctgctgccttggagagtgt

SEQ ID NO: 10032521 - DNA, 22 bp, Homo sapiens
aggctctggagttagccaggca

SEQ ID NO: 10032522 - DNA, 22 bp, Homo sapiens
aggctgctgaggccaccacgct

SEQ ID NO: 10032523 - DNA, 22 bp, Homo sapiens
accactggggcaagtcttcaaa

SEQ ID NO: 10032524 - DNA, 22 bp, Homo sapiens
aggcagtgtgtagctggaagag

SEQ ID NO: 10032525 - DNA, 22 bp, Homo sapiens
aggctctgaaggagaacctgtt

SEQ ID NO: 10032526 - DNA, 22 bp, Homo sapiens
acattaacaccgtgagtttggt

SEQ ID NO: 10032527 - DNA, 22 bp, Homo sapiens
acattaacaccataagtgtgtt

SEQ ID NO: 10032528 - DNA, 22 bp, Homo sapiens
agggaggtctttgaggggctta

SEQ ID NO: 10032529 - DNA, 19 bp, Homo sapiens
agggcacagggacagaagg

SEQ ID NO: 10032530 - DNA, 22 bp, Homo sapiens
acctcagagatacaaaccatgg

SEQ ID NO: 10032531 - DNA, 22 bp, Homo sapiens
acctcagagggatgttacaggc

SEQ ID NO: 10032532 - DNA, 22 bp, Homo sapiens
aggcagatattggggtgatgtg

SEQ ID NO: 10032533 - DNA, 22 bp, Homo sapiens
aggcagatcacttgaggccagg

SEQ ID NO: 10032534 - DNA, 22 bp, Homo sapiens
aggcagatgggagctggaagtt

SEQ ID NO: 10032535 - DNA, 22 bp, Homo sapiens
aggcagatgggagctggaagtt

SEQ ID NO: 10032536 - DNA, 22 bp, Homo sapiens
aggcagatgggagctggaagtt

SEQ ID NO: 10032537 - DNA, 22 bp, Homo sapiens
aggcagattacttgaggccagg

SEQ ID NO: 10032538 - DNA, 22 bp, Homo sapiens
aggcagactgtgcgggaagagt

SEQ ID NO: 10032539 - DNA, 22 bp, Homo sapiens
aggcagactcaatggctagata

SEQ ID NO: 10032540 - DNA, 22 bp, Homo sapiens
aggcagacaaggtccctggtct

SEQ ID NO: 10032541 - DNA, 18 bp, Homo sapiens
aggcagacactagaggtc

SEQ ID NO: 10032542 - DNA, 22 bp, Homo sapiens
aggcagacaaggacacagtggg

SEQ ID NO: 10032543 - DNA, 22 bp, Homo sapiens
aggcagatttaggagaaaagaa

SEQ ID NO: 10032544 - DNA, 22 bp, Homo sapiens
aggcagcaaatgtctggaacag

SEQ ID NO: 10032545 - DNA, 18 bp, Homo sapiens
aggcaggtgctggaagtc

SEQ ID NO: 10032546 - DNA, 23 bp, Homo sapiens
aggcagtggtggtaacatgtcaa

SEQ ID NO: 10032547 - DNA, 23 bp, Homo sapiens
aggcagtgtctcttatcctgtcc

SEQ ID NO: 10032548 - DNA, 22 bp, Homo sapiens
aggcagtgtgtagctggaagag

SEQ ID NO: 10032549 - DNA, 20 bp, Homo sapiens
aggaggcatagtctggaaag

SEQ ID NO: 10032550 - DNA, 22 bp, Homo sapiens
aggcacagatttggggaaagca

SEQ ID NO: 10032551 - DNA, 20 bp, Homo sapiens
acagtgttaggtttttcctt

SEQ ID NO: 10032552 - DNA, 22 bp, Homo sapiens
acagtgttacttgatagtgtat

SEQ ID NO: 10032553 - DNA, 22 bp, Homo sapiens
acagtgttacttgatagtgtat

SEQ ID NO: 10032554 - DNA, 22 bp, Homo sapiens
aggcaccttgcggtccagtgaa

SEQ ID NO: 10032555 - DNA, 22 bp, Homo sapiens
aggcaccttgagagcaggagct

SEQ ID NO: 10032556 - DNA, 20 bp, Homo sapiens
aggcacctgtcacaggtgag

SEQ ID NO: 10032557 - DNA, 22 bp, Homo sapiens
acagtgttctcttcctgtatag

SEQ ID NO: 10032558 - DNA, 22 bp, Homo sapiens
acagtgttctgaaagttgaggg

SEQ ID NO: 10032559 - DNA, 20 bp, Homo sapiens
acagtgttagttatcatctc

SEQ ID NO: 10032560 - DNA, 22 bp, Homo sapiens
acagtgttatttctgagtaatg

SEQ ID NO: 10032561 - DNA, 22 bp, Homo sapiens
acagtgttcactaaggttagct

SEQ ID NO: 10032562 - DNA, 22 bp, Homo sapiens
acagtgttcaaaccactaggct

SEQ ID NO: 10032563 - DNA, 22 bp, Homo sapiens
acagtgttcctttgttgtgact

SEQ ID NO: 10032564 - DNA, 22 bp, Homo sapiens
acagtgttcctttgttgtgact

SEQ ID NO: 10032565 - DNA, 22 bp, Homo sapiens
acagtgttcactaaggttagct

SEQ ID NO: 10032566 - DNA, 22 bp, Homo sapiens
acagtgttcacttaacaatgga

SEQ ID NO: 10032567 - DNA, 22 bp, Homo sapiens
acagccagaagtcagggtggga

SEQ ID NO: 10032568 - DNA, 22 bp, Homo sapiens
acagccagaggagccaggctgg

SEQ ID NO: 10032569 - DNA, 22 bp, Homo sapiens
agcttccacatctgtcttcagt

SEQ ID NO: 10032570 - DNA, 22 bp, Homo sapiens
acaggagaaatctggtcaaaag

SEQ ID NO: 10032571 - DNA, 22 bp, Homo sapiens
aggacagggattcaaactccca

SEQ ID NO: 10032572 - DNA, 22 bp, Homo sapiens
aggacagttagttaggaagttt

SEQ ID NO: 10032573 - DNA, 22 bp, Homo sapiens
aggacagttaaaaatagatggc

SEQ ID NO: 10032574 - DNA, 22 bp, Homo sapiens
aggacagtggcaaggcaggaca

SEQ ID NO: 10032575 - DNA, 22 bp, Homo sapiens
aggacagtggtgttctggagtg

SEQ ID NO: 10032576 - DNA, 22 bp, Homo sapiens
aggacagtggcagggtgacaga

SEQ ID NO: 10032577 - DNA, 22 bp, Homo sapiens
aggaaaggtagcgtgccagcag

SEQ ID NO: 10032578 - DNA, 23 bp, Homo sapiens
acagaaagttctgctggacagag

SEQ ID NO: 10032579 - DNA, 22 bp, Homo sapiens
acagacctgattcaagtcttga

SEQ ID NO: 10032580 - DNA, 22 bp, Homo sapiens
acactggtgtagttttctgcag

SEQ ID NO: 10032581 - DNA, 22 bp, Homo sapiens
acagcaggtagctttgtgcctc

SEQ ID NO: 10032582 - DNA, 22 bp, Homo sapiens
acagctgctgtttttgaaggac

SEQ ID NO: 10032583 - DNA, 22 bp, Homo sapiens
acagctgctgcttctcactggg

SEQ ID NO: 10032584 - DNA, 22 bp, Homo sapiens
acagctgctctatatctcagcc

SEQ ID NO: 10032585 - DNA, 22 bp, Homo sapiens
acaatgttctacatatacataa

SEQ ID NO: 10032586 - DNA, 22 bp, Homo sapiens
aagagtttccagttgtggctca

SEQ ID NO: 10032587 - DNA, 22 bp, Homo sapiens
aagagtttccatgctctgtgct

SEQ ID NO: 10032588 - DNA, 22 bp, Homo sapiens
acaaggctgttggtcacaaacc

SEQ ID NO: 10032589 - DNA, 22 bp, Homo sapiens
aagaacaggttctagaaccatt

SEQ ID NO: 10032590 - DNA, 22 bp, Homo sapiens
aagaactgtatcaagatgtagt

SEQ ID NO: 10032591 - DNA, 22 bp, Homo sapiens
aagaagagaaatgtgctgctgg

SEQ ID NO: 10032592 - DNA, 22 bp, Homo sapiens
aagaagagaactggcatcctaa

SEQ ID NO: 10032593 - DNA, 22 bp, Homo sapiens
aagaagagaactggcatcctaa

SEQ ID NO: 10032594 - DNA, 16 bp, Homo sapiens
aaggagggaagagaat

SEQ ID NO: 10032595 - DNA, 22 bp, Homo sapiens
aagggcaggagaagacggatat

SEQ ID NO: 10032596 - DNA, 22 bp, Homo sapiens
aagggaggggatgtaagcctgg

SEQ ID NO: 10032597 - DNA, 22 bp, Homo sapiens
aagtgccagtttctggcttcct

SEQ ID NO: 10032598 - DNA, 22 bp, Homo sapiens
aacagtgtcaggattacagata

SEQ ID NO: 10032599 - DNA, 22 bp, Homo sapiens
aacagtgtttttcttcagcact

SEQ ID NO: 10032600 - DNA, 22 bp, Homo sapiens
aatgcacctaccttgattctgc

SEQ ID NO: 10032601 - DNA, 22 bp, Homo sapiens
aatattgagaaccagcatgttt

SEQ ID NO: 10032602 - DNA, 22 bp, Homo sapiens
aaatattggtaggatgcttgtt

SEQ ID NO: 10032603 - DNA, 22 bp, Homo sapiens
aagaaggttgaatgactacttt

SEQ ID NO: 10032604 - DNA, 22 bp, Homo sapiens
aagaaggaagtgtggacatcac

SEQ ID NO: 10032605 - DNA, 22 bp, Homo sapiens
aagagtttctgggtcaaggatt

SEQ ID NO: 10032606 - DNA, 22 bp, Homo sapiens
aagagtttcttactggcatcta

SEQ ID NO: 10032607 - DNA, 22 bp, Homo sapiens
aagagtttctttattaaccttt

SEQ ID NO: 10032608 - DNA, 22 bp, Homo sapiens
aagagtttctgattcagtaggt

SEQ ID NO: 10032609 - DNA, 22 bp, Homo sapiens
aagagtttgtcagatctgcacg

SEQ ID NO: 10032610 - DNA, 22 bp, Homo sapiens
aagagtttgacctgtgccatcc

SEQ ID NO: 10032611 - DNA, 22 bp, Homo sapiens
aagagtttgggcaagtcataaa

SEQ ID NO: 10032612 - DNA, 22 bp, Homo sapiens
aagagttttagacaaactgatt

SEQ ID NO: 10032613 - DNA, 22 bp, Homo sapiens
aagagttttctataatcttggc

SEQ ID NO: 10032614 - DNA, 22 bp, Homo sapiens
aagagttttctctgatggcatt

SEQ ID NO: 10032615 - DNA, 22 bp, Homo sapiens
aagagtttttggagtgtgagtt

SEQ ID NO: 10032616 - DNA, 22 bp, Homo sapiens
aagagtttttaatgggtactgg

SEQ ID NO: 10032617 - DNA, 22 bp, Homo sapiens
aaattgctctttaaaagtactg

SEQ ID NO: 10032618 - DNA, 22 bp, Homo sapiens
aaaatactgtggagtgttgaaa

SEQ ID NO: 10032619 - DNA, 18 bp, Homo sapiens
aaaatgcaggcgacatgg

SEQ ID NO: 10032620 - DNA, 22 bp, Homo sapiens
aaaattggttcctttctgaggc

SEQ ID NO: 10032621 - DNA, 22 bp, Homo sapiens
aaaacactgcaaagctgattgg

SEQ ID NO: 10032622 - DNA, 22 bp, Homo sapiens
aaaagcaggtactcagcttggg

SEQ ID NO: 10032623 - DNA, 22 bp, Homo sapiens
aaagacagacggaaacctgagg

SEQ ID NO: 10032624 - DNA, 22 bp, Homo sapiens
aaatacacgtacatgtgtaaaa

SEQ ID NO: 10032625 - DNA, 22 bp, Homo sapiens
aaggaagaagggaagttactta

SEQ ID NO: 10032626 - DNA, 17 bp, Homo sapiens
aaggaatgtcagaagtt

SEQ ID NO: 10032627 - DNA, 22 bp, Homo sapiens
aaggaagatgctggcctgggga

SEQ ID NO: 10032628 - DNA, 22 bp, Homo sapiens
acatgaagcaagaaagatgcta

SEQ ID NO: 10032629 - DNA, 22 bp, Homo sapiens
acatcctcccgatctactggct

SEQ ID NO: 10032630 - DNA, 22 bp, Homo sapiens
aaggccagagcagactggagtt

SEQ ID NO: 10032631 - DNA, 22 bp, Homo sapiens
aaggcacatattttagagtcac

SEQ ID NO: 10032632 - DNA, 22 bp, Homo sapiens
aaggcacatattgcagatcttg

SEQ ID NO: 10032633 - DNA, 22 bp, Homo sapiens
aagggaggtaaagctatttaaa

SEQ ID NO: 10032634 - DNA, 22 bp, Homo sapiens
aagggcagaatagagaagatgg

SEQ ID NO: 10032635 - DNA, 22 bp, Homo sapiens
aagggcagagggaatcccacat

SEQ ID NO: 10032636 - DNA, 20 bp, Homo sapiens
aagggcagagggaacagact

SEQ ID NO: 10032637 - DNA, 22 bp, Homo sapiens
agaaggaaggctgagtgctgat

SEQ ID NO: 10032638 - DNA, 22 bp, Homo sapiens
actgtctcctcatcatgcctgg

SEQ ID NO: 10032639 - DNA, 22 bp, Homo sapiens
actgtctgagtcaggagtcaca

SEQ ID NO: 10032640 - DNA, 22 bp, Homo sapiens
actgtctgagctgattgagcta

SEQ ID NO: 10032641 - DNA, 22 bp, Homo sapiens
aataataagatactaagggagt

SEQ ID NO: 10032642 - DNA, 22 bp, Homo sapiens
actgcactccagcctgggtgac

SEQ ID NO: 10032643 - DNA, 18 bp, Homo sapiens
actctttctgcccacagg

SEQ ID NO: 10032644 - DNA, 22 bp, Homo sapiens
aagtgtgggactagggctccag

SEQ ID NO: 10032645 - DNA, 22 bp, Homo sapiens
agcacaggaccaaggaagctgt

SEQ ID NO: 10032646 - DNA, 22 bp, Homo sapiens
agcaaatacttgaataaaaaga

SEQ ID NO: 10032647 - DNA, 22 bp, Homo sapiens
agagaaggcatagaacttgagt

SEQ ID NO: 10032648 - DNA, 22 bp, Homo sapiens
agagcaacgaggtgatactaga

SEQ ID NO: 10032649 - DNA, 22 bp, Homo sapiens
agagcctggcaaaaggtcctgc

SEQ ID NO: 10032650 - DNA, 22 bp, Homo sapiens
aattacaaatgtagactctcat

SEQ ID NO: 10032651 - DNA, 23 bp, Homo sapiens
aattacaaccaagaactggaagg

SEQ ID NO: 10032652 - DNA, 22 bp, Homo sapiens
agaggaatttctggaaggaggc

SEQ ID NO: 10032653 - DNA, 22 bp, Homo sapiens
agaggaatgtatttccctgcaa

SEQ ID NO: 10032654 - DNA, 22 bp, Homo sapiens
aattccagaccacaagtgattt

SEQ ID NO: 10032655 - DNA, 22 bp, Homo sapiens
aattccagctacttggaaggtt

SEQ ID NO: 10032656 - DNA, 22 bp, Homo sapiens
agaggatggttgaggaagacct

SEQ ID NO: 10032657 - DNA, 22 bp, Homo sapiens
agaggatgattttaaggacact

SEQ ID NO: 10032658 - DNA, 22 bp, Homo sapiens
agaggacaaaatgagaagtgct

SEQ ID NO: 10032659 - DNA, 22 bp, Homo sapiens
agaggaggtccttttctgatgt

SEQ ID NO: 10032660 - DNA, 22 bp, Homo sapiens
agaggatgttctaggcactcat

SEQ ID NO: 10032661 - DNA, 22 bp, Homo sapiens
acagatatttaagagcttttgt

SEQ ID NO: 10032662 - DNA, 22 bp, Homo sapiens
acagcaggttacagtggcacag

SEQ ID NO: 10032663 - DNA, 22 bp, Homo sapiens
acagcaggttattgttatggca

SEQ ID NO: 10032664 - DNA, 22 bp, Homo sapiens
acagcaggcccatactggaagg

SEQ ID NO: 10032665 - DNA, 22 bp, Homo sapiens
acagcaggcatgaatgacactg

SEQ ID NO: 10032666 - DNA, 17 bp, Homo sapiens
acagcaggcccggaggg

SEQ ID NO: 10032667 - DNA, 17 bp, Homo sapiens
acagcagggaagtgttg

SEQ ID NO: 10032668 - DNA, 22 bp, Homo sapiens
acagcagggaatatgggaattg

SEQ ID NO: 10032669 - DNA, 22 bp, Homo sapiens
agcatttaattacagtttaatt

SEQ ID NO: 10032670 - DNA, 19 bp, Homo sapiens
agcaggtgggtaagaaaat

SEQ ID NO: 10032671 - DNA, 22 bp, Homo sapiens
agccagaggaacttgatgactg

SEQ ID NO: 10032672 - DNA, 22 bp, Homo sapiens
agccagctgttctggggcagca

SEQ ID NO: 10032673 - DNA, 22 bp, Homo sapiens
agccagctgtgggctcaggcgg

SEQ ID NO: 10032674 - DNA, 22 bp, Homo sapiens
acacagtttttcagacagagat

SEQ ID NO: 10032675 - DNA, 22 bp, Homo sapiens
acacagttcatgcatgaggtct

SEQ ID NO: 10032676 - DNA, 22 bp, Homo sapiens
acacagttcgtgcttttctatt

SEQ ID NO: 10032677 - DNA, 22 bp, Homo sapiens
acacagttcgttgttttctact

SEQ ID NO: 10032678 - DNA, 22 bp, Homo sapiens
acacagtttatggtattctgtt

SEQ ID NO: 10032679 - DNA, 22 bp, Homo sapiens
acacagttctttcactgttggt

SEQ ID NO: 10032680 - DNA, 22 bp, Homo sapiens
tcaggcattgtgcagagccttg

SEQ ID NO: 10032681 - DNA, 22 bp, Homo sapiens
tcagctctacctgggagctgtc

SEQ ID NO: 10032682 - DNA, 22 bp, Homo sapiens
tcagctctcacagatctcaacc

SEQ ID NO: 10032683 - DNA, 22 bp, Homo sapiens
tcagctctctgggctcgaacct

SEQ ID NO: 10032684 - DNA, 22 bp, Homo sapiens
tcagcagaacaaggaagcttaa

SEQ ID NO: 10032685 - DNA, 22 bp, Homo sapiens
tcagcaggcaccggaagtgttt

SEQ ID NO: 10032686 - DNA, 21 bp, Homo sapiens
tcagcaggcaccagaaggctg

SEQ ID NO: 10032687 - DNA, 22 bp, Homo sapiens
tcatggcacttagtgtctcaaa

SEQ ID NO: 10032688 - DNA, 23 bp, Homo sapiens
tcatggaactgggcaatcttgaa

SEQ ID NO: 10032689 - DNA, 22 bp, Homo sapiens
tcatagatgtgctgtgcacaaa

SEQ ID NO: 10032690 - DNA, 22 bp, Homo sapiens
tcagtgttcgctcagggactcc

SEQ ID NO: 10032691 - DNA, 22 bp, Homo sapiens
tcagtgttattagatgaggttt

SEQ ID NO: 10032692 - DNA, 22 bp, Homo sapiens
tcagtgttcagcggtgtgtgca

SEQ ID NO: 10032693 - DNA, 22 bp, Homo sapiens
tcagtgttcagggaccaggtcc

SEQ ID NO: 10032694 - DNA, 16 bp, Homo sapiens
tcagtgttccagaata

SEQ ID NO: 10032695 - DNA, 22 bp, Homo sapiens
tcatgcctggaatctcaccact

SEQ ID NO: 10032696 - DNA, 22 bp, Homo sapiens
tcagtgatttctggggtgaggg

SEQ ID NO: 10032697 - DNA, 22 bp, Homo sapiens
tcagtgttaatcagtggtacct

SEQ ID NO: 10032698 - DNA, 22 bp, Homo sapiens
tcagtgttagacaagtttggaa

SEQ ID NO: 10032699 - DNA, 22 bp, Homo sapiens
tcagtgttacattatatagaac

SEQ ID NO: 10032700 - DNA, 22 bp, Homo sapiens
tcagggacgtgagctcagagtc

SEQ ID NO: 10032701 - DNA, 22 bp, Homo sapiens
tcagagaagacatcattgtgaa

SEQ ID NO: 10032702 - DNA, 23 bp, Homo sapiens
tcagagaggccccctgcagagat

SEQ ID NO: 10032703 - DNA, 22 bp, Homo sapiens
tcagagctgggtgcttcttcct

SEQ ID NO: 10032704 - DNA, 22 bp, Homo sapiens
tccccagggctgcagagggtgt

SEQ ID NO: 10032705 - DNA, 22 bp, Homo sapiens
tcccagtgctacagacagggca

SEQ ID NO: 10032706 - DNA, 23 bp, Homo sapiens
tccagcagagccttccaggaggg

SEQ ID NO: 10032707 - DNA, 22 bp, Homo sapiens
tccagcagagtctctgaggggg

SEQ ID NO: 10032708 - DNA, 23 bp, Homo sapiens
tccagcagccaagaagggtagaa

SEQ ID NO: 10032709 - DNA, 22 bp, Homo sapiens
tccagcaggttggtcaggtgca

SEQ ID NO: 10032710 - DNA, 22 bp, Homo sapiens
tccagctcaaattcagcttcca

SEQ ID NO: 10032711 - DNA, 22 bp, Homo sapiens
tccagctgtactttgtcctggc

SEQ ID NO: 10032712 - DNA, 22 bp, Homo sapiens
tccagctgttgttttatctcag

SEQ ID NO: 10032713 - DNA, 22 bp, Homo sapiens
tccagctgttgatattctaggt

SEQ ID NO: 10032714 - DNA, 22 bp, Homo sapiens
tccaggagggattgggctgtgg

SEQ ID NO: 10032715 - DNA, 19 bp, Homo sapiens
tccaggaggctgccattga

SEQ ID NO: 10032716 - DNA, 22 bp, Homo sapiens
tccaggaggctctggttgacgt

SEQ ID NO: 10032717 - DNA, 22 bp, Homo sapiens
tccaggaggcctcatttcctgt

SEQ ID NO: 10032718 - DNA, 22 bp, Homo sapiens
tccatctgtcaaatatcatgct

SEQ ID NO: 10032719 - DNA, 23 bp, Homo sapiens
tccatctgtgagcatgccctgga

SEQ ID NO: 10032720 - DNA, 22 bp, Homo sapiens
tccaggatgcccgcttttgctt

SEQ ID NO: 10032721 - DNA, 22 bp, Homo sapiens
tccaggcataatgcccagtggt

SEQ ID NO: 10032722 - DNA, 22 bp, Homo sapiens
tccaggagtgtgtgctaatggg

SEQ ID NO: 10032723 - DNA, 21 bp, Homo sapiens
tccaggagttctaataggtgt

SEQ ID NO: 10032724 - DNA, 22 bp, Homo sapiens
tccaggagtttgagactgcagt

SEQ ID NO: 10032725 - DNA, 22 bp, Homo sapiens
tccaggagtttgacctgtgggc

SEQ ID NO: 10032726 - DNA, 22 bp, Homo sapiens
tccaggagtttgacctgtgggc

SEQ ID NO: 10032727 - DNA, 22 bp, Homo sapiens
tccaggagtggggcagaggtct

SEQ ID NO: 10032728 - DNA, 21 bp, Homo sapiens
tccaggagtggctgggcaggg

SEQ ID NO: 10032729 - DNA, 21 bp, Homo sapiens
tccaggagtggctgggcaggg

SEQ ID NO: 10032730 - DNA, 22 bp, Homo sapiens
tccaggagtgataaggccactg

SEQ ID NO: 10032731 - DNA, 22 bp, Homo sapiens
tccaggagtgctggttagagta

SEQ ID NO: 10032732 - DNA, 22 bp, Homo sapiens
tccaggaggttgagactgcagt

SEQ ID NO: 10032733 - DNA, 22 bp, Homo sapiens
tccaggaggtgaggggaccaaa

SEQ ID NO: 10032734 - DNA, 22 bp, Homo sapiens
tccaggaggtatgagtggcccc

SEQ ID NO: 10032735 - DNA, 20 bp, Homo sapiens
tccaggaggttagtgtggct

SEQ ID NO: 10032736 - DNA, 22 bp, Homo sapiens
tccaggagggttttctgccttc

SEQ ID NO: 10032737 - DNA, 22 bp, Homo sapiens
tccaggaggtagtgcttaattt

SEQ ID NO: 10032738 - DNA, 22 bp, Homo sapiens
tccaggagggggagccgtgccg

SEQ ID NO: 10032739 - DNA, 22 bp, Homo sapiens
tccaggaggggtaggcagtatg

SEQ ID NO: 10032740 - DNA, 22 bp, Homo sapiens
tccaggagtctagcctcaggcc

SEQ ID NO: 10032741 - DNA, 22 bp, Homo sapiens
tccaggagtcctgggtggcccc

SEQ ID NO: 10032742 - DNA, 22 bp, Homo sapiens
tccaggaggttgagtgagttcc

SEQ ID NO: 10032743 - DNA, 22 bp, Homo sapiens
tccaggaggtttggaggaagca

SEQ ID NO: 10032744 - DNA, 22 bp, Homo sapiens
tccaggagtcagacagatggtg

SEQ ID NO: 10032745 - DNA, 22 bp, Homo sapiens
tccaggagtcctgggagtgatt

SEQ ID NO: 10032746 - DNA, 22 bp, Homo sapiens
tccaggctctaggctgctctcc

SEQ ID NO: 10032747 - DNA, 22 bp, Homo sapiens
tccaggccactgcagaggctct

SEQ ID NO: 10032748 - DNA, 22 bp, Homo sapiens
tccaggcatgtggccagtactc

SEQ ID NO: 10032749 - DNA, 22 bp, Homo sapiens
tccaggcatgtggccagtactc

SEQ ID NO: 10032750 - DNA, 22 bp, Homo sapiens
tccaggcatgtctgagtccttc

SEQ ID NO: 10032751 - DNA, 22 bp, Homo sapiens
tagaaacattcagttgcagtcc

SEQ ID NO: 10032752 - DNA, 22 bp, Homo sapiens
tactttggatccttacaatagc

SEQ ID NO: 10032753 - DNA, 22 bp, Homo sapiens
tagaattgggcctaacttccat

SEQ ID NO: 10032754 - DNA, 22 bp, Homo sapiens
tagaaagtagccacttacagag

SEQ ID NO: 10032755 - DNA, 22 bp, Homo sapiens
tagaaagtcatgaattacacca

SEQ ID NO: 10032756 - DNA, 22 bp, Homo sapiens
tagaaagtgaaggttaattaat

SEQ ID NO: 10032757 - DNA, 22 bp, Homo sapiens
tagaaagtactaaatttaactg

SEQ ID NO: 10032758 - DNA, 22 bp, Homo sapiens
tagggatgtggtgagaactgag

SEQ ID NO: 10032759 - DNA, 22 bp, Homo sapiens
tagggatgtcctgagacttggc

SEQ ID NO: 10032760 - DNA, 22 bp, Homo sapiens
tagggcagagcttgtacacgat

SEQ ID NO: 10032761 - DNA, 22 bp, Homo sapiens
tagggatgtaaacatagtaatt

SEQ ID NO: 10032762 - DNA, 22 bp, Homo sapiens
tagggatgagccagtgggtagt

SEQ ID NO: 10032763 - DNA, 22 bp, Homo sapiens
tagggatgacgaaaggacagag

SEQ ID NO: 10032764 - DNA, 22 bp, Homo sapiens
tagggaggagggttttcaaatc

SEQ ID NO: 10032765 - DNA, 22 bp, Homo sapiens
tagggaggctacttcttgtagg

SEQ ID NO: 10032766 - DNA, 22 bp, Homo sapiens
taggagggttagagggaaatat

SEQ ID NO: 10032767 - DNA, 22 bp, Homo sapiens
tagcccagcatgagcagagctg

SEQ ID NO: 10032768 - DNA, 19 bp, Homo sapiens
tagccctggccatcatgag

SEQ ID NO: 10032769 - DNA, 22 bp, Homo sapiens
tagccctggagcagggaaatac

SEQ ID NO: 10032770 - DNA, 22 bp, Homo sapiens
tatacacatatacgtttgtgtg

SEQ ID NO: 10032771 - DNA, 17 bp, Homo sapiens
tatacacagacagactg

SEQ ID NO: 10032772 - DNA, 22 bp, Homo sapiens
taggtccacaagatcaatgcag

SEQ ID NO: 10032773 - DNA, 21 bp, Homo sapiens
taggtgggagccccagtatgc

SEQ ID NO: 10032774 - DNA, 22 bp, Homo sapiens
tattattatctttgaatgggac

SEQ ID NO: 10032775 - DNA, 22 bp, Homo sapiens
tattattatattggatgagact

SEQ ID NO: 10032776 - DNA, 22 bp, Homo sapiens
tattcatgagataggcagtttt

SEQ ID NO: 10032777 - DNA, 22 bp, Homo sapiens
tattgaattagaccctaaaatg

SEQ ID NO: 10032778 - DNA, 22 bp, Homo sapiens
tattgacagacttgaaagtgtt

SEQ ID NO: 10032779 - DNA, 22 bp, Homo sapiens
tatttattctttgtactgcctt

SEQ ID NO: 10032780 - DNA, 22 bp, Homo sapiens
tatgtacaccggggaaggtggg

SEQ ID NO: 10032781 - DNA, 22 bp, Homo sapiens
tatgtcctgctactctctcatg

SEQ ID NO: 10032782 - DNA, 22 bp, Homo sapiens
tatgtacataacatgaaatgca

SEQ ID NO: 10032783 - DNA, 23 bp, Homo sapiens
tattagcaattcccacagagcag

SEQ ID NO: 10032784 - DNA, 22 bp, Homo sapiens
tattagcagcatgagaatgggc

SEQ ID NO: 10032785 - DNA, 22 bp, Homo sapiens
tattacacagtgaaagcatgga

SEQ ID NO: 10032786 - DNA, 20 bp, Homo sapiens
tattacacacaatgagcagt

SEQ ID NO: 10032787 - DNA, 19 bp, Homo sapiens
gtttcattaagataggaaa

SEQ ID NO: 10032788 - DNA, 22 bp, Homo sapiens
gtttcatggttgtttgatggca

SEQ ID NO: 10032789 - DNA, 22 bp, Homo sapiens
gtttcataggcatgtgacctat

SEQ ID NO: 10032790 - DNA, 22 bp, Homo sapiens
gttacaaaggactgggggccac

SEQ ID NO: 10032791 - DNA, 22 bp, Homo sapiens
gttacaaaggaagcttcactgc

SEQ ID NO: 10032792 - DNA, 22 bp, Homo sapiens
gttacaaagcacttcaagtgaa

SEQ ID NO: 10032793 - DNA, 22 bp, Homo sapiens
gttacaaactcaggtgccaaaa

SEQ ID NO: 10032794 - DNA, 22 bp, Homo sapiens
gttttcattactgctgtgattt

SEQ ID NO: 10032795 - DNA, 22 bp, Homo sapiens
gttttcatgtctattgggcata

SEQ ID NO: 10032796 - DNA, 21 bp, Homo sapiens
gttttcatgatagagtctgta

SEQ ID NO: 10032797 - DNA, 22 bp, Homo sapiens
tacatttgctttgattttcagc

SEQ ID NO: 10032798 - DNA, 20 bp, Homo sapiens
tacaacaagtagagacatac

SEQ ID NO: 10032799 - DNA, 22 bp, Homo sapiens
taaggcaggtagatgactacgg

SEQ ID NO: 10032800 - DNA, 22 bp, Homo sapiens
taaggcagtgagaagaaacagg

SEQ ID NO: 10032801 - DNA, 22 bp, Homo sapiens
tacaaaaaattgatactgacga

SEQ ID NO: 10032802 - DNA, 22 bp, Homo sapiens
taattacaaagcaagcacaggg

SEQ ID NO: 10032803 - DNA, 22 bp, Homo sapiens
taattacaggtccaaaacaatc

SEQ ID NO: 10032804 - DNA, 22 bp, Homo sapiens
gctgtgtatcagatgccacggg

SEQ ID NO: 10032805 - DNA, 19 bp, Homo sapiens
gctgtgcctctctcctgct

SEQ ID NO: 10032806 - DNA, 22 bp, Homo sapiens
gctgtgctcaacgtgccttcct

SEQ ID NO: 10032807 - DNA, 22 bp, Homo sapiens
ggaagagggaaccacgactgta

SEQ ID NO: 10032808 - DNA, 18 bp, Homo sapiens
ggaatgtggacaggctgg

SEQ ID NO: 10032809 - DNA, 20 bp, Homo sapiens
gctttctatgagatggactg

SEQ ID NO: 10032810 - DNA, 22 bp, Homo sapiens
ggaagaggctgagccaggtccc

SEQ ID NO: 10032811 - DNA, 22 bp, Homo sapiens
ggaagaggctgaggccatgctg

SEQ ID NO: 10032812 - DNA, 22 bp, Homo sapiens
ggagcagtggtcattcagctgg

SEQ ID NO: 10032813 - DNA, 22 bp, Homo sapiens
ggagcagggcagtgaattctgg

SEQ ID NO: 10032814 - DNA, 22 bp, Homo sapiens
ggacatctcttgccagggctgc

SEQ ID NO: 10032815 - DNA, 22 bp, Homo sapiens
ggacatctgggccccaggtcta

SEQ ID NO: 10032816 - DNA, 22 bp, Homo sapiens
ggacatcttggttgcttccaag

SEQ ID NO: 10032817 - DNA, 22 bp, Homo sapiens
ggacagtgtgggccatctcact

SEQ ID NO: 10032818 - DNA, 20 bp, Homo sapiens
ggacagtgagacatatctca

SEQ ID NO: 10032819 - DNA, 22 bp, Homo sapiens
ggacaggtgtgaggctggcaca

SEQ ID NO: 10032820 - DNA, 22 bp, Homo sapiens
gcctttggctctgtctgacctg

SEQ ID NO: 10032821 - DNA, 18 bp, Homo sapiens
gcctttggactgctccca

SEQ ID NO: 10032822 - DNA, 22 bp, Homo sapiens
gcctttggagaatccagtcatg

SEQ ID NO: 10032823 - DNA, 22 bp, Homo sapiens
gcctttggactgaggtagtcag

SEQ ID NO: 10032824 - DNA, 21 bp, Homo sapiens
gcctttggtttcttgtcctgc

SEQ ID NO: 10032825 - DNA, 22 bp, Homo sapiens
gcgtctgagttgcgggggctca

SEQ ID NO: 10032826 - DNA, 22 bp, Homo sapiens
gcctctggtccctcatgctgtg

SEQ ID NO: 10032827 - DNA, 22 bp, Homo sapiens
gcctctggggcagctgagtcat

SEQ ID NO: 10032828 - DNA, 22 bp, Homo sapiens
gcctctgggggctcagacctgt

SEQ ID NO: 10032829 - DNA, 22 bp, Homo sapiens
gcctctgggtgacgaaaggtga

SEQ ID NO: 10032830 - DNA, 22 bp, Homo sapiens
gcctctgggttggtgacaggct

SEQ ID NO: 10032831 - DNA, 22 bp, Homo sapiens
gctccaggtgaatcctctcacc

SEQ ID NO: 10032832 - DNA, 22 bp, Homo sapiens
gctactgattgaccttggagag

SEQ ID NO: 10032833 - DNA, 22 bp, Homo sapiens
gctcagaggaggcctttaccta

SEQ ID NO: 10032834 - DNA, 22 bp, Homo sapiens
gctccagggtcagctcagaact

SEQ ID NO: 10032835 - DNA, 22 bp, Homo sapiens
gctgctgtgcctggcgtcctgt

SEQ ID NO: 10032836 - DNA, 22 bp, Homo sapiens
gctgctgtgttctcttgaccca

SEQ ID NO: 10032837 - DNA, 22 bp, Homo sapiens
gctgctgtgtgggagacaggcg

SEQ ID NO: 10032838 - DNA, 22 bp, Homo sapiens
gctgctgtgttggccactgctt

SEQ ID NO: 10032839 - DNA, 22 bp, Homo sapiens
gctgcccagggtggagccggct

SEQ ID NO: 10032840 - DNA, 22 bp, Homo sapiens
gctgcccattccactggatggt

SEQ ID NO: 10032841 - DNA, 22 bp, Homo sapiens
gctgcccaggagaggtggggct

SEQ ID NO: 10032842 - DNA, 22 bp, Homo sapiens
gctgcccacaatgattacatgg

SEQ ID NO: 10032843 - DNA, 22 bp, Homo sapiens
gctgcccagacattgaatcagg

SEQ ID NO: 10032844 - DNA, 22 bp, Homo sapiens
gctcctccaatatggactcctc

SEQ ID NO: 10032845 - DNA, 18 bp, Homo sapiens
gctctggctcacctccag

SEQ ID NO: 10032846 - DNA, 22 bp, Homo sapiens
gctctgggaactgactgccttc

SEQ ID NO: 10032847 - DNA, 20 bp, Homo sapiens
gctctgggagggatgtgatg

SEQ ID NO: 10032848 - DNA, 22 bp, Homo sapiens
gctctgggctgccctctggaca

SEQ ID NO: 10032849 - DNA, 20 bp, Homo sapiens
gcagtgatctcatcggtctg

SEQ ID NO: 10032850 - DNA, 22 bp, Homo sapiens
gccagctgaatttccaactgtt

SEQ ID NO: 10032851 - DNA, 22 bp, Homo sapiens
gccagggaacccaagggcctca

SEQ ID NO: 10032852 - DNA, 22 bp, Homo sapiens
gccagggaggctgtagggtcct

SEQ ID NO: 10032853 - DNA, 22 bp, Homo sapiens
gcccagcactaaaagctttgct

SEQ ID NO: 10032854 - DNA, 22 bp, Homo sapiens
gcccagcagctccacttggctt

SEQ ID NO: 10032855 - DNA, 22 bp, Homo sapiens
gcccagcacagctggaagagtc

SEQ ID NO: 10032856 - DNA, 21 bp, Homo sapiens
gcccagcaaggtgagaaggcc

SEQ ID NO: 10032857 - DNA, 22 bp, Homo sapiens
gcccagcaaggaccaagggccg

SEQ ID NO: 10032858 - DNA, 22 bp, Homo sapiens
gcccatggtccaggaagacaga

SEQ ID NO: 10032859 - DNA, 22 bp, Homo sapiens
gcccatggtcagggaggcaggg

SEQ ID NO: 10032860 - DNA, 22 bp, Homo sapiens
gcccatggcttccctaggcaca

SEQ ID NO: 10032861 - DNA, 22 bp, Homo sapiens
gcccatgggcctgaggccctag

SEQ ID NO: 10032862 - DNA, 22 bp, Homo sapiens
gcccatgggctccagacctggg

SEQ ID NO: 10032863 - DNA, 22 bp, Homo sapiens
gcccaggaggagaggctgcagt

SEQ ID NO: 10032864 - DNA, 22 bp, Homo sapiens
gcccatggcagaactgtgagca

SEQ ID NO: 10032865 - DNA, 22 bp, Homo sapiens
gcccaggagaggccagggctga

SEQ ID NO: 10032866 - DNA, 22 bp, Homo sapiens
gcccaggactcagggtgtcgcg

SEQ ID NO: 10032867 - DNA, 22 bp, Homo sapiens
gcccaggagcctggagatgtgt

SEQ ID NO: 10032868 - DNA, 22 bp, Homo sapiens
gcccaggaaagatagggcctca

SEQ ID NO: 10032869 - DNA, 22 bp, Homo sapiens
gcccaggaaataaaagtgggct

SEQ ID NO: 10032870 - DNA, 22 bp, Homo sapiens
gcccaggaaatgccccgtggtg

SEQ ID NO: 10032871 - DNA, 22 bp, Homo sapiens
gcccaggaagttgaggctgccg

SEQ ID NO: 10032872 - DNA, 20 bp, Homo sapiens
gcccaggaatttgcatttct

SEQ ID NO: 10032873 - DNA, 16 bp, Homo sapiens
gcccaggacgggaggc

SEQ ID NO: 10032874 - DNA, 17 bp, Homo sapiens
gcccaggaaggacggcc

SEQ ID NO: 10032875 - DNA, 22 bp, Homo sapiens
gcccaggaagccaccgggaagt

SEQ ID NO: 10032876 - DNA, 22 bp, Homo sapiens
gcccaggaagtgactcagatgt

SEQ ID NO: 10032877 - DNA, 22 bp, Homo sapiens
gccctggagctagactaggaca

SEQ ID NO: 10032878 - DNA, 22 bp, Homo sapiens
gccctgtggccccagtgggctc

SEQ ID NO: 10032879 - DNA, 22 bp, Homo sapiens
gccctgtggacccaggaactct

SEQ ID NO: 10032880 - DNA, 22 bp, Homo sapiens
gccctgtggacagtgagaagtg

SEQ ID NO: 10032881 - DNA, 22 bp, Homo sapiens
gccctgtgcttggatggcagat

SEQ ID NO: 10032882 - DNA, 22 bp, Homo sapiens
gccctgtgcgctgagttcaggg

SEQ ID NO: 10032883 - DNA, 22 bp, Homo sapiens
gccctgtgctataggttagggc

SEQ ID NO: 10032884 - DNA, 22 bp, Homo sapiens
gccctgtgctcatgggaacatc

SEQ ID NO: 10032885 - DNA, 22 bp, Homo sapiens
gccctgtgcgactctagaggtt

SEQ ID NO: 10032886 - DNA, 22 bp, Homo sapiens
gccctgggcaaggttctggcca

SEQ ID NO: 10032887 - DNA, 22 bp, Homo sapiens
gccctgggattgggtggaggct

SEQ ID NO: 10032888 - DNA, 22 bp, Homo sapiens
gccctggatgtacaggcatgtt

SEQ ID NO: 10032889 - DNA, 22 bp, Homo sapiens
gcctcctgaagtgctgggatta

SEQ ID NO: 10032890 - DNA, 22 bp, Homo sapiens
gccctgtggttccaggaagcaa

SEQ ID NO: 10032891 - DNA, 22 bp, Homo sapiens
gccctgtgtatcccctgtgctt

SEQ ID NO: 10032892 - DNA, 22 bp, Homo sapiens
gcctcctgagtagctgggattg

SEQ ID NO: 10032893 - DNA, 23 bp, Homo sapiens
gcctctggagccccagtgctcag

SEQ ID NO: 10032894 - DNA, 22 bp, Homo sapiens
gcctctggcttctgcatcagtg

SEQ ID NO: 10032895 - DNA, 22 bp, Homo sapiens
gcctctgggctctgcccctggc

SEQ ID NO: 10032896 - DNA, 22 bp, Homo sapiens
gcctctggagtcgcagcgtctt

SEQ ID NO: 10032897 - DNA, 22 bp, Homo sapiens
gcagctttctgcaatgtcatcc

SEQ ID NO: 10032898 - DNA, 22 bp, Homo sapiens
gcagctttctttttgcatgtct

SEQ ID NO: 10032899 - DNA, 22 bp, Homo sapiens
gcaggaagcatagaagaatgcc

SEQ ID NO: 10032900 - DNA, 22 bp, Homo sapiens
gcaggcagaggtggaggagaca

SEQ ID NO: 10032901 - DNA, 22 bp, Homo sapiens
gcagggaagatcttggagctgc

SEQ ID NO: 10032902 - DNA, 22 bp, Homo sapiens
gcaggcagttatttagtagaat

SEQ ID NO: 10032903 - DNA, 22 bp, Homo sapiens
gcagggaagacccggagcagcg

SEQ ID NO: 10032904 - DNA, 22 bp, Homo sapiens
gcaggcagttatttagtagaat

SEQ ID NO: 10032905 - DNA, 22 bp, Homo sapiens
gcagggacaactgtgcacctga

SEQ ID NO: 10032906 - DNA, 22 bp, Homo sapiens
gcaaagaaatgtcagtgagagg

SEQ ID NO: 10032907 - DNA, 22 bp, Homo sapiens
gcaaagcattctgtggagtcta

SEQ ID NO: 10032908 - DNA, 22 bp, Homo sapiens
gcagagaacccagcagattggc

SEQ ID NO: 10032909 - DNA, 22 bp, Homo sapiens
gcagagaagatgcccaggcttc

SEQ ID NO: 10032910 - DNA, 19 bp, Homo sapiens
gcagagtggggtggagggt

SEQ ID NO: 10032911 - DNA, 22 bp, Homo sapiens
gcagaggccaggccaccagcaa

SEQ ID NO: 10032912 - DNA, 22 bp, Homo sapiens
gcagaggatagcatatgaacct

SEQ ID NO: 10032913 - DNA, 22 bp, Homo sapiens
gggcacagcctaactatggaga

SEQ ID NO: 10032914 - DNA, 22 bp, Homo sapiens
gggcacagcccagtggggtccc

SEQ ID NO: 10032915 - DNA, 22 bp, Homo sapiens
gggcagctgcccctctctgggc

SEQ ID NO: 10032916 - DNA, 22 bp, Homo sapiens
gggcagctgccaagtgcatcgc

SEQ ID NO: 10032917 - DNA, 22 bp, Homo sapiens
gggcagctgccactccgcttgc

SEQ ID NO: 10032918 - DNA, 22 bp, Homo sapiens
gggcagctgccagaggccatgg

SEQ ID NO: 10032919 - DNA, 22 bp, Homo sapiens
gggcagctggatagttttaaat

SEQ ID NO: 10032920 - DNA, 22 bp, Homo sapiens
gggcagctggccaggtattctg

SEQ ID NO: 10032921 - DNA, 22 bp, Homo sapiens
gggcagctggcttataggtttg

SEQ ID NO: 10032922 - DNA, 22 bp, Homo sapiens
gggcagctgtatctgagcttat

SEQ ID NO: 10032923 - DNA, 23 bp, Homo sapiens
gggcagcttaagcttgtttttct

SEQ ID NO: 10032924 - DNA, 22 bp, Homo sapiens
gggcagctgtcttggttctcaa

SEQ ID NO: 10032925 - DNA, 22 bp, Homo sapiens
gggcagctctgcccatcagagg

SEQ ID NO: 10032926 - DNA, 22 bp, Homo sapiens
gggcagctctggctgtgggaag

SEQ ID NO: 10032927 - DNA, 22 bp, Homo sapiens
gggcagctgcagggatggtgac

SEQ ID NO: 10032928 - DNA, 21 bp, Homo sapiens
gggcagctctgttttattttc

SEQ ID NO: 10032929 - DNA, 22 bp, Homo sapiens
gggcagctctttggtatccttc

SEQ ID NO: 10032930 - DNA, 22 bp, Homo sapiens
gggcacaggaatttgggatgtg

SEQ ID NO: 10032931 - DNA, 22 bp, Homo sapiens
gggacatggaggcgcgcaggca

SEQ ID NO: 10032932 - DNA, 22 bp, Homo sapiens
gggacatctttctagtcagggt

SEQ ID NO: 10032933 - DNA, 22 bp, Homo sapiens
gggacatgaagcatcggaggca

SEQ ID NO: 10032934 - DNA, 22 bp, Homo sapiens
gggacagtgaggcacggggttt

SEQ ID NO: 10032935 - DNA, 22 bp, Homo sapiens
gggagaggttacccgagcaact

SEQ ID NO: 10032936 - DNA, 22 bp, Homo sapiens
gggagacacgctgcaggcataa

SEQ ID NO: 10032937 - DNA, 22 bp, Homo sapiens
ggctgctggccagcctaggagt

SEQ ID NO: 10032938 - DNA, 21 bp, Homo sapiens
ggctgctgggagagctgcgtg

SEQ ID NO: 10032939 - DNA, 22 bp, Homo sapiens
ggctgctgagttggccaggaga

SEQ ID NO: 10032940 - DNA, 22 bp, Homo sapiens
ggctccaccctgcttccagaag

SEQ ID NO: 10032941 - DNA, 22 bp, Homo sapiens
ggctccaggagatgctgggcag

SEQ ID NO: 10032942 - DNA, 22 bp, Homo sapiens
ggctccagctaatggtttctat

SEQ ID NO: 10032943 - DNA, 22 bp, Homo sapiens
ggcgctggccacggtggctctg

SEQ ID NO: 10032944 - DNA, 21 bp, Homo sapiens
ggcctgagtataggacaggcc

SEQ ID NO: 10032945 - DNA, 22 bp, Homo sapiens
ggcctcagagaaggctgtgcgg

SEQ ID NO: 10032946 - DNA, 22 bp, Homo sapiens
ggcctctggttcgtggtgacct

SEQ ID NO: 10032947 - DNA, 22 bp, Homo sapiens
ggcagtcttatcagcattggac

SEQ ID NO: 10032948 - DNA, 19 bp, Homo sapiens
ggcagtctcaagcagcaca

SEQ ID NO: 10032949 - DNA, 22 bp, Homo sapiens
ggcatgggccgaggtgcctcct

SEQ ID NO: 10032950 - DNA, 22 bp, Homo sapiens
ggcaggcagaggctgagacagg

SEQ ID NO: 10032951 - DNA, 22 bp, Homo sapiens
ggcaggcagaggctgagacagg

SEQ ID NO: 10032952 - DNA, 22 bp, Homo sapiens
ggcagtcagtttggagatggat

SEQ ID NO: 10032953 - DNA, 22 bp, Homo sapiens
ggcaagaaggcttcaggtagct

SEQ ID NO: 10032954 - DNA, 22 bp, Homo sapiens
ggcaagctcaggcctcaggtgt

SEQ ID NO: 10032955 - DNA, 23 bp, Homo sapiens
ggagtgcaatggcgccatctcgg

SEQ ID NO: 10032956 - DNA, 22 bp, Homo sapiens
ggcacagcaggagctatgtgaa

SEQ ID NO: 10032957 - DNA, 22 bp, Homo sapiens
ggcagaggaaggatgaattcac

SEQ ID NO: 10032958 - DNA, 22 bp, Homo sapiens
ggcagaggaggggtgaatttgc

SEQ ID NO: 10032959 - DNA, 22 bp, Homo sapiens
ggcagaggagctggaaacatgg

SEQ ID NO: 10032960 - DNA, 22 bp, Homo sapiens
ggcaggcaatgaggatgggaag

SEQ ID NO: 10032961 - DNA, 22 bp, Homo sapiens
ggcaggcaaggcagcctggtga

SEQ ID NO: 10032962 - DNA, 22 bp, Homo sapiens
gggtggagcttggacaccagta

SEQ ID NO: 10032963 - DNA, 22 bp, Homo sapiens
gggtggagccagttgactctgt

SEQ ID NO: 10032964 - DNA, 22 bp, Homo sapiens
gggtggagtagaaagatgaatt

SEQ ID NO: 10032965 - DNA, 22 bp, Homo sapiens
ggtttattgaaggccaccccac

SEQ ID NO: 10032966 - DNA, 22 bp, Homo sapiens
ggtttattgttaataagtttga

SEQ ID NO: 10032967 - DNA, 22 bp, Homo sapiens
ggtttattaatgtgaactgtat

SEQ ID NO: 10032968 - DNA, 18 bp, Homo sapiens
ggtggccttgacttctct

SEQ ID NO: 10032969 - DNA, 22 bp, Homo sapiens
ggtggcctagggcccagcctgt

SEQ ID NO: 10032970 - DNA, 22 bp, Homo sapiens
gggtggcatctctctgagctgt

SEQ ID NO: 10032971 - DNA, 22 bp, Homo sapiens
gggtggcaccacgtgtcttcaa

SEQ ID NO: 10032972 - DNA, 22 bp, Homo sapiens
gggtggcacaggtgcagagggt

SEQ ID NO: 10032973 - DNA, 20 bp, Homo sapiens
gggtggagttgcggtctgtg

SEQ ID NO: 10032974 - DNA, 22 bp, Homo sapiens
ggtcacaggggagaagagtgat

SEQ ID NO: 10032975 - DNA, 22 bp, Homo sapiens
ggtccctggaagtccctcttct

SEQ ID NO: 10032976 - DNA, 22 bp, Homo sapiens
ggtccctggggaactaggctgt

SEQ ID NO: 10032977 - DNA, 22 bp, Homo sapiens
ggtccctgggtcttcttacgtc

SEQ ID NO: 10032978 - DNA, 22 bp, Homo sapiens
gtctgcctgctagtggctgcct

SEQ ID NO: 10032979 - DNA, 22 bp, Homo sapiens
gtctgcctttatcatctcctta

SEQ ID NO: 10032980 - DNA, 22 bp, Homo sapiens
gtctgctggtgcctggcctgcg

SEQ ID NO: 10032981 - DNA, 22 bp, Homo sapiens
gtcctgggcctgctgaggctga

SEQ ID NO: 10032982 - DNA, 22 bp, Homo sapiens
gtgagcaggatttcatggtgta

SEQ ID NO: 10032983 - DNA, 22 bp, Homo sapiens
gtgaccttggcaatctctcaga

SEQ ID NO: 10032984 - DNA, 23 bp, Homo sapiens
gtaaaatacgcagtgcagtgtga

SEQ ID NO: 10032985 - DNA, 22 bp, Homo sapiens
ggtttggttctgagagttggca

SEQ ID NO: 10032986 - DNA, 22 bp, Homo sapiens
gtattattgtcatgaaataata

SEQ ID NO: 10032987 - DNA, 22 bp, Homo sapiens
gtagaacatggtagggcaggtg

SEQ ID NO: 10032988 - DNA, 22 bp, Homo sapiens
gtagaacactggggctctgttg

SEQ ID NO: 10032989 - DNA, 22 bp, Homo sapiens
gtccctgataagagccatcgat

SEQ ID NO: 10032990 - DNA, 22 bp, Homo sapiens
gtccctgagcctggcatttccc

SEQ ID NO: 10032991 - DNA, 22 bp, Homo sapiens
gtccctgacacccgggtggagg

SEQ ID NO: 10032992 - DNA, 22 bp, Homo sapiens
ctggcttttcaaactgttcagt

SEQ ID NO: 10032993 - DNA, 22 bp, Homo sapiens
ctgggagctagctctgagctga

SEQ ID NO: 10032994 - DNA, 22 bp, Homo sapiens
ctggctttctgaacatcagtga

SEQ ID NO: 10032995 - DNA, 22 bp, Homo sapiens
ctgggccacaaaaaactcctgt

SEQ ID NO: 10032996 - DNA, 22 bp, Homo sapiens
ctgggccacaagcctgtgtgat

SEQ ID NO: 10032997 - DNA, 22 bp, Homo sapiens
ctgggccagaagacatttagga

SEQ ID NO: 10032998 - DNA, 22 bp, Homo sapiens
ctgggcatttttctctgttaca

SEQ ID NO: 10032999 - DNA, 22 bp, Homo sapiens
ctgggccaaaagaagtgttctt

SEQ ID NO: 10033000 - DNA, 22 bp, Homo sapiens
ctgggccaagaagttgtgtatg

SEQ ID NO: 10033001 - DNA, 22 bp, Homo sapiens
ctgggcagttttacatcattgc

SEQ ID NO: 10033002 - DNA, 18 bp, Homo sapiens
ctgggccagagtttctgc

SEQ ID NO: 10033003 - DNA, 19 bp, Homo sapiens
ctgggccagagctgtcctc

SEQ ID NO: 10033004 - DNA, 22 bp, Homo sapiens
ctgggctgcggttctctgaagc

SEQ ID NO: 10033005 - DNA, 22 bp, Homo sapiens
ctggggtgtgctcagagcaggg

SEQ ID NO: 10033006 - DNA, 22 bp, Homo sapiens
ctggggcattgggagaggcctg

SEQ ID NO: 10033007 - DNA, 22 bp, Homo sapiens
ctggccagagttggagggtgtg

SEQ ID NO: 10033008 - DNA, 22 bp, Homo sapiens
ctggccagctgacagcagggct

SEQ ID NO: 10033009 - DNA, 22 bp, Homo sapiens
ctgccactctgggtgggcctgg

SEQ ID NO: 10033010 - DNA, 22 bp, Homo sapiens
ctggctcagacagctgtgcagt

SEQ ID NO: 10033011 - DNA, 22 bp, Homo sapiens
ctggccctgtaggatgtgagtt

SEQ ID NO: 10033012 - DNA, 22 bp, Homo sapiens
ctggccctgtcagcacagaatc

SEQ ID NO: 10033013 - DNA, 23 bp, Homo sapiens
ctggccctggctctgtgatcatg

SEQ ID NO: 10033014 - DNA, 22 bp, Homo sapiens
ctggccctggctggagcccagg

SEQ ID NO: 10033015 - DNA, 22 bp, Homo sapiens
ctggccctggtaaggacaccca

SEQ ID NO: 10033016 - DNA, 19 bp, Homo sapiens
ctggccaggccaggggccc

SEQ ID NO: 10033017 - DNA, 22 bp, Homo sapiens
ctggccctattccaggccttcc

SEQ ID NO: 10033018 - DNA, 22 bp, Homo sapiens
ctggccctatgagcctcctgat

SEQ ID NO: 10033019 - DNA, 22 bp, Homo sapiens
ctggccctgccagagatcaaca

SEQ ID NO: 10033020 - DNA, 22 bp, Homo sapiens
ctggccctcgtcagtttcactg

SEQ ID NO: 10033021 - DNA, 22 bp, Homo sapiens
ctggccctgcctaatgtacttg

SEQ ID NO: 10033022 - DNA, 22 bp, Homo sapiens
ctggccctgctccgcgccgcgg

SEQ ID NO: 10033023 - DNA, 22 bp, Homo sapiens
ctggccctggagggctgtgcga

SEQ ID NO: 10033024 - DNA, 16 bp, Homo sapiens
ctggccctggctctgg

SEQ ID NO: 10033025 - DNA, 22 bp, Homo sapiens
ctggccctcggagtccagctgc

SEQ ID NO: 10033026 - DNA, 22 bp, Homo sapiens
ctggccctcagactcatgggca

SEQ ID NO: 10033027 - DNA, 22 bp, Homo sapiens
cttcctctgcggcgccgggcgc

SEQ ID NO: 10033028 - DNA, 22 bp, Homo sapiens
cttcctctgtgtcctgggcttg

SEQ ID NO: 10033029 - DNA, 22 bp, Homo sapiens
cttcctctgtgtcctgggcttc

SEQ ID NO: 10033030 - DNA, 23 bp, Homo sapiens
cttgcagggctggaggcttagaa

SEQ ID NO: 10033031 - DNA, 22 bp, Homo sapiens
cttgcaggcctttctagctcta

SEQ ID NO: 10033032 - DNA, 22 bp, Homo sapiens
cttgcaggattttgctgctgta

SEQ ID NO: 10033033 - DNA, 23 bp, Homo sapiens
cttgcaggaagcagatggcacac

SEQ ID NO: 10033034 - DNA, 22 bp, Homo sapiens
cttcctgaggtgctgagcacag

SEQ ID NO: 10033035 - DNA, 22 bp, Homo sapiens
ctgtgcagtggcagcgtgtggg

SEQ ID NO: 10033036 - DNA, 22 bp, Homo sapiens
ctgtgcagtccagccctggaca

SEQ ID NO: 10033037 - DNA, 22 bp, Homo sapiens
ctgtgccactgccctgccacgc

SEQ ID NO: 10033038 - DNA, 22 bp, Homo sapiens
ctgtgccaggcccagctgactt

SEQ ID NO: 10033039 - DNA, 22 bp, Homo sapiens
ctgtgccagtgtattcctgtga

SEQ ID NO: 10033040 - DNA, 22 bp, Homo sapiens
ctgtgcccagctccctgactgc

SEQ ID NO: 10033041 - DNA, 22 bp, Homo sapiens
ctgtgccattctttgtagcatg

SEQ ID NO: 10033042 - DNA, 22 bp, Homo sapiens
ctgtgccatctttttgctacct

SEQ ID NO: 10033043 - DNA, 22 bp, Homo sapiens
ctgtgcccggcccagggccctg

SEQ ID NO: 10033044 - DNA, 22 bp, Homo sapiens
ctgtgcccaggctggagtgcag

SEQ ID NO: 10033045 - DNA, 22 bp, Homo sapiens
ctgtgccccacagagctccaca

SEQ ID NO: 10033046 - DNA, 23 bp, Homo sapiens
ctgtgcccggggctccacctgat

SEQ ID NO: 10033047 - DNA, 22 bp, Homo sapiens
ctgtccctgagcaactcctgtt

SEQ ID NO: 10033048 - DNA, 22 bp, Homo sapiens
ctgtgtctaatcaggtcagtca

SEQ ID NO: 10033049 - DNA, 22 bp, Homo sapiens
ctgtgtagtcaggtggtcccac

SEQ ID NO: 10033050 - DNA, 22 bp, Homo sapiens
ctgtgtagagcggctgcgagcg

SEQ ID NO: 10033051 - DNA, 20 bp, Homo sapiens
ctgtggctcatgcatctgcc

SEQ ID NO: 10033052 - DNA, 22 bp, Homo sapiens
gagcagcacttgaggcatgtca

SEQ ID NO: 10033053 - DNA, 22 bp, Homo sapiens
gagcagcaggtggggctggctt

SEQ ID NO: 10033054 - DNA, 18 bp, Homo sapiens
gagcagcaggatcaagaa

SEQ ID NO: 10033055 - DNA, 22 bp, Homo sapiens
gagcagcaggccaggttgcagg

SEQ ID NO: 10033056 - DNA, 22 bp, Homo sapiens
gagcagcagctgggccaggttc

SEQ ID NO: 10033057 - DNA, 22 bp, Homo sapiens
gagccactgttgggcactttcc

SEQ ID NO: 10033058 - DNA, 22 bp, Homo sapiens
gagcagcttatgtcaagccaga

SEQ ID NO: 10033059 - DNA, 22 bp, Homo sapiens
gagcagctgcagtgcagaccct

SEQ ID NO: 10033060 - DNA, 22 bp, Homo sapiens
gagcagctggacaggcctccct

SEQ ID NO: 10033061 - DNA, 22 bp, Homo sapiens
gagatgagtgggggatctctca

SEQ ID NO: 10033062 - DNA, 22 bp, Homo sapiens
gagagggagccagccaggaacc

SEQ ID NO: 10033063 - DNA, 22 bp, Homo sapiens
gagagggatactgagttttggt

SEQ ID NO: 10033064 - DNA, 22 bp, Homo sapiens
gaggcagaggaaggtggtctct

SEQ ID NO: 10033065 - DNA, 22 bp, Homo sapiens
gaggcagaggttgcagtgagct

SEQ ID NO: 10033066 - DNA, 22 bp, Homo sapiens
gaggccagctagtccaggaagt

SEQ ID NO: 10033067 - DNA, 22 bp, Homo sapiens
gaggccaggaagcccaagatca

SEQ ID NO: 10033068 - DNA, 22 bp, Homo sapiens
gaggccaggacatgaaagctga

SEQ ID NO: 10033069 - DNA, 22 bp, Homo sapiens
gaggcagaagttgcagtgagca

SEQ ID NO: 10033070 - DNA, 22 bp, Homo sapiens
gaggcagagaccttcaggacct

SEQ ID NO: 10033071 - DNA, 22 bp, Homo sapiens
gaggcagagaccttcaggacct

SEQ ID NO: 10033072 - DNA, 22 bp, Homo sapiens
gaggcactggaggaaaggagaa

SEQ ID NO: 10033073 - DNA, 22 bp, Homo sapiens
gaggcagaagttgcagtgagca

SEQ ID NO: 10033074 - DNA, 23 bp, Homo sapiens
gaggcactcaggaaatgtgagtg

SEQ ID NO: 10033075 - DNA, 22 bp, Homo sapiens
gaggcacctcgcgggaggaggc

SEQ ID NO: 10033076 - DNA, 22 bp, Homo sapiens
gaggcactgcagtacagtgact

SEQ ID NO: 10033077 - DNA, 22 bp, Homo sapiens
gaggaggccagtggaaggaagc

SEQ ID NO: 10033078 - DNA, 22 bp, Homo sapiens
gaggaggcacttgagcagatgt

SEQ ID NO: 10033079 - DNA, 19 bp, Homo sapiens
gaggagctatcggagacag

SEQ ID NO: 10033080 - DNA, 22 bp, Homo sapiens
gaggagcttgtgagaagatgtc

SEQ ID NO: 10033081 - DNA, 22 bp, Homo sapiens
gaggagcttgaggctaggagcc

SEQ ID NO: 10033082 - DNA, 22 bp, Homo sapiens
gagcctggacatctcaggccca

SEQ ID NO: 10033083 - DNA, 22 bp, Homo sapiens
gagcctgaaatacaggtcactg

SEQ ID NO: 10033084 - DNA, 22 bp, Homo sapiens
gagccctgttcaggcctcctca

SEQ ID NO: 10033085 - DNA, 22 bp, Homo sapiens
gaacagtactaagagctttaca

SEQ ID NO: 10033086 - DNA, 22 bp, Homo sapiens
gaaatatttctcttgagcccct

SEQ ID NO: 10033087 - DNA, 22 bp, Homo sapiens
gaagaggactgtggcatcctag

SEQ ID NO: 10033088 - DNA, 22 bp, Homo sapiens
gaagaggatgacaggagccggt

SEQ ID NO: 10033089 - DNA, 22 bp, Homo sapiens
gaccctggtgtccaggtcctgc

SEQ ID NO: 10033090 - DNA, 22 bp, Homo sapiens
gaccctggctggagctggcctg

SEQ ID NO: 10033091 - DNA, 22 bp, Homo sapiens
gaccctggctgccgcggtctgg

SEQ ID NO: 10033092 - DNA, 22 bp, Homo sapiens
gacacagacagttagaggtaat

SEQ ID NO: 10033093 - DNA, 22 bp, Homo sapiens
gacacagagacttgcagttgta

SEQ ID NO: 10033094 - DNA, 22 bp, Homo sapiens
gacagggaaacattgaagtgtc

SEQ ID NO: 10033095 - DNA, 22 bp, Homo sapiens
gaaggaaaacagatctgcctga

SEQ ID NO: 10033096 - DNA, 22 bp, Homo sapiens
gaaggaaaggtctcatgccttt

SEQ ID NO: 10033097 - DNA, 22 bp, Homo sapiens
ctgacccatataagagtggagg

SEQ ID NO: 10033098 - DNA, 22 bp, Homo sapiens
ctgacccatataagagtggagg

SEQ ID NO: 10033099 - DNA, 20 bp, Homo sapiens
ctgacccaatctctgtcccc

SEQ ID NO: 10033100 - DNA, 22 bp, Homo sapiens
ctgagcctccatttcatcaggt

SEQ ID NO: 10033101 - DNA, 22 bp, Homo sapiens
ctgagcccgttgtgaatattcc

SEQ ID NO: 10033102 - DNA, 22 bp, Homo sapiens
ctgactcccaaagaggacgcgt

SEQ ID NO: 10033103 - DNA, 22 bp, Homo sapiens
ctgactcctatgccccatgggc

SEQ ID NO: 10033104 - DNA, 22 bp, Homo sapiens
ctgactccctgattctgggttt

SEQ ID NO: 10033105 - DNA, 22 bp, Homo sapiens
ttttagtgtagtcaccgtgggt

SEQ ID NO: 10033106 - DNA, 22 bp, Homo sapiens
ttttcagttactgtttatgtga

SEQ ID NO: 10033107 - DNA, 22 bp, Homo sapiens
ttttcaggtgcagtaatcatat

SEQ ID NO: 10033108 - DNA, 22 bp, Homo sapiens
tttgtacatatataaaatctgt

SEQ ID NO: 10033109 - DNA, 22 bp, Homo sapiens
ctctgctttttagggagcctag

SEQ ID NO: 10033110 - DNA, 21 bp, Homo sapiens
ctctgcccagggcctcctgcc

SEQ ID NO: 10033111 - DNA, 22 bp, Homo sapiens
ctctgcccagtgcccacaggag

SEQ ID NO: 10033112 - DNA, 19 bp, Homo sapiens
ctctgccctacagaaagct

SEQ ID NO: 10033113 - DNA, 22 bp, Homo sapiens
ctctgcccccagctggtgcttg

SEQ ID NO: 10033114 - DNA, 22 bp, Homo sapiens
ctctgccctcgcacatctgcca

SEQ ID NO: 10033115 - DNA, 19 bp, Homo sapiens
ctctgcctccctcctgggt

SEQ ID NO: 10033116 - DNA, 22 bp, Homo sapiens
tttgcattttagatttaggcct

SEQ ID NO: 10033117 - DNA, 22 bp, Homo sapiens
tttgccacattctatacatttg

SEQ ID NO: 10033118 - DNA, 22 bp, Homo sapiens
tttccttgttcatttgccctat

SEQ ID NO: 10033119 - DNA, 19 bp, Homo sapiens
ctctgccatttgctgcctg

SEQ ID NO: 10033120 - DNA, 22 bp, Homo sapiens
ctctgccatctcactgggtcct

SEQ ID NO: 10033121 - DNA, 22 bp, Homo sapiens
ctctgccagtttctggcctcag

SEQ ID NO: 10033122 - DNA, 22 bp, Homo sapiens
ctctgccaccatgcttcctgac

SEQ ID NO: 10033123 - DNA, 22 bp, Homo sapiens
ctcccaggcacagggaggagcc

SEQ ID NO: 10033124 - DNA, 22 bp, Homo sapiens
ctcccaggactcagaggagaag

SEQ ID NO: 10033125 - DNA, 22 bp, Homo sapiens
tttccttgggtctcttagtggc

SEQ ID NO: 10033126 - DNA, 22 bp, Homo sapiens
tttccttgcctcctgtccttct

SEQ ID NO: 10033127 - DNA, 22 bp, Homo sapiens
tttccttgttattatttgtcct

SEQ ID NO: 10033128 - DNA, 18 bp, Homo sapiens
tttccttgtatgaacata

SEQ ID NO: 10033129 - DNA, 22 bp, Homo sapiens
tttagtactcaggggagaagtt

SEQ ID NO: 10033130 - DNA, 22 bp, Homo sapiens
tttagtactgtttaaaaatgga

SEQ ID NO: 10033131 - DNA, 22 bp, Homo sapiens
ctcctccacagacctactgaat

SEQ ID NO: 10033132 - DNA, 22 bp, Homo sapiens
tttatttaccttatgtcctcca

SEQ ID NO: 10033133 - DNA, 22 bp, Homo sapiens
tttattgtttagaagggggctg

SEQ ID NO: 10033134 - DNA, 22 bp, Homo sapiens
tttattgttatcatgggtgagt

SEQ ID NO: 10033135 - DNA, 22 bp, Homo sapiens
ctcctccagacttactgaatcc

SEQ ID NO: 10033136 - DNA, 18 bp, Homo sapiens
ctcctccacagcccctgc

SEQ ID NO: 10033137 - DNA, 22 bp, Homo sapiens
ctcctccagcttccagtggctc

SEQ ID NO: 10033138 - DNA, 22 bp, Homo sapiens
ccttcctttcagggctatgcct

SEQ ID NO: 10033139 - DNA, 22 bp, Homo sapiens
ccttccttgagaagcaattcct

SEQ ID NO: 10033140 - DNA, 22 bp, Homo sapiens
ttagaaaaatgttcagtagttt

SEQ ID NO: 10033141 - DNA, 22 bp, Homo sapiens
cctgtgtggccgcactgctccc

SEQ ID NO: 10033142 - DNA, 22 bp, Homo sapiens
cctgtgccttccttaggcacct

SEQ ID NO: 10033143 - DNA, 22 bp, Homo sapiens
cctgtctgtttgcccattcttg

SEQ ID NO: 10033144 - DNA, 23 bp, Homo sapiens
cctgtgacactgtttgtggtaag

SEQ ID NO: 10033145 - DNA, 19 bp, Homo sapiens
cctgtctgtcttcagctag

SEQ ID NO: 10033146 - DNA, 22 bp, Homo sapiens
cctgtctggccttccacggggg

SEQ ID NO: 10033147 - DNA, 20 bp, Homo sapiens
cctgtctggagacaaagaga

SEQ ID NO: 10033148 - DNA, 18 bp, Homo sapiens
cctgtctggggtccccac

SEQ ID NO: 10033149 - DNA, 22 bp, Homo sapiens
cctgtctgtattattcaccact

SEQ ID NO: 10033150 - DNA, 22 bp, Homo sapiens
tgtttataaattttcttgccat

SEQ ID NO: 10033151 - DNA, 22 bp, Homo sapiens
cctgtctgcatgatccctgcca

SEQ ID NO: 10033152 - DNA, 22 bp, Homo sapiens
cctgtctgcagatatctcaggt

SEQ ID NO: 10033153 - DNA, 22 bp, Homo sapiens
cctgtctgaaggcagggggatg

SEQ ID NO: 10033154 - DNA, 22 bp, Homo sapiens
cctgtctgaatcatgatttcct

SEQ ID NO: 10033155 - DNA, 22 bp, Homo sapiens
cctgggcaacatagtgagacct

SEQ ID NO: 10033156 - DNA, 22 bp, Homo sapiens
cctgggcaaatgccagagacaa

SEQ ID NO: 10033157 - DNA, 22 bp, Homo sapiens
cctgggcaaattatgttactca

SEQ ID NO: 10033158 - DNA, 22 bp, Homo sapiens
cctgggatttcctgagcactct

SEQ ID NO: 10033159 - DNA, 22 bp, Homo sapiens
cctgggcaacatagtgagaccc

SEQ ID NO: 10033160 - DNA, 22 bp, Homo sapiens
cctgggctgcatgatggcattt

SEQ ID NO: 10033161 - DNA, 22 bp, Homo sapiens
cctgggcttacgacctctgact

SEQ ID NO: 10033162 - DNA, 22 bp, Homo sapiens
tgtgttctgaaggagaagagtg

SEQ ID NO: 10033163 - DNA, 22 bp, Homo sapiens
tgttacaaggaagaatgtaggt

SEQ ID NO: 10033164 - DNA, 22 bp, Homo sapiens
ttcatctggaagttcccaaggc

SEQ ID NO: 10033165 - DNA, 22 bp, Homo sapiens
ttcatgaatgttccatgtgagt

SEQ ID NO: 10033166 - DNA, 22 bp, Homo sapiens
ttcagggagagcgggacgggtg

SEQ ID NO: 10033167 - DNA, 22 bp, Homo sapiens
ctagcagcattcttctagttag

SEQ ID NO: 10033168 - DNA, 22 bp, Homo sapiens
ctattacaatctgctactatga

SEQ ID NO: 10033169 - DNA, 18 bp, Homo sapiens
ctattacaatgcagtggt

SEQ ID NO: 10033170 - DNA, 22 bp, Homo sapiens
ctattacagggaagccttggga

SEQ ID NO: 10033171 - DNA, 22 bp, Homo sapiens
ctattacaattctgcaaggagt

SEQ ID NO: 10033172 - DNA, 22 bp, Homo sapiens
ctattacatttctggacattca

SEQ ID NO: 10033173 - DNA, 22 bp, Homo sapiens
ctcacagatacggctattcctg

SEQ ID NO: 10033174 - DNA, 22 bp, Homo sapiens
ctacccaggcttagagggctgg

SEQ ID NO: 10033175 - DNA, 22 bp, Homo sapiens
ctactctgaaaacccagaaact

SEQ ID NO: 10033176 - DNA, 22 bp, Homo sapiens
ctactactccaccacttaccag

SEQ ID NO: 10033177 - DNA, 22 bp, Homo sapiens
ctactgccattgtctctgccat

SEQ ID NO: 10033178 - DNA, 23 bp, Homo sapiens
ctactgccttgcacaggctagat

SEQ ID NO: 10033179 - DNA, 22 bp, Homo sapiens
ctacttcttgatctgtcgacct

SEQ ID NO: 10033180 - DNA, 22 bp, Homo sapiens
ttccaggaccaggaagagggga

SEQ ID NO: 10033181 - DNA, 22 bp, Homo sapiens
ttccaggaggaaagtttgggtg

SEQ ID NO: 10033182 - DNA, 22 bp, Homo sapiens
ttccaggagccacacaggggcg

SEQ ID NO: 10033183 - DNA, 22 bp, Homo sapiens
ttccaggagaggaaacctgatt

SEQ ID NO: 10033184 - DNA, 22 bp, Homo sapiens
ttccaggacttcatggctctga

SEQ ID NO: 10033185 - DNA, 22 bp, Homo sapiens
ttccaggactcgttctggctca

SEQ ID NO: 10033186 - DNA, 22 bp, Homo sapiens
ttccaggactcgttctggctca

SEQ ID NO: 10033187 - DNA, 22 bp, Homo sapiens
ttccaggaggcttggcgggagg

SEQ ID NO: 10033188 - DNA, 22 bp, Homo sapiens
ttccaggaggcactgacagagg

SEQ ID NO: 10033189 - DNA, 22 bp, Homo sapiens
ttccaggaggaggtactagagg

SEQ ID NO: 10033190 - DNA, 22 bp, Homo sapiens
ttccaggatggagacactagta

SEQ ID NO: 10033191 - DNA, 22 bp, Homo sapiens
ttccaggaggtcaaaggcctgt

SEQ ID NO: 10033192 - DNA, 22 bp, Homo sapiens
ttccaggatggcaataatgaat

SEQ ID NO: 10033193 - DNA, 22 bp, Homo sapiens
cctgagctgaactaagcagttt

SEQ ID NO: 10033194 - DNA, 22 bp, Homo sapiens
cctgagctctgcactttttaga

SEQ ID NO: 10033195 - DNA, 22 bp, Homo sapiens
cctgagctagggaaggaagacc

SEQ ID NO: 10033196 - DNA, 22 bp, Homo sapiens
cctgagcctggctcatgcactc

SEQ ID NO: 10033197 - DNA, 23 bp, Homo sapiens
tgggccctggagtcgccagtctg

SEQ ID NO: 10033198 - DNA, 22 bp, Homo sapiens
cctgagcctcttgcacgctcag

SEQ ID NO: 10033199 - DNA, 22 bp, Homo sapiens
cctgagcctgagtggtgcaggg

SEQ ID NO: 10033200 - DNA, 18 bp, Homo sapiens
cctgagccctgcttactt

SEQ ID NO: 10033201 - DNA, 22 bp, Homo sapiens
cctgagccgagcgctctttctc

SEQ ID NO: 10033202 - DNA, 22 bp, Homo sapiens
cctgagccaagagtcagaatct

SEQ ID NO: 10033203 - DNA, 22 bp, Homo sapiens
cctgagcagggctctgcagggc

SEQ ID NO: 10033204 - DNA, 23 bp, Homo sapiens
tgggagtgttgggatctctgctc

SEQ ID NO: 10033205 - DNA, 22 bp, Homo sapiens
cctcttctaggacgtccttgtg

SEQ ID NO: 10033206 - DNA, 22 bp, Homo sapiens
tgggagtgttcttggcttgctt

SEQ ID NO: 10033207 - DNA, 22 bp, Homo sapiens
cctcttctcaactccagccaga

SEQ ID NO: 10033208 - DNA, 19 bp, Homo sapiens
cctcttctctggcagcaga

SEQ ID NO: 10033209 - DNA, 22 bp, Homo sapiens
cctctgtggccttggaccagct

SEQ ID NO: 10033210 - DNA, 22 bp, Homo sapiens
cctctgctgctgttgagcaccg

SEQ ID NO: 10033211 - DNA, 22 bp, Homo sapiens
cctctgagtagactggacatga

SEQ ID NO: 10033212 - DNA, 22 bp, Homo sapiens
cctctgaggtgagcccagctgg

SEQ ID NO: 10033213 - DNA, 20 bp, Homo sapiens
cctctgccccggggctgcta

SEQ ID NO: 10033214 - DNA, 22 bp, Homo sapiens
cctctgcccttttcctgtatca

SEQ ID NO: 10033215 - DNA, 18 bp, Homo sapiens
cctctgccatagccagca

SEQ ID NO: 10033216 - DNA, 22 bp, Homo sapiens
cctctgcctgcacatcatcctg

SEQ ID NO: 10033217 - DNA, 20 bp, Homo sapiens
cctctgcctttctagtctga

SEQ ID NO: 10033218 - DNA, 19 bp, Homo sapiens
tggcagaggacaaggactt

SEQ ID NO: 10033219 - DNA, 21 bp, Homo sapiens
cccttcttgggtcaaagtata

SEQ ID NO: 10033220 - DNA, 22 bp, Homo sapiens
cccttcctcaaggagctgtgtt

SEQ ID NO: 10033221 - DNA, 22 bp, Homo sapiens
tggagcagggcatcactgtgcg

SEQ ID NO: 10033222 - DNA, 22 bp, Homo sapiens
ccctgcagccttgcatgccttc

SEQ ID NO: 10033223 - DNA, 22 bp, Homo sapiens
cctagagctctgctttatctaa

SEQ ID NO: 10033224 - DNA, 22 bp, Homo sapiens
cctagagctctgctttatctaa

SEQ ID NO: 10033225 - DNA, 22 bp, Homo sapiens
cctagagtctctctgcaggagt

SEQ ID NO: 10033226 - DNA, 22 bp, Homo sapiens
cctcagaggtgaacatcagtgc

SEQ ID NO: 10033227 - DNA, 22 bp, Homo sapiens
cctcagaggcatggttagaata

SEQ ID NO: 10033228 - DNA, 23 bp, Homo sapiens
cctcagaggcctcatagtctggc

SEQ ID NO: 10033229 - DNA, 22 bp, Homo sapiens
cctcagaggcagatggtaagaa

SEQ ID NO: 10033230 - DNA, 18 bp, Homo sapiens
cctcagaggcaaattgtt

SEQ ID NO: 10033231 - DNA, 22 bp, Homo sapiens
tggctctgaccaggtagaggag

SEQ ID NO: 10033232 - DNA, 22 bp, Homo sapiens
cctcaggctagctactgtccct

SEQ ID NO: 10033233 - DNA, 22 bp, Homo sapiens
tggcccagatctctgaccttga

SEQ ID NO: 10033234 - DNA, 22 bp, Homo sapiens
tggcccagcactccaagtaggg

SEQ ID NO: 10033235 - DNA, 17 bp, Homo sapiens
cctcagcttctttcctc

SEQ ID NO: 10033236 - DNA, 20 bp, Homo sapiens
tggcccagcacgacgaggac

SEQ ID NO: 10033237 - DNA, 19 bp, Homo sapiens
tggcccagatggtcctggg

SEQ ID NO: 10033238 - DNA, 22 bp, Homo sapiens
cctcagagtttaagatgtcaga

SEQ ID NO: 10033239 - DNA, 22 bp, Homo sapiens
cctcagagttggccacgagagc

SEQ ID NO: 10033240 - DNA, 22 bp, Homo sapiens
cctcagagttatttgaagtgaa

SEQ ID NO: 10033241 - DNA, 22 bp, Homo sapiens
cctcagagtctagtaaataata

SEQ ID NO: 10033242 - DNA, 22 bp, Homo sapiens
cctcagagttggaatcacattt

SEQ ID NO: 10033243 - DNA, 22 bp, Homo sapiens
cctcagaggtgtggcatctctg

SEQ ID NO: 10033244 - DNA, 22 bp, Homo sapiens
cctcagaggttttcattctgta

SEQ ID NO: 10033245 - DNA, 22 bp, Homo sapiens
cctcagaggttctgtgtgggaa

SEQ ID NO: 10033246 - DNA, 22 bp, Homo sapiens
cctcagagtaggtctcagctgt

SEQ ID NO: 10033247 - DNA, 22 bp, Homo sapiens
tgctggccaagcagaggtcaat

SEQ ID NO: 10033248 - DNA, 22 bp, Homo sapiens
cccagtttcaactttccagtgg

SEQ ID NO: 10033249 - DNA, 22 bp, Homo sapiens
cccattccctttactgttgcat

SEQ ID NO: 10033250 - DNA, 22 bp, Homo sapiens
cccattgtggttgttgaggata

SEQ ID NO: 10033251 - DNA, 22 bp, Homo sapiens
tgctggcctcggcgctgggcct

SEQ ID NO: 10033252 - DNA, 22 bp, Homo sapiens
tgctggcccagtatggactgca

SEQ ID NO: 10033253 - DNA, 21 bp, Homo sapiens
tgctggccatgtgctgggcat

SEQ ID NO: 10033254 - DNA, 23 bp, Homo sapiens
tgctgtgcctttgtctgcctcca

SEQ ID NO: 10033255 - DNA, 22 bp, Homo sapiens
ccctcgaggttttctgaggtac

SEQ ID NO: 10033256 - DNA, 22 bp, Homo sapiens
ccctgaggaaagggtggagggc

SEQ ID NO: 10033257 - DNA, 23 bp, Homo sapiens
ccctgagctggtccaggctcaac

SEQ ID NO: 10033258 - DNA, 22 bp, Homo sapiens
ccctgagccgcctgccgtgtcc

SEQ ID NO: 10033259 - DNA, 22 bp, Homo sapiens
ccctgagcgtgaggaggaagta

SEQ ID NO: 10033260 - DNA, 22 bp, Homo sapiens
ccctgagctcaggcccttgggg

SEQ ID NO: 10033261 - DNA, 22 bp, Homo sapiens
ccctgagccgctgctccaacct

SEQ ID NO: 10033262 - DNA, 22 bp, Homo sapiens
ccctgagccacacagagcaggt

SEQ ID NO: 10033263 - DNA, 22 bp, Homo sapiens
ccctgagcccatagttgacatt

SEQ ID NO: 10033264 - DNA, 22 bp, Homo sapiens
ccctgagcattcatgtgagctt

SEQ ID NO: 10033265 - DNA, 22 bp, Homo sapiens
ccctgagatgtgaatttcagag

SEQ ID NO: 10033266 - DNA, 22 bp, Homo sapiens
ccctgagcaacaaactgaatac

SEQ ID NO: 10033267 - DNA, 22 bp, Homo sapiens
ccctgagcagtctgcagagagc

SEQ ID NO: 10033268 - DNA, 22 bp, Homo sapiens
ccctgagcacacctggcagaca

SEQ ID NO: 10033269 - DNA, 22 bp, Homo sapiens
ccctgagaggttgagtgtctgc

SEQ ID NO: 10033270 - DNA, 22 bp, Homo sapiens
ccctgaacagtgagagataggg

SEQ ID NO: 10033271 - DNA, 22 bp, Homo sapiens
ccctgagagcagggtctttctc

SEQ ID NO: 10033272 - DNA, 20 bp, Homo sapiens
ccctgagacgactgagctcc

SEQ ID NO: 10033273 - DNA, 20 bp, Homo sapiens
ccctgagaccagagagcagc

SEQ ID NO: 10033274 - DNA, 20 bp, Homo sapiens
ccctgagacaaaggaggggc

SEQ ID NO: 10033275 - DNA, 22 bp, Homo sapiens
tgccttcctgctttgagttctg

SEQ ID NO: 10033276 - DNA, 22 bp, Homo sapiens
cccagggacagctaggtggggc

SEQ ID NO: 10033277 - DNA, 22 bp, Homo sapiens
tgcctgtgtggggtctgccgcc

SEQ ID NO: 10033278 - DNA, 22 bp, Homo sapiens
tgcctgtgtggtctgcgcatta

SEQ ID NO: 10033279 - DNA, 22 bp, Homo sapiens
cccaggggttcaaggctgcagt

SEQ ID NO: 10033280 - DNA, 22 bp, Homo sapiens
cccagggtggatgcaagcagca

SEQ ID NO: 10033281 - DNA, 20 bp, Homo sapiens
cccaggtaggtgccatgagt

SEQ ID NO: 10033282 - DNA, 21 bp, Homo sapiens
cccagggaagccgcagtcacc

SEQ ID NO: 10033283 - DNA, 22 bp, Homo sapiens
cccagggaatgactctggcctt

SEQ ID NO: 10033284 - DNA, 22 bp, Homo sapiens
cccagggaatgactctggcctt

SEQ ID NO: 10033285 - DNA, 23 bp, Homo sapiens
cccagggacacgatgacacctcc

SEQ ID NO: 10033286 - DNA, 23 bp, Homo sapiens
cccagggacacgatgacacctcc

SEQ ID NO: 10033287 - DNA, 22 bp, Homo sapiens
cccagggaaggcagatggagga

SEQ ID NO: 10033288 - DNA, 22 bp, Homo sapiens
tgccctggtagacacagactgt

SEQ ID NO: 10033289 - DNA, 22 bp, Homo sapiens
tgccctggtatcatgtggaatt

SEQ ID NO: 10033290 - DNA, 22 bp, Homo sapiens
cccaggagagggaaccaaatgt

SEQ ID NO: 10033291 - DNA, 22 bp, Homo sapiens
cccaggagagaggggataaagc

SEQ ID NO: 10033292 - DNA, 22 bp, Homo sapiens
cccaggagagaggccagttggc

SEQ ID NO: 10033293 - DNA, 22 bp, Homo sapiens
cccaggagataacgttcccaag

SEQ ID NO: 10033294 - DNA, 22 bp, Homo sapiens
cccaggagactgagctgtaacc

SEQ ID NO: 10033295 - DNA, 22 bp, Homo sapiens
cccaggagagagacttgaatct

SEQ ID NO: 10033296 - DNA, 22 bp, Homo sapiens
cccaggagacctgtgaaaggac

SEQ ID NO: 10033297 - DNA, 22 bp, Homo sapiens
cccaggagacctagatctgttt

SEQ ID NO: 10033298 - DNA, 22 bp, Homo sapiens
tgccaggatggccagggggcca

SEQ ID NO: 10033299 - DNA, 22 bp, Homo sapiens
tgccaggatataagagtgcgat

SEQ ID NO: 10033300 - DNA, 22 bp, Homo sapiens
tgccaggagtcaggccaggcag

SEQ ID NO: 10033301 - DNA, 22 bp, Homo sapiens
tgccagctccgaggagctgcag

SEQ ID NO: 10033302 - DNA, 22 bp, Homo sapiens
tgccagctcccttttctcctcc

SEQ ID NO: 10033303 - DNA, 21 bp, Homo sapiens
tgccagctgctgcatctgtct

SEQ ID NO: 10033304 - DNA, 22 bp, Homo sapiens
tgccagctgacagcagagacaa

SEQ ID NO: 10033305 - DNA, 22 bp, Homo sapiens
tgccagctcctgcagctcctgt

SEQ ID NO: 10033306 - DNA, 22 bp, Homo sapiens
tgccagcttttgactatcttag

SEQ ID NO: 10033307 - DNA, 22 bp, Homo sapiens
tgccagcttttgactatcttag

SEQ ID NO: 10033308 - DNA, 22 bp, Homo sapiens
tgccctgggctttgctatgact

SEQ ID NO: 10033309 - DNA, 22 bp, Homo sapiens
tgccctgggagttggagctgct

SEQ ID NO: 10033310 - DNA, 22 bp, Homo sapiens
tgccctggggagcccagccagg

SEQ ID NO: 10033311 - DNA, 22 bp, Homo sapiens
tgccctggggtctggagcagca

SEQ ID NO: 10033312 - DNA, 21 bp, Homo sapiens
tgccctggggctcttccctca

SEQ ID NO: 10033313 - DNA, 22 bp, Homo sapiens
tgccatattgcaaagtgtctgc

SEQ ID NO: 10033314 - DNA, 22 bp, Homo sapiens
tgcccagcgcccacattctgtc

SEQ ID NO: 10033315 - DNA, 22 bp, Homo sapiens
ccaggccaggagagcgaggttt

SEQ ID NO: 10033316 - DNA, 22 bp, Homo sapiens
ccaggccaggagagcgaggttt

SEQ ID NO: 10033317 - DNA, 22 bp, Homo sapiens
tctttcttcagccctgtaagat

SEQ ID NO: 10033318 - DNA, 22 bp, Homo sapiens
tctttggggcatctgggagatt

SEQ ID NO: 10033319 - DNA, 22 bp, Homo sapiens
ccaggccagcctggagcatggc

SEQ ID NO: 10033320 - DNA, 22 bp, Homo sapiens
ccaggccagagtgcagtggcac

SEQ ID NO: 10033321 - DNA, 17 bp, Homo sapiens
ccaggagagatgcttgt

SEQ ID NO: 10033322 - DNA, 22 bp, Homo sapiens
ccaggagactgtactgatattt

SEQ ID NO: 10033323 - DNA, 22 bp, Homo sapiens
ccaggagacaaagatgactgct

SEQ ID NO: 10033324 - DNA, 22 bp, Homo sapiens
ccaggagacccagggaaggagc

SEQ ID NO: 10033325 - DNA, 22 bp, Homo sapiens
ccaggagtggctggtgaccttc

SEQ ID NO: 10033326 - DNA, 19 bp, Homo sapiens
ccaggagtggtggggtgag

SEQ ID NO: 10033327 - DNA, 22 bp, Homo sapiens
ccaggagtctggatgaggtgtc

SEQ ID NO: 10033328 - DNA, 22 bp, Homo sapiens
ccagctctgcatgtttcccttg

SEQ ID NO: 10033329 - DNA, 22 bp, Homo sapiens
ccagctctctttgaagcataaa

SEQ ID NO: 10033330 - DNA, 22 bp, Homo sapiens
ccagctgcatgacattaggtga

SEQ ID NO: 10033331 - DNA, 22 bp, Homo sapiens
ccagctgcatcctattcactgc

SEQ ID NO: 10033332 - DNA, 22 bp, Homo sapiens
ccagctgcaggggagcagtgga

SEQ ID NO: 10033333 - DNA, 18 bp, Homo sapiens
ccagctgcgctgaaccga

SEQ ID NO: 10033334 - DNA, 22 bp, Homo sapiens
ccagctgcctaagcaatccata

SEQ ID NO: 10033335 - DNA, 22 bp, Homo sapiens
ccagctgcccaagaggcatcct

SEQ ID NO: 10033336 - DNA, 21 bp, Homo sapiens
ccagctgctccttgaggttcc

SEQ ID NO: 10033337 - DNA, 17 bp, Homo sapiens
ccagctgctccctcaga

SEQ ID NO: 10033338 - DNA, 22 bp, Homo sapiens
ccagctgcgggcatcgagagtt

SEQ ID NO: 10033339 - DNA, 22 bp, Homo sapiens
ccagctgctgtgcagggaggct

SEQ ID NO: 10033340 - DNA, 22 bp, Homo sapiens
tctgctttgaccttcttgatgc

SEQ ID NO: 10033341 - DNA, 22 bp, Homo sapiens
ccagctctctgcagaaaggact

SEQ ID NO: 10033342 - DNA, 22 bp, Homo sapiens
tctgctttattacactagccaa

SEQ ID NO: 10033343 - DNA, 22 bp, Homo sapiens
tctgctttatggctcagagact

SEQ ID NO: 10033344 - DNA, 22 bp, Homo sapiens
ccagagagaaatggatttgagt

SEQ ID NO: 10033345 - DNA, 22 bp, Homo sapiens
tctggtgtcagtattctttgaa

SEQ ID NO: 10033346 - DNA, 20 bp, Homo sapiens
tctggtccaggtcttcatgg

SEQ ID NO: 10033347 - DNA, 22 bp, Homo sapiens
tctggtcccttttcctgcagtc

SEQ ID NO: 10033348 - DNA, 22 bp, Homo sapiens
tctggtccctgctcacttcttg

SEQ ID NO: 10033349 - DNA, 22 bp, Homo sapiens
ccaggagaatgggattacccta

SEQ ID NO: 10033350 - DNA, 22 bp, Homo sapiens
ccaggagaataatggcagatta

SEQ ID NO: 10033351 - DNA, 22 bp, Homo sapiens
ccaggagaagcatctgagtgta

SEQ ID NO: 10033352 - DNA, 22 bp, Homo sapiens
tctggcctcctccaccagggaa

SEQ ID NO: 10033353 - DNA, 22 bp, Homo sapiens
tctggcctgaaagtccatgctt

SEQ ID NO: 10033354 - DNA, 22 bp, Homo sapiens
tctggccctgctgctgtgagca

SEQ ID NO: 10033355 - DNA, 22 bp, Homo sapiens
tctggcaggggttctgcacttg

SEQ ID NO: 10033356 - DNA, 22 bp, Homo sapiens
ccaggacagtgaacatgtaaga

SEQ ID NO: 10033357 - DNA, 22 bp, Homo sapiens
tgagaccttggggagccctgtt

SEQ ID NO: 10033358 - DNA, 17 bp, Homo sapiens
ccaggtgggaggtgggg

SEQ ID NO: 10033359 - DNA, 22 bp, Homo sapiens
tgaggcagagtaagatacatga

SEQ ID NO: 10033360 - DNA, 22 bp, Homo sapiens
tgaggcagaaattcctgttttc

SEQ ID NO: 10033361 - DNA, 22 bp, Homo sapiens
tgaggcagaaaatagcagttca

SEQ ID NO: 10033362 - DNA, 22 bp, Homo sapiens
tgaggcagatatttattgggtt

SEQ ID NO: 10033363 - DNA, 22 bp, Homo sapiens
tgaggcagcaattgattattca

SEQ ID NO: 10033364 - DNA, 22 bp, Homo sapiens
tgaggcagcaattgtattgtat

SEQ ID NO: 10033365 - DNA, 22 bp, Homo sapiens
tgaggacatttatcttggcgca

SEQ ID NO: 10033366 - DNA, 22 bp, Homo sapiens
ccaggtggacaaggctttcaca

SEQ ID NO: 10033367 - DNA, 22 bp, Homo sapiens
tgacatcctacacccctgggtc

SEQ ID NO: 10033368 - DNA, 22 bp, Homo sapiens
ccagggctgctgtgggactcca

SEQ ID NO: 10033369 - DNA, 22 bp, Homo sapiens
cccagaaggtcgaggctgcagt

SEQ ID NO: 10033370 - DNA, 22 bp, Homo sapiens
ccattgtaaattctgtggaagt

SEQ ID NO: 10033371 - DNA, 22 bp, Homo sapiens
ccagtgttgaacagtatttgga

SEQ ID NO: 10033372 - DNA, 22 bp, Homo sapiens
tgaggggaactgatgcccattg

SEQ ID NO: 10033373 - DNA, 22 bp, Homo sapiens
ccagtgttctggtgttcatttc

SEQ ID NO: 10033374 - DNA, 22 bp, Homo sapiens
ccagtgttccagagagctgatg

SEQ ID NO: 10033375 - DNA, 22 bp, Homo sapiens
ccagtgttccatggagtgatta

SEQ ID NO: 10033376 - DNA, 22 bp, Homo sapiens
ccagtgttccctcgggttcatg

SEQ ID NO: 10033377 - DNA, 22 bp, Homo sapiens
ccagtgtttaggaataaaatgt

SEQ ID NO: 10033378 - DNA, 22 bp, Homo sapiens
ccagtgttggaggatggcttgc

SEQ ID NO: 10033379 - DNA, 22 bp, Homo sapiens
ccagtgtttacagttgaacaaa

SEQ ID NO: 10033380 - DNA, 22 bp, Homo sapiens
ccagtgttgcataggatgggga

SEQ ID NO: 10033381 - DNA, 22 bp, Homo sapiens
tgaggcagcattcttcaagaca

SEQ ID NO: 10033382 - DNA, 22 bp, Homo sapiens
tgaggcagcccactttccttag

SEQ ID NO: 10033383 - DNA, 22 bp, Homo sapiens
tgaggcagcctgcattaaagag

SEQ ID NO: 10033384 - DNA, 22 bp, Homo sapiens
ccagtgtttccccagaagagag

SEQ ID NO: 10033385 - DNA, 22 bp, Homo sapiens
ccagtgtttccgtcagtacacg

SEQ ID NO: 10033386 - DNA, 22 bp, Homo sapiens
ccagtgtttgatgggattttca

SEQ ID NO: 10033387 - DNA, 22 bp, Homo sapiens
ccagtgttttcatcctcccttg

SEQ ID NO: 10033388 - DNA, 22 bp, Homo sapiens
ccatgcctggactccactctca

SEQ ID NO: 10033389 - DNA, 22 bp, Homo sapiens
ccatgcctttcactgaaccagt

SEQ ID NO: 10033390 - DNA, 22 bp, Homo sapiens
ccatgccttcctttccctggaa

SEQ ID NO: 10033391 - DNA, 23 bp, Homo sapiens
tccaggagaattccagggcccgg

SEQ ID NO: 10033392 - DNA, 22 bp, Homo sapiens
tccaggagaaggccatccagcg

SEQ ID NO: 10033393 - DNA, 22 bp, Homo sapiens
catggcattgcataacggggct

SEQ ID NO: 10033394 - DNA, 22 bp, Homo sapiens
tcagtgccatgggcagacaggc

SEQ ID NO: 10033395 - DNA, 17 bp, Homo sapiens
catctgctctgcccctt

SEQ ID NO: 10033396 - DNA, 22 bp, Homo sapiens
catctggcagaccctgcctccg

SEQ ID NO: 10033397 - DNA, 22 bp, Homo sapiens
cagttttggtgatatttgagaa

SEQ ID NO: 10033398 - DNA, 22 bp, Homo sapiens
tcagagagtgcaaaatatagct

SEQ ID NO: 10033399 - DNA, 22 bp, Homo sapiens
tcagagagttggaaagaattaa

SEQ ID NO: 10033400 - DNA, 21 bp, Homo sapiens
tcagagagtcacagtgaactg

SEQ ID NO: 10033401 - DNA, 22 bp, Homo sapiens
tcagagaggttggtgataagaa

SEQ ID NO: 10033402 - DNA, 22 bp, Homo sapiens
cagttgcctactacatggcagg

SEQ ID NO: 10033403 - DNA, 22 bp, Homo sapiens
tcaggccctttgctgctgcccc

SEQ ID NO: 10033404 - DNA, 22 bp, Homo sapiens
tcagcaggtctgaggcggggcc

SEQ ID NO: 10033405 - DNA, 22 bp, Homo sapiens
tcagcaggggccgttgggtgga

SEQ ID NO: 10033406 - DNA, 22 bp, Homo sapiens
tcagcaggtggtgggcaggtga

SEQ ID NO: 10033407 - DNA, 22 bp, Homo sapiens
tctaatcctatggtggggaggg

SEQ ID NO: 10033408 - DNA, 22 bp, Homo sapiens
ccagagacaaggagctggagtc

SEQ ID NO: 10033409 - DNA, 19 bp, Homo sapiens
ccagagacattggcatctt

SEQ ID NO: 10033410 - DNA, 22 bp, Homo sapiens
tccttcctcggggacccagatc

SEQ ID NO: 10033411 - DNA, 22 bp, Homo sapiens
tcctgggcttcacagactctgt

SEQ ID NO: 10033412 - DNA, 22 bp, Homo sapiens
tcctgggcttagtggctaggtc

SEQ ID NO: 10033413 - DNA, 22 bp, Homo sapiens
tcctgggctttgtttctctcct

SEQ ID NO: 10033414 - DNA, 22 bp, Homo sapiens
tcctgggcttgctcctccagct

SEQ ID NO: 10033415 - DNA, 22 bp, Homo sapiens
tcctgggcttaagtgatcctcc

SEQ ID NO: 10033416 - DNA, 22 bp, Homo sapiens
tcctgggagcccttgctccacc

SEQ ID NO: 10033417 - DNA, 22 bp, Homo sapiens
tcctgggctgtgtgccactctg

SEQ ID NO: 10033418 - DNA, 22 bp, Homo sapiens
tcctgggagcatggtgccgtga

SEQ ID NO: 10033419 - DNA, 22 bp, Homo sapiens
tcctgggagcacatggtcctgc

SEQ ID NO: 10033420 - DNA, 22 bp, Homo sapiens
tcctgggactttcaaggctagg

SEQ ID NO: 10033421 - DNA, 22 bp, Homo sapiens
tcctgggagacccagctgtgga

SEQ ID NO: 10033422 - DNA, 22 bp, Homo sapiens
tcctgggagagtgggactgtat

SEQ ID NO: 10033423 - DNA, 22 bp, Homo sapiens
tcctgggactctgcctcaggct

SEQ ID NO: 10033424 - DNA, 22 bp, Homo sapiens
catttaatcctcacaagcctat

SEQ ID NO: 10033425 - DNA, 22 bp, Homo sapiens
catttacacacagaggtgtgct

SEQ ID NO: 10033426 - DNA, 22 bp, Homo sapiens
catttacaatgtacaggttgtg

SEQ ID NO: 10033427 - DNA, 22 bp, Homo sapiens
catttacacttctaaccacaag

SEQ ID NO: 10033428 - DNA, 22 bp, Homo sapiens
catttattcatttgctagggct

SEQ ID NO: 10033429 - DNA, 22 bp, Homo sapiens
catttattcatgatctgtagct

SEQ ID NO: 10033430 - DNA, 22 bp, Homo sapiens
tccctgggtcctgcttgctctc

SEQ ID NO: 10033431 - DNA, 22 bp, Homo sapiens
tccctggggttcctccagccac

SEQ ID NO: 10033432 - DNA, 22 bp, Homo sapiens
tccctgggtcattctctggcac

SEQ ID NO: 10033433 - DNA, 22 bp, Homo sapiens
tccctgggttacctttcaaggt

SEQ ID NO: 10033434 - DNA, 18 bp, Homo sapiens
tccctggggctgccaccc

SEQ ID NO: 10033435 - DNA, 20 bp, Homo sapiens
tccctggggccctacttcct

SEQ ID NO: 10033436 - DNA, 22 bp, Homo sapiens
tccctggggtaacattagaggg

SEQ ID NO: 10033437 - DNA, 22 bp, Homo sapiens
tccctggggtatcgctgaggca

SEQ ID NO: 10033438 - DNA, 22 bp, Homo sapiens
tccaggagattcattaggtcat

SEQ ID NO: 10033439 - DNA, 22 bp, Homo sapiens
tccaggagatacactgcaccag

SEQ ID NO: 10033440 - DNA, 22 bp, Homo sapiens
tccaggagaggtagagggttcc

SEQ ID NO: 10033441 - DNA, 22 bp, Homo sapiens
tccaggagaggtgtggggactg

SEQ ID NO: 10033442 - DNA, 22 bp, Homo sapiens
tccaggagacacccttgtgtgt

SEQ ID NO: 10033443 - DNA, 22 bp, Homo sapiens
tccaggagacacaaggtacata

SEQ ID NO: 10033444 - DNA, 17 bp, Homo sapiens
tccaggagaggcaatgg

SEQ ID NO: 10033445 - DNA, 22 bp, Homo sapiens
tccaggagaccagatgtaggcc

SEQ ID NO: 10033446 - DNA, 22 bp, Homo sapiens
tccaggagaggcctgaccaggt

SEQ ID NO: 10033447 - DNA, 22 bp, Homo sapiens
tccaggagcatccaggtgaagc

SEQ ID NO: 10033448 - DNA, 21 bp, Homo sapiens
tccaggagcacgggactagga

SEQ ID NO: 10033449 - DNA, 19 bp, Homo sapiens
tccaggagcaaagccagtt

SEQ ID NO: 10033450 - DNA, 22 bp, Homo sapiens
catgggcagaagtggcatcatt

SEQ ID NO: 10033451 - DNA, 22 bp, Homo sapiens
taggagggccctgaaaatggca

SEQ ID NO: 10033452 - DNA, 22 bp, Homo sapiens
cagggccattggcgtggctgtc

SEQ ID NO: 10033453 - DNA, 22 bp, Homo sapiens
cagggagatcttggctcctggt

SEQ ID NO: 10033454 - DNA, 22 bp, Homo sapiens
tattatcattggtaatatggtc

SEQ ID NO: 10033455 - DNA, 22 bp, Homo sapiens
caggtaaaaataaatttgtgag

SEQ ID NO: 10033456 - DNA, 22 bp, Homo sapiens
tattttatctgccagagtggag

SEQ ID NO: 10033457 - DNA, 22 bp, Homo sapiens
cagtcaggggtgggatcaaggc

SEQ ID NO: 10033458 - DNA, 22 bp, Homo sapiens
tacatttataaggcttctctgt

SEQ ID NO: 10033459 - DNA, 22 bp, Homo sapiens
tacatttacagagccttctctg

SEQ ID NO: 10033460 - DNA, 22 bp, Homo sapiens
caggcgagtgaacagactctca

SEQ ID NO: 10033461 - DNA, 22 bp, Homo sapiens
cagggacaaacaaggttgggga

SEQ ID NO: 10033462 - DNA, 22 bp, Homo sapiens
cagggacaaagtgagaaaggaa

SEQ ID NO: 10033463 - DNA, 22 bp, Homo sapiens
caggcagagttagagcaactgg

SEQ ID NO: 10033464 - DNA, 22 bp, Homo sapiens
caggcagagccaatcgtggggt

SEQ ID NO: 10033465 - DNA, 22 bp, Homo sapiens
caggcagagttagtgatttagg

SEQ ID NO: 10033466 - DNA, 22 bp, Homo sapiens
caggcagagttagagcaactgg

SEQ ID NO: 10033467 - DNA, 22 bp, Homo sapiens
taatacaaggcaggaagcagta

SEQ ID NO: 10033468 - DNA, 22 bp, Homo sapiens
caggcagcagaggagtgtggga

SEQ ID NO: 10033469 - DNA, 22 bp, Homo sapiens
gtgcttcctctgccaacactct

SEQ ID NO: 10033470 - DNA, 20 bp, Homo sapiens
tacaaacctccacactggtg

SEQ ID NO: 10033471 - DNA, 22 bp, Homo sapiens
caggcatgtggcccaggggtga

SEQ ID NO: 10033472 - DNA, 22 bp, Homo sapiens
ttaacaaagtaacgggaaaaga

SEQ ID NO: 10033473 - DNA, 22 bp, Homo sapiens
tgttttggttttcaccgagtcc

SEQ ID NO: 10033474 - DNA, 22 bp, Homo sapiens
ttaattacaaaacacataggtt

SEQ ID NO: 10033475 - DNA, 22 bp, Homo sapiens
ttaagaatgtgccttttggttg

SEQ ID NO: 10033476 - DNA, 20 bp, Homo sapiens
ttaagaaaagcacatcctgc

SEQ ID NO: 10033477 - DNA, 22 bp, Homo sapiens
ttacttacaaaggcaaaggaag

SEQ ID NO: 10033478 - DNA, 22 bp, Homo sapiens
ttagagaaccaatgaatagtct

SEQ ID NO: 10033479 - DNA, 22 bp, Homo sapiens
ttagagaagatgaaccatcgtt

SEQ ID NO: 10033480 - DNA, 22 bp, Homo sapiens
ttacaaactgtcatatagtatt

SEQ ID NO: 10033481 - DNA, 22 bp, Homo sapiens
ttacacagcttctatccttgaa

SEQ ID NO: 10033482 - DNA, 22 bp, Homo sapiens
ttacacagatggttagtagagg

SEQ ID NO: 10033483 - DNA, 22 bp, Homo sapiens
ttacacagaaattttattgcct

SEQ ID NO: 10033484 - DNA, 22 bp, Homo sapiens
tgtttgatgacgacattgtaga

SEQ ID NO: 10033485 - DNA, 22 bp, Homo sapiens
tgtttcatgaaacatgtttagg

SEQ ID NO: 10033486 - DNA, 20 bp, Homo sapiens
tgtttcataagctgtcctat

SEQ ID NO: 10033487 - DNA, 21 bp, Homo sapiens
tgtttcatgctattttcttgt

SEQ ID NO: 10033488 - DNA, 22 bp, Homo sapiens
tgttctcttctcattgaacatg

SEQ ID NO: 10033489 - DNA, 22 bp, Homo sapiens
tgtgtttgaggcatgttgcaga

SEQ ID NO: 10033490 - DNA, 21 bp, Homo sapiens
tgtgttcttctaggtcagcta

SEQ ID NO: 10033491 - DNA, 21 bp, Homo sapiens
tgtggcagagacaatgctagt

SEQ ID NO: 10033492 - DNA, 22 bp, Homo sapiens
tgtggcagagagagcttccttg

SEQ ID NO: 10033493 - DNA, 22 bp, Homo sapiens
tgtggcccgatcttgggagaca

SEQ ID NO: 10033494 - DNA, 22 bp, Homo sapiens
ttctgccttacgatattttcaa

SEQ ID NO: 10033495 - DNA, 22 bp, Homo sapiens
ttctgggcaggactggggaccc

SEQ ID NO: 10033496 - DNA, 19 bp, Homo sapiens
ttctgggcattcatattta

SEQ ID NO: 10033497 - DNA, 22 bp, Homo sapiens
ttctgggccaatctcttaatct

SEQ ID NO: 10033498 - DNA, 22 bp, Homo sapiens
ttctgggcatgttacattctgt

SEQ ID NO: 10033499 - DNA, 22 bp, Homo sapiens
ttctgggcagagctggagctgc

SEQ ID NO: 10033500 - DNA, 19 bp, Homo sapiens
ttctgggcagcacatgaat

SEQ ID NO: 10033501 - DNA, 20 bp, Homo sapiens
ttctgggcagccatgtactt

SEQ ID NO: 10033502 - DNA, 22 bp, Homo sapiens
ttcttacagagtttacagagcc

SEQ ID NO: 10033503 - DNA, 23 bp, Homo sapiens
ttctgggctgtggaagcctcggg

SEQ ID NO: 10033504 - DNA, 22 bp, Homo sapiens
ttctgggctcacagagcagcag

SEQ ID NO: 10033505 - DNA, 22 bp, Homo sapiens
ttctgggctctctttctgtgtg

SEQ ID NO: 10033506 - DNA, 22 bp, Homo sapiens
ttctgggctgtccagagggtga

SEQ ID NO: 10033507 - DNA, 21 bp, Homo sapiens
ttctgggccatgctgcttctc

SEQ ID NO: 10033508 - DNA, 22 bp, Homo sapiens
ttgagccctacctcagactttc

SEQ ID NO: 10033509 - DNA, 22 bp, Homo sapiens
ttgagcaggatggctatgcaca

SEQ ID NO: 10033510 - DNA, 19 bp, Homo sapiens
ttgagcagtgcttagcacc

SEQ ID NO: 10033511 - DNA, 22 bp, Homo sapiens
ttgatgttcataaatgatacag

SEQ ID NO: 10033512 - DNA, 22 bp, Homo sapiens
ttgattacaaagtagatacatt

SEQ ID NO: 10033513 - DNA, 22 bp, Homo sapiens
ttgagtctctgccaaaacacaa

SEQ ID NO: 10033514 - DNA, 22 bp, Homo sapiens
ttctagctttttgcaccaaggt

SEQ ID NO: 10033515 - DNA, 22 bp, Homo sapiens
ttcatggatcatgccttttgtg

SEQ ID NO: 10033516 - DNA, 22 bp, Homo sapiens
tttactttctcaagtatatagg

SEQ ID NO: 10033517 - DNA, 22 bp, Homo sapiens
tttatttgaatcaggggagaat

SEQ ID NO: 10033518 - DNA, 22 bp, Homo sapiens
tttatttggcatccagggagaa

SEQ ID NO: 10033519 - DNA, 22 bp, Homo sapiens
tttattacaccaggttaactca

SEQ ID NO: 10033520 - DNA, 22 bp, Homo sapiens
tttattagattatcaaagaggt

SEQ ID NO: 10033521 - DNA, 22 bp, Homo sapiens
ttgtctgctcctcccagcctca

SEQ ID NO: 10033522 - DNA, 22 bp, Homo sapiens
ttgcaagatgttaccattgtta

SEQ ID NO: 10033523 - DNA, 22 bp, Homo sapiens
ttggggtgttcagggtacttct

SEQ ID NO: 10033524 - DNA, 22 bp, Homo sapiens
ttgtgtttcccttgcatattcc

SEQ ID NO: 10033525 - DNA, 22 bp, Homo sapiens
tttctctgtgggctttatgcat

SEQ ID NO: 10033526 - DNA, 22 bp, Homo sapiens
tttctgcatcttgaaacagagc

SEQ ID NO: 10033527 - DNA, 22 bp, Homo sapiens
tttcttctatgtgtgatatttt

SEQ ID NO: 10033528 - DNA, 19 bp, Homo sapiens
tttcaggagctatgcaggg

SEQ ID NO: 10033529 - DNA, 22 bp, Homo sapiens
tttcaggattagtttaagcagg

SEQ ID NO: 10033530 - DNA, 22 bp, Homo sapiens
tttcagggagcctagaagagct

SEQ ID NO: 10033531 - DNA, 22 bp, Homo sapiens
tttcagggtacatggagcaaat

SEQ ID NO: 10033532 - DNA, 22 bp, Homo sapiens
ttttggcagattacttaatatg

SEQ ID NO: 10033533 - DNA, 22 bp, Homo sapiens
ttttggcactgcgtctacatgg

SEQ ID NO: 10033534 - DNA, 22 bp, Homo sapiens
ttttggcactttgtctgattct

SEQ ID NO: 10033535 - DNA, 22 bp, Homo sapiens
ttttggcaaaggcattctcttt

SEQ ID NO: 10033536 - DNA, 22 bp, Homo sapiens
ttttctttaatctggtggggtg

SEQ ID NO: 10033537 - DNA, 23 bp, Homo sapiens
ttttcctttggacaggctgtatt

SEQ ID NO: 10033538 - DNA, 22 bp, Homo sapiens
ttttatgaagataattttctga

SEQ ID NO: 10033539 - DNA, 22 bp, Homo sapiens
tttttcttgtgctggatctaat

SEQ ID NO: 10033540 - DNA, 22 bp, Homo sapiens
tttttgggtccaggctgtatct

SEQ ID NO: 10033541 - DNA, 22 bp, Homo sapiens
tttggcagagtcatttcagaaa

SEQ ID NO: 10033542 - DNA, 22 bp, Homo sapiens
tttggcagagtaaggcctgctt

SEQ ID NO: 10033543 - DNA, 22 bp, Homo sapiens
ttttatatggcacattggttgg

SEQ ID NO: 10033544 - DNA, 22 bp, Homo sapiens
tttgtagaataatatctttctg

SEQ ID NO: 10033545 - DNA, 22 bp, Homo sapiens
ctggccaggcttgggacagaca

SEQ ID NO: 10033546 - DNA, 22 bp, Homo sapiens
ctggaacagaagcactggagag

SEQ ID NO: 10033547 - DNA, 22 bp, Homo sapiens
ctggagctggcttccttccact

SEQ ID NO: 10033548 - DNA, 18 bp, Homo sapiens
ctgcccagagcatttcat

SEQ ID NO: 10033549 - DNA, 18 bp, Homo sapiens
ctgccccttctctgagat

SEQ ID NO: 10033550 - DNA, 22 bp, Homo sapiens
ctgccctcccagttggtccgtg

SEQ ID NO: 10033551 - DNA, 22 bp, Homo sapiens
ctgccctctagggatgcactgg

SEQ ID NO: 10033552 - DNA, 22 bp, Homo sapiens
ctgcctgctgcctgtggagggt

SEQ ID NO: 10033553 - DNA, 22 bp, Homo sapiens
ctgccctgtggttgtgggttct

SEQ ID NO: 10033554 - DNA, 22 bp, Homo sapiens
ctgccctgtctgcagcctggct

SEQ ID NO: 10033555 - DNA, 22 bp, Homo sapiens
ctgccctgtgagggtccttggg

SEQ ID NO: 10033556 - DNA, 22 bp, Homo sapiens
agtttatttctccatttaccta

SEQ ID NO: 10033557 - DNA, 22 bp, Homo sapiens
agtttatttttgataagtcttg

SEQ ID NO: 10033558 - DNA, 22 bp, Homo sapiens
agtttattctgcttggccctcc

SEQ ID NO: 10033559 - DNA, 22 bp, Homo sapiens
agtttattgtatatggtagttt

SEQ ID NO: 10033560 - DNA, 17 bp, Homo sapiens
agtttatttagccttct

SEQ ID NO: 10033561 - DNA, 20 bp, Homo sapiens
agtttattccaggagaactg

SEQ ID NO: 10033562 - DNA, 22 bp, Homo sapiens
agtttattctctggtcttagta

SEQ ID NO: 10033563 - DNA, 22 bp, Homo sapiens
agtgttattgaggcaaaactgt

SEQ ID NO: 10033564 - DNA, 22 bp, Homo sapiens
agtgttcatttattcattcact

SEQ ID NO: 10033565 - DNA, 19 bp, Homo sapiens
agtttattataggtgattc

SEQ ID NO: 10033566 - DNA, 22 bp, Homo sapiens
agtttcttcatccaaaaaatgg

SEQ ID NO: 10033567 - DNA, 22 bp, Homo sapiens
agtttctttagatagaaagttc

SEQ ID NO: 10033568 - DNA, 22 bp, Homo sapiens
agttttatgttcacagaaggat

SEQ ID NO: 10033569 - DNA, 22 bp, Homo sapiens
agtttgtgcaatggtgtcacct

SEQ ID NO: 10033570 - DNA, 22 bp, Homo sapiens
ctgggccatggaagtctctgcc

SEQ ID NO: 10033571 - DNA, 22 bp, Homo sapiens
ctgggccagggaggtgtctgta

SEQ ID NO: 10033572 - DNA, 22 bp, Homo sapiens
ctgggcctgccaccatcttagg

SEQ ID NO: 10033573 - DNA, 22 bp, Homo sapiens
ctgggcctggacgggcagatct

SEQ ID NO: 10033574 - DNA, 22 bp, Homo sapiens
atatattttttgagacagagtc

SEQ ID NO: 10033575 - DNA, 22 bp, Homo sapiens
atctccagctggctgtgataaa

SEQ ID NO: 10033576 - DNA, 22 bp, Homo sapiens
atctccagtgcccaaaggaaat

SEQ ID NO: 10033577 - DNA, 22 bp, Homo sapiens
ctgttactggacgcacgcagct

SEQ ID NO: 10033578 - DNA, 22 bp, Homo sapiens
ctgtgcctcagtgtcctcgagt

SEQ ID NO: 10033579 - DNA, 20 bp, Homo sapiens
ctgtgcctaaacctccgggt

SEQ ID NO: 10033580 - DNA, 22 bp, Homo sapiens
ctgtgccctttcgctgcactgt

SEQ ID NO: 10033581 - DNA, 20 bp, Homo sapiens
ctgtgcctcctgctagtcct

SEQ ID NO: 10033582 - DNA, 22 bp, Homo sapiens
ctgtgcctccctttactttgag

SEQ ID NO: 10033583 - DNA, 22 bp, Homo sapiens
ctgtgccttctacttcactcta

SEQ ID NO: 10033584 - DNA, 22 bp, Homo sapiens
ctgtgccttctgcctggaacat

SEQ ID NO: 10033585 - DNA, 22 bp, Homo sapiens
ctgtgccttggcgctgtgccac

SEQ ID NO: 10033586 - DNA, 22 bp, Homo sapiens
agtggctggcataggaacagac

SEQ ID NO: 10033587 - DNA, 20 bp, Homo sapiens
agtggcaggcgatcattact

SEQ ID NO: 10033588 - DNA, 22 bp, Homo sapiens
agtggcaggaaagtggaagaga

SEQ ID NO: 10033589 - DNA, 22 bp, Homo sapiens
agtggcagccgagcaggagatg

SEQ ID NO: 10033590 - DNA, 22 bp, Homo sapiens
agtgggcttactgagggagtgt

SEQ ID NO: 10033591 - DNA, 22 bp, Homo sapiens
agtgggctgagcttgctgggtg

SEQ ID NO: 10033592 - DNA, 20 bp, Homo sapiens
agtcatctcctctactgctt

SEQ ID NO: 10033593 - DNA, 19 bp, Homo sapiens
agtcatctcactgtgccca

SEQ ID NO: 10033594 - DNA, 22 bp, Homo sapiens
agtctgtgtatattcactgccc

SEQ ID NO: 10033595 - DNA, 22 bp, Homo sapiens
agtctgtctttggcttcaccac

SEQ ID NO: 10033596 - DNA, 22 bp, Homo sapiens
agtgactcactagctctcagtg

SEQ ID NO: 10033597 - DNA, 21 bp, Homo sapiens
agtgacccatagggtagagta

SEQ ID NO: 10033598 - DNA, 22 bp, Homo sapiens
agtgcacagcctgctgcagaat

SEQ ID NO: 10033599 - DNA, 22 bp, Homo sapiens
ctcccaggttacatctgagcct

SEQ ID NO: 10033600 - DNA, 22 bp, Homo sapiens
agtgcagcatgctggggaggct

SEQ ID NO: 10033601 - DNA, 22 bp, Homo sapiens
agtgcagccgagatcaggtgct

SEQ ID NO: 10033602 - DNA, 22 bp, Homo sapiens
ctcccagggtagggagagacta

SEQ ID NO: 10033603 - DNA, 22 bp, Homo sapiens
ctcccagggtctaggctgctgg

SEQ ID NO: 10033604 - DNA, 22 bp, Homo sapiens
ctcctccccttgagtctgggat

SEQ ID NO: 10033605 - DNA, 19 bp, Homo sapiens
agggtggcaaaggagggtg

SEQ ID NO: 10033606 - DNA, 23 bp, Homo sapiens
agggtgagcaagctatggagacc

SEQ ID NO: 10033607 - DNA, 22 bp, Homo sapiens
agggtggcacctggaagggatg

SEQ ID NO: 10033608 - DNA, 22 bp, Homo sapiens
cctggagcatcaggaggaaggg

SEQ ID NO: 10033609 - DNA, 22 bp, Homo sapiens
cctggacctgcagcatcagcat

SEQ ID NO: 10033610 - DNA, 22 bp, Homo sapiens
agggtggctgagtagatggaag

SEQ ID NO: 10033611 - DNA, 22 bp, Homo sapiens
agggtggctggaggaatcagaa

SEQ ID NO: 10033612 - DNA, 22 bp, Homo sapiens
cctggagcccctctggccagcc

SEQ ID NO: 10033613 - DNA, 22 bp, Homo sapiens
cctggagcgcgggtcaagctgg

SEQ ID NO: 10033614 - DNA, 22 bp, Homo sapiens
agggtggccatgagggagagat

SEQ ID NO: 10033615 - DNA, 22 bp, Homo sapiens
aggtgcagaaaaaagtccttta

SEQ ID NO: 10033616 - DNA, 22 bp, Homo sapiens
cctgggcagcctgctcaaggac

SEQ ID NO: 10033617 - DNA, 22 bp, Homo sapiens
cctgggcagggagaccaggctc

SEQ ID NO: 10033618 - DNA, 22 bp, Homo sapiens
cctgggcaggccggacgctggg

SEQ ID NO: 10033619 - DNA, 22 bp, Homo sapiens
cctgggcagggctggactctca

SEQ ID NO: 10033620 - DNA, 22 bp, Homo sapiens
aggtgagggtgccagtgcatgg

SEQ ID NO: 10033621 - DNA, 22 bp, Homo sapiens
ctacacagagcctacttctgca

SEQ ID NO: 10033622 - DNA, 21 bp, Homo sapiens
ctacacagctttctataggaa

SEQ ID NO: 10033623 - DNA, 22 bp, Homo sapiens
agtcactttgctactctgcctt

SEQ ID NO: 10033624 - DNA, 22 bp, Homo sapiens
cgtgccactgcactctagcctg

SEQ ID NO: 10033625 - DNA, 22 bp, Homo sapiens
agtaacaggtgtacagactatc

SEQ ID NO: 10033626 - DNA, 22 bp, Homo sapiens
aggtttattaagtaaatagagc

SEQ ID NO: 10033627 - DNA, 22 bp, Homo sapiens
aggttatttaggaaggtagagc

SEQ ID NO: 10033628 - DNA, 22 bp, Homo sapiens
aggtttatctcatagaaagaat

SEQ ID NO: 10033629 - DNA, 22 bp, Homo sapiens
aggagggagcttaagccaggca

SEQ ID NO: 10033630 - DNA, 22 bp, Homo sapiens
cagtttatgcagctggaataga

SEQ ID NO: 10033631 - DNA, 20 bp, Homo sapiens
cagtttatctttccggagct

SEQ ID NO: 10033632 - DNA, 22 bp, Homo sapiens
cagtttatattctagtgctgtt

SEQ ID NO: 10033633 - DNA, 22 bp, Homo sapiens
cagtggcgtgatctctgctcac

SEQ ID NO: 10033634 - DNA, 19 bp, Homo sapiens
cagtttatgctttggggac

SEQ ID NO: 10033635 - DNA, 22 bp, Homo sapiens
cagtttattgttgcgttcacat

SEQ ID NO: 10033636 - DNA, 22 bp, Homo sapiens
cagtttatttccaagatgacaa

SEQ ID NO: 10033637 - DNA, 22 bp, Homo sapiens
aggacctggatcacagagatct

SEQ ID NO: 10033638 - DNA, 22 bp, Homo sapiens
aggacctgtgttttccttgaat

SEQ ID NO: 10033639 - DNA, 19 bp, Homo sapiens
aggacccttatcctggctt

SEQ ID NO: 10033640 - DNA, 22 bp, Homo sapiens
aggacaggattgagctgaactg

SEQ ID NO: 10033641 - DNA, 22 bp, Homo sapiens
aggacatgtttgtatcttcctt

SEQ ID NO: 10033642 - DNA, 22 bp, Homo sapiens
aggagaaggaagtgcatcacta

SEQ ID NO: 10033643 - DNA, 22 bp, Homo sapiens
cagtgcctggatagcaacatga

SEQ ID NO: 10033644 - DNA, 22 bp, Homo sapiens
cattaaaatatctcatggtgtt

SEQ ID NO: 10033645 - DNA, 19 bp, Homo sapiens
aggcagcaggccagggatg

SEQ ID NO: 10033646 - DNA, 21 bp, Homo sapiens
aggcagcaggatccagggaca

SEQ ID NO: 10033647 - DNA, 23 bp, Homo sapiens
aggcagcaggttgtccagggtga

SEQ ID NO: 10033648 - DNA, 22 bp, Homo sapiens
aggcagcagggccactggctga

SEQ ID NO: 10033649 - DNA, 23 bp, Homo sapiens
aggcagcaggttgtccagggtga

SEQ ID NO: 10033650 - DNA, 22 bp, Homo sapiens
catggagataaactgaaatatt

SEQ ID NO: 10033651 - DNA, 16 bp, Homo sapiens
aggaggggaattagga

SEQ ID NO: 10033652 - DNA, 20 bp, Homo sapiens
aggaggggatagaatcaaag

SEQ ID NO: 10033653 - DNA, 22 bp, Homo sapiens
aggaggggcaatgatagtctgg

SEQ ID NO: 10033654 - DNA, 22 bp, Homo sapiens
cagctgacagtgaggtgggggc

SEQ ID NO: 10033655 - DNA, 22 bp, Homo sapiens
cagctgacccgtgggaggcggg

SEQ ID NO: 10033656 - DNA, 22 bp, Homo sapiens
cagctgacgccagagtggaatt

SEQ ID NO: 10033657 - DNA, 22 bp, Homo sapiens
cagctgacttcataggaagaca

SEQ ID NO: 10033658 - DNA, 22 bp, Homo sapiens
cagctgacccagtgaggaggca

SEQ ID NO: 10033659 - DNA, 22 bp, Homo sapiens
cagctctgtaaattccttcatc

SEQ ID NO: 10033660 - DNA, 22 bp, Homo sapiens
cagctctgtaaattccttcatc

SEQ ID NO: 10033661 - DNA, 21 bp, Homo sapiens
agctgcaagagcaacatcttt

SEQ ID NO: 10033662 - DNA, 22 bp, Homo sapiens
agctgcagttcgttccagctct

SEQ ID NO: 10033663 - DNA, 19 bp, Homo sapiens
caggaaggggcgaatctgg

SEQ ID NO: 10033664 - DNA, 22 bp, Homo sapiens
agctgctgcctcactggtctgt

SEQ ID NO: 10033665 - DNA, 22 bp, Homo sapiens
caggcactcattcagagaggtg

SEQ ID NO: 10033666 - DNA, 22 bp, Homo sapiens
caggcactggggatgctgggat

SEQ ID NO: 10033667 - DNA, 22 bp, Homo sapiens
agctgctgagccatgtcctgct

SEQ ID NO: 10033668 - DNA, 22 bp, Homo sapiens
agctggccctcgagagccaatt

SEQ ID NO: 10033669 - DNA, 22 bp, Homo sapiens
caggctcagaagccagtggagc

SEQ ID NO: 10033670 - DNA, 22 bp, Homo sapiens
caggctcagtcagaaaatgtat

SEQ ID NO: 10033671 - DNA, 22 bp, Homo sapiens
cagggcctgcaagagacctggg

SEQ ID NO: 10033672 - DNA, 22 bp, Homo sapiens
cagggatgtctctggaagggag

SEQ ID NO: 10033673 - DNA, 22 bp, Homo sapiens
caggtgaggctgaacagatgaa

SEQ ID NO: 10033674 - DNA, 22 bp, Homo sapiens
cctgaggacatcagcatcacct

SEQ ID NO: 10033675 - DNA, 22 bp, Homo sapiens
cctgaggacacacgctgcagga

SEQ ID NO: 10033676 - DNA, 22 bp, Homo sapiens
cctgaggagattgtggctgggg

SEQ ID NO: 10033677 - DNA, 22 bp, Homo sapiens
cctgaggatgccagcatgggtg

SEQ ID NO: 10033678 - DNA, 22 bp, Homo sapiens
aggggctggcttatctgagagt

SEQ ID NO: 10033679 - DNA, 22 bp, Homo sapiens
cctctgggaagccagtcctgct

SEQ ID NO: 10033680 - DNA, 21 bp, Homo sapiens
cctctggcttgtgctgtgccc

SEQ ID NO: 10033681 - DNA, 19 bp, Homo sapiens
cctctgccagcccgcctct

SEQ ID NO: 10033682 - DNA, 22 bp, Homo sapiens
cctctgggagactgctactgag

SEQ ID NO: 10033683 - DNA, 16 bp, Homo sapiens
cctctgggatgtttgc

SEQ ID NO: 10033684 - DNA, 22 bp, Homo sapiens
cctctgggcaggtagcagcagc

SEQ ID NO: 10033685 - DNA, 22 bp, Homo sapiens
cctctgggcggagatctgctgc

SEQ ID NO: 10033686 - DNA, 22 bp, Homo sapiens
cctctgggcctggaagggcagt

SEQ ID NO: 10033687 - DNA, 22 bp, Homo sapiens
cctctgggccagcctggaccct

SEQ ID NO: 10033688 - DNA, 22 bp, Homo sapiens
cctcctgcacttgctttccttc

SEQ ID NO: 10033689 - DNA, 22 bp, Homo sapiens
ccctggaggcaaaggttgcagt

SEQ ID NO: 10033690 - DNA, 22 bp, Homo sapiens
ccctggaggcaaaggttgcagt

SEQ ID NO: 10033691 - DNA, 22 bp, Homo sapiens
ccctggaggctggaggcagtag

SEQ ID NO: 10033692 - DNA, 22 bp, Homo sapiens
ccctggaggctggaggcagtag

SEQ ID NO: 10033693 - DNA, 22 bp, Homo sapiens
ccctggaggcggatgttgcagt

SEQ ID NO: 10033694 - DNA, 22 bp, Homo sapiens
ccctttggcatttccaggatat

SEQ ID NO: 10033695 - DNA, 22 bp, Homo sapiens
ccctttgggttccccaagcctg

SEQ ID NO: 10033696 - DNA, 22 bp, Homo sapiens
agggcccttacgcaggcccttc

SEQ ID NO: 10033697 - DNA, 22 bp, Homo sapiens
cctcctctgtgcagctgtgggt

SEQ ID NO: 10033698 - DNA, 22 bp, Homo sapiens
cccaggagttggaggctacggt

SEQ ID NO: 10033699 - DNA, 22 bp, Homo sapiens
cccaggatggggctgcagttat

SEQ ID NO: 10033700 - DNA, 20 bp, Homo sapiens
cccaggagtttgctcttact

SEQ ID NO: 10033701 - DNA, 22 bp, Homo sapiens
cccaggagtttgagttcagcat

SEQ ID NO: 10033702 - DNA, 23 bp, Homo sapiens
cccaggagtttcactgcaaaggt

SEQ ID NO: 10033703 - DNA, 22 bp, Homo sapiens
cccaggagttggaggctgcagt

SEQ ID NO: 10033704 - DNA, 22 bp, Homo sapiens
cccagggaagccatttctgact

SEQ ID NO: 10033705 - DNA, 21 bp, Homo sapiens
cccagggaagccgcagtcacc

SEQ ID NO: 10033706 - DNA, 22 bp, Homo sapiens
cccagggcttgagtcatccatg

SEQ ID NO: 10033707 - DNA, 21 bp, Homo sapiens
ccctggaatcctgagtgccag

SEQ ID NO: 10033708 - DNA, 22 bp, Homo sapiens
ccctggacggggaatatgactt

SEQ ID NO: 10033709 - DNA, 22 bp, Homo sapiens
ccctggaaggttctctggctca

SEQ ID NO: 10033710 - DNA, 22 bp, Homo sapiens
ccctggaggaccccaatgtggc

SEQ ID NO: 10033711 - DNA, 22 bp, Homo sapiens
ccctggaggagcttagagcttg

SEQ ID NO: 10033712 - DNA, 19 bp, Homo sapiens
ccctggaggagtgttggct

SEQ ID NO: 10033713 - DNA, 22 bp, Homo sapiens
agggatggaagacttgaagacc

SEQ ID NO: 10033714 - DNA, 18 bp, Homo sapiens
agggagttttagggaagg

SEQ ID NO: 10033715 - DNA, 22 bp, Homo sapiens
agggactggctctctgagcagg

SEQ ID NO: 10033716 - DNA, 22 bp, Homo sapiens
agggactgagctaggatctagt

SEQ ID NO: 10033717 - DNA, 22 bp, Homo sapiens
agggagtggttaagaaggtgca

SEQ ID NO: 10033718 - DNA, 22 bp, Homo sapiens
aggctctgtgcagcctgcatct

SEQ ID NO: 10033719 - DNA, 22 bp, Homo sapiens
aggctctgtgatgtgccaggca

SEQ ID NO: 10033720 - DNA, 22 bp, Homo sapiens
ccatgggagatgatggggagtg

SEQ ID NO: 10033721 - DNA, 22 bp, Homo sapiens
ccatgggcgcacaggcctggag

SEQ ID NO: 10033722 - DNA, 22 bp, Homo sapiens
ccagggtgagtgtcatgggtta

SEQ ID NO: 10033723 - DNA, 22 bp, Homo sapiens
ccagcagagcatggggaggaag

SEQ ID NO: 10033724 - DNA, 22 bp, Homo sapiens
ccagcagaggggcggagtgcag

SEQ ID NO: 10033725 - DNA, 20 bp, Homo sapiens
ccacaggagtccagtcgacc

SEQ ID NO: 10033726 - DNA, 17 bp, Homo sapiens
ccagagagtagttagga

SEQ ID NO: 10033727 - DNA, 22 bp, Homo sapiens
aggcaggggagctggaagggta

SEQ ID NO: 10033728 - DNA, 22 bp, Homo sapiens
aggcaggctggtctgaagagtg

SEQ ID NO: 10033729 - DNA, 22 bp, Homo sapiens
ccagctggcccagctgtgctcc

SEQ ID NO: 10033730 - DNA, 22 bp, Homo sapiens
ccagcttttcttatcattataa

SEQ ID NO: 10033731 - DNA, 22 bp, Homo sapiens
aggccctggcactgcctgggag

SEQ ID NO: 10033732 - DNA, 22 bp, Homo sapiens
aggccctggcccccagagattc

SEQ ID NO: 10033733 - DNA, 22 bp, Homo sapiens
aggccctggggtctgttaaatt

SEQ ID NO: 10033734 - DNA, 22 bp, Homo sapiens
aggccctgggcagttctgtagc

SEQ ID NO: 10033735 - DNA, 22 bp, Homo sapiens
ccaggacaagtgtggccatggc

SEQ ID NO: 10033736 - DNA, 22 bp, Homo sapiens
aggccctggctgggtttcttta

SEQ ID NO: 10033737 - DNA, 22 bp, Homo sapiens
aggccctgggagcagagatgca

SEQ ID NO: 10033738 - DNA, 22 bp, Homo sapiens
aggccctggcctgactcaatgt

SEQ ID NO: 10033739 - DNA, 18 bp, Homo sapiens
aggccctggcctcgaaca

SEQ ID NO: 10033740 - DNA, 22 bp, Homo sapiens
ccaggagatttttccatagcac

SEQ ID NO: 10033741 - DNA, 22 bp, Homo sapiens
ccaggagatgggaaagtagcag

SEQ ID NO: 10033742 - DNA, 22 bp, Homo sapiens
ccaggagatgatgttggggatt

SEQ ID NO: 10033743 - DNA, 22 bp, Homo sapiens
ccaggagataagctgagtttat

SEQ ID NO: 10033744 - DNA, 19 bp, Homo sapiens
ccaggagagcttggagaag

SEQ ID NO: 10033745 - DNA, 22 bp, Homo sapiens
ccaggagatgggagcatctaaa

SEQ ID NO: 10033746 - DNA, 22 bp, Homo sapiens
ccaggagagcaggcgtgcagct

SEQ ID NO: 10033747 - DNA, 22 bp, Homo sapiens
ccaggagagcattgcacagagg

SEQ ID NO: 10033748 - DNA, 22 bp, Homo sapiens
ccaggagagcgccctcccggcc

SEQ ID NO: 10033749 - DNA, 22 bp, Homo sapiens
ccaggagagctctcgttcagtg

SEQ ID NO: 10033750 - DNA, 22 bp, Homo sapiens
ccaggagagctctaaatggctg

SEQ ID NO: 10033751 - DNA, 22 bp, Homo sapiens
gtcacagatctcttgagtcaag

SEQ ID NO: 10033752 - DNA, 22 bp, Homo sapiens
gtagggagcccagagcccagtg

SEQ ID NO: 10033753 - DNA, 22 bp, Homo sapiens
cagcatcctttgctggtttccc

SEQ ID NO: 10033754 - DNA, 22 bp, Homo sapiens
cagcatctggatttcctccact

SEQ ID NO: 10033755 - DNA, 22 bp, Homo sapiens
cagcagccagacaagatacatc

SEQ ID NO: 10033756 - DNA, 22 bp, Homo sapiens
gtaggcagtctctcaggtgatc

SEQ ID NO: 10033757 - DNA, 22 bp, Homo sapiens
gtaggcagtctctcaggtgatc

SEQ ID NO: 10033758 - DNA, 22 bp, Homo sapiens
gtaggcagtggttggaagagaa

SEQ ID NO: 10033759 - DNA, 22 bp, Homo sapiens
gtaggcaggtggaggagtgaag

SEQ ID NO: 10033760 - DNA, 22 bp, Homo sapiens
gtaggcagggctgtggggagaa

SEQ ID NO: 10033761 - DNA, 22 bp, Homo sapiens
ggctggcactctgtccagtgtc

SEQ ID NO: 10033762 - DNA, 22 bp, Homo sapiens
cagagcagtgaggagttgtgta

SEQ ID NO: 10033763 - DNA, 22 bp, Homo sapiens
cagagccaaaaccgtaacagcc

SEQ ID NO: 10033764 - DNA, 22 bp, Homo sapiens
cagagacaacaagtttaactat

SEQ ID NO: 10033765 - DNA, 22 bp, Homo sapiens
cagagacaatgtctctgcttgt

SEQ ID NO: 10033766 - DNA, 22 bp, Homo sapiens
gggatctgatgcactgctgaaa

SEQ ID NO: 10033767 - DNA, 22 bp, Homo sapiens
gggtgggatctgtggagcctca

SEQ ID NO: 10033768 - DNA, 22 bp, Homo sapiens
gggttcagtccctcttgctact

SEQ ID NO: 10033769 - DNA, 22 bp, Homo sapiens
gggtacagttcttccagtgtca

SEQ ID NO: 10033770 - DNA, 22 bp, Homo sapiens
gggtccagggccagtggctgag

SEQ ID NO: 10033771 - DNA, 22 bp, Homo sapiens
gggtccagtttcatctgaggtt

SEQ ID NO: 10033772 - DNA, 22 bp, Homo sapiens
gggtccctcgttctgggatctg

SEQ ID NO: 10033773 - DNA, 22 bp, Homo sapiens
ggtcacagctttttcagcagca

SEQ ID NO: 10033774 - DNA, 22 bp, Homo sapiens
ggtccctggttccctctgagct

SEQ ID NO: 10033775 - DNA, 23 bp, Homo sapiens
cagatgaggttggcagcatggtc

SEQ ID NO: 10033776 - DNA, 22 bp, Homo sapiens
ggggcagcctccaggaaagctg

SEQ ID NO: 10033777 - DNA, 22 bp, Homo sapiens
ggggcagctaccggaagtaggg

SEQ ID NO: 10033778 - DNA, 22 bp, Homo sapiens
gctgccctctctggccccacac

SEQ ID NO: 10033779 - DNA, 22 bp, Homo sapiens
gctgccctgtccggctctcctg

SEQ ID NO: 10033780 - DNA, 22 bp, Homo sapiens
gctggcccagcgtggggccgtg

SEQ ID NO: 10033781 - DNA, 22 bp, Homo sapiens
gctggcccagcgcccagggcag

SEQ ID NO: 10033782 - DNA, 22 bp, Homo sapiens
ggaagaggaggagccaggcttt

SEQ ID NO: 10033783 - DNA, 22 bp, Homo sapiens
ggagaagggacagactcagctt

SEQ ID NO: 10033784 - DNA, 22 bp, Homo sapiens
cacaggttaggtattatactat

SEQ ID NO: 10033785 - DNA, 22 bp, Homo sapiens
cacatgaaggctggggtcgtga

SEQ ID NO: 10033786 - DNA, 22 bp, Homo sapiens
cactccctctagttgcattctg

SEQ ID NO: 10033787 - DNA, 22 bp, Homo sapiens
caccaggctgcccaggacaggg

SEQ ID NO: 10033788 - DNA, 22 bp, Homo sapiens
caccctgggctgggcctgttaa

SEQ ID NO: 10033789 - DNA, 22 bp, Homo sapiens
cactgtgctccttccttagcac

SEQ ID NO: 10033790 - DNA, 22 bp, Homo sapiens
gatggcaggcaggtgagtagag

SEQ ID NO: 10033791 - DNA, 22 bp, Homo sapiens
gatggcagcagcagccagggat

SEQ ID NO: 10033792 - DNA, 22 bp, Homo sapiens
gatggcagcatattgacagcat

SEQ ID NO: 10033793 - DNA, 22 bp, Homo sapiens
gatggcaggtgatagccgagtc

SEQ ID NO: 10033794 - DNA, 22 bp, Homo sapiens
gatggcagtcaaccaggtgagg

SEQ ID NO: 10033795 - DNA, 22 bp, Homo sapiens
attatggatggaggcattagtc

SEQ ID NO: 10033796 - DNA, 22 bp, Homo sapiens
gcagagaccccgcagtgaggcc

SEQ ID NO: 10033797 - DNA, 22 bp, Homo sapiens
gcagagactagtagtgcagact

SEQ ID NO: 10033798 - DNA, 22 bp, Homo sapiens
gcagagatgggccagtgacgca

SEQ ID NO: 10033799 - DNA, 22 bp, Homo sapiens
attcacaaagaagggaagtaca

SEQ ID NO: 10033800 - DNA, 22 bp, Homo sapiens
gcagcttcagtaggtgaagaca

SEQ ID NO: 10033801 - DNA, 22 bp, Homo sapiens
gccttcccaagacgcctgagtt

SEQ ID NO: 10033802 - DNA, 22 bp, Homo sapiens
attttcagttgaaaaagttggt

SEQ ID NO: 10033803 - DNA, 22 bp, Homo sapiens
gctcccaggcatggaggtaatt

SEQ ID NO: 10033804 - DNA, 22 bp, Homo sapiens
attttgcacactatgcagcttt

SEQ ID NO: 10033805 - DNA, 22 bp, Homo sapiens
gccagctgcttctccagaattt

SEQ ID NO: 10033806 - DNA, 22 bp, Homo sapiens
gccagctgctggaacagcgcga

SEQ ID NO: 10033807 - DNA, 22 bp, Homo sapiens
atttattaagcatctgctatgt

SEQ ID NO: 10033808 - DNA, 22 bp, Homo sapiens
atttattatgggatttggcaca

SEQ ID NO: 10033809 - DNA, 22 bp, Homo sapiens
atttattacctcggagtttctg

SEQ ID NO: 10033810 - DNA, 22 bp, Homo sapiens
gccagctgcatctcctgggctg

SEQ ID NO: 10033811 - DNA, 19 bp, Homo sapiens
gccatcctgcccttgacat

SEQ ID NO: 10033812 - DNA, 23 bp, Homo sapiens
gccatcctaaaacccctgtctgt

SEQ ID NO: 10033813 - DNA, 22 bp, Homo sapiens
gccatcttgggccatgatgcca

SEQ ID NO: 10033814 - DNA, 22 bp, Homo sapiens
gccatcttcaacatcagaagtt

SEQ ID NO: 10033815 - DNA, 22 bp, Homo sapiens
gccatctggcattgcagcacct

SEQ ID NO: 10033816 - DNA, 22 bp, Homo sapiens
gccatgcttggtatgctgtgag

SEQ ID NO: 10033817 - DNA, 22 bp, Homo sapiens
gcccagtagttcaaggttgcag

SEQ ID NO: 10033818 - DNA, 22 bp, Homo sapiens
gcccaggagttgaatgcagcag

SEQ ID NO: 10033819 - DNA, 22 bp, Homo sapiens
gccctggggaaggtgtctccaa

SEQ ID NO: 10033820 - DNA, 22 bp, Homo sapiens
gccctgtgagattagaacagca

SEQ ID NO: 10033821 - DNA, 22 bp, Homo sapiens
gccctgtgatggagactagagg

SEQ ID NO: 10033822 - DNA, 22 bp, Homo sapiens
gccctgtgagtcatgcggcaga

SEQ ID NO: 10033823 - DNA, 22 bp, Homo sapiens
gccctgtgcaggtgtgcagcag

SEQ ID NO: 10033824 - DNA, 22 bp, Homo sapiens
gccctgggctccctgctccaca

SEQ ID NO: 10033825 - DNA, 22 bp, Homo sapiens
atgtgaggttaacctactgtta

SEQ ID NO: 10033826 - DNA, 22 bp, Homo sapiens
atgggcagcagctgccattcat

SEQ ID NO: 10033827 - DNA, 17 bp, Homo sapiens
gagacagcaggagcccc

SEQ ID NO: 10033828 - DNA, 22 bp, Homo sapiens
gagacagcacaggccactggga

SEQ ID NO: 10033829 - DNA, 21 bp, Homo sapiens
gagacagcccagtgccagggc

SEQ ID NO: 10033830 - DNA, 22 bp, Homo sapiens
atgctgtgattgtagaaatatt

SEQ ID NO: 10033831 - DNA, 22 bp, Homo sapiens
gagaaggtggacctgaaggagc

SEQ ID NO: 10033832 - DNA, 22 bp, Homo sapiens
gagaagtgcagagtggttaagc

SEQ ID NO: 10033833 - DNA, 18 bp, Homo sapiens
gagaagtgcatacattat

SEQ ID NO: 10033834 - DNA, 22 bp, Homo sapiens
gagaagtttttcttattacatg

SEQ ID NO: 10033835 - DNA, 22 bp, Homo sapiens
gagaagtttaatcattagacca

SEQ ID NO: 10033836 - DNA, 23 bp, Homo sapiens
gagaacagccacagagagctgtg

SEQ ID NO: 10033837 - DNA, 22 bp, Homo sapiens
atggccctttattccttcttcc

SEQ ID NO: 10033838 - DNA, 21 bp, Homo sapiens
atgggcagaggcagagaggct

SEQ ID NO: 10033839 - DNA, 22 bp, Homo sapiens
atgccactgcactccagcctag

SEQ ID NO: 10033840 - DNA, 22 bp, Homo sapiens
atgccactgcacttcagcctgg

SEQ ID NO: 10033841 - DNA, 22 bp, Homo sapiens
atgccactgcactccagcctgg

SEQ ID NO: 10033842 - DNA, 22 bp, Homo sapiens
gaagcagcaagtataggacagg

SEQ ID NO: 10033843 - DNA, 22 bp, Homo sapiens
gaagcagcagctggggacagtt

SEQ ID NO: 10033844 - DNA, 22 bp, Homo sapiens
gaaggaggcgttagccctagga

SEQ ID NO: 10033845 - DNA, 22 bp, Homo sapiens
gaaggaggtgtcagttggactg

SEQ ID NO: 10033846 - DNA, 22 bp, Homo sapiens
ctttattagatgtagactttct

SEQ ID NO: 10033847 - DNA, 22 bp, Homo sapiens
ctttacacatcctaaccagtgt

SEQ ID NO: 10033848 - DNA, 22 bp, Homo sapiens
ctttacacatgagacctgcaat

SEQ ID NO: 10033849 - DNA, 22 bp, Homo sapiens
ctttacacaatgattttcttta

SEQ ID NO: 10033850 - DNA, 22 bp, Homo sapiens
ctttacaccaagcagatctttc

SEQ ID NO: 10033851 - DNA, 22 bp, Homo sapiens
ctttacacttggacccacactt

SEQ ID NO: 10033852 - DNA, 22 bp, Homo sapiens
atgacagaggagtgcaggtgat

SEQ ID NO: 10033853 - DNA, 22 bp, Homo sapiens
atgagaaatttattacaagcta

SEQ ID NO: 10033854 - DNA, 22 bp, Homo sapiens
ctttgggcaaagggccaattcg

SEQ ID NO: 10033855 - DNA, 22 bp, Homo sapiens
aatgtccaccgtgatgatggaa

SEQ ID NO: 10033856 - DNA, 19 bp, Homo sapiens
agacagagctcagtgggtt

SEQ ID NO: 10033857 - DNA, 23 bp, Homo sapiens
agaaggtgggcctgctgagttat

SEQ ID NO: 10033858 - DNA, 22 bp, Homo sapiens
agaaggggagaagctaccagga

SEQ ID NO: 10033859 - DNA, 22 bp, Homo sapiens
aatttacacttcatttggaggg

SEQ ID NO: 10033860 - DNA, 22 bp, Homo sapiens
aatttacaggtgcactcgccat

SEQ ID NO: 10033861 - DNA, 22 bp, Homo sapiens
aatttacagttgctgatggtac

SEQ ID NO: 10033862 - DNA, 22 bp, Homo sapiens
aatgtttgcatctattcacatg

SEQ ID NO: 10033863 - DNA, 22 bp, Homo sapiens
acaatgtttttgttcaaagagt

SEQ ID NO: 10033864 - DNA, 22 bp, Homo sapiens
acaattactcaactttgctgct

SEQ ID NO: 10033865 - DNA, 22 bp, Homo sapiens
agcacaggtacggagatgctac

SEQ ID NO: 10033866 - DNA, 22 bp, Homo sapiens
acaaacagagttgaaaaatagg

SEQ ID NO: 10033867 - DNA, 22 bp, Homo sapiens
aattttcacagtgctgtgagat

SEQ ID NO: 10033868 - DNA, 22 bp, Homo sapiens
aattttattagaaggcaagggg

SEQ ID NO: 10033869 - DNA, 22 bp, Homo sapiens
aattttattaactggatgtagc

SEQ ID NO: 10033870 - DNA, 22 bp, Homo sapiens
agcaccatttctctaaagcact

SEQ ID NO: 10033871 - DNA, 21 bp, Homo sapiens
agcaccctcccttctggaggg

SEQ ID NO: 10033872 - DNA, 22 bp, Homo sapiens
acaattttccccataggttatc

SEQ ID NO: 10033873 - DNA, 23 bp, Homo sapiens
agcagcagtgagaggtgtcttac

SEQ ID NO: 10033874 - DNA, 22 bp, Homo sapiens
agcagcagtgtgtggtcatgtt

SEQ ID NO: 10033875 - DNA, 22 bp, Homo sapiens
agcagcagtgttctggaattct

SEQ ID NO: 10033876 - DNA, 22 bp, Homo sapiens
agcagcaggtgcttctggatct

SEQ ID NO: 10033877 - DNA, 22 bp, Homo sapiens
agcagcagtcatgcctatgctc

SEQ ID NO: 10033878 - DNA, 22 bp, Homo sapiens
agctattgtgtgcccagcagga

SEQ ID NO: 10033879 - DNA, 22 bp, Homo sapiens
acagcagcgtgaagtgtgttat

SEQ ID NO: 10033880 - DNA, 22 bp, Homo sapiens
acagcaggagccttcatatgct

SEQ ID NO: 10033881 - DNA, 22 bp, Homo sapiens
acagcaggatttggcgatgttg

SEQ ID NO: 10033882 - DNA, 22 bp, Homo sapiens
acagcaggcacacaaggataga

SEQ ID NO: 10033883 - DNA, 22 bp, Homo sapiens
acagcaggcatgaagaaatgtt

SEQ ID NO: 10033884 - DNA, 19 bp, Homo sapiens
acagagtgatgaggataga

SEQ ID NO: 10033885 - DNA, 22 bp, Homo sapiens
agccatctgaattagctttgtt

SEQ ID NO: 10033886 - DNA, 22 bp, Homo sapiens
agccatgggagactgtgggaga

SEQ ID NO: 10033887 - DNA, 22 bp, Homo sapiens
accatcttttcctctgcctcct

SEQ ID NO: 10033888 - DNA, 22 bp, Homo sapiens
aaggtggggtcctgtcatctga

SEQ ID NO: 10033889 - DNA, 22 bp, Homo sapiens
aagggcaggaaaagatggatgt

SEQ ID NO: 10033890 - DNA, 22 bp, Homo sapiens
acatgtgtctaagaatgaaaga

SEQ ID NO: 10033891 - DNA, 22 bp, Homo sapiens
acatgtgtggacatgaatctac

SEQ ID NO: 10033892 - DNA, 21 bp, Homo sapiens
aaggcagaagcatggaatgag

SEQ ID NO: 10033893 - DNA, 22 bp, Homo sapiens
aaggcagaaagggatgtgagtg

SEQ ID NO: 10033894 - DNA, 22 bp, Homo sapiens
aaggcagcttcaccacagcatt

SEQ ID NO: 10033895 - DNA, 22 bp, Homo sapiens
aaggcagctttaaaaaagatgc

SEQ ID NO: 10033896 - DNA, 22 bp, Homo sapiens
aaggcagcctctgccagccggg

SEQ ID NO: 10033897 - DNA, 22 bp, Homo sapiens
aaggcagctcagctcatggcag

SEQ ID NO: 10033898 - DNA, 22 bp, Homo sapiens
aaggcagcctttgtttgattga

SEQ ID NO: 10033899 - DNA, 22 bp, Homo sapiens
aaggcagccttttgagttgatt

SEQ ID NO: 10033900 - DNA, 22 bp, Homo sapiens
aaggcagccgtgtgactgcatg

SEQ ID NO: 10033901 - DNA, 22 bp, Homo sapiens
aaggaaagctgtggttctgaga

SEQ ID NO: 10033902 - DNA, 20 bp, Homo sapiens
actccaggtggcatgaggac

SEQ ID NO: 10033903 - DNA, 21 bp, Homo sapiens
actcccatcataactggtggg

SEQ ID NO: 10033904 - DNA, 22 bp, Homo sapiens
actccaggttttttcactgaag

SEQ ID NO: 10033905 - DNA, 22 bp, Homo sapiens
aagttactggcaagggctgcag

SEQ ID NO: 10033906 - DNA, 22 bp, Homo sapiens
actgcctgtttggcatggcccc

SEQ ID NO: 10033907 - DNA, 22 bp, Homo sapiens
aagtttatccctctcacagtta

SEQ ID NO: 10033908 - DNA, 22 bp, Homo sapiens
aagtttatgttctttgaaggca

SEQ ID NO: 10033909 - DNA, 22 bp, Homo sapiens
aagtttatgaagtctaagccaa

SEQ ID NO: 10033910 - DNA, 22 bp, Homo sapiens
aagtttatctttgctgggtact

SEQ ID NO: 10033911 - DNA, 22 bp, Homo sapiens
aagtttatgttggtaagatatc

SEQ ID NO: 10033912 - DNA, 22 bp, Homo sapiens
aagtttattaattgacttgtgc

SEQ ID NO: 10033913 - DNA, 22 bp, Homo sapiens
aatcataattgtatacattcat

SEQ ID NO: 10033914 - DNA, 20 bp, Homo sapiens
agaaataccacatttggcaa

SEQ ID NO: 10033915 - DNA, 18 bp, Homo sapiens
agaaataccagtattgga

SEQ ID NO: 10033916 - DNA, 22 bp, Homo sapiens
aaagccatgaatgttatagagg

SEQ ID NO: 10033917 - DNA, 22 bp, Homo sapiens
aaagccatgggtctttggcata

SEQ ID NO: 10033918 - DNA, 22 bp, Homo sapiens
aagcacagataaaacaggattc

SEQ ID NO: 10033919 - DNA, 22 bp, Homo sapiens
aagcatctcattcttgcctgtc

SEQ ID NO: 10033920 - DNA, 22 bp, Homo sapiens
aaaccgcaattacttttgcgtc

SEQ ID NO: 10033921 - DNA, 22 bp, Homo sapiens
aaaggtcttaatgttaacatac

SEQ ID NO: 10033922 - DNA, 22 bp, Homo sapiens
aaaggtcttaaggttaagcagg

SEQ ID NO: 10033923 - DNA, 22 bp, Homo sapiens
aaacctttaccagactagcaag

SEQ ID NO: 10033924 - DNA, 22 bp, Homo sapiens
aaagaggcaatcaatgtagcaa

SEQ ID NO: 10033925 - DNA, 22 bp, Homo sapiens
aaaaaagattgatggtggatgc

SEQ ID NO: 10033926 - DNA, 22 bp, Homo sapiens
aaggtctgcttatatcttacat

SEQ ID NO: 10033927 - DNA, 22 bp, Homo sapiens
aacagagcttgggtcatctcat

SEQ ID NO: 10033928 - DNA, 22 bp, Homo sapiens
aaggtatttagtgtgaaagcta

SEQ ID NO: 10033929 - DNA, 23 bp, Homo sapiens
aaggtatttattttaaaggtaag

SEQ ID NO: 10033930 - DNA, 22 bp, Homo sapiens
aaccaccattctctcctcttcc

SEQ ID NO: 10033931 - DNA, 22 bp, Homo sapiens
aacatgaaaagcccagagaggt

SEQ ID NO: 10033932 - DNA, 22 bp, Homo sapiens
aacttaaacccactcatgtaga

SEQ ID NO: 10033933 - DNA, 22 bp, Homo sapiens
aacttaggaaaataaggcatga

SEQ ID NO: 10033934 - DNA, 21 bp, Homo sapiens
aactgctggtcttttctgtct

SEQ ID NO: 10033935 - DNA, 22 bp, Homo sapiens
aagagaggacatggtgaacctg

SEQ ID NO: 10033936 - DNA, 17 bp, Homo sapiens
aagagaggctgagctgg

SEQ ID NO: 10033937 - DNA, 22 bp, Homo sapiens
aagagaggggttgcatggaaat

SEQ ID NO: 10033938 - DNA, 21 bp, Homo sapiens
aagaaagataattaaggaccc

SEQ ID NO: 10033939 - DNA, 22 bp, Homo sapiens
acagcagctgccttcaggctct

SEQ ID NO: 10033940 - DNA, 22 bp, Homo sapiens
acagaggttaggatgggttgta

SEQ ID NO: 10033941 - DNA, 22 bp, Homo sapiens
aagcagagtccccttcccatgg

SEQ ID NO: 10033942 - DNA, 22 bp, Homo sapiens
aagcacaggagacgcacagcca

SEQ ID NO: 10033943 - DNA, 22 bp, Homo sapiens
aagcacagggactcaggaccgg

SEQ ID NO: 10033944 - DNA, 22 bp, Homo sapiens
aagcacagaaaaggagcatgga

SEQ ID NO: 10033945 - DNA, 22 bp, Homo sapiens
aagcacagtgggcagagcagcc

SEQ ID NO: 10033946 - DNA, 22 bp, Homo sapiens
aagcacagtaaaagcagatttt

SEQ ID NO: 10033947 - DNA, 17 bp, Homo sapiens
agagttttaagaaattt

SEQ ID NO: 10033948 - DNA, 22 bp, Homo sapiens
agaggtcagatttctcctggtg

SEQ ID NO: 10033949 - DNA, 22 bp, Homo sapiens
attgctaggaacaggttgcacc

SEQ ID NO: 10033950 - DNA, 22 bp, Homo sapiens
agagtttaacacaagaaaagtt

SEQ ID NO: 10033951 - DNA, 22 bp, Homo sapiens
agagtttaaacactgtcacaga

SEQ ID NO: 10033952 - DNA, 22 bp, Homo sapiens
agagtttaggggacacagaata

SEQ ID NO: 10033953 - DNA, 22 bp, Homo sapiens
agagtttaggggtaagcatagt

SEQ ID NO: 10033954 - DNA, 19 bp, Homo sapiens
agagtttaggtctatcagg

SEQ ID NO: 10033955 - DNA, 17 bp, Homo sapiens
atttccagagtggccct

SEQ ID NO: 10033956 - DNA, 18 bp, Homo sapiens
atttggcagatgatgaac

SEQ ID NO: 10033957 - DNA, 22 bp, Homo sapiens
atttgtgaattaagcatgtcaa

SEQ ID NO: 10033958 - DNA, 20 bp, Homo sapiens
agaggaggattattttattc

SEQ ID NO: 10033959 - DNA, 22 bp, Homo sapiens
agaggaggaagagctttaaaat

SEQ ID NO: 10033960 - DNA, 22 bp, Homo sapiens
agaggaggcagcttaactcagt

SEQ ID NO: 10033961 - DNA, 22 bp, Homo sapiens
attattactcctgattgtactg

SEQ ID NO: 10033962 - DNA, 22 bp, Homo sapiens
agaggcagaagtgttcaaaccc

SEQ ID NO: 10033963 - DNA, 22 bp, Homo sapiens
agaggacagacggaaagtgcca

SEQ ID NO: 10033964 - DNA, 22 bp, Homo sapiens
agaggacaggttttccatgggc

SEQ ID NO: 10033965 - DNA, 22 bp, Homo sapiens
agaggcggagcttgcagtgagc

SEQ ID NO: 10033966 - DNA, 22 bp, Homo sapiens
agaggcggaggttgcagtgagc

SEQ ID NO: 10033967 - DNA, 22 bp, Homo sapiens
agaggcagcagtcatactacag

SEQ ID NO: 10033968 - DNA, 17 bp, Homo sapiens
agaggcagatacttgga

SEQ ID NO: 10033969 - DNA, 22 bp, Homo sapiens
agaggcaggaggttgacttgag

SEQ ID NO: 10033970 - DNA, 22 bp, Homo sapiens
agaggcaggaagagctgatttt

SEQ ID NO: 10033971 - DNA, 22 bp, Homo sapiens
agaggcagccgtatttcaaagg

SEQ ID NO: 10033972 - DNA, 22 bp, Homo sapiens
attccaggttgtagaaaagttt

SEQ ID NO: 10033973 - DNA, 22 bp, Homo sapiens
attccaggagctaactgtggtc

SEQ ID NO: 10033974 - DNA, 22 bp, Homo sapiens
attccaggactaaaggaacagc

SEQ ID NO: 10033975 - DNA, 22 bp, Homo sapiens
attccaggaagtgtgggaccaa

SEQ ID NO: 10033976 - DNA, 23 bp, Homo sapiens
attccaggaaatacttggctttc

SEQ ID NO: 10033977 - DNA, 22 bp, Homo sapiens
attccaggcaaagcagagaaga

SEQ ID NO: 10033978 - DNA, 22 bp, Homo sapiens
attccaggcatgcaggaacaag

SEQ ID NO: 10033979 - DNA, 22 bp, Homo sapiens
attccaggcagaccagagagat

SEQ ID NO: 10033980 - DNA, 22 bp, Homo sapiens
attccaggattccaggacaaat

SEQ ID NO: 10033981 - DNA, 17 bp, Homo sapiens
agagggaaaatgcggtt

SEQ ID NO: 10033982 - DNA, 22 bp, Homo sapiens
agagacagggttttgtcgtgtt

SEQ ID NO: 10033983 - DNA, 23 bp, Homo sapiens
agagacatttggatacagaaaca

SEQ ID NO: 10033984 - DNA, 22 bp, Homo sapiens
agagacatggagaggcaaagtt

SEQ ID NO: 10033985 - DNA, 22 bp, Homo sapiens
agagagttgtaccacactcata

SEQ ID NO: 10033986 - DNA, 22 bp, Homo sapiens
agagagttgaggaagcaacact

SEQ ID NO: 10033987 - DNA, 22 bp, Homo sapiens
agagagttgtatgtttctaaaa

SEQ ID NO: 10033988 - DNA, 22 bp, Homo sapiens
agagatgaagggcattccccag

SEQ ID NO: 10033989 - DNA, 22 bp, Homo sapiens
atggccttattatggcacccga

SEQ ID NO: 10033990 - DNA, 22 bp, Homo sapiens
atggccttattcaaggaagact

SEQ ID NO: 10033991 - DNA, 22 bp, Homo sapiens
agagaccttcctgactccagag

SEQ ID NO: 10033992 - DNA, 22 bp, Homo sapiens
atggcctggccagagctctgct

SEQ ID NO: 10033993 - DNA, 22 bp, Homo sapiens
atggcctgatgcacctgtccca

SEQ ID NO: 10033994 - DNA, 22 bp, Homo sapiens
atggcctggggagcatgggaag

SEQ ID NO: 10033995 - DNA, 22 bp, Homo sapiens
agagaagacttacagccacagt

SEQ ID NO: 10033996 - DNA, 22 bp, Homo sapiens
atggcagcctgagcagaggaat

SEQ ID NO: 10033997 - DNA, 22 bp, Homo sapiens
atggggtgaccatgagcattta

SEQ ID NO: 10033998 - DNA, 22 bp, Homo sapiens
atggggtggagtccgggcagcg

SEQ ID NO: 10033999 - DNA, 22 bp, Homo sapiens
atgtgggaaatacaagctaaaa

SEQ ID NO: 10034000 - DNA, 22 bp, Homo sapiens
atgtcaaagcagactgagagcg

SEQ ID NO: 10034001 - DNA, 22 bp, Homo sapiens
agagcctgcagtggagaccttg

SEQ ID NO: 10034002 - DNA, 22 bp, Homo sapiens
agaagtttggtcctataaactc

SEQ ID NO: 10034003 - DNA, 22 bp, Homo sapiens
agaagtttgaaattaggagaaa

SEQ ID NO: 10034004 - DNA, 22 bp, Homo sapiens
atctttgttgctctcatttctg

SEQ ID NO: 10034005 - DNA, 22 bp, Homo sapiens
atctttgttatctcagatcttg

SEQ ID NO: 10034006 - DNA, 18 bp, Homo sapiens
agaattgctgcttcttct

SEQ ID NO: 10034007 - DNA, 22 bp, Homo sapiens
agacagctaataaatgagtgtg

SEQ ID NO: 10034008 - DNA, 22 bp, Homo sapiens
agacagctgggaaatggagtgt

SEQ ID NO: 10034009 - DNA, 22 bp, Homo sapiens
atgacaaaggctgaaagggaaa

SEQ ID NO: 10034010 - DNA, 22 bp, Homo sapiens
cagccctgagagaaccatctat

SEQ ID NO: 10034011 - DNA, 22 bp, Homo sapiens
cagcagggtatacagggaattt

SEQ ID NO: 10034012 - DNA, 21 bp, Homo sapiens
cagcagtgtgtctgagctaga

SEQ ID NO: 10034013 - DNA, 22 bp, Homo sapiens
cagcagtgtggaagctgagggg

SEQ ID NO: 10034014 - DNA, 18 bp, Homo sapiens
agctcctgaactctgtgg

SEQ ID NO: 10034015 - DNA, 22 bp, Homo sapiens
cagcagcattgctctggattcc

SEQ ID NO: 10034016 - DNA, 22 bp, Homo sapiens
cagcagctcagtctctcagtag

SEQ ID NO: 10034017 - DNA, 22 bp, Homo sapiens
cagcaggatatggtggagagag

SEQ ID NO: 10034018 - DNA, 22 bp, Homo sapiens
cagcagggcccccgggtgcgcc

SEQ ID NO: 10034019 - DNA, 22 bp, Homo sapiens
agccactgtgcaggagcagtgt

SEQ ID NO: 10034020 - DNA, 22 bp, Homo sapiens
agccactgtgagaggaccaggg

SEQ ID NO: 10034021 - DNA, 22 bp, Homo sapiens
agccactccttcagcgtctgct

SEQ ID NO: 10034022 - DNA, 22 bp, Homo sapiens
cagaggcatactcccagtcttg

SEQ ID NO: 10034023 - DNA, 22 bp, Homo sapiens
cagaggcattactgaaaaggtg

SEQ ID NO: 10034024 - DNA, 20 bp, Homo sapiens
cagaggcattttcagactct

SEQ ID NO: 10034025 - DNA, 22 bp, Homo sapiens
agcccaggcagagggatgcttg

SEQ ID NO: 10034026 - DNA, 22 bp, Homo sapiens
cagaggcagtggggttgctcct

SEQ ID NO: 10034027 - DNA, 20 bp, Homo sapiens
agcccaggcctgtgtgagtc

SEQ ID NO: 10034028 - DNA, 22 bp, Homo sapiens
agcccagggaaccaggaagtgg

SEQ ID NO: 10034029 - DNA, 22 bp, Homo sapiens
agcagcagggtgatagtgccca

SEQ ID NO: 10034030 - DNA, 22 bp, Homo sapiens
agcagcagggtcattgctcttt

SEQ ID NO: 10034031 - DNA, 22 bp, Homo sapiens
agcagcagggacaaaggaacag

SEQ ID NO: 10034032 - DNA, 22 bp, Homo sapiens
agcagcagggcatgtcttactc

SEQ ID NO: 10034033 - DNA, 22 bp, Homo sapiens
agcagcaggcttaaggaaaagt

SEQ ID NO: 10034034 - DNA, 21 bp, Homo sapiens
agcagcagggaagcctcatcc

SEQ ID NO: 10034035 - DNA, 22 bp, Homo sapiens
cacaaggaggtcctgaggaagc

SEQ ID NO: 10034036 - DNA, 22 bp, Homo sapiens
cacaaggactggatggagtggg

SEQ ID NO: 10034037 - DNA, 20 bp, Homo sapiens
agcagcagatgttggaggtg

SEQ ID NO: 10034038 - DNA, 22 bp, Homo sapiens
agcagcagctctgttgccctac

SEQ ID NO: 10034039 - DNA, 22 bp, Homo sapiens
agcagcaggaggccattgtctt

SEQ ID NO: 10034040 - DNA, 22 bp, Homo sapiens
agcagcaggagccgtggggtga

SEQ ID NO: 10034041 - DNA, 22 bp, Homo sapiens
agcagcaggattttcgttggga

SEQ ID NO: 10034042 - DNA, 22 bp, Homo sapiens
agcagcaggctgtgtggactga

SEQ ID NO: 10034043 - DNA, 22 bp, Homo sapiens
agcagcaggctgggatgagtct

SEQ ID NO: 10034044 - DNA, 22 bp, Homo sapiens
agcagcaggctagggaactgct

SEQ ID NO: 10034045 - DNA, 17 bp, Homo sapiens
caagagagatgactgga

SEQ ID NO: 10034046 - DNA, 22 bp, Homo sapiens
caacagaggagtggcctgatcc

SEQ ID NO: 10034047 - DNA, 22 bp, Homo sapiens
caaatattccaggtacatccct

SEQ ID NO: 10034048 - DNA, 22 bp, Homo sapiens
caaattaccctcaacatctaga

SEQ ID NO: 10034049 - DNA, 22 bp, Homo sapiens
caagagacgggcaaggcaagag

SEQ ID NO: 10034050 - DNA, 22 bp, Homo sapiens
agcacatgcacagtgctacact

SEQ ID NO: 10034051 - DNA, 22 bp, Homo sapiens
cactgctgtttttaccacactg

SEQ ID NO: 10034052 - DNA, 22 bp, Homo sapiens
cacctctgcctcaagcttccca

SEQ ID NO: 10034053 - DNA, 22 bp, Homo sapiens
agcagggttctcagttggtgct

SEQ ID NO: 10034054 - DNA, 22 bp, Homo sapiens
agcagctgcagggagggtctgc

SEQ ID NO: 10034055 - DNA, 22 bp, Homo sapiens
cacagtgtttgatttaggggcc

SEQ ID NO: 10034056 - DNA, 22 bp, Homo sapiens
cacagtttctgaacactttgca

SEQ ID NO: 10034057 - DNA, 22 bp, Homo sapiens
cacagtttcaataattattctt

SEQ ID NO: 10034058 - DNA, 22 bp, Homo sapiens
cacagtttctataggtcagaat

SEQ ID NO: 10034059 - DNA, 22 bp, Homo sapiens
atattacacacggtatcacggg

SEQ ID NO: 10034060 - DNA, 22 bp, Homo sapiens
atattcatcgtgtagaaatact

SEQ ID NO: 10034061 - DNA, 22 bp, Homo sapiens
agaaaataaattgatggtggaa

SEQ ID NO: 10034062 - DNA, 19 bp, Homo sapiens
agaacagctttttgtgaca

SEQ ID NO: 10034063 - DNA, 22 bp, Homo sapiens
atctcacatcctcagtagtgca

SEQ ID NO: 10034064 - DNA, 22 bp, Homo sapiens
agaaagttgttggaggaaatga

SEQ ID NO: 10034065 - DNA, 22 bp, Homo sapiens
agaaagttgttttagccaaacc

SEQ ID NO: 10034066 - DNA, 22 bp, Homo sapiens
agaaagttatcacaaaattgag

SEQ ID NO: 10034067 - DNA, 22 bp, Homo sapiens
agaaagggttctctgaggtgct

SEQ ID NO: 10034068 - DNA, 22 bp, Homo sapiens
agaaagtttattcctatctagc

SEQ ID NO: 10034069 - DNA, 22 bp, Homo sapiens
agaacagaagggaggaaggcct

SEQ ID NO: 10034070 - DNA, 22 bp, Homo sapiens
atacatgttgagaaaatatctg

SEQ ID NO: 10034071 - DNA, 22 bp, Homo sapiens
aggtggccccaggcctctgcca

SEQ ID NO: 10034072 - DNA, 23 bp, Homo sapiens
aggtggcctttgcctctttctct

SEQ ID NO: 10034073 - DNA, 19 bp, Homo sapiens
acctggcctcttgagcaag

SEQ ID NO: 10034074 - DNA, 19 bp, Homo sapiens
acctggccagagttcaata

SEQ ID NO: 10034075 - DNA, 22 bp, Homo sapiens
acctgcaggggtgctctctggg

SEQ ID NO: 10034076 - DNA, 22 bp, Homo sapiens
acctgcagtggccactcctaat

SEQ ID NO: 10034077 - DNA, 22 bp, Homo sapiens
acctgagcctagggaggttgag

SEQ ID NO: 10034078 - DNA, 21 bp, Homo sapiens
acctgagctccacctcctgcc

SEQ ID NO: 10034079 - DNA, 22 bp, Homo sapiens
acctgagcatgccaggagagtg

SEQ ID NO: 10034080 - DNA, 22 bp, Homo sapiens
actgcacttcagcctgggtgtc

SEQ ID NO: 10034081 - DNA, 19 bp, Homo sapiens
agtgtagctaggatgtgct

SEQ ID NO: 10034082 - DNA, 22 bp, Homo sapiens
actgcacttcagcctgggtgac

SEQ ID NO: 10034083 - DNA, 22 bp, Homo sapiens
agtggcagtagatgagctggtt

SEQ ID NO: 10034084 - DNA, 22 bp, Homo sapiens
agtggcaggtgtgtagtatccc

SEQ ID NO: 10034085 - DNA, 22 bp, Homo sapiens
agtgtattaagttatgaagtta

SEQ ID NO: 10034086 - DNA, 22 bp, Homo sapiens
agtgtttaatgccttttccagc

SEQ ID NO: 10034087 - DNA, 22 bp, Homo sapiens
agtgttcttcttcaaagctctg

SEQ ID NO: 10034088 - DNA, 22 bp, Homo sapiens
actctgtgtttagtgctgccat

SEQ ID NO: 10034089 - DNA, 22 bp, Homo sapiens
acaggagaattatctggaacaa

SEQ ID NO: 10034090 - DNA, 22 bp, Homo sapiens
agctggtggattatgctgtaca

SEQ ID NO: 10034091 - DNA, 17 bp, Homo sapiens
agctgaccagatggact

SEQ ID NO: 10034092 - DNA, 22 bp, Homo sapiens
acagctgctcacctgtgagccc

SEQ ID NO: 10034093 - DNA, 22 bp, Homo sapiens
agctggaggggccagcaggtgt

SEQ ID NO: 10034094 - DNA, 22 bp, Homo sapiens
acagtgggatgaggctggcccc

SEQ ID NO: 10034095 - DNA, 23 bp, Homo sapiens
acagtcgtaggtatccttttcct

SEQ ID NO: 10034096 - DNA, 22 bp, Homo sapiens
acagtcaggccgagatgggcct

SEQ ID NO: 10034097 - DNA, 22 bp, Homo sapiens
acaggtttagctcttagtagtc

SEQ ID NO: 10034098 - DNA, 22 bp, Homo sapiens
aggagcagaatttaatgtgcag

SEQ ID NO: 10034099 - DNA, 22 bp, Homo sapiens
aggagcagaactgattctgact

SEQ ID NO: 10034100 - DNA, 22 bp, Homo sapiens
aggatgaggctggcaggtcttg

SEQ ID NO: 10034101 - DNA, 22 bp, Homo sapiens
aggatgagccgcgcaagctgac

SEQ ID NO: 10034102 - DNA, 22 bp, Homo sapiens
acagtttataaaaataatgagg

SEQ ID NO: 10034103 - DNA, 22 bp, Homo sapiens
acagtttaggatgagagaacac

SEQ ID NO: 10034104 - DNA, 20 bp, Homo sapiens
acagtttattttacttggtt

SEQ ID NO: 10034105 - DNA, 22 bp, Homo sapiens
acagtttgaataatttagatag

SEQ ID NO: 10034106 - DNA, 17 bp, Homo sapiens
acagtttgattttagca

SEQ ID NO: 10034107 - DNA, 21 bp, Homo sapiens
acagtttattagagtaagtgc

SEQ ID NO: 10034108 - DNA, 22 bp, Homo sapiens
aggcagctggacataactaacc

SEQ ID NO: 10034109 - DNA, 22 bp, Homo sapiens
aggcagctggaggcagagacta

SEQ ID NO: 10034110 - DNA, 22 bp, Homo sapiens
aggcagctggaaaactccaggc

SEQ ID NO: 10034111 - DNA, 22 bp, Homo sapiens
aggcagctgccctctccttcct

SEQ ID NO: 10034112 - DNA, 21 bp, Homo sapiens
aggcagctggaaggcctggct

SEQ ID NO: 10034113 - DNA, 22 bp, Homo sapiens
aggcagctctgtggcctcccag

SEQ ID NO: 10034114 - DNA, 21 bp, Homo sapiens
aggcagctcaggcccagagag

SEQ ID NO: 10034115 - DNA, 22 bp, Homo sapiens
aggcagctgaggtctggcgccc

SEQ ID NO: 10034116 - DNA, 22 bp, Homo sapiens
aggcagctgaccacagtatgat

SEQ ID NO: 10034117 - DNA, 17 bp, Homo sapiens
aggcagctcagaacatc

SEQ ID NO: 10034118 - DNA, 22 bp, Homo sapiens
aggcagctagagagtgaaactg

SEQ ID NO: 10034119 - DNA, 22 bp, Homo sapiens
aggcagctaagatggataatga

SEQ ID NO: 10034120 - DNA, 22 bp, Homo sapiens
acatttgagcatatttcttgtc

SEQ ID NO: 10034121 - DNA, 22 bp, Homo sapiens
acatttgagtcatatttgctta

SEQ ID NO: 10034122 - DNA, 22 bp, Homo sapiens
acatttgatatggagttgtgta

SEQ ID NO: 10034123 - DNA, 22 bp, Homo sapiens
aggctgagctggcccttgaaat

SEQ ID NO: 10034124 - DNA, 18 bp, Homo sapiens
aggcctctgtgtgcccag

SEQ ID NO: 10034125 - DNA, 22 bp, Homo sapiens
acatgtttggctctatgctata

SEQ ID NO: 10034126 - DNA, 22 bp, Homo sapiens
acatgttagctactattgttat

SEQ ID NO: 10034127 - DNA, 22 bp, Homo sapiens
accagcagctgccagagtggag

SEQ ID NO: 10034128 - DNA, 22 bp, Homo sapiens
accagcagagttgaggaggaca

SEQ ID NO: 10034129 - DNA, 21 bp, Homo sapiens
accagcaggagatcagaagga

SEQ ID NO: 10034130 - DNA, 21 bp, Homo sapiens
agggcagattagctgtaagag

SEQ ID NO: 10034131 - DNA, 22 bp, Homo sapiens
agggcagcagcggcccaggcct

SEQ ID NO: 10034132 - DNA, 22 bp, Homo sapiens
agggcagcagctcctcctagct

SEQ ID NO: 10034133 - DNA, 22 bp, Homo sapiens
agggcagcacaaggcatggact

SEQ ID NO: 10034134 - DNA, 18 bp, Homo sapiens
agggagagaccgcgggtc

SEQ ID NO: 10034135 - DNA, 22 bp, Homo sapiens
acccaggagagagctataaaat

SEQ ID NO: 10034136 - DNA, 22 bp, Homo sapiens
acccaggagacggaggtgcagt

SEQ ID NO: 10034137 - DNA, 22 bp, Homo sapiens
acccaggagacaggttgcagtg

SEQ ID NO: 10034138 - DNA, 22 bp, Homo sapiens
acccaggactctcttccagtag

SEQ ID NO: 10034139 - DNA, 22 bp, Homo sapiens
acccaggacttggcaacctcat

SEQ ID NO: 10034140 - DNA, 22 bp, Homo sapiens
acccaggacaaaataaccaggt

SEQ ID NO: 10034141 - DNA, 22 bp, Homo sapiens
acccaggaaaacatggtgcaga

SEQ ID NO: 10034142 - DNA, 22 bp, Homo sapiens
acccaggacacagagatgaccc

SEQ ID NO: 10034143 - DNA, 22 bp, Homo sapiens
acccaggacatgggcacccgtg

SEQ ID NO: 10034144 - DNA, 22 bp, Homo sapiens
tccaggtctaatttgtccttga

SEQ ID NO: 10034145 - DNA, 22 bp, Homo sapiens
tccaggtctggcctgctaggca

SEQ ID NO: 10034146 - DNA, 19 bp, Homo sapiens
tccatgcccaggcaccaag

SEQ ID NO: 10034147 - DNA, 22 bp, Homo sapiens
tccagggaaggtgtgaggctgg

SEQ ID NO: 10034148 - DNA, 18 bp, Homo sapiens
tccaggcctgaagtgtcc

SEQ ID NO: 10034149 - DNA, 22 bp, Homo sapiens
tccaggcctttgcacatgttgt

SEQ ID NO: 10034150 - DNA, 22 bp, Homo sapiens
tcctcagcaaacacttcactct

SEQ ID NO: 10034151 - DNA, 22 bp, Homo sapiens
tcctcagacaccctgctggctt

SEQ ID NO: 10034152 - DNA, 22 bp, Homo sapiens
tcctcagggggccaacccagcc

SEQ ID NO: 10034153 - DNA, 20 bp, Homo sapiens
tcctagcttctctctgtaca

SEQ ID NO: 10034154 - DNA, 18 bp, Homo sapiens
tccctgggatataattac

SEQ ID NO: 10034155 - DNA, 16 bp, Homo sapiens
tccctgggagtggtgg

SEQ ID NO: 10034156 - DNA, 22 bp, Homo sapiens
tccctgggacggccttttggag

SEQ ID NO: 10034157 - DNA, 22 bp, Homo sapiens
tccctgggaccggcagctcaca

SEQ ID NO: 10034158 - DNA, 22 bp, Homo sapiens
tccctgggactcagacatggaa

SEQ ID NO: 10034159 - DNA, 15 bp, Homo sapiens
tccctgggagatggt

SEQ ID NO: 10034160 - DNA, 22 bp, Homo sapiens
tccctgggagatgatgatgagg

SEQ ID NO: 10034161 - DNA, 22 bp, Homo sapiens
tccctgggaaatgtcagtttca

SEQ ID NO: 10034162 - DNA, 22 bp, Homo sapiens
tccctgggaattaatatttgga

SEQ ID NO: 10034163 - DNA, 22 bp, Homo sapiens
tccctgggaacaaaggatgaga

SEQ ID NO: 10034164 - DNA, 22 bp, Homo sapiens
tccctgagactctggagtgtaa

SEQ ID NO: 10034165 - DNA, 22 bp, Homo sapiens
tccctgagactctggagtgtaa

SEQ ID NO: 10034166 - DNA, 22 bp, Homo sapiens
tccctgagaaagcccaggaggt

SEQ ID NO: 10034167 - DNA, 22 bp, Homo sapiens
tccctgagaaagcccaggaggt

SEQ ID NO: 10034168 - DNA, 22 bp, Homo sapiens
tccctcagcttgtctccatgca

SEQ ID NO: 10034169 - DNA, 20 bp, Homo sapiens
tcccaggctgggctccagct

SEQ ID NO: 10034170 - DNA, 20 bp, Homo sapiens
tcccaggctgggctccagct

SEQ ID NO: 10034171 - DNA, 20 bp, Homo sapiens
tcccaggctccaccctagac

SEQ ID NO: 10034172 - DNA, 22 bp, Homo sapiens
tcccctggtgccacgatctgct

SEQ ID NO: 10034173 - DNA, 22 bp, Homo sapiens
tcctctgggcctatttgttcac

SEQ ID NO: 10034174 - DNA, 22 bp, Homo sapiens
tcctgagctacagtagtatgat

SEQ ID NO: 10034175 - DNA, 22 bp, Homo sapiens
tcctgagctcccatgaacaggc

SEQ ID NO: 10034176 - DNA, 22 bp, Homo sapiens
tcctgagctgacacttggggag

SEQ ID NO: 10034177 - DNA, 22 bp, Homo sapiens
tcctgagctgccgcatcagcag

SEQ ID NO: 10034178 - DNA, 22 bp, Homo sapiens
tcctgagctttacagtaaggac

SEQ ID NO: 10034179 - DNA, 22 bp, Homo sapiens
tcctgagcacagagacaaggaa

SEQ ID NO: 10034180 - DNA, 22 bp, Homo sapiens
tcctgagcaacacagctaagtg

SEQ ID NO: 10034181 - DNA, 22 bp, Homo sapiens
tcctgagcacctatgccatggc

SEQ ID NO: 10034182 - DNA, 22 bp, Homo sapiens
tcctgagccctactctagacga

SEQ ID NO: 10034183 - DNA, 22 bp, Homo sapiens
tcctgagccctggggtcagtgt

SEQ ID NO: 10034184 - DNA, 22 bp, Homo sapiens
tcaggagactggcagtgcccac

SEQ ID NO: 10034185 - DNA, 22 bp, Homo sapiens
tcaggagacattcttaaagtag

SEQ ID NO: 10034186 - DNA, 22 bp, Homo sapiens
tcaggagaatcagggctgtcct

SEQ ID NO: 10034187 - DNA, 22 bp, Homo sapiens
tcaggagacaaagggtgcggag

SEQ ID NO: 10034188 - DNA, 18 bp, Homo sapiens
tcaggagacacagacgca

SEQ ID NO: 10034189 - DNA, 22 bp, Homo sapiens
tcaggagaaagccaattagagt

SEQ ID NO: 10034190 - DNA, 22 bp, Homo sapiens
tcaggagaaaatatcaggaagt

SEQ ID NO: 10034191 - DNA, 22 bp, Homo sapiens
tcaggagaacttccttctaccc

SEQ ID NO: 10034192 - DNA, 22 bp, Homo sapiens
tcaggagaaggcaatgtggaaa

SEQ ID NO: 10034193 - DNA, 22 bp, Homo sapiens
tcaggacacttggcacaaggtc

SEQ ID NO: 10034194 - DNA, 22 bp, Homo sapiens
tcagctctgcctgtggaggcac

SEQ ID NO: 10034195 - DNA, 22 bp, Homo sapiens
tcagcagggctgtggtgtggct

SEQ ID NO: 10034196 - DNA, 22 bp, Homo sapiens
tcagcagggctgggagctgtga

SEQ ID NO: 10034197 - DNA, 22 bp, Homo sapiens
tcagcaggctgtcagcaggggc

SEQ ID NO: 10034198 - DNA, 22 bp, Homo sapiens
tcagcagggagaggagaatgca

SEQ ID NO: 10034199 - DNA, 22 bp, Homo sapiens
tcagagtgggagaatgtgccaa

SEQ ID NO: 10034200 - DNA, 22 bp, Homo sapiens
tcacagtgacttacagagattg

SEQ ID NO: 10034201 - DNA, 22 bp, Homo sapiens
tcactgcaacctccacctcccg

SEQ ID NO: 10034202 - DNA, 22 bp, Homo sapiens
tcactgcaacctccacctcctg

SEQ ID NO: 10034203 - DNA, 22 bp, Homo sapiens
tcagaaaggagttagaggtctc

SEQ ID NO: 10034204 - DNA, 22 bp, Homo sapiens
tcagaaaggttgagtcatgtgc

SEQ ID NO: 10034205 - DNA, 22 bp, Homo sapiens
tcagaaagctatatggtgtgtc

SEQ ID NO: 10034206 - DNA, 22 bp, Homo sapiens
tcagaaagcttagtgtcttgca

SEQ ID NO: 10034207 - DNA, 22 bp, Homo sapiens
tcagaaaccagctctctcaatt

SEQ ID NO: 10034208 - DNA, 22 bp, Homo sapiens
tcagaaacactcttcttctgtc

SEQ ID NO: 10034209 - DNA, 22 bp, Homo sapiens
tcagaaagaacacaggcagtag

SEQ ID NO: 10034210 - DNA, 22 bp, Homo sapiens
tccaaagaacctggctactgtc

SEQ ID NO: 10034211 - DNA, 22 bp, Homo sapiens
tccaaagacttgctgtatgtaa

SEQ ID NO: 10034212 - DNA, 22 bp, Homo sapiens
tcatttacatgtctttctctga

SEQ ID NO: 10034213 - DNA, 22 bp, Homo sapiens
tcatttacgcgcctccttcctt

SEQ ID NO: 10034214 - DNA, 22 bp, Homo sapiens
tcatacattcagcagatatttg

SEQ ID NO: 10034215 - DNA, 22 bp, Homo sapiens
tcagtgtttttaaagcaatata

SEQ ID NO: 10034216 - DNA, 22 bp, Homo sapiens
tcagtgttttccagggtctact

SEQ ID NO: 10034217 - DNA, 22 bp, Homo sapiens
tcagtgttttaactgtctttta

SEQ ID NO: 10034218 - DNA, 22 bp, Homo sapiens
tcagtgtttgtggcaaatgtta

SEQ ID NO: 10034219 - DNA, 22 bp, Homo sapiens
tcagtgtttgaacccagggtta

SEQ ID NO: 10034220 - DNA, 22 bp, Homo sapiens
tcagtgtttggtttcagaattg

SEQ ID NO: 10034221 - DNA, 22 bp, Homo sapiens
tcagtgtttcctagagcatata

SEQ ID NO: 10034222 - DNA, 22 bp, Homo sapiens
tcagtgtttcctgtggtacagc

SEQ ID NO: 10034223 - DNA, 23 bp, Homo sapiens
tcataaatattagcacagtagga

SEQ ID NO: 10034224 - DNA, 22 bp, Homo sapiens
tcagtgttctggatttggggca

SEQ ID NO: 10034225 - DNA, 22 bp, Homo sapiens
tcagtgttcttatttaattagg

SEQ ID NO: 10034226 - DNA, 22 bp, Homo sapiens
tcagtgttgaattttttgcaaa

SEQ ID NO: 10034227 - DNA, 22 bp, Homo sapiens
tcagtgttggagataattgcac

SEQ ID NO: 10034228 - DNA, 22 bp, Homo sapiens
tcagtgttggcattcagaaatg

SEQ ID NO: 10034229 - DNA, 22 bp, Homo sapiens
tcagtgtttattgcggtgtgta

SEQ ID NO: 10034230 - DNA, 22 bp, Homo sapiens
tcagtgtttcagtttggaaatg

SEQ ID NO: 10034231 - DNA, 22 bp, Homo sapiens
tcagtgtttaccgtatgttgtt

SEQ ID NO: 10034232 - DNA, 22 bp, Homo sapiens
tcagtgtttattcaatgttatt

SEQ ID NO: 10034233 - DNA, 22 bp, Homo sapiens
tcagtgtttacatgcatccttg

SEQ ID NO: 10034234 - DNA, 22 bp, Homo sapiens
tcagtgttgtgcacatacaaaa

SEQ ID NO: 10034235 - DNA, 22 bp, Homo sapiens
tcagtgttggtcaagaatcagt

SEQ ID NO: 10034236 - DNA, 22 bp, Homo sapiens
tcagtgttggctacatctgcct

SEQ ID NO: 10034237 - DNA, 22 bp, Homo sapiens
tcaggagagtgttcagtggagg

SEQ ID NO: 10034238 - DNA, 22 bp, Homo sapiens
tcaggagagaaagaatacaatt

SEQ ID NO: 10034239 - DNA, 22 bp, Homo sapiens
tcaggagacttatgtcacagtg

SEQ ID NO: 10034240 - DNA, 22 bp, Homo sapiens
tcaggagagagaaattggggct

SEQ ID NO: 10034241 - DNA, 22 bp, Homo sapiens
tcaggagagagttgggtaggct

SEQ ID NO: 10034242 - DNA, 21 bp, Homo sapiens
tcaggagagcccatctacaaa

SEQ ID NO: 10034243 - DNA, 22 bp, Homo sapiens
tcagggcatctcttaagtggtg

SEQ ID NO: 10034244 - DNA, 22 bp, Homo sapiens
tatcagcaagatggcagtatag

SEQ ID NO: 10034245 - DNA, 22 bp, Homo sapiens
tatgacaagaaatacagaggta

SEQ ID NO: 10034246 - DNA, 20 bp, Homo sapiens
tatgacaacgcagcaaggca

SEQ ID NO: 10034247 - DNA, 22 bp, Homo sapiens
tatgcttttaacctgtaactga

SEQ ID NO: 10034248 - DNA, 20 bp, Homo sapiens
tatgctttttataagattga

SEQ ID NO: 10034249 - DNA, 22 bp, Homo sapiens
tatgctttggtagagagttgtg

SEQ ID NO: 10034250 - DNA, 22 bp, Homo sapiens
tatgctttacttttcattgtga

SEQ ID NO: 10034251 - DNA, 22 bp, Homo sapiens
tatgctttcattcatatgtgag

SEQ ID NO: 10034252 - DNA, 18 bp, Homo sapiens
tcaaatactttgggcagt

SEQ ID NO: 10034253 - DNA, 22 bp, Homo sapiens
tcaaataccagcaatttcatgt

SEQ ID NO: 10034254 - DNA, 20 bp, Homo sapiens
tcaaagaagattcagctcaa

SEQ ID NO: 10034255 - DNA, 22 bp, Homo sapiens
tattacaatttacattgcactt

SEQ ID NO: 10034256 - DNA, 23 bp, Homo sapiens
tattacaattggtcttattaaga

SEQ ID NO: 10034257 - DNA, 22 bp, Homo sapiens
tattacaaattataatgggaga

SEQ ID NO: 10034258 - DNA, 22 bp, Homo sapiens
tattacaagaaagggcatgaat

SEQ ID NO: 10034259 - DNA, 19 bp, Homo sapiens
tagcagctgccaaaggaga

SEQ ID NO: 10034260 - DNA, 22 bp, Homo sapiens
tagctgcttcagtctaggtctc

SEQ ID NO: 10034261 - DNA, 22 bp, Homo sapiens
tacttacattagcaaacaaggt

SEQ ID NO: 10034262 - DNA, 22 bp, Homo sapiens
tagagaacaagtatggcacgga

SEQ ID NO: 10034263 - DNA, 22 bp, Homo sapiens
tagagaactcagtgtgcagcct

SEQ ID NO: 10034264 - DNA, 22 bp, Homo sapiens
tagttacagtgcatagcaagat

SEQ ID NO: 10034265 - DNA, 22 bp, Homo sapiens
tagtttatgattttttggaagg

SEQ ID NO: 10034266 - DNA, 22 bp, Homo sapiens
tagtttatagttagcgagcacg

SEQ ID NO: 10034267 - DNA, 22 bp, Homo sapiens
tagtttatgctgctgcagtgag

SEQ ID NO: 10034268 - DNA, 22 bp, Homo sapiens
tagtgccaaagcctggtgtcat

SEQ ID NO: 10034269 - DNA, 22 bp, Homo sapiens
tagtgccaagctaatgccagaa

SEQ ID NO: 10034270 - DNA, 22 bp, Homo sapiens
tagtgccaccttccaagtatca

SEQ ID NO: 10034271 - DNA, 20 bp, Homo sapiens
tagtgccagtgtgcatgcta

SEQ ID NO: 10034272 - DNA, 22 bp, Homo sapiens
tagtgccatatgtgactagaac

SEQ ID NO: 10034273 - DNA, 22 bp, Homo sapiens
tagtgccatagataggaccatt

SEQ ID NO: 10034274 - DNA, 22 bp, Homo sapiens
taggcagaattcattgtgctgc

SEQ ID NO: 10034275 - DNA, 22 bp, Homo sapiens
taggcagaattgttgaatgaag

SEQ ID NO: 10034276 - DNA, 22 bp, Homo sapiens
taggcagcagtgctatgattct

SEQ ID NO: 10034277 - DNA, 22 bp, Homo sapiens
taggcagcatggattctgaata

SEQ ID NO: 10034278 - DNA, 22 bp, Homo sapiens
taggcagccagcatcagttggg

SEQ ID NO: 10034279 - DNA, 22 bp, Homo sapiens
taggcagctgcaaacttcggtc

SEQ ID NO: 10034280 - DNA, 22 bp, Homo sapiens
taggcagcgcttggctgtgctt

SEQ ID NO: 10034281 - DNA, 22 bp, Homo sapiens
taggcagcttaggttagaagtg

SEQ ID NO: 10034282 - DNA, 20 bp, Homo sapiens
taggcagcttgacccttggt

SEQ ID NO: 10034283 - DNA, 22 bp, Homo sapiens
taggcagatgttaacaggaaaa

SEQ ID NO: 10034284 - DNA, 20 bp, Homo sapiens
taggcagagctgtgcagcct

SEQ ID NO: 10034285 - DNA, 23 bp, Homo sapiens
tagggcagctgggagggacatgc

SEQ ID NO: 10034286 - DNA, 22 bp, Homo sapiens
tagggcagagtccaggatgggc

SEQ ID NO: 10034287 - DNA, 22 bp, Homo sapiens
gttatattggcagaagagaaga

SEQ ID NO: 10034288 - DNA, 22 bp, Homo sapiens
gtttgattcaagaacaaagagt

SEQ ID NO: 10034289 - DNA, 22 bp, Homo sapiens
gtttgtcaatgacttaggcgtt

SEQ ID NO: 10034290 - DNA, 22 bp, Homo sapiens
gtttgtcatttgtacttctagc

SEQ ID NO: 10034291 - DNA, 22 bp, Homo sapiens
gttcttggaccagcagcattga

SEQ ID NO: 10034292 - DNA, 22 bp, Homo sapiens
gtttatctagtgaagtgaagaa

SEQ ID NO: 10034293 - DNA, 22 bp, Homo sapiens
gtttatgaatgttactatagag

SEQ ID NO: 10034294 - DNA, 22 bp, Homo sapiens
gtttatgaatgtgtcagacata

SEQ ID NO: 10034295 - DNA, 22 bp, Homo sapiens
gtttattagagttttctgtctg

SEQ ID NO: 10034296 - DNA, 22 bp, Homo sapiens
gtttattaactgtcaagtgatt

SEQ ID NO: 10034297 - DNA, 22 bp, Homo sapiens
gtttattatacaacaaaagcta

SEQ ID NO: 10034298 - DNA, 18 bp, Homo sapiens
taaggaagggggtgaaga

SEQ ID NO: 10034299 - DNA, 22 bp, Homo sapiens
taaggaagtcacaagaatcgct

SEQ ID NO: 10034300 - DNA, 22 bp, Homo sapiens
taaggaaggggaaagacatgtc

SEQ ID NO: 10034301 - DNA, 22 bp, Homo sapiens
tacacagttttgctcccatgat

SEQ ID NO: 10034302 - DNA, 22 bp, Homo sapiens
tacacagaacctggtgtacagt

SEQ ID NO: 10034303 - DNA, 22 bp, Homo sapiens
tacacagtatatgggatcacag

SEQ ID NO: 10034304 - DNA, 22 bp, Homo sapiens
tacacaatctgtttttccattt

SEQ ID NO: 10034305 - DNA, 22 bp, Homo sapiens
taccacagacagatttcagtaa

SEQ ID NO: 10034306 - DNA, 22 bp, Homo sapiens
tacttacacagctgtagaaggt

SEQ ID NO: 10034307 - DNA, 22 bp, Homo sapiens
tacttacatgaattcaagagca

SEQ ID NO: 10034308 - DNA, 22 bp, Homo sapiens
tacttacagaaggaagcaattg

SEQ ID NO: 10034309 - DNA, 22 bp, Homo sapiens
tacttacactgaagcaaagata

SEQ ID NO: 10034310 - DNA, 22 bp, Homo sapiens
tactgtgtgcccagccgagctg

SEQ ID NO: 10034311 - DNA, 22 bp, Homo sapiens
tacagtgtccctttttcagaca

SEQ ID NO: 10034312 - DNA, 22 bp, Homo sapiens
tacagtgtctggatatcaaagg

SEQ ID NO: 10034313 - DNA, 22 bp, Homo sapiens
tacagtgtgacatttctacaaa

SEQ ID NO: 10034314 - DNA, 22 bp, Homo sapiens
taccaagtgtattatgctttgt

SEQ ID NO: 10034315 - DNA, 22 bp, Homo sapiens
ggcagtggctcctctctactcc

SEQ ID NO: 10034316 - DNA, 22 bp, Homo sapiens
ggcagtggctgtagtctcttgg

SEQ ID NO: 10034317 - DNA, 22 bp, Homo sapiens
ggccagctcttgtccacggagg

SEQ ID NO: 10034318 - DNA, 22 bp, Homo sapiens
ggccagctctgcacagcagctg

SEQ ID NO: 10034319 - DNA, 22 bp, Homo sapiens
ggccagctgggccaccaggtgc

SEQ ID NO: 10034320 - DNA, 22 bp, Homo sapiens
ggcccagctttcattccttgct

SEQ ID NO: 10034321 - DNA, 22 bp, Homo sapiens
ggctctgaagggtgacaggttt

SEQ ID NO: 10034322 - DNA, 22 bp, Homo sapiens
ggctctgaattattcctgagtc

SEQ ID NO: 10034323 - DNA, 22 bp, Homo sapiens
ggctcactgcaacttccgcctc

SEQ ID NO: 10034324 - DNA, 18 bp, Homo sapiens
ggcctctggactggcagc

SEQ ID NO: 10034325 - DNA, 22 bp, Homo sapiens
ggcctctgcttatgctgatgac

SEQ ID NO: 10034326 - DNA, 22 bp, Homo sapiens
ggcctctggggtcctgagccca

SEQ ID NO: 10034327 - DNA, 22 bp, Homo sapiens
ggcctctggcaggcaggccctc

SEQ ID NO: 10034328 - DNA, 22 bp, Homo sapiens
ggcctctgcctcatctgggcac

SEQ ID NO: 10034329 - DNA, 22 bp, Homo sapiens
ggcctctgccccagccacacct

SEQ ID NO: 10034330 - DNA, 22 bp, Homo sapiens
ggcctctgcaactggctgtggc

SEQ ID NO: 10034331 - DNA, 22 bp, Homo sapiens
ggcagcaaactggcttcaggct

SEQ ID NO: 10034332 - DNA, 22 bp, Homo sapiens
ggcagcactgcagcttgttggg

SEQ ID NO: 10034333 - DNA, 22 bp, Homo sapiens
ggcactgagaacaggctgactt

SEQ ID NO: 10034334 - DNA, 22 bp, Homo sapiens
ggaggatgagctacgaggagct

SEQ ID NO: 10034335 - DNA, 22 bp, Homo sapiens
ggaggaggtgggttaagttgta

SEQ ID NO: 10034336 - DNA, 22 bp, Homo sapiens
ggaggaggggtttacattggaa

SEQ ID NO: 10034337 - DNA, 22 bp, Homo sapiens
ggaggatgccaagctgtgcaca

SEQ ID NO: 10034338 - DNA, 22 bp, Homo sapiens
ggcacctgtctgctcacagtga

SEQ ID NO: 10034339 - DNA, 22 bp, Homo sapiens
ggcacctggtaagtgctcagta

SEQ ID NO: 10034340 - DNA, 22 bp, Homo sapiens
ggcacctggatgtagcagtgaa

SEQ ID NO: 10034341 - DNA, 22 bp, Homo sapiens
ggaggcagaacttcccgtcagt

SEQ ID NO: 10034342 - DNA, 22 bp, Homo sapiens
ggcagggaagctggcatcacgg

SEQ ID NO: 10034343 - DNA, 22 bp, Homo sapiens
ggcagggcttgtctctgtgatg

SEQ ID NO: 10034344 - DNA, 18 bp, Homo sapiens
ggcagggaaaagataggg

SEQ ID NO: 10034345 - DNA, 20 bp, Homo sapiens
ggcaggctttatatggaggg

SEQ ID NO: 10034346 - DNA, 21 bp, Homo sapiens
ggcagctcagcagatggggac

SEQ ID NO: 10034347 - DNA, 22 bp, Homo sapiens
ggcagccttgagggaggcctgg

SEQ ID NO: 10034348 - DNA, 22 bp, Homo sapiens
ggcagctcacgggcatggggtg

SEQ ID NO: 10034349 - DNA, 22 bp, Homo sapiens
ggcagctattccaagcagcact

SEQ ID NO: 10034350 - DNA, 22 bp, Homo sapiens
ggcagctagtttaagaaagagg

SEQ ID NO: 10034351 - DNA, 22 bp, Homo sapiens
ggcagctaggggcagggaattc

SEQ ID NO: 10034352 - DNA, 21 bp, Homo sapiens
ggcagcgtgtggacaggaagg

SEQ ID NO: 10034353 - DNA, 21 bp, Homo sapiens
ggcagcctgacccccagagag

SEQ ID NO: 10034354 - DNA, 21 bp, Homo sapiens
ggcagcctctgtggaagggga

SEQ ID NO: 10034355 - DNA, 22 bp, Homo sapiens
ggcagccttgactagtgactta

SEQ ID NO: 10034356 - DNA, 17 bp, Homo sapiens
ggcagcctcaggcgttt

SEQ ID NO: 10034357 - DNA, 20 bp, Homo sapiens
gggcagagccagccagtccc

SEQ ID NO: 10034358 - DNA, 22 bp, Homo sapiens
gggcactgtacactgtgcatgg

SEQ ID NO: 10034359 - DNA, 22 bp, Homo sapiens
gggcactggtgctgccatcttg

SEQ ID NO: 10034360 - DNA, 19 bp, Homo sapiens
gggatcagcccagggctct

SEQ ID NO: 10034361 - DNA, 22 bp, Homo sapiens
gggatcagaaacatagccctga

SEQ ID NO: 10034362 - DNA, 22 bp, Homo sapiens
gggaggttgaggctgcagtgag

SEQ ID NO: 10034363 - DNA, 22 bp, Homo sapiens
gggctctggatggagcctgcag

SEQ ID NO: 10034364 - DNA, 22 bp, Homo sapiens
gggccctggggcctgatttgca

SEQ ID NO: 10034365 - DNA, 22 bp, Homo sapiens
gggccctgtgatttcttgagga

SEQ ID NO: 10034366 - DNA, 22 bp, Homo sapiens
gggccctgcctaaggaacacac

SEQ ID NO: 10034367 - DNA, 22 bp, Homo sapiens
gggccctggggatgtggacgcg

SEQ ID NO: 10034368 - DNA, 22 bp, Homo sapiens
gggccctgggattcagagcaag

SEQ ID NO: 10034369 - DNA, 22 bp, Homo sapiens
gggccctgatctgtgagcgcag

SEQ ID NO: 10034370 - DNA, 22 bp, Homo sapiens
gggccctgccccgtggctctga

SEQ ID NO: 10034371 - DNA, 22 bp, Homo sapiens
gggagatgactcagtgacctcg

SEQ ID NO: 10034372 - DNA, 22 bp, Homo sapiens
gggaagagtaactagcccatgt

SEQ ID NO: 10034373 - DNA, 22 bp, Homo sapiens
gggaagcaggtgcagctcgcct

SEQ ID NO: 10034374 - DNA, 22 bp, Homo sapiens
gtaggcagataggagtgcagcc

SEQ ID NO: 10034375 - DNA, 22 bp, Homo sapiens
gtacaatagcagttttcccttt

SEQ ID NO: 10034376 - DNA, 22 bp, Homo sapiens
gtcactggaaatttcctttgtt

SEQ ID NO: 10034377 - DNA, 22 bp, Homo sapiens
gtcactggaattacaggcatgc

SEQ ID NO: 10034378 - DNA, 22 bp, Homo sapiens
gtccagctctcagatggctgca

SEQ ID NO: 10034379 - DNA, 22 bp, Homo sapiens
gtcctctggtgaaagcattccc

SEQ ID NO: 10034380 - DNA, 22 bp, Homo sapiens
gtcggccacgcaggtgcggtag

SEQ ID NO: 10034381 - DNA, 22 bp, Homo sapiens
gtcctctggaagatgagttctt

SEQ ID NO: 10034382 - DNA, 22 bp, Homo sapiens
gtgaggaagtctgagagccaca

SEQ ID NO: 10034383 - DNA, 22 bp, Homo sapiens
gtcttgtccattccatgctgct

SEQ ID NO: 10034384 - DNA, 22 bp, Homo sapiens
gtgcagggctggcaccggaggc

SEQ ID NO: 10034385 - DNA, 22 bp, Homo sapiens
gtgccaggtgctaagctgtgct

SEQ ID NO: 10034386 - DNA, 18 bp, Homo sapiens
gggtgcaggcactgactg

SEQ ID NO: 10034387 - DNA, 22 bp, Homo sapiens
gggtggagaggctaagtccagt

SEQ ID NO: 10034388 - DNA, 22 bp, Homo sapiens
ggggtggccctaccctctggaa

SEQ ID NO: 10034389 - DNA, 22 bp, Homo sapiens
ggggtggattcctacaggtcca

SEQ ID NO: 10034390 - DNA, 22 bp, Homo sapiens
ggggtggatcaggcaggcccag

SEQ ID NO: 10034391 - DNA, 22 bp, Homo sapiens
ggggtggagatggtggcccttt

SEQ ID NO: 10034392 - DNA, 22 bp, Homo sapiens
gggctctgggatgctcttagag

SEQ ID NO: 10034393 - DNA, 20 bp, Homo sapiens
gggctctggccaatgctttg

SEQ ID NO: 10034394 - DNA, 22 bp, Homo sapiens
gggctgtgtgcccacttcccat

SEQ ID NO: 10034395 - DNA, 18 bp, Homo sapiens
gggctgtgttcatgccca

SEQ ID NO: 10034396 - DNA, 22 bp, Homo sapiens
ggtggtggagccagctgggagt

SEQ ID NO: 10034397 - DNA, 22 bp, Homo sapiens
ggtggatgctgactgttctgct

SEQ ID NO: 10034398 - DNA, 22 bp, Homo sapiens
ggtccctgaagaggcctggggt

SEQ ID NO: 10034399 - DNA, 22 bp, Homo sapiens
ggtccctgaagatgcctgagga

SEQ ID NO: 10034400 - DNA, 23 bp, Homo sapiens
ggtccctgacagcgggcaagttg

SEQ ID NO: 10034401 - DNA, 23 bp, Homo sapiens
ggtccctgacagcgggcaagttg

SEQ ID NO: 10034402 - DNA, 22 bp, Homo sapiens
ggtccctgcccacctgggagct

SEQ ID NO: 10034403 - DNA, 22 bp, Homo sapiens
ggtccctgcccaaagcccttgg

SEQ ID NO: 10034404 - DNA, 22 bp, Homo sapiens
ggtccctgcccaaagcccttgg

SEQ ID NO: 10034405 - DNA, 20 bp, Homo sapiens
ggtccctgccctctgtcatc

SEQ ID NO: 10034406 - DNA, 22 bp, Homo sapiens
ggtccctgcctgaggctggcct

SEQ ID NO: 10034407 - DNA, 22 bp, Homo sapiens
ggtccctgccctacattttctt

SEQ ID NO: 10034408 - DNA, 22 bp, Homo sapiens
ggtccctgccctacattttctt

SEQ ID NO: 10034409 - DNA, 22 bp, Homo sapiens
ggtccctgcccacctgggagct

SEQ ID NO: 10034410 - DNA, 22 bp, Homo sapiens
ggtccctgccctaaaactcgtc

SEQ ID NO: 10034411 - DNA, 22 bp, Homo sapiens
ggtcccaggctccctcttgtcc

SEQ ID NO: 10034412 - DNA, 22 bp, Homo sapiens
ggtggaaggcctggaaggaggc

SEQ ID NO: 10034413 - DNA, 22 bp, Homo sapiens
ggtgagggagtggaacgaggtg

SEQ ID NO: 10034414 - DNA, 22 bp, Homo sapiens
ggtgaggcgtccccaccatggg

SEQ ID NO: 10034415 - DNA, 22 bp, Homo sapiens
ggtgacagccgcttggcgctag

SEQ ID NO: 10034416 - DNA, 21 bp, Homo sapiens
ggtgacacgtggccccgctct

SEQ ID NO: 10034417 - DNA, 22 bp, Homo sapiens
ggtccctggaaggcactagtga

SEQ ID NO: 10034418 - DNA, 22 bp, Homo sapiens
ggtccctgctgaagccttggtg

SEQ ID NO: 10034419 - DNA, 22 bp, Homo sapiens
ggtccctggaaggcactagtga

SEQ ID NO: 10034420 - DNA, 22 bp, Homo sapiens
ggtccctgcctgaggctggcct

SEQ ID NO: 10034421 - DNA, 22 bp, Homo sapiens
ggtccctgctgaagccttggtg

SEQ ID NO: 10034422 - DNA, 22 bp, Homo sapiens
ggtccctggaaggccaagcttg

SEQ ID NO: 10034423 - DNA, 22 bp, Homo sapiens
gccactgtgttgatctagcctg

SEQ ID NO: 10034424 - DNA, 22 bp, Homo sapiens
gccactgttccaccatcttgat

SEQ ID NO: 10034425 - DNA, 22 bp, Homo sapiens
gcagtttgaaagtatgagtcca

SEQ ID NO: 10034426 - DNA, 22 bp, Homo sapiens
gcagtttgtttgtggacacctt

SEQ ID NO: 10034427 - DNA, 22 bp, Homo sapiens
gcagtttgctggactaatgaag

SEQ ID NO: 10034428 - DNA, 22 bp, Homo sapiens
gcagtgtttcaaatcaaaggca

SEQ ID NO: 10034429 - DNA, 22 bp, Homo sapiens
gcagtgtttacatattagaaac

SEQ ID NO: 10034430 - DNA, 22 bp, Homo sapiens
gcagtgttgttaaaagattaga

SEQ ID NO: 10034431 - DNA, 22 bp, Homo sapiens
gcagtgttgtgatccaggtctt

SEQ ID NO: 10034432 - DNA, 22 bp, Homo sapiens
gcagtgtttggatccatagcga

SEQ ID NO: 10034433 - DNA, 23 bp, Homo sapiens
gcagtgtttgcttcatcttatcc

SEQ ID NO: 10034434 - DNA, 22 bp, Homo sapiens
gcagtgtttcagtgctttttct

SEQ ID NO: 10034435 - DNA, 22 bp, Homo sapiens
gcagtgtttcccagagatggaa

SEQ ID NO: 10034436 - DNA, 22 bp, Homo sapiens
gcagtgttggcaggatggggct

SEQ ID NO: 10034437 - DNA, 22 bp, Homo sapiens
gcagtgttggtttgctctgcag

SEQ ID NO: 10034438 - DNA, 22 bp, Homo sapiens
gcagtgttgctaggtgcggtga

SEQ ID NO: 10034439 - DNA, 22 bp, Homo sapiens
gcagtgtttgtgttctcacatg

SEQ ID NO: 10034440 - DNA, 22 bp, Homo sapiens
gcagtgttttacagaccagcat

SEQ ID NO: 10034441 - DNA, 22 bp, Homo sapiens
gcagtgtttttcaatgcttcca

SEQ ID NO: 10034442 - DNA, 22 bp, Homo sapiens
gccagctggtaggcacctagcc

SEQ ID NO: 10034443 - DNA, 22 bp, Homo sapiens
gccagctgtttcagagcccagt

SEQ ID NO: 10034444 - DNA, 22 bp, Homo sapiens
gccagctgttcagacattcttt

SEQ ID NO: 10034445 - DNA, 22 bp, Homo sapiens
gcccaaggtatatcagagacag

SEQ ID NO: 10034446 - DNA, 22 bp, Homo sapiens
gcctcaggtgcatctctcattc

SEQ ID NO: 10034447 - DNA, 22 bp, Homo sapiens
gccctggacagtgacggtgacc

SEQ ID NO: 10034448 - DNA, 22 bp, Homo sapiens
gccctggaaaggaacctgggct

SEQ ID NO: 10034449 - DNA, 22 bp, Homo sapiens
gcccctggctggccagctcctc

SEQ ID NO: 10034450 - DNA, 22 bp, Homo sapiens
gccctgagtggtacctgtgggt

SEQ ID NO: 10034451 - DNA, 22 bp, Homo sapiens
gccctgagtgcctgtgtaagaa

SEQ ID NO: 10034452 - DNA, 19 bp, Homo sapiens
gccctgagtaagctaggag

SEQ ID NO: 10034453 - DNA, 22 bp, Homo sapiens
gccctagggcttttgggcctgt

SEQ ID NO: 10034454 - DNA, 22 bp, Homo sapiens
gccctaggcttttgtgactgcc

SEQ ID NO: 10034455 - DNA, 21 bp, Homo sapiens
gccctaggctacctggagcgc

SEQ ID NO: 10034456 - DNA, 22 bp, Homo sapiens
gcccctgggagcagagccacca

SEQ ID NO: 10034457 - DNA, 19 bp, Homo sapiens
gcctgcagaaaaggcaggg

SEQ ID NO: 10034458 - DNA, 22 bp, Homo sapiens
gcacagagggcagtgagcctct

SEQ ID NO: 10034459 - DNA, 22 bp, Homo sapiens
gcacagagacagtcctgagatc

SEQ ID NO: 10034460 - DNA, 22 bp, Homo sapiens
gcagacagatgagggtgctggg

SEQ ID NO: 10034461 - DNA, 22 bp, Homo sapiens
gcagagtgccgagatggaagcg

SEQ ID NO: 10034462 - DNA, 22 bp, Homo sapiens
gcagacaggcccagtggaggga

SEQ ID NO: 10034463 - DNA, 22 bp, Homo sapiens
gcagcagcaagaaggttggact

SEQ ID NO: 10034464 - DNA, 22 bp, Homo sapiens
gcagccagtatcctctgagatt

SEQ ID NO: 10034465 - DNA, 22 bp, Homo sapiens
gcagggcagctcactgtggttc

SEQ ID NO: 10034466 - DNA, 22 bp, Homo sapiens
gctctggggttggaaagtgatc

SEQ ID NO: 10034467 - DNA, 22 bp, Homo sapiens
gctctgtgcagttcagggacac

SEQ ID NO: 10034468 - DNA, 22 bp, Homo sapiens
gctctgtcaacagctagctgtg

SEQ ID NO: 10034469 - DNA, 21 bp, Homo sapiens
gctctgtccctgctgtgtgtc

SEQ ID NO: 10034470 - DNA, 22 bp, Homo sapiens
gctctcctgtgcagatgctgct

SEQ ID NO: 10034471 - DNA, 22 bp, Homo sapiens
gctctctgcagcctccttggag

SEQ ID NO: 10034472 - DNA, 20 bp, Homo sapiens
gctcccagcctgcagtcccc

SEQ ID NO: 10034473 - DNA, 22 bp, Homo sapiens
gctcagtgaatttttgcccatg

SEQ ID NO: 10034474 - DNA, 22 bp, Homo sapiens
gctcagtgagatattgactcca

SEQ ID NO: 10034475 - DNA, 22 bp, Homo sapiens
gctcccagactgaccagaggtg

SEQ ID NO: 10034476 - DNA, 22 bp, Homo sapiens
gctcccagactgaccagaggtg

SEQ ID NO: 10034477 - DNA, 22 bp, Homo sapiens
gctcccagcaattgaggcagcc

SEQ ID NO: 10034478 - DNA, 22 bp, Homo sapiens
gctctgtggcattcatgggcag

SEQ ID NO: 10034479 - DNA, 22 bp, Homo sapiens
gctctgtgggggaaatcctggg

SEQ ID NO: 10034480 - DNA, 22 bp, Homo sapiens
gctggaggtagggaggtcctgt

SEQ ID NO: 10034481 - DNA, 22 bp, Homo sapiens
gctgctgtaacactaagtgcag

SEQ ID NO: 10034482 - DNA, 22 bp, Homo sapiens
gctgctgtcagcaggccttgtt

SEQ ID NO: 10034483 - DNA, 22 bp, Homo sapiens
gctgctgtcacccacatctgtc

SEQ ID NO: 10034484 - DNA, 22 bp, Homo sapiens
gctgctgtccttcaagtctgcg

SEQ ID NO: 10034485 - DNA, 22 bp, Homo sapiens
ggagccaggcaatctgtacttt

SEQ ID NO: 10034486 - DNA, 22 bp, Homo sapiens
ggagaagaggagctggaagcct

SEQ ID NO: 10034487 - DNA, 22 bp, Homo sapiens
ggagccagtttagacctcagtt

SEQ ID NO: 10034488 - DNA, 22 bp, Homo sapiens
ggagcctggagtttctgatggg

SEQ ID NO: 10034489 - DNA, 22 bp, Homo sapiens
ggagctgggaactatgtagtat

SEQ ID NO: 10034490 - DNA, 22 bp, Homo sapiens
ggagcctggcctggctctgtgt

SEQ ID NO: 10034491 - DNA, 21 bp, Homo sapiens
ggagctggggagctggcccca

SEQ ID NO: 10034492 - DNA, 22 bp, Homo sapiens
ggagctgtgttatccattccca

SEQ ID NO: 10034493 - DNA, 22 bp, Homo sapiens
ggaggaggggtgactgaatgct

SEQ ID NO: 10034494 - DNA, 22 bp, Homo sapiens
ggaggaggggcgctttgtctat

SEQ ID NO: 10034495 - DNA, 22 bp, Homo sapiens
gctgtctggatatcttggaatt

SEQ ID NO: 10034496 - DNA, 22 bp, Homo sapiens
gctgtctgggatgtcactgctg

SEQ ID NO: 10034497 - DNA, 22 bp, Homo sapiens
gctgtctggaggctctgaggga

SEQ ID NO: 10034498 - DNA, 22 bp, Homo sapiens
gctgtctgctgtgcactgagca

SEQ ID NO: 10034499 - DNA, 22 bp, Homo sapiens
gctgtctgggtgcccaaaagaa

SEQ ID NO: 10034500 - DNA, 22 bp, Homo sapiens
gctgtctgtctctgtcccacca

SEQ ID NO: 10034501 - DNA, 22 bp, Homo sapiens
gctgtctgtggtgtcagctgac

SEQ ID NO: 10034502 - DNA, 22 bp, Homo sapiens
gctttgggggctgcagtgcgtg

SEQ ID NO: 10034503 - DNA, 22 bp, Homo sapiens
gaggtggctgtcagcttcactt

SEQ ID NO: 10034504 - DNA, 22 bp, Homo sapiens
gaggtggaaggcaggaacaaat

SEQ ID NO: 10034505 - DNA, 22 bp, Homo sapiens
gagggtgggtttcttgcacgtc

SEQ ID NO: 10034506 - DNA, 22 bp, Homo sapiens
gagggtgggccagatatgaggg

SEQ ID NO: 10034507 - DNA, 22 bp, Homo sapiens
gagggtggagctccagaatctg

SEQ ID NO: 10034508 - DNA, 22 bp, Homo sapiens
gaggcgagaagctggagatggt

SEQ ID NO: 10034509 - DNA, 19 bp, Homo sapiens
gaggcgaggcgtgcaggag

SEQ ID NO: 10034510 - DNA, 22 bp, Homo sapiens
gagggccagcagcctcagcatg

SEQ ID NO: 10034511 - DNA, 22 bp, Homo sapiens
gagggaatggtgtgcaagaggt

SEQ ID NO: 10034512 - DNA, 22 bp, Homo sapiens
gaggagagaacattcctccata

SEQ ID NO: 10034513 - DNA, 22 bp, Homo sapiens
gaggagagaagctaacggtgct

SEQ ID NO: 10034514 - DNA, 22 bp, Homo sapiens
gaggagagagggactgtctgca

SEQ ID NO: 10034515 - DNA, 22 bp, Homo sapiens
gaggcaacacatttggaaagca

SEQ ID NO: 10034516 - DNA, 22 bp, Homo sapiens
gaggatggaggtgtgagctatg

SEQ ID NO: 10034517 - DNA, 22 bp, Homo sapiens
gaggcatggcctgaggctagga

SEQ ID NO: 10034518 - DNA, 22 bp, Homo sapiens
gaggcatgcagagctggagcag

SEQ ID NO: 10034519 - DNA, 22 bp, Homo sapiens
gaggccagaagtgcctcgggct

SEQ ID NO: 10034520 - DNA, 22 bp, Homo sapiens
gaggccagagttccccgagtca

SEQ ID NO: 10034521 - DNA, 22 bp, Homo sapiens
gagctcattcattcattgcctg

SEQ ID NO: 10034522 - DNA, 17 bp, Homo sapiens
gaggacagggaagtagg

SEQ ID NO: 10034523 - DNA, 22 bp, Homo sapiens
gagctgtgaaaagtgcctgggg

SEQ ID NO: 10034524 - DNA, 22 bp, Homo sapiens
gacatggatacttgataagggg

SEQ ID NO: 10034525 - DNA, 22 bp, Homo sapiens
gacagctggcagtggaaaggtg

SEQ ID NO: 10034526 - DNA, 22 bp, Homo sapiens
gacagcaggtaattagttaaca

SEQ ID NO: 10034527 - DNA, 22 bp, Homo sapiens
gacagcagggaaagtccagacc

SEQ ID NO: 10034528 - DNA, 22 bp, Homo sapiens
gagaacagtgttgtattttttc

SEQ ID NO: 10034529 - DNA, 21 bp, Homo sapiens
gagaactgaaccagagcagct

SEQ ID NO: 10034530 - DNA, 22 bp, Homo sapiens
gagaacaggctctggagtcaga

SEQ ID NO: 10034531 - DNA, 22 bp, Homo sapiens
gactccagaatctggacggtcc

SEQ ID NO: 10034532 - DNA, 22 bp, Homo sapiens
gagaggagtagacactttggtt

SEQ ID NO: 10034533 - DNA, 22 bp, Homo sapiens
gagaggaggtggctatgacagc

SEQ ID NO: 10034534 - DNA, 18 bp, Homo sapiens
gagaggagccagaatttt

SEQ ID NO: 10034535 - DNA, 22 bp, Homo sapiens
gagagcaggaggcagcgggacg

SEQ ID NO: 10034536 - DNA, 22 bp, Homo sapiens
gagaggatccacaaaccaggaa

SEQ ID NO: 10034537 - DNA, 22 bp, Homo sapiens
gagaggcagaggcctgaaaccg

SEQ ID NO: 10034538 - DNA, 22 bp, Homo sapiens
gagaggagttactatttccgag

SEQ ID NO: 10034539 - DNA, 22 bp, Homo sapiens
gagaggcaggcgctgcaatggt

SEQ ID NO: 10034540 - DNA, 22 bp, Homo sapiens
cttgcctgccactacagctgaa

SEQ ID NO: 10034541 - DNA, 22 bp, Homo sapiens
cttccaggacaccagggtagta

SEQ ID NO: 10034542 - DNA, 22 bp, Homo sapiens
cttcccagaccttagagtgcag

SEQ ID NO: 10034543 - DNA, 22 bp, Homo sapiens
gaaatacaggaatgccacacag

SEQ ID NO: 10034544 - DNA, 22 bp, Homo sapiens
gaaatattcttgtcttgttttc

SEQ ID NO: 10034545 - DNA, 22 bp, Homo sapiens
gaaatattacagtggaggggat

SEQ ID NO: 10034546 - DNA, 22 bp, Homo sapiens
gaaatattgtactggagatgtt

SEQ ID NO: 10034547 - DNA, 22 bp, Homo sapiens
gaaatattgggactcagagctt

SEQ ID NO: 10034548 - DNA, 22 bp, Homo sapiens
ctttttctaatcataattgtct

SEQ ID NO: 10034549 - DNA, 22 bp, Homo sapiens
gaaactgtttctggctttggtg

SEQ ID NO: 10034550 - DNA, 22 bp, Homo sapiens
ctgggagtgaaaggagggctgc

SEQ ID NO: 10034551 - DNA, 22 bp, Homo sapiens
ctgggagtggtgacagctctcg

SEQ ID NO: 10034552 - DNA, 22 bp, Homo sapiens
ctgggagtctaagctagcaccg

SEQ ID NO: 10034553 - DNA, 22 bp, Homo sapiens
ctgggagtctggcctctggtcc

SEQ ID NO: 10034554 - DNA, 22 bp, Homo sapiens
ctgggagtctggaattttggta

SEQ ID NO: 10034555 - DNA, 22 bp, Homo sapiens
ctgggagtactgggggatgtca

SEQ ID NO: 10034556 - DNA, 22 bp, Homo sapiens
ctgggagtcaccaggagcaagg

SEQ ID NO: 10034557 - DNA, 22 bp, Homo sapiens
ctgggagtccctggaatagctc

SEQ ID NO: 10034558 - DNA, 22 bp, Homo sapiens
ctgggccagcaactgcaatgga

SEQ ID NO: 10034559 - DNA, 22 bp, Homo sapiens
ctgggatccacgggctcccaag

SEQ ID NO: 10034560 - DNA, 22 bp, Homo sapiens
ctgggagtgtccctctggtaat

SEQ ID NO: 10034561 - DNA, 22 bp, Homo sapiens
ctgggagtgttctaggtcacat

SEQ ID NO: 10034562 - DNA, 22 bp, Homo sapiens
ctgggagtgttctaggtcacat

SEQ ID NO: 10034563 - DNA, 19 bp, Homo sapiens
ctgggagttcactgctgcc

SEQ ID NO: 10034564 - DNA, 22 bp, Homo sapiens
ctgggccctgaagacagtcagg

SEQ ID NO: 10034565 - DNA, 22 bp, Homo sapiens
ctgggcctagaggaagctgaca

SEQ ID NO: 10034566 - DNA, 22 bp, Homo sapiens
ctgggcctagcaacagaggagt

SEQ ID NO: 10034567 - DNA, 22 bp, Homo sapiens
ctgggcctcatcctcagagttt

SEQ ID NO: 10034568 - DNA, 22 bp, Homo sapiens
ctgggcctcatccagccacaac

SEQ ID NO: 10034569 - DNA, 22 bp, Homo sapiens
ctgggcctcaatctcagagttt

SEQ ID NO: 10034570 - DNA, 22 bp, Homo sapiens
ctgggctcaaatcctggccctg

SEQ ID NO: 10034571 - DNA, 22 bp, Homo sapiens
ctgggctcagcccatgctgtcc

SEQ ID NO: 10034572 - DNA, 20 bp, Homo sapiens
ctgggctcggtggccctggc

SEQ ID NO: 10034573 - DNA, 22 bp, Homo sapiens
ctgggctccctcatgtgtctgc

SEQ ID NO: 10034574 - DNA, 22 bp, Homo sapiens
ctggggtgaaggattacctgag

SEQ ID NO: 10034575 - DNA, 22 bp, Homo sapiens
ctggggtggaggagctcccctg

SEQ ID NO: 10034576 - DNA, 22 bp, Homo sapiens
ctggggtggatgggtccaagtt

SEQ ID NO: 10034577 - DNA, 22 bp, Homo sapiens
ctggggtgtctcgtctgccatt

SEQ ID NO: 10034578 - DNA, 22 bp, Homo sapiens
ctggtgtggcggcgccctgtag

SEQ ID NO: 10034579 - DNA, 22 bp, Homo sapiens
ctggtgcctcctctcccaggtc

SEQ ID NO: 10034580 - DNA, 22 bp, Homo sapiens
ctggtgccctgtgtggcaggag

SEQ ID NO: 10034581 - DNA, 22 bp, Homo sapiens
ctggtaacaatatccacaaaga

SEQ ID NO: 10034582 - DNA, 22 bp, Homo sapiens
ctgtgaggcggaaaggactctc

SEQ ID NO: 10034583 - DNA, 22 bp, Homo sapiens
ctgtgacttgccaaaggtcatt

SEQ ID NO: 10034584 - DNA, 22 bp, Homo sapiens
ctgtgactagacctgcaggaga

SEQ ID NO: 10034585 - DNA, 22 bp, Homo sapiens
ctgtgactccttctacctgtct

SEQ ID NO: 10034586 - DNA, 22 bp, Homo sapiens
ctgtctgttatctcaccagtcc

SEQ ID NO: 10034587 - DNA, 22 bp, Homo sapiens
ctgtctgtgtggacacggctgc

SEQ ID NO: 10034588 - DNA, 22 bp, Homo sapiens
ctgtccctcagttctgggcaaa

SEQ ID NO: 10034589 - DNA, 22 bp, Homo sapiens
ctgtccctcatcacctctgggt

SEQ ID NO: 10034590 - DNA, 22 bp, Homo sapiens
ctgtccctctcacacctcacca

SEQ ID NO: 10034591 - DNA, 22 bp, Homo sapiens
ctgtcccagtgatcctgagtgc

SEQ ID NO: 10034592 - DNA, 22 bp, Homo sapiens
ctgtgtgaatagtgaggtctat

SEQ ID NO: 10034593 - DNA, 22 bp, Homo sapiens
ctgtgtgacaagtgaggacgcc

SEQ ID NO: 10034594 - DNA, 22 bp, Homo sapiens
ctgtggggaaagggtcctgctc

SEQ ID NO: 10034595 - DNA, 23 bp, Homo sapiens
ctgtggccacccctagctggagg

SEQ ID NO: 10034596 - DNA, 22 bp, Homo sapiens
ctgtggctttctctgcctcctt

SEQ ID NO: 10034597 - DNA, 22 bp, Homo sapiens
ttctggaagggtggagtagctt

SEQ ID NO: 10034598 - DNA, 22 bp, Homo sapiens
ctagaaagatacttaaatcaag

SEQ ID NO: 10034599 - DNA, 22 bp, Homo sapiens
ctagagaaaggcagtggagcaa

SEQ ID NO: 10034600 - DNA, 22 bp, Homo sapiens
ctagataaggtggcttggaatt

SEQ ID NO: 10034601 - DNA, 22 bp, Homo sapiens
ctagagaggtggtgttgggtgg

SEQ ID NO: 10034602 - DNA, 22 bp, Homo sapiens
ctagagagccgctgtggaaaat

SEQ ID NO: 10034603 - DNA, 17 bp, Homo sapiens
ctagagagaaagagcta

SEQ ID NO: 10034604 - DNA, 22 bp, Homo sapiens
cgtttattttgaagattccact

SEQ ID NO: 10034605 - DNA, 22 bp, Homo sapiens
cgtttttcagtggtcttaggtc

SEQ ID NO: 10034606 - DNA, 22 bp, Homo sapiens
ctaaaaatccacactaggtgaa

SEQ ID NO: 10034607 - DNA, 21 bp, Homo sapiens
ttctttctgaatctgaagtat

SEQ ID NO: 10034608 - DNA, 21 bp, Homo sapiens
ttctttctgaatctgaagtat

SEQ ID NO: 10034609 - DNA, 22 bp, Homo sapiens
ttctttctgtccataatgagac

SEQ ID NO: 10034610 - DNA, 22 bp, Homo sapiens
ctcagagaaaaggagcaagggt

SEQ ID NO: 10034611 - DNA, 22 bp, Homo sapiens
ctcagagaggttgaacaacttg

SEQ ID NO: 10034612 - DNA, 22 bp, Homo sapiens
ctcagagagacaatgtgggaca

SEQ ID NO: 10034613 - DNA, 22 bp, Homo sapiens
ctcagagaagtctttgctaaac

SEQ ID NO: 10034614 - DNA, 22 bp, Homo sapiens
ctcagagaggcagtggaagtca

SEQ ID NO: 10034615 - DNA, 22 bp, Homo sapiens
ctcagagaggcagtggaagtca

SEQ ID NO: 10034616 - DNA, 22 bp, Homo sapiens
ctcagagagttaagtgaattac

SEQ ID NO: 10034617 - DNA, 22 bp, Homo sapiens
ctcactgcaacctctgcctccc

SEQ ID NO: 10034618 - DNA, 19 bp, Homo sapiens
ctcacctctgtgcgccccc

SEQ ID NO: 10034619 - DNA, 22 bp, Homo sapiens
ctatacatcccaatttcagaga

SEQ ID NO: 10034620 - DNA, 22 bp, Homo sapiens
ctcagccccaatttgccctctt

SEQ ID NO: 10034621 - DNA, 22 bp, Homo sapiens
ttgccctgtcagtagaagtgca

SEQ ID NO: 10034622 - DNA, 22 bp, Homo sapiens
ttgccctggggctggcctggca

SEQ ID NO: 10034623 - DNA, 22 bp, Homo sapiens
ttgccctgcagcggtgagtggt

SEQ ID NO: 10034624 - DNA, 22 bp, Homo sapiens
ttgcccagagtccacagcgtac

SEQ ID NO: 10034625 - DNA, 22 bp, Homo sapiens
ctcagggccaaggatgctgttg

SEQ ID NO: 10034626 - DNA, 22 bp, Homo sapiens
ctcaggtcttagttctgtcatc

SEQ ID NO: 10034627 - DNA, 22 bp, Homo sapiens
ctcagtagaaaatacatggact

SEQ ID NO: 10034628 - DNA, 22 bp, Homo sapiens
ctccagagggtcagactctgag

SEQ ID NO: 10034629 - DNA, 22 bp, Homo sapiens
ttataacattataaagtggaga

SEQ ID NO: 10034630 - DNA, 22 bp, Homo sapiens
ccttgccctgagcaggggtcag

SEQ ID NO: 10034631 - DNA, 21 bp, Homo sapiens
ttacagaatccatgggaagtc

SEQ ID NO: 10034632 - DNA, 22 bp, Homo sapiens
ttacaaagcgttgagacaagta

SEQ ID NO: 10034633 - DNA, 22 bp, Homo sapiens
cggagtcttgctatgttgccca

SEQ ID NO: 10034634 - DNA, 22 bp, Homo sapiens
cggagaggtgggggcagcatct

SEQ ID NO: 10034635 - DNA, 22 bp, Homo sapiens
cggagaggacctgcaactcgct

SEQ ID NO: 10034636 - DNA, 22 bp, Homo sapiens
cggcagctcgagggccacccgt

SEQ ID NO: 10034637 - DNA, 22 bp, Homo sapiens
cggcagctccgcgccgtaggac

SEQ ID NO: 10034638 - DNA, 22 bp, Homo sapiens
cggcagctgattgcagagcacc

SEQ ID NO: 10034639 - DNA, 22 bp, Homo sapiens
ttattgcaactcctaaatagag

SEQ ID NO: 10034640 - DNA, 22 bp, Homo sapiens
cgagagttagctaggagtcaca

SEQ ID NO: 10034641 - DNA, 22 bp, Homo sapiens
ttattgcaactttagggataga

SEQ ID NO: 10034642 - DNA, 22 bp, Homo sapiens
ctggagcaggcttgtcccagct

SEQ ID NO: 10034643 - DNA, 22 bp, Homo sapiens
ctggagcagcaggtggccaggg

SEQ ID NO: 10034644 - DNA, 22 bp, Homo sapiens
ctggagcaggtttaggagtccc

SEQ ID NO: 10034645 - DNA, 22 bp, Homo sapiens
ctgctgtgagcactccagcctg

SEQ ID NO: 10034646 - DNA, 22 bp, Homo sapiens
ctgctgtgacagctgccgtgtt

SEQ ID NO: 10034647 - DNA, 22 bp, Homo sapiens
ctgccttttaaagccagtgtta

SEQ ID NO: 10034648 - DNA, 22 bp, Homo sapiens
ctgcgcaggggtggcgccagaa

SEQ ID NO: 10034649 - DNA, 22 bp, Homo sapiens
ctgccttttcatctgagctgga

SEQ ID NO: 10034650 - DNA, 22 bp, Homo sapiens
ctgcgcagcaatcagagaggag

SEQ ID NO: 10034651 - DNA, 22 bp, Homo sapiens
ctgctctgttcccccatcatct

SEQ ID NO: 10034652 - DNA, 22 bp, Homo sapiens
ctgctcttcacactacacccgt

SEQ ID NO: 10034653 - DNA, 21 bp, Homo sapiens
ctgctctgacagtgaggccag

SEQ ID NO: 10034654 - DNA, 22 bp, Homo sapiens
ctgcctgtggacaccctggagg

SEQ ID NO: 10034655 - DNA, 22 bp, Homo sapiens
ctgcccctgccaggcagctgtc

SEQ ID NO: 10034656 - DNA, 22 bp, Homo sapiens
ctgcctgtttcctcttgctccc

SEQ ID NO: 10034657 - DNA, 22 bp, Homo sapiens
ctgctgtccaggagtgccctgt

SEQ ID NO: 10034658 - DNA, 22 bp, Homo sapiens
ctgctgtcatctggcgctgtgc

SEQ ID NO: 10034659 - DNA, 22 bp, Homo sapiens
ctgctgggtccccctgctgatt

SEQ ID NO: 10034660 - DNA, 22 bp, Homo sapiens
ctgctcttcccactcactccca

SEQ ID NO: 10034661 - DNA, 22 bp, Homo sapiens
ctgctcttgagggactgcggtc

SEQ ID NO: 10034662 - DNA, 22 bp, Homo sapiens
ctgctgggatagaagtatctca

SEQ ID NO: 10034663 - DNA, 22 bp, Homo sapiens
ctgctgggaaggtctgctcagt

SEQ ID NO: 10034664 - DNA, 22 bp, Homo sapiens
ctgagcactgggcacatagctg

SEQ ID NO: 10034665 - DNA, 22 bp, Homo sapiens
ctcttcttatggccgtggctga

SEQ ID NO: 10034666 - DNA, 20 bp, Homo sapiens
ctgcccagccactgagggat

SEQ ID NO: 10034667 - DNA, 22 bp, Homo sapiens
ctgcccaggaaccagaggggca

SEQ ID NO: 10034668 - DNA, 22 bp, Homo sapiens
ctgcccatctgcagacatgcgt

SEQ ID NO: 10034669 - DNA, 22 bp, Homo sapiens
ctgcccaggctgaaggaacatc

SEQ ID NO: 10034670 - DNA, 22 bp, Homo sapiens
ctgcccaggaaggagaggatgg

SEQ ID NO: 10034671 - DNA, 22 bp, Homo sapiens
ctgaggtgctagggtccctgct

SEQ ID NO: 10034672 - DNA, 22 bp, Homo sapiens
ctgcagcctaggtgcagctggg

SEQ ID NO: 10034673 - DNA, 22 bp, Homo sapiens
ctctgaggtctaggaccatggc

SEQ ID NO: 10034674 - DNA, 22 bp, Homo sapiens
ctctggccgcagctcagctctg

SEQ ID NO: 10034675 - DNA, 22 bp, Homo sapiens
ctctggcacactccttccaggt

SEQ ID NO: 10034676 - DNA, 22 bp, Homo sapiens
ctctggccagagcctgcgggaa

SEQ ID NO: 10034677 - DNA, 22 bp, Homo sapiens
ctctggcctgcagatccatgct

SEQ ID NO: 10034678 - DNA, 19 bp, Homo sapiens
ctctggcctctggatgctg

SEQ ID NO: 10034679 - DNA, 22 bp, Homo sapiens
ctctggcctggggcctgctccc

SEQ ID NO: 10034680 - DNA, 22 bp, Homo sapiens
ctctggcctgcttcctcaggta

SEQ ID NO: 10034681 - DNA, 22 bp, Homo sapiens
ctctgtgccctactgctcagct

SEQ ID NO: 10034682 - DNA, 22 bp, Homo sapiens
ctctgtgtggtcctctgtattg

SEQ ID NO: 10034683 - DNA, 22 bp, Homo sapiens
ctctgggctgaatggctgaacc

SEQ ID NO: 10034684 - DNA, 20 bp, Homo sapiens
ctctgggctgcaccctcgcc

SEQ ID NO: 10034685 - DNA, 22 bp, Homo sapiens
tttatgtaagtggaatgatgcc

SEQ ID NO: 10034686 - DNA, 23 bp, Homo sapiens
tttatattcctaatgtcttgagc

SEQ ID NO: 10034687 - DNA, 22 bp, Homo sapiens
ctccaggagggggatggctgta

SEQ ID NO: 10034688 - DNA, 18 bp, Homo sapiens
tttcattataaagcaggc

SEQ ID NO: 10034689 - DNA, 22 bp, Homo sapiens
ccaggtaggagagagggatcct

SEQ ID NO: 10034690 - DNA, 22 bp, Homo sapiens
tgaggacattgagactggagac

SEQ ID NO: 10034691 - DNA, 22 bp, Homo sapiens
tgaccacagacccaatgactac

SEQ ID NO: 10034692 - DNA, 22 bp, Homo sapiens
tgacccaggtgagctgtgacca

SEQ ID NO: 10034693 - DNA, 22 bp, Homo sapiens
tgacatctggcttgtgccctgc

SEQ ID NO: 10034694 - DNA, 22 bp, Homo sapiens
tgacatctggagtctgggctgt

SEQ ID NO: 10034695 - DNA, 22 bp, Homo sapiens
tgacatctgggccctcagctaa

SEQ ID NO: 10034696 - DNA, 22 bp, Homo sapiens
tgacatctttgatctcatttag

SEQ ID NO: 10034697 - DNA, 22 bp, Homo sapiens
tgaccccactgtgctcagaggt

SEQ ID NO: 10034698 - DNA, 22 bp, Homo sapiens
ccagggcatgtccaagacttag

SEQ ID NO: 10034699 - DNA, 22 bp, Homo sapiens
tgcagcattagtacaagtctca

SEQ ID NO: 10034700 - DNA, 22 bp, Homo sapiens
tgcagcagtttaatgcagggtt

SEQ ID NO: 10034701 - DNA, 22 bp, Homo sapiens
tgcagcagtgttccttggcttg

SEQ ID NO: 10034702 - DNA, 22 bp, Homo sapiens
cccagcagtaaccagtggaaat

SEQ ID NO: 10034703 - DNA, 22 bp, Homo sapiens
cccaggagaatataatgttctt

SEQ ID NO: 10034704 - DNA, 21 bp, Homo sapiens
cccaggagaagaaaagatgca

SEQ ID NO: 10034705 - DNA, 22 bp, Homo sapiens
cccaggaccgcgcggctgagcg

SEQ ID NO: 10034706 - DNA, 22 bp, Homo sapiens
cccaggaattggaggctgcagt

SEQ ID NO: 10034707 - DNA, 22 bp, Homo sapiens
cccagctcaagcagagagctaa

SEQ ID NO: 10034708 - DNA, 21 bp, Homo sapiens
cccaggaggctgagaagagca

SEQ ID NO: 10034709 - DNA, 22 bp, Homo sapiens
cccaggaggcggaggttgcagt

SEQ ID NO: 10034710 - DNA, 22 bp, Homo sapiens
cccaggaggcggaggttgtggt

SEQ ID NO: 10034711 - DNA, 22 bp, Homo sapiens
tgcccaggatctggcgatgctc

SEQ ID NO: 10034712 - DNA, 22 bp, Homo sapiens
tgccctctgcctcctctgcaga

SEQ ID NO: 10034713 - DNA, 22 bp, Homo sapiens
tgccctcttaggtctgcgcagc

SEQ ID NO: 10034714 - DNA, 22 bp, Homo sapiens
tgccctctcaagttgagtcaga

SEQ ID NO: 10034715 - DNA, 22 bp, Homo sapiens
tgccctccctgtactgtcagga

SEQ ID NO: 10034716 - DNA, 22 bp, Homo sapiens
tgccctggttctgtgggtgagc

SEQ ID NO: 10034717 - DNA, 20 bp, Homo sapiens
cccaggagtgagcagcttta

SEQ ID NO: 10034718 - DNA, 22 bp, Homo sapiens
cccaggagttagaggttgtggt

SEQ ID NO: 10034719 - DNA, 22 bp, Homo sapiens
tgccctggttacactggagtcc

SEQ ID NO: 10034720 - DNA, 19 bp, Homo sapiens
cccaggagtctggctggtt

SEQ ID NO: 10034721 - DNA, 21 bp, Homo sapiens
cccaggagtcctatttaaatg

SEQ ID NO: 10034722 - DNA, 22 bp, Homo sapiens
cccaggagtaagtgacattgtt

SEQ ID NO: 10034723 - DNA, 22 bp, Homo sapiens
cccaggaggttggggctacagt

SEQ ID NO: 10034724 - DNA, 22 bp, Homo sapiens
cccaggaggacattccataccc

SEQ ID NO: 10034725 - DNA, 21 bp, Homo sapiens
cccaggaggagctccggctcc

SEQ ID NO: 10034726 - DNA, 22 bp, Homo sapiens
cccaggagatctggatctcgtc

SEQ ID NO: 10034727 - DNA, 22 bp, Homo sapiens
cccaggagacatatagaaggac

SEQ ID NO: 10034728 - DNA, 22 bp, Homo sapiens
cccaggagacagaaacagaggt

SEQ ID NO: 10034729 - DNA, 22 bp, Homo sapiens
cccaggagaatatttttgggtc

SEQ ID NO: 10034730 - DNA, 22 bp, Homo sapiens
cccaggaggcagaggttggagc

SEQ ID NO: 10034731 - DNA, 22 bp, Homo sapiens
cccaggaggccaaggttgcagt

SEQ ID NO: 10034732 - DNA, 22 bp, Homo sapiens
cccaggaggcagatgttgcagt

SEQ ID NO: 10034733 - DNA, 22 bp, Homo sapiens
cccaggaggcctgcctggccgg

SEQ ID NO: 10034734 - DNA, 22 bp, Homo sapiens
cccaggaggcgcaggttgcggt

SEQ ID NO: 10034735 - DNA, 19 bp, Homo sapiens
cccaggaggcggaggttgc

SEQ ID NO: 10034736 - DNA, 22 bp, Homo sapiens
cccaggaggcagaggttgcagt

SEQ ID NO: 10034737 - DNA, 22 bp, Homo sapiens
cccaggaggcagagcttgcagt

SEQ ID NO: 10034738 - DNA, 22 bp, Homo sapiens
cccaggaggcagagatagcagt

SEQ ID NO: 10034739 - DNA, 22 bp, Homo sapiens
cccaggaggaggaaaaagctcg

SEQ ID NO: 10034740 - DNA, 22 bp, Homo sapiens
cccaggaggcagaagttgcagt

SEQ ID NO: 10034741 - DNA, 22 bp, Homo sapiens
tgattacagtctgacagatgtt

SEQ ID NO: 10034742 - DNA, 22 bp, Homo sapiens
cccaagaggtggaggttgcagt

SEQ ID NO: 10034743 - DNA, 22 bp, Homo sapiens
cccaagagcttctaggacgctg

SEQ ID NO: 10034744 - DNA, 22 bp, Homo sapiens
ccagtgttcatcaagaaaatgt

SEQ ID NO: 10034745 - DNA, 22 bp, Homo sapiens
ccagtgttcataattttacact

SEQ ID NO: 10034746 - DNA, 22 bp, Homo sapiens
ccagtgttcagtatgcattaag

SEQ ID NO: 10034747 - DNA, 22 bp, Homo sapiens
ccagtgttcaatacatatttgt

SEQ ID NO: 10034748 - DNA, 22 bp, Homo sapiens
ccagtgttagagactgatacag

SEQ ID NO: 10034749 - DNA, 22 bp, Homo sapiens
ccagtgttattttagagtgtga

SEQ ID NO: 10034750 - DNA, 22 bp, Homo sapiens
ccagtgttacggcttgaactat

SEQ ID NO: 10034751 - DNA, 22 bp, Homo sapiens
tgaggcagtattctccattcca

SEQ ID NO: 10034752 - DNA, 22 bp, Homo sapiens
tgaggcaggtaagcaagttttg

SEQ ID NO: 10034753 - DNA, 22 bp, Homo sapiens
tgaggcaggtggattacaaggt

SEQ ID NO: 10034754 - DNA, 22 bp, Homo sapiens
tgaggcagtcaccccctcctgc

SEQ ID NO: 10034755 - DNA, 22 bp, Homo sapiens
tgaggcagtattttagtgactt

SEQ ID NO: 10034756 - DNA, 18 bp, Homo sapiens
tgaggcagtcagtgatgg

SEQ ID NO: 10034757 - DNA, 19 bp, Homo sapiens
ccatggagagagatgcatt

SEQ ID NO: 10034758 - DNA, 22 bp, Homo sapiens
tgaggcagtgatgtttaagcac

SEQ ID NO: 10034759 - DNA, 22 bp, Homo sapiens
tgaggcagtgctgggaagcctg

SEQ ID NO: 10034760 - DNA, 22 bp, Homo sapiens
tgcagcagtcagtcaggcctgg

SEQ ID NO: 10034761 - DNA, 22 bp, Homo sapiens
ccctgtggaggcagcatcctgc

SEQ ID NO: 10034762 - DNA, 22 bp, Homo sapiens
ccctgtggaggaggagagcagt

SEQ ID NO: 10034763 - DNA, 22 bp, Homo sapiens
ccctgtgagcggctggatgcct

SEQ ID NO: 10034764 - DNA, 22 bp, Homo sapiens
ccctgtgagtagggactggtgg

SEQ ID NO: 10034765 - DNA, 22 bp, Homo sapiens
ccctgtgacagtatctgcttga

SEQ ID NO: 10034766 - DNA, 22 bp, Homo sapiens
ccctggtggtacggcactggca

SEQ ID NO: 10034767 - DNA, 22 bp, Homo sapiens
ccctggtgtccactggaggaag

SEQ ID NO: 10034768 - DNA, 22 bp, Homo sapiens
ccctggagctgcttgcatgttg

SEQ ID NO: 10034769 - DNA, 22 bp, Homo sapiens
ccctgggagtccactgatgtca

SEQ ID NO: 10034770 - DNA, 22 bp, Homo sapiens
ccctggaggaaaatctgaggct

SEQ ID NO: 10034771 - DNA, 22 bp, Homo sapiens
ccctggtgccctgggtcagcct

SEQ ID NO: 10034772 - DNA, 22 bp, Homo sapiens
ccctgggttctggctgggctgc

SEQ ID NO: 10034773 - DNA, 22 bp, Homo sapiens
ccctgggataccagacaccaga

SEQ ID NO: 10034774 - DNA, 17 bp, Homo sapiens
cctcacagggaccagac

SEQ ID NO: 10034775 - DNA, 20 bp, Homo sapiens
cctcacagggcagagagggg

SEQ ID NO: 10034776 - DNA, 22 bp, Homo sapiens
cctcacagagcccagatgtcta

SEQ ID NO: 10034777 - DNA, 22 bp, Homo sapiens
cctcacagccctcctctagcac

SEQ ID NO: 10034778 - DNA, 22 bp, Homo sapiens
tggctcagcggtggcagcagac

SEQ ID NO: 10034779 - DNA, 22 bp, Homo sapiens
cctcccctcagacagagactgg

SEQ ID NO: 10034780 - DNA, 22 bp, Homo sapiens
tggctaaggtcgatagaggctt

SEQ ID NO: 10034781 - DNA, 22 bp, Homo sapiens
tggctagcactctacctttctc

SEQ ID NO: 10034782 - DNA, 22 bp, Homo sapiens
tggctcagccagccctaggaac

SEQ ID NO: 10034783 - DNA, 22 bp, Homo sapiens
tggccctgcttatgtctctctt

SEQ ID NO: 10034784 - DNA, 22 bp, Homo sapiens
cctcagccttggccccaggcag

SEQ ID NO: 10034785 - DNA, 22 bp, Homo sapiens
cctcagcccctgaatggagaga

SEQ ID NO: 10034786 - DNA, 23 bp, Homo sapiens
tggcctctccccacctggcagaa

SEQ ID NO: 10034787 - DNA, 22 bp, Homo sapiens
tggcctctcctggcagcatcca

SEQ ID NO: 10034788 - DNA, 22 bp, Homo sapiens
tgcctgctaggccctgctgggt

SEQ ID NO: 10034789 - DNA, 22 bp, Homo sapiens
tgcctgctccagtcctgtccac

SEQ ID NO: 10034790 - DNA, 22 bp, Homo sapiens
ccctagagagatcagatgggga

SEQ ID NO: 10034791 - DNA, 22 bp, Homo sapiens
cccgggaggtggaggttgcagt

SEQ ID NO: 10034792 - DNA, 22 bp, Homo sapiens
cccgggaggaggaagttgcagt

SEQ ID NO: 10034793 - DNA, 22 bp, Homo sapiens
cccgggaggcggaggttgcagt

SEQ ID NO: 10034794 - DNA, 22 bp, Homo sapiens
cccgggaggcagaggttgcagt

SEQ ID NO: 10034795 - DNA, 22 bp, Homo sapiens
tggaggtgagtgtggtacagca

SEQ ID NO: 10034796 - DNA, 22 bp, Homo sapiens
tggaggtgacggggcctcgttg

SEQ ID NO: 10034797 - DNA, 23 bp, Homo sapiens
ccctggagctagtctgagcagag

SEQ ID NO: 10034798 - DNA, 22 bp, Homo sapiens
ccctggagctagtctgagcaga

SEQ ID NO: 10034799 - DNA, 19 bp, Homo sapiens
tggaggggtttgaatgtgg

SEQ ID NO: 10034800 - DNA, 22 bp, Homo sapiens
tggaggggcaatggagcgcgga

SEQ ID NO: 10034801 - DNA, 22 bp, Homo sapiens
tggacagttactgagcttgagt

SEQ ID NO: 10034802 - DNA, 22 bp, Homo sapiens
tggacagtaggaagagtgtggg

SEQ ID NO: 10034803 - DNA, 23 bp, Homo sapiens
tggacagtagggtagacagtgcc

SEQ ID NO: 10034804 - DNA, 22 bp, Homo sapiens
ccctgcagtcctttcttggctc

SEQ ID NO: 10034805 - DNA, 22 bp, Homo sapiens
cctggagcttttccagttgaca

SEQ ID NO: 10034806 - DNA, 22 bp, Homo sapiens
cctgctgttagatttcagtcac

SEQ ID NO: 10034807 - DNA, 22 bp, Homo sapiens
cctgctgtgtgacgggatgtta

SEQ ID NO: 10034808 - DNA, 22 bp, Homo sapiens
cctgctgtgtccctggctttct

SEQ ID NO: 10034809 - DNA, 20 bp, Homo sapiens
cctgctgtttccatggggcc

SEQ ID NO: 10034810 - DNA, 22 bp, Homo sapiens
cctggagcacatggcaggaggc

SEQ ID NO: 10034811 - DNA, 22 bp, Homo sapiens
cctgctgtaccctactcggagt

SEQ ID NO: 10034812 - DNA, 22 bp, Homo sapiens
cctgctgtcagcatcctcgcga

SEQ ID NO: 10034813 - DNA, 22 bp, Homo sapiens
cctgctgtagggcccctggggc

SEQ ID NO: 10034814 - DNA, 22 bp, Homo sapiens
cctgctgtcagtggggcaggca

SEQ ID NO: 10034815 - DNA, 22 bp, Homo sapiens
cctgctgtcccctgagcctgga

SEQ ID NO: 10034816 - DNA, 22 bp, Homo sapiens
cctgctgtgaagccaggcctgt

SEQ ID NO: 10034817 - DNA, 22 bp, Homo sapiens
cctgctgtgaaactggcatatg

SEQ ID NO: 10034818 - DNA, 22 bp, Homo sapiens
cctgctgtccctctgggctcca

SEQ ID NO: 10034819 - DNA, 22 bp, Homo sapiens
cctgctgtctctgggcaggcag

SEQ ID NO: 10034820 - DNA, 22 bp, Homo sapiens
cctgctgtctgctgtgttaagc

SEQ ID NO: 10034821 - DNA, 21 bp, Homo sapiens
tggctctgaaagagtgctgca

SEQ ID NO: 10034822 - DNA, 22 bp, Homo sapiens
cctctggcagccagccagttgt

SEQ ID NO: 10034823 - DNA, 22 bp, Homo sapiens
cctctggcaacttcacagccca

SEQ ID NO: 10034824 - DNA, 22 bp, Homo sapiens
cctgaagcaagggtaggcaggt

SEQ ID NO: 10034825 - DNA, 22 bp, Homo sapiens
tgggccagaagtatgcatgttt

SEQ ID NO: 10034826 - DNA, 22 bp, Homo sapiens
tgggggtgtgccagggacctcc

SEQ ID NO: 10034827 - DNA, 22 bp, Homo sapiens
cctgagaagctggacctggcag

SEQ ID NO: 10034828 - DNA, 22 bp, Homo sapiens
ccagcagagtctaggaaggagg

SEQ ID NO: 10034829 - DNA, 22 bp, Homo sapiens
ccagcagcagcgtccaaggaga

SEQ ID NO: 10034830 - DNA, 22 bp, Homo sapiens
ccagcagcccacaggcgtccct

SEQ ID NO: 10034831 - DNA, 22 bp, Homo sapiens
ccagcagccctcttccaagact

SEQ ID NO: 10034832 - DNA, 22 bp, Homo sapiens
ccagcagccagagaaggacctc

SEQ ID NO: 10034833 - DNA, 22 bp, Homo sapiens
ccagcagcaggccaggccctcc

SEQ ID NO: 10034834 - DNA, 22 bp, Homo sapiens
ccagcagctttattggctctcc

SEQ ID NO: 10034835 - DNA, 22 bp, Homo sapiens
ccagcagctgctatgtggtttt

SEQ ID NO: 10034836 - DNA, 22 bp, Homo sapiens
ccagcagctgtggctttgcctc

SEQ ID NO: 10034837 - DNA, 21 bp, Homo sapiens
ccagcagctcaaggatctctt

SEQ ID NO: 10034838 - DNA, 22 bp, Homo sapiens
ccagcagcgatagggtgagtgc

SEQ ID NO: 10034839 - DNA, 22 bp, Homo sapiens
ccagcagctcagctactggtca

SEQ ID NO: 10034840 - DNA, 22 bp, Homo sapiens
ccagcagctccctcagggtccg

SEQ ID NO: 10034841 - DNA, 22 bp, Homo sapiens
ccagcagctgacaccagtccca

SEQ ID NO: 10034842 - DNA, 22 bp, Homo sapiens
ccagcagctgcaaagcctgggt

SEQ ID NO: 10034843 - DNA, 22 bp, Homo sapiens
tctctgccacagcttctgcctt

SEQ ID NO: 10034844 - DNA, 22 bp, Homo sapiens
tctctgcccaagtttctcaagt

SEQ ID NO: 10034845 - DNA, 22 bp, Homo sapiens
tctctgggagcaattgtttgct

SEQ ID NO: 10034846 - DNA, 22 bp, Homo sapiens
ccagcatctgtcctttccctca

SEQ ID NO: 10034847 - DNA, 22 bp, Homo sapiens
tcctctctgcactggccctgcc

SEQ ID NO: 10034848 - DNA, 18 bp, Homo sapiens
tcctctctttccccaggg

SEQ ID NO: 10034849 - DNA, 22 bp, Homo sapiens
tcctctgaattcgctctgtgat

SEQ ID NO: 10034850 - DNA, 22 bp, Homo sapiens
tctccctctttgtctgctttgg

SEQ ID NO: 10034851 - DNA, 22 bp, Homo sapiens
ccagagagattgcttctaaaga

SEQ ID NO: 10034852 - DNA, 22 bp, Homo sapiens
ccagagagattgcttctaaaga

SEQ ID NO: 10034853 - DNA, 19 bp, Homo sapiens
ccagagagctaggtacaga

SEQ ID NO: 10034854 - DNA, 18 bp, Homo sapiens
tctccacttctgtgagaa

SEQ ID NO: 10034855 - DNA, 22 bp, Homo sapiens
catgtttactaccaggagaatg

SEQ ID NO: 10034856 - DNA, 22 bp, Homo sapiens
tcccaggacaggccacatggaa

SEQ ID NO: 10034857 - DNA, 22 bp, Homo sapiens
tcccaggaattgaagccagtgt

SEQ ID NO: 10034858 - DNA, 22 bp, Homo sapiens
tcccaggaatgtctgaaagtga

SEQ ID NO: 10034859 - DNA, 23 bp, Homo sapiens
tcccaggaatctgcatttttaac

SEQ ID NO: 10034860 - DNA, 22 bp, Homo sapiens
tcccaggacatgggctctgctc

SEQ ID NO: 10034861 - DNA, 22 bp, Homo sapiens
tcccaggacttccagttggagg

SEQ ID NO: 10034862 - DNA, 22 bp, Homo sapiens
tcccaggacccaggcattcaca

SEQ ID NO: 10034863 - DNA, 22 bp, Homo sapiens
tcccaggagcaccttttgagcc

SEQ ID NO: 10034864 - DNA, 22 bp, Homo sapiens
tcctcagctttggtttactcat

SEQ ID NO: 10034865 - DNA, 22 bp, Homo sapiens
tcctcagcttttatttcacttg

SEQ ID NO: 10034866 - DNA, 22 bp, Homo sapiens
tcccaggaggtgcttcctagga

SEQ ID NO: 10034867 - DNA, 16 bp, Homo sapiens
tcccaggaggcggaac

SEQ ID NO: 10034868 - DNA, 22 bp, Homo sapiens
tcccaggatctgagggcagaga

SEQ ID NO: 10034869 - DNA, 22 bp, Homo sapiens
cattgaaatatggaaactgatg

SEQ ID NO: 10034870 - DNA, 22 bp, Homo sapiens
tccacagtctatttttagtcta

SEQ ID NO: 10034871 - DNA, 22 bp, Homo sapiens
tccagctgctagctagatgcaa

SEQ ID NO: 10034872 - DNA, 22 bp, Homo sapiens
tccagcccagctgtccccttca

SEQ ID NO: 10034873 - DNA, 22 bp, Homo sapiens
tccaggcccctgcctgggcctg

SEQ ID NO: 10034874 - DNA, 22 bp, Homo sapiens
catgtgttaatctttctgcaaa

SEQ ID NO: 10034875 - DNA, 22 bp, Homo sapiens
catgtgttttgtcatttcaata

SEQ ID NO: 10034876 - DNA, 22 bp, Homo sapiens
cagggcaggaatttgacattgc

SEQ ID NO: 10034877 - DNA, 18 bp, Homo sapiens
taggagagaatttattta

SEQ ID NO: 10034878 - DNA, 22 bp, Homo sapiens
taggagagctgaactattgtct

SEQ ID NO: 10034879 - DNA, 22 bp, Homo sapiens
taggagaggtgaatggcacact

SEQ ID NO: 10034880 - DNA, 22 bp, Homo sapiens
caggggagttttatgcaacaga

SEQ ID NO: 10034881 - DNA, 22 bp, Homo sapiens
tatatttaaatccaggttgaaa

SEQ ID NO: 10034882 - DNA, 23 bp, Homo sapiens
tagggcagctgggagggacatgc

SEQ ID NO: 10034883 - DNA, 21 bp, Homo sapiens
tagggcaggcattggaagaga

SEQ ID NO: 10034884 - DNA, 22 bp, Homo sapiens
tagggcaggtgaagaaaagcta

SEQ ID NO: 10034885 - DNA, 22 bp, Homo sapiens
tagggcaggggaggaatctgaa

SEQ ID NO: 10034886 - DNA, 19 bp, Homo sapiens
tagaggagaagggaagtgg

SEQ ID NO: 10034887 - DNA, 20 bp, Homo sapiens
cagggcacactgcagcctcg

SEQ ID NO: 10034888 - DNA, 22 bp, Homo sapiens
gtgaggggtggctgagcagttt

SEQ ID NO: 10034889 - DNA, 20 bp, Homo sapiens
cagccctgtgacctggccct

SEQ ID NO: 10034890 - DNA, 22 bp, Homo sapiens
tactcaaactcactaagacaga

SEQ ID NO: 10034891 - DNA, 22 bp, Homo sapiens
tcacaagaatttgtagatgaaa

SEQ ID NO: 10034892 - DNA, 22 bp, Homo sapiens
cagtgccaagccacagatcact

SEQ ID NO: 10034893 - DNA, 22 bp, Homo sapiens
tatttcaggtatggtgtgaaat

SEQ ID NO: 10034894 - DNA, 22 bp, Homo sapiens
cagggtgggcacccagcctcca

SEQ ID NO: 10034895 - DNA, 22 bp, Homo sapiens
cagtgtttgtggaattcaggtg

SEQ ID NO: 10034896 - DNA, 22 bp, Homo sapiens
cagtgccatgatgcagagcaat

SEQ ID NO: 10034897 - DNA, 22 bp, Homo sapiens
cagtgccatgtctgagccccta

SEQ ID NO: 10034898 - DNA, 23 bp, Homo sapiens
cagtgccatttgtcttgcctatg

SEQ ID NO: 10034899 - DNA, 22 bp, Homo sapiens
cagtgccagctgcttggcctac

SEQ ID NO: 10034900 - DNA, 22 bp, Homo sapiens
cagtgccacaggaatggccaat

SEQ ID NO: 10034901 - DNA, 22 bp, Homo sapiens
cagtgccaaggctcttggtctg

SEQ ID NO: 10034902 - DNA, 22 bp, Homo sapiens
cagtgccaaggatggcctggga

SEQ ID NO: 10034903 - DNA, 22 bp, Homo sapiens
tcagcagatgtggtgaaaagtc

SEQ ID NO: 10034904 - DNA, 19 bp, Homo sapiens
tcagcagcactgtgatttc

SEQ ID NO: 10034905 - DNA, 23 bp, Homo sapiens
tcagcagcagaagtgctgggatg

SEQ ID NO: 10034906 - DNA, 22 bp, Homo sapiens
tcagcttttgtcagaaattgta

SEQ ID NO: 10034907 - DNA, 22 bp, Homo sapiens
cagtttatagctctagcagctt

SEQ ID NO: 10034908 - DNA, 22 bp, Homo sapiens
cagtttatagttgttatgtgtg

SEQ ID NO: 10034909 - DNA, 22 bp, Homo sapiens
cagtttatatataagcacattg

SEQ ID NO: 10034910 - DNA, 22 bp, Homo sapiens
cagtttatagttgttatgtgtg

SEQ ID NO: 10034911 - DNA, 22 bp, Homo sapiens
ttttcagtttgcactgcagtgc

SEQ ID NO: 10034912 - DNA, 22 bp, Homo sapiens
ttttcatgtcatgtccttgagg

SEQ ID NO: 10034913 - DNA, 22 bp, Homo sapiens
ttttcatctctgctttgtacct

SEQ ID NO: 10034914 - DNA, 22 bp, Homo sapiens
ttttattagtggctagatgggg

SEQ ID NO: 10034915 - DNA, 22 bp, Homo sapiens
ttttattatctttgaatgggac

SEQ ID NO: 10034916 - DNA, 22 bp, Homo sapiens
ttttaattgcaattatggtccc

SEQ ID NO: 10034917 - DNA, 22 bp, Homo sapiens
tttgttacaaagaaagaagagc

SEQ ID NO: 10034918 - DNA, 22 bp, Homo sapiens
tttgttactatagcatagagtg

SEQ ID NO: 10034919 - DNA, 22 bp, Homo sapiens
tttgttacattaaaaagtaggt

SEQ ID NO: 10034920 - DNA, 22 bp, Homo sapiens
tttgaggttagctagcagatca

SEQ ID NO: 10034921 - DNA, 22 bp, Homo sapiens
tttgaagagccacagtgaaatt

SEQ ID NO: 10034922 - DNA, 22 bp, Homo sapiens
ttccttgaaagtttgaactgac

SEQ ID NO: 10034923 - DNA, 22 bp, Homo sapiens
ttccttgaatgagtcatggaaa

SEQ ID NO: 10034924 - DNA, 22 bp, Homo sapiens
ttccttgaccactgcataatga

SEQ ID NO: 10034925 - DNA, 22 bp, Homo sapiens
ttctcagatccatcagaagtcc

SEQ ID NO: 10034926 - DNA, 22 bp, Homo sapiens
ttctcaggcctttgggatggga

SEQ ID NO: 10034927 - DNA, 22 bp, Homo sapiens
ttctctgctctcacatacagaa

SEQ ID NO: 10034928 - DNA, 22 bp, Homo sapiens
ttctctgaaggttgtggaacta

SEQ ID NO: 10034929 - DNA, 22 bp, Homo sapiens
ttgaactggtagttggaaatct

SEQ ID NO: 10034930 - DNA, 22 bp, Homo sapiens
ttgaactgtaagcatgtctgcc

SEQ ID NO: 10034931 - DNA, 17 bp, Homo sapiens
ttgaactgctgagtcag

SEQ ID NO: 10034932 - DNA, 22 bp, Homo sapiens
ttcagagacatgttctagatca

SEQ ID NO: 10034933 - DNA, 22 bp, Homo sapiens
ttccagtgaaacatgaggtgtg

SEQ ID NO: 10034934 - DNA, 22 bp, Homo sapiens
ttccagggctaggtaatgggta

SEQ ID NO: 10034935 - DNA, 22 bp, Homo sapiens
ttccaggctcccttggaggtgt

SEQ ID NO: 10034936 - DNA, 22 bp, Homo sapiens
ttccaggaagctctcggcctct

SEQ ID NO: 10034937 - DNA, 22 bp, Homo sapiens
ttccaggaacagatgaaggttg

SEQ ID NO: 10034938 - DNA, 22 bp, Homo sapiens
ttccaggaacactctgtgtccc

SEQ ID NO: 10034939 - DNA, 22 bp, Homo sapiens
ttccaggaagcagttagcagcc

SEQ ID NO: 10034940 - DNA, 22 bp, Homo sapiens
ttattgactgatcagagaggga

SEQ ID NO: 10034941 - DNA, 22 bp, Homo sapiens
ttattatggcagttttctaggt

SEQ ID NO: 10034942 - DNA, 22 bp, Homo sapiens
ttattactgtattaatccagag

SEQ ID NO: 10034943 - DNA, 22 bp, Homo sapiens
ttattacagtcccagggagtag

SEQ ID NO: 10034944 - DNA, 22 bp, Homo sapiens
ttattacactgaaagaattgcg

SEQ ID NO: 10034945 - DNA, 22 bp, Homo sapiens
ttattacaatgcagaaaataga

SEQ ID NO: 10034946 - DNA, 21 bp, Homo sapiens
tcctgctgctcctgtcgtgtt

SEQ ID NO: 10034947 - DNA, 22 bp, Homo sapiens
tcctgctggaaacttcctcttg

SEQ ID NO: 10034948 - DNA, 20 bp, Homo sapiens
tcctgctgccacctcttctt

SEQ ID NO: 10034949 - DNA, 22 bp, Homo sapiens
tcctgctgctcacctttttgtc

SEQ ID NO: 10034950 - DNA, 22 bp, Homo sapiens
tcctgctgagcgtctgtcattt

SEQ ID NO: 10034951 - DNA, 22 bp, Homo sapiens
tcctgctgagcatgttctgccc

SEQ ID NO: 10034952 - DNA, 22 bp, Homo sapiens
ttgtacccatgctactaatgtc

SEQ ID NO: 10034953 - DNA, 22 bp, Homo sapiens
ttgtccagcgaccaggctctgt

SEQ ID NO: 10034954 - DNA, 22 bp, Homo sapiens
ttgggacatgtaagctggaagt

SEQ ID NO: 10034955 - DNA, 22 bp, Homo sapiens
ttgggcagggaaaggacaggca

SEQ ID NO: 10034956 - DNA, 22 bp, Homo sapiens
ttgggcagtctggctgcagagt

SEQ ID NO: 10034957 - DNA, 22 bp, Homo sapiens
ttgggcagtagcctcttggtgt

SEQ ID NO: 10034958 - DNA, 22 bp, Homo sapiens
ttggcaggaatattgcagaggt

SEQ ID NO: 10034959 - DNA, 22 bp, Homo sapiens
ttggacagttgtagccagcaga

SEQ ID NO: 10034960 - DNA, 21 bp, Homo sapiens
ttggaacaagcagcagtttgc

SEQ ID NO: 10034961 - DNA, 20 bp, Homo sapiens
ttggacagacgcattgacac

SEQ ID NO: 10034962 - DNA, 22 bp, Homo sapiens
ttggaacacaatgtttctttca

SEQ ID NO: 10034963 - DNA, 22 bp, Homo sapiens
ttgacaaaggctgagaggaaaa

SEQ ID NO: 10034964 - DNA, 22 bp, Homo sapiens
ttgcaggattttagagatgaca

SEQ ID NO: 10034965 - DNA, 22 bp, Homo sapiens
ttgcaggaaactgagtgtgagc

SEQ ID NO: 10034966 - DNA, 22 bp, Homo sapiens
tttcatgcacaaatgagcaagg

SEQ ID NO: 10034967 - DNA, 22 bp, Homo sapiens
tttcatgctcatggaacacagc

SEQ ID NO: 10034968 - DNA, 20 bp, Homo sapiens
tttattcacagagaagagtt

SEQ ID NO: 10034969 - DNA, 22 bp, Homo sapiens
tttattgacccaaagcgagagt

SEQ ID NO: 10034970 - DNA, 22 bp, Homo sapiens
tttatcacagaataagaagtca

SEQ ID NO: 10034971 - DNA, 22 bp, Homo sapiens
tttatattgtaaaaatggttct

SEQ ID NO: 10034972 - DNA, 22 bp, Homo sapiens
tttatattgtaaaaatggttct

SEQ ID NO: 10034973 - DNA, 22 bp, Homo sapiens
tttatatttcccaggattggcc

SEQ ID NO: 10034974 - DNA, 22 bp, Homo sapiens
tttatatttcccaggattggcc

SEQ ID NO: 10034975 - DNA, 22 bp, Homo sapiens
tttatattgggagtcgttttga

SEQ ID NO: 10034976 - DNA, 22 bp, Homo sapiens
gacagtttaggttcaaatctca

SEQ ID NO: 10034977 - DNA, 22 bp, Homo sapiens
atgctttagtgtcaagtttggg

SEQ ID NO: 10034978 - DNA, 22 bp, Homo sapiens
cttgagaatgtgagccacagat

SEQ ID NO: 10034979 - DNA, 22 bp, Homo sapiens
cttgagaagcattaagaggtag

SEQ ID NO: 10034980 - DNA, 22 bp, Homo sapiens
gaacatgatggctgttattttg

SEQ ID NO: 10034981 - DNA, 22 bp, Homo sapiens
atgcacaagaggctagaaaaga

SEQ ID NO: 10034982 - DNA, 22 bp, Homo sapiens
gagaggtagaggctctgcttaa

SEQ ID NO: 10034983 - DNA, 22 bp, Homo sapiens
gagaggtgaaggctgccctggg

SEQ ID NO: 10034984 - DNA, 22 bp, Homo sapiens
gagcagctcgagaaggaagcag

SEQ ID NO: 10034985 - DNA, 22 bp, Homo sapiens
gagcagctccagccgcatgact

SEQ ID NO: 10034986 - DNA, 22 bp, Homo sapiens
gagcagctcaggcacttagcca

SEQ ID NO: 10034987 - DNA, 22 bp, Homo sapiens
gagcagctctgtgcctggagac

SEQ ID NO: 10034988 - DNA, 22 bp, Homo sapiens
gagcagctctgggtgacccagt

SEQ ID NO: 10034989 - DNA, 22 bp, Homo sapiens
gagcagctgagctggaatgaga

SEQ ID NO: 10034990 - DNA, 22 bp, Homo sapiens
gagcctgggtccttccctggga

SEQ ID NO: 10034991 - DNA, 22 bp, Homo sapiens
gagcgatgtgggtatgtagaag

SEQ ID NO: 10034992 - DNA, 19 bp, Homo sapiens
gagcgcagagggcagggga

SEQ ID NO: 10034993 - DNA, 22 bp, Homo sapiens
atgtaatttatgttatccataa

SEQ ID NO: 10034994 - DNA, 22 bp, Homo sapiens
atgtacaacctgcatgacagtc

SEQ ID NO: 10034995 - DNA, 22 bp, Homo sapiens
atgtacaatctatcacaagaag

SEQ ID NO: 10034996 - DNA, 22 bp, Homo sapiens
atgtacaatctatcacaagaag

SEQ ID NO: 10034997 - DNA, 22 bp, Homo sapiens
gagtgcagatgaacagaagatt

SEQ ID NO: 10034998 - DNA, 22 bp, Homo sapiens
gagtgcagatgccagccccagt

SEQ ID NO: 10034999 - DNA, 21 bp, Homo sapiens
gagtgcagcaaggtagagtct

SEQ ID NO: 10035000 - DNA, 22 bp, Homo sapiens
gagtgcaggcctgagcaccatc

SEQ ID NO: 10035001 - DNA, 22 bp, Homo sapiens
atgtttattttgcagagtaggg

SEQ ID NO: 10035002 - DNA, 22 bp, Homo sapiens
gagggatggtgtgagaggctca

SEQ ID NO: 10035003 - DNA, 22 bp, Homo sapiens
gaggtagccacagatagagact

SEQ ID NO: 10035004 - DNA, 22 bp, Homo sapiens
gaggtagcgagtggacagtgca

SEQ ID NO: 10035005 - DNA, 22 bp, Homo sapiens
gaggtagcatgctggaagggac

SEQ ID NO: 10035006 - DNA, 22 bp, Homo sapiens
gctgagaaatgcagacatgctg

SEQ ID NO: 10035007 - DNA, 22 bp, Homo sapiens
gctctgggtgaacttggagcaa

SEQ ID NO: 10035008 - DNA, 22 bp, Homo sapiens
gctctgggtagccactgcctgg

SEQ ID NO: 10035009 - DNA, 22 bp, Homo sapiens
gctccaggctgctctgtcccat

SEQ ID NO: 10035010 - DNA, 22 bp, Homo sapiens
gcgcaggagccgcggagggccg

SEQ ID NO: 10035011 - DNA, 22 bp, Homo sapiens
atttgagaaaggagggaacttt

SEQ ID NO: 10035012 - DNA, 23 bp, Homo sapiens
attttacaggtcagttccttgaa

SEQ ID NO: 10035013 - DNA, 22 bp, Homo sapiens
gcccagcaggggatggcagctc

SEQ ID NO: 10035014 - DNA, 22 bp, Homo sapiens
gcccagcaggacagagtggttt

SEQ ID NO: 10035015 - DNA, 22 bp, Homo sapiens
gcccagcagctggtggagaagg

SEQ ID NO: 10035016 - DNA, 22 bp, Homo sapiens
atttacataatagactttaggt

SEQ ID NO: 10035017 - DNA, 22 bp, Homo sapiens
gcccaggagttgaagggctgac

SEQ ID NO: 10035018 - DNA, 22 bp, Homo sapiens
gcccaggagttcaaggctgcag

SEQ ID NO: 10035019 - DNA, 22 bp, Homo sapiens
gcccaggagttcaagtctagtg

SEQ ID NO: 10035020 - DNA, 22 bp, Homo sapiens
gcccaggaggtggaggtgcagt

SEQ ID NO: 10035021 - DNA, 22 bp, Homo sapiens
gcccaggaggttgggctgtgca

SEQ ID NO: 10035022 - DNA, 22 bp, Homo sapiens
gccactgtcctgtgcctgtgct

SEQ ID NO: 10035023 - DNA, 20 bp, Homo sapiens
gccactgggcaccagcaggg

SEQ ID NO: 10035024 - DNA, 22 bp, Homo sapiens
gccactggcgctgtgcagagtg

SEQ ID NO: 10035025 - DNA, 22 bp, Homo sapiens
gccactggcatctagttggtag

SEQ ID NO: 10035026 - DNA, 22 bp, Homo sapiens
gccactggagacagtggggaag

SEQ ID NO: 10035027 - DNA, 22 bp, Homo sapiens
gcattccttgagttccctgtgc

SEQ ID NO: 10035028 - DNA, 22 bp, Homo sapiens
gcattcctacaggctgctatga

SEQ ID NO: 10035029 - DNA, 22 bp, Homo sapiens
gcagtgccttgcttctctgtct

SEQ ID NO: 10035030 - DNA, 22 bp, Homo sapiens
gcagtgccacaagatgggagga

SEQ ID NO: 10035031 - DNA, 22 bp, Homo sapiens
gcagggaggaagagatgcttcc

SEQ ID NO: 10035032 - DNA, 22 bp, Homo sapiens
gcagggaggtttgctgacctgg

SEQ ID NO: 10035033 - DNA, 22 bp, Homo sapiens
attggcagttagtgacgaggct

SEQ ID NO: 10035034 - DNA, 22 bp, Homo sapiens
gcaaaagtacagccggatttct

SEQ ID NO: 10035035 - DNA, 22 bp, Homo sapiens
gcaactgaacatgtgtgtggcc

SEQ ID NO: 10035036 - DNA, 22 bp, Homo sapiens
gcacagaggatgaggcagctct

SEQ ID NO: 10035037 - DNA, 22 bp, Homo sapiens
gcacagagctggccctccaggc

SEQ ID NO: 10035038 - DNA, 22 bp, Homo sapiens
gcactgggggcagcagtgaggg

SEQ ID NO: 10035039 - DNA, 22 bp, Homo sapiens
gcagctttagaaacaagggctg

SEQ ID NO: 10035040 - DNA, 22 bp, Homo sapiens
gcaggagagtctgtgccaggtt

SEQ ID NO: 10035041 - DNA, 18 bp, Homo sapiens
gcaggagatgggtggggt

SEQ ID NO: 10035042 - DNA, 22 bp, Homo sapiens
gcagaggctgtagggaaggttg

SEQ ID NO: 10035043 - DNA, 22 bp, Homo sapiens
gcagaggcctaggtggaaggcc

SEQ ID NO: 10035044 - DNA, 22 bp, Homo sapiens
ggccactgtttcctgggcagtt

SEQ ID NO: 10035045 - DNA, 19 bp, Homo sapiens
ggccccagccagggtatca

SEQ ID NO: 10035046 - DNA, 22 bp, Homo sapiens
ggcagtagccagggactggcag

SEQ ID NO: 10035047 - DNA, 19 bp, Homo sapiens
ggcagtcacggtcaggagc

SEQ ID NO: 10035048 - DNA, 19 bp, Homo sapiens
ggatccagaggatctgcca

SEQ ID NO: 10035049 - DNA, 22 bp, Homo sapiens
cactgcccaggcacccatcttg

SEQ ID NO: 10035050 - DNA, 20 bp, Homo sapiens
cactgccctccagcctgagc

SEQ ID NO: 10035051 - DNA, 22 bp, Homo sapiens
cactgccctgggggttgccatc

SEQ ID NO: 10035052 - DNA, 22 bp, Homo sapiens
cactgcccttacatgccctgca

SEQ ID NO: 10035053 - DNA, 22 bp, Homo sapiens
cactgcccaggacctgccaccc

SEQ ID NO: 10035054 - DNA, 22 bp, Homo sapiens
cactgcccagcgtcttaggcac

SEQ ID NO: 10035055 - DNA, 22 bp, Homo sapiens
ggctcctgtggcaagacagctt

SEQ ID NO: 10035056 - DNA, 22 bp, Homo sapiens
ggctcctgtcctcctggagctc

SEQ ID NO: 10035057 - DNA, 22 bp, Homo sapiens
ggctcctgtcccctcagctgct

SEQ ID NO: 10035058 - DNA, 22 bp, Homo sapiens
cactgtccctgtttcctggaaa

SEQ ID NO: 10035059 - DNA, 22 bp, Homo sapiens
ggctgctcaaggactctgatcg

SEQ ID NO: 10035060 - DNA, 22 bp, Homo sapiens
cagaacagagcctgaatctctc

SEQ ID NO: 10035061 - DNA, 19 bp, Homo sapiens
cagaacagaggtcatggcc

SEQ ID NO: 10035062 - DNA, 19 bp, Homo sapiens
cagaacaggaccaggggcc

SEQ ID NO: 10035063 - DNA, 22 bp, Homo sapiens
cagaacagtacctagcacatag

SEQ ID NO: 10035064 - DNA, 22 bp, Homo sapiens
cagaacagtcgcctgcatggat

SEQ ID NO: 10035065 - DNA, 22 bp, Homo sapiens
cagaagagtagctgaacaagtt

SEQ ID NO: 10035066 - DNA, 22 bp, Homo sapiens
cagaagaggactgggtagctca

SEQ ID NO: 10035067 - DNA, 22 bp, Homo sapiens
cagaacagaaacgttgttccat

SEQ ID NO: 10035068 - DNA, 22 bp, Homo sapiens
cagaacagaatcgtgtggtgag

SEQ ID NO: 10035069 - DNA, 22 bp, Homo sapiens
gctgggccagccagacatgtga

SEQ ID NO: 10035070 - DNA, 22 bp, Homo sapiens
gctgggccccatccctcgagca

SEQ ID NO: 10035071 - DNA, 19 bp, Homo sapiens
gctgggagcagaccctccc

SEQ ID NO: 10035072 - DNA, 22 bp, Homo sapiens
caatcccatcaccatctgctct

SEQ ID NO: 10035073 - DNA, 22 bp, Homo sapiens
ggacagctgctttcaggccaca

SEQ ID NO: 10035074 - DNA, 22 bp, Homo sapiens
ggacagctctgccaggagctca

SEQ ID NO: 10035075 - DNA, 21 bp, Homo sapiens
ggacagctgcgcgcagggctc

SEQ ID NO: 10035076 - DNA, 22 bp, Homo sapiens
ggacagcagcctcttacatgaa

SEQ ID NO: 10035077 - DNA, 22 bp, Homo sapiens
ggagagtgggagcaactgttgc

SEQ ID NO: 10035078 - DNA, 19 bp, Homo sapiens
ggacacagaaagctgcatt

SEQ ID NO: 10035079 - DNA, 22 bp, Homo sapiens
ggacaagcctgtgagtgggttt

SEQ ID NO: 10035080 - DNA, 22 bp, Homo sapiens
ggagcaggagtctcttgaattt

SEQ ID NO: 10035081 - DNA, 22 bp, Homo sapiens
cacagcaggtgcttaatgatta

SEQ ID NO: 10035082 - DNA, 22 bp, Homo sapiens
cacagcagggcatggctgttgt

SEQ ID NO: 10035083 - DNA, 22 bp, Homo sapiens
cacagcagggatgaatggagtg

SEQ ID NO: 10035084 - DNA, 22 bp, Homo sapiens
cacagcaggcactatacagggc

SEQ ID NO: 10035085 - DNA, 22 bp, Homo sapiens
ggaggggatttagtagatgcta

SEQ ID NO: 10035086 - DNA, 22 bp, Homo sapiens
ggaggggatggtttgaccctgg

SEQ ID NO: 10035087 - DNA, 22 bp, Homo sapiens
cacagctaggaggaaagcagag

SEQ ID NO: 10035088 - DNA, 22 bp, Homo sapiens
cacaggagagctgggaggtgcc

SEQ ID NO: 10035089 - DNA, 22 bp, Homo sapiens
cagagtttcggtaagcatagaa

SEQ ID NO: 10035090 - DNA, 22 bp, Homo sapiens
cagaggcaggataagaactgcg

SEQ ID NO: 10035091 - DNA, 22 bp, Homo sapiens
ggtgagaggcagaggacagctt

SEQ ID NO: 10035092 - DNA, 22 bp, Homo sapiens
cagatataagaaagctattgtc

SEQ ID NO: 10035093 - DNA, 22 bp, Homo sapiens
ggtggcagggagtgtccctggg

SEQ ID NO: 10035094 - DNA, 18 bp, Homo sapiens
ggtggcaggtcagatgcc

SEQ ID NO: 10035095 - DNA, 22 bp, Homo sapiens
ggtggcagtagcactgggcctg

SEQ ID NO: 10035096 - DNA, 22 bp, Homo sapiens
ggtggcaggctggcattggcaa

SEQ ID NO: 10035097 - DNA, 22 bp, Homo sapiens
ggtggcagtggtctctgacaga

SEQ ID NO: 10035098 - DNA, 20 bp, Homo sapiens
cagcagagacccatggggag

SEQ ID NO: 10035099 - DNA, 22 bp, Homo sapiens
cagcagagaaattaaacttctg

SEQ ID NO: 10035100 - DNA, 22 bp, Homo sapiens
cagcagagaccaagtgatttga

SEQ ID NO: 10035101 - DNA, 22 bp, Homo sapiens
cagcagagaaattacatatttg

SEQ ID NO: 10035102 - DNA, 22 bp, Homo sapiens
cagaggcagccgggggagaacg

SEQ ID NO: 10035103 - DNA, 22 bp, Homo sapiens
cagaggcaggaagatgggcagt

SEQ ID NO: 10035104 - DNA, 22 bp, Homo sapiens
gggctctgcctggctgggagta

SEQ ID NO: 10035105 - DNA, 22 bp, Homo sapiens
gggctctgcgctcagctccagc

SEQ ID NO: 10035106 - DNA, 22 bp, Homo sapiens
cagagagagtcaaatctttgct

SEQ ID NO: 10035107 - DNA, 22 bp, Homo sapiens
cagagacagtttcacagggtct

SEQ ID NO: 10035108 - DNA, 22 bp, Homo sapiens
cagaagcagattctaaagcaag

SEQ ID NO: 10035109 - DNA, 20 bp, Homo sapiens
gggccctgggattcagagca

SEQ ID NO: 10035110 - DNA, 22 bp, Homo sapiens
gggccctggctttcctgttctt

SEQ ID NO: 10035111 - DNA, 18 bp, Homo sapiens
gggccctggcgtccgccc

SEQ ID NO: 10035112 - DNA, 22 bp, Homo sapiens
gggccctgcgtccggaagtctg

SEQ ID NO: 10035113 - DNA, 22 bp, Homo sapiens
gggccctgcgactcgcggcgga

SEQ ID NO: 10035114 - DNA, 22 bp, Homo sapiens
gggccctggacgtggcggcaga

SEQ ID NO: 10035115 - DNA, 22 bp, Homo sapiens
gggccctggccgaatccctctg

SEQ ID NO: 10035116 - DNA, 22 bp, Homo sapiens
gggccctggatttaagcatgga

SEQ ID NO: 10035117 - DNA, 22 bp, Homo sapiens
cagagagcacataggatacttt

SEQ ID NO: 10035118 - DNA, 22 bp, Homo sapiens
cagcagtgatgtgtgagggttc

SEQ ID NO: 10035119 - DNA, 22 bp, Homo sapiens
cagcagtgcttcagtgtgagat

SEQ ID NO: 10035120 - DNA, 22 bp, Homo sapiens
cagcaggtcttgttgctgctga

SEQ ID NO: 10035121 - DNA, 22 bp, Homo sapiens
cagcaggtgtctagcaagggtc

SEQ ID NO: 10035122 - DNA, 22 bp, Homo sapiens
cagcaggttctacgggtgagat

SEQ ID NO: 10035123 - DNA, 22 bp, Homo sapiens
cagcaggttaacagaggctggt

SEQ ID NO: 10035124 - DNA, 22 bp, Homo sapiens
cagcagagcatttggtaggagg

SEQ ID NO: 10035125 - DNA, 22 bp, Homo sapiens
cagcagagctgggctttgaatt

SEQ ID NO: 10035126 - DNA, 22 bp, Homo sapiens
cagcaggtcatgaaagaaaacc

SEQ ID NO: 10035127 - DNA, 22 bp, Homo sapiens
gtctttggagaggtgccatttc

SEQ ID NO: 10035128 - DNA, 22 bp, Homo sapiens
gtctctgtgtctgagagagccc

SEQ ID NO: 10035129 - DNA, 22 bp, Homo sapiens
gtctctgttatttccagggtca

SEQ ID NO: 10035130 - DNA, 22 bp, Homo sapiens
gtgcagctgtggtggagccagg

SEQ ID NO: 10035131 - DNA, 22 bp, Homo sapiens
gtgcagctgcaggagtcaggtc

SEQ ID NO: 10035132 - DNA, 22 bp, Homo sapiens
gtgcagcaggggccctctcacc

SEQ ID NO: 10035133 - DNA, 22 bp, Homo sapiens
cagccctttccttctcagcttt

SEQ ID NO: 10035134 - DNA, 22 bp, Homo sapiens
cagctccaaagccccactgtcc

SEQ ID NO: 10035135 - DNA, 22 bp, Homo sapiens
cagctcagcttcctgggtgtgt

SEQ ID NO: 10035136 - DNA, 22 bp, Homo sapiens
cagctccacttgagtggggcct

SEQ ID NO: 10035137 - DNA, 21 bp, Homo sapiens
cagctccactaaagcagctgt

SEQ ID NO: 10035138 - DNA, 22 bp, Homo sapiens
cagctccagcccaggcagctcc

SEQ ID NO: 10035139 - DNA, 22 bp, Homo sapiens
cagctccagccgactgtaagaa

SEQ ID NO: 10035140 - DNA, 21 bp, Homo sapiens
cagctctgagatttctactag

SEQ ID NO: 10035141 - DNA, 22 bp, Homo sapiens
cagctctgaggaacactccttt

SEQ ID NO: 10035142 - DNA, 22 bp, Homo sapiens
cagctcccgccatcgggaggca

SEQ ID NO: 10035143 - DNA, 22 bp, Homo sapiens
cagctcctcacgagtcttgaaa

SEQ ID NO: 10035144 - DNA, 22 bp, Homo sapiens
aggctgctcagtagatggagct

SEQ ID NO: 10035145 - DNA, 22 bp, Homo sapiens
ccaggtgactgtcagaggtttt

SEQ ID NO: 10035146 - DNA, 22 bp, Homo sapiens
ccaggtgaaatcttcatggttc

SEQ ID NO: 10035147 - DNA, 22 bp, Homo sapiens
ccagctctgtaagctgtgaaat

SEQ ID NO: 10035148 - DNA, 22 bp, Homo sapiens
ccagcaggagactagcaacata

SEQ ID NO: 10035149 - DNA, 22 bp, Homo sapiens
aggcggctggtgtcctgcaggt

SEQ ID NO: 10035150 - DNA, 22 bp, Homo sapiens
aggcggctccgggagtgtgggc

SEQ ID NO: 10035151 - DNA, 18 bp, Homo sapiens
aggcaggctggagtgact

SEQ ID NO: 10035152 - DNA, 19 bp, Homo sapiens
ccagcagctttgattctct

SEQ ID NO: 10035153 - DNA, 22 bp, Homo sapiens
ccagcagctttgcatacactaa

SEQ ID NO: 10035154 - DNA, 22 bp, Homo sapiens
ccagcaggactttggaaatatg

SEQ ID NO: 10035155 - DNA, 22 bp, Homo sapiens
aggggatgatcctcccgcagcg

SEQ ID NO: 10035156 - DNA, 22 bp, Homo sapiens
agggtaggaactgagtggaagg

SEQ ID NO: 10035157 - DNA, 22 bp, Homo sapiens
agggtagggcccggagacagac

SEQ ID NO: 10035158 - DNA, 22 bp, Homo sapiens
agggtagggccgtagggccatg

SEQ ID NO: 10035159 - DNA, 22 bp, Homo sapiens
agggtaggtgtaagatagccct

SEQ ID NO: 10035160 - DNA, 22 bp, Homo sapiens
cctgaactctaaatagagcagt

SEQ ID NO: 10035161 - DNA, 19 bp, Homo sapiens
cctcagagctagtgaacat

SEQ ID NO: 10035162 - DNA, 22 bp, Homo sapiens
cctcagagcgcgtggcattatt

SEQ ID NO: 10035163 - DNA, 20 bp, Homo sapiens
cctcagagcgcaggccccct

SEQ ID NO: 10035164 - DNA, 23 bp, Homo sapiens
ccctggaacttcactcatgcaca

SEQ ID NO: 10035165 - DNA, 22 bp, Homo sapiens
ccctggaagagcctgggcatgg

SEQ ID NO: 10035166 - DNA, 22 bp, Homo sapiens
ccctggaacccatggccagtgt

SEQ ID NO: 10035167 - DNA, 22 bp, Homo sapiens
ccctggaactgccaagcctcag

SEQ ID NO: 10035168 - DNA, 22 bp, Homo sapiens
cctcaggatccgcaggtgcagt

SEQ ID NO: 10035169 - DNA, 20 bp, Homo sapiens
cctcaggatgagggtgagca

SEQ ID NO: 10035170 - DNA, 22 bp, Homo sapiens
cctcaggcaggaaactgtcccg

SEQ ID NO: 10035171 - DNA, 22 bp, Homo sapiens
cccatgaggtggaggttgcagt

SEQ ID NO: 10035172 - DNA, 22 bp, Homo sapiens
cccatgagtgctgctcagaggc

SEQ ID NO: 10035173 - DNA, 22 bp, Homo sapiens
cccatggggacaccatgaagga

SEQ ID NO: 10035174 - DNA, 22 bp, Homo sapiens
ccctagggtttggccagagccc

SEQ ID NO: 10035175 - DNA, 22 bp, Homo sapiens
ccctagggctaagcaggactgc

SEQ ID NO: 10035176 - DNA, 19 bp, Homo sapiens
ccctaggggctcctgaggg

SEQ ID NO: 10035177 - DNA, 22 bp, Homo sapiens
ccctaggggcaatgatggtgct

SEQ ID NO: 10035178 - DNA, 22 bp, Homo sapiens
ccctgatggcctatctggcagt

SEQ ID NO: 10035179 - DNA, 22 bp, Homo sapiens
cccagggaagccatttctgact

SEQ ID NO: 10035180 - DNA, 22 bp, Homo sapiens
cccaggaggtcgaagctgcagt

SEQ ID NO: 10035181 - DNA, 22 bp, Homo sapiens
cccaggaggtggagcttgcagt

SEQ ID NO: 10035182 - DNA, 22 bp, Homo sapiens
cccaggaatgaggggcggaggc

SEQ ID NO: 10035183 - DNA, 22 bp, Homo sapiens
aggctgggtacctgtcatatgc

SEQ ID NO: 10035184 - DNA, 22 bp, Homo sapiens
cccaggaggtcaaggctgcagt

SEQ ID NO: 10035185 - DNA, 22 bp, Homo sapiens
cccaggaggtagaggttgcagt

SEQ ID NO: 10035186 - DNA, 20 bp, Homo sapiens
cccaggagctgtgccccatc

SEQ ID NO: 10035187 - DNA, 22 bp, Homo sapiens
cccaggagcttctctctgcctc

SEQ ID NO: 10035188 - DNA, 22 bp, Homo sapiens
cccaggagatggtgcgtggtct

SEQ ID NO: 10035189 - DNA, 19 bp, Homo sapiens
cccaggagcagtattgatg

SEQ ID NO: 10035190 - DNA, 22 bp, Homo sapiens
cccaggagccatctgtcttggc

SEQ ID NO: 10035191 - DNA, 23 bp, Homo sapiens
cccaggagcctgagtcctctctg

SEQ ID NO: 10035192 - DNA, 22 bp, Homo sapiens
cccaggagatggaggttgcagt

SEQ ID NO: 10035193 - DNA, 22 bp, Homo sapiens
cccaggaatgggaaggaggaat

SEQ ID NO: 10035194 - DNA, 22 bp, Homo sapiens
cccaggagatgcactccattgg

SEQ ID NO: 10035195 - DNA, 22 bp, Homo sapiens
caggcagaggcttttcatggct

SEQ ID NO: 10035196 - DNA, 22 bp, Homo sapiens
caggcagaggaagtctgggtct

SEQ ID NO: 10035197 - DNA, 22 bp, Homo sapiens
agctggagcttcaagcaggtaa

SEQ ID NO: 10035198 - DNA, 22 bp, Homo sapiens
caggcagagctgaagatagatg

SEQ ID NO: 10035199 - DNA, 20 bp, Homo sapiens
agctgcccttttcacatgtt

SEQ ID NO: 10035200 - DNA, 22 bp, Homo sapiens
agctgccgatgcccagctgcat

SEQ ID NO: 10035201 - DNA, 22 bp, Homo sapiens
agctgccctgtggggagggttg

SEQ ID NO: 10035202 - DNA, 22 bp, Homo sapiens
agctgccctggtaagattgatg

SEQ ID NO: 10035203 - DNA, 22 bp, Homo sapiens
agctgcccttaataggcattca

SEQ ID NO: 10035204 - DNA, 22 bp, Homo sapiens
agctgccctttatgatgctgaa

SEQ ID NO: 10035205 - DNA, 22 bp, Homo sapiens
agctgccctgggctggagatgg

SEQ ID NO: 10035206 - DNA, 22 bp, Homo sapiens
agctgccctggcggagctgctc

SEQ ID NO: 10035207 - DNA, 20 bp, Homo sapiens
agctgcccctgggcactgcc

SEQ ID NO: 10035208 - DNA, 22 bp, Homo sapiens
aggaaaacacagtattgatgga

SEQ ID NO: 10035209 - DNA, 22 bp, Homo sapiens
cagggacatttccaagagaatt

SEQ ID NO: 10035210 - DNA, 22 bp, Homo sapiens
cagggacaggggagaaaagatg

SEQ ID NO: 10035211 - DNA, 20 bp, Homo sapiens
cagggacagtggcagattca

SEQ ID NO: 10035212 - DNA, 22 bp, Homo sapiens
cagggacataagaggaacatgg

SEQ ID NO: 10035213 - DNA, 22 bp, Homo sapiens
cagggttgggctccaaggatgg

SEQ ID NO: 10035214 - DNA, 22 bp, Homo sapiens
caggtcccgttccccagagatt

SEQ ID NO: 10035215 - DNA, 23 bp, Homo sapiens
aggaatgtgcccacccatctcct

SEQ ID NO: 10035216 - DNA, 22 bp, Homo sapiens
caggtccagtcactggtctgca

SEQ ID NO: 10035217 - DNA, 22 bp, Homo sapiens
aggatgagaagattggaatctt

SEQ ID NO: 10035218 - DNA, 22 bp, Homo sapiens
aggcacaggcctcagcacccag

SEQ ID NO: 10035219 - DNA, 22 bp, Homo sapiens
aggatcagtgaatactcagggt

SEQ ID NO: 10035220 - DNA, 16 bp, Homo sapiens
aggcagagatttaccc

SEQ ID NO: 10035221 - DNA, 22 bp, Homo sapiens
aggcagagagcagtggccgtct

SEQ ID NO: 10035222 - DNA, 22 bp, Homo sapiens
aggcagagaaaaaccagatatg

SEQ ID NO: 10035223 - DNA, 20 bp, Homo sapiens
aggcacagttcctagttggg

SEQ ID NO: 10035224 - DNA, 22 bp, Homo sapiens
aggcacaggtggacttcacagt

SEQ ID NO: 10035225 - DNA, 19 bp, Homo sapiens
aggcacaggttgtctggac

SEQ ID NO: 10035226 - DNA, 22 bp, Homo sapiens
aggcacagtggctcacacctgt

SEQ ID NO: 10035227 - DNA, 22 bp, Homo sapiens
aggcacagtgcctggaatcaaa

SEQ ID NO: 10035228 - DNA, 22 bp, Homo sapiens
aggcacagtggccctgtttggg

SEQ ID NO: 10035229 - DNA, 22 bp, Homo sapiens
aggcagaggagaatgatcttcc

SEQ ID NO: 10035230 - DNA, 22 bp, Homo sapiens
aggcagaggaagggtggatttg

SEQ ID NO: 10035231 - DNA, 22 bp, Homo sapiens
aggcagaggagaatgatcttcc

SEQ ID NO: 10035232 - DNA, 22 bp, Homo sapiens
aggcagagctgggttttgaaat

SEQ ID NO: 10035233 - DNA, 22 bp, Homo sapiens
aggcagagctgggttttgaaat

SEQ ID NO: 10035234 - DNA, 23 bp, Homo sapiens
aggcagagccaaggtcaaaaccc

SEQ ID NO: 10035235 - DNA, 20 bp, Homo sapiens
aggcagagcgcacttttaga

SEQ ID NO: 10035236 - DNA, 22 bp, Homo sapiens
aggcagagctgatgttctgtga

SEQ ID NO: 10035237 - DNA, 22 bp, Homo sapiens
aggcagagctaggaagaattgt

SEQ ID NO: 10035238 - DNA, 22 bp, Homo sapiens
aggcagctttctggtgcaccat

SEQ ID NO: 10035239 - DNA, 22 bp, Homo sapiens
aggcagctttctgtaggggtgt

SEQ ID NO: 10035240 - DNA, 22 bp, Homo sapiens
aggcagctttgtagtaaagcta

SEQ ID NO: 10035241 - DNA, 22 bp, Homo sapiens
aggcagcttaagccctggccca

SEQ ID NO: 10035242 - DNA, 22 bp, Homo sapiens
aggcagcttctgattagcagcg

SEQ ID NO: 10035243 - DNA, 22 bp, Homo sapiens
aggcagctttaactggtagtag

SEQ ID NO: 10035244 - DNA, 22 bp, Homo sapiens
aggcagctttcagtgtctctca

SEQ ID NO: 10035245 - DNA, 22 bp, Homo sapiens
aggcagcgtagcaaggctagta

SEQ ID NO: 10035246 - DNA, 22 bp, Homo sapiens
aggcagctggcagcacccaggg

SEQ ID NO: 10035247 - DNA, 20 bp, Homo sapiens
aggcagctgggaaatgaggg

SEQ ID NO: 10035248 - DNA, 20 bp, Homo sapiens
aggcagctggccaggcaggt

SEQ ID NO: 10035249 - DNA, 23 bp, Homo sapiens
aggcagctgggtagcatctttct

SEQ ID NO: 10035250 - DNA, 22 bp, Homo sapiens
aggcagctgtgaggactggatt

SEQ ID NO: 10035251 - DNA, 22 bp, Homo sapiens
aggcaggcccctgagaatagac

SEQ ID NO: 10035252 - DNA, 22 bp, Homo sapiens
aggcaggccctctggaaaggta

SEQ ID NO: 10035253 - DNA, 22 bp, Homo sapiens
ccaaaccatccatctccaggct

SEQ ID NO: 10035254 - DNA, 22 bp, Homo sapiens
aggcaggctgctatggagtaga

SEQ ID NO: 10035255 - DNA, 22 bp, Homo sapiens
aggcaggctcaggcccatgctt

SEQ ID NO: 10035256 - DNA, 22 bp, Homo sapiens
aggcaggctcaatgcccagtct

SEQ ID NO: 10035257 - DNA, 22 bp, Homo sapiens
aggagtggtgcaggacctgcca

SEQ ID NO: 10035258 - DNA, 22 bp, Homo sapiens
aggagcagcttctgaaccatgt

SEQ ID NO: 10035259 - DNA, 22 bp, Homo sapiens
atcacaaaggtctcagagcaca

SEQ ID NO: 10035260 - DNA, 22 bp, Homo sapiens
ctgtctcctccactgcatggga

SEQ ID NO: 10035261 - DNA, 22 bp, Homo sapiens
ctggtccctggacctccctgga

SEQ ID NO: 10035262 - DNA, 22 bp, Homo sapiens
ctggtccccagactgggcttag

SEQ ID NO: 10035263 - DNA, 22 bp, Homo sapiens
ctggtccctgagtagttatgca

SEQ ID NO: 10035264 - DNA, 17 bp, Homo sapiens
ctggtcccaccaagccc

SEQ ID NO: 10035265 - DNA, 22 bp, Homo sapiens
ctggtcccagctctgccaccaa

SEQ ID NO: 10035266 - DNA, 22 bp, Homo sapiens
ctggtcccagcagagctctgag

SEQ ID NO: 10035267 - DNA, 22 bp, Homo sapiens
ctggggcatcatccattctttc

SEQ ID NO: 10035268 - DNA, 22 bp, Homo sapiens
atctggttttggctgtgtccct

SEQ ID NO: 10035269 - DNA, 22 bp, Homo sapiens
cttccttgtggtccttctcatt

SEQ ID NO: 10035270 - DNA, 22 bp, Homo sapiens
cttccttggcttctggggtgtg

SEQ ID NO: 10035271 - DNA, 22 bp, Homo sapiens
cttccttctgaagcatagaagc

SEQ ID NO: 10035272 - DNA, 22 bp, Homo sapiens
cttccttgctgtctgctccagg

SEQ ID NO: 10035273 - DNA, 19 bp, Homo sapiens
cttccttgctccccatgtg

SEQ ID NO: 10035274 - DNA, 22 bp, Homo sapiens
cttccttgcggcccctgcctag

SEQ ID NO: 10035275 - DNA, 22 bp, Homo sapiens
atcatacagcctttgttagtgt

SEQ ID NO: 10035276 - DNA, 22 bp, Homo sapiens
ctgggagctgaggctgacgctg

SEQ ID NO: 10035277 - DNA, 22 bp, Homo sapiens
ctggctctttcagccgctggag

SEQ ID NO: 10035278 - DNA, 22 bp, Homo sapiens
ctggctctttcctagctaggct

SEQ ID NO: 10035279 - DNA, 22 bp, Homo sapiens
ctggccttttgtttctggagaa

SEQ ID NO: 10035280 - DNA, 22 bp, Homo sapiens
ctggcctttagccccagtgtct

SEQ ID NO: 10035281 - DNA, 22 bp, Homo sapiens
ctggccttcagactcggactga

SEQ ID NO: 10035282 - DNA, 22 bp, Homo sapiens
ctggcaagtactgggccagctc

SEQ ID NO: 10035283 - DNA, 22 bp, Homo sapiens
ctggcctcagagggtcatggtg

SEQ ID NO: 10035284 - DNA, 22 bp, Homo sapiens
ctggcctcatagccaagctgtg

SEQ ID NO: 10035285 - DNA, 22 bp, Homo sapiens
ctggcccttctcttgcttcctg

SEQ ID NO: 10035286 - DNA, 22 bp, Homo sapiens
ctggcccttgacttacagcagg

SEQ ID NO: 10035287 - DNA, 22 bp, Homo sapiens
ctggccctaggcaaacacagat

SEQ ID NO: 10035288 - DNA, 22 bp, Homo sapiens
ataaaaatgagggcggtagcta

SEQ ID NO: 10035289 - DNA, 22 bp, Homo sapiens
agttctataattaaaatgaagg

SEQ ID NO: 10035290 - DNA, 22 bp, Homo sapiens
ctgcctgtgccaatgctccttt

SEQ ID NO: 10035291 - DNA, 22 bp, Homo sapiens
ctgctgggcagaggctgcatga

SEQ ID NO: 10035292 - DNA, 22 bp, Homo sapiens
ctgctggggaggcgcctcgacg

SEQ ID NO: 10035293 - DNA, 22 bp, Homo sapiens
ctgctgggctcctcatgtgact

SEQ ID NO: 10035294 - DNA, 22 bp, Homo sapiens
ctgctgggcctggtctctgagg

SEQ ID NO: 10035295 - DNA, 22 bp, Homo sapiens
atacacaggcatgcttctgatt

SEQ ID NO: 10035296 - DNA, 22 bp, Homo sapiens
ctgctgtgcctcttttcacgtg

SEQ ID NO: 10035297 - DNA, 22 bp, Homo sapiens
ctgctgtgcttgtggccacccg

SEQ ID NO: 10035298 - DNA, 22 bp, Homo sapiens
ctgctgtgcagacagactctct

SEQ ID NO: 10035299 - DNA, 22 bp, Homo sapiens
ctgctgtgcaggtgcctatgat

SEQ ID NO: 10035300 - DNA, 22 bp, Homo sapiens
ctgctgtgcatatttatctagg

SEQ ID NO: 10035301 - DNA, 22 bp, Homo sapiens
ctgctgtggtgtcaagcatctc

SEQ ID NO: 10035302 - DNA, 22 bp, Homo sapiens
ctgctgtggatgcaggacctca

SEQ ID NO: 10035303 - DNA, 22 bp, Homo sapiens
ctgctgtgggttaagacactgt

SEQ ID NO: 10035304 - DNA, 22 bp, Homo sapiens
ctgctgtgggcagggtagctgg

SEQ ID NO: 10035305 - DNA, 22 bp, Homo sapiens
agtgtatttgcctataaaaatg

SEQ ID NO: 10035306 - DNA, 22 bp, Homo sapiens
agtgtatttgagcatctcctta

SEQ ID NO: 10035307 - DNA, 22 bp, Homo sapiens
agtgtctttgacacattcaaag

SEQ ID NO: 10035308 - DNA, 22 bp, Homo sapiens
agtgtctttgtctctcaagcac

SEQ ID NO: 10035309 - DNA, 22 bp, Homo sapiens
ctgagctaggagttaggaagct

SEQ ID NO: 10035310 - DNA, 22 bp, Homo sapiens
agtgaggtcatactggagaggg

SEQ ID NO: 10035311 - DNA, 22 bp, Homo sapiens
agtgagggatgaagaactgcgg

SEQ ID NO: 10035312 - DNA, 22 bp, Homo sapiens
agtgatggcatcgggtccagca

SEQ ID NO: 10035313 - DNA, 22 bp, Homo sapiens
agtctattgcctaacagagagg

SEQ ID NO: 10035314 - DNA, 22 bp, Homo sapiens
agtgcctggaccccatgacata

SEQ ID NO: 10035315 - DNA, 22 bp, Homo sapiens
agtgccctgtggcttcagcaat

SEQ ID NO: 10035316 - DNA, 22 bp, Homo sapiens
agtgcccacctctcttcagcta

SEQ ID NO: 10035317 - DNA, 22 bp, Homo sapiens
agtgccatgtagtccagcagaa

SEQ ID NO: 10035318 - DNA, 22 bp, Homo sapiens
agtggcagttttatatttcatg

SEQ ID NO: 10035319 - DNA, 20 bp, Homo sapiens
agtggcagggaaatggaaag

SEQ ID NO: 10035320 - DNA, 22 bp, Homo sapiens
agtggcagggacttcatataaa

SEQ ID NO: 10035321 - DNA, 22 bp, Homo sapiens
agtcctgggtccagcaggtcct

SEQ ID NO: 10035322 - DNA, 22 bp, Homo sapiens
ctatatttggtgagggatgtct

SEQ ID NO: 10035323 - DNA, 22 bp, Homo sapiens
agtaaagcagagttgcagtaca

SEQ ID NO: 10035324 - DNA, 23 bp, Homo sapiens
agtaaagcaattgttggcgagag

SEQ ID NO: 10035325 - DNA, 22 bp, Homo sapiens
agtaaatcagacctcattatgt

SEQ ID NO: 10035326 - DNA, 18 bp, Homo sapiens
agtaaagcttattacatg

SEQ ID NO: 10035327 - DNA, 22 bp, Homo sapiens
agtaaataacagagaaaatggg

SEQ ID NO: 10035328 - DNA, 23 bp, Homo sapiens
aggtcagcaggcaaggaaatggc

SEQ ID NO: 10035329 - DNA, 22 bp, Homo sapiens
aggtcagcaggccaggggcgaa

SEQ ID NO: 10035330 - DNA, 21 bp, Homo sapiens
aggtcagcccagctctggaag

SEQ ID NO: 10035331 - DNA, 22 bp, Homo sapiens
aggtcagcatgagtagaaggta

SEQ ID NO: 10035332 - DNA, 22 bp, Homo sapiens
cctgggaggctgaggctgcagt

SEQ ID NO: 10035333 - DNA, 22 bp, Homo sapiens
cctgggagaactgctgggttgg

SEQ ID NO: 10035334 - DNA, 22 bp, Homo sapiens
cctgggaggctgtgggtctgct

SEQ ID NO: 10035335 - DNA, 22 bp, Homo sapiens
cctgagtccaaaagtctttagc

SEQ ID NO: 10035336 - DNA, 22 bp, Homo sapiens
cctgagtcaagatgtatggtaa

SEQ ID NO: 10035337 - DNA, 22 bp, Homo sapiens
aggtggcaggaggtcagagaaa

SEQ ID NO: 10035338 - DNA, 22 bp, Homo sapiens
aggtggcagcagaatcagggag

SEQ ID NO: 10035339 - DNA, 19 bp, Homo sapiens
ccttccagctccttttcag

SEQ ID NO: 10035340 - DNA, 22 bp, Homo sapiens
aggtggcagaggactcctcctg

SEQ ID NO: 10035341 - DNA, 22 bp, Homo sapiens
aggtggcaaggggcgcctctct

SEQ ID NO: 10035342 - DNA, 18 bp, Homo sapiens
aggtgcagcctctgaggc

SEQ ID NO: 10035343 - DNA, 22 bp, Homo sapiens
aggtgcagctggtggagtctgg

SEQ ID NO: 10035344 - DNA, 17 bp, Homo sapiens
aggtgcagaggcagagc

SEQ ID NO: 10035345 - DNA, 22 bp, Homo sapiens
actgggccaactatttgttcta

SEQ ID NO: 10035346 - DNA, 22 bp, Homo sapiens
actgggccagatcagagcaact

SEQ ID NO: 10035347 - DNA, 23 bp, Homo sapiens
actgggccagctacttagcactg

SEQ ID NO: 10035348 - DNA, 22 bp, Homo sapiens
actgcccattatggtagtcact

SEQ ID NO: 10035349 - DNA, 22 bp, Homo sapiens
actgcccattaaaggtgctttg

SEQ ID NO: 10035350 - DNA, 22 bp, Homo sapiens
actgcccttgtcctggcacacc

SEQ ID NO: 10035351 - DNA, 22 bp, Homo sapiens
actgccctggcaccacacatgc

SEQ ID NO: 10035352 - DNA, 22 bp, Homo sapiens
actgcctgcctctgattctgca

SEQ ID NO: 10035353 - DNA, 22 bp, Homo sapiens
actgcctgctcctggctccaca

SEQ ID NO: 10035354 - DNA, 21 bp, Homo sapiens
actgcctggggtgctggccaa

SEQ ID NO: 10035355 - DNA, 22 bp, Homo sapiens
actgcactccagcctgggtgat

SEQ ID NO: 10035356 - DNA, 22 bp, Homo sapiens
actgccaatggtagtttgatgg

SEQ ID NO: 10035357 - DNA, 22 bp, Homo sapiens
actgcacttcaccctgggtgac

SEQ ID NO: 10035358 - DNA, 22 bp, Homo sapiens
actctgagaatccctggacttt

SEQ ID NO: 10035359 - DNA, 19 bp, Homo sapiens
actctgagcttgctctatc

SEQ ID NO: 10035360 - DNA, 22 bp, Homo sapiens
actctgagtcatgcactccttg

SEQ ID NO: 10035361 - DNA, 22 bp, Homo sapiens
actctgaggagtgactagaggt

SEQ ID NO: 10035362 - DNA, 22 bp, Homo sapiens
actctgcctgaacctcctgcaa

SEQ ID NO: 10035363 - DNA, 22 bp, Homo sapiens
actctgccctaggcctctgggg

SEQ ID NO: 10035364 - DNA, 22 bp, Homo sapiens
actctgccccgagttctgggaa

SEQ ID NO: 10035365 - DNA, 22 bp, Homo sapiens
actctgaggggtatgttcctat

SEQ ID NO: 10035366 - DNA, 22 bp, Homo sapiens
actctgccacataaaggtagat

SEQ ID NO: 10035367 - DNA, 21 bp, Homo sapiens
actctgccagtctcctgcact

SEQ ID NO: 10035368 - DNA, 22 bp, Homo sapiens
actctgcctggaggtaacagga

SEQ ID NO: 10035369 - DNA, 22 bp, Homo sapiens
actctgcctgcggtgggcggga

SEQ ID NO: 10035370 - DNA, 22 bp, Homo sapiens
actctgccttagtcctggggct

SEQ ID NO: 10035371 - DNA, 22 bp, Homo sapiens
actctgccttggtgtcacaaga

SEQ ID NO: 10035372 - DNA, 22 bp, Homo sapiens
actctgcctttcagcagatgaa

SEQ ID NO: 10035373 - DNA, 22 bp, Homo sapiens
acgagaggtccttagaatctgt

SEQ ID NO: 10035374 - DNA, 22 bp, Homo sapiens
aggtccagcctgccctctctcc

SEQ ID NO: 10035375 - DNA, 22 bp, Homo sapiens
aggtccaggttccgtttctgcg

SEQ ID NO: 10035376 - DNA, 22 bp, Homo sapiens
acctttggaaataaacactctg

SEQ ID NO: 10035377 - DNA, 22 bp, Homo sapiens
agtaccctagggtgggagctca

SEQ ID NO: 10035378 - DNA, 22 bp, Homo sapiens
agtcactgctttgtccctgtgt

SEQ ID NO: 10035379 - DNA, 18 bp, Homo sapiens
agtttttaggaagaaatg

SEQ ID NO: 10035380 - DNA, 22 bp, Homo sapiens
actgggccttgtgtgtctcatc

SEQ ID NO: 10035381 - DNA, 22 bp, Homo sapiens
agttttatggctcaacctaata

SEQ ID NO: 10035382 - DNA, 22 bp, Homo sapiens
acttccttttgggaaactgttt

SEQ ID NO: 10035383 - DNA, 22 bp, Homo sapiens
atacaaaatatatactggagac

SEQ ID NO: 10035384 - DNA, 22 bp, Homo sapiens
atacaaaaattagccgggagta

SEQ ID NO: 10035385 - DNA, 22 bp, Homo sapiens
atacatatccacaggagataaa

SEQ ID NO: 10035386 - DNA, 22 bp, Homo sapiens
actttggcacagaacttccatt

SEQ ID NO: 10035387 - DNA, 22 bp, Homo sapiens
atagagttttattttccaataa

SEQ ID NO: 10035388 - DNA, 22 bp, Homo sapiens
atagagtgatgtaaggtatgtg

SEQ ID NO: 10035389 - DNA, 22 bp, Homo sapiens
acttttcaaatgggaaactcag

SEQ ID NO: 10035390 - DNA, 22 bp, Homo sapiens
atccagctttgtctggtcttcg

SEQ ID NO: 10035391 - DNA, 22 bp, Homo sapiens
agaacagtcgtggtgagagaaa

SEQ ID NO: 10035392 - DNA, 22 bp, Homo sapiens
atctctgcgtccccagcatcga

SEQ ID NO: 10035393 - DNA, 21 bp, Homo sapiens
agaaggcaaaagcagacatct

SEQ ID NO: 10035394 - DNA, 22 bp, Homo sapiens
agaaggcacagtgctgctaaga

SEQ ID NO: 10035395 - DNA, 22 bp, Homo sapiens
agaaggcactcacactggcacg

SEQ ID NO: 10035396 - DNA, 22 bp, Homo sapiens
atctctgtaattacatgatatt

SEQ ID NO: 10035397 - DNA, 22 bp, Homo sapiens
atcaggtgggttttgaagaaac

SEQ ID NO: 10035398 - DNA, 22 bp, Homo sapiens
aggaagctaaccagggagtgag

SEQ ID NO: 10035399 - DNA, 22 bp, Homo sapiens
aggaagctagagccaccggact

SEQ ID NO: 10035400 - DNA, 22 bp, Homo sapiens
aggaagctcaaagccatgatgt

SEQ ID NO: 10035401 - DNA, 22 bp, Homo sapiens
acatacacatgaatatattttt

SEQ ID NO: 10035402 - DNA, 18 bp, Homo sapiens
aggcacagagcatacata

SEQ ID NO: 10035403 - DNA, 22 bp, Homo sapiens
aggcacagagaatgccctccat

SEQ ID NO: 10035404 - DNA, 22 bp, Homo sapiens
aggcacagaatggcattcagtg

SEQ ID NO: 10035405 - DNA, 22 bp, Homo sapiens
aggagggagatgcccatcctgg

SEQ ID NO: 10035406 - DNA, 20 bp, Homo sapiens
aggagggacctggattggcg

SEQ ID NO: 10035407 - DNA, 22 bp, Homo sapiens
aggagggacctaggaatattgc

SEQ ID NO: 10035408 - DNA, 22 bp, Homo sapiens
aggaggggcatagaaatgtaat

SEQ ID NO: 10035409 - DNA, 21 bp, Homo sapiens
aggaggggtctttcccactga

SEQ ID NO: 10035410 - DNA, 22 bp, Homo sapiens
aggagggacaccaatatatgtt

SEQ ID NO: 10035411 - DNA, 22 bp, Homo sapiens
aggaggggttctcgggtgctga

SEQ ID NO: 10035412 - DNA, 22 bp, Homo sapiens
agctgctgtggggctcggcctg

SEQ ID NO: 10035413 - DNA, 22 bp, Homo sapiens
agctggccttagtgagcacctg

SEQ ID NO: 10035414 - DNA, 22 bp, Homo sapiens
agctggcctgttagagctgagt

SEQ ID NO: 10035415 - DNA, 22 bp, Homo sapiens
acagccagggtctcaggaggcg

SEQ ID NO: 10035416 - DNA, 22 bp, Homo sapiens
agctttggtgctgtcacacaaa

SEQ ID NO: 10035417 - DNA, 22 bp, Homo sapiens
agcttattatcttatcaagctt

SEQ ID NO: 10035418 - DNA, 22 bp, Homo sapiens
aggccctgcaggagtggggaca

SEQ ID NO: 10035419 - DNA, 22 bp, Homo sapiens
aggccctgatccgaatccagat

SEQ ID NO: 10035420 - DNA, 22 bp, Homo sapiens
aggccctgcaggaagcaggatg

SEQ ID NO: 10035421 - DNA, 22 bp, Homo sapiens
acattaacactggtgctggtgt

SEQ ID NO: 10035422 - DNA, 22 bp, Homo sapiens
aggccctgcattgtactgaggg

SEQ ID NO: 10035423 - DNA, 20 bp, Homo sapiens
aggcagttagaaggagatga

SEQ ID NO: 10035424 - DNA, 22 bp, Homo sapiens
aggccagcacgacagccgcagg

SEQ ID NO: 10035425 - DNA, 22 bp, Homo sapiens
acatgaaaagactatctgatta

SEQ ID NO: 10035426 - DNA, 22 bp, Homo sapiens
aggccagcctcaggcagggacc

SEQ ID NO: 10035427 - DNA, 22 bp, Homo sapiens
aggccagccctgggctgagaga

SEQ ID NO: 10035428 - DNA, 22 bp, Homo sapiens
aggccagcagcatgacggcatc

SEQ ID NO: 10035429 - DNA, 22 bp, Homo sapiens
aggccctgagcatccgagggca

SEQ ID NO: 10035430 - DNA, 22 bp, Homo sapiens
aggccctgagaaaatccctgca

SEQ ID NO: 10035431 - DNA, 22 bp, Homo sapiens
accctctggctcatttcctagt

SEQ ID NO: 10035432 - DNA, 22 bp, Homo sapiens
accctgggttcccgcagcacca

SEQ ID NO: 10035433 - DNA, 21 bp, Homo sapiens
accctgggttctccataccct

SEQ ID NO: 10035434 - DNA, 22 bp, Homo sapiens
accctgggtctcaatcatccta

SEQ ID NO: 10035435 - DNA, 22 bp, Homo sapiens
accctgggtgagaggcaaacag

SEQ ID NO: 10035436 - DNA, 22 bp, Homo sapiens
accctggggtcacccttctctg

SEQ ID NO: 10035437 - DNA, 16 bp, Homo sapiens
accctgggtagtcctg

SEQ ID NO: 10035438 - DNA, 22 bp, Homo sapiens
accctgggtatttcccaaactt

SEQ ID NO: 10035439 - DNA, 22 bp, Homo sapiens
accctgggtcatatacagtgtg

SEQ ID NO: 10035440 - DNA, 22 bp, Homo sapiens
accctgggcttggcctgctcag

SEQ ID NO: 10035441 - DNA, 22 bp, Homo sapiens
accctgggggtggccagtgcca

SEQ ID NO: 10035442 - DNA, 22 bp, Homo sapiens
accctgggaactggaaactgga

SEQ ID NO: 10035443 - DNA, 22 bp, Homo sapiens
accctgggacctggaggtggat

SEQ ID NO: 10035444 - DNA, 22 bp, Homo sapiens
accctgggacttccgagttgag

SEQ ID NO: 10035445 - DNA, 18 bp, Homo sapiens
accctgggcaattcactc

SEQ ID NO: 10035446 - DNA, 22 bp, Homo sapiens
accctgggcacaccatttcccc

SEQ ID NO: 10035447 - DNA, 23 bp, Homo sapiens
accctgggcaagtcacctaacct

SEQ ID NO: 10035448 - DNA, 22 bp, Homo sapiens
accctgggagggagaaatcaga

SEQ ID NO: 10035449 - DNA, 22 bp, Homo sapiens
accaggagccacaggaggagcc

SEQ ID NO: 10035450 - DNA, 23 bp, Homo sapiens
accaggagccaagatctccctgg

SEQ ID NO: 10035451 - DNA, 22 bp, Homo sapiens
accaggagcattttttattagt

SEQ ID NO: 10035452 - DNA, 20 bp, Homo sapiens
accaggagatggaggcaggg

SEQ ID NO: 10035453 - DNA, 22 bp, Homo sapiens
accaggaggccttggttctgag

SEQ ID NO: 10035454 - DNA, 22 bp, Homo sapiens
accaggaggctacactgtccca

SEQ ID NO: 10035455 - DNA, 22 bp, Homo sapiens
accaggaggaagtgttaatgat

SEQ ID NO: 10035456 - DNA, 22 bp, Homo sapiens
accaggagccatagagtcaggc

SEQ ID NO: 10035457 - DNA, 22 bp, Homo sapiens
accaggaggcctggagcacaaa

SEQ ID NO: 10035458 - DNA, 22 bp, Homo sapiens
accaggagaggcacttgcaatg

SEQ ID NO: 10035459 - DNA, 22 bp, Homo sapiens
accaggagagattttattgaga

SEQ ID NO: 10035460 - DNA, 22 bp, Homo sapiens
accaggagacatgaccaatgag

SEQ ID NO: 10035461 - DNA, 23 bp, Homo sapiens
accaggagaaaagctttgcggga

SEQ ID NO: 10035462 - DNA, 19 bp, Homo sapiens
accaggagacagtgagctt

SEQ ID NO: 10035463 - DNA, 22 bp, Homo sapiens
accagttttttatacatcttct

SEQ ID NO: 10035464 - DNA, 22 bp, Homo sapiens
accaggagggaccctggtggcc

SEQ ID NO: 10035465 - DNA, 22 bp, Homo sapiens
accaggaggtgtttgctcaagt

SEQ ID NO: 10035466 - DNA, 22 bp, Homo sapiens
accaggagtaacagtgagtggt

SEQ ID NO: 10035467 - DNA, 19 bp, Homo sapiens
accaggagtatcagagctg

SEQ ID NO: 10035468 - DNA, 22 bp, Homo sapiens
accaggagtagaatatctgtga

SEQ ID NO: 10035469 - DNA, 22 bp, Homo sapiens
accaggagttgggggtgggacc

SEQ ID NO: 10035470 - DNA, 22 bp, Homo sapiens
accaggagtctagcctagtcaa

SEQ ID NO: 10035471 - DNA, 22 bp, Homo sapiens
agatggcaggggtacctggaag

SEQ ID NO: 10035472 - DNA, 17 bp, Homo sapiens
agatggcaggaggcaga

SEQ ID NO: 10035473 - DNA, 19 bp, Homo sapiens
agatggcaaaatgcaaaga

SEQ ID NO: 10035474 - DNA, 22 bp, Homo sapiens
agagtggcaccttacctgagac

SEQ ID NO: 10035475 - DNA, 22 bp, Homo sapiens
attggtagttttgtatttctct

SEQ ID NO: 10035476 - DNA, 22 bp, Homo sapiens
agatgtgtttctagttcctgca

SEQ ID NO: 10035477 - DNA, 22 bp, Homo sapiens
attttcagaacattcattcact

SEQ ID NO: 10035478 - DNA, 22 bp, Homo sapiens
attttatgacacgattcttcca

SEQ ID NO: 10035479 - DNA, 20 bp, Homo sapiens
agcaagagtaaggacagcga

SEQ ID NO: 10035480 - DNA, 22 bp, Homo sapiens
agagtgcaaccgaaacaagcag

SEQ ID NO: 10035481 - DNA, 22 bp, Homo sapiens
agagtgcttaaagctggctttg

SEQ ID NO: 10035482 - DNA, 22 bp, Homo sapiens
agagtgcagataagagaatgtt

SEQ ID NO: 10035483 - DNA, 18 bp, Homo sapiens
agaggggaggtaagtctg

SEQ ID NO: 10035484 - DNA, 22 bp, Homo sapiens
agaggggagtcctaatctgatt

SEQ ID NO: 10035485 - DNA, 22 bp, Homo sapiens
agaggggaggcgaaccagagtc

SEQ ID NO: 10035486 - DNA, 23 bp, Homo sapiens
agaggggagcatctgctggctga

SEQ ID NO: 10035487 - DNA, 22 bp, Homo sapiens
agaggggagagctaagcaattc

SEQ ID NO: 10035488 - DNA, 22 bp, Homo sapiens
agaggggacagccacctgcccg

SEQ ID NO: 10035489 - DNA, 22 bp, Homo sapiens
agaggggaagtaatgaatgata

SEQ ID NO: 10035490 - DNA, 22 bp, Homo sapiens
agaggggaaggatgtgatgtga

SEQ ID NO: 10035491 - DNA, 22 bp, Homo sapiens
agagggcagggcggtaagtcct

SEQ ID NO: 10035492 - DNA, 22 bp, Homo sapiens
agagggcagtctcagattggga

SEQ ID NO: 10035493 - DNA, 22 bp, Homo sapiens
attacagagtcttgggaggtca

SEQ ID NO: 10035494 - DNA, 23 bp, Homo sapiens
agaggcaggagtggcttgcccgg

SEQ ID NO: 10035495 - DNA, 22 bp, Homo sapiens
attacacagcggttactactag

SEQ ID NO: 10035496 - DNA, 22 bp, Homo sapiens
attacacaggatttgccttact

SEQ ID NO: 10035497 - DNA, 22 bp, Homo sapiens
attacacaggctggctctttga

SEQ ID NO: 10035498 - DNA, 22 bp, Homo sapiens
attacacatagacattcgttca

SEQ ID NO: 10035499 - DNA, 22 bp, Homo sapiens
agaggccactttgcctgtgatg

SEQ ID NO: 10035500 - DNA, 22 bp, Homo sapiens
atgaagctaaaccctgcagcca

SEQ ID NO: 10035501 - DNA, 22 bp, Homo sapiens
atgaagctggttttggcttggg

SEQ ID NO: 10035502 - DNA, 22 bp, Homo sapiens
atgaagctgaccttgtcttgct

SEQ ID NO: 10035503 - DNA, 22 bp, Homo sapiens
agacgagggcctggcacacagt

SEQ ID NO: 10035504 - DNA, 22 bp, Homo sapiens
agacgagggcccccaggacagc

SEQ ID NO: 10035505 - DNA, 22 bp, Homo sapiens
agacctggtttatcaccagcat

SEQ ID NO: 10035506 - DNA, 22 bp, Homo sapiens
agacctggtaagcaggttgggc

SEQ ID NO: 10035507 - DNA, 22 bp, Homo sapiens
agacctgggttcgagtcctaac

SEQ ID NO: 10035508 - DNA, 22 bp, Homo sapiens
agacctgggtgccctgtgcttt

SEQ ID NO: 10035509 - DNA, 22 bp, Homo sapiens
agacctggagtggggcctcagg

SEQ ID NO: 10035510 - DNA, 22 bp, Homo sapiens
agacctggatgtgagggaagta

SEQ ID NO: 10035511 - DNA, 22 bp, Homo sapiens
agacctggattccaatcctacc

SEQ ID NO: 10035512 - DNA, 22 bp, Homo sapiens
agacctggagtgaagagttccc

SEQ ID NO: 10035513 - DNA, 22 bp, Homo sapiens
agacctggaagttcaagagaaa

SEQ ID NO: 10035514 - DNA, 22 bp, Homo sapiens
agacctggagacctgagtggta

SEQ ID NO: 10035515 - DNA, 22 bp, Homo sapiens
atgcatttttgagtatgaatga

SEQ ID NO: 10035516 - DNA, 22 bp, Homo sapiens
agagcctgaggatgtcccagct

SEQ ID NO: 10035517 - DNA, 22 bp, Homo sapiens
agagcagcacgttgtccccaca

SEQ ID NO: 10035518 - DNA, 20 bp, Homo sapiens
agagcagcagttggtgaggt

SEQ ID NO: 10035519 - DNA, 22 bp, Homo sapiens
agagcagatggagctggaagag

SEQ ID NO: 10035520 - DNA, 22 bp, Homo sapiens
agagattgtgctactcacccaa

SEQ ID NO: 10035521 - DNA, 22 bp, Homo sapiens
agagagttctttctagttgaag

SEQ ID NO: 10035522 - DNA, 21 bp, Homo sapiens
agagagggagatgaaacatcc

SEQ ID NO: 10035523 - DNA, 22 bp, Homo sapiens
agagaggttaaggagctcttgt

SEQ ID NO: 10035524 - DNA, 22 bp, Homo sapiens
agagagggcatagaaaaaggga

SEQ ID NO: 10035525 - DNA, 22 bp, Homo sapiens
agagagcctgagtggcagctat

SEQ ID NO: 10035526 - DNA, 22 bp, Homo sapiens
agagagcattgaggaaatcttc

SEQ ID NO: 10035527 - DNA, 21 bp, Homo sapiens
agagacagagaaagtaacatt

SEQ ID NO: 10035528 - DNA, 22 bp, Homo sapiens
agagaagtgtcatttcagtttt

SEQ ID NO: 10035529 - DNA, 22 bp, Homo sapiens
agagaagtgagcttgttcactc

SEQ ID NO: 10035530 - DNA, 22 bp, Homo sapiens
cagagacatccattttatatgc

SEQ ID NO: 10035531 - DNA, 21 bp, Homo sapiens
agccagctatcacacagcatt

SEQ ID NO: 10035532 - DNA, 22 bp, Homo sapiens
cagagaccctaggcaggtgaca

SEQ ID NO: 10035533 - DNA, 22 bp, Homo sapiens
cagagccttagttctcctagaa

SEQ ID NO: 10035534 - DNA, 22 bp, Homo sapiens
agccagagttgaatgtgagtct

SEQ ID NO: 10035535 - DNA, 22 bp, Homo sapiens
agccctgagccagcctggtcag

SEQ ID NO: 10035536 - DNA, 22 bp, Homo sapiens
agccctgagctggcctgggctt

SEQ ID NO: 10035537 - DNA, 22 bp, Homo sapiens
agccctgattaaccttggcttt

SEQ ID NO: 10035538 - DNA, 22 bp, Homo sapiens
agccctggaagccacagtccta

SEQ ID NO: 10035539 - DNA, 22 bp, Homo sapiens
agccctggaccttagcccccac

SEQ ID NO: 10035540 - DNA, 22 bp, Homo sapiens
agccctggattctgaggtccaa

SEQ ID NO: 10035541 - DNA, 22 bp, Homo sapiens
agccctggagcaaaggtgtctt

SEQ ID NO: 10035542 - DNA, 22 bp, Homo sapiens
agccctggatggacagtttccc

SEQ ID NO: 10035543 - DNA, 22 bp, Homo sapiens
agccctggcagagccaggtagt

SEQ ID NO: 10035544 - DNA, 22 bp, Homo sapiens
agccctggcccggctgtgcttt

SEQ ID NO: 10035545 - DNA, 22 bp, Homo sapiens
agccctggctcccagcagcgct

SEQ ID NO: 10035546 - DNA, 22 bp, Homo sapiens
agccctgggcacctgtgagggg

SEQ ID NO: 10035547 - DNA, 22 bp, Homo sapiens
agccctgggaggccagcttgta

SEQ ID NO: 10035548 - DNA, 22 bp, Homo sapiens
agccctgggcgttactgggatg

SEQ ID NO: 10035549 - DNA, 22 bp, Homo sapiens
agcccagggacagggcggatgt

SEQ ID NO: 10035550 - DNA, 21 bp, Homo sapiens
agcctgggtatcctttgagga

SEQ ID NO: 10035551 - DNA, 22 bp, Homo sapiens
agctacttccctgtaggaaaca

SEQ ID NO: 10035552 - DNA, 22 bp, Homo sapiens
agctacccgaggacaggctaag

SEQ ID NO: 10035553 - DNA, 22 bp, Homo sapiens
agctagctttaactcttagaca

SEQ ID NO: 10035554 - DNA, 22 bp, Homo sapiens
agctagcctaggcagagtgcat

SEQ ID NO: 10035555 - DNA, 22 bp, Homo sapiens
agctccagcccatctgctcgtg

SEQ ID NO: 10035556 - DNA, 19 bp, Homo sapiens
agctccaggcctggatgct

SEQ ID NO: 10035557 - DNA, 21 bp, Homo sapiens
agctccaggctcctggggttc

SEQ ID NO: 10035558 - DNA, 22 bp, Homo sapiens
agctctgggattctcaggccac

SEQ ID NO: 10035559 - DNA, 22 bp, Homo sapiens
cacagcagaaagtgtaggagga

SEQ ID NO: 10035560 - DNA, 22 bp, Homo sapiens
cacagcagaaatatgaaggcag

SEQ ID NO: 10035561 - DNA, 22 bp, Homo sapiens
cacagcagacagggaggcggct

SEQ ID NO: 10035562 - DNA, 22 bp, Homo sapiens
cacagcagatccaggggttgtg

SEQ ID NO: 10035563 - DNA, 22 bp, Homo sapiens
caccagctacagactactgtgt

SEQ ID NO: 10035564 - DNA, 22 bp, Homo sapiens
agcagggctctgccatgggccc

SEQ ID NO: 10035565 - DNA, 22 bp, Homo sapiens
caccagcagcggtgtgagggtg

SEQ ID NO: 10035566 - DNA, 22 bp, Homo sapiens
caccagcagaagactgagggtg

SEQ ID NO: 10035567 - DNA, 22 bp, Homo sapiens
agcaggtgtcggcgagggtctt

SEQ ID NO: 10035568 - DNA, 22 bp, Homo sapiens
agcagtcagtcctgaatgaagg

SEQ ID NO: 10035569 - DNA, 22 bp, Homo sapiens
agcagtcattttaggtcatgca

SEQ ID NO: 10035570 - DNA, 22 bp, Homo sapiens
agcagtcaggacctgtgatttt

SEQ ID NO: 10035571 - DNA, 19 bp, Homo sapiens
cactgtggtccttcactgc

SEQ ID NO: 10035572 - DNA, 19 bp, Homo sapiens
agcagctggaggtggagtg

SEQ ID NO: 10035573 - DNA, 21 bp, Homo sapiens
agcagcagatctggtgagggc

SEQ ID NO: 10035574 - DNA, 19 bp, Homo sapiens
agcagcagaagtgtgcctt

SEQ ID NO: 10035575 - DNA, 22 bp, Homo sapiens
agcagcagagctctggtctgca

SEQ ID NO: 10035576 - DNA, 22 bp, Homo sapiens
agcagcagaggtcagaaaggta

SEQ ID NO: 10035577 - DNA, 22 bp, Homo sapiens
agcagcagatcaaacaggcttg

SEQ ID NO: 10035578 - DNA, 21 bp, Homo sapiens
agcagaggcagaatgtatgca

SEQ ID NO: 10035579 - DNA, 21 bp, Homo sapiens
agcagaggctgcctggtgact

SEQ ID NO: 10035580 - DNA, 22 bp, Homo sapiens
agcagaggaggatttagttagg

SEQ ID NO: 10035581 - DNA, 21 bp, Homo sapiens
agcagaggggacatgtttgat

SEQ ID NO: 10035582 - DNA, 22 bp, Homo sapiens
agcagaggtgtttattatggga

SEQ ID NO: 10035583 - DNA, 22 bp, Homo sapiens
agcagaggtttgttggaaacct

SEQ ID NO: 10035584 - DNA, 23 bp, Homo sapiens
agcacctgtgatttcctagctct

SEQ ID NO: 10035585 - DNA, 19 bp, Homo sapiens
agcacctgtgagagcctgg

SEQ ID NO: 10035586 - DNA, 22 bp, Homo sapiens
agcacctgggctggaagacccc

SEQ ID NO: 10035587 - DNA, 22 bp, Homo sapiens
agcacctggtctcctggcgctg

SEQ ID NO: 10035588 - DNA, 22 bp, Homo sapiens
agcacctgtcaagtccaggctg

SEQ ID NO: 10035589 - DNA, 22 bp, Homo sapiens
agaaaataatttcttggctggt

SEQ ID NO: 10035590 - DNA, 23 bp, Homo sapiens
actgtctgatatgttttccatca

SEQ ID NO: 10035591 - DNA, 22 bp, Homo sapiens
actgtctgcaaaactcatactc

SEQ ID NO: 10035592 - DNA, 22 bp, Homo sapiens
actgtctgcacccgaggaggcc

SEQ ID NO: 10035593 - DNA, 22 bp, Homo sapiens
acctgggagagaggagccggcg

SEQ ID NO: 10035594 - DNA, 22 bp, Homo sapiens
acctgggaaaaggagtggccat

SEQ ID NO: 10035595 - DNA, 22 bp, Homo sapiens
acctgggaaagccgtggaaagg

SEQ ID NO: 10035596 - DNA, 22 bp, Homo sapiens
acctgggaggcggaggttgcag

SEQ ID NO: 10035597 - DNA, 22 bp, Homo sapiens
acctgggaggcagaggttgcag

SEQ ID NO: 10035598 - DNA, 20 bp, Homo sapiens
acctgggattagatacccaa

SEQ ID NO: 10035599 - DNA, 22 bp, Homo sapiens
acctgggatggggccaggttta

SEQ ID NO: 10035600 - DNA, 22 bp, Homo sapiens
acctgggagtcacacctgagaa

SEQ ID NO: 10035601 - DNA, 22 bp, Homo sapiens
acctgggagtatgcagtggtga

SEQ ID NO: 10035602 - DNA, 22 bp, Homo sapiens
aagtttgtggtcatttattata

SEQ ID NO: 10035603 - DNA, 22 bp, Homo sapiens
aagtttgttgtacatgttagta

SEQ ID NO: 10035604 - DNA, 22 bp, Homo sapiens
acatggtgagcggcaggcctat

SEQ ID NO: 10035605 - DNA, 22 bp, Homo sapiens
acattttgcccttatttgctga

SEQ ID NO: 10035606 - DNA, 22 bp, Homo sapiens
aagggcagcctgactcacggtc

SEQ ID NO: 10035607 - DNA, 22 bp, Homo sapiens
accaggcactcctgaggtctga

SEQ ID NO: 10035608 - DNA, 22 bp, Homo sapiens
accaggcagtatggtgctgcaa

SEQ ID NO: 10035609 - DNA, 22 bp, Homo sapiens
accaggcagctgggggtgatgt

SEQ ID NO: 10035610 - DNA, 22 bp, Homo sapiens
aagtaaaatgtttcctttatta

SEQ ID NO: 10035611 - DNA, 22 bp, Homo sapiens
aaggttgtctctttattatctt

SEQ ID NO: 10035612 - DNA, 22 bp, Homo sapiens
acaggagaccctgctggttctg

SEQ ID NO: 10035613 - DNA, 21 bp, Homo sapiens
acaggagaccgcctggcagtc

SEQ ID NO: 10035614 - DNA, 20 bp, Homo sapiens
acaggagatctgaggaaagg

SEQ ID NO: 10035615 - DNA, 22 bp, Homo sapiens
acaggtcagataaaggctggtg

SEQ ID NO: 10035616 - DNA, 22 bp, Homo sapiens
acagtttacagggatttgagct

SEQ ID NO: 10035617 - DNA, 20 bp, Homo sapiens
acagtgggtggggagcactg

SEQ ID NO: 10035618 - DNA, 22 bp, Homo sapiens
agcagcagctcagttctcagct

SEQ ID NO: 10035619 - DNA, 22 bp, Homo sapiens
agcagcagctcattcttcctgt

SEQ ID NO: 10035620 - DNA, 22 bp, Homo sapiens
agcagcagttgctgacgttcta

SEQ ID NO: 10035621 - DNA, 22 bp, Homo sapiens
agcagcagattcagcaggaatg

SEQ ID NO: 10035622 - DNA, 22 bp, Homo sapiens
agcagcagattatggtctacat

SEQ ID NO: 10035623 - DNA, 23 bp, Homo sapiens
agcagcagcaattaagtggatat

SEQ ID NO: 10035624 - DNA, 19 bp, Homo sapiens
agcagcagcaccagggatt

SEQ ID NO: 10035625 - DNA, 21 bp, Homo sapiens
agcagcagcagtggggcttct

SEQ ID NO: 10035626 - DNA, 22 bp, Homo sapiens
agcagcagcattgagcgcttgt

SEQ ID NO: 10035627 - DNA, 20 bp, Homo sapiens
agcaggtgacggggcctgct

SEQ ID NO: 10035628 - DNA, 22 bp, Homo sapiens
agcaggtgacagggctgtggtg

SEQ ID NO: 10035629 - DNA, 22 bp, Homo sapiens
agcatcctgcttgctgtctgtg

SEQ ID NO: 10035630 - DNA, 22 bp, Homo sapiens
agcatctagcaattgtcctctt

SEQ ID NO: 10035631 - DNA, 22 bp, Homo sapiens
agcccaggtggagtgtgtgggg

SEQ ID NO: 10035632 - DNA, 22 bp, Homo sapiens
agcccaggttctaaagccaaac

SEQ ID NO: 10035633 - DNA, 22 bp, Homo sapiens
agcccaggtgaggggttcgaaa

SEQ ID NO: 10035634 - DNA, 22 bp, Homo sapiens
agcccaggtctcaaagtacagg

SEQ ID NO: 10035635 - DNA, 22 bp, Homo sapiens
agccctggtagcctgctgccat

SEQ ID NO: 10035636 - DNA, 22 bp, Homo sapiens
agccctggggtgcagaaccatg

SEQ ID NO: 10035637 - DNA, 22 bp, Homo sapiens
agccctggggctggtgcttacc

SEQ ID NO: 10035638 - DNA, 22 bp, Homo sapiens
agccctgggtcccagtcctggc

SEQ ID NO: 10035639 - DNA, 22 bp, Homo sapiens
agccctggggctggtcttggaa

SEQ ID NO: 10035640 - DNA, 22 bp, Homo sapiens
agccctgggctgtagataagca

SEQ ID NO: 10035641 - DNA, 22 bp, Homo sapiens
agagagagggaaactgctaaac

SEQ ID NO: 10035642 - DNA, 17 bp, Homo sapiens
agagagagcatgccacc

SEQ ID NO: 10035643 - DNA, 22 bp, Homo sapiens
agacactgatgttcagctcaat

SEQ ID NO: 10035644 - DNA, 22 bp, Homo sapiens
agacactgccacttctgttccc

SEQ ID NO: 10035645 - DNA, 22 bp, Homo sapiens
aatggaatacctaggtggccca

SEQ ID NO: 10035646 - DNA, 22 bp, Homo sapiens
agagcagctggggcagagacca

SEQ ID NO: 10035647 - DNA, 22 bp, Homo sapiens
agagcagctgtgacatggacag

SEQ ID NO: 10035648 - DNA, 22 bp, Homo sapiens
agaggcagtatacaatccgagc

SEQ ID NO: 10035649 - DNA, 21 bp, Homo sapiens
agaggcaggcattaagtacac

SEQ ID NO: 10035650 - DNA, 19 bp, Homo sapiens
agaggcagtctccaacagg

SEQ ID NO: 10035651 - DNA, 22 bp, Homo sapiens
agagtctggcgctgagatgaca

SEQ ID NO: 10035652 - DNA, 22 bp, Homo sapiens
agagtctggtgcatgataagca

SEQ ID NO: 10035653 - DNA, 22 bp, Homo sapiens
agattatttccagactaatgaa

SEQ ID NO: 10035654 - DNA, 22 bp, Homo sapiens
agatcggctttgcagacctcat

SEQ ID NO: 10035655 - DNA, 22 bp, Homo sapiens
aactatgttaataagtttcatt

SEQ ID NO: 10035656 - DNA, 22 bp, Homo sapiens
aacaagaacacctacagttcta

SEQ ID NO: 10035657 - DNA, 22 bp, Homo sapiens
aacacaaagaagctgcaggatc

SEQ ID NO: 10035658 - DNA, 23 bp, Homo sapiens
aaatggtccttggctggcatctt

SEQ ID NO: 10035659 - DNA, 18 bp, Homo sapiens
aagaggaggagcaggttg

SEQ ID NO: 10035660 - DNA, 22 bp, Homo sapiens
aagaggagacttcagcaacttg

SEQ ID NO: 10035661 - DNA, 18 bp, Homo sapiens
aagaggaggaaacccagg

SEQ ID NO: 10035662 - DNA, 22 bp, Homo sapiens
aagaggaggacggttcccagaa

SEQ ID NO: 10035663 - DNA, 22 bp, Homo sapiens
aagcaaaggcaggagcttgtga

SEQ ID NO: 10035664 - DNA, 22 bp, Homo sapiens
aagaaaggatatatgggaggta

SEQ ID NO: 10035665 - DNA, 22 bp, Homo sapiens
aagaaagtgctttgtaaattat

SEQ ID NO: 10035666 - DNA, 22 bp, Homo sapiens
aagaatgtcaagcagaaggtct

SEQ ID NO: 10035667 - DNA, 17 bp, Homo sapiens
aagacagaagccatgag

SEQ ID NO: 10035668 - DNA, 22 bp, Homo sapiens
aagacagagactctgcaacagg

SEQ ID NO: 10035669 - DNA, 22 bp, Homo sapiens
aagagcagtgttttactcagct

SEQ ID NO: 10035670 - DNA, 20 bp, Homo sapiens
aagagaggaagttatactag

SEQ ID NO: 10035671 - DNA, 22 bp, Homo sapiens
aagagcatcaatgactcgcagt

SEQ ID NO: 10035672 - DNA, 22 bp, Homo sapiens
aaatgcagctgggcatgagagg

SEQ ID NO: 10035673 - DNA, 22 bp, Homo sapiens
aaatataatttctgcctcaata

SEQ ID NO: 10035674 - DNA, 23 bp, Homo sapiens
aaactaagggagtagatgagatg

SEQ ID NO: 10035675 - DNA, 22 bp, Homo sapiens
aaactaagggagatgtgggctg

SEQ ID NO: 10035676 - DNA, 22 bp, Homo sapiens
aaaaagacttccaactcaggag

SEQ ID NO: 10035677 - DNA, 22 bp, Homo sapiens
aaaaagactagtcgagtgcagt

SEQ ID NO: 10035678 - DNA, 22 bp, Homo sapiens
aaaaagacagaggatgaggcag

SEQ ID NO: 10035679 - DNA, 22 bp, Homo sapiens
aagggaggccagaggttttgca

SEQ ID NO: 10035680 - DNA, 22 bp, Homo sapiens
aagggaggaggatttattgtac

SEQ ID NO: 10035681 - DNA, 22 bp, Homo sapiens
aagccagtaagtttttgtcatt

SEQ ID NO: 10035682 - DNA, 22 bp, Homo sapiens
aagaattggtttcctctgtcat

SEQ ID NO: 10035683 - DNA, 22 bp, Homo sapiens
aagagtttaccagtgctgcttc

SEQ ID NO: 10035684 - DNA, 22 bp, Homo sapiens
aagagtttaattttgtctagac

SEQ ID NO: 10035685 - DNA, 23 bp, Homo sapiens
aagagtttagagtcttgcagagt

SEQ ID NO: 10035686 - DNA, 22 bp, Homo sapiens
aagagtttatgatataacatgt

SEQ ID NO: 10035687 - DNA, 22 bp, Homo sapiens
aagaggcagtggtgatgaatgg

SEQ ID NO: 10035688 - DNA, 22 bp, Homo sapiens
acagatgaaacccagctagttg

SEQ ID NO: 10035689 - DNA, 22 bp, Homo sapiens
ggcagtgggtggatctcaggga

SEQ ID NO: 10035690 - DNA, 22 bp, Homo sapiens
ggcaggagaatggcgtgaactc

SEQ ID NO: 10035691 - DNA, 22 bp, Homo sapiens
ggccagctgtaagctgctgaat

SEQ ID NO: 10035692 - DNA, 22 bp, Homo sapiens
ggcatgctgcgtacagatgaac

SEQ ID NO: 10035693 - DNA, 22 bp, Homo sapiens
ggcatgctctttgtccacagta

SEQ ID NO: 10035694 - DNA, 22 bp, Homo sapiens
ggccagctttgagctgcaggaa

SEQ ID NO: 10035695 - DNA, 22 bp, Homo sapiens
ggccaggaagggaagatcagca

SEQ ID NO: 10035696 - DNA, 18 bp, Homo sapiens
ggcatctgcacagcagcc

SEQ ID NO: 10035697 - DNA, 22 bp, Homo sapiens
ggcatctccaaaacatgaactc

SEQ ID NO: 10035698 - DNA, 22 bp, Homo sapiens
ggccaggagaggagggcactga

SEQ ID NO: 10035699 - DNA, 22 bp, Homo sapiens
ggccaggagctgcacagggctc

SEQ ID NO: 10035700 - DNA, 22 bp, Homo sapiens
ggccgtgctccaaagtcatcgt

SEQ ID NO: 10035701 - DNA, 22 bp, Homo sapiens
ggccctgggcagaggagtgggc

SEQ ID NO: 10035702 - DNA, 22 bp, Homo sapiens
ggccctgggccctctagcttgt

SEQ ID NO: 10035703 - DNA, 22 bp, Homo sapiens
ggccctgggatgctcagcagtg

SEQ ID NO: 10035704 - DNA, 22 bp, Homo sapiens
ggccctggcagccacgaaagcc

SEQ ID NO: 10035705 - DNA, 22 bp, Homo sapiens
ggcagcagggtagccatttctc

SEQ ID NO: 10035706 - DNA, 22 bp, Homo sapiens
ggcagcagggtctagattgatg

SEQ ID NO: 10035707 - DNA, 22 bp, Homo sapiens
ggcagcagtaggagctaatctt

SEQ ID NO: 10035708 - DNA, 20 bp, Homo sapiens
ggcagcaggagtttcctctt

SEQ ID NO: 10035709 - DNA, 22 bp, Homo sapiens
ggcagctgtgaagtgcctcaca

SEQ ID NO: 10035710 - DNA, 17 bp, Homo sapiens
ggcagctgtgtgcatgc

SEQ ID NO: 10035711 - DNA, 22 bp, Homo sapiens
ggcagcttgtccttcaggagag

SEQ ID NO: 10035712 - DNA, 22 bp, Homo sapiens
ggcagcttgtcctggaggatgg

SEQ ID NO: 10035713 - DNA, 20 bp, Homo sapiens
ggcagcttgggcagcagtta

SEQ ID NO: 10035714 - DNA, 22 bp, Homo sapiens
ggcagctttcaatagggttatg

SEQ ID NO: 10035715 - DNA, 22 bp, Homo sapiens
ggcagctttctcacccatgacc

SEQ ID NO: 10035716 - DNA, 19 bp, Homo sapiens
ggcagcttgggaaggtagc

SEQ ID NO: 10035717 - DNA, 22 bp, Homo sapiens
ggcagcttcttaatatggagac

SEQ ID NO: 10035718 - DNA, 18 bp, Homo sapiens
ggcagcttgactagcaac

SEQ ID NO: 10035719 - DNA, 22 bp, Homo sapiens
ggcagcttctcccaggctgttt

SEQ ID NO: 10035720 - DNA, 22 bp, Homo sapiens
ggcagcttcctaggagagggca

SEQ ID NO: 10035721 - DNA, 22 bp, Homo sapiens
ggcagcttcctgagccagcagc

SEQ ID NO: 10035722 - DNA, 19 bp, Homo sapiens
ggcactggggccaggacca

SEQ ID NO: 10035723 - DNA, 22 bp, Homo sapiens
ggcagcagcaaggttggagctg

SEQ ID NO: 10035724 - DNA, 22 bp, Homo sapiens
ggcagcaggagccatctggtag

SEQ ID NO: 10035725 - DNA, 22 bp, Homo sapiens
ggatgaggaagattactgagaa

SEQ ID NO: 10035726 - DNA, 20 bp, Homo sapiens
ggctgctgtgggcagagagg

SEQ ID NO: 10035727 - DNA, 22 bp, Homo sapiens
ggctccagtttgtgccttcagc

SEQ ID NO: 10035728 - DNA, 22 bp, Homo sapiens
ggctctgtggctggccatgatg

SEQ ID NO: 10035729 - DNA, 23 bp, Homo sapiens
ggctctgtgctgggcctgcagga

SEQ ID NO: 10035730 - DNA, 22 bp, Homo sapiens
ggctctggttgaccatgatggc

SEQ ID NO: 10035731 - DNA, 22 bp, Homo sapiens
ggctctgtaaagtgacacctgc

SEQ ID NO: 10035732 - DNA, 22 bp, Homo sapiens
ggctctgggccagagttggctt

SEQ ID NO: 10035733 - DNA, 22 bp, Homo sapiens
ggctcctgagaatgggccatca

SEQ ID NO: 10035734 - DNA, 22 bp, Homo sapiens
ggctcctgaggaccaggcacag

SEQ ID NO: 10035735 - DNA, 22 bp, Homo sapiens
gggagggaggtgatgcttggct

SEQ ID NO: 10035736 - DNA, 22 bp, Homo sapiens
gggaggtgattaggaccatgta

SEQ ID NO: 10035737 - DNA, 22 bp, Homo sapiens
gggaggtgatggcaagcagcgg

SEQ ID NO: 10035738 - DNA, 22 bp, Homo sapiens
gggcactggaaggctctcaggc

SEQ ID NO: 10035739 - DNA, 22 bp, Homo sapiens
gggcactgctttgctctgtcac

SEQ ID NO: 10035740 - DNA, 22 bp, Homo sapiens
gggcactgagtggatgatgcag

SEQ ID NO: 10035741 - DNA, 22 bp, Homo sapiens
gggcactgaacaccctcttcgc

SEQ ID NO: 10035742 - DNA, 22 bp, Homo sapiens
gggcacaggagaaggatctggc

SEQ ID NO: 10035743 - DNA, 22 bp, Homo sapiens
gggcacagtctaaagttgggcc

SEQ ID NO: 10035744 - DNA, 22 bp, Homo sapiens
gggcagtgttgctctcaaagtc

SEQ ID NO: 10035745 - DNA, 22 bp, Homo sapiens
gggcagtgacaaaggggatgaa

SEQ ID NO: 10035746 - DNA, 22 bp, Homo sapiens
gggcactggccgcccatccctg

SEQ ID NO: 10035747 - DNA, 22 bp, Homo sapiens
gtccctggagctgagcagtgct

SEQ ID NO: 10035748 - DNA, 22 bp, Homo sapiens
gtagctctgtttaaagttcttt

SEQ ID NO: 10035749 - DNA, 22 bp, Homo sapiens
gtagctgcatattttcttagaa

SEQ ID NO: 10035750 - DNA, 22 bp, Homo sapiens
gtgaggtgagtagtgagaagcc

SEQ ID NO: 10035751 - DNA, 22 bp, Homo sapiens
gtgatgtggggaccgtcctggc

SEQ ID NO: 10035752 - DNA, 22 bp, Homo sapiens
gtcttatttaaggacaagaaga

SEQ ID NO: 10035753 - DNA, 22 bp, Homo sapiens
gtgccctggctcacagtgtctc

SEQ ID NO: 10035754 - DNA, 22 bp, Homo sapiens
gtgccctggatgactttggtct

SEQ ID NO: 10035755 - DNA, 22 bp, Homo sapiens
gtgccctgggccttcagggcca

SEQ ID NO: 10035756 - DNA, 22 bp, Homo sapiens
gtgccctgtgaactgtaaggaa

SEQ ID NO: 10035757 - DNA, 20 bp, Homo sapiens
gtgccctgtgggctattttc

SEQ ID NO: 10035758 - DNA, 22 bp, Homo sapiens
gtgccctgttcatttctctccc

SEQ ID NO: 10035759 - DNA, 21 bp, Homo sapiens
gtgccctgttcccacatgccc

SEQ ID NO: 10035760 - DNA, 22 bp, Homo sapiens
gtgcctctcattggctgagccc

SEQ ID NO: 10035761 - DNA, 22 bp, Homo sapiens
gtgcctctgaccggagaccagg

SEQ ID NO: 10035762 - DNA, 22 bp, Homo sapiens
gtgctgggattacaggtgtgag

SEQ ID NO: 10035763 - DNA, 22 bp, Homo sapiens
gtgccctgagtgggtaggagag

SEQ ID NO: 10035764 - DNA, 22 bp, Homo sapiens
gtgccctgatcgctaggctccc

SEQ ID NO: 10035765 - DNA, 22 bp, Homo sapiens
gtgccctgagcttatgcattct

SEQ ID NO: 10035766 - DNA, 22 bp, Homo sapiens
ggggatggaatgtagtagtgat

SEQ ID NO: 10035767 - DNA, 22 bp, Homo sapiens
ggggatggaggcgtgtggtcct

SEQ ID NO: 10035768 - DNA, 22 bp, Homo sapiens
ggggatggattccgggtccctg

SEQ ID NO: 10035769 - DNA, 22 bp, Homo sapiens
ggggcagctcccgagggcagga

SEQ ID NO: 10035770 - DNA, 22 bp, Homo sapiens
gggctcctggcagtcatgctca

SEQ ID NO: 10035771 - DNA, 22 bp, Homo sapiens
gggctcctcctctgactgtggc

SEQ ID NO: 10035772 - DNA, 20 bp, Homo sapiens
gggctccagctgtgattctt

SEQ ID NO: 10035773 - DNA, 22 bp, Homo sapiens
gggcagtgttgtggttctctat

SEQ ID NO: 10035774 - DNA, 23 bp, Homo sapiens
gggcagttatgttgtccttggct

SEQ ID NO: 10035775 - DNA, 22 bp, Homo sapiens
gggcagttgatggaggtctgga

SEQ ID NO: 10035776 - DNA, 22 bp, Homo sapiens
gggcagtttattctagatggtt

SEQ ID NO: 10035777 - DNA, 20 bp, Homo sapiens
gggcagttcaatgccactct

SEQ ID NO: 10035778 - DNA, 21 bp, Homo sapiens
gggcctggctgcgcaggacgg

SEQ ID NO: 10035779 - DNA, 22 bp, Homo sapiens
gggtcagtccagggcgctggga

SEQ ID NO: 10035780 - DNA, 23 bp, Homo sapiens
gggtccagagacaggcatgggtg

SEQ ID NO: 10035781 - DNA, 23 bp, Homo sapiens
gggtccagagaagccattagggc

SEQ ID NO: 10035782 - DNA, 19 bp, Homo sapiens
ggtcagctgggctagaggc

SEQ ID NO: 10035783 - DNA, 23 bp, Homo sapiens
ggtccaggaaaggcagcagcacc

SEQ ID NO: 10035784 - DNA, 22 bp, Homo sapiens
ggtccagccaggtgctcatgcc

SEQ ID NO: 10035785 - DNA, 22 bp, Homo sapiens
ggtgccagcctagtgcagtggt

SEQ ID NO: 10035786 - DNA, 22 bp, Homo sapiens
ggtgcagtggtgtggcaaaggg

SEQ ID NO: 10035787 - DNA, 22 bp, Homo sapiens
ggtgaagggccttaggagacag

SEQ ID NO: 10035788 - DNA, 22 bp, Homo sapiens
ggtgaaggcacaagagggcaag

SEQ ID NO: 10035789 - DNA, 22 bp, Homo sapiens
ggtgaaggtcagagcaggaaaa

SEQ ID NO: 10035790 - DNA, 22 bp, Homo sapiens
ggtgaagggtgtcatggcattt

SEQ ID NO: 10035791 - DNA, 22 bp, Homo sapiens
ggtgaaggtggaacgcagagca

SEQ ID NO: 10035792 - DNA, 22 bp, Homo sapiens
ggtctgtctgcctcaggagatg

SEQ ID NO: 10035793 - DNA, 22 bp, Homo sapiens
gcatctttagcctctccgtggc

SEQ ID NO: 10035794 - DNA, 22 bp, Homo sapiens
gccaggagttcagatgcatgtt

SEQ ID NO: 10035795 - DNA, 22 bp, Homo sapiens
gccaggagccctgggcaagttc

SEQ ID NO: 10035796 - DNA, 22 bp, Homo sapiens
gccaggagccagcttcttagca

SEQ ID NO: 10035797 - DNA, 22 bp, Homo sapiens
gccaggaggctgctgtgtaggc

SEQ ID NO: 10035798 - DNA, 22 bp, Homo sapiens
gccaggagaatgctagcagagg

SEQ ID NO: 10035799 - DNA, 22 bp, Homo sapiens
gccaggagactccattcatttg

SEQ ID NO: 10035800 - DNA, 22 bp, Homo sapiens
gccaggagcatgtcattgttga

SEQ ID NO: 10035801 - DNA, 22 bp, Homo sapiens
gccaggagagctccttcaggtt

SEQ ID NO: 10035802 - DNA, 22 bp, Homo sapiens
gccaggagaaaaggcgaatgat

SEQ ID NO: 10035803 - DNA, 23 bp, Homo sapiens
gcccagagaggctcaccaggaat

SEQ ID NO: 10035804 - DNA, 22 bp, Homo sapiens
gcctcagctgttgcaggggccc

SEQ ID NO: 10035805 - DNA, 22 bp, Homo sapiens
gcctactgagaccacagacagt

SEQ ID NO: 10035806 - DNA, 22 bp, Homo sapiens
gcctcagacactgcctgggtgt

SEQ ID NO: 10035807 - DNA, 22 bp, Homo sapiens
gccctgaggggtggtgtctgta

SEQ ID NO: 10035808 - DNA, 22 bp, Homo sapiens
gccctgagccaccaatgccatt

SEQ ID NO: 10035809 - DNA, 22 bp, Homo sapiens
gccctgagcactgctgctgggg

SEQ ID NO: 10035810 - DNA, 22 bp, Homo sapiens
gccctgagaggcaatgactctt

SEQ ID NO: 10035811 - DNA, 19 bp, Homo sapiens
gccctgagagcttgggttc

SEQ ID NO: 10035812 - DNA, 22 bp, Homo sapiens
gccctgagcacacagtagcaaa

SEQ ID NO: 10035813 - DNA, 22 bp, Homo sapiens
gccctgagattcttggattctg

SEQ ID NO: 10035814 - DNA, 22 bp, Homo sapiens
gccctgagctagtgtgggcagg

SEQ ID NO: 10035815 - DNA, 22 bp, Homo sapiens
gccctgaggatttgcatttcct

SEQ ID NO: 10035816 - DNA, 22 bp, Homo sapiens
gccctgaggcaaaagaacagtc

SEQ ID NO: 10035817 - DNA, 22 bp, Homo sapiens
gccctgagcctatgagcctctc

SEQ ID NO: 10035818 - DNA, 22 bp, Homo sapiens
gccctgagactgagcatgggtt

SEQ ID NO: 10035819 - DNA, 22 bp, Homo sapiens
gccctgagactgaagaactgtc

SEQ ID NO: 10035820 - DNA, 22 bp, Homo sapiens
gccctgagaatgtgtgtgtcta

SEQ ID NO: 10035821 - DNA, 22 bp, Homo sapiens
gccctgagaagaagtcggaggg

SEQ ID NO: 10035822 - DNA, 22 bp, Homo sapiens
gcccagggcttcaaagagagaa

SEQ ID NO: 10035823 - DNA, 22 bp, Homo sapiens
gcccatggacacccaagtgcca

SEQ ID NO: 10035824 - DNA, 22 bp, Homo sapiens
gccctctggtgggtgagccccg

SEQ ID NO: 10035825 - DNA, 23 bp, Homo sapiens
gcccatggagtctggatctggcc

SEQ ID NO: 10035826 - DNA, 18 bp, Homo sapiens
gccctctggctgctgatg

SEQ ID NO: 10035827 - DNA, 22 bp, Homo sapiens
gcccagggcagggcaagagtga

SEQ ID NO: 10035828 - DNA, 22 bp, Homo sapiens
gcccagggctgcaagtggacgc

SEQ ID NO: 10035829 - DNA, 22 bp, Homo sapiens
gcccagggcgatggtcggggcc

SEQ ID NO: 10035830 - DNA, 22 bp, Homo sapiens
gcccagagtttgaagatacagt

SEQ ID NO: 10035831 - DNA, 22 bp, Homo sapiens
gcactctgtgatctgcagagcc

SEQ ID NO: 10035832 - DNA, 22 bp, Homo sapiens
gcacctggctgcccaggtggag

SEQ ID NO: 10035833 - DNA, 22 bp, Homo sapiens
gcacctgggacccagaggcacc

SEQ ID NO: 10035834 - DNA, 23 bp, Homo sapiens
gcactgccatgtgctctgcaggc

SEQ ID NO: 10035835 - DNA, 22 bp, Homo sapiens
gcagaggacagggatttagatt

SEQ ID NO: 10035836 - DNA, 22 bp, Homo sapiens
gcagaggagatgaagatacttt

SEQ ID NO: 10035837 - DNA, 23 bp, Homo sapiens
gcagaggagcaagctggacacca

SEQ ID NO: 10035838 - DNA, 22 bp, Homo sapiens
gcactgggaatgctgatgggct

SEQ ID NO: 10035839 - DNA, 22 bp, Homo sapiens
gcactgggagtctgtgggggtt

SEQ ID NO: 10035840 - DNA, 22 bp, Homo sapiens
gcacagctcgagctcaggaggg

SEQ ID NO: 10035841 - DNA, 22 bp, Homo sapiens
gcagcatggagaagtagctaga

SEQ ID NO: 10035842 - DNA, 22 bp, Homo sapiens
gcagctgcagaccctcagtgct

SEQ ID NO: 10035843 - DNA, 22 bp, Homo sapiens
gcagctgcagagaccgggtggg

SEQ ID NO: 10035844 - DNA, 22 bp, Homo sapiens
gcagctgcaataggcatcaagc

SEQ ID NO: 10035845 - DNA, 22 bp, Homo sapiens
gcagctgccccgactgtgagtc

SEQ ID NO: 10035846 - DNA, 22 bp, Homo sapiens
gcagctgccccgactgtgagtc

SEQ ID NO: 10035847 - DNA, 22 bp, Homo sapiens
gcagcaggactgccgttaaagt

SEQ ID NO: 10035848 - DNA, 22 bp, Homo sapiens
gcagcaggaataggataagcaa

SEQ ID NO: 10035849 - DNA, 22 bp, Homo sapiens
gcagcagctgacagtgggtgcc

SEQ ID NO: 10035850 - DNA, 22 bp, Homo sapiens
gcagaggagcaagttgctacag

SEQ ID NO: 10035851 - DNA, 22 bp, Homo sapiens
gcagcagcccagggctctcaga

SEQ ID NO: 10035852 - DNA, 22 bp, Homo sapiens
gcagcagctccctatccaggct

SEQ ID NO: 10035853 - DNA, 22 bp, Homo sapiens
gcagcagctctcaaagtggtct

SEQ ID NO: 10035854 - DNA, 22 bp, Homo sapiens
gcagcagctcagttctgggagg

SEQ ID NO: 10035855 - DNA, 22 bp, Homo sapiens
gctgtgagtacaaggccctggg

SEQ ID NO: 10035856 - DNA, 22 bp, Homo sapiens
gctgtgcccagctccagctctg

SEQ ID NO: 10035857 - DNA, 22 bp, Homo sapiens
gctgtgcccatattctgctgac

SEQ ID NO: 10035858 - DNA, 22 bp, Homo sapiens
gctggggtctgtgaggagggct

SEQ ID NO: 10035859 - DNA, 18 bp, Homo sapiens
gctggggttgagctctcc

SEQ ID NO: 10035860 - DNA, 22 bp, Homo sapiens
gctggtagacctcactgcactc

SEQ ID NO: 10035861 - DNA, 21 bp, Homo sapiens
gctgcccaaccctgcatctcc

SEQ ID NO: 10035862 - DNA, 22 bp, Homo sapiens
gcttcccacagctggactgggg

SEQ ID NO: 10035863 - DNA, 22 bp, Homo sapiens
gcttcccagcagaggaaagact

SEQ ID NO: 10035864 - DNA, 22 bp, Homo sapiens
gcttcctagcattagccattgc

SEQ ID NO: 10035865 - DNA, 20 bp, Homo sapiens
ggaccctgggttcttctgag

SEQ ID NO: 10035866 - DNA, 22 bp, Homo sapiens
ggaccctgggctctgggcctat

SEQ ID NO: 10035867 - DNA, 22 bp, Homo sapiens
ggaccctggagacccactggga

SEQ ID NO: 10035868 - DNA, 22 bp, Homo sapiens
ggaccctgtaaagtcgtgtcca

SEQ ID NO: 10035869 - DNA, 23 bp, Homo sapiens
ggaccctgtggagggtgagagtc

SEQ ID NO: 10035870 - DNA, 22 bp, Homo sapiens
ggacccagaggggagtctggca

SEQ ID NO: 10035871 - DNA, 22 bp, Homo sapiens
ggagaggaaatgccagcacttc

SEQ ID NO: 10035872 - DNA, 22 bp, Homo sapiens
ggagaggacatggctcccacag

SEQ ID NO: 10035873 - DNA, 22 bp, Homo sapiens
ggagaggagattgtggcatttt

SEQ ID NO: 10035874 - DNA, 22 bp, Homo sapiens
ggagaggagctattgggggctc

SEQ ID NO: 10035875 - DNA, 22 bp, Homo sapiens
ggagaggatgttttagtaactt

SEQ ID NO: 10035876 - DNA, 22 bp, Homo sapiens
gccttctgtgctcctggccttt

SEQ ID NO: 10035877 - DNA, 22 bp, Homo sapiens
gcggagggcgagcccgcggagc

SEQ ID NO: 10035878 - DNA, 22 bp, Homo sapiens
gctctcatgccctctgggcttg

SEQ ID NO: 10035879 - DNA, 22 bp, Homo sapiens
gctctgcccagtgccctgagac

SEQ ID NO: 10035880 - DNA, 18 bp, Homo sapiens
gctctgcccaggctgccc

SEQ ID NO: 10035881 - DNA, 22 bp, Homo sapiens
gctctgcccaggaccgtccttg

SEQ ID NO: 10035882 - DNA, 22 bp, Homo sapiens
gctctgcctggtcgcgtgctgg

SEQ ID NO: 10035883 - DNA, 22 bp, Homo sapiens
gctctgcctttgtcttacacgg

SEQ ID NO: 10035884 - DNA, 22 bp, Homo sapiens
gctctgccttctcactgggttc

SEQ ID NO: 10035885 - DNA, 22 bp, Homo sapiens
gctctgcctcccctagtgttac

SEQ ID NO: 10035886 - DNA, 22 bp, Homo sapiens
gctctgccctgggccgttgtaa

SEQ ID NO: 10035887 - DNA, 22 bp, Homo sapiens
gctctgccccaggaactcagcc

SEQ ID NO: 10035888 - DNA, 17 bp, Homo sapiens
gctctgccccagcctct

SEQ ID NO: 10035889 - DNA, 22 bp, Homo sapiens
gctctgcctctttgctgcgtca

SEQ ID NO: 10035890 - DNA, 17 bp, Homo sapiens
gctctgcctctcccacc

SEQ ID NO: 10035891 - DNA, 22 bp, Homo sapiens
gctctggcactggcgcgggatg

SEQ ID NO: 10035892 - DNA, 23 bp, Homo sapiens
gctctggcagcttgtgtcagcac

SEQ ID NO: 10035893 - DNA, 22 bp, Homo sapiens
gctgccacttggtcatgtcatg

SEQ ID NO: 10035894 - DNA, 22 bp, Homo sapiens
tcagggcagcctaaggcacctc

SEQ ID NO: 10035895 - DNA, 22 bp, Homo sapiens
tcagggacttacaaaccagaag

SEQ ID NO: 10035896 - DNA, 22 bp, Homo sapiens
tcagggcaagtctcagaaggtt

SEQ ID NO: 10035897 - DNA, 22 bp, Homo sapiens
tcagtttgaatgttagcacagt

SEQ ID NO: 10035898 - DNA, 22 bp, Homo sapiens
tcatccctctgccaggcccagg

SEQ ID NO: 10035899 - DNA, 23 bp, Homo sapiens
tcagcctcttaggacttctcacc

SEQ ID NO: 10035900 - DNA, 22 bp, Homo sapiens
tcagagtgaggcccagcaatct

SEQ ID NO: 10035901 - DNA, 22 bp, Homo sapiens
tcagagtcaactgttgcctgtt

SEQ ID NO: 10035902 - DNA, 22 bp, Homo sapiens
tcaggagatggtctttataggc

SEQ ID NO: 10035903 - DNA, 22 bp, Homo sapiens
tcaggagatgtaaccttagctg

SEQ ID NO: 10035904 - DNA, 21 bp, Homo sapiens
tcacagagccacagaattggt

SEQ ID NO: 10035905 - DNA, 22 bp, Homo sapiens
tcacagagcacacaagaattgc

SEQ ID NO: 10035906 - DNA, 20 bp, Homo sapiens
tcacatcctctcccaacatg

SEQ ID NO: 10035907 - DNA, 22 bp, Homo sapiens
tcacagcagaatttaggaggca

SEQ ID NO: 10035908 - DNA, 22 bp, Homo sapiens
tcacagcaccctgaggtgctgg

SEQ ID NO: 10035909 - DNA, 19 bp, Homo sapiens
tcacagcatctgtctgaac

SEQ ID NO: 10035910 - DNA, 22 bp, Homo sapiens
tcactgctttgagccactgagc

SEQ ID NO: 10035911 - DNA, 22 bp, Homo sapiens
tcactgggtaggacatgctgat

SEQ ID NO: 10035912 - DNA, 22 bp, Homo sapiens
tcaccgaggctggagtgcagtg

SEQ ID NO: 10035913 - DNA, 22 bp, Homo sapiens
tcaccggcagacgtggcctgat

SEQ ID NO: 10035914 - DNA, 22 bp, Homo sapiens
tcagagacctagcaagaaattg

SEQ ID NO: 10035915 - DNA, 22 bp, Homo sapiens
tcagagacagttctggggcagg

SEQ ID NO: 10035916 - DNA, 18 bp, Homo sapiens
tcagagagaatagtaatt

SEQ ID NO: 10035917 - DNA, 23 bp, Homo sapiens
tcagagagctgttgagagctgcc

SEQ ID NO: 10035918 - DNA, 22 bp, Homo sapiens
tccaggacctgactgggcctgc

SEQ ID NO: 10035919 - DNA, 22 bp, Homo sapiens
tccaggagaaaactgacggtgg

SEQ ID NO: 10035920 - DNA, 22 bp, Homo sapiens
tccaggagctcatccacgtcaa

SEQ ID NO: 10035921 - DNA, 22 bp, Homo sapiens
tccaggaggaggaaggctgcca

SEQ ID NO: 10035922 - DNA, 22 bp, Homo sapiens
tccaggaggactgagggggctg

SEQ ID NO: 10035923 - DNA, 23 bp, Homo sapiens
tccaggagaacccctgtctgtcc

SEQ ID NO: 10035924 - DNA, 23 bp, Homo sapiens
tccaggagaacccctgtctgtcc

SEQ ID NO: 10035925 - DNA, 20 bp, Homo sapiens
tccaggagaactgggagccg

SEQ ID NO: 10035926 - DNA, 23 bp, Homo sapiens
tccaggagcatgctggctggcga

SEQ ID NO: 10035927 - DNA, 22 bp, Homo sapiens
tccacagacgtgttattagttg

SEQ ID NO: 10035928 - DNA, 22 bp, Homo sapiens
tccacagcacaaagccagtgtg

SEQ ID NO: 10035929 - DNA, 22 bp, Homo sapiens
tccacagatgcctttaggagta

SEQ ID NO: 10035930 - DNA, 22 bp, Homo sapiens
tccagggagtcaaatgaactac

SEQ ID NO: 10035931 - DNA, 22 bp, Homo sapiens
tccagggagcaagtcaggccgg

SEQ ID NO: 10035932 - DNA, 22 bp, Homo sapiens
tccagggatgtcctgtagcact

SEQ ID NO: 10035933 - DNA, 22 bp, Homo sapiens
tccagggatgccagccatgttg

SEQ ID NO: 10035934 - DNA, 22 bp, Homo sapiens
tccagggatctttagagtcttt

SEQ ID NO: 10035935 - DNA, 22 bp, Homo sapiens
tccaggcctaggccaagtgatt

SEQ ID NO: 10035936 - DNA, 22 bp, Homo sapiens
tccagggagatactggctgcca

SEQ ID NO: 10035937 - DNA, 22 bp, Homo sapiens
tccagggagatactggctgcca

SEQ ID NO: 10035938 - DNA, 22 bp, Homo sapiens
tccagggagagccgctgctcca

SEQ ID NO: 10035939 - DNA, 22 bp, Homo sapiens
tccagggagagccgctgctcca

SEQ ID NO: 10035940 - DNA, 20 bp, Homo sapiens
tccaggcccactcagctgaa

SEQ ID NO: 10035941 - DNA, 22 bp, Homo sapiens
tccaggaggcacctttggacca

SEQ ID NO: 10035942 - DNA, 22 bp, Homo sapiens
tccaggaggcagggctgtgccc

SEQ ID NO: 10035943 - DNA, 22 bp, Homo sapiens
tcccagctgtgtggaggagatg

SEQ ID NO: 10035944 - DNA, 22 bp, Homo sapiens
tcccaggaaaacactcgaggac

SEQ ID NO: 10035945 - DNA, 22 bp, Homo sapiens
tcccagctcacatatggtaact

SEQ ID NO: 10035946 - DNA, 22 bp, Homo sapiens
tcccagctactctagaggctga

SEQ ID NO: 10035947 - DNA, 22 bp, Homo sapiens
tcccagctgagattgagcaagg

SEQ ID NO: 10035948 - DNA, 22 bp, Homo sapiens
tcccaggatgttggcggcaggt

SEQ ID NO: 10035949 - DNA, 22 bp, Homo sapiens
tcccaggatgtgcgtgccgccg

SEQ ID NO: 10035950 - DNA, 22 bp, Homo sapiens
tcccaggatgaagacagtgttg

SEQ ID NO: 10035951 - DNA, 22 bp, Homo sapiens
tcccaggaatccgtcctctaga

SEQ ID NO: 10035952 - DNA, 22 bp, Homo sapiens
tcccaggaaggattcggcattt

SEQ ID NO: 10035953 - DNA, 19 bp, Homo sapiens
tcccaggaaccttttattt

SEQ ID NO: 10035954 - DNA, 17 bp, Homo sapiens
tcccaggaacagggaat

SEQ ID NO: 10035955 - DNA, 22 bp, Homo sapiens
tcccaggaagatcccagggacc

SEQ ID NO: 10035956 - DNA, 19 bp, Homo sapiens
tcccaggaagcaaatgtca

SEQ ID NO: 10035957 - DNA, 22 bp, Homo sapiens
tccctgggttcccgtggaagtg

SEQ ID NO: 10035958 - DNA, 22 bp, Homo sapiens
tccctggggcagtggctcggag

SEQ ID NO: 10035959 - DNA, 22 bp, Homo sapiens
tccctgggcggacattctccca

SEQ ID NO: 10035960 - DNA, 22 bp, Homo sapiens
tccctgggcctcctgctatgca

SEQ ID NO: 10035961 - DNA, 22 bp, Homo sapiens
tccctgggcctatcttagctcc

SEQ ID NO: 10035962 - DNA, 22 bp, Homo sapiens
tccctggggaagggcaagcaag

SEQ ID NO: 10035963 - DNA, 22 bp, Homo sapiens
tccctgggcttctccagacttg

SEQ ID NO: 10035964 - DNA, 22 bp, Homo sapiens
tccctggggatgttggcctgcc

SEQ ID NO: 10035965 - DNA, 22 bp, Homo sapiens
tcccaggatgtttatggctggt

SEQ ID NO: 10035966 - DNA, 22 bp, Homo sapiens
tcccaggattttaggctctcag

SEQ ID NO: 10035967 - DNA, 22 bp, Homo sapiens
tcccaggcaaaggcagctcatt

SEQ ID NO: 10035968 - DNA, 22 bp, Homo sapiens
tccctgagagcactggggagcc

SEQ ID NO: 10035969 - DNA, 21 bp, Homo sapiens
tccctgagcccaaggggctcc

SEQ ID NO: 10035970 - DNA, 21 bp, Homo sapiens
tccctgagcccaaggggctcc

SEQ ID NO: 10035971 - DNA, 23 bp, Homo sapiens
tccctgagatgctgctctgtccc

SEQ ID NO: 10035972 - DNA, 23 bp, Homo sapiens
tccctgagatgctgctctgtccc

SEQ ID NO: 10035973 - DNA, 22 bp, Homo sapiens
tccctgagcttcatcaggcttt

SEQ ID NO: 10035974 - DNA, 22 bp, Homo sapiens
tccctgagcttctctgaaatgg

SEQ ID NO: 10035975 - DNA, 22 bp, Homo sapiens
tccctgagcttctctgaaatgg

SEQ ID NO: 10035976 - DNA, 23 bp, Homo sapiens
tccctgagctggagagactgcac

SEQ ID NO: 10035977 - DNA, 22 bp, Homo sapiens
tccctgagcttcatcaggcttt

SEQ ID NO: 10035978 - DNA, 22 bp, Homo sapiens
tccctgagctgagctcaacagc

SEQ ID NO: 10035979 - DNA, 23 bp, Homo sapiens
tccctgagctggagagactgcac

SEQ ID NO: 10035980 - DNA, 22 bp, Homo sapiens
tccctgagctgagctcaacagc

SEQ ID NO: 10035981 - DNA, 22 bp, Homo sapiens
tccctgagctcacatggcagga

SEQ ID NO: 10035982 - DNA, 22 bp, Homo sapiens
tccctgagctcacatggcagga

SEQ ID NO: 10035983 - DNA, 16 bp, Homo sapiens
tccctgaggttttgga

SEQ ID NO: 10035984 - DNA, 16 bp, Homo sapiens
tccctgaggttttgga

SEQ ID NO: 10035985 - DNA, 22 bp, Homo sapiens
tccctgagtgggctggtagtat

SEQ ID NO: 10035986 - DNA, 22 bp, Homo sapiens
tccctgagtgtatgtggtgaac

SEQ ID NO: 10035987 - DNA, 19 bp, Homo sapiens
tccctgagttccagcccag

SEQ ID NO: 10035988 - DNA, 22 bp, Homo sapiens
tccctgaggatggttgtattta

SEQ ID NO: 10035989 - DNA, 22 bp, Homo sapiens
tccctgaggatgaggctgatca

SEQ ID NO: 10035990 - DNA, 22 bp, Homo sapiens
tccctgaggaaggggtgtggtg

SEQ ID NO: 10035991 - DNA, 22 bp, Homo sapiens
tccctgaggaaggggtgtggtg

SEQ ID NO: 10035992 - DNA, 22 bp, Homo sapiens
tccctgaggatgaggctgatca

SEQ ID NO: 10035993 - DNA, 22 bp, Homo sapiens
tccctgagggcagctcaagtcc

SEQ ID NO: 10035994 - DNA, 22 bp, Homo sapiens
tccctgagggcagctcaagtcc

SEQ ID NO: 10035995 - DNA, 19 bp, Homo sapiens
tccctgagttccagcccag

SEQ ID NO: 10035996 - DNA, 21 bp, Homo sapiens
tccctgagttctctgagcatc

SEQ ID NO: 10035997 - DNA, 21 bp, Homo sapiens
tccctgagttctctgagcatc

SEQ ID NO: 10035998 - DNA, 22 bp, Homo sapiens
tccctgagttttctttctgact

SEQ ID NO: 10035999 - DNA, 22 bp, Homo sapiens
tccctgagttttctttctgact

SEQ ID NO: 10036000 - DNA, 23 bp, Homo sapiens
tccctgggcccgtgccagcggtg

SEQ ID NO: 10036001 - DNA, 22 bp, Homo sapiens
tccctgggccacagctgtgagc

SEQ ID NO: 10036002 - DNA, 22 bp, Homo sapiens
tccctgggcatcacgttgcttc

SEQ ID NO: 10036003 - DNA, 22 bp, Homo sapiens
tccctgggcaagtttactcttc

SEQ ID NO: 10036004 - DNA, 22 bp, Homo sapiens
tccctgggcacaatctgctggc

SEQ ID NO: 10036005 - DNA, 22 bp, Homo sapiens
tcctccagtggcccagtccttc

SEQ ID NO: 10036006 - DNA, 22 bp, Homo sapiens
tcctccagcaggactgaggccc

SEQ ID NO: 10036007 - DNA, 22 bp, Homo sapiens
tcctccagaccacttctgtgcg

SEQ ID NO: 10036008 - DNA, 23 bp, Homo sapiens
tcctccagaggccctccttggcc

SEQ ID NO: 10036009 - DNA, 22 bp, Homo sapiens
tcctccaggcacctcactggct

SEQ ID NO: 10036010 - DNA, 22 bp, Homo sapiens
tcctccagctgtatcctgcctg

SEQ ID NO: 10036011 - DNA, 22 bp, Homo sapiens
tattgagttacagaaaatactt

SEQ ID NO: 10036012 - DNA, 22 bp, Homo sapiens
tatttcagcacatgggataggt

SEQ ID NO: 10036013 - DNA, 22 bp, Homo sapiens
tattgcaagtggcataaaattt

SEQ ID NO: 10036014 - DNA, 22 bp, Homo sapiens
tattgcaatttggctaaagaat

SEQ ID NO: 10036015 - DNA, 22 bp, Homo sapiens
tattttcaccttctctggatat

SEQ ID NO: 10036016 - DNA, 22 bp, Homo sapiens
tattttcatcttgtccttggat

SEQ ID NO: 10036017 - DNA, 22 bp, Homo sapiens
tattttcattctgtgtgactgt

SEQ ID NO: 10036018 - DNA, 22 bp, Homo sapiens
tagtgtttagtacatatgcata

SEQ ID NO: 10036019 - DNA, 22 bp, Homo sapiens
tagttaaagccctaaattgata

SEQ ID NO: 10036020 - DNA, 22 bp, Homo sapiens
taggaatgatgtatttttctct

SEQ ID NO: 10036021 - DNA, 22 bp, Homo sapiens
taggaatgaagaagtatgatat

SEQ ID NO: 10036022 - DNA, 22 bp, Homo sapiens
taggaatggtgctcagcagaaa

SEQ ID NO: 10036023 - DNA, 22 bp, Homo sapiens
taggaatgggctatcccaagct

SEQ ID NO: 10036024 - DNA, 22 bp, Homo sapiens
taggaatgggcaagacaaagaa

SEQ ID NO: 10036025 - DNA, 22 bp, Homo sapiens
tagcccagaagagggaagcaac

SEQ ID NO: 10036026 - DNA, 19 bp, Homo sapiens
tagaagcactaggcaaact

SEQ ID NO: 10036027 - DNA, 22 bp, Homo sapiens
tagaagcagcaggagtaaaggc

SEQ ID NO: 10036028 - DNA, 22 bp, Homo sapiens
tagaaggaggactggcagtgtt

SEQ ID NO: 10036029 - DNA, 22 bp, Homo sapiens
tagaagttgaactaaaaatatt

SEQ ID NO: 10036030 - DNA, 22 bp, Homo sapiens
tagaagttatgataataatagt

SEQ ID NO: 10036031 - DNA, 22 bp, Homo sapiens
tagaagttaaaggaatacagaa

SEQ ID NO: 10036032 - DNA, 22 bp, Homo sapiens
tagaagttgctcaataaatgtt

SEQ ID NO: 10036033 - DNA, 22 bp, Homo sapiens
tagcatttggacattgtcacct

SEQ ID NO: 10036034 - DNA, 22 bp, Homo sapiens
gttccaggcaagtgggatagga

SEQ ID NO: 10036035 - DNA, 22 bp, Homo sapiens
gttccaggaccctggcctctga

SEQ ID NO: 10036036 - DNA, 22 bp, Homo sapiens
gttccttggaagaacttgaggt

SEQ ID NO: 10036037 - DNA, 22 bp, Homo sapiens
gttccttgggaacaacgctgaa

SEQ ID NO: 10036038 - DNA, 22 bp, Homo sapiens
gttccttgtaatttgttaagga

SEQ ID NO: 10036039 - DNA, 22 bp, Homo sapiens
gttccttgtatttcagacatga

SEQ ID NO: 10036040 - DNA, 22 bp, Homo sapiens
gtttcttaaatgtagcaggacc

SEQ ID NO: 10036041 - DNA, 22 bp, Homo sapiens
gtttcttaagttacaaaatctt

SEQ ID NO: 10036042 - DNA, 22 bp, Homo sapiens
gtttatatgaacttcataccca

SEQ ID NO: 10036043 - DNA, 22 bp, Homo sapiens
gtttataaggtaaaggagagag

SEQ ID NO: 10036044 - DNA, 22 bp, Homo sapiens
gttacaaaggtcataaaagtgt

SEQ ID NO: 10036045 - DNA, 22 bp, Homo sapiens
taagaaatttagttatagaatg

SEQ ID NO: 10036046 - DNA, 22 bp, Homo sapiens
taagagttactggtttagaacc

SEQ ID NO: 10036047 - DNA, 22 bp, Homo sapiens
taagagttagggctagcaatat

SEQ ID NO: 10036048 - DNA, 22 bp, Homo sapiens
taacacagttctctgttgcaca

SEQ ID NO: 10036049 - DNA, 22 bp, Homo sapiens
gttttataggctgttgctatat

SEQ ID NO: 10036050 - DNA, 22 bp, Homo sapiens
tacacatatgtgtgtatatgtg

SEQ ID NO: 10036051 - DNA, 22 bp, Homo sapiens
tacaatttagtggtgtgtggtt

SEQ ID NO: 10036052 - DNA, 22 bp, Homo sapiens
tacaccagattatttataacat

SEQ ID NO: 10036053 - DNA, 22 bp, Homo sapiens
tacctgtggcttgttggatgga

SEQ ID NO: 10036054 - DNA, 22 bp, Homo sapiens
tacctgggcccaccagtgcctg

SEQ ID NO: 10036055 - DNA, 22 bp, Homo sapiens
tactggccaagagaatgcagta

SEQ ID NO: 10036056 - DNA, 23 bp, Homo sapiens
tactgggcagctgctctgacacc

SEQ ID NO: 10036057 - DNA, 22 bp, Homo sapiens
tactgcccagagctgcccgtgg

SEQ ID NO: 10036058 - DNA, 22 bp, Homo sapiens
tacatgtctacatgcatttttg

SEQ ID NO: 10036059 - DNA, 22 bp, Homo sapiens
tacagcagcatcgcagtgacct

SEQ ID NO: 10036060 - DNA, 22 bp, Homo sapiens
ttacagaagagaaagaattcag

SEQ ID NO: 10036061 - DNA, 22 bp, Homo sapiens
cctttggggtcctgcctgggct

SEQ ID NO: 10036062 - DNA, 22 bp, Homo sapiens
ttattcaccagtgtaaaacact

SEQ ID NO: 10036063 - DNA, 22 bp, Homo sapiens
ttattcactcattaaagcagga

SEQ ID NO: 10036064 - DNA, 22 bp, Homo sapiens
cctggggagccgcctgagcccc

SEQ ID NO: 10036065 - DNA, 22 bp, Homo sapiens
tgttgctcttttttaggtgagt

SEQ ID NO: 10036066 - DNA, 22 bp, Homo sapiens
tggttcctacgcacattgaatt

SEQ ID NO: 10036067 - DNA, 22 bp, Homo sapiens
cctgtggagttcccatctgaat

SEQ ID NO: 10036068 - DNA, 22 bp, Homo sapiens
cctgtggacattctgtgtggaa

SEQ ID NO: 10036069 - DNA, 22 bp, Homo sapiens
cctgtggaccaggaggcagccc

SEQ ID NO: 10036070 - DNA, 22 bp, Homo sapiens
ttctgaaccattgagcactgcc

SEQ ID NO: 10036071 - DNA, 22 bp, Homo sapiens
ctcactgcaagctctgcctccc

SEQ ID NO: 10036072 - DNA, 22 bp, Homo sapiens
ctcactgcaagctctgcctcca

SEQ ID NO: 10036073 - DNA, 22 bp, Homo sapiens
ctcagccccaattctccccatt

SEQ ID NO: 10036074 - DNA, 22 bp, Homo sapiens
ctcagcccagcccaggaccagg

SEQ ID NO: 10036075 - DNA, 22 bp, Homo sapiens
ctcagccccaattctccccatt

SEQ ID NO: 10036076 - DNA, 22 bp, Homo sapiens
ctcagccatgcaacatgctggg

SEQ ID NO: 10036077 - DNA, 22 bp, Homo sapiens
cgcagcagccccgtggtaggtg

SEQ ID NO: 10036078 - DNA, 20 bp, Homo sapiens
cgcagcagtggaagtggaat

SEQ ID NO: 10036079 - DNA, 22 bp, Homo sapiens
ttctccttgaaaagctgcatct

SEQ ID NO: 10036080 - DNA, 22 bp, Homo sapiens
ctctaccttcctgtccactgaa

SEQ ID NO: 10036081 - DNA, 22 bp, Homo sapiens
ctctctggaattaaagcccaat

SEQ ID NO: 10036082 - DNA, 22 bp, Homo sapiens
ctctgaggcttgttctatgtat

SEQ ID NO: 10036083 - DNA, 19 bp, Homo sapiens
ctctgaggattagctgtgg

SEQ ID NO: 10036084 - DNA, 22 bp, Homo sapiens
ctctgagctcgtgcagtacttc

SEQ ID NO: 10036085 - DNA, 22 bp, Homo sapiens
ctctgagctccaaaagtcagca

SEQ ID NO: 10036086 - DNA, 19 bp, Homo sapiens
tttctgcagctcagagaag

SEQ ID NO: 10036087 - DNA, 19 bp, Homo sapiens
ctctgcctctggctgtggc

SEQ ID NO: 10036088 - DNA, 19 bp, Homo sapiens
ctctgcttggtccatatgc

SEQ ID NO: 10036089 - DNA, 22 bp, Homo sapiens
ctctgcttggaactggacagaa

SEQ ID NO: 10036090 - DNA, 22 bp, Homo sapiens
ctctgcttgtgtcaggcatgct

SEQ ID NO: 10036091 - DNA, 22 bp, Homo sapiens
ctctggagcatttcacctacat

SEQ ID NO: 10036092 - DNA, 21 bp, Homo sapiens
ctcctcaggaccagccacagg

SEQ ID NO: 10036093 - DNA, 22 bp, Homo sapiens
ctcctcaggaagtagcatgtgt

SEQ ID NO: 10036094 - DNA, 22 bp, Homo sapiens
ctccctgacaggccatgggctt

SEQ ID NO: 10036095 - DNA, 22 bp, Homo sapiens
ctccctgcttgtttcccttcag

SEQ ID NO: 10036096 - DNA, 23 bp, Homo sapiens
ctccccagtgtcctcatgcatct

SEQ ID NO: 10036097 - DNA, 22 bp, Homo sapiens
ctccccaggttcaggaggtggg

SEQ ID NO: 10036098 - DNA, 22 bp, Homo sapiens
tttatattacctggaatagctt

SEQ ID NO: 10036099 - DNA, 22 bp, Homo sapiens
ctgcccctgctcatggctgtcc

SEQ ID NO: 10036100 - DNA, 22 bp, Homo sapiens
ctgcagtgttctggaatgcatt

SEQ ID NO: 10036101 - DNA, 22 bp, Homo sapiens
ctgcagtgaaatcaggaagcaa

SEQ ID NO: 10036102 - DNA, 22 bp, Homo sapiens
ctgccctggcagcctaccatgg

SEQ ID NO: 10036103 - DNA, 22 bp, Homo sapiens
ctgcctctggttttggtccctg

SEQ ID NO: 10036104 - DNA, 22 bp, Homo sapiens
ctgctccagacacctgcagggg

SEQ ID NO: 10036105 - DNA, 23 bp, Homo sapiens
ctgctccaggacagcatggaggt

SEQ ID NO: 10036106 - DNA, 22 bp, Homo sapiens
ctgctctccccaggccagtctg

SEQ ID NO: 10036107 - DNA, 22 bp, Homo sapiens
tttttcttaaatgtgggttggc

SEQ ID NO: 10036108 - DNA, 22 bp, Homo sapiens
ctgaaggaagcaggtggcctgt

SEQ ID NO: 10036109 - DNA, 22 bp, Homo sapiens
ctgaaggacttggtgatagttg

SEQ ID NO: 10036110 - DNA, 22 bp, Homo sapiens
ctgaaggagcatagtcagtttt

SEQ ID NO: 10036111 - DNA, 18 bp, Homo sapiens
ctgaaggatccaggtgta

SEQ ID NO: 10036112 - DNA, 22 bp, Homo sapiens
ctgaaggatttagttctttgct

SEQ ID NO: 10036113 - DNA, 22 bp, Homo sapiens
ctgagagtattggcaggcttgg

SEQ ID NO: 10036114 - DNA, 22 bp, Homo sapiens
ctgagatctttatacgaggcac

SEQ ID NO: 10036115 - DNA, 22 bp, Homo sapiens
gaggcagtgtttactgccctgt

SEQ ID NO: 10036116 - DNA, 22 bp, Homo sapiens
gaggcagtgtcggtggcaggat

SEQ ID NO: 10036117 - DNA, 22 bp, Homo sapiens
gaggcagtgttgaaaaggagag

SEQ ID NO: 10036118 - DNA, 22 bp, Homo sapiens
gaggcagtgtcggtggcaggat

SEQ ID NO: 10036119 - DNA, 22 bp, Homo sapiens
gaggcagtgcattgtctagggg

SEQ ID NO: 10036120 - DNA, 22 bp, Homo sapiens
gaggcagtttgccatgccagga

SEQ ID NO: 10036121 - DNA, 22 bp, Homo sapiens
gaggcagttcctgagtgacaag

SEQ ID NO: 10036122 - DNA, 22 bp, Homo sapiens
gaggcatctgggcacagaagtg

SEQ ID NO: 10036123 - DNA, 22 bp, Homo sapiens
gaggcagcttggggctgtgggt

SEQ ID NO: 10036124 - DNA, 22 bp, Homo sapiens
gaggcagcttagggtactgact

SEQ ID NO: 10036125 - DNA, 22 bp, Homo sapiens
gaggagaggccatcgttgttat

SEQ ID NO: 10036126 - DNA, 22 bp, Homo sapiens
gaggagagcctgcactttgacc

SEQ ID NO: 10036127 - DNA, 22 bp, Homo sapiens
gaggagaggctggacgcggtga

SEQ ID NO: 10036128 - DNA, 22 bp, Homo sapiens
gaggagagggctgcgggcccac

SEQ ID NO: 10036129 - DNA, 22 bp, Homo sapiens
gaggagaggggctcccaagagc

SEQ ID NO: 10036130 - DNA, 22 bp, Homo sapiens
gaggctgcccaactggagtgga

SEQ ID NO: 10036131 - DNA, 22 bp, Homo sapiens
gagggaggggagctccaccctc

SEQ ID NO: 10036132 - DNA, 22 bp, Homo sapiens
gagggagggccaggtcccaacc

SEQ ID NO: 10036133 - DNA, 22 bp, Homo sapiens
gagggagggactagcattctct

SEQ ID NO: 10036134 - DNA, 22 bp, Homo sapiens
gagggagggaaagtttaacact

SEQ ID NO: 10036135 - DNA, 22 bp, Homo sapiens
gagggaggcatcatgaatccag

SEQ ID NO: 10036136 - DNA, 22 bp, Homo sapiens
gaggggaaagtgtgaggctgcg

SEQ ID NO: 10036137 - DNA, 22 bp, Homo sapiens
gagggagtctgtgcaaagaatt

SEQ ID NO: 10036138 - DNA, 22 bp, Homo sapiens
gagggaggtgatactgaacgta

SEQ ID NO: 10036139 - DNA, 22 bp, Homo sapiens
gagccctgaacaacagcaggaa

SEQ ID NO: 10036140 - DNA, 22 bp, Homo sapiens
gagccctgacactgagggagtt

SEQ ID NO: 10036141 - DNA, 22 bp, Homo sapiens
gagcccaggttctgcttccagc

SEQ ID NO: 10036142 - DNA, 22 bp, Homo sapiens
gagcagtggtctgatcttctaa

SEQ ID NO: 10036143 - DNA, 22 bp, Homo sapiens
gagcatctgtggtccatcagaa

SEQ ID NO: 10036144 - DNA, 22 bp, Homo sapiens
gagcagtgatgggaggacgtca

SEQ ID NO: 10036145 - DNA, 22 bp, Homo sapiens
gagaggggcccaagccacatag

SEQ ID NO: 10036146 - DNA, 22 bp, Homo sapiens
gagccctggcagtctgggatgg

SEQ ID NO: 10036147 - DNA, 18 bp, Homo sapiens
gagccctgggagatctct

SEQ ID NO: 10036148 - DNA, 22 bp, Homo sapiens
gagccctgtagcaagtcatgtc

SEQ ID NO: 10036149 - DNA, 22 bp, Homo sapiens
gagccctgtaggaatctctcaa

SEQ ID NO: 10036150 - DNA, 22 bp, Homo sapiens
gagccctgatttgcagcatttg

SEQ ID NO: 10036151 - DNA, 22 bp, Homo sapiens
gagccctgagagttgtgaggcc

SEQ ID NO: 10036152 - DNA, 22 bp, Homo sapiens
gaggagagatggtagattgggt

SEQ ID NO: 10036153 - DNA, 22 bp, Homo sapiens
gaggagagagggactgtctgca

SEQ ID NO: 10036154 - DNA, 18 bp, Homo sapiens
gaggaaacaaggcagagg

SEQ ID NO: 10036155 - DNA, 22 bp, Homo sapiens
gaaggcagggaatgtggtgcta

SEQ ID NO: 10036156 - DNA, 22 bp, Homo sapiens
gaagcagctttctggtgaggag

SEQ ID NO: 10036157 - DNA, 20 bp, Homo sapiens
gaagcagcttcatgtagaca

SEQ ID NO: 10036158 - DNA, 22 bp, Homo sapiens
gaagcagccacggggagacaga

SEQ ID NO: 10036159 - DNA, 22 bp, Homo sapiens
gaagcagcgaagtggaagggac

SEQ ID NO: 10036160 - DNA, 22 bp, Homo sapiens
gaagcagctggtgagatggagc

SEQ ID NO: 10036161 - DNA, 22 bp, Homo sapiens
gaagcagctgccagagatgtct

SEQ ID NO: 10036162 - DNA, 22 bp, Homo sapiens
gacacagtaatgtgtttcatct

SEQ ID NO: 10036163 - DNA, 22 bp, Homo sapiens
gacacagttacttattttgcct

SEQ ID NO: 10036164 - DNA, 22 bp, Homo sapiens
gaaggggactggcagctgcaga

SEQ ID NO: 10036165 - DNA, 22 bp, Homo sapiens
gacatttaatagtattgtggga

SEQ ID NO: 10036166 - DNA, 22 bp, Homo sapiens
gacatttaaggcagtcacttaa

SEQ ID NO: 10036167 - DNA, 22 bp, Homo sapiens
gactcctctctaacccactgga

SEQ ID NO: 10036168 - DNA, 22 bp, Homo sapiens
gactcctcagtcaccctcagct

SEQ ID NO: 10036169 - DNA, 22 bp, Homo sapiens
gactctgggctgagccagggcc

SEQ ID NO: 10036170 - DNA, 22 bp, Homo sapiens
gacatttagctgttttgcattt

SEQ ID NO: 10036171 - DNA, 18 bp, Homo sapiens
gagagggatccctcagga

SEQ ID NO: 10036172 - DNA, 22 bp, Homo sapiens
gagacctgagtcaccctgtctg

SEQ ID NO: 10036173 - DNA, 22 bp, Homo sapiens
gagacctgcagctgtagtctgc

SEQ ID NO: 10036174 - DNA, 22 bp, Homo sapiens
cttccaagttgctctgctgacc

SEQ ID NO: 10036175 - DNA, 22 bp, Homo sapiens
cttacaaatacacttaggagag

SEQ ID NO: 10036176 - DNA, 22 bp, Homo sapiens
cttacaaaggagaggagatagg

SEQ ID NO: 10036177 - DNA, 22 bp, Homo sapiens
cttacacactagatggtaggtg

SEQ ID NO: 10036178 - DNA, 19 bp, Homo sapiens
cttctggccctgagccacc

SEQ ID NO: 10036179 - DNA, 22 bp, Homo sapiens
cttctgggcatggcagagcctg

SEQ ID NO: 10036180 - DNA, 22 bp, Homo sapiens
cttctgggccatggccttcctc

SEQ ID NO: 10036181 - DNA, 22 bp, Homo sapiens
ctgggcttgtgttagctgacaa

SEQ ID NO: 10036182 - DNA, 22 bp, Homo sapiens
ctggtctgccacccacacccct

SEQ ID NO: 10036183 - DNA, 22 bp, Homo sapiens
ctggtccttgacgcgtgggagg

SEQ ID NO: 10036184 - DNA, 22 bp, Homo sapiens
ctgtccttgctggccaggtatg

SEQ ID NO: 10036185 - DNA, 22 bp, Homo sapiens
ctgtctgcaggatagtaccctc

SEQ ID NO: 10036186 - DNA, 22 bp, Homo sapiens
ctgtctgccctggccagagccc

SEQ ID NO: 10036187 - DNA, 22 bp, Homo sapiens
ctgtgctgtcttgggagcctta

SEQ ID NO: 10036188 - DNA, 22 bp, Homo sapiens
ctgtgctggtgaaacccacaga

SEQ ID NO: 10036189 - DNA, 22 bp, Homo sapiens
ctgtgctgctagacctggattc

SEQ ID NO: 10036190 - DNA, 22 bp, Homo sapiens
ctgtgccctggccaggcctctc

SEQ ID NO: 10036191 - DNA, 22 bp, Homo sapiens
ctgtctgtgcctcttctcccag

SEQ ID NO: 10036192 - DNA, 22 bp, Homo sapiens
ctgtctgtggagcttctgatgt

SEQ ID NO: 10036193 - DNA, 18 bp, Homo sapiens
ctgtgccctgctcctact

SEQ ID NO: 10036194 - DNA, 22 bp, Homo sapiens
ctgtctgtgacctctgcatgtc

SEQ ID NO: 10036195 - DNA, 22 bp, Homo sapiens
ctgtctgtcctgagttcaacca

SEQ ID NO: 10036196 - DNA, 22 bp, Homo sapiens
ctgtctgtcaagttcatctcca

SEQ ID NO: 10036197 - DNA, 22 bp, Homo sapiens
ctgtctgtatccctgttggtaa

SEQ ID NO: 10036198 - DNA, 22 bp, Homo sapiens
ctgtctgtacaaatgtggggcc

SEQ ID NO: 10036199 - DNA, 17 bp, Homo sapiens
ctgtctgctgcttcctc

SEQ ID NO: 10036200 - DNA, 22 bp, Homo sapiens
ctgtctgctagaacatctatac

SEQ ID NO: 10036201 - DNA, 22 bp, Homo sapiens
ctgctgtgtttctgctagaaaa

SEQ ID NO: 10036202 - DNA, 22 bp, Homo sapiens
ctgctgtgtttcacacctctgg

SEQ ID NO: 10036203 - DNA, 22 bp, Homo sapiens
ctgctgtgttgccagtgtcacc

SEQ ID NO: 10036204 - DNA, 22 bp, Homo sapiens
ctgctgtgcacccaggaaggct

SEQ ID NO: 10036205 - DNA, 22 bp, Homo sapiens
ctgctgtgtggattcaatggct

SEQ ID NO: 10036206 - DNA, 22 bp, Homo sapiens
ctgctgtgattgggagaaaccg

SEQ ID NO: 10036207 - DNA, 20 bp, Homo sapiens
ctgctgtgattccctcctcc

SEQ ID NO: 10036208 - DNA, 20 bp, Homo sapiens
ctgctgtgtgtgcctcagcc

SEQ ID NO: 10036209 - DNA, 22 bp, Homo sapiens
ctgctgtgtggtgaaactcagt

SEQ ID NO: 10036210 - DNA, 22 bp, Homo sapiens
ctgctgtgttcctcctgcatct

SEQ ID NO: 10036211 - DNA, 22 bp, Homo sapiens
ctgggacacgttctattccaaa

SEQ ID NO: 10036212 - DNA, 22 bp, Homo sapiens
ctgggacacccagagctgcaga

SEQ ID NO: 10036213 - DNA, 22 bp, Homo sapiens
ctgggacatagatcagcctttt

SEQ ID NO: 10036214 - DNA, 23 bp, Homo sapiens
ctgggacatggtaggggcacaac

SEQ ID NO: 10036215 - DNA, 22 bp, Homo sapiens
ctgggacatattgctagtgttg

SEQ ID NO: 10036216 - DNA, 22 bp, Homo sapiens
ctgggaccatctgtgtctactt

SEQ ID NO: 10036217 - DNA, 22 bp, Homo sapiens
ctgggacatggtgctgtcttta

SEQ ID NO: 10036218 - DNA, 22 bp, Homo sapiens
ctgggagatctcctgagggcag

SEQ ID NO: 10036219 - DNA, 22 bp, Homo sapiens
ctgggctagaaggaccaggatg

SEQ ID NO: 10036220 - DNA, 22 bp, Homo sapiens
ctgggcgtgtcttccagctggc

SEQ ID NO: 10036221 - DNA, 22 bp, Homo sapiens
ctgggcctgtgactcccatcct

SEQ ID NO: 10036222 - DNA, 22 bp, Homo sapiens
ctgggccttgccttgcccacag

SEQ ID NO: 10036223 - DNA, 22 bp, Homo sapiens
ctgggccttgatcacacaggtg

SEQ ID NO: 10036224 - DNA, 22 bp, Homo sapiens
ctgggccttatgagtacctgga

SEQ ID NO: 10036225 - DNA, 22 bp, Homo sapiens
ctgggatgtgaggagcgcctct

SEQ ID NO: 10036226 - DNA, 22 bp, Homo sapiens
ctgggcagctgtatcagggagt

SEQ ID NO: 10036227 - DNA, 22 bp, Homo sapiens
ctgggcacttgctcacagctct

SEQ ID NO: 10036228 - DNA, 22 bp, Homo sapiens
ctgggcagcacatcatcgtatc

SEQ ID NO: 10036229 - DNA, 22 bp, Homo sapiens
tacagccacggtctatggaggc

SEQ ID NO: 10036230 - DNA, 22 bp, Homo sapiens
tacagctagagggcacgtgaac

SEQ ID NO: 10036231 - DNA, 22 bp, Homo sapiens
tacagcagggcgctgtgatgaa

SEQ ID NO: 10036232 - DNA, 22 bp, Homo sapiens
caggccctcgcccgcagcgacc

SEQ ID NO: 10036233 - DNA, 22 bp, Homo sapiens
gtggagaggagcagctacctca

SEQ ID NO: 10036234 - DNA, 17 bp, Homo sapiens
cagctctgcagacttcc

SEQ ID NO: 10036235 - DNA, 17 bp, Homo sapiens
cagctctgcatcttcct

SEQ ID NO: 10036236 - DNA, 22 bp, Homo sapiens
cagctctgccatcatctgcctt

SEQ ID NO: 10036237 - DNA, 22 bp, Homo sapiens
cagggcataagatgaggctgta

SEQ ID NO: 10036238 - DNA, 22 bp, Homo sapiens
cagggatgagcagatggagcaa

SEQ ID NO: 10036239 - DNA, 22 bp, Homo sapiens
tagcagcaaaatgaccttctaa

SEQ ID NO: 10036240 - DNA, 22 bp, Homo sapiens
tagcagcaattcaggtgtgatg

SEQ ID NO: 10036241 - DNA, 23 bp, Homo sapiens
cagggaggagatactgtgtatct

SEQ ID NO: 10036242 - DNA, 22 bp, Homo sapiens
cagggaggctgtcttatgcctg

SEQ ID NO: 10036243 - DNA, 22 bp, Homo sapiens
cagggaggatgggctgttttgc

SEQ ID NO: 10036244 - DNA, 22 bp, Homo sapiens
cagggagggacaattgtcacct

SEQ ID NO: 10036245 - DNA, 22 bp, Homo sapiens
cagggagggaggaaaatttgct

SEQ ID NO: 10036246 - DNA, 22 bp, Homo sapiens
cagggagaggcctctgttgccc

SEQ ID NO: 10036247 - DNA, 22 bp, Homo sapiens
tagaacagcatttggctattaa

SEQ ID NO: 10036248 - DNA, 22 bp, Homo sapiens
tacccagggcttttctgatgca

SEQ ID NO: 10036249 - DNA, 22 bp, Homo sapiens
tacccaggaggaaactgaggct

SEQ ID NO: 10036250 - DNA, 22 bp, Homo sapiens
tacccaggagaaacagcagggc

SEQ ID NO: 10036251 - DNA, 22 bp, Homo sapiens
tacccaggggctgagcagaggt

SEQ ID NO: 10036252 - DNA, 19 bp, Homo sapiens
taccctgggctctctgccc

SEQ ID NO: 10036253 - DNA, 22 bp, Homo sapiens
tagtgttctaagaacatccatg

SEQ ID NO: 10036254 - DNA, 22 bp, Homo sapiens
tatgaacttttgatgtgacatg

SEQ ID NO: 10036255 - DNA, 23 bp, Homo sapiens
tatgaactgcattgctggtgtgt

SEQ ID NO: 10036256 - DNA, 22 bp, Homo sapiens
tatgaactctggagtctgagtg

SEQ ID NO: 10036257 - DNA, 22 bp, Homo sapiens
caggtgggccggggtttgttct

SEQ ID NO: 10036258 - DNA, 22 bp, Homo sapiens
tatgtacatcgttgaattcaaa

SEQ ID NO: 10036259 - DNA, 22 bp, Homo sapiens
caggtggggcagctgtgggagc

SEQ ID NO: 10036260 - DNA, 22 bp, Homo sapiens
caggtggggagagtgtggagca

SEQ ID NO: 10036261 - DNA, 22 bp, Homo sapiens
tatgtacatcttgagcaatgaa

SEQ ID NO: 10036262 - DNA, 22 bp, Homo sapiens
tatgtacatgttaaagggcaaa

SEQ ID NO: 10036263 - DNA, 20 bp, Homo sapiens
tattccaagggtagagaaaa

SEQ ID NO: 10036264 - DNA, 22 bp, Homo sapiens
cagtgaaatcacaactttagtt

SEQ ID NO: 10036265 - DNA, 22 bp, Homo sapiens
tctctgtattctgatattcact

SEQ ID NO: 10036266 - DNA, 22 bp, Homo sapiens
tctctgtatcccagaaccaaaa

SEQ ID NO: 10036267 - DNA, 21 bp, Homo sapiens
tctctgtatccatgggttcca

SEQ ID NO: 10036268 - DNA, 22 bp, Homo sapiens
tctctgtagagacagcactgtg

SEQ ID NO: 10036269 - DNA, 22 bp, Homo sapiens
tctctgtagggctgcttgagta

SEQ ID NO: 10036270 - DNA, 22 bp, Homo sapiens
tctctgtagttgggcagctgct

SEQ ID NO: 10036271 - DNA, 22 bp, Homo sapiens
tctctgtacagtacatgccgtg

SEQ ID NO: 10036272 - DNA, 22 bp, Homo sapiens
tctctgtaaaatgtggatgata

SEQ ID NO: 10036273 - DNA, 20 bp, Homo sapiens
ccagcaccctctcagctgaa

SEQ ID NO: 10036274 - DNA, 22 bp, Homo sapiens
tctcagagaagtgatgagcaat

SEQ ID NO: 10036275 - DNA, 23 bp, Homo sapiens
ccaagactgttaggagtggggag

SEQ ID NO: 10036276 - DNA, 22 bp, Homo sapiens
catttattggcatgtagtaggt

SEQ ID NO: 10036277 - DNA, 22 bp, Homo sapiens
cattttatgtttatggagtgct

SEQ ID NO: 10036278 - DNA, 22 bp, Homo sapiens
cattttgtagcaatgactgttg

SEQ ID NO: 10036279 - DNA, 22 bp, Homo sapiens
catcagagttaacatcatgact

SEQ ID NO: 10036280 - DNA, 22 bp, Homo sapiens
catcaggtgcctctgtgcagtg

SEQ ID NO: 10036281 - DNA, 22 bp, Homo sapiens
catccctgtctgccactctgaa

SEQ ID NO: 10036282 - DNA, 22 bp, Homo sapiens
catcctctccagcagtggagtg

SEQ ID NO: 10036283 - DNA, 23 bp, Homo sapiens
catgtgcctgctgtgtggaagcc

SEQ ID NO: 10036284 - DNA, 22 bp, Homo sapiens
tccaggcttcacgtctgccctc

SEQ ID NO: 10036285 - DNA, 22 bp, Homo sapiens
cattacaaccccaaattacaaa

SEQ ID NO: 10036286 - DNA, 21 bp, Homo sapiens
cattacaagatttccaatttg

SEQ ID NO: 10036287 - DNA, 22 bp, Homo sapiens
cattacaaacatgttaagattt

SEQ ID NO: 10036288 - DNA, 22 bp, Homo sapiens
cattacaacaatctgccatggc

SEQ ID NO: 10036289 - DNA, 19 bp, Homo sapiens
cattacaaatttgtaggga

SEQ ID NO: 10036290 - DNA, 22 bp, Homo sapiens
cattacaaagttataaacagtt

SEQ ID NO: 10036291 - DNA, 22 bp, Homo sapiens
tccaggtccagaggttcaactg

SEQ ID NO: 10036292 - DNA, 22 bp, Homo sapiens
tccaagatggttggtgtggtgg

SEQ ID NO: 10036293 - DNA, 22 bp, Homo sapiens
tccaagatcaaggtgttggcag

SEQ ID NO: 10036294 - DNA, 22 bp, Homo sapiens
catggtgggtgtagtttccgcc

SEQ ID NO: 10036295 - DNA, 20 bp, Homo sapiens
catggtggaggagcagggcc

SEQ ID NO: 10036296 - DNA, 22 bp, Homo sapiens
tccagcagaaaagaggtaggga

SEQ ID NO: 10036297 - DNA, 22 bp, Homo sapiens
catgctttgggtcagaaatgcc

SEQ ID NO: 10036298 - DNA, 22 bp, Homo sapiens
cccttgagctgtggctgggtga

SEQ ID NO: 10036299 - DNA, 22 bp, Homo sapiens
cccttgagcctggaggagctct

SEQ ID NO: 10036300 - DNA, 19 bp, Homo sapiens
tggcagggagagtttgaag

SEQ ID NO: 10036301 - DNA, 22 bp, Homo sapiens
cccttgggcttcagccctaccg

SEQ ID NO: 10036302 - DNA, 22 bp, Homo sapiens
ccctgggaggcttccaggcaga

SEQ ID NO: 10036303 - DNA, 19 bp, Homo sapiens
tggcaggcccaggatggac

SEQ ID NO: 10036304 - DNA, 22 bp, Homo sapiens
ccctgggaagtattccagctat

SEQ ID NO: 10036305 - DNA, 22 bp, Homo sapiens
ccctgggacccgctgcagaggc

SEQ ID NO: 10036306 - DNA, 22 bp, Homo sapiens
ccctgggagaagttgagggctg

SEQ ID NO: 10036307 - DNA, 22 bp, Homo sapiens
ccctgggagctgcctggctgac

SEQ ID NO: 10036308 - DNA, 22 bp, Homo sapiens
ccctggagtgtgacgaggcatt

SEQ ID NO: 10036309 - DNA, 22 bp, Homo sapiens
ccctggaggtggaggttgcagg

SEQ ID NO: 10036310 - DNA, 22 bp, Homo sapiens
ccctggaggtggaggttgcagg

SEQ ID NO: 10036311 - DNA, 22 bp, Homo sapiens
ccctggaggttgaggctgcagt

SEQ ID NO: 10036312 - DNA, 22 bp, Homo sapiens
ccctggagggcagacagatgcc

SEQ ID NO: 10036313 - DNA, 22 bp, Homo sapiens
ccctggaggtcagaggcctggg

SEQ ID NO: 10036314 - DNA, 22 bp, Homo sapiens
ccctggaggtcagaggcctggg

SEQ ID NO: 10036315 - DNA, 22 bp, Homo sapiens
ccctggaggttgaggctgcagt

SEQ ID NO: 10036316 - DNA, 23 bp, Homo sapiens
ccctggagtaaattcttggaagg

SEQ ID NO: 10036317 - DNA, 22 bp, Homo sapiens
ccctggagtagcactgggtcgc

SEQ ID NO: 10036318 - DNA, 22 bp, Homo sapiens
ccctggagtccggagctcacct

SEQ ID NO: 10036319 - DNA, 22 bp, Homo sapiens
ccctggagtcctggcagttgat

SEQ ID NO: 10036320 - DNA, 22 bp, Homo sapiens
ccctggagtcctggcagttgat

SEQ ID NO: 10036321 - DNA, 22 bp, Homo sapiens
ccctggaggaagaaacaatggc

SEQ ID NO: 10036322 - DNA, 23 bp, Homo sapiens
tggaggaaacacatcagaagacc

SEQ ID NO: 10036323 - DNA, 22 bp, Homo sapiens
tggaggaagttgctggaagtca

SEQ ID NO: 10036324 - DNA, 22 bp, Homo sapiens
tggaggaagtggctggccagaa

SEQ ID NO: 10036325 - DNA, 21 bp, Homo sapiens
tggaggaataaagcacagaag

SEQ ID NO: 10036326 - DNA, 22 bp, Homo sapiens
tgctagctcacccttgcctccc

SEQ ID NO: 10036327 - DNA, 22 bp, Homo sapiens
tgccttcctggagctgaaggct

SEQ ID NO: 10036328 - DNA, 20 bp, Homo sapiens
cccagtgaagcatggaagag

SEQ ID NO: 10036329 - DNA, 22 bp, Homo sapiens
tgctgcctggtttcttcttgct

SEQ ID NO: 10036330 - DNA, 22 bp, Homo sapiens
tgctgcctggagccttttgttt

SEQ ID NO: 10036331 - DNA, 22 bp, Homo sapiens
ccccagctgagatttgaggaga

SEQ ID NO: 10036332 - DNA, 22 bp, Homo sapiens
ccccaggaagcctcagatttgc

SEQ ID NO: 10036333 - DNA, 22 bp, Homo sapiens
ccccaggacacatggaccaagt

SEQ ID NO: 10036334 - DNA, 18 bp, Homo sapiens
tgctggggtagaatccac

SEQ ID NO: 10036335 - DNA, 22 bp, Homo sapiens
tgctgggggttcagatgagtaa

SEQ ID NO: 10036336 - DNA, 22 bp, Homo sapiens
tgctgggggtagctctgcgtag

SEQ ID NO: 10036337 - DNA, 22 bp, Homo sapiens
tgctgggggctttctggatacc

SEQ ID NO: 10036338 - DNA, 22 bp, Homo sapiens
tgctggggctctgaccactcca

SEQ ID NO: 10036339 - DNA, 22 bp, Homo sapiens
tgctgggcaccagtgcctgcag

SEQ ID NO: 10036340 - DNA, 22 bp, Homo sapiens
tgcttccttgagctctccaatc

SEQ ID NO: 10036341 - DNA, 22 bp, Homo sapiens
tgcttccttgatcattcccaaa

SEQ ID NO: 10036342 - DNA, 22 bp, Homo sapiens
tgcttccttcccgttcttctcc

SEQ ID NO: 10036343 - DNA, 22 bp, Homo sapiens
tgcttcctatccacacaatgcc

SEQ ID NO: 10036344 - DNA, 22 bp, Homo sapiens
tgcttcctgaggccgtcttctc

SEQ ID NO: 10036345 - DNA, 22 bp, Homo sapiens
ccccaggagaaatcttaaacta

SEQ ID NO: 10036346 - DNA, 22 bp, Homo sapiens
ccccaggagatttgggagcaca

SEQ ID NO: 10036347 - DNA, 16 bp, Homo sapiens
ccccaggacttggcac

SEQ ID NO: 10036348 - DNA, 22 bp, Homo sapiens
ccccaggacgtggccctcatag

SEQ ID NO: 10036349 - DNA, 22 bp, Homo sapiens
ccccaggagcttgttttagaga

SEQ ID NO: 10036350 - DNA, 22 bp, Homo sapiens
tgggacagattataagtctgca

SEQ ID NO: 10036351 - DNA, 22 bp, Homo sapiens
cctccagggcccctctcactgg

SEQ ID NO: 10036352 - DNA, 19 bp, Homo sapiens
tggcagtgtggcttccaga

SEQ ID NO: 10036353 - DNA, 22 bp, Homo sapiens
tggcagtgtataggtggctcct

SEQ ID NO: 10036354 - DNA, 22 bp, Homo sapiens
tggcagtggctttgctggtgga

SEQ ID NO: 10036355 - DNA, 22 bp, Homo sapiens
tggcagtggtgtctgcacaggc

SEQ ID NO: 10036356 - DNA, 22 bp, Homo sapiens
cctcctctggtgctgccaaccc

SEQ ID NO: 10036357 - DNA, 22 bp, Homo sapiens
tgggtggagaagtggacctgct

SEQ ID NO: 10036358 - DNA, 22 bp, Homo sapiens
cctgcctcaggactctgcatat

SEQ ID NO: 10036359 - DNA, 22 bp, Homo sapiens
cctgccctgtcactggctaggg

SEQ ID NO: 10036360 - DNA, 22 bp, Homo sapiens
cctgccctgtgtttggggacta

SEQ ID NO: 10036361 - DNA, 22 bp, Homo sapiens
cctgagtctttcccattgcgct

SEQ ID NO: 10036362 - DNA, 22 bp, Homo sapiens
cctgagtcttggcttcttggct

SEQ ID NO: 10036363 - DNA, 22 bp, Homo sapiens
cctgagtcttcccaaaactcct

SEQ ID NO: 10036364 - DNA, 22 bp, Homo sapiens
cctgcagctttgcctcctgaac

SEQ ID NO: 10036365 - DNA, 22 bp, Homo sapiens
tgggcctggacaaggccactag

SEQ ID NO: 10036366 - DNA, 22 bp, Homo sapiens
tgggctccaatttgtcctttca

SEQ ID NO: 10036367 - DNA, 22 bp, Homo sapiens
tgggctccggcggcctcaggct

SEQ ID NO: 10036368 - DNA, 22 bp, Homo sapiens
tgggctccagcacctgtgctct

SEQ ID NO: 10036369 - DNA, 23 bp, Homo sapiens
tgggcctggcctcccagtccagc

SEQ ID NO: 10036370 - DNA, 22 bp, Homo sapiens
cccagcaggaggaggttgcagt

SEQ ID NO: 10036371 - DNA, 22 bp, Homo sapiens
tgcaggaatcagaggggaagcg

SEQ ID NO: 10036372 - DNA, 22 bp, Homo sapiens
cccaaggacacgggcagggaca

SEQ ID NO: 10036373 - DNA, 22 bp, Homo sapiens
cccaaggaagacgcttgtgata

SEQ ID NO: 10036374 - DNA, 22 bp, Homo sapiens
tgcactttgcaggcatggaaac

SEQ ID NO: 10036375 - DNA, 22 bp, Homo sapiens
ccatccctcctactcacagtca

SEQ ID NO: 10036376 - DNA, 22 bp, Homo sapiens
ccagtgttttccagtttgccca

SEQ ID NO: 10036377 - DNA, 22 bp, Homo sapiens
tgaggcagtgtgagataataaa

SEQ ID NO: 10036378 - DNA, 22 bp, Homo sapiens
ccaggtggataaggtttctgga

SEQ ID NO: 10036379 - DNA, 22 bp, Homo sapiens
tgagccagtggaagatggcagt

SEQ ID NO: 10036380 - DNA, 23 bp, Homo sapiens
tgagcccaggaggtcaaggctgc

SEQ ID NO: 10036381 - DNA, 22 bp, Homo sapiens
ccagtgcccagctgcccaggca

SEQ ID NO: 10036382 - DNA, 22 bp, Homo sapiens
ccaggagcagatatggacataa

SEQ ID NO: 10036383 - DNA, 22 bp, Homo sapiens
ccaggagagcaaaggtcactct

SEQ ID NO: 10036384 - DNA, 22 bp, Homo sapiens
ccaggagagcagaagcccaggc

SEQ ID NO: 10036385 - DNA, 22 bp, Homo sapiens
tctgggcctgtctcagagctgg

SEQ ID NO: 10036386 - DNA, 22 bp, Homo sapiens
tctgggcctcacctgctgctca

SEQ ID NO: 10036387 - DNA, 22 bp, Homo sapiens
tctgggcctcagtttcttcatc

SEQ ID NO: 10036388 - DNA, 22 bp, Homo sapiens
tctgggccctaaaccagctcta

SEQ ID NO: 10036389 - DNA, 22 bp, Homo sapiens
tctgggccggagccgacggcag

SEQ ID NO: 10036390 - DNA, 22 bp, Homo sapiens
tctgggccctgagatgttcttc

SEQ ID NO: 10036391 - DNA, 22 bp, Homo sapiens
tctgggccgctgcgttccatga

SEQ ID NO: 10036392 - DNA, 22 bp, Homo sapiens
tcttacaagaaataagccaatg

SEQ ID NO: 10036393 - DNA, 22 bp, Homo sapiens
tcttacaagaaggaaaagggag

SEQ ID NO: 10036394 - DNA, 22 bp, Homo sapiens
ccaggcagcaaattttctgaat

SEQ ID NO: 10036395 - DNA, 22 bp, Homo sapiens
ccaggcacttgtttgccaggca

SEQ ID NO: 10036396 - DNA, 22 bp, Homo sapiens
ccaggcaggcgatggtgcagtg

SEQ ID NO: 10036397 - DNA, 22 bp, Homo sapiens
ccagggagtttccaatctgaga

SEQ ID NO: 10036398 - DNA, 22 bp, Homo sapiens
ccagggatgccaagctttacca

SEQ ID NO: 10036399 - DNA, 18 bp, Homo sapiens
ccagggatgcatggtccc

SEQ ID NO: 10036400 - DNA, 22 bp, Homo sapiens
ccagggatgccaagctttacca

SEQ ID NO: 10036401 - DNA, 22 bp, Homo sapiens
ccagggatgcagaggttgcagt

SEQ ID NO: 10036402 - DNA, 22 bp, Homo sapiens
ccagggcaacgctgtctcagag

SEQ ID NO: 10036403 - DNA, 22 bp, Homo sapiens
ccagggcaattatttggagggt

SEQ ID NO: 10036404 - DNA, 22 bp, Homo sapiens
ccagggcaggggctggagttca

SEQ ID NO: 10036405 - DNA, 22 bp, Homo sapiens
ccagggcagtgggagaaggtgc

SEQ ID NO: 10036406 - DNA, 22 bp, Homo sapiens
tgaagtgagtagtgtctagggg

SEQ ID NO: 10036407 - DNA, 21 bp, Homo sapiens
tttgtccacctgtgttcacca

SEQ ID NO: 10036408 - DNA, 20 bp, Homo sapiens
tttgtccagcgtctactctg

SEQ ID NO: 10036409 - DNA, 22 bp, Homo sapiens
tttgtccagatgcacagataat

SEQ ID NO: 10036410 - DNA, 22 bp, Homo sapiens
tttgggcaggcttttccctaga

SEQ ID NO: 10036411 - DNA, 22 bp, Homo sapiens
tttgggctggtttgccatgccc

SEQ ID NO: 10036412 - DNA, 22 bp, Homo sapiens
tttgcattacttgactttagtt

SEQ ID NO: 10036413 - DNA, 22 bp, Homo sapiens
tttgaacttctacctgtcatat

SEQ ID NO: 10036414 - DNA, 22 bp, Homo sapiens
ttttgggtgaatttgccagtta

SEQ ID NO: 10036415 - DNA, 22 bp, Homo sapiens
ttttgtatcctccctttcactg

SEQ ID NO: 10036416 - DNA, 22 bp, Homo sapiens
ttttacacctcagatgagcaga

SEQ ID NO: 10036417 - DNA, 22 bp, Homo sapiens
ttttacacctgttaactctaag

SEQ ID NO: 10036418 - DNA, 22 bp, Homo sapiens
ttttacacttcggttgtgtgca

SEQ ID NO: 10036419 - DNA, 22 bp, Homo sapiens
tttgtggaactctcttcttgca

SEQ ID NO: 10036420 - DNA, 19 bp, Homo sapiens
tttgtgcagcaacattaat

SEQ ID NO: 10036421 - DNA, 22 bp, Homo sapiens
tttgtgcacattgcttttctat

SEQ ID NO: 10036422 - DNA, 22 bp, Homo sapiens
tttgtgcaatttatgtactata

SEQ ID NO: 10036423 - DNA, 22 bp, Homo sapiens
ttatttaaaagtggtaagattc

SEQ ID NO: 10036424 - DNA, 22 bp, Homo sapiens
tcctctggatataagcctcacc

SEQ ID NO: 10036425 - DNA, 19 bp, Homo sapiens
ttcccaggaaaggggtgca

SEQ ID NO: 10036426 - DNA, 19 bp, Homo sapiens
ttcccaggaaaggggtgca

SEQ ID NO: 10036427 - DNA, 22 bp, Homo sapiens
ttccaagagctgctggggtaag

SEQ ID NO: 10036428 - DNA, 22 bp, Homo sapiens
ttccaaggtgggactggggtgc

SEQ ID NO: 10036429 - DNA, 22 bp, Homo sapiens
ttctttctttgtagtcctgaac

SEQ ID NO: 10036430 - DNA, 18 bp, Homo sapiens
ttgagggaggggcagagt

SEQ ID NO: 10036431 - DNA, 22 bp, Homo sapiens
ttctgccctgccagtgggctca

SEQ ID NO: 10036432 - DNA, 22 bp, Homo sapiens
tttccaggagaaagagagcctt

SEQ ID NO: 10036433 - DNA, 18 bp, Homo sapiens
tttccagggattaggtgg

SEQ ID NO: 10036434 - DNA, 22 bp, Homo sapiens
tttccagggaggaatgtggggt

SEQ ID NO: 10036435 - DNA, 22 bp, Homo sapiens
tttccaggtattaatactgtat

SEQ ID NO: 10036436 - DNA, 22 bp, Homo sapiens
tttccttgcacattggtttcca

SEQ ID NO: 10036437 - DNA, 22 bp, Homo sapiens
ttgtttaaaagaaatcatagaa

SEQ ID NO: 10036438 - DNA, 22 bp, Homo sapiens
ttgttgggcatgcagtggctgt

SEQ ID NO: 10036439 - DNA, 22 bp, Homo sapiens
tttaacttagaagagatatcct

SEQ ID NO: 10036440 - DNA, 22 bp, Homo sapiens
tttacacattattttcagtgtg

SEQ ID NO: 10036441 - DNA, 22 bp, Homo sapiens
tttattgccctgtagtacagga

SEQ ID NO: 10036442 - DNA, 22 bp, Homo sapiens
tttatgacccaagaagatacca

SEQ ID NO: 10036443 - DNA, 22 bp, Homo sapiens
tttatgacattacaatatcaag

SEQ ID NO: 10036444 - DNA, 22 bp, Homo sapiens
ttggaacagaaacagacaaata

SEQ ID NO: 10036445 - DNA, 22 bp, Homo sapiens
ttggaacagagccctaaggaca

SEQ ID NO: 10036446 - DNA, 22 bp, Homo sapiens
ttggaacagaactgcgttcatt

SEQ ID NO: 10036447 - DNA, 22 bp, Homo sapiens
ttggaacaggattcaattaaag

SEQ ID NO: 10036448 - DNA, 22 bp, Homo sapiens
ttggaacatccaggacagatat

SEQ ID NO: 10036449 - DNA, 22 bp, Homo sapiens
ttggaacagtgtgaaaaggtta

SEQ ID NO: 10036450 - DNA, 20 bp, Homo sapiens
ttggaacagtggatcagcag

SEQ ID NO: 10036451 - DNA, 23 bp, Homo sapiens
ttggaacacagtaaatgcacaat

SEQ ID NO: 10036452 - DNA, 22 bp, Homo sapiens
ttggaattcaagttgtagctta

SEQ ID NO: 10036453 - DNA, 22 bp, Homo sapiens
ttgcctgtgaggattctggttg

SEQ ID NO: 10036454 - DNA, 19 bp, Homo sapiens
ttgcatttcatgtttgatt

SEQ ID NO: 10036455 - DNA, 22 bp, Homo sapiens
ttgcatttgctcatttgatatg

SEQ ID NO: 10036456 - DNA, 22 bp, Homo sapiens
ttgcatttcctgtactgtttga

SEQ ID NO: 10036457 - DNA, 22 bp, Homo sapiens
ttgcatttttagatgcttctgt

SEQ ID NO: 10036458 - DNA, 21 bp, Homo sapiens
ttgcattttaagtttactgct

SEQ ID NO: 10036459 - DNA, 22 bp, Homo sapiens
ttgcattttggttgtaaatatg

SEQ ID NO: 10036460 - DNA, 22 bp, Homo sapiens
ttgccagggccagtgggggtgt

SEQ ID NO: 10036461 - DNA, 22 bp, Homo sapiens
ttggccctgaggaggcagctgc

SEQ ID NO: 10036462 - DNA, 22 bp, Homo sapiens
ttggccctccacctggctgtgc

SEQ ID NO: 10036463 - DNA, 22 bp, Homo sapiens
ttggccctggggccagcttcga

SEQ ID NO: 10036464 - DNA, 22 bp, Homo sapiens
ttggccctgaggttatcatcta

SEQ ID NO: 10036465 - DNA, 22 bp, Homo sapiens
ttggccctttatgggatgggca

SEQ ID NO: 10036466 - DNA, 22 bp, Homo sapiens
ttgggctcaggagtttgagacc

SEQ ID NO: 10036467 - DNA, 22 bp, Homo sapiens
ttgtacttttgtcaggtggaca

SEQ ID NO: 10036468 - DNA, 22 bp, Homo sapiens
ttgtattaattgaaatgaatgc

SEQ ID NO: 10036469 - DNA, 22 bp, Homo sapiens
cccagctcgccgccgatgtgcg

SEQ ID NO: 10036470 - DNA, 22 bp, Homo sapiens
ccatgagacagcaactgaaagt

SEQ ID NO: 10036471 - DNA, 22 bp, Homo sapiens
ccagtttgaggaagaagtagat

SEQ ID NO: 10036472 - DNA, 22 bp, Homo sapiens
agggagccagagttgggagctc

SEQ ID NO: 10036473 - DNA, 22 bp, Homo sapiens
agggagcatgggtgaagcaggc

SEQ ID NO: 10036474 - DNA, 22 bp, Homo sapiens
ccctgggattcaatttcactct

SEQ ID NO: 10036475 - DNA, 21 bp, Homo sapiens
ccctgggatgggcttggactt

SEQ ID NO: 10036476 - DNA, 22 bp, Homo sapiens
ccctgggatggattggcaggaa

SEQ ID NO: 10036477 - DNA, 22 bp, Homo sapiens
ccctgggcagtctgcacttcag

SEQ ID NO: 10036478 - DNA, 22 bp, Homo sapiens
ccctgggcaccaggcctggtaa

SEQ ID NO: 10036479 - DNA, 22 bp, Homo sapiens
ccctgggcaagccctattttcc

SEQ ID NO: 10036480 - DNA, 22 bp, Homo sapiens
ccctgggattgccttggccttg

SEQ ID NO: 10036481 - DNA, 22 bp, Homo sapiens
ccctgggctcagagcaggtagc

SEQ ID NO: 10036482 - DNA, 22 bp, Homo sapiens
agggcagcctctcagcctaggt

SEQ ID NO: 10036483 - DNA, 22 bp, Homo sapiens
agggcagctctcacctctggcc

SEQ ID NO: 10036484 - DNA, 22 bp, Homo sapiens
agggcagcccttctgggagggc

SEQ ID NO: 10036485 - DNA, 22 bp, Homo sapiens
agggcagccattgagggattct

SEQ ID NO: 10036486 - DNA, 22 bp, Homo sapiens
cctctcctggctgtaggacctc

SEQ ID NO: 10036487 - DNA, 22 bp, Homo sapiens
cctcccatggagctctgtccat

SEQ ID NO: 10036488 - DNA, 22 bp, Homo sapiens
cctccagctgcctcagtctctt

SEQ ID NO: 10036489 - DNA, 21 bp, Homo sapiens
cctcagagacagatacgggtg

SEQ ID NO: 10036490 - DNA, 22 bp, Homo sapiens
cctcagagacagtaactggaat

SEQ ID NO: 10036491 - DNA, 22 bp, Homo sapiens
cctcagagactgcatcttccct

SEQ ID NO: 10036492 - DNA, 23 bp, Homo sapiens
cctcagagaggcagagccacatg

SEQ ID NO: 10036493 - DNA, 22 bp, Homo sapiens
cctcagagcagcacccagatga

SEQ ID NO: 10036494 - DNA, 22 bp, Homo sapiens
cctcagagccatgcctgagttc

SEQ ID NO: 10036495 - DNA, 22 bp, Homo sapiens
cctcagagcctccagaaggaat

SEQ ID NO: 10036496 - DNA, 22 bp, Homo sapiens
cctcagagaaaggtatggctga

SEQ ID NO: 10036497 - DNA, 22 bp, Homo sapiens
cctcagagaaatgtctattcaa

SEQ ID NO: 10036498 - DNA, 22 bp, Homo sapiens
aggcagtctagtccccaggcaa

SEQ ID NO: 10036499 - DNA, 22 bp, Homo sapiens
aggcagtctatctctggagcct

SEQ ID NO: 10036500 - DNA, 22 bp, Homo sapiens
aggcaggttggtgagaagactg

SEQ ID NO: 10036501 - DNA, 22 bp, Homo sapiens
aggcagccctgtgctggatgct

SEQ ID NO: 10036502 - DNA, 22 bp, Homo sapiens
aggcagccatctgcaggaagga

SEQ ID NO: 10036503 - DNA, 22 bp, Homo sapiens
aggcagcccacaggacacagga

SEQ ID NO: 10036504 - DNA, 22 bp, Homo sapiens
aggcagtggagctggaataggc

SEQ ID NO: 10036505 - DNA, 22 bp, Homo sapiens
aggcagtgctgtgccctgaacc

SEQ ID NO: 10036506 - DNA, 22 bp, Homo sapiens
aggcagtggaaggagaaagcaa

SEQ ID NO: 10036507 - DNA, 22 bp, Homo sapiens
aggcagtggatgtcaggaatgg

SEQ ID NO: 10036508 - DNA, 22 bp, Homo sapiens
aggcagtggctgagaccagggg

SEQ ID NO: 10036509 - DNA, 22 bp, Homo sapiens
aggcagtgcctggaccccagct

SEQ ID NO: 10036510 - DNA, 22 bp, Homo sapiens
aggcagtgcatgcaaaggtcgg

SEQ ID NO: 10036511 - DNA, 22 bp, Homo sapiens
aggcagtgctcaagacagcagc

SEQ ID NO: 10036512 - DNA, 22 bp, Homo sapiens
aggcagttgtagagagggctct

SEQ ID NO: 10036513 - DNA, 22 bp, Homo sapiens
aggcagttgttgctgagcagct

SEQ ID NO: 10036514 - DNA, 22 bp, Homo sapiens
aggcagtttatccccagagcct

SEQ ID NO: 10036515 - DNA, 22 bp, Homo sapiens
aggcagtttctgggacagcata

SEQ ID NO: 10036516 - DNA, 22 bp, Homo sapiens
aggcagtggctgagaccagggg

SEQ ID NO: 10036517 - DNA, 22 bp, Homo sapiens
aggcagtggcttttgttgtgtt

SEQ ID NO: 10036518 - DNA, 22 bp, Homo sapiens
aggcatctgagtttgcaagctt

SEQ ID NO: 10036519 - DNA, 21 bp, Homo sapiens
aggcatctaaagagagtagac

SEQ ID NO: 10036520 - DNA, 21 bp, Homo sapiens
aggcatctaaagagagtagac

SEQ ID NO: 10036521 - DNA, 22 bp, Homo sapiens
aggcatgatgtgcagtggcaaa

SEQ ID NO: 10036522 - DNA, 22 bp, Homo sapiens
aggccagctctacccttggact

SEQ ID NO: 10036523 - DNA, 22 bp, Homo sapiens
aggccagcttccagaggggcag

SEQ ID NO: 10036524 - DNA, 22 bp, Homo sapiens
aggccagcgctgctagctcccg

SEQ ID NO: 10036525 - DNA, 22 bp, Homo sapiens
aggccagcaagaaagagagtct

SEQ ID NO: 10036526 - DNA, 22 bp, Homo sapiens
aggcccagtcctctgccgtctg

SEQ ID NO: 10036527 - DNA, 22 bp, Homo sapiens
aggccctgggttagggcccact

SEQ ID NO: 10036528 - DNA, 22 bp, Homo sapiens
aggccctgaagtcggcccctca

SEQ ID NO: 10036529 - DNA, 22 bp, Homo sapiens
aggctctgccaattccttcctc

SEQ ID NO: 10036530 - DNA, 22 bp, Homo sapiens
aggctctgagtagagctgccag

SEQ ID NO: 10036531 - DNA, 22 bp, Homo sapiens
aggctctgcagtccatcccgtg

SEQ ID NO: 10036532 - DNA, 22 bp, Homo sapiens
ccagtctgtgtgccagcctgcg

SEQ ID NO: 10036533 - DNA, 23 bp, Homo sapiens
ccagtgattgcctggaaggaggt

SEQ ID NO: 10036534 - DNA, 22 bp, Homo sapiens
ccagtctgtactttgctctgtt

SEQ ID NO: 10036535 - DNA, 22 bp, Homo sapiens
ccaggcacttcatcattagggt

SEQ ID NO: 10036536 - DNA, 22 bp, Homo sapiens
aggaagctcctggagagccagt

SEQ ID NO: 10036537 - DNA, 22 bp, Homo sapiens
aggaagctccatgaaggcagag

SEQ ID NO: 10036538 - DNA, 22 bp, Homo sapiens
aggaactccacggtcttgtcgg

SEQ ID NO: 10036539 - DNA, 22 bp, Homo sapiens
aggaactgatgagcagccaggg

SEQ ID NO: 10036540 - DNA, 22 bp, Homo sapiens
cagcttttaggactgtgagaaa

SEQ ID NO: 10036541 - DNA, 22 bp, Homo sapiens
agctctgccttgacaccttctc

SEQ ID NO: 10036542 - DNA, 22 bp, Homo sapiens
agctctctgataaattgataaa

SEQ ID NO: 10036543 - DNA, 22 bp, Homo sapiens
cagcttctgtcctagaaactgg

SEQ ID NO: 10036544 - DNA, 21 bp, Homo sapiens
agctggcctggtttgagctcc

SEQ ID NO: 10036545 - DNA, 22 bp, Homo sapiens
caggacagagcccagactgtgt

SEQ ID NO: 10036546 - DNA, 22 bp, Homo sapiens
aggcagcagcttgctggttgcc

SEQ ID NO: 10036547 - DNA, 22 bp, Homo sapiens
catttacagcagactgatgaaa

SEQ ID NO: 10036548 - DNA, 22 bp, Homo sapiens
catttacagtgagagtttttac

SEQ ID NO: 10036549 - DNA, 22 bp, Homo sapiens
catttacataacagtaacgctg

SEQ ID NO: 10036550 - DNA, 21 bp, Homo sapiens
catttacatgacagattggtt

SEQ ID NO: 10036551 - DNA, 22 bp, Homo sapiens
aggcagcagaggttgaggaaag

SEQ ID NO: 10036552 - DNA, 22 bp, Homo sapiens
aggcagcatttgaatccaggtc

SEQ ID NO: 10036553 - DNA, 22 bp, Homo sapiens
aggcagccaatcagaggctgac

SEQ ID NO: 10036554 - DNA, 19 bp, Homo sapiens
aggcagcattctggggctt

SEQ ID NO: 10036555 - DNA, 22 bp, Homo sapiens
aggcagcagtcatgaggaaaga

SEQ ID NO: 10036556 - DNA, 22 bp, Homo sapiens
catttacatttaaggttaatat

SEQ ID NO: 10036557 - DNA, 22 bp, Homo sapiens
catggcctgcctcctcctggtg

SEQ ID NO: 10036558 - DNA, 22 bp, Homo sapiens
catggccttgagtgactgcact

SEQ ID NO: 10036559 - DNA, 22 bp, Homo sapiens
catggcctcaaaggactgcaga

SEQ ID NO: 10036560 - DNA, 19 bp, Homo sapiens
aggcagaggcttggctagc

SEQ ID NO: 10036561 - DNA, 22 bp, Homo sapiens
catgccaggactctggaggctt

SEQ ID NO: 10036562 - DNA, 22 bp, Homo sapiens
catgcctgtaatcccagcactt

SEQ ID NO: 10036563 - DNA, 22 bp, Homo sapiens
catgcctgtaatcccagctctt

SEQ ID NO: 10036564 - DNA, 20 bp, Homo sapiens
catgccatgtctactgaggc

SEQ ID NO: 10036565 - DNA, 22 bp, Homo sapiens
aggcacaggaatgtcatccagt

SEQ ID NO: 10036566 - DNA, 22 bp, Homo sapiens
aggcacaggaggtggtaagaag

SEQ ID NO: 10036567 - DNA, 22 bp, Homo sapiens
aggcacaggaacaggaaaagag

SEQ ID NO: 10036568 - DNA, 22 bp, Homo sapiens
aggcacagcctcccttcacatg

SEQ ID NO: 10036569 - DNA, 22 bp, Homo sapiens
catgcctgtatttctgatctat

SEQ ID NO: 10036570 - DNA, 22 bp, Homo sapiens
aggcacagcacacctggccccc

SEQ ID NO: 10036571 - DNA, 22 bp, Homo sapiens
aggcacagcctcccccaactcc

SEQ ID NO: 10036572 - DNA, 22 bp, Homo sapiens
aggaggtggctgaacttgaggg

SEQ ID NO: 10036573 - DNA, 22 bp, Homo sapiens
aggaggcactcactctcagggt

SEQ ID NO: 10036574 - DNA, 22 bp, Homo sapiens
aggagagggtggcattaagttt

SEQ ID NO: 10036575 - DNA, 22 bp, Homo sapiens
aggagaggggtaggattaattt

SEQ ID NO: 10036576 - DNA, 22 bp, Homo sapiens
aggagaggctctaactctgtgt

SEQ ID NO: 10036577 - DNA, 22 bp, Homo sapiens
aggagaggaatcattattacaa

SEQ ID NO: 10036578 - DNA, 22 bp, Homo sapiens
aggagagctggtgtctggaatc

SEQ ID NO: 10036579 - DNA, 22 bp, Homo sapiens
aggagaggcatcaagaaaatcg

SEQ ID NO: 10036580 - DNA, 22 bp, Homo sapiens
aggagagaatgttccaggcttg

SEQ ID NO: 10036581 - DNA, 18 bp, Homo sapiens
aggagcctttgcactgga

SEQ ID NO: 10036582 - DNA, 22 bp, Homo sapiens
aggagaggtctcccttccccag

SEQ ID NO: 10036583 - DNA, 22 bp, Homo sapiens
aggagctgagggagcgcccttg

SEQ ID NO: 10036584 - DNA, 22 bp, Homo sapiens
aggacagcccttgagagcacat

SEQ ID NO: 10036585 - DNA, 22 bp, Homo sapiens
aggacagcagttggtgaggttc

SEQ ID NO: 10036586 - DNA, 22 bp, Homo sapiens
aggaagctgctggagtagtgtg

SEQ ID NO: 10036587 - DNA, 20 bp, Homo sapiens
aggaagctgagatgtagagg

SEQ ID NO: 10036588 - DNA, 22 bp, Homo sapiens
aggaagctgcctgggatgggaa

SEQ ID NO: 10036589 - DNA, 22 bp, Homo sapiens
aggaagcttagtgaaaggacca

SEQ ID NO: 10036590 - DNA, 22 bp, Homo sapiens
aggaagctggtgtgaggatgaa

SEQ ID NO: 10036591 - DNA, 22 bp, Homo sapiens
aggacagcagtgctggcacttg

SEQ ID NO: 10036592 - DNA, 20 bp, Homo sapiens
aggacagcagctgccacttg

SEQ ID NO: 10036593 - DNA, 20 bp, Homo sapiens
agggtctgatgtggtggccc

SEQ ID NO: 10036594 - DNA, 22 bp, Homo sapiens
agggtctggtgtagaagttctc

SEQ ID NO: 10036595 - DNA, 22 bp, Homo sapiens
agggtctgaccaccagtaggga

SEQ ID NO: 10036596 - DNA, 22 bp, Homo sapiens
cctctgccacctcccacgaggc

SEQ ID NO: 10036597 - DNA, 22 bp, Homo sapiens
cctctgagtcctccctggttgc

SEQ ID NO: 10036598 - DNA, 22 bp, Homo sapiens
cctctgagtgttttccccgggt

SEQ ID NO: 10036599 - DNA, 22 bp, Homo sapiens
cctctgagttagagatctagat

SEQ ID NO: 10036600 - DNA, 22 bp, Homo sapiens
cctctgagtgacagcctcctct

SEQ ID NO: 10036601 - DNA, 22 bp, Homo sapiens
cctctgagtcctttgggctctc

SEQ ID NO: 10036602 - DNA, 22 bp, Homo sapiens
cctctgagtctcactgtaacct

SEQ ID NO: 10036603 - DNA, 22 bp, Homo sapiens
cctggacagagggcagcggcca

SEQ ID NO: 10036604 - DNA, 22 bp, Homo sapiens
cctggacaatgagatgtcaggg

SEQ ID NO: 10036605 - DNA, 22 bp, Homo sapiens
cggaggggatacattttctgaa

SEQ ID NO: 10036606 - DNA, 22 bp, Homo sapiens
cggaggggtttgaacagaggag

SEQ ID NO: 10036607 - DNA, 22 bp, Homo sapiens
cggccaagccggggccccgaag

SEQ ID NO: 10036608 - DNA, 22 bp, Homo sapiens
cggccctggcggaggcgggaga

SEQ ID NO: 10036609 - DNA, 22 bp, Homo sapiens
cggccctgaccagaccttagtt

SEQ ID NO: 10036610 - DNA, 22 bp, Homo sapiens
cggccctgctgagcttgtctgg

SEQ ID NO: 10036611 - DNA, 22 bp, Homo sapiens
cgaggcagggaagctgcaaaag

SEQ ID NO: 10036612 - DNA, 22 bp, Homo sapiens
cgaggcagacaaaagttggaag

SEQ ID NO: 10036613 - DNA, 18 bp, Homo sapiens
cgaggcaggcggatcacg

SEQ ID NO: 10036614 - DNA, 22 bp, Homo sapiens
cgaggcaggcaggcggaggata

SEQ ID NO: 10036615 - DNA, 22 bp, Homo sapiens
cgaggcagaggctgaaacggct

SEQ ID NO: 10036616 - DNA, 22 bp, Homo sapiens
aggtgggggctgtgtccttgac

SEQ ID NO: 10036617 - DNA, 22 bp, Homo sapiens
cctgggacttggtctggggttt

SEQ ID NO: 10036618 - DNA, 22 bp, Homo sapiens
cctgggactcggccaggacaga

SEQ ID NO: 10036619 - DNA, 22 bp, Homo sapiens
cctgggacgactctgtaccctt

SEQ ID NO: 10036620 - DNA, 21 bp, Homo sapiens
cctgggacactcaccagctcc

SEQ ID NO: 10036621 - DNA, 22 bp, Homo sapiens
cctgggaagttgtggctgcagt

SEQ ID NO: 10036622 - DNA, 22 bp, Homo sapiens
ctccttctgggcctggcagtgg

SEQ ID NO: 10036623 - DNA, 22 bp, Homo sapiens
ctcctgaggggacaggactcat

SEQ ID NO: 10036624 - DNA, 22 bp, Homo sapiens
agtggtggagccaggaaatgtg

SEQ ID NO: 10036625 - DNA, 22 bp, Homo sapiens
ctctgtccttgcacagttccta

SEQ ID NO: 10036626 - DNA, 22 bp, Homo sapiens
ctctgtatgaatcatatggagt

SEQ ID NO: 10036627 - DNA, 22 bp, Homo sapiens
ctctgtatagaaaggaaacatt

SEQ ID NO: 10036628 - DNA, 22 bp, Homo sapiens
agtgggaccggtgctattccag

SEQ ID NO: 10036629 - DNA, 22 bp, Homo sapiens
ctctggacttgtacatactcag

SEQ ID NO: 10036630 - DNA, 22 bp, Homo sapiens
ctctggacctcagtctactaat

SEQ ID NO: 10036631 - DNA, 21 bp, Homo sapiens
ctcaaagaccaaaagtgtaga

SEQ ID NO: 10036632 - DNA, 22 bp, Homo sapiens
ctcaaagagccaggtaatcacc

SEQ ID NO: 10036633 - DNA, 22 bp, Homo sapiens
cggggtggcactctaaatagaa

SEQ ID NO: 10036634 - DNA, 22 bp, Homo sapiens
cggggtgggaatagacctgtct

SEQ ID NO: 10036635 - DNA, 22 bp, Homo sapiens
agtgacaaaacggaacatacag

SEQ ID NO: 10036636 - DNA, 22 bp, Homo sapiens
agtgacacggagagacagcatg

SEQ ID NO: 10036637 - DNA, 22 bp, Homo sapiens
ctcagccccagcccagatagca

SEQ ID NO: 10036638 - DNA, 22 bp, Homo sapiens
ctcagctctgtcacttactagc

SEQ ID NO: 10036639 - DNA, 22 bp, Homo sapiens
agtctcagccacacagacctat

SEQ ID NO: 10036640 - DNA, 22 bp, Homo sapiens
ctgggcacacagtgactctgca

SEQ ID NO: 10036641 - DNA, 22 bp, Homo sapiens
ctgggcacattttgactagtgt

SEQ ID NO: 10036642 - DNA, 20 bp, Homo sapiens
ctgggcacctgtctgcagtt

SEQ ID NO: 10036643 - DNA, 22 bp, Homo sapiens
ctgggacaagctctgtctagct

SEQ ID NO: 10036644 - DNA, 22 bp, Homo sapiens
ctgggacacagccttacctggg

SEQ ID NO: 10036645 - DNA, 23 bp, Homo sapiens
atatgtcatgcaccagcacttta

SEQ ID NO: 10036646 - DNA, 22 bp, Homo sapiens
ctgggcaggatacttcatggga

SEQ ID NO: 10036647 - DNA, 22 bp, Homo sapiens
ctgggcaggagggctctatgga

SEQ ID NO: 10036648 - DNA, 22 bp, Homo sapiens
atatgcaagcacatagaatact

SEQ ID NO: 10036649 - DNA, 22 bp, Homo sapiens
ctgggcagtggtggcatctttg

SEQ ID NO: 10036650 - DNA, 22 bp, Homo sapiens
ctgtctgttttaccttctccag

SEQ ID NO: 10036651 - DNA, 22 bp, Homo sapiens
ctgtctgtttctgattcaacct

SEQ ID NO: 10036652 - DNA, 22 bp, Homo sapiens
ctgtgcagctggcttcctggaa

SEQ ID NO: 10036653 - DNA, 22 bp, Homo sapiens
atctacaacgggtggagtaggg

SEQ ID NO: 10036654 - DNA, 22 bp, Homo sapiens
atcctcagtgtttctgacatct

SEQ ID NO: 10036655 - DNA, 18 bp, Homo sapiens
atcctctagcttctcaga

SEQ ID NO: 10036656 - DNA, 22 bp, Homo sapiens
atcctcagacttcacgttccat

SEQ ID NO: 10036657 - DNA, 22 bp, Homo sapiens
atccccaggggcattcaagctt

SEQ ID NO: 10036658 - DNA, 22 bp, Homo sapiens
atccctgaatgctcctgactgg

SEQ ID NO: 10036659 - DNA, 22 bp, Homo sapiens
ctgccaggcagggagatggctg

SEQ ID NO: 10036660 - DNA, 22 bp, Homo sapiens
ctgccaggcagcagagggagaa

SEQ ID NO: 10036661 - DNA, 22 bp, Homo sapiens
ctgccaggcacgtgcagcatca

SEQ ID NO: 10036662 - DNA, 22 bp, Homo sapiens
ctgcagcctcaacctcctgagc

SEQ ID NO: 10036663 - DNA, 22 bp, Homo sapiens
agttgtcccggtctagccactt

SEQ ID NO: 10036664 - DNA, 22 bp, Homo sapiens
agtttgtaaacttgagctagcc

SEQ ID NO: 10036665 - DNA, 22 bp, Homo sapiens
agtttgtaaaatgtggcctgga

SEQ ID NO: 10036666 - DNA, 19 bp, Homo sapiens
agtttgaggaagttaagaa

SEQ ID NO: 10036667 - DNA, 22 bp, Homo sapiens
agtttgatggcttaatagtaga

SEQ ID NO: 10036668 - DNA, 22 bp, Homo sapiens
agtttgatgattacagagaaaa

SEQ ID NO: 10036669 - DNA, 20 bp, Homo sapiens
agtttgagaggaagtcagtg

SEQ ID NO: 10036670 - DNA, 22 bp, Homo sapiens
agttgtattagagaacacaaac

SEQ ID NO: 10036671 - DNA, 22 bp, Homo sapiens
ctgaggcaggagaattgctgga

SEQ ID NO: 10036672 - DNA, 22 bp, Homo sapiens
agttggagtgaacatgagattg

SEQ ID NO: 10036673 - DNA, 22 bp, Homo sapiens
ctgctgtgtgaccatggacagg

SEQ ID NO: 10036674 - DNA, 18 bp, Homo sapiens
ctgctgtgtcgtctgggc

SEQ ID NO: 10036675 - DNA, 18 bp, Homo sapiens
ctgcccagagcacttgtg

SEQ ID NO: 10036676 - DNA, 22 bp, Homo sapiens
ctgcccagaagccagatgggca

SEQ ID NO: 10036677 - DNA, 22 bp, Homo sapiens
ctgctctgagaggctcttccta

SEQ ID NO: 10036678 - DNA, 22 bp, Homo sapiens
ctgctctggtctcttcatgttt

SEQ ID NO: 10036679 - DNA, 22 bp, Homo sapiens
cagcatgcccagactgagctaa

SEQ ID NO: 10036680 - DNA, 22 bp, Homo sapiens
cagcatgcctgggctgcctgcc

SEQ ID NO: 10036681 - DNA, 22 bp, Homo sapiens
cagccactctcagacagtccca

SEQ ID NO: 10036682 - DNA, 22 bp, Homo sapiens
cagccactgaactcctggctat

SEQ ID NO: 10036683 - DNA, 22 bp, Homo sapiens
cagccactggtgccaggctgtt

SEQ ID NO: 10036684 - DNA, 21 bp, Homo sapiens
cagcagagtaatgcattcgta

SEQ ID NO: 10036685 - DNA, 22 bp, Homo sapiens
cagcagagctgtgtgggaaggg

SEQ ID NO: 10036686 - DNA, 22 bp, Homo sapiens
cagcagcaaatctagaagagga

SEQ ID NO: 10036687 - DNA, 22 bp, Homo sapiens
cagcagcaacaacggaagcctt

SEQ ID NO: 10036688 - DNA, 22 bp, Homo sapiens
cagcagcagagatactggtttc

SEQ ID NO: 10036689 - DNA, 22 bp, Homo sapiens
cagcagcacctattatagtgtt

SEQ ID NO: 10036690 - DNA, 22 bp, Homo sapiens
cagcagcactctgcgggtcccc

SEQ ID NO: 10036691 - DNA, 22 bp, Homo sapiens
cagcagcaaggtgagggtggag

SEQ ID NO: 10036692 - DNA, 22 bp, Homo sapiens
gtatcggtttatttttgggata

SEQ ID NO: 10036693 - DNA, 22 bp, Homo sapiens
cagcaggaccattgaggcatca

SEQ ID NO: 10036694 - DNA, 22 bp, Homo sapiens
cagcaggatttgaaaggaagag

SEQ ID NO: 10036695 - DNA, 22 bp, Homo sapiens
cagcaggatttgaaaggaagag

SEQ ID NO: 10036696 - DNA, 22 bp, Homo sapiens
cagcaggatatggtggagagag

SEQ ID NO: 10036697 - DNA, 21 bp, Homo sapiens
gggtgggaggacacagcaggc

SEQ ID NO: 10036698 - DNA, 20 bp, Homo sapiens
gggtgggagagtctgagggt

SEQ ID NO: 10036699 - DNA, 22 bp, Homo sapiens
gggtgggaaggctaagggattg

SEQ ID NO: 10036700 - DNA, 22 bp, Homo sapiens
gggtgggactctttggcctgag

SEQ ID NO: 10036701 - DNA, 22 bp, Homo sapiens
gggtgggactgaagtctgaggg

SEQ ID NO: 10036702 - DNA, 22 bp, Homo sapiens
gtaaaattctagcatctgaaag

SEQ ID NO: 10036703 - DNA, 22 bp, Homo sapiens
cagagctgattggatccagaga

SEQ ID NO: 10036704 - DNA, 22 bp, Homo sapiens
gggcacagagggtcttgaagaa

SEQ ID NO: 10036705 - DNA, 22 bp, Homo sapiens
gggcactgtggggcccatgctg

SEQ ID NO: 10036706 - DNA, 22 bp, Homo sapiens
gggcactgtgttcagagtgcag

SEQ ID NO: 10036707 - DNA, 22 bp, Homo sapiens
cagagccagcccactgttcccg

SEQ ID NO: 10036708 - DNA, 22 bp, Homo sapiens
cagacagggccctgtgatggta

SEQ ID NO: 10036709 - DNA, 22 bp, Homo sapiens
gggaggggttgcatgtttgagt

SEQ ID NO: 10036710 - DNA, 22 bp, Homo sapiens
cagacaggaattctggcgtggt

SEQ ID NO: 10036711 - DNA, 22 bp, Homo sapiens
cactggcccataaaggcctggg

SEQ ID NO: 10036712 - DNA, 22 bp, Homo sapiens
cactggcccagccaggcctgtt

SEQ ID NO: 10036713 - DNA, 22 bp, Homo sapiens
gggactctgagagcctgagggt

SEQ ID NO: 10036714 - DNA, 22 bp, Homo sapiens
cactgcccactccttcgtccaa

SEQ ID NO: 10036715 - DNA, 22 bp, Homo sapiens
cactgcccaactgttttccaaa

SEQ ID NO: 10036716 - DNA, 22 bp, Homo sapiens
ggcagttgcgtgcatcagtggt

SEQ ID NO: 10036717 - DNA, 22 bp, Homo sapiens
ggcactggaagtcccattgtct

SEQ ID NO: 10036718 - DNA, 22 bp, Homo sapiens
ggcactggaaggatcatgtgag

SEQ ID NO: 10036719 - DNA, 22 bp, Homo sapiens
ggcactgggaatgcagtgatga

SEQ ID NO: 10036720 - DNA, 22 bp, Homo sapiens
ggcacaggagtcacagcatttc

SEQ ID NO: 10036721 - DNA, 22 bp, Homo sapiens
ggcacagggagccgcagttgca

SEQ ID NO: 10036722 - DNA, 22 bp, Homo sapiens
ggcacagggtgatgttgcagtt

SEQ ID NO: 10036723 - DNA, 22 bp, Homo sapiens
ggcacagtgattaagagccagt

SEQ ID NO: 10036724 - DNA, 22 bp, Homo sapiens
ggcagcagtggctgctattgtc

SEQ ID NO: 10036725 - DNA, 22 bp, Homo sapiens
cacagtgtctgtgcttcagtgt

SEQ ID NO: 10036726 - DNA, 22 bp, Homo sapiens
cacagtgtgactgaccttcagc

SEQ ID NO: 10036727 - DNA, 22 bp, Homo sapiens
ggcagcatctctggcagcagct

SEQ ID NO: 10036728 - DNA, 22 bp, Homo sapiens
ggcagcatatattcagtgggca

SEQ ID NO: 10036729 - DNA, 22 bp, Homo sapiens
ggcagcagttacaaatgtgcag

SEQ ID NO: 10036730 - DNA, 22 bp, Homo sapiens
ggcagagctctggactgagaac

SEQ ID NO: 10036731 - DNA, 22 bp, Homo sapiens
cacagtgtagactaataataga

SEQ ID NO: 10036732 - DNA, 22 bp, Homo sapiens
cacagctggtgcactagctctg

SEQ ID NO: 10036733 - DNA, 22 bp, Homo sapiens
cacagctgttttctccaggcag

SEQ ID NO: 10036734 - DNA, 22 bp, Homo sapiens
ggaggcgatcctgggaaacacc

SEQ ID NO: 10036735 - DNA, 22 bp, Homo sapiens
ggaggccttgcctgcaggcaca

SEQ ID NO: 10036736 - DNA, 22 bp, Homo sapiens
cacagggaggcggtcactggct

SEQ ID NO: 10036737 - DNA, 22 bp, Homo sapiens
ggatgggagcagaggacgacca

SEQ ID NO: 10036738 - DNA, 22 bp, Homo sapiens
gctgcagtgagccaagatcgtg

SEQ ID NO: 10036739 - DNA, 22 bp, Homo sapiens
gctgccacattttcaggactaa

SEQ ID NO: 10036740 - DNA, 23 bp, Homo sapiens
gctgccacagggctcaggcaggt

SEQ ID NO: 10036741 - DNA, 22 bp, Homo sapiens
gctcctcttctcccactgaatg

SEQ ID NO: 10036742 - DNA, 22 bp, Homo sapiens
gctgccttcccaggcctttgct

SEQ ID NO: 10036743 - DNA, 22 bp, Homo sapiens
gctgccttccaaagagttttat

SEQ ID NO: 10036744 - DNA, 22 bp, Homo sapiens
gctgccttcccggaatgtcatc

SEQ ID NO: 10036745 - DNA, 20 bp, Homo sapiens
gctgccttgtcctgcttggt

SEQ ID NO: 10036746 - DNA, 22 bp, Homo sapiens
caagatgtggtgggctgagttt

SEQ ID NO: 10036747 - DNA, 22 bp, Homo sapiens
caagagttgagggatgtcagtt

SEQ ID NO: 10036748 - DNA, 22 bp, Homo sapiens
gctgtgctgattcattccctgc

SEQ ID NO: 10036749 - DNA, 22 bp, Homo sapiens
gctgtctgcaagccaggaaatg

SEQ ID NO: 10036750 - DNA, 20 bp, Homo sapiens
gctgtctgacagttcccaga

SEQ ID NO: 10036751 - DNA, 22 bp, Homo sapiens
gcttggccagcagccgggatgc

SEQ ID NO: 10036752 - DNA, 22 bp, Homo sapiens
attccttgtttcactgaaaagg

SEQ ID NO: 10036753 - DNA, 22 bp, Homo sapiens
gcagcaggcttttcataccttg

SEQ ID NO: 10036754 - DNA, 22 bp, Homo sapiens
gcagcagggagcaggggtgtca

SEQ ID NO: 10036755 - DNA, 22 bp, Homo sapiens
attgctgttgttatggcactgt

SEQ ID NO: 10036756 - DNA, 22 bp, Homo sapiens
attgaaaaatgactattgctta

SEQ ID NO: 10036757 - DNA, 22 bp, Homo sapiens
attgaagattaaatgcttcctt

SEQ ID NO: 10036758 - DNA, 20 bp, Homo sapiens
attattcatacatgtgtgac

SEQ ID NO: 10036759 - DNA, 22 bp, Homo sapiens
attacaacaagaaaagggtaag

SEQ ID NO: 10036760 - DNA, 22 bp, Homo sapiens
attacaaaagaagggagaaggt

SEQ ID NO: 10036761 - DNA, 22 bp, Homo sapiens
caaaccttgcagaactgggcag

SEQ ID NO: 10036762 - DNA, 17 bp, Homo sapiens
gcgcagctcctggcgcg

SEQ ID NO: 10036763 - DNA, 22 bp, Homo sapiens
gcctgggagggcagcagtgtgg

SEQ ID NO: 10036764 - DNA, 18 bp, Homo sapiens
gcctgggaggaggaaatg

SEQ ID NO: 10036765 - DNA, 23 bp, Homo sapiens
gcctgggagttgcgatctgcccg

SEQ ID NO: 10036766 - DNA, 22 bp, Homo sapiens
gcctgggagtgcacagtgaggt

SEQ ID NO: 10036767 - DNA, 22 bp, Homo sapiens
gcctctctgggctgccgaggct

SEQ ID NO: 10036768 - DNA, 22 bp, Homo sapiens
gcctgctggatgtggccaggcc

SEQ ID NO: 10036769 - DNA, 22 bp, Homo sapiens
gcctgctgccaccctggctccg

SEQ ID NO: 10036770 - DNA, 22 bp, Homo sapiens
gcctgggagcacatcggggtcc

SEQ ID NO: 10036771 - DNA, 22 bp, Homo sapiens
gcctgggagatgcgttgtggcc

SEQ ID NO: 10036772 - DNA, 22 bp, Homo sapiens
gcctgggagattaattaggaag

SEQ ID NO: 10036773 - DNA, 22 bp, Homo sapiens
gcctgggagagggatagtgcag

SEQ ID NO: 10036774 - DNA, 22 bp, Homo sapiens
gcctctccgagccactgcctct

SEQ ID NO: 10036775 - DNA, 22 bp, Homo sapiens
gcctccagggtagaggaggaag

SEQ ID NO: 10036776 - DNA, 22 bp, Homo sapiens
atttcaggtacctgtgggatcc

SEQ ID NO: 10036777 - DNA, 19 bp, Homo sapiens
gccaggagggctctggctg

SEQ ID NO: 10036778 - DNA, 22 bp, Homo sapiens
gccaggaggggagagtgtgtca

SEQ ID NO: 10036779 - DNA, 22 bp, Homo sapiens
gccaggagggaaaggacaattt

SEQ ID NO: 10036780 - DNA, 22 bp, Homo sapiens
gccaggaggcttaactggacag

SEQ ID NO: 10036781 - DNA, 22 bp, Homo sapiens
atttacacttggtttactagag

SEQ ID NO: 10036782 - DNA, 22 bp, Homo sapiens
atttacactggttctcagagct

SEQ ID NO: 10036783 - DNA, 22 bp, Homo sapiens
atttacactaaaggaaggagga

SEQ ID NO: 10036784 - DNA, 22 bp, Homo sapiens
atttacaccttcttcgattctc

SEQ ID NO: 10036785 - DNA, 22 bp, Homo sapiens
atttacacattcataagatttc

SEQ ID NO: 10036786 - DNA, 22 bp, Homo sapiens
gccaggagtgtgtggctatgtt

SEQ ID NO: 10036787 - DNA, 22 bp, Homo sapiens
gccaggagtgtcccactcattt

SEQ ID NO: 10036788 - DNA, 20 bp, Homo sapiens
gccaggagggtgtgatgagc

SEQ ID NO: 10036789 - DNA, 22 bp, Homo sapiens
gccaggaggtcagcccctcaac

SEQ ID NO: 10036790 - DNA, 21 bp, Homo sapiens
gccaggagtagattacattta

SEQ ID NO: 10036791 - DNA, 23 bp, Homo sapiens
gccaggagtgggtagactaatgc

SEQ ID NO: 10036792 - DNA, 17 bp, Homo sapiens
gccaggaggtttgagct

SEQ ID NO: 10036793 - DNA, 22 bp, Homo sapiens
atttagaactttgtttgccaat

SEQ ID NO: 10036794 - DNA, 22 bp, Homo sapiens
attggcaggaaccgaggagggg

SEQ ID NO: 10036795 - DNA, 22 bp, Homo sapiens
attggcagaaacagcagggcca

SEQ ID NO: 10036796 - DNA, 22 bp, Homo sapiens
attggaaatacagtagaaaaat

SEQ ID NO: 10036797 - DNA, 22 bp, Homo sapiens
atgccactgcacttcagcttgg

SEQ ID NO: 10036798 - DNA, 22 bp, Homo sapiens
gacagagttgttgatgtatgct

SEQ ID NO: 10036799 - DNA, 22 bp, Homo sapiens
gacagaggctggagcacctcct

SEQ ID NO: 10036800 - DNA, 22 bp, Homo sapiens
atgccactgcgctctagcctgg

SEQ ID NO: 10036801 - DNA, 22 bp, Homo sapiens
atgccactgcgctccagcctgg

SEQ ID NO: 10036802 - DNA, 18 bp, Homo sapiens
gagaaagtttgggcagaa

SEQ ID NO: 10036803 - DNA, 22 bp, Homo sapiens
atggctgctttcccttagcacc

SEQ ID NO: 10036804 - DNA, 22 bp, Homo sapiens
gagccagctatgtagcaagagg

SEQ ID NO: 10036805 - DNA, 22 bp, Homo sapiens
atggccctgctaccacttttct

SEQ ID NO: 10036806 - DNA, 22 bp, Homo sapiens
atggccctaatgagttggtgtt

SEQ ID NO: 10036807 - DNA, 22 bp, Homo sapiens
atggccctctccttaggtcagc

SEQ ID NO: 10036808 - DNA, 22 bp, Homo sapiens
atggccctcagtccttccttgg

SEQ ID NO: 10036809 - DNA, 22 bp, Homo sapiens
gagaggaaagaaccaatgaccc

SEQ ID NO: 10036810 - DNA, 22 bp, Homo sapiens
atggcagttgcccagccaatcc

SEQ ID NO: 10036811 - DNA, 22 bp, Homo sapiens
gagaacagatttttctgctgtc

SEQ ID NO: 10036812 - DNA, 22 bp, Homo sapiens
gagaacagatttttctgctgtc

SEQ ID NO: 10036813 - DNA, 22 bp, Homo sapiens
atggcagtatttgtatcacaga

SEQ ID NO: 10036814 - DNA, 22 bp, Homo sapiens
atggcagtatttcagtacagag

SEQ ID NO: 10036815 - DNA, 22 bp, Homo sapiens
atgggttcaagtgattctcctg

SEQ ID NO: 10036816 - DNA, 22 bp, Homo sapiens
atggtactggggtcccggagtt

SEQ ID NO: 10036817 - DNA, 22 bp, Homo sapiens
gagctgggcctgcgagtgctgc

SEQ ID NO: 10036818 - DNA, 22 bp, Homo sapiens
gaggccaggggcctggagatga

SEQ ID NO: 10036819 - DNA, 22 bp, Homo sapiens
gaggccagggatgcaatgagag

SEQ ID NO: 10036820 - DNA, 22 bp, Homo sapiens
gaggagctggctgtcgggaggc

SEQ ID NO: 10036821 - DNA, 22 bp, Homo sapiens
gaggagctgggctgagagggtc

SEQ ID NO: 10036822 - DNA, 22 bp, Homo sapiens
gaggagctgggtcagggagaca

SEQ ID NO: 10036823 - DNA, 17 bp, Homo sapiens
gaggagctccagtaggt

SEQ ID NO: 10036824 - DNA, 17 bp, Homo sapiens
gaggagctccagtaggt

SEQ ID NO: 10036825 - DNA, 22 bp, Homo sapiens
gaggagctgaggctgaggcctc

SEQ ID NO: 10036826 - DNA, 18 bp, Homo sapiens
atgtacatttgctaaagc

SEQ ID NO: 10036827 - DNA, 22 bp, Homo sapiens
gaggctgccccttcctcagctg

SEQ ID NO: 10036828 - DNA, 22 bp, Homo sapiens
gaggctgctgttagccctgggc

SEQ ID NO: 10036829 - DNA, 22 bp, Homo sapiens
gaggggaagacttctggacagt

SEQ ID NO: 10036830 - DNA, 22 bp, Homo sapiens
gaggctgctttgatgacaggag

SEQ ID NO: 10036831 - DNA, 22 bp, Homo sapiens
gaggggagacagggaaatcagt

SEQ ID NO: 10036832 - DNA, 22 bp, Homo sapiens
cttttattttgaattaagggct

SEQ ID NO: 10036833 - DNA, 22 bp, Homo sapiens
ctttggtctgtccatcctgcct

SEQ ID NO: 10036834 - DNA, 19 bp, Homo sapiens
cttgcctgttcctacagct

SEQ ID NO: 10036835 - DNA, 22 bp, Homo sapiens
atgagtgtgaagttagctcagt

SEQ ID NO: 10036836 - DNA, 20 bp, Homo sapiens
atgcaaactcacaaaatacc

SEQ ID NO: 10036837 - DNA, 22 bp, Homo sapiens
atgcagcttcaggattatgatg

SEQ ID NO: 10036838 - DNA, 22 bp, Homo sapiens
atgcagctgtgggcaagaaatg

SEQ ID NO: 10036839 - DNA, 22 bp, Homo sapiens
atgcagctgtcagggagaacat

SEQ ID NO: 10036840 - DNA, 22 bp, Homo sapiens
atgcatttatgtgtgtacattg

SEQ ID NO: 10036841 - DNA, 22 bp, Homo sapiens
agacacagaagttgctgttggg

SEQ ID NO: 10036842 - DNA, 22 bp, Homo sapiens
agaatacatcaatctattttct

SEQ ID NO: 10036843 - DNA, 22 bp, Homo sapiens
atctttgtgaatctcaacttgg

SEQ ID NO: 10036844 - DNA, 22 bp, Homo sapiens
atctttgtcactctactgtcta

SEQ ID NO: 10036845 - DNA, 22 bp, Homo sapiens
agaaggctaaagaaacagattg

SEQ ID NO: 10036846 - DNA, 22 bp, Homo sapiens
agaagtttggtccttttcaagg

SEQ ID NO: 10036847 - DNA, 22 bp, Homo sapiens
atgggaggatgctcgggtgctc

SEQ ID NO: 10036848 - DNA, 22 bp, Homo sapiens
atgtctgtgtgatcttggataa

SEQ ID NO: 10036849 - DNA, 22 bp, Homo sapiens
atgtctgtctttgtactccaca

SEQ ID NO: 10036850 - DNA, 22 bp, Homo sapiens
atgtctgtctatagccatgaga

SEQ ID NO: 10036851 - DNA, 22 bp, Homo sapiens
atgtctgtttatccttcaagat

SEQ ID NO: 10036852 - DNA, 22 bp, Homo sapiens
atgtctgttttcatatcagata

SEQ ID NO: 10036853 - DNA, 21 bp, Homo sapiens
atgtctgttctttctggcagg

SEQ ID NO: 10036854 - DNA, 22 bp, Homo sapiens
atggaaagggaagcaaggaaca

SEQ ID NO: 10036855 - DNA, 22 bp, Homo sapiens
atggaaagtgcatggaagtcat

SEQ ID NO: 10036856 - DNA, 22 bp, Homo sapiens
atggctgggtcaccatcagggt

SEQ ID NO: 10036857 - DNA, 22 bp, Homo sapiens
attagcaaggttcatgagaaga

SEQ ID NO: 10036858 - DNA, 22 bp, Homo sapiens
attagcaactcttatgtaagca

SEQ ID NO: 10036859 - DNA, 20 bp, Homo sapiens
attagctcaggtgaggtcat

SEQ ID NO: 10036860 - DNA, 22 bp, Homo sapiens
attaaagaaacccagcatgtga

SEQ ID NO: 10036861 - DNA, 22 bp, Homo sapiens
attaaagacagcagatggatgg

SEQ ID NO: 10036862 - DNA, 22 bp, Homo sapiens
agagggagtgaaatggaataga

SEQ ID NO: 10036863 - DNA, 22 bp, Homo sapiens
agagggataatatgtattgtaa

SEQ ID NO: 10036864 - DNA, 22 bp, Homo sapiens
agagggatcaccctgtttctgg

SEQ ID NO: 10036865 - DNA, 22 bp, Homo sapiens
agagggatggccccgtaactca

SEQ ID NO: 10036866 - DNA, 22 bp, Homo sapiens
agagggcaagtgtagtccagta

SEQ ID NO: 10036867 - DNA, 22 bp, Homo sapiens
agaggtagaggttgcagtgagc

SEQ ID NO: 10036868 - DNA, 22 bp, Homo sapiens
atttattatgggatttggctca

SEQ ID NO: 10036869 - DNA, 22 bp, Homo sapiens
atttattattgtggttacttct

SEQ ID NO: 10036870 - DNA, 22 bp, Homo sapiens
agatgaagatgccactaagacc

SEQ ID NO: 10036871 - DNA, 22 bp, Homo sapiens
agccagctccctcccctgcagg

SEQ ID NO: 10036872 - DNA, 22 bp, Homo sapiens
cagaactgagtctcatggccat

SEQ ID NO: 10036873 - DNA, 22 bp, Homo sapiens
agcccaggaagttgaggcttgc

SEQ ID NO: 10036874 - DNA, 22 bp, Homo sapiens
agcccaggaatctgcatcttga

SEQ ID NO: 10036875 - DNA, 22 bp, Homo sapiens
agcccaggaggtggaggttgca

SEQ ID NO: 10036876 - DNA, 22 bp, Homo sapiens
agcccaggaggtggaggttgca

SEQ ID NO: 10036877 - DNA, 22 bp, Homo sapiens
agcccaggagtttgaggctgtg

SEQ ID NO: 10036878 - DNA, 22 bp, Homo sapiens
agcccaggagtttgaggctgtg

SEQ ID NO: 10036879 - DNA, 22 bp, Homo sapiens
cagagagtggcagttactgaag

SEQ ID NO: 10036880 - DNA, 22 bp, Homo sapiens
cagcaggaccattgaggcatca

SEQ ID NO: 10036881 - DNA, 22 bp, Homo sapiens
cagcaggagcagtcagactcct

SEQ ID NO: 10036882 - DNA, 22 bp, Homo sapiens
cagcaggaggtgagatgtgacc

SEQ ID NO: 10036883 - DNA, 22 bp, Homo sapiens
cagcaggaggtgagtagcaggt

SEQ ID NO: 10036884 - DNA, 22 bp, Homo sapiens
cagcacagggcttgagaggtgt

SEQ ID NO: 10036885 - DNA, 22 bp, Homo sapiens
cagcacaggaatatggtggaca

SEQ ID NO: 10036886 - DNA, 22 bp, Homo sapiens
cagcagaggtggttcacattgt

SEQ ID NO: 10036887 - DNA, 22 bp, Homo sapiens
cagcagaggcacgtctgtgaat

SEQ ID NO: 10036888 - DNA, 22 bp, Homo sapiens
cagcagagggagccattgaaat

SEQ ID NO: 10036889 - DNA, 22 bp, Homo sapiens
agcctccagtagctgaagagac

SEQ ID NO: 10036890 - DNA, 22 bp, Homo sapiens
cagcagcagcttagtggtcccc

SEQ ID NO: 10036891 - DNA, 22 bp, Homo sapiens
cagcagcagccccaggaaggtt

SEQ ID NO: 10036892 - DNA, 22 bp, Homo sapiens
cagcagcatgaattcgagccac

SEQ ID NO: 10036893 - DNA, 22 bp, Homo sapiens
cagcagcagtggctgcagaaca

SEQ ID NO: 10036894 - DNA, 22 bp, Homo sapiens
agcagcatgttgggatgtgaaa

SEQ ID NO: 10036895 - DNA, 22 bp, Homo sapiens
agcagacaccaggagtaaagaa

SEQ ID NO: 10036896 - DNA, 22 bp, Homo sapiens
agcagcagaaggtttgcaccca

SEQ ID NO: 10036897 - DNA, 22 bp, Homo sapiens
agcagcagaaagttgatggcag

SEQ ID NO: 10036898 - DNA, 22 bp, Homo sapiens
agcagcagaagggagacccagg

SEQ ID NO: 10036899 - DNA, 22 bp, Homo sapiens
agcagcacccagagccatgtct

SEQ ID NO: 10036900 - DNA, 22 bp, Homo sapiens
caccaggtgctggaggacatca

SEQ ID NO: 10036901 - DNA, 21 bp, Homo sapiens
agcaggtgctgttggaggaaa

SEQ ID NO: 10036902 - DNA, 22 bp, Homo sapiens
cacatcttccagagtagctaaa

SEQ ID NO: 10036903 - DNA, 22 bp, Homo sapiens
acatttaggatgttttgagaga

SEQ ID NO: 10036904 - DNA, 22 bp, Homo sapiens
acatttacattttctctggcct

SEQ ID NO: 10036905 - DNA, 22 bp, Homo sapiens
aggctagctttggctcagtaaa

SEQ ID NO: 10036906 - DNA, 22 bp, Homo sapiens
aggccttaccatagctgtagca

SEQ ID NO: 10036907 - DNA, 22 bp, Homo sapiens
aggctagcaatgggagatgagt

SEQ ID NO: 10036908 - DNA, 23 bp, Homo sapiens
aggcgagctcttctccagcacgt

SEQ ID NO: 10036909 - DNA, 22 bp, Homo sapiens
aggccctgttgtagcattttgg

SEQ ID NO: 10036910 - DNA, 22 bp, Homo sapiens
aggccctgttatgagccactgt

SEQ ID NO: 10036911 - DNA, 22 bp, Homo sapiens
aggccctgtccatggtgctgaa

SEQ ID NO: 10036912 - DNA, 20 bp, Homo sapiens
aggccctgtgcatcttgttt

SEQ ID NO: 10036913 - DNA, 22 bp, Homo sapiens
aggccctggtcaggtctggctg

SEQ ID NO: 10036914 - DNA, 22 bp, Homo sapiens
aggccctgtaaggtgtggagat

SEQ ID NO: 10036915 - DNA, 20 bp, Homo sapiens
aggccctgccagggacggag

SEQ ID NO: 10036916 - DNA, 22 bp, Homo sapiens
acatgaaagttattctgagttg

SEQ ID NO: 10036917 - DNA, 17 bp, Homo sapiens
aggcaggcagagcggga

SEQ ID NO: 10036918 - DNA, 20 bp, Homo sapiens
agggcagcttgaggagccgg

SEQ ID NO: 10036919 - DNA, 22 bp, Homo sapiens
acccaggagcaggctgggcagt

SEQ ID NO: 10036920 - DNA, 22 bp, Homo sapiens
agggcagtgtggtgggactgac

SEQ ID NO: 10036921 - DNA, 22 bp, Homo sapiens
agggagctctaagtagagggac

SEQ ID NO: 10036922 - DNA, 22 bp, Homo sapiens
agggagctcacagtccagtaga

SEQ ID NO: 10036923 - DNA, 22 bp, Homo sapiens
agggagctcagttggaagcggt

SEQ ID NO: 10036924 - DNA, 22 bp, Homo sapiens
agggaagcttgttactgagaag

SEQ ID NO: 10036925 - DNA, 22 bp, Homo sapiens
agggaagccctggctgagaccc

SEQ ID NO: 10036926 - DNA, 22 bp, Homo sapiens
agggagctaggatcctgaaggt

SEQ ID NO: 10036927 - DNA, 23 bp, Homo sapiens
agggagctaaaaggctggagcag

SEQ ID NO: 10036928 - DNA, 23 bp, Homo sapiens
accaggagttgtctcaggaaaca

SEQ ID NO: 10036929 - DNA, 22 bp, Homo sapiens
accaggagttttgaccaggggc

SEQ ID NO: 10036930 - DNA, 22 bp, Homo sapiens
acaggtggcataggcagtttga

SEQ ID NO: 10036931 - DNA, 20 bp, Homo sapiens
acagtgtttttgagtagagc

SEQ ID NO: 10036932 - DNA, 22 bp, Homo sapiens
acagtgttttatgagaattgtt

SEQ ID NO: 10036933 - DNA, 22 bp, Homo sapiens
acagtgttttcttaaggagaaa

SEQ ID NO: 10036934 - DNA, 22 bp, Homo sapiens
acagtgttttgtctggcagggc

SEQ ID NO: 10036935 - DNA, 22 bp, Homo sapiens
acagtgttttagaaaagcttga

SEQ ID NO: 10036936 - DNA, 22 bp, Homo sapiens
acagtgttctgctttttaatcc

SEQ ID NO: 10036937 - DNA, 22 bp, Homo sapiens
aggcagcatgggccccagctcc

SEQ ID NO: 10036938 - DNA, 17 bp, Homo sapiens
acagtttgtcattctaa

SEQ ID NO: 10036939 - DNA, 22 bp, Homo sapiens
aggcagcattcaggggtgatga

SEQ ID NO: 10036940 - DNA, 22 bp, Homo sapiens
acagtttgccctgacattctcc

SEQ ID NO: 10036941 - DNA, 22 bp, Homo sapiens
acagtttggcgtgattgatagt

SEQ ID NO: 10036942 - DNA, 22 bp, Homo sapiens
acagtttggcagtttcttacta

SEQ ID NO: 10036943 - DNA, 22 bp, Homo sapiens
aggcagcagtcatgaggaaaga

SEQ ID NO: 10036944 - DNA, 22 bp, Homo sapiens
aggcagcagtgataagatagga

SEQ ID NO: 10036945 - DNA, 22 bp, Homo sapiens
aggcagcatccagaggagaatg

SEQ ID NO: 10036946 - DNA, 22 bp, Homo sapiens
aggcagcatgggcccagagtcc

SEQ ID NO: 10036947 - DNA, 22 bp, Homo sapiens
aggcagcatccagaggagaatg

SEQ ID NO: 10036948 - DNA, 22 bp, Homo sapiens
aggcaggcaaccacctgggaag

SEQ ID NO: 10036949 - DNA, 22 bp, Homo sapiens
aggcaggcactccggaagtgtc

SEQ ID NO: 10036950 - DNA, 22 bp, Homo sapiens
aggcaggcacacttcctccagg

SEQ ID NO: 10036951 - DNA, 22 bp, Homo sapiens
acagtttgtgttggccatgggc

SEQ ID NO: 10036952 - DNA, 22 bp, Homo sapiens
acagtttgttccttttcattgc

SEQ ID NO: 10036953 - DNA, 22 bp, Homo sapiens
aggcagctggcaaattctagag

SEQ ID NO: 10036954 - DNA, 22 bp, Homo sapiens
agctttatgcttcctacaagct

SEQ ID NO: 10036955 - DNA, 23 bp, Homo sapiens
aggaatggctagaagtgtgaccc

SEQ ID NO: 10036956 - DNA, 19 bp, Homo sapiens
agctggggcggtgtgtgtt

SEQ ID NO: 10036957 - DNA, 22 bp, Homo sapiens
acagctgcaaattgttagagga

SEQ ID NO: 10036958 - DNA, 22 bp, Homo sapiens
acagctctgagatattactatt

SEQ ID NO: 10036959 - DNA, 22 bp, Homo sapiens
acagctctccctcagagaaatg

SEQ ID NO: 10036960 - DNA, 22 bp, Homo sapiens
acagcagacattgggtgattga

SEQ ID NO: 10036961 - DNA, 22 bp, Homo sapiens
agctgcccagataggaggaggc

SEQ ID NO: 10036962 - DNA, 22 bp, Homo sapiens
agctgcccagctaggaagaagg

SEQ ID NO: 10036963 - DNA, 22 bp, Homo sapiens
agctgccatcctgttcagcacc

SEQ ID NO: 10036964 - DNA, 22 bp, Homo sapiens
agctgccccatgagaggcaggt

SEQ ID NO: 10036965 - DNA, 22 bp, Homo sapiens
agaaacagaaccaggtgtcatt

SEQ ID NO: 10036966 - DNA, 23 bp, Homo sapiens
actgtctgtgcttttttagggct

SEQ ID NO: 10036967 - DNA, 22 bp, Homo sapiens
actgtctgtgccagatgctggg

SEQ ID NO: 10036968 - DNA, 22 bp, Homo sapiens
actgtctgctggcccctggtta

SEQ ID NO: 10036969 - DNA, 20 bp, Homo sapiens
actgtctggggacctcatta

SEQ ID NO: 10036970 - DNA, 22 bp, Homo sapiens
actgtctgtacttcttgcaagg

SEQ ID NO: 10036971 - DNA, 21 bp, Homo sapiens
agtttcctcaactgcagaagg

SEQ ID NO: 10036972 - DNA, 22 bp, Homo sapiens
agtttcatttcttagtaccagt

SEQ ID NO: 10036973 - DNA, 22 bp, Homo sapiens
actgtgcctttcacttgcactt

SEQ ID NO: 10036974 - DNA, 22 bp, Homo sapiens
agtttatgattttatgtaagta

SEQ ID NO: 10036975 - DNA, 22 bp, Homo sapiens
actgtgtgccaggcgctggtct

SEQ ID NO: 10036976 - DNA, 22 bp, Homo sapiens
actgtgtgggccgctcactggg

SEQ ID NO: 10036977 - DNA, 22 bp, Homo sapiens
actgtgtggaccactctgaggc

SEQ ID NO: 10036978 - DNA, 22 bp, Homo sapiens
agggtggttcttttagtggaag

SEQ ID NO: 10036979 - DNA, 22 bp, Homo sapiens
acctgtggatcagattcttgta

SEQ ID NO: 10036980 - DNA, 23 bp, Homo sapiens
acctggctgctcaacctgcaggg

SEQ ID NO: 10036981 - DNA, 22 bp, Homo sapiens
acctggacacctgctgtcatct

SEQ ID NO: 10036982 - DNA, 22 bp, Homo sapiens
actgcaacctccacctcctggg

SEQ ID NO: 10036983 - DNA, 22 bp, Homo sapiens
actgctgcaggtccagcccctt

SEQ ID NO: 10036984 - DNA, 20 bp, Homo sapiens
actgctgtagaccatctgca

SEQ ID NO: 10036985 - DNA, 23 bp, Homo sapiens
actgctgtctttgaagtgcttga

SEQ ID NO: 10036986 - DNA, 22 bp, Homo sapiens
actccacaccacgggggccgcc

SEQ ID NO: 10036987 - DNA, 22 bp, Homo sapiens
aagccgaggccacacagcagga

SEQ ID NO: 10036988 - DNA, 22 bp, Homo sapiens
aaagtttgaatgatatattagt

SEQ ID NO: 10036989 - DNA, 22 bp, Homo sapiens
aagagggcagcacaggtgggtc

SEQ ID NO: 10036990 - DNA, 22 bp, Homo sapiens
aagagggctgcaatcttattgc

SEQ ID NO: 10036991 - DNA, 22 bp, Homo sapiens
aagaggtaatgactgcttgagt

SEQ ID NO: 10036992 - DNA, 22 bp, Homo sapiens
aagaggtaaccatagcaaccac

SEQ ID NO: 10036993 - DNA, 22 bp, Homo sapiens
aaatactagaattcagagttga

SEQ ID NO: 10036994 - DNA, 22 bp, Homo sapiens
aagacctgggatggccctgaag

SEQ ID NO: 10036995 - DNA, 22 bp, Homo sapiens
aagacctgagtatagatccctg

SEQ ID NO: 10036996 - DNA, 22 bp, Homo sapiens
aagacagagggaagcaatgatg

SEQ ID NO: 10036997 - DNA, 22 bp, Homo sapiens
aagaacagttgggaggtgagcc

SEQ ID NO: 10036998 - DNA, 22 bp, Homo sapiens
aagaacagtgtcctgggactcg

SEQ ID NO: 10036999 - DNA, 22 bp, Homo sapiens
aaagcagattctgatgcagtag

SEQ ID NO: 10037000 - DNA, 22 bp, Homo sapiens
aaagcagaggttgcagtgagct

SEQ ID NO: 10037001 - DNA, 22 bp, Homo sapiens
aaagcagaggtgatatgactta

SEQ ID NO: 10037002 - DNA, 22 bp, Homo sapiens
aaagcagaactgagagagctgg

SEQ ID NO: 10037003 - DNA, 22 bp, Homo sapiens
aaagcagactgatttgcatcac

SEQ ID NO: 10037004 - DNA, 22 bp, Homo sapiens
aaagcagagcagggcacttatg

SEQ ID NO: 10037005 - DNA, 19 bp, Homo sapiens
aaagcagaggagcatctga

SEQ ID NO: 10037006 - DNA, 22 bp, Homo sapiens
aaagccattacaaaatttcata

SEQ ID NO: 10037007 - DNA, 22 bp, Homo sapiens
aaagccattgaactgtacttta

SEQ ID NO: 10037008 - DNA, 22 bp, Homo sapiens
aaacagcagctgtttaatttgc

SEQ ID NO: 10037009 - DNA, 22 bp, Homo sapiens
aaacaggtctgaaaatagctac

SEQ ID NO: 10037010 - DNA, 22 bp, Homo sapiens
aaaatattttagggccaggaga

SEQ ID NO: 10037011 - DNA, 22 bp, Homo sapiens
aacacagtcctgctcacttatt

SEQ ID NO: 10037012 - DNA, 22 bp, Homo sapiens
aacacagtcagttcctggatca

SEQ ID NO: 10037013 - DNA, 22 bp, Homo sapiens
aacacagttttccaaaatagag

SEQ ID NO: 10037014 - DNA, 22 bp, Homo sapiens
aacacagtttctctatgagagt

SEQ ID NO: 10037015 - DNA, 22 bp, Homo sapiens
aacacagtttctgcattggtag

SEQ ID NO: 10037016 - DNA, 22 bp, Homo sapiens
aaggaagagcaaagaattatgt

SEQ ID NO: 10037017 - DNA, 22 bp, Homo sapiens
aaggaagatgaaagtactgcta

SEQ ID NO: 10037018 - DNA, 22 bp, Homo sapiens
aaggcagcaactaatggatctc

SEQ ID NO: 10037019 - DNA, 22 bp, Homo sapiens
aaggcagcaccgcctcctgaaa

SEQ ID NO: 10037020 - DNA, 22 bp, Homo sapiens
aaggcagcagaggaaaggtgct

SEQ ID NO: 10037021 - DNA, 22 bp, Homo sapiens
aaggcagcaggatttggtgact

SEQ ID NO: 10037022 - DNA, 22 bp, Homo sapiens
aaggcagcaagaattccaggtt

SEQ ID NO: 10037023 - DNA, 22 bp, Homo sapiens
aaggcagcacagcaactgctca

SEQ ID NO: 10037024 - DNA, 22 bp, Homo sapiens
aaggcagccctggctcagcctg

SEQ ID NO: 10037025 - DNA, 22 bp, Homo sapiens
aaggcagccatagcaccatcca

SEQ ID NO: 10037026 - DNA, 22 bp, Homo sapiens
aaggcagccatgtgctttgggt

SEQ ID NO: 10037027 - DNA, 22 bp, Homo sapiens
aaggcagcagtgcacgactgat

SEQ ID NO: 10037028 - DNA, 19 bp, Homo sapiens
aaggcagcagtagcatcca

SEQ ID NO: 10037029 - DNA, 22 bp, Homo sapiens
aaggcagcatgaatccctgtac

SEQ ID NO: 10037030 - DNA, 22 bp, Homo sapiens
aaggcagccagatcctttgggt

SEQ ID NO: 10037031 - DNA, 22 bp, Homo sapiens
aacctggagtgctggtttcact

SEQ ID NO: 10037032 - DNA, 22 bp, Homo sapiens
aacctggaccttttgggtattg

SEQ ID NO: 10037033 - DNA, 22 bp, Homo sapiens
aacatgaaaagcccagagaggt

SEQ ID NO: 10037034 - DNA, 22 bp, Homo sapiens
aacagctattagaacttcatgg

SEQ ID NO: 10037035 - DNA, 21 bp, Homo sapiens
acacaaacctcctcagcctgg

SEQ ID NO: 10037036 - DNA, 22 bp, Homo sapiens
aagaacagattcagcctgaact

SEQ ID NO: 10037037 - DNA, 22 bp, Homo sapiens
aagcagagggtatggccaggtt

SEQ ID NO: 10037038 - DNA, 22 bp, Homo sapiens
aagcagcttttgaagagtgagg

SEQ ID NO: 10037039 - DNA, 22 bp, Homo sapiens
aagcagctggaagagtaagatg

SEQ ID NO: 10037040 - DNA, 22 bp, Homo sapiens
aagcagaggaccgacggaggga

SEQ ID NO: 10037041 - DNA, 22 bp, Homo sapiens
aagcagagcaagcgtatttatt

SEQ ID NO: 10037042 - DNA, 22 bp, Homo sapiens
aagagcaggacagaatcagaac

SEQ ID NO: 10037043 - DNA, 22 bp, Homo sapiens
acagtgttcttgatattacagt

SEQ ID NO: 10037044 - DNA, 22 bp, Homo sapiens
acagtgttcttggcgctgagtg

SEQ ID NO: 10037045 - DNA, 22 bp, Homo sapiens
acagtgttgtggctcttaatag

SEQ ID NO: 10037046 - DNA, 22 bp, Homo sapiens
acagtgttgaggtgcttgtttc

SEQ ID NO: 10037047 - DNA, 22 bp, Homo sapiens
acagtgttgtatttagtttgat

SEQ ID NO: 10037048 - DNA, 22 bp, Homo sapiens
acagtgtttaaaataatatgct

SEQ ID NO: 10037049 - DNA, 22 bp, Homo sapiens
acagtgtttaaaaatcagatct

SEQ ID NO: 10037050 - DNA, 22 bp, Homo sapiens
aaggagagagctttgctggaac

SEQ ID NO: 10037051 - DNA, 22 bp, Homo sapiens
aaggagaggttgtccgtgttgt

SEQ ID NO: 10037052 - DNA, 22 bp, Homo sapiens
aaggagagtacaggagttggta

SEQ ID NO: 10037053 - DNA, 22 bp, Homo sapiens
aaggcagagattagcagaatga

SEQ ID NO: 10037054 - DNA, 22 bp, Homo sapiens
aaggcagagggctggatcagag

SEQ ID NO: 10037055 - DNA, 19 bp, Homo sapiens
acatatgtggatatacatg

SEQ ID NO: 10037056 - DNA, 22 bp, Homo sapiens
acagtgtttaagagatggcatt

SEQ ID NO: 10037057 - DNA, 22 bp, Homo sapiens
acagtgtttatgtacagattgt

SEQ ID NO: 10037058 - DNA, 22 bp, Homo sapiens
acagtgtttcacttaaccgttt

SEQ ID NO: 10037059 - DNA, 22 bp, Homo sapiens
acagtgtttggcaatgcatgca

SEQ ID NO: 10037060 - DNA, 22 bp, Homo sapiens
acagtgtttggcaatgcatgca

SEQ ID NO: 10037061 - DNA, 22 bp, Homo sapiens
acattttgagaaatgacaagct

SEQ ID NO: 10037062 - DNA, 22 bp, Homo sapiens
accctgagtcagacagcctgac

SEQ ID NO: 10037063 - DNA, 22 bp, Homo sapiens
accctgagtgcaacggtgagga

SEQ ID NO: 10037064 - DNA, 22 bp, Homo sapiens
accctgaggggtatagcagaag

SEQ ID NO: 10037065 - DNA, 22 bp, Homo sapiens
accctgagtcactgtctgtctg

SEQ ID NO: 10037066 - DNA, 22 bp, Homo sapiens
accctgagggtgctgggtttct

SEQ ID NO: 10037067 - DNA, 22 bp, Homo sapiens
accctgagccgccaggaaggcc

SEQ ID NO: 10037068 - DNA, 22 bp, Homo sapiens
accctgagggatgagagttgca

SEQ ID NO: 10037069 - DNA, 20 bp, Homo sapiens
accctgaggctccccagcct

SEQ ID NO: 10037070 - DNA, 22 bp, Homo sapiens
accctgagatgccacagcatga

SEQ ID NO: 10037071 - DNA, 22 bp, Homo sapiens
accctgagccaaaccagttaga

SEQ ID NO: 10037072 - DNA, 22 bp, Homo sapiens
accctgagaaagtcacatgcat

SEQ ID NO: 10037073 - DNA, 19 bp, Homo sapiens
accctgagaggtggtccgg

SEQ ID NO: 10037074 - DNA, 22 bp, Homo sapiens
accctgagaatgagtgtctcct

SEQ ID NO: 10037075 - DNA, 22 bp, Homo sapiens
acccaggatgataatgttcaca

SEQ ID NO: 10037076 - DNA, 22 bp, Homo sapiens
acccaggaggtgacacagggct

SEQ ID NO: 10037077 - DNA, 22 bp, Homo sapiens
acccaggaggcagaggttgcag

SEQ ID NO: 10037078 - DNA, 22 bp, Homo sapiens
acccaggagccgtgagaggtta

SEQ ID NO: 10037079 - DNA, 22 bp, Homo sapiens
acccaggagctctggggtcctc

SEQ ID NO: 10037080 - DNA, 22 bp, Homo sapiens
acccaggaggcaaggttgcagt

SEQ ID NO: 10037081 - DNA, 22 bp, Homo sapiens
acccaggataatctgtgtatct

SEQ ID NO: 10037082 - DNA, 22 bp, Homo sapiens
acccaggatagagtgctgcagt

SEQ ID NO: 10037083 - DNA, 22 bp, Homo sapiens
acccaggaggtggaggctgcag

SEQ ID NO: 10037084 - DNA, 22 bp, Homo sapiens
aaggcagataagaattcagcaa

SEQ ID NO: 10037085 - DNA, 22 bp, Homo sapiens
actgttcttcatttagcaaaga

SEQ ID NO: 10037086 - DNA, 19 bp, Homo sapiens
actgttctgtatgttgatt

SEQ ID NO: 10037087 - DNA, 22 bp, Homo sapiens
actgttctgcatgctgtgaggg

SEQ ID NO: 10037088 - DNA, 23 bp, Homo sapiens
actttattgaccccaggtcagtt

SEQ ID NO: 10037089 - DNA, 22 bp, Homo sapiens
acgtagcactgagagatgcagg

SEQ ID NO: 10037090 - DNA, 22 bp, Homo sapiens
acggtgctgggtattggggttc

SEQ ID NO: 10037091 - DNA, 22 bp, Homo sapiens
actcagagaatatctagaagga

SEQ ID NO: 10037092 - DNA, 22 bp, Homo sapiens
actcagagaacattcccagtct

SEQ ID NO: 10037093 - DNA, 21 bp, Homo sapiens
actggccctgccttacaaata

SEQ ID NO: 10037094 - DNA, 22 bp, Homo sapiens
actggcccgggagcagaggcct

SEQ ID NO: 10037095 - DNA, 22 bp, Homo sapiens
actggccctggctgctaggctg

SEQ ID NO: 10037096 - DNA, 22 bp, Homo sapiens
actggcccttgattgcatcagc

SEQ ID NO: 10037097 - DNA, 22 bp, Homo sapiens
actggactccccaagggccagg

SEQ ID NO: 10037098 - DNA, 22 bp, Homo sapiens
actggactgagttggaattgag

SEQ ID NO: 10037099 - DNA, 22 bp, Homo sapiens
actgcactccaacctgggtgac

SEQ ID NO: 10037100 - DNA, 20 bp, Homo sapiens
agacaaaatgacttcatgca

SEQ ID NO: 10037101 - DNA, 22 bp, Homo sapiens
agaagcagactctgaggcaagg

SEQ ID NO: 10037102 - DNA, 22 bp, Homo sapiens
agaagcagactctgaggcaagg

SEQ ID NO: 10037103 - DNA, 22 bp, Homo sapiens
aattaaaaaaggagagcttgct

SEQ ID NO: 10037104 - DNA, 22 bp, Homo sapiens
acacatgtaaaacacttagcaa

SEQ ID NO: 10037105 - DNA, 22 bp, Homo sapiens
acactctgctctgagcttcagg

SEQ ID NO: 10037106 - DNA, 22 bp, Homo sapiens
acactagctaaatgctgattaa

SEQ ID NO: 10037107 - DNA, 22 bp, Homo sapiens
acacagatgctatttagtctct

SEQ ID NO: 10037108 - DNA, 20 bp, Homo sapiens
acagaaagagagaatgtcag

SEQ ID NO: 10037109 - DNA, 22 bp, Homo sapiens
agccaggggattcatcagggac

SEQ ID NO: 10037110 - DNA, 22 bp, Homo sapiens
acagagacttggagcaggctga

SEQ ID NO: 10037111 - DNA, 22 bp, Homo sapiens
acagagacaggcagacagtctt

SEQ ID NO: 10037112 - DNA, 22 bp, Homo sapiens
acagagaccagttacagcgtcc

SEQ ID NO: 10037113 - DNA, 20 bp, Homo sapiens
acagatgaggatgcggaggc

SEQ ID NO: 10037114 - DNA, 22 bp, Homo sapiens
acagagctaaatttcaatccca

SEQ ID NO: 10037115 - DNA, 22 bp, Homo sapiens
agcctctagaccctggcctgca

SEQ ID NO: 10037116 - DNA, 22 bp, Homo sapiens
agctcccagagctcgagagtaa

SEQ ID NO: 10037117 - DNA, 22 bp, Homo sapiens
ggaggcagaatagagtgtgggt

SEQ ID NO: 10037118 - DNA, 22 bp, Homo sapiens
ggaggaggcggcagaagttcct

SEQ ID NO: 10037119 - DNA, 22 bp, Homo sapiens
ggaggacactggctctgccttc

SEQ ID NO: 10037120 - DNA, 22 bp, Homo sapiens
ggaggacaggggctgcagcaca

SEQ ID NO: 10037121 - DNA, 22 bp, Homo sapiens
ggagagggtgtggaaagttatc

SEQ ID NO: 10037122 - DNA, 22 bp, Homo sapiens
ggagaggggcaagtttatctag

SEQ ID NO: 10037123 - DNA, 23 bp, Homo sapiens
ggagaggggtgtgggcatcttta

SEQ ID NO: 10037124 - DNA, 22 bp, Homo sapiens
ggagcgtgcagcatgagctcat

SEQ ID NO: 10037125 - DNA, 22 bp, Homo sapiens
ggagcctgttagttgagtgctc

SEQ ID NO: 10037126 - DNA, 22 bp, Homo sapiens
ggagcggagggagggccactgt

SEQ ID NO: 10037127 - DNA, 22 bp, Homo sapiens
ggagcctgtgggatgagatgtg

SEQ ID NO: 10037128 - DNA, 22 bp, Homo sapiens
ggagatggaatagattctgact

SEQ ID NO: 10037129 - DNA, 22 bp, Homo sapiens
gcttagctgcatgcatgttctt

SEQ ID NO: 10037130 - DNA, 22 bp, Homo sapiens
gcttccttattgttgccatagt

SEQ ID NO: 10037131 - DNA, 22 bp, Homo sapiens
gcttccttctaccacatcatgc

SEQ ID NO: 10037132 - DNA, 22 bp, Homo sapiens
gcttcagacctgaaaggaaaaa

SEQ ID NO: 10037133 - DNA, 22 bp, Homo sapiens
ggagtgggaacaatgacatggt

SEQ ID NO: 10037134 - DNA, 21 bp, Homo sapiens
ggcagagaagctggaagttgg

SEQ ID NO: 10037135 - DNA, 22 bp, Homo sapiens
ggcagactgtaataggagaatt

SEQ ID NO: 10037136 - DNA, 22 bp, Homo sapiens
ggcacagcacagagcacatgta

SEQ ID NO: 10037137 - DNA, 22 bp, Homo sapiens
ggcaggctgcttgggtcatgtc

SEQ ID NO: 10037138 - DNA, 22 bp, Homo sapiens
ggcaggctcagcagccaaggag

SEQ ID NO: 10037139 - DNA, 19 bp, Homo sapiens
ggcaggctggatagagagg

SEQ ID NO: 10037140 - DNA, 22 bp, Homo sapiens
ggcaggctgggtgtcatggagt

SEQ ID NO: 10037141 - DNA, 23 bp, Homo sapiens
ggcagctctcatctgatgactga

SEQ ID NO: 10037142 - DNA, 22 bp, Homo sapiens
ggcagctctgctccacatgagt

SEQ ID NO: 10037143 - DNA, 22 bp, Homo sapiens
ggcagctgtaagatgagtgaat

SEQ ID NO: 10037144 - DNA, 22 bp, Homo sapiens
ggcagctgtctctgagttagca

SEQ ID NO: 10037145 - DNA, 22 bp, Homo sapiens
ggcagctgggttggccagaaac

SEQ ID NO: 10037146 - DNA, 22 bp, Homo sapiens
ggaggtggcagggaacataatt

SEQ ID NO: 10037147 - DNA, 22 bp, Homo sapiens
ggaggtgggattaggacctaaa

SEQ ID NO: 10037148 - DNA, 22 bp, Homo sapiens
ggaggtggtggcagtgacaatt

SEQ ID NO: 10037149 - DNA, 22 bp, Homo sapiens
ggaggtgggctaaggactctct

SEQ ID NO: 10037150 - DNA, 22 bp, Homo sapiens
ggaggtgggctaaggactctct

SEQ ID NO: 10037151 - DNA, 22 bp, Homo sapiens
ggagtaggagtagaactcatca

SEQ ID NO: 10037152 - DNA, 22 bp, Homo sapiens
ggaggtggcagagggacattct

SEQ ID NO: 10037153 - DNA, 20 bp, Homo sapiens
ggagggtggaagaaagcaag

SEQ ID NO: 10037154 - DNA, 22 bp, Homo sapiens
ggaggggtctctagcgaggaga

SEQ ID NO: 10037155 - DNA, 22 bp, Homo sapiens
ggaggggagtctcccaaagccg

SEQ ID NO: 10037156 - DNA, 22 bp, Homo sapiens
ggaggggaggtccagctgatct

SEQ ID NO: 10037157 - DNA, 22 bp, Homo sapiens
ggaggggagatgtttgggctca

SEQ ID NO: 10037158 - DNA, 22 bp, Homo sapiens
ggaggggaggattaatgacaaa

SEQ ID NO: 10037159 - DNA, 22 bp, Homo sapiens
ggagggaatgtctagcattctt

SEQ ID NO: 10037160 - DNA, 22 bp, Homo sapiens
ggagggacccactctagaggtg

SEQ ID NO: 10037161 - DNA, 21 bp, Homo sapiens
ggagggcagcccagactggct

SEQ ID NO: 10037162 - DNA, 22 bp, Homo sapiens
ggaggggaactaatcccgtgac

SEQ ID NO: 10037163 - DNA, 19 bp, Homo sapiens
ggctcctgtggctgcagcc

SEQ ID NO: 10037164 - DNA, 23 bp, Homo sapiens
ggctgctcttttcatgctgtttc

SEQ ID NO: 10037165 - DNA, 22 bp, Homo sapiens
gggaagagaccgtaccctggcc

SEQ ID NO: 10037166 - DNA, 22 bp, Homo sapiens
ggctttgggattcagcatgaga

SEQ ID NO: 10037167 - DNA, 22 bp, Homo sapiens
ggcccctgcggactgcctagag

SEQ ID NO: 10037168 - DNA, 22 bp, Homo sapiens
ggccctgagctgaagtactgtg

SEQ ID NO: 10037169 - DNA, 22 bp, Homo sapiens
ggccctgagcacagctcctctc

SEQ ID NO: 10037170 - DNA, 22 bp, Homo sapiens
ggccctgagtctagctgctctt

SEQ ID NO: 10037171 - DNA, 21 bp, Homo sapiens
ggctcctgctttgtgaggggc

SEQ ID NO: 10037172 - DNA, 22 bp, Homo sapiens
gggctctgtggttgtgctttgt

SEQ ID NO: 10037173 - DNA, 22 bp, Homo sapiens
gggctagcctcttccctgctcc

SEQ ID NO: 10037174 - DNA, 21 bp, Homo sapiens
gggctggacatggtggctcat

SEQ ID NO: 10037175 - DNA, 22 bp, Homo sapiens
gggtccaggcggcatagttgta

SEQ ID NO: 10037176 - DNA, 22 bp, Homo sapiens
ggggggtgctgatcagtggagc

SEQ ID NO: 10037177 - DNA, 20 bp, Homo sapiens
gggagaagggctgatgagag

SEQ ID NO: 10037178 - DNA, 22 bp, Homo sapiens
gggacgggcagtccaaggggtc

SEQ ID NO: 10037179 - DNA, 22 bp, Homo sapiens
gggatggctgcctgcatcagga

SEQ ID NO: 10037180 - DNA, 22 bp, Homo sapiens
gggatggggagctggaaagggg

SEQ ID NO: 10037181 - DNA, 21 bp, Homo sapiens
gggcagaggggcctcctgggt

SEQ ID NO: 10037182 - DNA, 22 bp, Homo sapiens
gggcagcacagacagtgaaggc

SEQ ID NO: 10037183 - DNA, 22 bp, Homo sapiens
gggcagcacgtttcaggaggat

SEQ ID NO: 10037184 - DNA, 22 bp, Homo sapiens
gggcagcagaattggacagaaa

SEQ ID NO: 10037185 - DNA, 22 bp, Homo sapiens
gggcagctctcacagcagccaa

SEQ ID NO: 10037186 - DNA, 22 bp, Homo sapiens
gggcagctcggaagtgggaaag

SEQ ID NO: 10037187 - DNA, 22 bp, Homo sapiens
gggcagctcagccaccatgcag

SEQ ID NO: 10037188 - DNA, 20 bp, Homo sapiens
gggcagctcccctcattctg

SEQ ID NO: 10037189 - DNA, 22 bp, Homo sapiens
gggcagctcctgtggaatccac

SEQ ID NO: 10037190 - DNA, 22 bp, Homo sapiens
gggcagctagccctctagccca

SEQ ID NO: 10037191 - DNA, 22 bp, Homo sapiens
gggccagtagcacctgtgtgga

SEQ ID NO: 10037192 - DNA, 23 bp, Homo sapiens
gggcccagcacaggacctggcag

SEQ ID NO: 10037193 - DNA, 22 bp, Homo sapiens
gggcctggtgcttctgactcct

SEQ ID NO: 10037194 - DNA, 22 bp, Homo sapiens
gggcgtggatggtcagtgcagg

SEQ ID NO: 10037195 - DNA, 22 bp, Homo sapiens
gtggggtagatctttctcagga

SEQ ID NO: 10037196 - DNA, 22 bp, Homo sapiens
gtggggtgcagcagtactgtgt

SEQ ID NO: 10037197 - DNA, 22 bp, Homo sapiens
gtggtgtaggtcacagttagga

SEQ ID NO: 10037198 - DNA, 20 bp, Homo sapiens
gtgggcagatgtgtgcatgg

SEQ ID NO: 10037199 - DNA, 22 bp, Homo sapiens
gtgggcagattaatttctcaat

SEQ ID NO: 10037200 - DNA, 20 bp, Homo sapiens
gtgggcagcaggcatactgg

SEQ ID NO: 10037201 - DNA, 20 bp, Homo sapiens
gtgggcagagcaccacctgg

SEQ ID NO: 10037202 - DNA, 22 bp, Homo sapiens
gtgggcagacagtgctttgcag

SEQ ID NO: 10037203 - DNA, 22 bp, Homo sapiens
gtgggcagccccttcaaggcca

SEQ ID NO: 10037204 - DNA, 22 bp, Homo sapiens
gtgggcagtggtttgcgcggtc

SEQ ID NO: 10037205 - DNA, 22 bp, Homo sapiens
gtgggcagttcaattctgggag

SEQ ID NO: 10037206 - DNA, 22 bp, Homo sapiens
gttctctagggctgtagactgg

SEQ ID NO: 10037207 - DNA, 22 bp, Homo sapiens
gttctatttcagtaagcaggca

SEQ ID NO: 10037208 - DNA, 22 bp, Homo sapiens
gttcgcatcttgatcatggact

SEQ ID NO: 10037209 - DNA, 22 bp, Homo sapiens
gtttttctaagtagcgatattt

SEQ ID NO: 10037210 - DNA, 20 bp, Homo sapiens
gtttttctctcttgccacta

SEQ ID NO: 10037211 - DNA, 22 bp, Homo sapiens
gtttttctctgaaatagttgac

SEQ ID NO: 10037212 - DNA, 22 bp, Homo sapiens
gtttttctgtgagcggtaaagg

SEQ ID NO: 10037213 - DNA, 22 bp, Homo sapiens
gtttttctagaaatctcctcct

SEQ ID NO: 10037214 - DNA, 22 bp, Homo sapiens
gtttttctagactgggagtttg

SEQ ID NO: 10037215 - DNA, 22 bp, Homo sapiens
gtttttctaggaccatgtgatt

SEQ ID NO: 10037216 - DNA, 22 bp, Homo sapiens
gtttttctttgtgtgaagacaa

SEQ ID NO: 10037217 - DNA, 20 bp, Homo sapiens
gtttttcttgggcgagctat

SEQ ID NO: 10037218 - DNA, 22 bp, Homo sapiens
gtggcccaggttggagtgcagt

SEQ ID NO: 10037219 - DNA, 22 bp, Homo sapiens
gtggcccaggctggagtgcagt

SEQ ID NO: 10037220 - DNA, 22 bp, Homo sapiens
gtggccctcagcagttgccaag

SEQ ID NO: 10037221 - DNA, 22 bp, Homo sapiens
gtggccctaacaccgtttctca

SEQ ID NO: 10037222 - DNA, 22 bp, Homo sapiens
gtggccctatttgaggacccca

SEQ ID NO: 10037223 - DNA, 21 bp, Homo sapiens
gtggccctgccgcagtgtcca

SEQ ID NO: 10037224 - DNA, 22 bp, Homo sapiens
gtggccctctgatagggtcagg

SEQ ID NO: 10037225 - DNA, 22 bp, Homo sapiens
gtggccctgagccctttgacag

SEQ ID NO: 10037226 - DNA, 22 bp, Homo sapiens
gtggccagcaagtgctgcctct

SEQ ID NO: 10037227 - DNA, 22 bp, Homo sapiens
gtggcaggggtattccagctga

SEQ ID NO: 10037228 - DNA, 22 bp, Homo sapiens
gtggcagttttgacatcacaaa

SEQ ID NO: 10037229 - DNA, 22 bp, Homo sapiens
gtggcatcagagctccctccag

SEQ ID NO: 10037230 - DNA, 22 bp, Homo sapiens
gtggcagttgctgtggcaataa

SEQ ID NO: 10037231 - DNA, 22 bp, Homo sapiens
gtggcattgacatgtaaacagt

SEQ ID NO: 10037232 - DNA, 20 bp, Homo sapiens
gtggcaggcagtgaaggagc

SEQ ID NO: 10037233 - DNA, 22 bp, Homo sapiens
gtggcaggagactggaagatgg

SEQ ID NO: 10037234 - DNA, 22 bp, Homo sapiens
gtggcaggagagacacagccat

SEQ ID NO: 10037235 - DNA, 22 bp, Homo sapiens
gtggctgctgtcctctctggtt

SEQ ID NO: 10037236 - DNA, 22 bp, Homo sapiens
gtggccctggagttgtgacact

SEQ ID NO: 10037237 - DNA, 22 bp, Homo sapiens
gtggccctgtcccaggcctcct

SEQ ID NO: 10037238 - DNA, 22 bp, Homo sapiens
gtggcccttgaagcagcttcat

SEQ ID NO: 10037239 - DNA, 22 bp, Homo sapiens
gtggcccttggagttgtgacct

SEQ ID NO: 10037240 - DNA, 22 bp, Homo sapiens
gtggccctgtgaacagcgcagt

SEQ ID NO: 10037241 - DNA, 20 bp, Homo sapiens
gtggcccttaaagagggaag

SEQ ID NO: 10037242 - DNA, 22 bp, Homo sapiens
gtggcacagggtgtggcacaca

SEQ ID NO: 10037243 - DNA, 22 bp, Homo sapiens
gtggcacacaggagagagctca

SEQ ID NO: 10037244 - DNA, 22 bp, Homo sapiens
gtggcagaggttcctcagtgtg

SEQ ID NO: 10037245 - DNA, 22 bp, Homo sapiens
gtggcagcaaatgcctggacta

SEQ ID NO: 10037246 - DNA, 22 bp, Homo sapiens
gtggcagctacatttaatgcaa

SEQ ID NO: 10037247 - DNA, 22 bp, Homo sapiens
gtggcagcggtgtgcaaggagg

SEQ ID NO: 10037248 - DNA, 22 bp, Homo sapiens
gtggagggtgattgccggctgt

SEQ ID NO: 10037249 - DNA, 22 bp, Homo sapiens
gtggagggaatgaatcttctct

SEQ ID NO: 10037250 - DNA, 22 bp, Homo sapiens
gtggacagcttctaggtgccag

SEQ ID NO: 10037251 - DNA, 22 bp, Homo sapiens
gtggacaggcaggctgtcgggg

SEQ ID NO: 10037252 - DNA, 22 bp, Homo sapiens
gtggagagagataagcctggtc

SEQ ID NO: 10037253 - DNA, 22 bp, Homo sapiens
gtgcctgcagcaatccatggca

SEQ ID NO: 10037254 - DNA, 22 bp, Homo sapiens
gtggaaggaattaacagactag

SEQ ID NO: 10037255 - DNA, 22 bp, Homo sapiens
ggtggcaggccctgagcatccc

SEQ ID NO: 10037256 - DNA, 23 bp, Homo sapiens
ggtggcaggagtggatgctgagc

SEQ ID NO: 10037257 - DNA, 22 bp, Homo sapiens
ggtggcagcgtctatctgacat

SEQ ID NO: 10037258 - DNA, 22 bp, Homo sapiens
gggtggggtgtatcggatccta

SEQ ID NO: 10037259 - DNA, 22 bp, Homo sapiens
ggtggcagagaggaggtagttt

SEQ ID NO: 10037260 - DNA, 22 bp, Homo sapiens
ggtgatgtttgagttgagacag

SEQ ID NO: 10037261 - DNA, 22 bp, Homo sapiens
gtaaacattactgtgctgtata

SEQ ID NO: 10037262 - DNA, 22 bp, Homo sapiens
gtctgacttgcgggcactctgg

SEQ ID NO: 10037263 - DNA, 22 bp, Homo sapiens
gtctgacttcctaatccatcac

SEQ ID NO: 10037264 - DNA, 22 bp, Homo sapiens
gtctgagggacagagtcctggc

SEQ ID NO: 10037265 - DNA, 22 bp, Homo sapiens
gtctgggctcctggcaggcagc

SEQ ID NO: 10037266 - DNA, 22 bp, Homo sapiens
gtctgggcagcagcatttctta

SEQ ID NO: 10037267 - DNA, 22 bp, Homo sapiens
gtctgggcaggaatctgcattc

SEQ ID NO: 10037268 - DNA, 22 bp, Homo sapiens
gtattacatttagtaattaggc

SEQ ID NO: 10037269 - DNA, 20 bp, Homo sapiens
gtattacaggcttagaacca

SEQ ID NO: 10037270 - DNA, 22 bp, Homo sapiens
gtattacaaataaatgttactg

SEQ ID NO: 10037271 - DNA, 22 bp, Homo sapiens
gtccatccagggtcaccatgac

SEQ ID NO: 10037272 - DNA, 22 bp, Homo sapiens
gcctcctgtcccaggctgagga

SEQ ID NO: 10037273 - DNA, 22 bp, Homo sapiens
gccgtggggagagagggtgcgt

SEQ ID NO: 10037274 - DNA, 22 bp, Homo sapiens
gcctctgctcggactttgcctc

SEQ ID NO: 10037275 - DNA, 22 bp, Homo sapiens
gcctctgcggagctgtacatca

SEQ ID NO: 10037276 - DNA, 22 bp, Homo sapiens
gccctctcttctgcagcctcca

SEQ ID NO: 10037277 - DNA, 22 bp, Homo sapiens
gccctcagtgaccactgattca

SEQ ID NO: 10037278 - DNA, 22 bp, Homo sapiens
gccctcagagttccccacagtg

SEQ ID NO: 10037279 - DNA, 22 bp, Homo sapiens
gccatgggcaaatgcagagctg

SEQ ID NO: 10037280 - DNA, 22 bp, Homo sapiens
gcccaggagttggaggctgcag

SEQ ID NO: 10037281 - DNA, 22 bp, Homo sapiens
gcccaggaggtcaagtagctat

SEQ ID NO: 10037282 - DNA, 22 bp, Homo sapiens
gcccaggaggcagaggttgtgg

SEQ ID NO: 10037283 - DNA, 22 bp, Homo sapiens
gcccaggatggtgtgtagtggt

SEQ ID NO: 10037284 - DNA, 22 bp, Homo sapiens
gcccaggattctttcttcctta

SEQ ID NO: 10037285 - DNA, 20 bp, Homo sapiens
gcccaggatctctgaggcat

SEQ ID NO: 10037286 - DNA, 22 bp, Homo sapiens
gcccaggataatgctgtccctg

SEQ ID NO: 10037287 - DNA, 22 bp, Homo sapiens
gcccaggagttggtggctgcag

SEQ ID NO: 10037288 - DNA, 22 bp, Homo sapiens
gcccaggagtttgcattttaac

SEQ ID NO: 10037289 - DNA, 22 bp, Homo sapiens
gcccaggatctgctcagatcat

SEQ ID NO: 10037290 - DNA, 22 bp, Homo sapiens
gcccaggatggctggaggtgct

SEQ ID NO: 10037291 - DNA, 22 bp, Homo sapiens
gcccaggatggagaatagtggt

SEQ ID NO: 10037292 - DNA, 22 bp, Homo sapiens
gcctgtgtggatgcgccggtgc

SEQ ID NO: 10037293 - DNA, 22 bp, Homo sapiens
gcctgtgtgtttagctctgggg

SEQ ID NO: 10037294 - DNA, 22 bp, Homo sapiens
gcctgggattgtgtaagtgaat

SEQ ID NO: 10037295 - DNA, 19 bp, Homo sapiens
gcctgggatgggcagaact

SEQ ID NO: 10037296 - DNA, 20 bp, Homo sapiens
gcctgggattatccactggt

SEQ ID NO: 10037297 - DNA, 21 bp, Homo sapiens
gcctgggatagtggcctccgg

SEQ ID NO: 10037298 - DNA, 23 bp, Homo sapiens
gcctgggactcaggaggagctca

SEQ ID NO: 10037299 - DNA, 23 bp, Homo sapiens
gcctgggactggtagtgtgacct

SEQ ID NO: 10037300 - DNA, 22 bp, Homo sapiens
gcctgggactgcagatccccag

SEQ ID NO: 10037301 - DNA, 22 bp, Homo sapiens
gcctgggaagactaagtgggag

SEQ ID NO: 10037302 - DNA, 22 bp, Homo sapiens
gcctgggaactctgatctcctg

SEQ ID NO: 10037303 - DNA, 22 bp, Homo sapiens
gcctgggaaagagtagggaaat

SEQ ID NO: 10037304 - DNA, 22 bp, Homo sapiens
gcctgggaaatggtggggtcag

SEQ ID NO: 10037305 - DNA, 21 bp, Homo sapiens
gcctgggaaatctgggaagcc

SEQ ID NO: 10037306 - DNA, 20 bp, Homo sapiens
gcctgcctcagctagctgag

SEQ ID NO: 10037307 - DNA, 22 bp, Homo sapiens
gcctctggaagaattacatcca

SEQ ID NO: 10037308 - DNA, 22 bp, Homo sapiens
gctggccccgagtgctacgctc

SEQ ID NO: 10037309 - DNA, 19 bp, Homo sapiens
gctggcccctgggatccag

SEQ ID NO: 10037310 - DNA, 22 bp, Homo sapiens
gctggcccagtgacccacagtg

SEQ ID NO: 10037311 - DNA, 22 bp, Homo sapiens
gctggcccagggtcacctagga

SEQ ID NO: 10037312 - DNA, 22 bp, Homo sapiens
gctggcctgggcagaggctatg

SEQ ID NO: 10037313 - DNA, 22 bp, Homo sapiens
gctgggagttactgtctccttt

SEQ ID NO: 10037314 - DNA, 22 bp, Homo sapiens
gctcttctaaagaatgtacagg

SEQ ID NO: 10037315 - DNA, 22 bp, Homo sapiens
gctcttctcagattgtacactc

SEQ ID NO: 10037316 - DNA, 22 bp, Homo sapiens
gctctgtgttccctccaggctc

SEQ ID NO: 10037317 - DNA, 22 bp, Homo sapiens
gctctgcccaaagctgtggctg

SEQ ID NO: 10037318 - DNA, 22 bp, Homo sapiens
gctctgcccaatgtccctacac

SEQ ID NO: 10037319 - DNA, 22 bp, Homo sapiens
gctctgccagcccaaggcgcag

SEQ ID NO: 10037320 - DNA, 22 bp, Homo sapiens
gctctgccagacactgtggcca

SEQ ID NO: 10037321 - DNA, 20 bp, Homo sapiens
gctctgccacttagaagctg

SEQ ID NO: 10037322 - DNA, 22 bp, Homo sapiens
gctctgagtctcagctaccaca

SEQ ID NO: 10037323 - DNA, 23 bp, Homo sapiens
gctctgccacttaatagctgtgt

SEQ ID NO: 10037324 - DNA, 22 bp, Homo sapiens
gctctgccaacagtttgggcaa

SEQ ID NO: 10037325 - DNA, 22 bp, Homo sapiens
gctcagagcatcccagtgaatg

SEQ ID NO: 10037326 - DNA, 22 bp, Homo sapiens
gctcagagatgtctgctgcctt

SEQ ID NO: 10037327 - DNA, 22 bp, Homo sapiens
gctccaggagctcacagctcgc

SEQ ID NO: 10037328 - DNA, 22 bp, Homo sapiens
gctcctggatgttcaagtcggc

SEQ ID NO: 10037329 - DNA, 22 bp, Homo sapiens
gctcctggccagcacagggccc

SEQ ID NO: 10037330 - DNA, 22 bp, Homo sapiens
gctccagctcgtggctcccagc

SEQ ID NO: 10037331 - DNA, 22 bp, Homo sapiens
gctccagctctgttctggggaa

SEQ ID NO: 10037332 - DNA, 22 bp, Homo sapiens
gctccaggagagggaagcagat

SEQ ID NO: 10037333 - DNA, 22 bp, Homo sapiens
gcagtgttaggaataaaaatga

SEQ ID NO: 10037334 - DNA, 22 bp, Homo sapiens
gcagtgttacttggtttgcaga

SEQ ID NO: 10037335 - DNA, 22 bp, Homo sapiens
gcagtgtcagtgcctgggtggt

SEQ ID NO: 10037336 - DNA, 22 bp, Homo sapiens
gcagtgttcagtgaagcaggag

SEQ ID NO: 10037337 - DNA, 22 bp, Homo sapiens
gcagtgttccttctactggggc

SEQ ID NO: 10037338 - DNA, 22 bp, Homo sapiens
gcagtgttatgttttctataat

SEQ ID NO: 10037339 - DNA, 22 bp, Homo sapiens
gcagtgttctaaattgggtgtg

SEQ ID NO: 10037340 - DNA, 22 bp, Homo sapiens
gcagtgttcttgttgcttttat

SEQ ID NO: 10037341 - DNA, 22 bp, Homo sapiens
gcagtgttgagccagctggggg

SEQ ID NO: 10037342 - DNA, 22 bp, Homo sapiens
gcagtgttgagtggtggctgaa

SEQ ID NO: 10037343 - DNA, 22 bp, Homo sapiens
gcagtgttgactatggtatgag

SEQ ID NO: 10037344 - DNA, 22 bp, Homo sapiens
gcaggtggtccccgtggagtgg

SEQ ID NO: 10037345 - DNA, 19 bp, Homo sapiens
gccagcagaatgatgaggc

SEQ ID NO: 10037346 - DNA, 20 bp, Homo sapiens
gccagcacagggagcagttc

SEQ ID NO: 10037347 - DNA, 22 bp, Homo sapiens
gcatggtggagtctgagcaggg

SEQ ID NO: 10037348 - DNA, 22 bp, Homo sapiens
gcatggtggggagatggcagcc

SEQ ID NO: 10037349 - DNA, 22 bp, Homo sapiens
gcagctgagagaagaacagggc

SEQ ID NO: 10037350 - DNA, 22 bp, Homo sapiens
gcagctgagcgtgaggaagagt

SEQ ID NO: 10037351 - DNA, 22 bp, Homo sapiens
gcaggagactggctgtggtagt

SEQ ID NO: 10037352 - DNA, 22 bp, Homo sapiens
gcaggagacaactgtaaggaga

SEQ ID NO: 10037353 - DNA, 22 bp, Homo sapiens
gcaggagagccagcaggcttcc

SEQ ID NO: 10037354 - DNA, 22 bp, Homo sapiens
gcaggagaaatgaagattgggt

SEQ ID NO: 10037355 - DNA, 22 bp, Homo sapiens
gcaggagaacaaagcaagctgc

SEQ ID NO: 10037356 - DNA, 18 bp, Homo sapiens
gcagctgacactggagtt

SEQ ID NO: 10037357 - DNA, 22 bp, Homo sapiens
gcagctcccagcttgaaaggtc

SEQ ID NO: 10037358 - DNA, 22 bp, Homo sapiens
gcagctattgtctcctgggccc

SEQ ID NO: 10037359 - DNA, 22 bp, Homo sapiens
gcagctattgtctcctgggccc

SEQ ID NO: 10037360 - DNA, 22 bp, Homo sapiens
gcagctattgtctcctgggccc

SEQ ID NO: 10037361 - DNA, 22 bp, Homo sapiens
gcagctcctcctgggctggaga

SEQ ID NO: 10037362 - DNA, 22 bp, Homo sapiens
gcagctaccacccaggaaggac

SEQ ID NO: 10037363 - DNA, 18 bp, Homo sapiens
gcagctagccaggggggc

SEQ ID NO: 10037364 - DNA, 20 bp, Homo sapiens
gcagctactctgtctcgctc

SEQ ID NO: 10037365 - DNA, 22 bp, Homo sapiens
gcagggcagaaggtgctgagga

SEQ ID NO: 10037366 - DNA, 22 bp, Homo sapiens
gcaggcagaggtggaggagaca

SEQ ID NO: 10037367 - DNA, 22 bp, Homo sapiens
gattttcatgataaacttgtga

SEQ ID NO: 10037368 - DNA, 22 bp, Homo sapiens
gattttcatttgcactctagaa

SEQ ID NO: 10037369 - DNA, 21 bp, Homo sapiens
gcagaaaggaatcttaggtcc

SEQ ID NO: 10037370 - DNA, 22 bp, Homo sapiens
gcaccctgagtgttcagctcca

SEQ ID NO: 10037371 - DNA, 22 bp, Homo sapiens
gcacccattgtgtgcagctctg

SEQ ID NO: 10037372 - DNA, 22 bp, Homo sapiens
gatgggcttcttccatgaagaa

SEQ ID NO: 10037373 - DNA, 22 bp, Homo sapiens
gatgggctgtctgagcgctgtg

SEQ ID NO: 10037374 - DNA, 22 bp, Homo sapiens
gatggtggagtaacattgccta

SEQ ID NO: 10037375 - DNA, 22 bp, Homo sapiens
gatggtgcaggtgaagtgctgg

SEQ ID NO: 10037376 - DNA, 22 bp, Homo sapiens
gatgtctgggtcttcctggctt

SEQ ID NO: 10037377 - DNA, 22 bp, Homo sapiens
gatgtctggctaccactcgcac

SEQ ID NO: 10037378 - DNA, 22 bp, Homo sapiens
gatgtctgtgagatcaaactaa

SEQ ID NO: 10037379 - DNA, 18 bp, Homo sapiens
gatggaaagtgtatgagt

SEQ ID NO: 10037380 - DNA, 22 bp, Homo sapiens
gatggacagcctggaaggaaag

SEQ ID NO: 10037381 - DNA, 22 bp, Homo sapiens
gatggcttgcttagtgacagca

SEQ ID NO: 10037382 - DNA, 20 bp, Homo sapiens
gatgggaatcggagctggta

SEQ ID NO: 10037383 - DNA, 22 bp, Homo sapiens
gattacaattcaggttgataag

SEQ ID NO: 10037384 - DNA, 20 bp, Homo sapiens
gattacaaaatgaaatgcat

SEQ ID NO: 10037385 - DNA, 22 bp, Homo sapiens
gattacaaaggtccttttctct

SEQ ID NO: 10037386 - DNA, 22 bp, Homo sapiens
gattacaaaactcatctatgac

SEQ ID NO: 10037387 - DNA, 22 bp, Homo sapiens
gatttacaaagctctctagtgt

SEQ ID NO: 10037388 - DNA, 22 bp, Homo sapiens
gatttacagatctaagggtcac

SEQ ID NO: 10037389 - DNA, 22 bp, Homo sapiens
gatttacagctatacccaatgg

SEQ ID NO: 10037390 - DNA, 22 bp, Homo sapiens
gatttacaggttaggtcctgta

SEQ ID NO: 10037391 - DNA, 22 bp, Homo sapiens
gaggtggtggtggaggcatagc

SEQ ID NO: 10037392 - DNA, 22 bp, Homo sapiens
gaggtggtcgaggaggggtacc

SEQ ID NO: 10037393 - DNA, 22 bp, Homo sapiens
gagtcacttcccgaataaaccc

SEQ ID NO: 10037394 - DNA, 22 bp, Homo sapiens
gaggtgggagggcagtccctaa

SEQ ID NO: 10037395 - DNA, 22 bp, Homo sapiens
gaggtgggatgtgtgtgctact

SEQ ID NO: 10037396 - DNA, 22 bp, Homo sapiens
gaggtcagtcagaccagggttt

SEQ ID NO: 10037397 - DNA, 22 bp, Homo sapiens
gaggtcaggggagaggctgatg

SEQ ID NO: 10037398 - DNA, 22 bp, Homo sapiens
gaggtcaggcttgcagcagggt

SEQ ID NO: 10037399 - DNA, 19 bp, Homo sapiens
gaggtcagcaagaagtatt

SEQ ID NO: 10037400 - DNA, 22 bp, Homo sapiens
gagggatggtagttgacactga

SEQ ID NO: 10037401 - DNA, 22 bp, Homo sapiens
gagggatgcagaaacagaggcc

SEQ ID NO: 10037402 - DNA, 22 bp, Homo sapiens
gaggcctgcagcgtggtccctg

SEQ ID NO: 10037403 - DNA, 22 bp, Homo sapiens
gagggcagtagcctcgtaccct

SEQ ID NO: 10037404 - DNA, 22 bp, Homo sapiens
gaggggaaagttctgcacaagg

SEQ ID NO: 10037405 - DNA, 22 bp, Homo sapiens
gagggcatagttaaataggagg

SEQ ID NO: 10037406 - DNA, 22 bp, Homo sapiens
gaggacagagccgcctggcaag

SEQ ID NO: 10037407 - DNA, 22 bp, Homo sapiens
gaggaggcttccgggaggcacg

SEQ ID NO: 10037408 - DNA, 22 bp, Homo sapiens
gaggcagaggttgcagtgagct

SEQ ID NO: 10037409 - DNA, 22 bp, Homo sapiens
gaggcagcagaacatggaagag

SEQ ID NO: 10037410 - DNA, 22 bp, Homo sapiens
gaggcagcaaaatatatcataa

SEQ ID NO: 10037411 - DNA, 22 bp, Homo sapiens
gaggcagcaataaaaagaattt

SEQ ID NO: 10037412 - DNA, 22 bp, Homo sapiens
gaggcagagtgcaccccaggag

SEQ ID NO: 10037413 - DNA, 22 bp, Homo sapiens
gaggcctgaaaggggacctatg

SEQ ID NO: 10037414 - DNA, 22 bp, Homo sapiens
gaggcagctgaaggagtgacag

SEQ ID NO: 10037415 - DNA, 22 bp, Homo sapiens
gaggcagctgggatacaaggga

SEQ ID NO: 10037416 - DNA, 22 bp, Homo sapiens
gaggcagctgggctggtggttt

SEQ ID NO: 10037417 - DNA, 22 bp, Homo sapiens
gaggcagctgggtccggtcggg

SEQ ID NO: 10037418 - DNA, 23 bp, Homo sapiens
gaggcagctcctgcagtgccctg

SEQ ID NO: 10037419 - DNA, 22 bp, Homo sapiens
gaggcagctgaagcttcaaaga

SEQ ID NO: 10037420 - DNA, 22 bp, Homo sapiens
gaggcagctcttctgaatgggg

SEQ ID NO: 10037421 - DNA, 22 bp, Homo sapiens
gaggcagcagggctggttcctt

SEQ ID NO: 10037422 - DNA, 18 bp, Homo sapiens
gaggcagctagcaatttt

SEQ ID NO: 10037423 - DNA, 22 bp, Homo sapiens
gaggcagcaggctgaggaggat

SEQ ID NO: 10037424 - DNA, 22 bp, Homo sapiens
gagtttatttgactggattctc

SEQ ID NO: 10037425 - DNA, 22 bp, Homo sapiens
gagtttattgtcttccaggctt

SEQ ID NO: 10037426 - DNA, 22 bp, Homo sapiens
gagtttatgtctttcattgttc

SEQ ID NO: 10037427 - DNA, 22 bp, Homo sapiens
gagtttattcaggaaatagcca

SEQ ID NO: 10037428 - DNA, 19 bp, Homo sapiens
gagtttatctcctagccct

SEQ ID NO: 10037429 - DNA, 23 bp, Homo sapiens
gagtgcagaatagacatgcagtg

SEQ ID NO: 10037430 - DNA, 22 bp, Homo sapiens
gagtgcagttggggtgagggga

SEQ ID NO: 10037431 - DNA, 22 bp, Homo sapiens
gagtgccatgtgttacctctgg

SEQ ID NO: 10037432 - DNA, 22 bp, Homo sapiens
gatgatgggttgatgtgaaggg

SEQ ID NO: 10037433 - DNA, 22 bp, Homo sapiens
ctttggcagcctcagctgcagg

SEQ ID NO: 10037434 - DNA, 20 bp, Homo sapiens
ctttggcaggccttgccacg

SEQ ID NO: 10037435 - DNA, 22 bp, Homo sapiens
cttggattcctcatatgcacag

SEQ ID NO: 10037436 - DNA, 22 bp, Homo sapiens
cttgaactcaatgtgaggaaga

SEQ ID NO: 10037437 - DNA, 22 bp, Homo sapiens
cttctctgcaccccacttttgc

SEQ ID NO: 10037438 - DNA, 22 bp, Homo sapiens
ctggctgtatgctggcctcaga

SEQ ID NO: 10037439 - DNA, 22 bp, Homo sapiens
cttctcggccgtgtggatgcgc

SEQ ID NO: 10037440 - DNA, 22 bp, Homo sapiens
ctggctctgtgggacctggcct

SEQ ID NO: 10037441 - DNA, 22 bp, Homo sapiens
gaacacagtcaagggctgctgt

SEQ ID NO: 10037442 - DNA, 22 bp, Homo sapiens
gaaagttttctcacacagtaat

SEQ ID NO: 10037443 - DNA, 22 bp, Homo sapiens
gaaagttttcatatataccaaa

SEQ ID NO: 10037444 - DNA, 22 bp, Homo sapiens
gaaagtttcttcattaagatgt

SEQ ID NO: 10037445 - DNA, 22 bp, Homo sapiens
gaaatacaaagccagccatttt

SEQ ID NO: 10037446 - DNA, 22 bp, Homo sapiens
gaacagagttgaaacaaggctg

SEQ ID NO: 10037447 - DNA, 22 bp, Homo sapiens
gaaagtttataggttatataat

SEQ ID NO: 10037448 - DNA, 22 bp, Homo sapiens
gaaaaggaaatttatagagatc

SEQ ID NO: 10037449 - DNA, 22 bp, Homo sapiens
gacacagagggcaccagatatg

SEQ ID NO: 10037450 - DNA, 22 bp, Homo sapiens
gacacagatatctctgagatta

SEQ ID NO: 10037451 - DNA, 22 bp, Homo sapiens
gacagctgtggagaggcatgtg

SEQ ID NO: 10037452 - DNA, 22 bp, Homo sapiens
gacagctgtgcaggagaagggg

SEQ ID NO: 10037453 - DNA, 22 bp, Homo sapiens
gacccaggagagagggttgcat

SEQ ID NO: 10037454 - DNA, 22 bp, Homo sapiens
gacccaggaagctacttctggt

SEQ ID NO: 10037455 - DNA, 22 bp, Homo sapiens
gacccaggagtgcagagagtgg

SEQ ID NO: 10037456 - DNA, 22 bp, Homo sapiens
gacccaggcccaaggctgccag

SEQ ID NO: 10037457 - DNA, 22 bp, Homo sapiens
gacccaggctcgtgggacggct

SEQ ID NO: 10037458 - DNA, 22 bp, Homo sapiens
gacccagggtggtcacctgaaa

SEQ ID NO: 10037459 - DNA, 22 bp, Homo sapiens
gacccagggtatccagagctgc

SEQ ID NO: 10037460 - DNA, 22 bp, Homo sapiens
gaccatcctggccaacgtggta

SEQ ID NO: 10037461 - DNA, 22 bp, Homo sapiens
gagacagatctcggctccatgc

SEQ ID NO: 10037462 - DNA, 22 bp, Homo sapiens
gagacagagtttcactcttgtt

SEQ ID NO: 10037463 - DNA, 20 bp, Homo sapiens
gagagctggggatgaggctg

SEQ ID NO: 10037464 - DNA, 21 bp, Homo sapiens
tggcagcacccacaccctctg

SEQ ID NO: 10037465 - DNA, 22 bp, Homo sapiens
tggcagctggctctgcgcaggc

SEQ ID NO: 10037466 - DNA, 22 bp, Homo sapiens
tggcagctggatcccaaggcag

SEQ ID NO: 10037467 - DNA, 22 bp, Homo sapiens
tggcagctggagggcaatggcc

SEQ ID NO: 10037468 - DNA, 22 bp, Homo sapiens
tggcagcaccagcagtgtcctt

SEQ ID NO: 10037469 - DNA, 22 bp, Homo sapiens
tggcacagggcttggtcgctca

SEQ ID NO: 10037470 - DNA, 22 bp, Homo sapiens
tggcacaggagcactgccctgg

SEQ ID NO: 10037471 - DNA, 22 bp, Homo sapiens
tggcacaggatctcagcggcca

SEQ ID NO: 10037472 - DNA, 22 bp, Homo sapiens
tggcaaggccacaggtgcagtt

SEQ ID NO: 10037473 - DNA, 23 bp, Homo sapiens
tggcaaggaatgggatggagact

SEQ ID NO: 10037474 - DNA, 22 bp, Homo sapiens
tggcaaggctgtgggggcagag

SEQ ID NO: 10037475 - DNA, 22 bp, Homo sapiens
tggccaggcaggtagaacggcc

SEQ ID NO: 10037476 - DNA, 15 bp, Homo sapiens
tggcagcttgttaag

SEQ ID NO: 10037477 - DNA, 22 bp, Homo sapiens
tggcagctttttgtttcaggct

SEQ ID NO: 10037478 - DNA, 23 bp, Homo sapiens
tggcagctgtgtaagagaaagca

SEQ ID NO: 10037479 - DNA, 22 bp, Homo sapiens
tggcagctgtgcttcattcttt

SEQ ID NO: 10037480 - DNA, 22 bp, Homo sapiens
tggcagctgtcagaatgcaaat

SEQ ID NO: 10037481 - DNA, 22 bp, Homo sapiens
tggcagctgtctgtggggtctc

SEQ ID NO: 10037482 - DNA, 22 bp, Homo sapiens
tggcagctggtacagtgggtct

SEQ ID NO: 10037483 - DNA, 22 bp, Homo sapiens
tggcagctgtgtccaggtagaa

SEQ ID NO: 10037484 - DNA, 22 bp, Homo sapiens
tggcagcttcctgctcatagga

SEQ ID NO: 10037485 - DNA, 22 bp, Homo sapiens
tggcagctgttaatgttttgtt

SEQ ID NO: 10037486 - DNA, 22 bp, Homo sapiens
tggcagcttcctgctcatagga

SEQ ID NO: 10037487 - DNA, 22 bp, Homo sapiens
tggcagcttgaatgcagtcttt

SEQ ID NO: 10037488 - DNA, 22 bp, Homo sapiens
cctagggatacagcagagtaca

SEQ ID NO: 10037489 - DNA, 22 bp, Homo sapiens
cctagggagcctgagagcagtg

SEQ ID NO: 10037490 - DNA, 22 bp, Homo sapiens
tggatctcggcaatgcgggact

SEQ ID NO: 10037491 - DNA, 22 bp, Homo sapiens
ccctggcctacaggcccagaga

SEQ ID NO: 10037492 - DNA, 20 bp, Homo sapiens
ccctggcctgtttcatgccc

SEQ ID NO: 10037493 - DNA, 22 bp, Homo sapiens
ccctggagcatctctgctgtct

SEQ ID NO: 10037494 - DNA, 22 bp, Homo sapiens
ccctggagaggactcacccctg

SEQ ID NO: 10037495 - DNA, 22 bp, Homo sapiens
ccctggagatcgggagaggaag

SEQ ID NO: 10037496 - DNA, 19 bp, Homo sapiens
ccctggagaataccctgga

SEQ ID NO: 10037497 - DNA, 20 bp, Homo sapiens
ccctggagagaagctccacg

SEQ ID NO: 10037498 - DNA, 22 bp, Homo sapiens
cctccagccttcctgaagagcc

SEQ ID NO: 10037499 - DNA, 22 bp, Homo sapiens
cctccagcattactggcccatg

SEQ ID NO: 10037500 - DNA, 22 bp, Homo sapiens
cctcctctgggaagattcagag

SEQ ID NO: 10037501 - DNA, 22 bp, Homo sapiens
tggccctgctgggtcagagctg

SEQ ID NO: 10037502 - DNA, 22 bp, Homo sapiens
tggccctgctggccaaaggcta

SEQ ID NO: 10037503 - DNA, 22 bp, Homo sapiens
tggccctgctgtatcatctgct

SEQ ID NO: 10037504 - DNA, 22 bp, Homo sapiens
tggccctgccgccacgacgtct

SEQ ID NO: 10037505 - DNA, 22 bp, Homo sapiens
tggccctgctatgatcctgcaa

SEQ ID NO: 10037506 - DNA, 22 bp, Homo sapiens
tggccctgctggacacgcctgc

SEQ ID NO: 10037507 - DNA, 18 bp, Homo sapiens
tggccccttatcagtcct

SEQ ID NO: 10037508 - DNA, 22 bp, Homo sapiens
tggcccagtgcttatgctctga

SEQ ID NO: 10037509 - DNA, 20 bp, Homo sapiens
tggcccagtggggcagggtg

SEQ ID NO: 10037510 - DNA, 22 bp, Homo sapiens
cctctgagaacacctggcgtcc

SEQ ID NO: 10037511 - DNA, 22 bp, Homo sapiens
cctctgagagaaggccttcagc

SEQ ID NO: 10037512 - DNA, 22 bp, Homo sapiens
cctctgagaccagctctgcacc

SEQ ID NO: 10037513 - DNA, 22 bp, Homo sapiens
cctctgagaggccatctctcct

SEQ ID NO: 10037514 - DNA, 22 bp, Homo sapiens
cctctggggcatcagacaaagg

SEQ ID NO: 10037515 - DNA, 22 bp, Homo sapiens
cctctgggctgcctgcacgggt

SEQ ID NO: 10037516 - DNA, 22 bp, Homo sapiens
cctctgaggtcatggacttggc

SEQ ID NO: 10037517 - DNA, 18 bp, Homo sapiens
cctctgggttttgttccc

SEQ ID NO: 10037518 - DNA, 22 bp, Homo sapiens
cctctgggtgggaggccgggcg

SEQ ID NO: 10037519 - DNA, 22 bp, Homo sapiens
cctctgtgacaaacagtcctgg

SEQ ID NO: 10037520 - DNA, 22 bp, Homo sapiens
cctctggggtgagtgggccact

SEQ ID NO: 10037521 - DNA, 22 bp, Homo sapiens
cctctgggggtcctcagagtct

SEQ ID NO: 10037522 - DNA, 22 bp, Homo sapiens
cctctgggtatctgtggaagta

SEQ ID NO: 10037523 - DNA, 22 bp, Homo sapiens
cctctgggtgacagactcttgg

SEQ ID NO: 10037524 - DNA, 22 bp, Homo sapiens
cctctctgtgtggcctctccat

SEQ ID NO: 10037525 - DNA, 22 bp, Homo sapiens
cctctctgtagcagcccccagt

SEQ ID NO: 10037526 - DNA, 22 bp, Homo sapiens
cctctctgtaagggtccctccc

SEQ ID NO: 10037527 - DNA, 20 bp, Homo sapiens
cctctctgcatgctccctga

SEQ ID NO: 10037528 - DNA, 20 bp, Homo sapiens
cctctctgaagaggtcatct

SEQ ID NO: 10037529 - DNA, 22 bp, Homo sapiens
cccagcgagtttgccggtgaac

SEQ ID NO: 10037530 - DNA, 22 bp, Homo sapiens
cccagctccgagctccgagccg

SEQ ID NO: 10037531 - DNA, 22 bp, Homo sapiens
cccagctcttttagcggcatct

SEQ ID NO: 10037532 - DNA, 22 bp, Homo sapiens
cccaggaaaagcagtgccagca

SEQ ID NO: 10037533 - DNA, 22 bp, Homo sapiens
cccaggaaacccgaaggcgacc

SEQ ID NO: 10037534 - DNA, 22 bp, Homo sapiens
cccaggaaagtggaggcggctg

SEQ ID NO: 10037535 - DNA, 22 bp, Homo sapiens
cccaggaaagagactgctgggt

SEQ ID NO: 10037536 - DNA, 22 bp, Homo sapiens
cccaggaggtggaggttgcagt

SEQ ID NO: 10037537 - DNA, 22 bp, Homo sapiens
cccaggaggtggaggttgcagc

SEQ ID NO: 10037538 - DNA, 22 bp, Homo sapiens
cccaggagggtggcctctgccc

SEQ ID NO: 10037539 - DNA, 22 bp, Homo sapiens
cccaggaggtggaggctgcagt

SEQ ID NO: 10037540 - DNA, 22 bp, Homo sapiens
cccaggaggtgtgcccaactcg

SEQ ID NO: 10037541 - DNA, 22 bp, Homo sapiens
cccaggaggtgtagctgcgtgg

SEQ ID NO: 10037542 - DNA, 22 bp, Homo sapiens
cccaggaggtggaggttgcggt

SEQ ID NO: 10037543 - DNA, 22 bp, Homo sapiens
cccaggaggtggagttcacagt

SEQ ID NO: 10037544 - DNA, 22 bp, Homo sapiens
cccaggaggttgaggctgcagt

SEQ ID NO: 10037545 - DNA, 15 bp, Homo sapiens
cccaggagttcgaga

SEQ ID NO: 10037546 - DNA, 22 bp, Homo sapiens
cccaggatgtcgaggctgcagt

SEQ ID NO: 10037547 - DNA, 22 bp, Homo sapiens
cccaggagttcgaggctgtagt

SEQ ID NO: 10037548 - DNA, 22 bp, Homo sapiens
cccaggcacagattatcccaat

SEQ ID NO: 10037549 - DNA, 22 bp, Homo sapiens
cccaggcaggagtgtggtggct

SEQ ID NO: 10037550 - DNA, 22 bp, Homo sapiens
cccaggcagtgtgtgcatgcgt

SEQ ID NO: 10037551 - DNA, 19 bp, Homo sapiens
tgcctgctcctggcttcca

SEQ ID NO: 10037552 - DNA, 22 bp, Homo sapiens
cccaggcagtctggctctaaag

SEQ ID NO: 10037553 - DNA, 22 bp, Homo sapiens
cccaggcagcctgcagggaagg

SEQ ID NO: 10037554 - DNA, 22 bp, Homo sapiens
ccccggaggcggaggttgcagt

SEQ ID NO: 10037555 - DNA, 22 bp, Homo sapiens
tgctccaggtgtgcctctcatg

SEQ ID NO: 10037556 - DNA, 22 bp, Homo sapiens
cccagggatgtggcagatgtta

SEQ ID NO: 10037557 - DNA, 22 bp, Homo sapiens
cccagggaggcccaggctctgc

SEQ ID NO: 10037558 - DNA, 22 bp, Homo sapiens
cccagggaggtagcaggagaaa

SEQ ID NO: 10037559 - DNA, 22 bp, Homo sapiens
cccagggagagcgcggaggcgg

SEQ ID NO: 10037560 - DNA, 20 bp, Homo sapiens
cccagggacctgagctccat

SEQ ID NO: 10037561 - DNA, 22 bp, Homo sapiens
cccagggactcgggattctagg

SEQ ID NO: 10037562 - DNA, 22 bp, Homo sapiens
tgctcccagctcctgcagcaac

SEQ ID NO: 10037563 - DNA, 22 bp, Homo sapiens
tgctgactcctggctgtgacac

SEQ ID NO: 10037564 - DNA, 22 bp, Homo sapiens
cctgggccaggcttgggaatgc

SEQ ID NO: 10037565 - DNA, 23 bp, Homo sapiens
cctgggcattggctgcagcttct

SEQ ID NO: 10037566 - DNA, 22 bp, Homo sapiens
cctgggcatctcatgcacctgc

SEQ ID NO: 10037567 - DNA, 22 bp, Homo sapiens
cctgggcattctttgagttctc

SEQ ID NO: 10037568 - DNA, 22 bp, Homo sapiens
cctgggcaatatagtgaggccc

SEQ ID NO: 10037569 - DNA, 19 bp, Homo sapiens
cctgggaggcggaggttgc

SEQ ID NO: 10037570 - DNA, 22 bp, Homo sapiens
tgtggcaggcaagatgtacaga

SEQ ID NO: 10037571 - DNA, 22 bp, Homo sapiens
tgtggcagggcgtgacatttgg

SEQ ID NO: 10037572 - DNA, 22 bp, Homo sapiens
tgtggcaggaagagcttctgag

SEQ ID NO: 10037573 - DNA, 22 bp, Homo sapiens
cctgggagctgtggaaaggctg

SEQ ID NO: 10037574 - DNA, 20 bp, Homo sapiens
cctgggctcaaagcatcctc

SEQ ID NO: 10037575 - DNA, 22 bp, Homo sapiens
cctgggccttgacctcgtgggc

SEQ ID NO: 10037576 - DNA, 22 bp, Homo sapiens
cctgggcctcacccagctcttg

SEQ ID NO: 10037577 - DNA, 22 bp, Homo sapiens
cctgggcctctcaaagtgctgg

SEQ ID NO: 10037578 - DNA, 22 bp, Homo sapiens
cctgggcctgaaaacatttctc

SEQ ID NO: 10037579 - DNA, 22 bp, Homo sapiens
tgtctgtctgtccttctcatta

SEQ ID NO: 10037580 - DNA, 22 bp, Homo sapiens
tgtctgtctgttgattcagaaa

SEQ ID NO: 10037581 - DNA, 22 bp, Homo sapiens
tgtctgtcatcagggatatcct

SEQ ID NO: 10037582 - DNA, 22 bp, Homo sapiens
tgtctgtcagcagtgggtcagg

SEQ ID NO: 10037583 - DNA, 22 bp, Homo sapiens
tgtctgtccttgtttggtatca

SEQ ID NO: 10037584 - DNA, 22 bp, Homo sapiens
tgtctgtcctgcttccttggac

SEQ ID NO: 10037585 - DNA, 22 bp, Homo sapiens
tgtctgtctgcaagccagaaag

SEQ ID NO: 10037586 - DNA, 22 bp, Homo sapiens
tgtctggtgggttgacaggcag

SEQ ID NO: 10037587 - DNA, 22 bp, Homo sapiens
tgtctggtgggttgacaggcag

SEQ ID NO: 10037588 - DNA, 22 bp, Homo sapiens
tgtgaactggcaggtggacggg

SEQ ID NO: 10037589 - DNA, 22 bp, Homo sapiens
tgtgcccatctcccagcttgac

SEQ ID NO: 10037590 - DNA, 20 bp, Homo sapiens
tgtgcccagcagaggctgcc

SEQ ID NO: 10037591 - DNA, 20 bp, Homo sapiens
tgtgcccaatgtccaggttc

SEQ ID NO: 10037592 - DNA, 22 bp, Homo sapiens
tgtgcccattacacagaggcat

SEQ ID NO: 10037593 - DNA, 22 bp, Homo sapiens
cctgggagagccatctgtggcc

SEQ ID NO: 10037594 - DNA, 22 bp, Homo sapiens
cctgggagagtctgtggtctcc

SEQ ID NO: 10037595 - DNA, 21 bp, Homo sapiens
cctgggagaattgggtgtggc

SEQ ID NO: 10037596 - DNA, 22 bp, Homo sapiens
tgtagggaggaagggttggaaa

SEQ ID NO: 10037597 - DNA, 22 bp, Homo sapiens
cctggagagctcgggccaggca

SEQ ID NO: 10037598 - DNA, 22 bp, Homo sapiens
cctggagatttcttcaagcttt

SEQ ID NO: 10037599 - DNA, 22 bp, Homo sapiens
cctggagattatttggtccaat

SEQ ID NO: 10037600 - DNA, 22 bp, Homo sapiens
cctggagcaaaaatctaaggag

SEQ ID NO: 10037601 - DNA, 22 bp, Homo sapiens
cctggagcacagcccagtccca

SEQ ID NO: 10037602 - DNA, 22 bp, Homo sapiens
tgtcagctggagatggcatggg

SEQ ID NO: 10037603 - DNA, 22 bp, Homo sapiens
tgtcatgggcatttattgaggg

SEQ ID NO: 10037604 - DNA, 22 bp, Homo sapiens
tgtcatgggtctaaacattgat

SEQ ID NO: 10037605 - DNA, 22 bp, Homo sapiens
cctggagacccacttctgccaa

SEQ ID NO: 10037606 - DNA, 22 bp, Homo sapiens
cctggagacctgatggcagcgg

SEQ ID NO: 10037607 - DNA, 22 bp, Homo sapiens
cctggagagagaggccaactgc

SEQ ID NO: 10037608 - DNA, 22 bp, Homo sapiens
cctggagacgaggctggaccat

SEQ ID NO: 10037609 - DNA, 21 bp, Homo sapiens
cctggagacaaagacagggtg

SEQ ID NO: 10037610 - DNA, 22 bp, Homo sapiens
cctggagaccagaggatacttc

SEQ ID NO: 10037611 - DNA, 22 bp, Homo sapiens
tggtccctgcctgccaagtgct

SEQ ID NO: 10037612 - DNA, 22 bp, Homo sapiens
tggtccctgcgttaagagcact

SEQ ID NO: 10037613 - DNA, 21 bp, Homo sapiens
tggtccctttcagagtctgga

SEQ ID NO: 10037614 - DNA, 22 bp, Homo sapiens
tggtccctagtgtgggagcttg

SEQ ID NO: 10037615 - DNA, 23 bp, Homo sapiens
tggtccctcaaggaggccagggc

SEQ ID NO: 10037616 - DNA, 22 bp, Homo sapiens
tggtccctattgtggtaagtgg

SEQ ID NO: 10037617 - DNA, 23 bp, Homo sapiens
tggtccctgagagctggggaggg

SEQ ID NO: 10037618 - DNA, 22 bp, Homo sapiens
tggtccctaggaaagcagtgtt

SEQ ID NO: 10037619 - DNA, 21 bp, Homo sapiens
tggtgccttcagctgtctttt

SEQ ID NO: 10037620 - DNA, 22 bp, Homo sapiens
tgtctcatctcttaaccccact

SEQ ID NO: 10037621 - DNA, 22 bp, Homo sapiens
cctggccctggaatagggcagg

SEQ ID NO: 10037622 - DNA, 19 bp, Homo sapiens
cctggccctgctgcgcggg

SEQ ID NO: 10037623 - DNA, 22 bp, Homo sapiens
cctggcccagggactttcgcct

SEQ ID NO: 10037624 - DNA, 16 bp, Homo sapiens
cctggcccggcttcct

SEQ ID NO: 10037625 - DNA, 22 bp, Homo sapiens
cctggcccacatggcttctccc

SEQ ID NO: 10037626 - DNA, 22 bp, Homo sapiens
tgtcctccaggacctgcagggc

SEQ ID NO: 10037627 - DNA, 22 bp, Homo sapiens
ctagcccttggtgagaacagcg

SEQ ID NO: 10037628 - DNA, 22 bp, Homo sapiens
ttcctttgggaaatcactaagg

SEQ ID NO: 10037629 - DNA, 22 bp, Homo sapiens
ctagggaaataaactgagtggt

SEQ ID NO: 10037630 - DNA, 22 bp, Homo sapiens
ctagggaatataatgtatgcca

SEQ ID NO: 10037631 - DNA, 22 bp, Homo sapiens
ctagggagtggcagagctggga

SEQ ID NO: 10037632 - DNA, 22 bp, Homo sapiens
ttcttgtctttgttatgtagga

SEQ ID NO: 10037633 - DNA, 22 bp, Homo sapiens
ctcagcagagaccagggaggaa

SEQ ID NO: 10037634 - DNA, 22 bp, Homo sapiens
ctcagcaggtaccacatgatct

SEQ ID NO: 10037635 - DNA, 22 bp, Homo sapiens
ttgagctttgatgcatggcagg

SEQ ID NO: 10037636 - DNA, 23 bp, Homo sapiens
cggctgctcggccgagtcctcgg

SEQ ID NO: 10037637 - DNA, 22 bp, Homo sapiens
cggctgctgcctgagtcgctgt

SEQ ID NO: 10037638 - DNA, 22 bp, Homo sapiens
ttccttccctcagtggctgaag

SEQ ID NO: 10037639 - DNA, 22 bp, Homo sapiens
ctaaggcaccgaggcaggagcg

SEQ ID NO: 10037640 - DNA, 22 bp, Homo sapiens
tttacatggaatattgtcttgt

SEQ ID NO: 10037641 - DNA, 22 bp, Homo sapiens
ctcctctccatcagcgccaccc

SEQ ID NO: 10037642 - DNA, 22 bp, Homo sapiens
ctcctctggaaattcctctgcc

SEQ ID NO: 10037643 - DNA, 20 bp, Homo sapiens
ctctcctcacccgtgtcagg

SEQ ID NO: 10037644 - DNA, 22 bp, Homo sapiens
ctcctgggctatgtctgcttgg

SEQ ID NO: 10037645 - DNA, 22 bp, Homo sapiens
ctcctgggctcaagtgatcctc

SEQ ID NO: 10037646 - DNA, 22 bp, Homo sapiens
ttgttacagcagcaatagaaaa

SEQ ID NO: 10037647 - DNA, 21 bp, Homo sapiens
ttgttacaatgcaagagtatg

SEQ ID NO: 10037648 - DNA, 22 bp, Homo sapiens
tttaaaaaactagtctgagtct

SEQ ID NO: 10037649 - DNA, 22 bp, Homo sapiens
ctccaggttttacaaggtctat

SEQ ID NO: 10037650 - DNA, 22 bp, Homo sapiens
ttgtatttctccactttctgtt

SEQ ID NO: 10037651 - DNA, 22 bp, Homo sapiens
ttggcattcatgggacaacaaa

SEQ ID NO: 10037652 - DNA, 22 bp, Homo sapiens
ttggcattgaagtttcattggt

SEQ ID NO: 10037653 - DNA, 22 bp, Homo sapiens
ttggcattggagatgcaagaac

SEQ ID NO: 10037654 - DNA, 22 bp, Homo sapiens
ttgggatctcaaatccagctat

SEQ ID NO: 10037655 - DNA, 22 bp, Homo sapiens
ttgggagttcctactgcggttt

SEQ ID NO: 10037656 - DNA, 22 bp, Homo sapiens
ttgggcaggaacagatgcttga

SEQ ID NO: 10037657 - DNA, 23 bp, Homo sapiens
ttgggcaggagagtaatgtgatc

SEQ ID NO: 10037658 - DNA, 22 bp, Homo sapiens
ttgggcagatgtttcctgtgga

SEQ ID NO: 10037659 - DNA, 22 bp, Homo sapiens
ttgggcagaggctgtgcagagg

SEQ ID NO: 10037660 - DNA, 22 bp, Homo sapiens
ttgggcaccagtgcactgacag

SEQ ID NO: 10037661 - DNA, 22 bp, Homo sapiens
ctggacagaaaaggccactgga

SEQ ID NO: 10037662 - DNA, 22 bp, Homo sapiens
ctgctttggcagaagtcagcta

SEQ ID NO: 10037663 - DNA, 22 bp, Homo sapiens
ctgctttgaggggctctgtata

SEQ ID NO: 10037664 - DNA, 22 bp, Homo sapiens
ctggaccctgtttccctaggtc

SEQ ID NO: 10037665 - DNA, 23 bp, Homo sapiens
ctggcccaggtgagaggttggtg

SEQ ID NO: 10037666 - DNA, 22 bp, Homo sapiens
ctggccctgtggaggcaggaac

SEQ ID NO: 10037667 - DNA, 22 bp, Homo sapiens
ctggcccttaggaaaacaaagt

SEQ ID NO: 10037668 - DNA, 22 bp, Homo sapiens
ctggccctgtggcctaaggact

SEQ ID NO: 10037669 - DNA, 22 bp, Homo sapiens
ctggccataggttctcagtgtg

SEQ ID NO: 10037670 - DNA, 20 bp, Homo sapiens
ctggcccaggatgatggcgc

SEQ ID NO: 10037671 - DNA, 22 bp, Homo sapiens
ctggcccaggctcctggggcac

SEQ ID NO: 10037672 - DNA, 22 bp, Homo sapiens
ctggcccagagagcagagctta

SEQ ID NO: 10037673 - DNA, 22 bp, Homo sapiens
ctggcccaggagagcaggcatt

SEQ ID NO: 10037674 - DNA, 22 bp, Homo sapiens
ctggctccaggtcatgcactca

SEQ ID NO: 10037675 - DNA, 22 bp, Homo sapiens
ctggctccctggacatggggcc

SEQ ID NO: 10037676 - DNA, 22 bp, Homo sapiens
ctggctcctcaggactgcggga

SEQ ID NO: 10037677 - DNA, 22 bp, Homo sapiens
ctggctctgggctaagctccca

SEQ ID NO: 10037678 - DNA, 22 bp, Homo sapiens
ctggctctgggcctcagacact

SEQ ID NO: 10037679 - DNA, 22 bp, Homo sapiens
ctggctctgaccgcgctggcct

SEQ ID NO: 10037680 - DNA, 22 bp, Homo sapiens
ctggcagtggggcctcagtgtt

SEQ ID NO: 10037681 - DNA, 22 bp, Homo sapiens
ctggcagtcacggccatgtgct

SEQ ID NO: 10037682 - DNA, 22 bp, Homo sapiens
ctggcagtgcccagtcactgtt

SEQ ID NO: 10037683 - DNA, 22 bp, Homo sapiens
ctggcagtgagctggccactca

SEQ ID NO: 10037684 - DNA, 22 bp, Homo sapiens
ctggcacatagtaggtgcacag

SEQ ID NO: 10037685 - DNA, 22 bp, Homo sapiens
ctggcactggatcgtgcatatc

SEQ ID NO: 10037686 - DNA, 22 bp, Homo sapiens
ctggcaagaaatatatatctta

SEQ ID NO: 10037687 - DNA, 22 bp, Homo sapiens
ctgaactctttatgacagcttg

SEQ ID NO: 10037688 - DNA, 22 bp, Homo sapiens
ctgaacttattgagtgcttgct

SEQ ID NO: 10037689 - DNA, 21 bp, Homo sapiens
ctctggtcctgtctggcaggc

SEQ ID NO: 10037690 - DNA, 22 bp, Homo sapiens
ctctgggcaggaccagtggacc

SEQ ID NO: 10037691 - DNA, 22 bp, Homo sapiens
ctctgggcaggacgccaggcct

SEQ ID NO: 10037692 - DNA, 17 bp, Homo sapiens
ctctgggcagcctgggg

SEQ ID NO: 10037693 - DNA, 22 bp, Homo sapiens
ctctgggcactgtatgggttct

SEQ ID NO: 10037694 - DNA, 22 bp, Homo sapiens
ctctgggcaccaaagagcagct

SEQ ID NO: 10037695 - DNA, 22 bp, Homo sapiens
ctctgggcacattttccaggac

SEQ ID NO: 10037696 - DNA, 22 bp, Homo sapiens
ctctgggcaagtttcttcatga

SEQ ID NO: 10037697 - DNA, 19 bp, Homo sapiens
ctctgggcaagtcacttaa

SEQ ID NO: 10037698 - DNA, 22 bp, Homo sapiens
ctctgggcaaagatgcctcatc

SEQ ID NO: 10037699 - DNA, 22 bp, Homo sapiens
ctctgggcaagtatgatagaaa

SEQ ID NO: 10037700 - DNA, 22 bp, Homo sapiens
ctctgggctccttcagcccttt

SEQ ID NO: 10037701 - DNA, 22 bp, Homo sapiens
ctctgggcggcccaggccaacc

SEQ ID NO: 10037702 - DNA, 23 bp, Homo sapiens
ctctgggcgggcaggtcagcctc

SEQ ID NO: 10037703 - DNA, 21 bp, Homo sapiens
ctctgggccattttcttccac

SEQ ID NO: 10037704 - DNA, 22 bp, Homo sapiens
ctctgggcccacttaaatctgg

SEQ ID NO: 10037705 - DNA, 22 bp, Homo sapiens
ctctgggccatgctactgctct

SEQ ID NO: 10037706 - DNA, 22 bp, Homo sapiens
ctctgggccaccgctggtgtat

SEQ ID NO: 10037707 - DNA, 22 bp, Homo sapiens
ctctcctctgaagtggtgaccc

SEQ ID NO: 10037708 - DNA, 22 bp, Homo sapiens
ctctcctcccatgtaggagatg

SEQ ID NO: 10037709 - DNA, 22 bp, Homo sapiens
tttgtgaataggttggcttcca

SEQ ID NO: 10037710 - DNA, 19 bp, Homo sapiens
ctctggctcctgggctgcc

SEQ ID NO: 10037711 - DNA, 22 bp, Homo sapiens
ctgatttcatgctatcaatgtt

SEQ ID NO: 10037712 - DNA, 22 bp, Homo sapiens
ctgattctttcttcttgccagg

SEQ ID NO: 10037713 - DNA, 22 bp, Homo sapiens
ctgattctctgactcttggctt

SEQ ID NO: 10037714 - DNA, 22 bp, Homo sapiens
ctgattctgtaatttttcctaa

SEQ ID NO: 10037715 - DNA, 22 bp, Homo sapiens
ctgaggcactgtcagctgaggc

SEQ ID NO: 10037716 - DNA, 22 bp, Homo sapiens
ctgagacatggtttgactggca

SEQ ID NO: 10037717 - DNA, 22 bp, Homo sapiens
ctgagacccagacacctgagga

SEQ ID NO: 10037718 - DNA, 22 bp, Homo sapiens
ctgcctccaggctcaccttgac

SEQ ID NO: 10037719 - DNA, 22 bp, Homo sapiens
ctgcctcctgccgtgcagcttc

SEQ ID NO: 10037720 - DNA, 22 bp, Homo sapiens
ctgcagccacgagtcacagccc

SEQ ID NO: 10037721 - DNA, 22 bp, Homo sapiens
ctgccaggcgatggattggctg

SEQ ID NO: 10037722 - DNA, 22 bp, Homo sapiens
caggaaagggatgggctgccac

SEQ ID NO: 10037723 - DNA, 22 bp, Homo sapiens
caggaaaggtgtgtcatgatgg

SEQ ID NO: 10037724 - DNA, 22 bp, Homo sapiens
gttctgtctgagcaccacagga

SEQ ID NO: 10037725 - DNA, 22 bp, Homo sapiens
gtttattattcaacttcatgtt

SEQ ID NO: 10037726 - DNA, 22 bp, Homo sapiens
gtttattcttcagcaacatctg

SEQ ID NO: 10037727 - DNA, 22 bp, Homo sapiens
gtttacacataactcctatcaa

SEQ ID NO: 10037728 - DNA, 18 bp, Homo sapiens
gtttacacattctagaaa

SEQ ID NO: 10037729 - DNA, 22 bp, Homo sapiens
gtttacactccaggctggggtg

SEQ ID NO: 10037730 - DNA, 22 bp, Homo sapiens
cagcttctccggcctggtgcgg

SEQ ID NO: 10037731 - DNA, 22 bp, Homo sapiens
gtgtttggtcagacgtccgggg

SEQ ID NO: 10037732 - DNA, 22 bp, Homo sapiens
gttacaaatgtaaattctgggg

SEQ ID NO: 10037733 - DNA, 22 bp, Homo sapiens
gttacaaatgccaaagctgaga

SEQ ID NO: 10037734 - DNA, 22 bp, Homo sapiens
cagcttccgaccgggggctgca

SEQ ID NO: 10037735 - DNA, 22 bp, Homo sapiens
cagcttccataagagatggaga

SEQ ID NO: 10037736 - DNA, 22 bp, Homo sapiens
cagcttcatgacaaacagtttt

SEQ ID NO: 10037737 - DNA, 22 bp, Homo sapiens
cagcttcaactgcacagtcaac

SEQ ID NO: 10037738 - DNA, 22 bp, Homo sapiens
gtgggtggatggctcacctcca

SEQ ID NO: 10037739 - DNA, 22 bp, Homo sapiens
gtgggtggggagctctctggag

SEQ ID NO: 10037740 - DNA, 22 bp, Homo sapiens
gtgtattagtgagaaggaagat

SEQ ID NO: 10037741 - DNA, 22 bp, Homo sapiens
gtgtctggaacgggtggtactc

SEQ ID NO: 10037742 - DNA, 22 bp, Homo sapiens
cagctggctggtcagtgcacaa

SEQ ID NO: 10037743 - DNA, 18 bp, Homo sapiens
cagctgcaggctcaggac

SEQ ID NO: 10037744 - DNA, 22 bp, Homo sapiens
cagctgcaggctgtgcaggaag

SEQ ID NO: 10037745 - DNA, 22 bp, Homo sapiens
cagctgccacacctctttctct

SEQ ID NO: 10037746 - DNA, 22 bp, Homo sapiens
cagctgccacaggactttctga

SEQ ID NO: 10037747 - DNA, 20 bp, Homo sapiens
cagctgcctggctctgggat

SEQ ID NO: 10037748 - DNA, 22 bp, Homo sapiens
cagctggccccacagtagaggc

SEQ ID NO: 10037749 - DNA, 22 bp, Homo sapiens
cagctggcgggcagagccgcca

SEQ ID NO: 10037750 - DNA, 22 bp, Homo sapiens
cagctggctgcatgatgccaaa

SEQ ID NO: 10037751 - DNA, 22 bp, Homo sapiens
cagctgctgtaacagaatactt

SEQ ID NO: 10037752 - DNA, 22 bp, Homo sapiens
cagctgctgttcagttttgttt

SEQ ID NO: 10037753 - DNA, 22 bp, Homo sapiens
cagctggccaatcagggcgccc

SEQ ID NO: 10037754 - DNA, 22 bp, Homo sapiens
cagctgcctgtctggaggcaat

SEQ ID NO: 10037755 - DNA, 22 bp, Homo sapiens
cagctgcctgtattgtcctcat

SEQ ID NO: 10037756 - DNA, 22 bp, Homo sapiens
cagctgccttctgcgggaagtc

SEQ ID NO: 10037757 - DNA, 22 bp, Homo sapiens
gtggagccaggggctgtaggta

SEQ ID NO: 10037758 - DNA, 21 bp, Homo sapiens
cagcccagcttcttccccagt

SEQ ID NO: 10037759 - DNA, 22 bp, Homo sapiens
cagcccagctctgactaaccct

SEQ ID NO: 10037760 - DNA, 22 bp, Homo sapiens
gtggcaggttataagcatctca

SEQ ID NO: 10037761 - DNA, 22 bp, Homo sapiens
gtggcagaaatattcttgctct

SEQ ID NO: 10037762 - DNA, 22 bp, Homo sapiens
gtggcagtagacagtgcatcta

SEQ ID NO: 10037763 - DNA, 22 bp, Homo sapiens
gtggcagtcgctgacagataca

SEQ ID NO: 10037764 - DNA, 22 bp, Homo sapiens
gtggcagtcggaagtcaggaga

SEQ ID NO: 10037765 - DNA, 22 bp, Homo sapiens
gtggcagtctcatctgtggctc

SEQ ID NO: 10037766 - DNA, 22 bp, Homo sapiens
gtggcagtctttggcaatgaca

SEQ ID NO: 10037767 - DNA, 19 bp, Homo sapiens
gtgggacagacattacata

SEQ ID NO: 10037768 - DNA, 22 bp, Homo sapiens
gtgggacagtcagaagtgagca

SEQ ID NO: 10037769 - DNA, 22 bp, Homo sapiens
gtgggacagctggagggtccct

SEQ ID NO: 10037770 - DNA, 22 bp, Homo sapiens
gtgggacagctttccgttgagg

SEQ ID NO: 10037771 - DNA, 22 bp, Homo sapiens
gtgggcaggtaggcaccagcta

SEQ ID NO: 10037772 - DNA, 22 bp, Homo sapiens
gtgggcagtgcctgacggatga

SEQ ID NO: 10037773 - DNA, 22 bp, Homo sapiens
caggcactttgctgggggcgca

SEQ ID NO: 10037774 - DNA, 22 bp, Homo sapiens
caggatgaggtagaggcagata

SEQ ID NO: 10037775 - DNA, 22 bp, Homo sapiens
caggatgagaagggctcttacg

SEQ ID NO: 10037776 - DNA, 22 bp, Homo sapiens
tacagctggactggtagctgtg

SEQ ID NO: 10037777 - DNA, 22 bp, Homo sapiens
caggcagggagctggaaaggat

SEQ ID NO: 10037778 - DNA, 19 bp, Homo sapiens
caggccctggacccatctg

SEQ ID NO: 10037779 - DNA, 22 bp, Homo sapiens
caggccctgggcaggcacagag

SEQ ID NO: 10037780 - DNA, 17 bp, Homo sapiens
caggcagacatgtaagc

SEQ ID NO: 10037781 - DNA, 22 bp, Homo sapiens
caggcagaatgaccgacctcgc

SEQ ID NO: 10037782 - DNA, 22 bp, Homo sapiens
caggcagaagaagtggaaggac

SEQ ID NO: 10037783 - DNA, 22 bp, Homo sapiens
caggcagagacgtcagtgtagg

SEQ ID NO: 10037784 - DNA, 22 bp, Homo sapiens
caggcagcaggagccctgctcg

SEQ ID NO: 10037785 - DNA, 22 bp, Homo sapiens
caggcagcagccactctggtat

SEQ ID NO: 10037786 - DNA, 22 bp, Homo sapiens
caggcagcatttactctgatga

SEQ ID NO: 10037787 - DNA, 22 bp, Homo sapiens
caggcagccaggggacctgtcc

SEQ ID NO: 10037788 - DNA, 22 bp, Homo sapiens
caggcagcatcagtctgctgta

SEQ ID NO: 10037789 - DNA, 22 bp, Homo sapiens
caggcagctgactgtcagatat

SEQ ID NO: 10037790 - DNA, 22 bp, Homo sapiens
caggcagctctgcttttcctaa

SEQ ID NO: 10037791 - DNA, 22 bp, Homo sapiens
caggcagcctgagggatctggg

SEQ ID NO: 10037792 - DNA, 22 bp, Homo sapiens
caggcagccctgcaccaagtgt

SEQ ID NO: 10037793 - DNA, 22 bp, Homo sapiens
caggcagctctaatggaaagtg

SEQ ID NO: 10037794 - DNA, 22 bp, Homo sapiens
caggcagctgctgggttcagcc

SEQ ID NO: 10037795 - DNA, 22 bp, Homo sapiens
caggcagctgcgacaagagagc

SEQ ID NO: 10037796 - DNA, 22 bp, Homo sapiens
caggcagctgaggactttgcta

SEQ ID NO: 10037797 - DNA, 22 bp, Homo sapiens
caggcagctgggtcaccgtccc

SEQ ID NO: 10037798 - DNA, 22 bp, Homo sapiens
caggagagatatgagtccccac

SEQ ID NO: 10037799 - DNA, 19 bp, Homo sapiens
caggagagcatgcactttg

SEQ ID NO: 10037800 - DNA, 22 bp, Homo sapiens
caggagagcccgggtccgggct

SEQ ID NO: 10037801 - DNA, 15 bp, Homo sapiens
caggagaggaaggtt

SEQ ID NO: 10037802 - DNA, 22 bp, Homo sapiens
caggagaggaggctacttctta

SEQ ID NO: 10037803 - DNA, 22 bp, Homo sapiens
caggagatgtaagacttctgtt

SEQ ID NO: 10037804 - DNA, 22 bp, Homo sapiens
caggagatcttaggaattctta

SEQ ID NO: 10037805 - DNA, 22 bp, Homo sapiens
caggagaggctgtacgtttctc

SEQ ID NO: 10037806 - DNA, 22 bp, Homo sapiens
caggagggggtggagtttcgcc

SEQ ID NO: 10037807 - DNA, 20 bp, Homo sapiens
caggagggacatttcagcat

SEQ ID NO: 10037808 - DNA, 22 bp, Homo sapiens
caggagggcccgagactcttcc

SEQ ID NO: 10037809 - DNA, 22 bp, Homo sapiens
caggaggaagaactctgcaaca

SEQ ID NO: 10037810 - DNA, 22 bp, Homo sapiens
caggaatgacccaacagtttca

SEQ ID NO: 10037811 - DNA, 22 bp, Homo sapiens
caggaatggaggcatttatgaa

SEQ ID NO: 10037812 - DNA, 22 bp, Homo sapiens
caggaatgccttcttcagccat

SEQ ID NO: 10037813 - DNA, 22 bp, Homo sapiens
caggaatggttaatctaaagtg

SEQ ID NO: 10037814 - DNA, 22 bp, Homo sapiens
caggaatgagttctggtgctct

SEQ ID NO: 10037815 - DNA, 22 bp, Homo sapiens
caggaatgatattcgaggagat

SEQ ID NO: 10037816 - DNA, 22 bp, Homo sapiens
caggaatgtttgtgctccttta

SEQ ID NO: 10037817 - DNA, 22 bp, Homo sapiens
caggaatgttgcatgtgatctt

SEQ ID NO: 10037818 - DNA, 22 bp, Homo sapiens
caggaatgtcccatccccttca

SEQ ID NO: 10037819 - DNA, 22 bp, Homo sapiens
caggaatgtgagggttccctgc

SEQ ID NO: 10037820 - DNA, 22 bp, Homo sapiens
caggaatgtccttgtcatttca

SEQ ID NO: 10037821 - DNA, 22 bp, Homo sapiens
caggacagctcaacacctcctc

SEQ ID NO: 10037822 - DNA, 22 bp, Homo sapiens
catggctgaacactcagtgact

SEQ ID NO: 10037823 - DNA, 22 bp, Homo sapiens
catgtctgggtatatgcatatg

SEQ ID NO: 10037824 - DNA, 21 bp, Homo sapiens
tcatgggcaggtcacttcttt

SEQ ID NO: 10037825 - DNA, 22 bp, Homo sapiens
catccctgggcgggacactctt

SEQ ID NO: 10037826 - DNA, 22 bp, Homo sapiens
catccctgattcctagtacagt

SEQ ID NO: 10037827 - DNA, 22 bp, Homo sapiens
tcagctctgttttgagtggaac

SEQ ID NO: 10037828 - DNA, 22 bp, Homo sapiens
tcagctcttccccccagccagg

SEQ ID NO: 10037829 - DNA, 22 bp, Homo sapiens
tcagccctgaggacagaggcag

SEQ ID NO: 10037830 - DNA, 22 bp, Homo sapiens
cagtttatatgtcagagctgta

SEQ ID NO: 10037831 - DNA, 22 bp, Homo sapiens
cagtttatatgagggtatcaag

SEQ ID NO: 10037832 - DNA, 22 bp, Homo sapiens
catcacagatgttgtgtggagt

SEQ ID NO: 10037833 - DNA, 22 bp, Homo sapiens
tcagggattgcaaaattcatcc

SEQ ID NO: 10037834 - DNA, 22 bp, Homo sapiens
tacatgttatttcactattggt

SEQ ID NO: 10037835 - DNA, 22 bp, Homo sapiens
tacatgtgttctgtttcaagtt

SEQ ID NO: 10037836 - DNA, 22 bp, Homo sapiens
cagggtggcactcagcgcatct

SEQ ID NO: 10037837 - DNA, 22 bp, Homo sapiens
caggtccagaaaccaaaggatt

SEQ ID NO: 10037838 - DNA, 22 bp, Homo sapiens
caggtccacggcgcccaggggt

SEQ ID NO: 10037839 - DNA, 22 bp, Homo sapiens
tatctccatctggagagcaaaa

SEQ ID NO: 10037840 - DNA, 22 bp, Homo sapiens
tatctccagtttctgagcctca

SEQ ID NO: 10037841 - DNA, 19 bp, Homo sapiens
tatggcaggccgaggcact

SEQ ID NO: 10037842 - DNA, 20 bp, Homo sapiens
tatttacaacttagagcctc

SEQ ID NO: 10037843 - DNA, 19 bp, Homo sapiens
tctctctgtacattagata

SEQ ID NO: 10037844 - DNA, 22 bp, Homo sapiens
tctctctgtgacagctttgctg

SEQ ID NO: 10037845 - DNA, 22 bp, Homo sapiens
tctgccaccttcatcctccact

SEQ ID NO: 10037846 - DNA, 23 bp, Homo sapiens
tctgtctgtgtatgtgcagaaag

SEQ ID NO: 10037847 - DNA, 17 bp, Homo sapiens
tctgtctgtggtccact

SEQ ID NO: 10037848 - DNA, 21 bp, Homo sapiens
tctgtctggttttagagtggc

SEQ ID NO: 10037849 - DNA, 22 bp, Homo sapiens
ccaggaagctgtctgatatgaa

SEQ ID NO: 10037850 - DNA, 21 bp, Homo sapiens
ccaggaaggactgagctccct

SEQ ID NO: 10037851 - DNA, 22 bp, Homo sapiens
ccaggaaatagtgctgtgatct

SEQ ID NO: 10037852 - DNA, 22 bp, Homo sapiens
ccaggaaatggcttgcttcttt

SEQ ID NO: 10037853 - DNA, 22 bp, Homo sapiens
ccagcttctccttatgtcctca

SEQ ID NO: 10037854 - DNA, 22 bp, Homo sapiens
ccaggaaaataccaagctttaa

SEQ ID NO: 10037855 - DNA, 22 bp, Homo sapiens
ccagctggtgggtctttctctg

SEQ ID NO: 10037856 - DNA, 22 bp, Homo sapiens
ccagctgctttttgtcacatgg

SEQ ID NO: 10037857 - DNA, 22 bp, Homo sapiens
tctggcttggctggcatctctg

SEQ ID NO: 10037858 - DNA, 22 bp, Homo sapiens
tctggagcttgtttcagatggt

SEQ ID NO: 10037859 - DNA, 22 bp, Homo sapiens
tctggctgttaggcctgacctt

SEQ ID NO: 10037860 - DNA, 22 bp, Homo sapiens
ccacagctagggcaatctgatt

SEQ ID NO: 10037861 - DNA, 22 bp, Homo sapiens
ccactgccagctttgtcctccc

SEQ ID NO: 10037862 - DNA, 22 bp, Homo sapiens
ccactgccgatgttccatcttg

SEQ ID NO: 10037863 - DNA, 22 bp, Homo sapiens
ccactgcctatttgcagggccc

SEQ ID NO: 10037864 - DNA, 22 bp, Homo sapiens
ccactgagtgagcagagcaggg

SEQ ID NO: 10037865 - DNA, 17 bp, Homo sapiens
tctttcctgccatgctc

SEQ ID NO: 10037866 - DNA, 22 bp, Homo sapiens
tctttcggccatagcgatgatt

SEQ ID NO: 10037867 - DNA, 22 bp, Homo sapiens
tctttctgtaagctccatggaa

SEQ ID NO: 10037868 - DNA, 22 bp, Homo sapiens
tctttctggtctcgccttattc

SEQ ID NO: 10037869 - DNA, 22 bp, Homo sapiens
tctttctgcagcacaggggcag

SEQ ID NO: 10037870 - DNA, 22 bp, Homo sapiens
tcttgctccacatgctgagatg

SEQ ID NO: 10037871 - DNA, 22 bp, Homo sapiens
tcttgaaggggggcagtgttga

SEQ ID NO: 10037872 - DNA, 22 bp, Homo sapiens
tcttggaatctccatagagtga

SEQ ID NO: 10037873 - DNA, 22 bp, Homo sapiens
tcttggaacttattattgtaga

SEQ ID NO: 10037874 - DNA, 22 bp, Homo sapiens
tcttcttcccatccctcaaatg

SEQ ID NO: 10037875 - DNA, 22 bp, Homo sapiens
tcttctgttttagattgcatac

SEQ ID NO: 10037876 - DNA, 22 bp, Homo sapiens
tctgtctgcctgtgtccccacc

SEQ ID NO: 10037877 - DNA, 22 bp, Homo sapiens
tctgtctgccttgtgagggcac

SEQ ID NO: 10037878 - DNA, 22 bp, Homo sapiens
tctgtctgcgcttgccctggtg

SEQ ID NO: 10037879 - DNA, 22 bp, Homo sapiens
tctgtctgctcatttacctcag

SEQ ID NO: 10037880 - DNA, 22 bp, Homo sapiens
tctgtctttagaggcctgtgct

SEQ ID NO: 10037881 - DNA, 23 bp, Homo sapiens
tctgtgctcgggggagctctctg

SEQ ID NO: 10037882 - DNA, 22 bp, Homo sapiens
tctgtgctgagctctgagatgt

SEQ ID NO: 10037883 - DNA, 22 bp, Homo sapiens
tctgtgctgccatcctgtggcc

SEQ ID NO: 10037884 - DNA, 18 bp, Homo sapiens
tctgtccttccattcttc

SEQ ID NO: 10037885 - DNA, 22 bp, Homo sapiens
tctgtcctgtttcctcctgaca

SEQ ID NO: 10037886 - DNA, 22 bp, Homo sapiens
tctgtctgactaccatgaggca

SEQ ID NO: 10037887 - DNA, 22 bp, Homo sapiens
tctgtctcctgccagtgcctct

SEQ ID NO: 10037888 - DNA, 22 bp, Homo sapiens
tctgggcttggattggctctgc

SEQ ID NO: 10037889 - DNA, 22 bp, Homo sapiens
tctgagcttctgcctgctgcaa

SEQ ID NO: 10037890 - DNA, 22 bp, Homo sapiens
tctgagccacctgagcccatgg

SEQ ID NO: 10037891 - DNA, 22 bp, Homo sapiens
tctgagccacctgccagtgctg

SEQ ID NO: 10037892 - DNA, 22 bp, Homo sapiens
tctgagcccagtgagtctcgca

SEQ ID NO: 10037893 - DNA, 22 bp, Homo sapiens
tctgagccataagagtacagga

SEQ ID NO: 10037894 - DNA, 22 bp, Homo sapiens
tctgagccagacaagacagcca

SEQ ID NO: 10037895 - DNA, 22 bp, Homo sapiens
tctgagctgtggccattcttcc

SEQ ID NO: 10037896 - DNA, 22 bp, Homo sapiens
tctgagctggagcccatcacct

SEQ ID NO: 10037897 - DNA, 22 bp, Homo sapiens
tctgagctgggggcctggcatg

SEQ ID NO: 10037898 - DNA, 22 bp, Homo sapiens
tctgagcctatttcaaattcct

SEQ ID NO: 10037899 - DNA, 22 bp, Homo sapiens
tctgagctaatcctgttgccga

SEQ ID NO: 10037900 - DNA, 22 bp, Homo sapiens
tctgagctacgatgcctgtcac

SEQ ID NO: 10037901 - DNA, 22 bp, Homo sapiens
tctgagctagaaagtatgccct

SEQ ID NO: 10037902 - DNA, 22 bp, Homo sapiens
tctgagctctatctgtgggaat

SEQ ID NO: 10037903 - DNA, 22 bp, Homo sapiens
tctgagctatgtaagacttgga

SEQ ID NO: 10037904 - DNA, 22 bp, Homo sapiens
tctgagctgcagagtggggtgg

SEQ ID NO: 10037905 - DNA, 21 bp, Homo sapiens
tctgagctgagtcctctaggt

SEQ ID NO: 10037906 - DNA, 20 bp, Homo sapiens
tctgcactcctgcatgtgcc

SEQ ID NO: 10037907 - DNA, 22 bp, Homo sapiens
tctgcaggctctagatgaggtt

SEQ ID NO: 10037908 - DNA, 22 bp, Homo sapiens
tctgcaggaggctggctgcagg

SEQ ID NO: 10037909 - DNA, 22 bp, Homo sapiens
tctgcaggtgttggaagggtca

SEQ ID NO: 10037910 - DNA, 22 bp, Homo sapiens
tctgcaggcttataggatgggt

SEQ ID NO: 10037911 - DNA, 22 bp, Homo sapiens
tctgcaggctgtacaggaagca

SEQ ID NO: 10037912 - DNA, 22 bp, Homo sapiens
tctgcagggatgtgaggggtga

SEQ ID NO: 10037913 - DNA, 22 bp, Homo sapiens
tctgcaggcttggagtggcagc

SEQ ID NO: 10037914 - DNA, 22 bp, Homo sapiens
tctgctcactattacatggaca

SEQ ID NO: 10037915 - DNA, 22 bp, Homo sapiens
tctgccctggggtcagcctcca

SEQ ID NO: 10037916 - DNA, 18 bp, Homo sapiens
tctgccctgccattcact

SEQ ID NO: 10037917 - DNA, 22 bp, Homo sapiens
tctgccctcattgctgcctgga

SEQ ID NO: 10037918 - DNA, 22 bp, Homo sapiens
tctggagaagcagtgagagtca

SEQ ID NO: 10037919 - DNA, 22 bp, Homo sapiens
tctggagagtcacagtgccaga

SEQ ID NO: 10037920 - DNA, 22 bp, Homo sapiens
tctggagataagacagacagat

SEQ ID NO: 10037921 - DNA, 22 bp, Homo sapiens
tctgctgttgagcacaagtgaa

SEQ ID NO: 10037922 - DNA, 22 bp, Homo sapiens
tctgctgttctcatgctgattt

SEQ ID NO: 10037923 - DNA, 22 bp, Homo sapiens
tctgctgttgccatgagtaata

SEQ ID NO: 10037924 - DNA, 22 bp, Homo sapiens
tctgctgtgtccctggtctcct

SEQ ID NO: 10037925 - DNA, 22 bp, Homo sapiens
tctgctgtgttgaatgattggt

SEQ ID NO: 10037926 - DNA, 22 bp, Homo sapiens
tctgctgttcattcttttagct

SEQ ID NO: 10037927 - DNA, 22 bp, Homo sapiens
tctgctgtgtcccctgtgcggg

SEQ ID NO: 10037928 - DNA, 22 bp, Homo sapiens
tctgctgtgaggaggcaggatg

SEQ ID NO: 10037929 - DNA, 22 bp, Homo sapiens
tctgctgtgaaaggtgaatatt

SEQ ID NO: 10037930 - DNA, 22 bp, Homo sapiens
tctgctgtgggcagagacccct

SEQ ID NO: 10037931 - DNA, 22 bp, Homo sapiens
tctgctgtgatttgctacctgt

SEQ ID NO: 10037932 - DNA, 22 bp, Homo sapiens
tctgctgtattaggttgaactg

SEQ ID NO: 10037933 - DNA, 22 bp, Homo sapiens
tctgctgtacttttggtctgtt

SEQ ID NO: 10037934 - DNA, 22 bp, Homo sapiens
tctgctgtcactcatttgcttc

SEQ ID NO: 10037935 - DNA, 22 bp, Homo sapiens
tctgctgtcccgagggccactt

SEQ ID NO: 10037936 - DNA, 22 bp, Homo sapiens
tctgctgtcctttatatagatt

SEQ ID NO: 10037937 - DNA, 22 bp, Homo sapiens
tctgctgtctatgcaagtcctt

SEQ ID NO: 10037938 - DNA, 22 bp, Homo sapiens
tctgctgtcttttctgggtgag

SEQ ID NO: 10037939 - DNA, 22 bp, Homo sapiens
tctgctgtaaccttcagaggta

SEQ ID NO: 10037940 - DNA, 22 bp, Homo sapiens
tctgctctagttgcttcctgcc

SEQ ID NO: 10037941 - DNA, 22 bp, Homo sapiens
tctgctctgagagggccatcag

SEQ ID NO: 10037942 - DNA, 22 bp, Homo sapiens
tctgctgaatcagatagctaag

SEQ ID NO: 10037943 - DNA, 22 bp, Homo sapiens
tctggcccagcccctgaggtca

SEQ ID NO: 10037944 - DNA, 22 bp, Homo sapiens
tctggcccagcccctgatccca

SEQ ID NO: 10037945 - DNA, 22 bp, Homo sapiens
tctggcccaagttttcggtgag

SEQ ID NO: 10037946 - DNA, 22 bp, Homo sapiens
tctgggctgctatgaggcagag

SEQ ID NO: 10037947 - DNA, 21 bp, Homo sapiens
tctgggcccatgctgcctcac

SEQ ID NO: 10037948 - DNA, 22 bp, Homo sapiens
tctgggcccactcaacttcact

SEQ ID NO: 10037949 - DNA, 22 bp, Homo sapiens
tctgggccagatctagggatct

SEQ ID NO: 10037950 - DNA, 23 bp, Homo sapiens
tctgggccacttgtctgcacttc

SEQ ID NO: 10037951 - DNA, 22 bp, Homo sapiens
tctgggccaacccttccatggg

SEQ ID NO: 10037952 - DNA, 22 bp, Homo sapiens
tctgggagtgggtccaaggaat

SEQ ID NO: 10037953 - DNA, 20 bp, Homo sapiens
tctggccccttcctgtcctg

SEQ ID NO: 10037954 - DNA, 21 bp, Homo sapiens
tctggccctaggttgggcctc

SEQ ID NO: 10037955 - DNA, 22 bp, Homo sapiens
tctggcccctggtctctggtgt

SEQ ID NO: 10037956 - DNA, 22 bp, Homo sapiens
tctggcccctggcagtcctgga

SEQ ID NO: 10037957 - DNA, 22 bp, Homo sapiens
tctggcccatgatcctgctaac

SEQ ID NO: 10037958 - DNA, 22 bp, Homo sapiens
tctggcccatcttctgccacca

SEQ ID NO: 10037959 - DNA, 22 bp, Homo sapiens
tctggccccatacagagggtct

SEQ ID NO: 10037960 - DNA, 23 bp, Homo sapiens
tctggccccattctttcccatgt

SEQ ID NO: 10037961 - DNA, 22 bp, Homo sapiens
tctggccccggtcttcacagct

SEQ ID NO: 10037962 - DNA, 22 bp, Homo sapiens
tctggcccctatggcggtggag

SEQ ID NO: 10037963 - DNA, 22 bp, Homo sapiens
tctggccccgcatgcactttat

SEQ ID NO: 10037964 - DNA, 22 bp, Homo sapiens
tctggccctatggcatgtacct

SEQ ID NO: 10037965 - DNA, 21 bp, Homo sapiens
tctggccctcacagtcacacc

SEQ ID NO: 10037966 - DNA, 19 bp, Homo sapiens
tctccaggcaggtgagcga

SEQ ID NO: 10037967 - DNA, 22 bp, Homo sapiens
tctcagagatgtcaagagtcta

SEQ ID NO: 10037968 - DNA, 22 bp, Homo sapiens
tctcagagatttatggaaaact

SEQ ID NO: 10037969 - DNA, 22 bp, Homo sapiens
tctcagagatgttagggaagag

SEQ ID NO: 10037970 - DNA, 22 bp, Homo sapiens
tctcagagattcagggagaagt

SEQ ID NO: 10037971 - DNA, 18 bp, Homo sapiens
tctcagaggccatcctag

SEQ ID NO: 10037972 - DNA, 22 bp, Homo sapiens
tctcagagcttcagaaagcacc

SEQ ID NO: 10037973 - DNA, 22 bp, Homo sapiens
tctcagagtttagagctgagcc

SEQ ID NO: 10037974 - DNA, 22 bp, Homo sapiens
tctcagagtttttttccaggac

SEQ ID NO: 10037975 - DNA, 20 bp, Homo sapiens
tctcagcataagaacccttc

SEQ ID NO: 10037976 - DNA, 22 bp, Homo sapiens
tctcagagtaattctttaaggt

SEQ ID NO: 10037977 - DNA, 22 bp, Homo sapiens
tctcagagtggtggtccctctg

SEQ ID NO: 10037978 - DNA, 22 bp, Homo sapiens
tctcagaggtcttcagcctctg

SEQ ID NO: 10037979 - DNA, 22 bp, Homo sapiens
tctcagctgactgctttcctcg

SEQ ID NO: 10037980 - DNA, 22 bp, Homo sapiens
tctcagcctcacctctatggag

SEQ ID NO: 10037981 - DNA, 22 bp, Homo sapiens
tctcagctcagcttccacagag

SEQ ID NO: 10037982 - DNA, 22 bp, Homo sapiens
tctccttgctacccagtatgtc

SEQ ID NO: 10037983 - DNA, 22 bp, Homo sapiens
tctcctgcttcaactgatggac

SEQ ID NO: 10037984 - DNA, 22 bp, Homo sapiens
tctcctccagaggctgtgggga

SEQ ID NO: 10037985 - DNA, 22 bp, Homo sapiens
tctcccattacttatggcccac

SEQ ID NO: 10037986 - DNA, 19 bp, Homo sapiens
tctcccatgcctgtgtcta

SEQ ID NO: 10037987 - DNA, 18 bp, Homo sapiens
tctcttcttggcagtcaa

SEQ ID NO: 10037988 - DNA, 19 bp, Homo sapiens
tctcttctccctggtttta

SEQ ID NO: 10037989 - DNA, 22 bp, Homo sapiens
tctcttctagcttcttgtggtt

SEQ ID NO: 10037990 - DNA, 22 bp, Homo sapiens
tctcttctaattagggtccatg

SEQ ID NO: 10037991 - DNA, 22 bp, Homo sapiens
tctctgtccctaggagccttgc

SEQ ID NO: 10037992 - DNA, 22 bp, Homo sapiens
tctctgtctttgttgtcttcac

SEQ ID NO: 10037993 - DNA, 22 bp, Homo sapiens
tctcttctttggggtgggctca

SEQ ID NO: 10037994 - DNA, 22 bp, Homo sapiens
tctgaactccagccctgctctc

SEQ ID NO: 10037995 - DNA, 23 bp, Homo sapiens
tctctctggcaaatttcacatat

SEQ ID NO: 10037996 - DNA, 22 bp, Homo sapiens
tctctgagtatcctgaactgcc

SEQ ID NO: 10037997 - DNA, 18 bp, Homo sapiens
tctctctgaagagttccc

SEQ ID NO: 10037998 - DNA, 18 bp, Homo sapiens
tctctctgataacatttt

SEQ ID NO: 10037999 - DNA, 19 bp, Homo sapiens
tctctgcttctcttggcat

SEQ ID NO: 10038000 - DNA, 20 bp, Homo sapiens
tctctggcaagaagctgcag

SEQ ID NO: 10038001 - DNA, 19 bp, Homo sapiens
tctctggcatagactcaat

SEQ ID NO: 10038002 - DNA, 22 bp, Homo sapiens
tctctgggtaaagttctctcat

SEQ ID NO: 10038003 - DNA, 22 bp, Homo sapiens
tctctggggatgcttattcttg

SEQ ID NO: 10038004 - DNA, 22 bp, Homo sapiens
tctctgggcctgttttctcatc

SEQ ID NO: 10038005 - DNA, 22 bp, Homo sapiens
tctctgggcctcagttttctca

SEQ ID NO: 10038006 - DNA, 22 bp, Homo sapiens
taagaacagtagaacagtaggt

SEQ ID NO: 10038007 - DNA, 22 bp, Homo sapiens
taagaacagtgtttcatctcta

SEQ ID NO: 10038008 - DNA, 22 bp, Homo sapiens
taagaacagtgacagccaacat

SEQ ID NO: 10038009 - DNA, 22 bp, Homo sapiens
tcctgctggattgtgtctggtg

SEQ ID NO: 10038010 - DNA, 22 bp, Homo sapiens
tcctgctgggtctaactctggt

SEQ ID NO: 10038011 - DNA, 20 bp, Homo sapiens
tcctggcctccctggggctc

SEQ ID NO: 10038012 - DNA, 22 bp, Homo sapiens
tcctggctcggcttggggactt

SEQ ID NO: 10038013 - DNA, 22 bp, Homo sapiens
tcctggcctagctcaccctgga

SEQ ID NO: 10038014 - DNA, 22 bp, Homo sapiens
tcctggccatgcaagatgagga

SEQ ID NO: 10038015 - DNA, 21 bp, Homo sapiens
tcctggccagggcactaggca

SEQ ID NO: 10038016 - DNA, 22 bp, Homo sapiens
tcctgggatcaagtgatcctcc

SEQ ID NO: 10038017 - DNA, 22 bp, Homo sapiens
tcctgggagtggccatgtaatg

SEQ ID NO: 10038018 - DNA, 22 bp, Homo sapiens
tcctgggagtaaaagctgccct

SEQ ID NO: 10038019 - DNA, 22 bp, Homo sapiens
tcctgggcaaagaggggcagtg

SEQ ID NO: 10038020 - DNA, 22 bp, Homo sapiens
tcctgggcacaagtgagtctcc

SEQ ID NO: 10038021 - DNA, 22 bp, Homo sapiens
tcctgggcagaatgggatggct

SEQ ID NO: 10038022 - DNA, 22 bp, Homo sapiens
tcctgggcagcctctctggaag

SEQ ID NO: 10038023 - DNA, 22 bp, Homo sapiens
tcctgggattctgcatttctaa

SEQ ID NO: 10038024 - DNA, 22 bp, Homo sapiens
tcctgggatttgcccttttctc

SEQ ID NO: 10038025 - DNA, 22 bp, Homo sapiens
tcctgggattaaggtggtgatt

SEQ ID NO: 10038026 - DNA, 22 bp, Homo sapiens
tcctgggcgaggtactggggct

SEQ ID NO: 10038027 - DNA, 22 bp, Homo sapiens
tcctgggcctgtactccatccg

SEQ ID NO: 10038028 - DNA, 22 bp, Homo sapiens
tcctgggccctccggatcaggt

SEQ ID NO: 10038029 - DNA, 22 bp, Homo sapiens
tcctgggcccaggctgccaggg

SEQ ID NO: 10038030 - DNA, 22 bp, Homo sapiens
tcctgggccaagggctgtgagg

SEQ ID NO: 10038031 - DNA, 22 bp, Homo sapiens
tcctgggcagcgggacgctcag

SEQ ID NO: 10038032 - DNA, 19 bp, Homo sapiens
tcctgggctgcgtcttgcc

SEQ ID NO: 10038033 - DNA, 22 bp, Homo sapiens
tcctgggcggttatgtgatctg

SEQ ID NO: 10038034 - DNA, 22 bp, Homo sapiens
tcctgggcgattttctgaatat

SEQ ID NO: 10038035 - DNA, 19 bp, Homo sapiens
tcctgggcgttgactttgg

SEQ ID NO: 10038036 - DNA, 19 bp, Homo sapiens
tcctgggctgggccaggtc

SEQ ID NO: 10038037 - DNA, 22 bp, Homo sapiens
tcctgggaagagacctgagcat

SEQ ID NO: 10038038 - DNA, 21 bp, Homo sapiens
tcctgggaagcactggggtgg

SEQ ID NO: 10038039 - DNA, 22 bp, Homo sapiens
tcctgggaagcgccggcctgcg

SEQ ID NO: 10038040 - DNA, 22 bp, Homo sapiens
tcctgggaagtggctggctgag

SEQ ID NO: 10038041 - DNA, 22 bp, Homo sapiens
tcctgggaccctgggtgcagag

SEQ ID NO: 10038042 - DNA, 22 bp, Homo sapiens
tcctgggactcaacttagaagg

SEQ ID NO: 10038043 - DNA, 22 bp, Homo sapiens
tcctgggaggctgtgcctggct

SEQ ID NO: 10038044 - DNA, 22 bp, Homo sapiens
tcctgggaggcaggaccccttt

SEQ ID NO: 10038045 - DNA, 22 bp, Homo sapiens
tcctgggaagactgtgaggaca

SEQ ID NO: 10038046 - DNA, 18 bp, Homo sapiens
tcctgggaacttgctagc

SEQ ID NO: 10038047 - DNA, 18 bp, Homo sapiens
tcctgggaaaggcataca

SEQ ID NO: 10038048 - DNA, 22 bp, Homo sapiens
tcctgggaactcggaaagctct

SEQ ID NO: 10038049 - DNA, 22 bp, Homo sapiens
tccttctttgacaagtggcaga

SEQ ID NO: 10038050 - DNA, 22 bp, Homo sapiens
tccttctttccccctagtcatt

SEQ ID NO: 10038051 - DNA, 22 bp, Homo sapiens
tccttggaggtgttcatctgcc

SEQ ID NO: 10038052 - DNA, 21 bp, Homo sapiens
tccttgctattttcctcagct

SEQ ID NO: 10038053 - DNA, 21 bp, Homo sapiens
tccttccttgaggtcctttcc

SEQ ID NO: 10038054 - DNA, 22 bp, Homo sapiens
tccttcctggggtctctgctgc

SEQ ID NO: 10038055 - DNA, 22 bp, Homo sapiens
tccttctcctccttgagtgaca

SEQ ID NO: 10038056 - DNA, 17 bp, Homo sapiens
tccttcagggcctcaca

SEQ ID NO: 10038057 - DNA, 22 bp, Homo sapiens
tccttcaaagctcctagtgagc

SEQ ID NO: 10038058 - DNA, 22 bp, Homo sapiens
tccttcaaaagttgagagagcc

SEQ ID NO: 10038059 - DNA, 22 bp, Homo sapiens
tcgcccaggctggaagtgcagt

SEQ ID NO: 10038060 - DNA, 22 bp, Homo sapiens
tcgaactcatagtcgtagctgt

SEQ ID NO: 10038061 - DNA, 22 bp, Homo sapiens
tcgaggcagtgcgctggctgtt

SEQ ID NO: 10038062 - DNA, 22 bp, Homo sapiens
tctattactcttttaaggaaaa

SEQ ID NO: 10038063 - DNA, 22 bp, Homo sapiens
tctatgcttgagacagatgggg

SEQ ID NO: 10038064 - DNA, 22 bp, Homo sapiens
tctagagaaaaaactcaagtga

SEQ ID NO: 10038065 - DNA, 22 bp, Homo sapiens
tctagagactataatgtgtcct

SEQ ID NO: 10038066 - DNA, 22 bp, Homo sapiens
tctagagatacattggtcattt

SEQ ID NO: 10038067 - DNA, 22 bp, Homo sapiens
tgagacaacattgggcaagtcc

SEQ ID NO: 10038068 - DNA, 22 bp, Homo sapiens
tgagaacatacaaacagagaaa

SEQ ID NO: 10038069 - DNA, 22 bp, Homo sapiens
tgagaagatttgctcttctgag

SEQ ID NO: 10038070 - DNA, 22 bp, Homo sapiens
tgagaaaatccagaggctagtt

SEQ ID NO: 10038071 - DNA, 22 bp, Homo sapiens
tgagccagagaggttgaggcta

SEQ ID NO: 10038072 - DNA, 22 bp, Homo sapiens
tgagcagtggctcctgctggac

SEQ ID NO: 10038073 - DNA, 22 bp, Homo sapiens
tgagccaggagtttgaggctgt

SEQ ID NO: 10038074 - DNA, 22 bp, Homo sapiens
tgagccaggcccagtggggtca

SEQ ID NO: 10038075 - DNA, 20 bp, Homo sapiens
tgagccaggctaggaagggc

SEQ ID NO: 10038076 - DNA, 22 bp, Homo sapiens
tgagccagtctgtctgggtgaa

SEQ ID NO: 10038077 - DNA, 21 bp, Homo sapiens
tgagcccttgcctcagagccc

SEQ ID NO: 10038078 - DNA, 22 bp, Homo sapiens
tgagccctgacctagcctggcc

SEQ ID NO: 10038079 - DNA, 22 bp, Homo sapiens
tgagccctacctgctcatctcc

SEQ ID NO: 10038080 - DNA, 22 bp, Homo sapiens
tgagctgtaaggctgtcactga

SEQ ID NO: 10038081 - DNA, 22 bp, Homo sapiens
tgagctgtgtgacattgagcca

SEQ ID NO: 10038082 - DNA, 22 bp, Homo sapiens
tgagggagagggcgaaaatgaa

SEQ ID NO: 10038083 - DNA, 22 bp, Homo sapiens
tgaggggagacagagtggactc

SEQ ID NO: 10038084 - DNA, 22 bp, Homo sapiens
tgaggggaaggcatgataaata

SEQ ID NO: 10038085 - DNA, 22 bp, Homo sapiens
tgaggggagaagcagcagcctg

SEQ ID NO: 10038086 - DNA, 22 bp, Homo sapiens
tgaggggaggttggggcacatc

SEQ ID NO: 10038087 - DNA, 22 bp, Homo sapiens
tgaggggatacggtacacattg

SEQ ID NO: 10038088 - DNA, 22 bp, Homo sapiens
tgaggggagctagcatgccttg

SEQ ID NO: 10038089 - DNA, 22 bp, Homo sapiens
tgaggggagcccgccctggacg

SEQ ID NO: 10038090 - DNA, 19 bp, Homo sapiens
tgaggggaggagaggcctg

SEQ ID NO: 10038091 - DNA, 22 bp, Homo sapiens
tgaggctctgcttctgtggctc

SEQ ID NO: 10038092 - DNA, 22 bp, Homo sapiens
tgaggcctggagggaggagttt

SEQ ID NO: 10038093 - DNA, 22 bp, Homo sapiens
tgaggctcagagaagtgctgtt

SEQ ID NO: 10038094 - DNA, 22 bp, Homo sapiens
tgagggtgcatttagcatgtag

SEQ ID NO: 10038095 - DNA, 22 bp, Homo sapiens
tgaggaggcccaggttggggct

SEQ ID NO: 10038096 - DNA, 22 bp, Homo sapiens
tgaggaactcaccaggcagaga

SEQ ID NO: 10038097 - DNA, 22 bp, Homo sapiens
tgaggaacaactcctgtgacta

SEQ ID NO: 10038098 - DNA, 22 bp, Homo sapiens
tgaggcagctttttctgtgtgt

SEQ ID NO: 10038099 - DNA, 22 bp, Homo sapiens
tgaggcaggaagttatataatg

SEQ ID NO: 10038100 - DNA, 22 bp, Homo sapiens
tgaggcactgggagagcacact

SEQ ID NO: 10038101 - DNA, 22 bp, Homo sapiens
tgaggcagaaaatagcagttca

SEQ ID NO: 10038102 - DNA, 22 bp, Homo sapiens
tgaggcagctttttctgtgtgt

SEQ ID NO: 10038103 - DNA, 22 bp, Homo sapiens
tgaggcaggacatggacaactg

SEQ ID NO: 10038104 - DNA, 22 bp, Homo sapiens
tgaggcaggaatggggaaaagt

SEQ ID NO: 10038105 - DNA, 22 bp, Homo sapiens
tgaggcaggactgagcgggatg

SEQ ID NO: 10038106 - DNA, 22 bp, Homo sapiens
tgaggcaggacttgcataaagt

SEQ ID NO: 10038107 - DNA, 22 bp, Homo sapiens
tgaggcaggagaatcacatgaa

SEQ ID NO: 10038108 - DNA, 22 bp, Homo sapiens
tgaggcaggagaatcacatgaa

SEQ ID NO: 10038109 - DNA, 22 bp, Homo sapiens
tgaggcaggagaatcaccggaa

SEQ ID NO: 10038110 - DNA, 20 bp, Homo sapiens
tgaggcaggagaatggcatg

SEQ ID NO: 10038111 - DNA, 22 bp, Homo sapiens
tgaggcctcatttagggagagg

SEQ ID NO: 10038112 - DNA, 22 bp, Homo sapiens
tgaggcaggaggattgcaggat

SEQ ID NO: 10038113 - DNA, 20 bp, Homo sapiens
tgaggcaggagaatggcatg

SEQ ID NO: 10038114 - DNA, 22 bp, Homo sapiens
tgaggcaggagaatggcgggaa

SEQ ID NO: 10038115 - DNA, 22 bp, Homo sapiens
tgaggcaggaggttgagaactg

SEQ ID NO: 10038116 - DNA, 22 bp, Homo sapiens
tgaggcaggaggttgagaactg

SEQ ID NO: 10038117 - DNA, 22 bp, Homo sapiens
tgaggcaggagttaatgtgctc

SEQ ID NO: 10038118 - DNA, 22 bp, Homo sapiens
tgaggcaggagttaatgtgctc

SEQ ID NO: 10038119 - DNA, 22 bp, Homo sapiens
tgaggcaggagttcaggctgcg

SEQ ID NO: 10038120 - DNA, 22 bp, Homo sapiens
tgaggcaggatgcttgcacagg

SEQ ID NO: 10038121 - DNA, 23 bp, Homo sapiens
tgaggcaggcggatcacgaggtc

SEQ ID NO: 10038122 - DNA, 22 bp, Homo sapiens
tgaggcagttgagcttcctgag

SEQ ID NO: 10038123 - DNA, 21 bp, Homo sapiens
tgaggcaggggtgcttttgtc

SEQ ID NO: 10038124 - DNA, 22 bp, Homo sapiens
tgaggcagttcttacttgtatt

SEQ ID NO: 10038125 - DNA, 22 bp, Homo sapiens
tgaggcagggagagtggatatg

SEQ ID NO: 10038126 - DNA, 22 bp, Homo sapiens
tgaggcagggagtttaattgtc

SEQ ID NO: 10038127 - DNA, 22 bp, Homo sapiens
tgaggcagggagagtggatatg

SEQ ID NO: 10038128 - DNA, 22 bp, Homo sapiens
tgacagggtgtttgtgagacta

SEQ ID NO: 10038129 - DNA, 22 bp, Homo sapiens
tgacagggtcagagctgagctg

SEQ ID NO: 10038130 - DNA, 22 bp, Homo sapiens
tgacacagggcatgcagcagaa

SEQ ID NO: 10038131 - DNA, 22 bp, Homo sapiens
tgacatttcggtgtatgtgatg

SEQ ID NO: 10038132 - DNA, 22 bp, Homo sapiens
tgacctattagatttccttgcc

SEQ ID NO: 10038133 - DNA, 22 bp, Homo sapiens
tgaccctggcagcccactggcc

SEQ ID NO: 10038134 - DNA, 22 bp, Homo sapiens
tgactcctggtatggatgacag

SEQ ID NO: 10038135 - DNA, 22 bp, Homo sapiens
tgactgtgccgtgcccctagga

SEQ ID NO: 10038136 - DNA, 22 bp, Homo sapiens
tgactgtgcaagcagagagcat

SEQ ID NO: 10038137 - DNA, 22 bp, Homo sapiens
tgaagcctgaaagctggacagg

SEQ ID NO: 10038138 - DNA, 22 bp, Homo sapiens
tgaaggtaatggaatctcctga

SEQ ID NO: 10038139 - DNA, 22 bp, Homo sapiens
tgaaggcttggtggcagcctct

SEQ ID NO: 10038140 - DNA, 22 bp, Homo sapiens
tgacaaaactgcaattactttt

SEQ ID NO: 10038141 - DNA, 22 bp, Homo sapiens
tgacaaaccctgcaaatagctc

SEQ ID NO: 10038142 - DNA, 21 bp, Homo sapiens
tgaatgcttcgtcatcctggc

SEQ ID NO: 10038143 - DNA, 22 bp, Homo sapiens
tgaatgcttggagtcataaaat

SEQ ID NO: 10038144 - DNA, 22 bp, Homo sapiens
tgaatctgatttccctggaggc

SEQ ID NO: 10038145 - DNA, 22 bp, Homo sapiens
tgaactccaaatactgctgatt

SEQ ID NO: 10038146 - DNA, 22 bp, Homo sapiens
tgaactcgggaggaggctgcag

SEQ ID NO: 10038147 - DNA, 22 bp, Homo sapiens
tgaactctctcaagtgacagaa

SEQ ID NO: 10038148 - DNA, 22 bp, Homo sapiens
tgaacctgtttccaggctcatt

SEQ ID NO: 10038149 - DNA, 22 bp, Homo sapiens
tgcctctgtgtgcaggtgagca

SEQ ID NO: 10038150 - DNA, 22 bp, Homo sapiens
tgcctctgtgggccttcctggc

SEQ ID NO: 10038151 - DNA, 22 bp, Homo sapiens
tgcctctgctgctgtggcatca

SEQ ID NO: 10038152 - DNA, 23 bp, Homo sapiens
tgcctctgcctccctagtctgca

SEQ ID NO: 10038153 - DNA, 22 bp, Homo sapiens
tgcctggcatctagccctggga

SEQ ID NO: 10038154 - DNA, 22 bp, Homo sapiens
tgcctggcaactgtggtgggct

SEQ ID NO: 10038155 - DNA, 22 bp, Homo sapiens
tgcctgccaatgatgcttgtgt

SEQ ID NO: 10038156 - DNA, 22 bp, Homo sapiens
tgcctgcttgtgtacctggtga

SEQ ID NO: 10038157 - DNA, 22 bp, Homo sapiens
tgcctgctgctaagctctttgt

SEQ ID NO: 10038158 - DNA, 22 bp, Homo sapiens
tgcctgctttctgggctgccat

SEQ ID NO: 10038159 - DNA, 22 bp, Homo sapiens
tgcccctgatgcctagaacaga

SEQ ID NO: 10038160 - DNA, 22 bp, Homo sapiens
tgcccctgacctcaggcgaagg

SEQ ID NO: 10038161 - DNA, 19 bp, Homo sapiens
tgcccctgcagtctaccca

SEQ ID NO: 10038162 - DNA, 22 bp, Homo sapiens
tgccctggaaatgagaggtgtg

SEQ ID NO: 10038163 - DNA, 22 bp, Homo sapiens
tgccctggaaccatctacagtc

SEQ ID NO: 10038164 - DNA, 22 bp, Homo sapiens
tgccctggagtcagtggctatt

SEQ ID NO: 10038165 - DNA, 22 bp, Homo sapiens
tgccctggaggggcttacagtc

SEQ ID NO: 10038166 - DNA, 22 bp, Homo sapiens
tgccctggatgctgcaggtgtg

SEQ ID NO: 10038167 - DNA, 22 bp, Homo sapiens
tgccctggcattgggttggata

SEQ ID NO: 10038168 - DNA, 22 bp, Homo sapiens
tgccctggcacacacacagctg

SEQ ID NO: 10038169 - DNA, 22 bp, Homo sapiens
tgccctggcgctgtctctatgg

SEQ ID NO: 10038170 - DNA, 22 bp, Homo sapiens
tgccctggctcctcccacgctg

SEQ ID NO: 10038171 - DNA, 22 bp, Homo sapiens
tgccctggctctccactagttt

SEQ ID NO: 10038172 - DNA, 22 bp, Homo sapiens
tgccgcagtgcggggagggccc

SEQ ID NO: 10038173 - DNA, 22 bp, Homo sapiens
tgccctgtctaagctgtcagta

SEQ ID NO: 10038174 - DNA, 22 bp, Homo sapiens
tgccctgggaggctttcctgtt

SEQ ID NO: 10038175 - DNA, 22 bp, Homo sapiens
tgccctgggaacacagatgcca

SEQ ID NO: 10038176 - DNA, 22 bp, Homo sapiens
tgccctggctcttcttgttcca

SEQ ID NO: 10038177 - DNA, 22 bp, Homo sapiens
tgccctggctggagtgcagtgg

SEQ ID NO: 10038178 - DNA, 22 bp, Homo sapiens
tgccctggcttcagctttggct

SEQ ID NO: 10038179 - DNA, 22 bp, Homo sapiens
tgcctactagtactattttgtg

SEQ ID NO: 10038180 - DNA, 22 bp, Homo sapiens
tgcccaggctggaatgcagtgg

SEQ ID NO: 10038181 - DNA, 19 bp, Homo sapiens
tgcccaggccaggttgggc

SEQ ID NO: 10038182 - DNA, 19 bp, Homo sapiens
tgcccaggccaggttgggc

SEQ ID NO: 10038183 - DNA, 22 bp, Homo sapiens
tgcccaggattgtgaggtcagg

SEQ ID NO: 10038184 - DNA, 22 bp, Homo sapiens
tgcccagggataagcctagaga

SEQ ID NO: 10038185 - DNA, 22 bp, Homo sapiens
tgcccagggataagcctagaga

SEQ ID NO: 10038186 - DNA, 22 bp, Homo sapiens
tgcccatgcatgacagatggct

SEQ ID NO: 10038187 - DNA, 22 bp, Homo sapiens
tgcccagggtttctaagagcag

SEQ ID NO: 10038188 - DNA, 19 bp, Homo sapiens
tgccatttgactgaatgta

SEQ ID NO: 10038189 - DNA, 22 bp, Homo sapiens
tgccatttctttcaatattctt

SEQ ID NO: 10038190 - DNA, 18 bp, Homo sapiens
tgccatccccagtcaagt

SEQ ID NO: 10038191 - DNA, 21 bp, Homo sapiens
tgccatctctgtgggaccagg

SEQ ID NO: 10038192 - DNA, 22 bp, Homo sapiens
tgccatccttgaggaagggcaa

SEQ ID NO: 10038193 - DNA, 22 bp, Homo sapiens
tgccatcttccttcctctgcac

SEQ ID NO: 10038194 - DNA, 22 bp, Homo sapiens
tgccatcttcaataacactgag

SEQ ID NO: 10038195 - DNA, 22 bp, Homo sapiens
tgccatctcttcctcgtgctgc

SEQ ID NO: 10038196 - DNA, 22 bp, Homo sapiens
tgccatctgcacccacctgccc

SEQ ID NO: 10038197 - DNA, 23 bp, Homo sapiens
tgccagggtttgtttgtggttca

SEQ ID NO: 10038198 - DNA, 22 bp, Homo sapiens
tgccatccaacagttccatctt

SEQ ID NO: 10038199 - DNA, 22 bp, Homo sapiens
tgccatcactgaacttctgaaa

SEQ ID NO: 10038200 - DNA, 22 bp, Homo sapiens
tgccagggtcctgagggccttg

SEQ ID NO: 10038201 - DNA, 22 bp, Homo sapiens
tgccagggtcagctgcagctct

SEQ ID NO: 10038202 - DNA, 22 bp, Homo sapiens
tgccagctactctgtaggctga

SEQ ID NO: 10038203 - DNA, 19 bp, Homo sapiens
tgccagctcacaggagctc

SEQ ID NO: 10038204 - DNA, 22 bp, Homo sapiens
tgcattcctttgtctgttaaag

SEQ ID NO: 10038205 - DNA, 22 bp, Homo sapiens
tgccacagggtcctcaggccag

SEQ ID NO: 10038206 - DNA, 22 bp, Homo sapiens
tgcatgttaagaaaatattgag

SEQ ID NO: 10038207 - DNA, 22 bp, Homo sapiens
tgcatcctagggaaggcactga

SEQ ID NO: 10038208 - DNA, 22 bp, Homo sapiens
tgcatcctcctttgtcctcttg

SEQ ID NO: 10038209 - DNA, 22 bp, Homo sapiens
tgatattttatgagctttcata

SEQ ID NO: 10038210 - DNA, 22 bp, Homo sapiens
tgatcccaatctttcctgctcc

SEQ ID NO: 10038211 - DNA, 18 bp, Homo sapiens
tgagttcattagacttcc

SEQ ID NO: 10038212 - DNA, 23 bp, Homo sapiens
tgattacaagggccaaagaaagg

SEQ ID NO: 10038213 - DNA, 22 bp, Homo sapiens
tgatttaaaagaaacattgtct

SEQ ID NO: 10038214 - DNA, 22 bp, Homo sapiens
tgcagagattgaacaagaagga

SEQ ID NO: 10038215 - DNA, 22 bp, Homo sapiens
tgcaggaaattccagggtggcc

SEQ ID NO: 10038216 - DNA, 22 bp, Homo sapiens
tgcaggaactgggagggatagt

SEQ ID NO: 10038217 - DNA, 22 bp, Homo sapiens
tgcagcagcagggaggaggctc

SEQ ID NO: 10038218 - DNA, 22 bp, Homo sapiens
tgcagcagggacctctatgtga

SEQ ID NO: 10038219 - DNA, 22 bp, Homo sapiens
tgcagcaggcacaggacggaag

SEQ ID NO: 10038220 - DNA, 22 bp, Homo sapiens
tgcagcaggagccaggcctggt

SEQ ID NO: 10038221 - DNA, 22 bp, Homo sapiens
tgcagcagagtgggcctgggtg

SEQ ID NO: 10038222 - DNA, 21 bp, Homo sapiens
tgcagcagatttgggggaaga

SEQ ID NO: 10038223 - DNA, 21 bp, Homo sapiens
tgcagcagagtaagcagggga

SEQ ID NO: 10038224 - DNA, 22 bp, Homo sapiens
tgcagcagacataatgtggatt

SEQ ID NO: 10038225 - DNA, 22 bp, Homo sapiens
tgcagcagaatatggctgcagg

SEQ ID NO: 10038226 - DNA, 22 bp, Homo sapiens
tgcagcagactgagtatgagaa

SEQ ID NO: 10038227 - DNA, 22 bp, Homo sapiens
tgcagctagcgtgcctagtgaa

SEQ ID NO: 10038228 - DNA, 22 bp, Homo sapiens
tgtgtggattcatctcaaagag

SEQ ID NO: 10038229 - DNA, 22 bp, Homo sapiens
tgtggctctgccccctggtaag

SEQ ID NO: 10038230 - DNA, 22 bp, Homo sapiens
tgtggctcggccagctgctgaa

SEQ ID NO: 10038231 - DNA, 22 bp, Homo sapiens
tgtgggagaaggaagcaagctg

SEQ ID NO: 10038232 - DNA, 22 bp, Homo sapiens
tgtgggacagggacagtgatat

SEQ ID NO: 10038233 - DNA, 22 bp, Homo sapiens
tgtgggaggaacacagccagaa

SEQ ID NO: 10038234 - DNA, 22 bp, Homo sapiens
tgtgggatggttttgccagaat

SEQ ID NO: 10038235 - DNA, 22 bp, Homo sapiens
tgtgggaggtctggaaggctcc

SEQ ID NO: 10038236 - DNA, 22 bp, Homo sapiens
tgtgtacatatctatcctagat

SEQ ID NO: 10038237 - DNA, 22 bp, Homo sapiens
ttaaacacctgtctagtgtagc

SEQ ID NO: 10038238 - DNA, 22 bp, Homo sapiens
ttaaaatttccccaccatgtat

SEQ ID NO: 10038239 - DNA, 22 bp, Homo sapiens
ttaaaaatatgtagggcccgat

SEQ ID NO: 10038240 - DNA, 18 bp, Homo sapiens
tgtttatttttctcttac

SEQ ID NO: 10038241 - DNA, 22 bp, Homo sapiens
tgttcttgagcctttagaccta

SEQ ID NO: 10038242 - DNA, 22 bp, Homo sapiens
tgtttattgagtgcctactata

SEQ ID NO: 10038243 - DNA, 18 bp, Homo sapiens
tgtttattctcctgacag

SEQ ID NO: 10038244 - DNA, 22 bp, Homo sapiens
tgtttattttcaggatggattg

SEQ ID NO: 10038245 - DNA, 22 bp, Homo sapiens
tgtttattgcagtgctgggctg

SEQ ID NO: 10038246 - DNA, 22 bp, Homo sapiens
tgtttattgctgcaattgtgcc

SEQ ID NO: 10038247 - DNA, 22 bp, Homo sapiens
tgtttatagggtctgtcacttg

SEQ ID NO: 10038248 - DNA, 22 bp, Homo sapiens
tgtttattacagttcttggaat

SEQ ID NO: 10038249 - DNA, 22 bp, Homo sapiens
tgtttattcatggctaatgaaa

SEQ ID NO: 10038250 - DNA, 21 bp, Homo sapiens
tgtctttggcctcattcccag

SEQ ID NO: 10038251 - DNA, 22 bp, Homo sapiens
tgtctgtgtccaaatttcctct

SEQ ID NO: 10038252 - DNA, 22 bp, Homo sapiens
tgtctgtgggcaacgcctccca

SEQ ID NO: 10038253 - DNA, 22 bp, Homo sapiens
tgtctgtgcccaaggctcccgg

SEQ ID NO: 10038254 - DNA, 20 bp, Homo sapiens
tgtctgtgccacggcactcc

SEQ ID NO: 10038255 - DNA, 18 bp, Homo sapiens
tgtctgcttctccaactc

SEQ ID NO: 10038256 - DNA, 19 bp, Homo sapiens
tgtctgctgatgactctat

SEQ ID NO: 10038257 - DNA, 22 bp, Homo sapiens
tgtctgtgacagacctttgcta

SEQ ID NO: 10038258 - DNA, 22 bp, Homo sapiens
tgtctctagggcaatgtgaact

SEQ ID NO: 10038259 - DNA, 23 bp, Homo sapiens
tgtctccatctcattacttgggg

SEQ ID NO: 10038260 - DNA, 22 bp, Homo sapiens
tgtctgcctgtctctgtgcaaa

SEQ ID NO: 10038261 - DNA, 22 bp, Homo sapiens
tgtctgcccattcatgggcaca

SEQ ID NO: 10038262 - DNA, 22 bp, Homo sapiens
tgtctgctcggggttcccacct

SEQ ID NO: 10038263 - DNA, 20 bp, Homo sapiens
tgtctgctgagctgctgccc

SEQ ID NO: 10038264 - DNA, 21 bp, Homo sapiens
tgtctgctaagctcagcttcc

SEQ ID NO: 10038265 - DNA, 22 bp, Homo sapiens
tgtctctgaagccccctccttt

SEQ ID NO: 10038266 - DNA, 22 bp, Homo sapiens
tgtgatttattgaaaagagctt

SEQ ID NO: 10038267 - DNA, 22 bp, Homo sapiens
tgtgactctggcacatggtgag

SEQ ID NO: 10038268 - DNA, 22 bp, Homo sapiens
tgtgactgcatttggagctggg

SEQ ID NO: 10038269 - DNA, 22 bp, Homo sapiens
tgtgagagaagtgtgtgctccc

SEQ ID NO: 10038270 - DNA, 22 bp, Homo sapiens
tgtgacagtgccagcttcatag

SEQ ID NO: 10038271 - DNA, 22 bp, Homo sapiens
tgtgcacaggaagctattctct

SEQ ID NO: 10038272 - DNA, 22 bp, Homo sapiens
tgtgcacaggaagctattctct

SEQ ID NO: 10038273 - DNA, 22 bp, Homo sapiens
tgtgcacatatactcatattcc

SEQ ID NO: 10038274 - DNA, 22 bp, Homo sapiens
tgtgcagtgtgaccagggctgc

SEQ ID NO: 10038275 - DNA, 22 bp, Homo sapiens
tgtgcaggtgcaggaagggggc

SEQ ID NO: 10038276 - DNA, 22 bp, Homo sapiens
tgtgcagctatctctctacagt

SEQ ID NO: 10038277 - DNA, 20 bp, Homo sapiens
tgtgcaggagagtgaggctg

SEQ ID NO: 10038278 - DNA, 22 bp, Homo sapiens
tgtgcccttttgacagtgagag

SEQ ID NO: 10038279 - DNA, 22 bp, Homo sapiens
tgtgccctcagaagagtacatc

SEQ ID NO: 10038280 - DNA, 22 bp, Homo sapiens
tgtgccctctctgagccataaa

SEQ ID NO: 10038281 - DNA, 22 bp, Homo sapiens
ttcattacattcaaaaggcatt

SEQ ID NO: 10038282 - DNA, 22 bp, Homo sapiens
ttccagagttgggggagtggtt

SEQ ID NO: 10038283 - DNA, 22 bp, Homo sapiens
ttccagctaactcacatccctt

SEQ ID NO: 10038284 - DNA, 22 bp, Homo sapiens
ttccaggaaaacagttggaagt

SEQ ID NO: 10038285 - DNA, 22 bp, Homo sapiens
ttcaggaaggtcctatagcaga

SEQ ID NO: 10038286 - DNA, 22 bp, Homo sapiens
ttacatttcccccttggaggct

SEQ ID NO: 10038287 - DNA, 22 bp, Homo sapiens
ttacaagatgggaaagggaagt

SEQ ID NO: 10038288 - DNA, 22 bp, Homo sapiens
ttacaagatctttgaaggcaag

SEQ ID NO: 10038289 - DNA, 22 bp, Homo sapiens
ttacaagatatgtgagaactag

SEQ ID NO: 10038290 - DNA, 22 bp, Homo sapiens
ttacaagataacggagaaagca

SEQ ID NO: 10038291 - DNA, 22 bp, Homo sapiens
ttaatacagaagcaagacactg

SEQ ID NO: 10038292 - DNA, 22 bp, Homo sapiens
ttattctggaggaagcaaatgg

SEQ ID NO: 10038293 - DNA, 22 bp, Homo sapiens
ttattattggtgagttaaggaa

SEQ ID NO: 10038294 - DNA, 22 bp, Homo sapiens
ttattccaggcacagaaggagg

SEQ ID NO: 10038295 - DNA, 22 bp, Homo sapiens
ttatgacatatgagtacaagta

SEQ ID NO: 10038296 - DNA, 22 bp, Homo sapiens
ttatgacaggaaaatcacagaa

SEQ ID NO: 10038297 - DNA, 22 bp, Homo sapiens
ttagcagctaagtcatgctgca

SEQ ID NO: 10038298 - DNA, 22 bp, Homo sapiens
ttagcagcttttaaatggttct

SEQ ID NO: 10038299 - DNA, 22 bp, Homo sapiens
ttagcaaacaaatgaaatggtt

SEQ ID NO: 10038300 - DNA, 22 bp, Homo sapiens
ttagtacagaatcaaaagcaat

SEQ ID NO: 10038301 - DNA, 22 bp, Homo sapiens
ttacattttgcacagatgtccc

SEQ ID NO: 10038302 - DNA, 22 bp, Homo sapiens
ttagatcaatactaaagaagtt

SEQ ID NO: 10038303 - DNA, 22 bp, Homo sapiens
tgggatggcatcctgggccttg

SEQ ID NO: 10038304 - DNA, 22 bp, Homo sapiens
tgggcacagagtcccatctgcc

SEQ ID NO: 10038305 - DNA, 20 bp, Homo sapiens
tgggcacagctttggagggc

SEQ ID NO: 10038306 - DNA, 22 bp, Homo sapiens
tgggcacatagttttatggtca

SEQ ID NO: 10038307 - DNA, 22 bp, Homo sapiens
tgggcacagtgagttgccttta

SEQ ID NO: 10038308 - DNA, 23 bp, Homo sapiens
tgggatggattcaccagtgtgct

SEQ ID NO: 10038309 - DNA, 18 bp, Homo sapiens
tgggagtgggagtggata

SEQ ID NO: 10038310 - DNA, 22 bp, Homo sapiens
tgggagtgaggcagagtctatc

SEQ ID NO: 10038311 - DNA, 22 bp, Homo sapiens
tgggaggtctcttgcggcctag

SEQ ID NO: 10038312 - DNA, 22 bp, Homo sapiens
tgggcagggagctggaaccaca

SEQ ID NO: 10038313 - DNA, 22 bp, Homo sapiens
tgggcatcatggacagcagagg

SEQ ID NO: 10038314 - DNA, 22 bp, Homo sapiens
tgggcagtgtgtaatgcataga

SEQ ID NO: 10038315 - DNA, 22 bp, Homo sapiens
tgggcagttttctatgctgcaa

SEQ ID NO: 10038316 - DNA, 22 bp, Homo sapiens
tgggcagttgctcctcagaccc

SEQ ID NO: 10038317 - DNA, 23 bp, Homo sapiens
tgggcatctcctctgtgccaggc

SEQ ID NO: 10038318 - DNA, 22 bp, Homo sapiens
tgggcagtcatcagcacaccgg

SEQ ID NO: 10038319 - DNA, 22 bp, Homo sapiens
tgggcagtggctgggcctctct

SEQ ID NO: 10038320 - DNA, 22 bp, Homo sapiens
tgggcagtggcgcaatctctgg

SEQ ID NO: 10038321 - DNA, 19 bp, Homo sapiens
tgggcagtgccagggctta

SEQ ID NO: 10038322 - DNA, 22 bp, Homo sapiens
tgggcagtgagaaaggtcaggt

SEQ ID NO: 10038323 - DNA, 22 bp, Homo sapiens
tgggcagggtctctgttatcag

SEQ ID NO: 10038324 - DNA, 21 bp, Homo sapiens
tgggctctttaacccaggcac

SEQ ID NO: 10038325 - DNA, 22 bp, Homo sapiens
tgggctctcgtccctgcagaag

SEQ ID NO: 10038326 - DNA, 22 bp, Homo sapiens
tgggctctgcatcagtgcccat

SEQ ID NO: 10038327 - DNA, 22 bp, Homo sapiens
tgggcctgttgcctgagtccat

SEQ ID NO: 10038328 - DNA, 22 bp, Homo sapiens
tgggccaggtctgtgtcagctg

SEQ ID NO: 10038329 - DNA, 22 bp, Homo sapiens
tgggccaggtgcagtgctttag

SEQ ID NO: 10038330 - DNA, 22 bp, Homo sapiens
tgggccaggcatgtgatcagca

SEQ ID NO: 10038331 - DNA, 22 bp, Homo sapiens
tgggccaggggcctcttctgat

SEQ ID NO: 10038332 - DNA, 22 bp, Homo sapiens
tgggcctccgcatggcccagcg

SEQ ID NO: 10038333 - DNA, 21 bp, Homo sapiens
tgggcctcaggcagctgtgac

SEQ ID NO: 10038334 - DNA, 19 bp, Homo sapiens
tgggcctcacaatgctccc

SEQ ID NO: 10038335 - DNA, 22 bp, Homo sapiens
tgggccagttctttactcgtcc

SEQ ID NO: 10038336 - DNA, 23 bp, Homo sapiens
tgggccagttctgttgaaagcca

SEQ ID NO: 10038337 - DNA, 20 bp, Homo sapiens
tgggcctctggtgcctctgg

SEQ ID NO: 10038338 - DNA, 22 bp, Homo sapiens
tgggcctctgtttcctcatctg

SEQ ID NO: 10038339 - DNA, 20 bp, Homo sapiens
tgggcctgagcctgtgggct

SEQ ID NO: 10038340 - DNA, 23 bp, Homo sapiens
tgggcctggaaagccttagagag

SEQ ID NO: 10038341 - DNA, 17 bp, Homo sapiens
tggggatggttcatgag

SEQ ID NO: 10038342 - DNA, 22 bp, Homo sapiens
tggggatggatgaatctttgct

SEQ ID NO: 10038343 - DNA, 22 bp, Homo sapiens
tggggctggctattgtctccct

SEQ ID NO: 10038344 - DNA, 22 bp, Homo sapiens
tggggtgctttcttgcctgtac

SEQ ID NO: 10038345 - DNA, 22 bp, Homo sapiens
tggggtggaacccttctgctgg

SEQ ID NO: 10038346 - DNA, 22 bp, Homo sapiens
tggggtgggcatgcgctgtcct

SEQ ID NO: 10038347 - DNA, 22 bp, Homo sapiens
tggggtggggttactcattctg

SEQ ID NO: 10038348 - DNA, 22 bp, Homo sapiens
tgggggtgaaagtctggacagt

SEQ ID NO: 10038349 - DNA, 22 bp, Homo sapiens
tgggtctgtagggctgtccaat

SEQ ID NO: 10038350 - DNA, 22 bp, Homo sapiens
tggtatgaccgtggtgcaagca

SEQ ID NO: 10038351 - DNA, 22 bp, Homo sapiens
tggtatgtaaattgtaactcaa

SEQ ID NO: 10038352 - DNA, 22 bp, Homo sapiens
tgtccagctgaaggcagcctca

SEQ ID NO: 10038353 - DNA, 22 bp, Homo sapiens
tgtcccagggaaggcccagcac

SEQ ID NO: 10038354 - DNA, 22 bp, Homo sapiens
tgtcccagtcaaggctgtcatc

SEQ ID NO: 10038355 - DNA, 22 bp, Homo sapiens
tgtccctggaactatggctcca

SEQ ID NO: 10038356 - DNA, 22 bp, Homo sapiens
tgtccctggactccaggagcca

SEQ ID NO: 10038357 - DNA, 22 bp, Homo sapiens
tgtccctggtggaggctggcag

SEQ ID NO: 10038358 - DNA, 18 bp, Homo sapiens
tgtccctgcaaataacat

SEQ ID NO: 10038359 - DNA, 22 bp, Homo sapiens
tgtccctcattgacgctgtgcc

SEQ ID NO: 10038360 - DNA, 22 bp, Homo sapiens
tgtcacataggcaaaatgtttt

SEQ ID NO: 10038361 - DNA, 22 bp, Homo sapiens
tgtcacattgaatatgatttat

SEQ ID NO: 10038362 - DNA, 21 bp, Homo sapiens
tgtcacatgtggatggtattt

SEQ ID NO: 10038363 - DNA, 22 bp, Homo sapiens
tgtatttagtccagtctctcat

SEQ ID NO: 10038364 - DNA, 22 bp, Homo sapiens
tgtatttattcttctggtgttt

SEQ ID NO: 10038365 - DNA, 22 bp, Homo sapiens
tgtagcctttatgtgagaagga

SEQ ID NO: 10038366 - DNA, 22 bp, Homo sapiens
tgtagcctattaggagaggagc

SEQ ID NO: 10038367 - DNA, 22 bp, Homo sapiens
tgtagaagtttatgaacacatt

SEQ ID NO: 10038368 - DNA, 22 bp, Homo sapiens
tgtagaagctagcctggagcca

SEQ ID NO: 10038369 - DNA, 22 bp, Homo sapiens
tgtagaagtaggagtcatctca

SEQ ID NO: 10038370 - DNA, 22 bp, Homo sapiens
tgtacttgaacttgactgtaga

SEQ ID NO: 10038371 - DNA, 23 bp, Homo sapiens
tgtatctgtactattcctgcctc

SEQ ID NO: 10038372 - DNA, 22 bp, Homo sapiens
tgtatacattctcttgggtttg

SEQ ID NO: 10038373 - DNA, 22 bp, Homo sapiens
tggtgcctccagctgcttctcc

SEQ ID NO: 10038374 - DNA, 22 bp, Homo sapiens
tggtggcaaatcaggacacttc

SEQ ID NO: 10038375 - DNA, 21 bp, Homo sapiens
tggtggagtgtgctgagcatg

SEQ ID NO: 10038376 - DNA, 22 bp, Homo sapiens
tggtggcaacattgctggagtg

SEQ ID NO: 10038377 - DNA, 19 bp, Homo sapiens
tggtggcaatgtcagctaa

SEQ ID NO: 10038378 - DNA, 22 bp, Homo sapiens
tggtggcaattcaaagacagca

SEQ ID NO: 10038379 - DNA, 23 bp, Homo sapiens
tggtggcagaagtagcagatgac

SEQ ID NO: 10038380 - DNA, 22 bp, Homo sapiens
tggtggcagagcaagagctgga

SEQ ID NO: 10038381 - DNA, 22 bp, Homo sapiens
tggtggcagctgagtgtcaggt

SEQ ID NO: 10038382 - DNA, 22 bp, Homo sapiens
tggtggcagtctcctggctgtg

SEQ ID NO: 10038383 - DNA, 22 bp, Homo sapiens
tggtggcagctgggacagaggt

SEQ ID NO: 10038384 - DNA, 22 bp, Homo sapiens
tggtggcatcactcagcctccc

SEQ ID NO: 10038385 - DNA, 22 bp, Homo sapiens
tggtgggggaggctgtctagca

SEQ ID NO: 10038386 - DNA, 22 bp, Homo sapiens
tggtgggagtgagggcatgcca

SEQ ID NO: 10038387 - DNA, 22 bp, Homo sapiens
tggtccaggcacccttctagag

SEQ ID NO: 10038388 - DNA, 22 bp, Homo sapiens
tggtccagggtgtagtacagag

SEQ ID NO: 10038389 - DNA, 23 bp, Homo sapiens
tggtcagtgccttgcatgtggga

SEQ ID NO: 10038390 - DNA, 22 bp, Homo sapiens
tggtcagtacctggtcaccata

SEQ ID NO: 10038391 - DNA, 22 bp, Homo sapiens
tggtcaggggcttctgagctgt

SEQ ID NO: 10038392 - DNA, 22 bp, Homo sapiens
tggtcaggattctcagcccttc

SEQ ID NO: 10038393 - DNA, 22 bp, Homo sapiens
tggtcctggtgcaagtgcattt

SEQ ID NO: 10038394 - DNA, 22 bp, Homo sapiens
tggtgaggccaaagccatgaca

SEQ ID NO: 10038395 - DNA, 22 bp, Homo sapiens
tggtgaggtcatagagaactgt

SEQ ID NO: 10038396 - DNA, 22 bp, Homo sapiens
tggaggtgtataaggtagcttc

SEQ ID NO: 10038397 - DNA, 22 bp, Homo sapiens
tggaggtgtccaactcgtgggt

SEQ ID NO: 10038398 - DNA, 22 bp, Homo sapiens
tggaggtggcacaagggaggtc

SEQ ID NO: 10038399 - DNA, 22 bp, Homo sapiens
tggaggaaaaaaccaggcagag

SEQ ID NO: 10038400 - DNA, 19 bp, Homo sapiens
tggagaggaaatgctgctc

SEQ ID NO: 10038401 - DNA, 22 bp, Homo sapiens
tggagaggaaagtgcagttttg

SEQ ID NO: 10038402 - DNA, 22 bp, Homo sapiens
tggagaggttgaataacttgtc

SEQ ID NO: 10038403 - DNA, 22 bp, Homo sapiens
tggagaggagcaccatggccat

SEQ ID NO: 10038404 - DNA, 22 bp, Homo sapiens
tggagaggtttaaacaaaagtt

SEQ ID NO: 10038405 - DNA, 22 bp, Homo sapiens
tggagcagccatgatgacagag

SEQ ID NO: 10038406 - DNA, 18 bp, Homo sapiens
tggagcaggtaggcatga

SEQ ID NO: 10038407 - DNA, 22 bp, Homo sapiens
tggacacacatgtatgtcagag

SEQ ID NO: 10038408 - DNA, 22 bp, Homo sapiens
tggactcttggaccttctctaa

SEQ ID NO: 10038409 - DNA, 22 bp, Homo sapiens
tggactctaagcagaggatcta

SEQ ID NO: 10038410 - DNA, 22 bp, Homo sapiens
tggactctatgatgcgccagca

SEQ ID NO: 10038411 - DNA, 21 bp, Homo sapiens
tggacttatggagtgtttctt

SEQ ID NO: 10038412 - DNA, 23 bp, Homo sapiens
tggaccctgcacaccagctctac

SEQ ID NO: 10038413 - DNA, 17 bp, Homo sapiens
tggacccttgggcctcc

SEQ ID NO: 10038414 - DNA, 22 bp, Homo sapiens
tggaccctttatgcggaacagg

SEQ ID NO: 10038415 - DNA, 22 bp, Homo sapiens
tggaaggagactgggaagtgtg

SEQ ID NO: 10038416 - DNA, 22 bp, Homo sapiens
tggaaggaagccaaggaaggtt

SEQ ID NO: 10038417 - DNA, 22 bp, Homo sapiens
tggaaggaaaggtagcagagaa

SEQ ID NO: 10038418 - DNA, 23 bp, Homo sapiens
tggaaagcggacctggggcagag

SEQ ID NO: 10038419 - DNA, 22 bp, Homo sapiens
tggaaagcgaggagttggcatt

SEQ ID NO: 10038420 - DNA, 22 bp, Homo sapiens
tggaacactttcagtagctatt

SEQ ID NO: 10038421 - DNA, 20 bp, Homo sapiens
tggaacctaggcagagctgg

SEQ ID NO: 10038422 - DNA, 19 bp, Homo sapiens
tggaaaatggattgaatca

SEQ ID NO: 10038423 - DNA, 22 bp, Homo sapiens
tgctttgctggcactcctggct

SEQ ID NO: 10038424 - DNA, 22 bp, Homo sapiens
tgctttgcactgactccttcct

SEQ ID NO: 10038425 - DNA, 22 bp, Homo sapiens
tgctttaaaccatggatgtgag

SEQ ID NO: 10038426 - DNA, 22 bp, Homo sapiens
tgcttgcaagagatgcaatgac

SEQ ID NO: 10038427 - DNA, 22 bp, Homo sapiens
tgcctgtgtcacagtgatgttt

SEQ ID NO: 10038428 - DNA, 22 bp, Homo sapiens
tgcctgtgtatttccggcctgc

SEQ ID NO: 10038429 - DNA, 22 bp, Homo sapiens
tgcctgtgtccccttcttggca

SEQ ID NO: 10038430 - DNA, 19 bp, Homo sapiens
tgcctgtggcgagcatctt

SEQ ID NO: 10038431 - DNA, 19 bp, Homo sapiens
tgcctgtggcgagcatctt

SEQ ID NO: 10038432 - DNA, 22 bp, Homo sapiens
tgcctgtgtatgtgcatgcaca

SEQ ID NO: 10038433 - DNA, 22 bp, Homo sapiens
tgcctgtgggtgatgatttgat

SEQ ID NO: 10038434 - DNA, 22 bp, Homo sapiens
tgcctgtgcccttcttggcatt

SEQ ID NO: 10038435 - DNA, 22 bp, Homo sapiens
tgcctgtgccctttgctgggag

SEQ ID NO: 10038436 - DNA, 22 bp, Homo sapiens
tgcctgtctctgactgccatta

SEQ ID NO: 10038437 - DNA, 22 bp, Homo sapiens
tgcctgtcttggagtcctggcc

SEQ ID NO: 10038438 - DNA, 17 bp, Homo sapiens
tgcctgtgataagcaca

SEQ ID NO: 10038439 - DNA, 22 bp, Homo sapiens
tgcctgtgatcagctgagttca

SEQ ID NO: 10038440 - DNA, 22 bp, Homo sapiens
tgcctgtgacccaaggatgcga

SEQ ID NO: 10038441 - DNA, 22 bp, Homo sapiens
tgctccagaacctgaccatgct

SEQ ID NO: 10038442 - DNA, 22 bp, Homo sapiens
tgctcccagggactctggctgg

SEQ ID NO: 10038443 - DNA, 22 bp, Homo sapiens
tgctccagggcctccagtgggg

SEQ ID NO: 10038444 - DNA, 22 bp, Homo sapiens
tgctccagctggagatgggggc

SEQ ID NO: 10038445 - DNA, 20 bp, Homo sapiens
tgctccaggaacactggccg

SEQ ID NO: 10038446 - DNA, 22 bp, Homo sapiens
tgctccagcaccaagagctcca

SEQ ID NO: 10038447 - DNA, 22 bp, Homo sapiens
tgctccagcctatgctctccgg

SEQ ID NO: 10038448 - DNA, 18 bp, Homo sapiens
tgctccaggcccatgggc

SEQ ID NO: 10038449 - DNA, 22 bp, Homo sapiens
tgctccaggcaagctgagagtt

SEQ ID NO: 10038450 - DNA, 21 bp, Homo sapiens
tgctccagggcagcttccagc

SEQ ID NO: 10038451 - DNA, 22 bp, Homo sapiens
tgctcttcacagtttcagcatc

SEQ ID NO: 10038452 - DNA, 22 bp, Homo sapiens
tgctcttcaccattacatcatg

SEQ ID NO: 10038453 - DNA, 22 bp, Homo sapiens
tgctgagcgcatccggcggccg

SEQ ID NO: 10038454 - DNA, 22 bp, Homo sapiens
tgctgaggctagacctggaagt

SEQ ID NO: 10038455 - DNA, 22 bp, Homo sapiens
tgctgctttgatgtgtaaatca

SEQ ID NO: 10038456 - DNA, 20 bp, Homo sapiens
tgctgctttgccactagttg

SEQ ID NO: 10038457 - DNA, 22 bp, Homo sapiens
tgctgctgatggcacctaggca

SEQ ID NO: 10038458 - DNA, 22 bp, Homo sapiens
tgctgctgatggatgcctggac

SEQ ID NO: 10038459 - DNA, 22 bp, Homo sapiens
tgctgtcccccgtgtctgggct

SEQ ID NO: 10038460 - DNA, 22 bp, Homo sapiens
tgctgtgacagagtctcatgga

SEQ ID NO: 10038461 - DNA, 22 bp, Homo sapiens
tgcttctgctcagcttcctact

SEQ ID NO: 10038462 - DNA, 20 bp, Homo sapiens
tgctgggcatgcagtggaaa

SEQ ID NO: 10038463 - DNA, 22 bp, Homo sapiens
tgctgggcatttatgcagatgg

SEQ ID NO: 10038464 - DNA, 20 bp, Homo sapiens
tgctgggccatcttgcatgc

SEQ ID NO: 10038465 - DNA, 22 bp, Homo sapiens
tgctgggctagaagctgaggcc

SEQ ID NO: 10038466 - DNA, 23 bp, Homo sapiens
tgctgtagtctctacagctggtc

SEQ ID NO: 10038467 - DNA, 22 bp, Homo sapiens
tgctggggtctctccggtgccc

SEQ ID NO: 10038468 - DNA, 22 bp, Homo sapiens
tgctggggtcatggggcgcccg

SEQ ID NO: 10038469 - DNA, 23 bp, Homo sapiens
tgctggggtagtttgtggcacag

SEQ ID NO: 10038470 - DNA, 20 bp, Homo sapiens
tgctggggacatacagggtg

SEQ ID NO: 10038471 - DNA, 22 bp, Homo sapiens
tgctggggatccgtaccaaccc

SEQ ID NO: 10038472 - DNA, 22 bp, Homo sapiens
tggcagtgctgcagtgccctta

SEQ ID NO: 10038473 - DNA, 22 bp, Homo sapiens
tggcagtgccccttgaccagtg

SEQ ID NO: 10038474 - DNA, 22 bp, Homo sapiens
tggcagtgttgtgccacattcc

SEQ ID NO: 10038475 - DNA, 22 bp, Homo sapiens
tggcagtgaaccaaggctccaa

SEQ ID NO: 10038476 - DNA, 22 bp, Homo sapiens
tggcagtgaaagacaattgggc

SEQ ID NO: 10038477 - DNA, 18 bp, Homo sapiens
tggcagtgaggtaggcat

SEQ ID NO: 10038478 - DNA, 22 bp, Homo sapiens
tggcatttagttgcgtattgca

SEQ ID NO: 10038479 - DNA, 22 bp, Homo sapiens
tggccactcctccctgcaggct

SEQ ID NO: 10038480 - DNA, 20 bp, Homo sapiens
tggccactggccactggagc

SEQ ID NO: 10038481 - DNA, 20 bp, Homo sapiens
tggcctctgagatgccacgg

SEQ ID NO: 10038482 - DNA, 22 bp, Homo sapiens
tggcctctgggaaagcagattc

SEQ ID NO: 10038483 - DNA, 20 bp, Homo sapiens
tggcctctgtagaggccaag

SEQ ID NO: 10038484 - DNA, 22 bp, Homo sapiens
tggcctctggctgaggactaac

SEQ ID NO: 10038485 - DNA, 22 bp, Homo sapiens
tggcctctgtgggagctgagca

SEQ ID NO: 10038486 - DNA, 22 bp, Homo sapiens
tggcctgactgtcaggctgtat

SEQ ID NO: 10038487 - DNA, 20 bp, Homo sapiens
tggccctgttttctccaggc

SEQ ID NO: 10038488 - DNA, 22 bp, Homo sapiens
tggccctgttctgtacctcata

SEQ ID NO: 10038489 - DNA, 23 bp, Homo sapiens
tggccctgtgcatgctgcttccc

SEQ ID NO: 10038490 - DNA, 22 bp, Homo sapiens
tggccctgtggcttcagaacag

SEQ ID NO: 10038491 - DNA, 22 bp, Homo sapiens
tggccctgtggaggtcagtgag

SEQ ID NO: 10038492 - DNA, 22 bp, Homo sapiens
tggccctgtgtcctgctgccag

SEQ ID NO: 10038493 - DNA, 22 bp, Homo sapiens
tggccctgtgtgcaggctgcac

SEQ ID NO: 10038494 - DNA, 22 bp, Homo sapiens
tggccctgccactcactgctga

SEQ ID NO: 10038495 - DNA, 22 bp, Homo sapiens
tggccctgccctcttcatcttt

SEQ ID NO: 10038496 - DNA, 22 bp, Homo sapiens
tggccctgccgcactatcctca

SEQ ID NO: 10038497 - DNA, 21 bp, Homo sapiens
tggccctggccacggctgcca

SEQ ID NO: 10038498 - DNA, 22 bp, Homo sapiens
tggccctggctgagttagattt

SEQ ID NO: 10038499 - DNA, 22 bp, Homo sapiens
tggccctgggcagaggcaacat

SEQ ID NO: 10038500 - DNA, 22 bp, Homo sapiens
tggccctgggcatctttcgtga

SEQ ID NO: 10038501 - DNA, 22 bp, Homo sapiens
tggccctgtccctggagcctgg

SEQ ID NO: 10038502 - DNA, 22 bp, Homo sapiens
tggccctggtggcacagcctgc

SEQ ID NO: 10038503 - DNA, 22 bp, Homo sapiens
tggccctgggtggaatgtccca

SEQ ID NO: 10038504 - DNA, 22 bp, Homo sapiens
tggccctgtctgcacacaggat

SEQ ID NO: 10038505 - DNA, 22 bp, Homo sapiens
tggccctgtgactgagttctag

SEQ ID NO: 10038506 - DNA, 22 bp, Homo sapiens
tggccctgtcctcatttcatct

SEQ ID NO: 10038507 - DNA, 23 bp, Homo sapiens
tggccctgaatctgtcctggagg

SEQ ID NO: 10038508 - DNA, 22 bp, Homo sapiens
tggccctgaaggccttgagcat

SEQ ID NO: 10038509 - DNA, 22 bp, Homo sapiens
tggccctgaatcaaggccagca

SEQ ID NO: 10038510 - DNA, 22 bp, Homo sapiens
tggcccagtcagcaggagaggg

SEQ ID NO: 10038511 - DNA, 22 bp, Homo sapiens
tggcccggctctgagctgtgct

SEQ ID NO: 10038512 - DNA, 22 bp, Homo sapiens
tggcccaggtgcaagagacaga

SEQ ID NO: 10038513 - DNA, 22 bp, Homo sapiens
tggcccaggtgcacccagaggc

SEQ ID NO: 10038514 - DNA, 22 bp, Homo sapiens
tggccctgacaggtcctgggca

SEQ ID NO: 10038515 - DNA, 22 bp, Homo sapiens
tggccctgacacgtggtactgg

SEQ ID NO: 10038516 - DNA, 22 bp, Homo sapiens
tggccctgactgatgtggaggg

SEQ ID NO: 10038517 - DNA, 22 bp, Homo sapiens
tggccctgacttggaggcctga

SEQ ID NO: 10038518 - DNA, 22 bp, Homo sapiens
tggccctgaggggctgtgcccc

SEQ ID NO: 10038519 - DNA, 22 bp, Homo sapiens
tggccctgaggacccagtgtgg

SEQ ID NO: 10038520 - DNA, 22 bp, Homo sapiens
tggccctgagggctcggagcca

SEQ ID NO: 10038521 - DNA, 22 bp, Homo sapiens
tggccctgcagaactagcctgg

SEQ ID NO: 10038522 - DNA, 22 bp, Homo sapiens
tggccctgcacccagagcagtt

SEQ ID NO: 10038523 - DNA, 22 bp, Homo sapiens
tggcccaggtctctctgagccc

SEQ ID NO: 10038524 - DNA, 22 bp, Homo sapiens
tggcccagggtctacagcctca

SEQ ID NO: 10038525 - DNA, 22 bp, Homo sapiens
tggcccaggggctcttggtgtt

SEQ ID NO: 10038526 - DNA, 22 bp, Homo sapiens
tggcccagggagttcatggtgt

SEQ ID NO: 10038527 - DNA, 22 bp, Homo sapiens
tggcccagggcacagcagggag

SEQ ID NO: 10038528 - DNA, 22 bp, Homo sapiens
tggcccagctgcagatggtgga

SEQ ID NO: 10038529 - DNA, 22 bp, Homo sapiens
tggcccaggaggccagagggca

SEQ ID NO: 10038530 - DNA, 22 bp, Homo sapiens
tggcccaggcgaggtgggcaga

SEQ ID NO: 10038531 - DNA, 22 bp, Homo sapiens
tggcccaggccaaagccctgga

SEQ ID NO: 10038532 - DNA, 22 bp, Homo sapiens
tggcccagctcagggtgggcgg

SEQ ID NO: 10038533 - DNA, 22 bp, Homo sapiens
tggcccagccctgctctagggc

SEQ ID NO: 10038534 - DNA, 22 bp, Homo sapiens
tggcccagactctgctcttatc

SEQ ID NO: 10038535 - DNA, 22 bp, Homo sapiens
tggcagctgaggggaggctttg

SEQ ID NO: 10038536 - DNA, 22 bp, Homo sapiens
tggcagctgaatggctggatgg

SEQ ID NO: 10038537 - DNA, 17 bp, Homo sapiens
tggcagctgaaagctct

SEQ ID NO: 10038538 - DNA, 22 bp, Homo sapiens
tggcagctgagtgcaccccctc

SEQ ID NO: 10038539 - DNA, 22 bp, Homo sapiens
tggcagctgattagatggtgcc

SEQ ID NO: 10038540 - DNA, 22 bp, Homo sapiens
tggcagctgcgttgtgtttctg

SEQ ID NO: 10038541 - DNA, 22 bp, Homo sapiens
tggcagctgcaggcctcctgag

SEQ ID NO: 10038542 - DNA, 22 bp, Homo sapiens
tggcagctgccatgtccacgtg

SEQ ID NO: 10038543 - DNA, 22 bp, Homo sapiens
tggcaggcagtgtgggagctgg

SEQ ID NO: 10038544 - DNA, 21 bp, Homo sapiens
tggcaggcagctggaagcttg

SEQ ID NO: 10038545 - DNA, 22 bp, Homo sapiens
tggcagagtcatcacatctgga

SEQ ID NO: 10038546 - DNA, 22 bp, Homo sapiens
tggcagagtaggatggccctgt

SEQ ID NO: 10038547 - DNA, 22 bp, Homo sapiens
tggcagagtgcagaagaggcat

SEQ ID NO: 10038548 - DNA, 22 bp, Homo sapiens
tggcagagtgcagaagaggcat

SEQ ID NO: 10038549 - DNA, 22 bp, Homo sapiens
tggcagcagacaaaaggccatt

SEQ ID NO: 10038550 - DNA, 22 bp, Homo sapiens
tggcagagttcgctgtgccttt

SEQ ID NO: 10038551 - DNA, 22 bp, Homo sapiens
tggcagcatgttatgtaaggaa

SEQ ID NO: 10038552 - DNA, 18 bp, Homo sapiens
tggcagcaggaagccatt

SEQ ID NO: 10038553 - DNA, 22 bp, Homo sapiens
tggcagcagccatggaaggccc

SEQ ID NO: 10038554 - DNA, 22 bp, Homo sapiens
tggcagcagacaaaaggccatt

SEQ ID NO: 10038555 - DNA, 22 bp, Homo sapiens
tggcagctcccagagcttccaa

SEQ ID NO: 10038556 - DNA, 22 bp, Homo sapiens
tggcagctccgggtaggggctg

SEQ ID NO: 10038557 - DNA, 22 bp, Homo sapiens
tggcagctcatttggaaatgga

SEQ ID NO: 10038558 - DNA, 22 bp, Homo sapiens
tggcagctattacaaggaagtc

SEQ ID NO: 10038559 - DNA, 22 bp, Homo sapiens
tggcagctctgttcaacatgag

SEQ ID NO: 10038560 - DNA, 22 bp, Homo sapiens
tggcagctcctggggccagcac

SEQ ID NO: 10038561 - DNA, 22 bp, Homo sapiens
tggcagctacagacagaggtga

SEQ ID NO: 10038562 - DNA, 22 bp, Homo sapiens
tggcagctatctttaatgagat

SEQ ID NO: 10038563 - DNA, 18 bp, Homo sapiens
tggcagctaggtaaagaa

SEQ ID NO: 10038564 - DNA, 22 bp, Homo sapiens
tggcagctatggtctaagggcc

SEQ ID NO: 10038565 - DNA, 22 bp, Homo sapiens
tggcagctagatagtgtgttta

SEQ ID NO: 10038566 - DNA, 22 bp, Homo sapiens
tggcagctagctgttttcatgc

SEQ ID NO: 10038567 - DNA, 19 bp, Homo sapiens
tggcagcattggtaccttg

SEQ ID NO: 10038568 - DNA, 22 bp, Homo sapiens
tggcagcctggaatctctcagc

SEQ ID NO: 10038569 - DNA, 22 bp, Homo sapiens
tggcactgtcaccaatgctgtc

SEQ ID NO: 10038570 - DNA, 22 bp, Homo sapiens
tggcactgtagccactactgcc

SEQ ID NO: 10038571 - DNA, 22 bp, Homo sapiens
tggcactgaccccaggcctgtg

SEQ ID NO: 10038572 - DNA, 22 bp, Homo sapiens
tggcactgagcagccgcggcag

SEQ ID NO: 10038573 - DNA, 22 bp, Homo sapiens
tggcactgccaacctgctaggt

SEQ ID NO: 10038574 - DNA, 22 bp, Homo sapiens
tggcactgcctggcagggcccc

SEQ ID NO: 10038575 - DNA, 21 bp, Homo sapiens
tggcactgcttagcaggttcc

SEQ ID NO: 10038576 - DNA, 22 bp, Homo sapiens
tggcactggaatcgtagccttg

SEQ ID NO: 10038577 - DNA, 22 bp, Homo sapiens
tggcaccagggaacaagcattt

SEQ ID NO: 10038578 - DNA, 22 bp, Homo sapiens
tggcactgaaaaaggagaggtt

SEQ ID NO: 10038579 - DNA, 22 bp, Homo sapiens
tggcacgacaattggcaccaat

SEQ ID NO: 10038580 - DNA, 22 bp, Homo sapiens
tggcagagcaaaaagatagaat

SEQ ID NO: 10038581 - DNA, 22 bp, Homo sapiens
tggcagagagactctccttgat

SEQ ID NO: 10038582 - DNA, 22 bp, Homo sapiens
tggcagagactcctcctgggag

SEQ ID NO: 10038583 - DNA, 22 bp, Homo sapiens
tggcagagacaaggccgggcct

SEQ ID NO: 10038584 - DNA, 20 bp, Homo sapiens
tggcacagaacccttgccta

SEQ ID NO: 10038585 - DNA, 22 bp, Homo sapiens
tggcacagaaaaatgctccatt

SEQ ID NO: 10038586 - DNA, 22 bp, Homo sapiens
tggcacagaccttatcttctct

SEQ ID NO: 10038587 - DNA, 22 bp, Homo sapiens
tggcacagacagcacagcaatg

SEQ ID NO: 10038588 - DNA, 17 bp, Homo sapiens
tggcacagaggtgctat

SEQ ID NO: 10038589 - DNA, 19 bp, Homo sapiens
tggcacagatttcctccct

SEQ ID NO: 10038590 - DNA, 22 bp, Homo sapiens
tggcacagagggacccagcagc

SEQ ID NO: 10038591 - DNA, 23 bp, Homo sapiens
tggcacagaggaccatgctttgc

SEQ ID NO: 10038592 - DNA, 22 bp, Homo sapiens
tggcacagactgggccaaggaa

SEQ ID NO: 10038593 - DNA, 23 bp, Homo sapiens
tggcacagcaggtgtgctttgtt

SEQ ID NO: 10038594 - DNA, 22 bp, Homo sapiens
tggcacagccatcttctcctgc

SEQ ID NO: 10038595 - DNA, 22 bp, Homo sapiens
tggcacagcccagagctcttga

SEQ ID NO: 10038596 - DNA, 22 bp, Homo sapiens
tggcacagcccggattctatga

SEQ ID NO: 10038597 - DNA, 22 bp, Homo sapiens
tggcaactcctgactctactca

SEQ ID NO: 10038598 - DNA, 22 bp, Homo sapiens
tggcaaagactgcaaggacttt

SEQ ID NO: 10038599 - DNA, 22 bp, Homo sapiens
tggctgctgagaaggcagctgt

SEQ ID NO: 10038600 - DNA, 22 bp, Homo sapiens
tggctctggattaatctaggaa

SEQ ID NO: 10038601 - DNA, 22 bp, Homo sapiens
tggctctgctgaacctagtgca

SEQ ID NO: 10038602 - DNA, 21 bp, Homo sapiens
tggctctgctcagagcagtcc

SEQ ID NO: 10038603 - DNA, 20 bp, Homo sapiens
tggctcctgcggtggaacca

SEQ ID NO: 10038604 - DNA, 22 bp, Homo sapiens
tggccttgattatgccagtaga

SEQ ID NO: 10038605 - DNA, 22 bp, Homo sapiens
tggctcagaactacttctagtt

SEQ ID NO: 10038606 - DNA, 22 bp, Homo sapiens
tggctcagtggcagccgcagct

SEQ ID NO: 10038607 - DNA, 22 bp, Homo sapiens
tggctccaaatcaactgctgtt

SEQ ID NO: 10038608 - DNA, 22 bp, Homo sapiens
tggctccacaggccagggtgtg

SEQ ID NO: 10038609 - DNA, 22 bp, Homo sapiens
tggctcctatcaaggagtgggt

SEQ ID NO: 10038610 - DNA, 18 bp, Homo sapiens
tggctcctgcctcctgca

SEQ ID NO: 10038611 - DNA, 22 bp, Homo sapiens
tggctcctgcagaccatctgga

SEQ ID NO: 10038612 - DNA, 22 bp, Homo sapiens
tggctcctccctgtgtgtgcgt

SEQ ID NO: 10038613 - DNA, 20 bp, Homo sapiens
tggctcctcttggctgtggc

SEQ ID NO: 10038614 - DNA, 22 bp, Homo sapiens
tggctcctcttctgggtgtccc

SEQ ID NO: 10038615 - DNA, 22 bp, Homo sapiens
tggctcctcatcacagttggtg

SEQ ID NO: 10038616 - DNA, 22 bp, Homo sapiens
tgggagcagcagggagatgcgg

SEQ ID NO: 10038617 - DNA, 22 bp, Homo sapiens
tgggagcactctttgggaagca

SEQ ID NO: 10038618 - DNA, 22 bp, Homo sapiens
tgggactcactcttttggccag

SEQ ID NO: 10038619 - DNA, 22 bp, Homo sapiens
tgggacagtgtgccttgctcct

SEQ ID NO: 10038620 - DNA, 22 bp, Homo sapiens
tgggaccaagtcatttctttag

SEQ ID NO: 10038621 - DNA, 22 bp, Homo sapiens
tggctttgaaatccagtcatta

SEQ ID NO: 10038622 - DNA, 19 bp, Homo sapiens
tggctgggcgtgcctccgt

SEQ ID NO: 10038623 - DNA, 22 bp, Homo sapiens
tggctgggccgggccttgtgcc

SEQ ID NO: 10038624 - DNA, 22 bp, Homo sapiens
tggctggggagccccgactccc

SEQ ID NO: 10038625 - DNA, 22 bp, Homo sapiens
tggctggggcctgaatcctgca

SEQ ID NO: 10038626 - DNA, 22 bp, Homo sapiens
tggctgggcccccacctgcctc

SEQ ID NO: 10038627 - DNA, 22 bp, Homo sapiens
tggctgggagctggaactgggc

SEQ ID NO: 10038628 - DNA, 22 bp, Homo sapiens
acagagaaagtgggctgaagat

SEQ ID NO: 10038629 - DNA, 22 bp, Homo sapiens
agcagatgaatcccagataaag

SEQ ID NO: 10038630 - DNA, 22 bp, Homo sapiens
acaatgcaccagcatcttcacc

SEQ ID NO: 10038631 - DNA, 22 bp, Homo sapiens
aatgtttgtgcataaatatgtt

SEQ ID NO: 10038632 - DNA, 22 bp, Homo sapiens
aattgagtcatgctgtattgaa

SEQ ID NO: 10038633 - DNA, 22 bp, Homo sapiens
aattgagtgctagacatcatga

SEQ ID NO: 10038634 - DNA, 22 bp, Homo sapiens
actgttgaagtgccagcttgat

SEQ ID NO: 10038635 - DNA, 22 bp, Homo sapiens
agaacaatgttaaattattaag

SEQ ID NO: 10038636 - DNA, 22 bp, Homo sapiens
agaacaatgcgtattttactcc

SEQ ID NO: 10038637 - DNA, 22 bp, Homo sapiens
aatgatttcccctacacagaag

SEQ ID NO: 10038638 - DNA, 22 bp, Homo sapiens
acagtctttaatttctttgtgg

SEQ ID NO: 10038639 - DNA, 22 bp, Homo sapiens
aagatgaactgtcttcacccat

SEQ ID NO: 10038640 - DNA, 22 bp, Homo sapiens
aagcaatagcaacaactttaca

SEQ ID NO: 10038641 - DNA, 22 bp, Homo sapiens
aagatgcagctttacaataagg

SEQ ID NO: 10038642 - DNA, 22 bp, Homo sapiens
aagcagagaaaagcttaggttc

SEQ ID NO: 10038643 - DNA, 22 bp, Homo sapiens
aagcagagaccggctaatggag

SEQ ID NO: 10038644 - DNA, 22 bp, Homo sapiens
aagcaatagggtaatctactca

SEQ ID NO: 10038645 - DNA, 22 bp, Homo sapiens
aagaaatgtgaatattgaatag

SEQ ID NO: 10038646 - DNA, 22 bp, Homo sapiens
aagaaaacaatgacttgccagc

SEQ ID NO: 10038647 - DNA, 22 bp, Homo sapiens
aatgggaaaagagtatgattta

SEQ ID NO: 10038648 - DNA, 22 bp, Homo sapiens
aatgggaaagagactagatgct

SEQ ID NO: 10038649 - DNA, 22 bp, Homo sapiens
aacatctgatcgaacagtgcca

SEQ ID NO: 10038650 - DNA, 22 bp, Homo sapiens
aatggctatacaacatgagtat

SEQ ID NO: 10038651 - DNA, 22 bp, Homo sapiens
aaatttgataagccattgttac

SEQ ID NO: 10038652 - DNA, 22 bp, Homo sapiens
aaactggattaccaggctggtg

SEQ ID NO: 10038653 - DNA, 22 bp, Homo sapiens
aaaaggctcttcaaaatggaag

SEQ ID NO: 10038654 - DNA, 22 bp, Homo sapiens
aaactgtatatttatggcatgt

SEQ ID NO: 10038655 - DNA, 22 bp, Homo sapiens
aaagatcagtctgaagcaacat

SEQ ID NO: 10038656 - DNA, 22 bp, Homo sapiens
aaagagaacttttacccaagaa

SEQ ID NO: 10038657 - DNA, 20 bp, Homo sapiens
aaagagaagcctcaccttgt

SEQ ID NO: 10038658 - DNA, 22 bp, Homo sapiens
aaagagaaaaagatcccggctc

SEQ ID NO: 10038659 - DNA, 22 bp, Homo sapiens
aaagagaaaatgatctgtacat

SEQ ID NO: 10038660 - DNA, 22 bp, Homo sapiens
aaagaaacctatcagccacatg

SEQ ID NO: 10038661 - DNA, 19 bp, Homo sapiens
aaagcagaggagcatctga

SEQ ID NO: 10038662 - DNA, 22 bp, Homo sapiens
aaagcagaggtgatatgactta

SEQ ID NO: 10038663 - DNA, 22 bp, Homo sapiens
aagatccatgggaatgtttggc

SEQ ID NO: 10038664 - DNA, 22 bp, Homo sapiens
actgcaacctccgcctgccagg

SEQ ID NO: 10038665 - DNA, 22 bp, Homo sapiens
acctgtttagaaagcttatgag

SEQ ID NO: 10038666 - DNA, 19 bp, Homo sapiens
actaaaaatgatgtttgag

SEQ ID NO: 10038667 - DNA, 22 bp, Homo sapiens
actgtgtggaccactctgaggc

SEQ ID NO: 10038668 - DNA, 22 bp, Homo sapiens
actgtgttaaatacagagatgg

SEQ ID NO: 10038669 - DNA, 20 bp, Homo sapiens
actgtgtgatctggaaagct

SEQ ID NO: 10038670 - DNA, 20 bp, Homo sapiens
actgttagtatacttgtgcc

SEQ ID NO: 10038671 - DNA, 22 bp, Homo sapiens
atatccaccattctgcaccttc

SEQ ID NO: 10038672 - DNA, 22 bp, Homo sapiens
atatacacatctttttaaatat

SEQ ID NO: 10038673 - DNA, 22 bp, Homo sapiens
atcatcttgctttctgtttact

SEQ ID NO: 10038674 - DNA, 20 bp, Homo sapiens
agaaacagcacaattctgtt

SEQ ID NO: 10038675 - DNA, 22 bp, Homo sapiens
agaaacatttagattatatgtc

SEQ ID NO: 10038676 - DNA, 20 bp, Homo sapiens
agctgccttcattttctaga

SEQ ID NO: 10038677 - DNA, 22 bp, Homo sapiens
agctgccttaaattactttgtg

SEQ ID NO: 10038678 - DNA, 22 bp, Homo sapiens
aggaatggtgctcagcagaaat

SEQ ID NO: 10038679 - DNA, 22 bp, Homo sapiens
acagttaactggagagcgagtt

SEQ ID NO: 10038680 - DNA, 22 bp, Homo sapiens
acagttaattgttgttgggtgt

SEQ ID NO: 10038681 - DNA, 22 bp, Homo sapiens
acagttaataagtagtaagtca

SEQ ID NO: 10038682 - DNA, 22 bp, Homo sapiens
acagttaaggaaatggaggttc

SEQ ID NO: 10038683 - DNA, 22 bp, Homo sapiens
acagttaattaacattaagggg

SEQ ID NO: 10038684 - DNA, 22 bp, Homo sapiens
acagttaatatgtgacagaact

SEQ ID NO: 10038685 - DNA, 22 bp, Homo sapiens
acagttaatcaaatggcatatg

SEQ ID NO: 10038686 - DNA, 22 bp, Homo sapiens
acatgcaaaaatatatttatga

SEQ ID NO: 10038687 - DNA, 22 bp, Homo sapiens
cacatctactgaatgagcagtg

SEQ ID NO: 10038688 - DNA, 22 bp, Homo sapiens
cacatctatggagacagagagt

SEQ ID NO: 10038689 - DNA, 20 bp, Homo sapiens
cactctgagggagtccatgt

SEQ ID NO: 10038690 - DNA, 22 bp, Homo sapiens
cactctgagcccaagcaggctg

SEQ ID NO: 10038691 - DNA, 22 bp, Homo sapiens
cactctgattccacaaggctcc

SEQ ID NO: 10038692 - DNA, 23 bp, Homo sapiens
agcataaacctctgtggctttag

SEQ ID NO: 10038693 - DNA, 21 bp, Homo sapiens
agcagagtgctttgactttgt

SEQ ID NO: 10038694 - DNA, 22 bp, Homo sapiens
agatttcacatgctgctctatt

SEQ ID NO: 10038695 - DNA, 17 bp, Homo sapiens
agcaaaagtatcaaagc

SEQ ID NO: 10038696 - DNA, 22 bp, Homo sapiens
agcaaaataaggtaatttattg

SEQ ID NO: 10038697 - DNA, 22 bp, Homo sapiens
atttaagactgacttcaccagt

SEQ ID NO: 10038698 - DNA, 22 bp, Homo sapiens
attaaagaaacccagcatgtga

SEQ ID NO: 10038699 - DNA, 22 bp, Homo sapiens
atgtctgtttatccttcaagat

SEQ ID NO: 10038700 - DNA, 22 bp, Homo sapiens
atctttgtcactctactgtcta

SEQ ID NO: 10038701 - DNA, 22 bp, Homo sapiens
atctttgtgaatctcaacttgg

SEQ ID NO: 10038702 - DNA, 22 bp, Homo sapiens
agaagacagagtctacattcta

SEQ ID NO: 10038703 - DNA, 22 bp, Homo sapiens
agacaatatataattttagttg

SEQ ID NO: 10038704 - DNA, 22 bp, Homo sapiens
atgcaaaattaccattctgttc

SEQ ID NO: 10038705 - DNA, 22 bp, Homo sapiens
atgcagaaggagccatgcttgc

SEQ ID NO: 10038706 - DNA, 22 bp, Homo sapiens
atgcagaattgctaagtatctg

SEQ ID NO: 10038707 - DNA, 22 bp, Homo sapiens
atgcagaaagagaatgtaatgt

SEQ ID NO: 10038708 - DNA, 22 bp, Homo sapiens
atgcaaaagtaattgcaatttt

SEQ ID NO: 10038709 - DNA, 22 bp, Homo sapiens
gaaagcagatgaaattgcaaca

SEQ ID NO: 10038710 - DNA, 22 bp, Homo sapiens
gaaagcaatttgtgtaatctgt

SEQ ID NO: 10038711 - DNA, 19 bp, Homo sapiens
gaaagatttcagttgagga

SEQ ID NO: 10038712 - DNA, 22 bp, Homo sapiens
gcctctctccttggcttgcagt

SEQ ID NO: 10038713 - DNA, 22 bp, Homo sapiens
atttctcagtgaaatgacaggc

SEQ ID NO: 10038714 - DNA, 22 bp, Homo sapiens
atttctcaaccaggtcaaaaag

SEQ ID NO: 10038715 - DNA, 22 bp, Homo sapiens
atttctcactgagcagataaaa

SEQ ID NO: 10038716 - DNA, 22 bp, Homo sapiens
gcctctctctacccagtatgat

SEQ ID NO: 10038717 - DNA, 22 bp, Homo sapiens
attaaattaagtggctaattta

SEQ ID NO: 10038718 - DNA, 22 bp, Homo sapiens
attcctcatttgttgagaacca

SEQ ID NO: 10038719 - DNA, 20 bp, Homo sapiens
attccacttgtttgaggtac

SEQ ID NO: 10038720 - DNA, 22 bp, Homo sapiens
attcagtcaaaaatgatggaga

SEQ ID NO: 10038721 - DNA, 19 bp, Homo sapiens
cacaattatgagacactta

SEQ ID NO: 10038722 - DNA, 22 bp, Homo sapiens
cacaattatagaagaaagcata

SEQ ID NO: 10038723 - DNA, 18 bp, Homo sapiens
cacaatttacagatgaca

SEQ ID NO: 10038724 - DNA, 22 bp, Homo sapiens
ggatgggagcagaggacgacca

SEQ ID NO: 10038725 - DNA, 22 bp, Homo sapiens
cagccactcggccataaaggct

SEQ ID NO: 10038726 - DNA, 18 bp, Homo sapiens
atacaagatcaagtgttc

SEQ ID NO: 10038727 - DNA, 22 bp, Homo sapiens
atactcaatttgttggaaagca

SEQ ID NO: 10038728 - DNA, 22 bp, Homo sapiens
agtttgaaagcttaacagtaca

SEQ ID NO: 10038729 - DNA, 22 bp, Homo sapiens
agtttggaagtcaggcttttct

SEQ ID NO: 10038730 - DNA, 22 bp, Homo sapiens
atccacaggtcatgtaatgtgg

SEQ ID NO: 10038731 - DNA, 22 bp, Homo sapiens
atccacagggtgtgttaagatg

SEQ ID NO: 10038732 - DNA, 22 bp, Homo sapiens
atccacagtgggggtggcggaa

SEQ ID NO: 10038733 - DNA, 22 bp, Homo sapiens
atccacagtgcagcaagggccc

SEQ ID NO: 10038734 - DNA, 22 bp, Homo sapiens
atccacagagaggaagaatagt

SEQ ID NO: 10038735 - DNA, 22 bp, Homo sapiens
atccacaggagggtttggaaaa

SEQ ID NO: 10038736 - DNA, 22 bp, Homo sapiens
atccacagaaggaacttgaaag

SEQ ID NO: 10038737 - DNA, 20 bp, Homo sapiens
atccctggccttaaggagtg

SEQ ID NO: 10038738 - DNA, 20 bp, Homo sapiens
atcatctttacaatgtcagt

SEQ ID NO: 10038739 - DNA, 22 bp, Homo sapiens
atatgcaagcacatagaatact

SEQ ID NO: 10038740 - DNA, 22 bp, Homo sapiens
ctcgcaagtcgctccggttact

SEQ ID NO: 10038741 - DNA, 22 bp, Homo sapiens
ctctcgcgtgtgcctttccgct

SEQ ID NO: 10038742 - DNA, 22 bp, Homo sapiens
aggagaattaggaactcaagat

SEQ ID NO: 10038743 - DNA, 22 bp, Homo sapiens
cattcaaacattaatttattca

SEQ ID NO: 10038744 - DNA, 22 bp, Homo sapiens
aggaaatgcaggcaaatactct

SEQ ID NO: 10038745 - DNA, 22 bp, Homo sapiens
agcttaaactctttgaagttat

SEQ ID NO: 10038746 - DNA, 22 bp, Homo sapiens
ccccatgctgggatctgacacc

SEQ ID NO: 10038747 - DNA, 22 bp, Homo sapiens
ccatgagtagcgatttcatttt

SEQ ID NO: 10038748 - DNA, 22 bp, Homo sapiens
ccacaggtacggattgaggacc

SEQ ID NO: 10038749 - DNA, 22 bp, Homo sapiens
ccacagctagggcaatctgatt

SEQ ID NO: 10038750 - DNA, 22 bp, Homo sapiens
ccacaattttatgatttaggag

SEQ ID NO: 10038751 - DNA, 22 bp, Homo sapiens
tctgaaataggaaagcaaatgg

SEQ ID NO: 10038752 - DNA, 22 bp, Homo sapiens
tctgaaatatattttgagtgtt

SEQ ID NO: 10038753 - DNA, 22 bp, Homo sapiens
catcatctggcttttagaaaaa

SEQ ID NO: 10038754 - DNA, 22 bp, Homo sapiens
catatccaatatgactagtgtt

SEQ ID NO: 10038755 - DNA, 22 bp, Homo sapiens
catatccaggtttctttggttt

SEQ ID NO: 10038756 - DNA, 20 bp, Homo sapiens
tcagtttaaatcctggcttt

SEQ ID NO: 10038757 - DNA, 22 bp, Homo sapiens
catctttgcaccctcaaaacct

SEQ ID NO: 10038758 - DNA, 22 bp, Homo sapiens
catctttgccatatgatgtaat

SEQ ID NO: 10038759 - DNA, 22 bp, Homo sapiens
catctttgagacagcattaccc

SEQ ID NO: 10038760 - DNA, 22 bp, Homo sapiens
catctttgaactctgtataaac

SEQ ID NO: 10038761 - DNA, 22 bp, Homo sapiens
catgatctggtcctactgtggg

SEQ ID NO: 10038762 - DNA, 22 bp, Homo sapiens
taaaaagtagtgagaatggcgc

SEQ ID NO: 10038763 - DNA, 22 bp, Homo sapiens
gttttctgattagcaaatctga

SEQ ID NO: 10038764 - DNA, 22 bp, Homo sapiens
taaatgctttctatgaaagagg

SEQ ID NO: 10038765 - DNA, 22 bp, Homo sapiens
tacatatttgtctttgtactgt

SEQ ID NO: 10038766 - DNA, 22 bp, Homo sapiens
taacagaaaggggacagaaata

SEQ ID NO: 10038767 - DNA, 22 bp, Homo sapiens
taacagaaatagaaatgagagt

SEQ ID NO: 10038768 - DNA, 20 bp, Homo sapiens
taacagaagtagaagtgggt

SEQ ID NO: 10038769 - DNA, 22 bp, Homo sapiens
taacaacatgcaatttaacctt

SEQ ID NO: 10038770 - DNA, 22 bp, Homo sapiens
taaggcagatgtggaatcaatt

SEQ ID NO: 10038771 - DNA, 22 bp, Homo sapiens
gttaaagaagaatagttccttt

SEQ ID NO: 10038772 - DNA, 22 bp, Homo sapiens
gttacaatgttcttcagttctg

SEQ ID NO: 10038773 - DNA, 22 bp, Homo sapiens
caggaaaatggaatcacctgta

SEQ ID NO: 10038774 - DNA, 22 bp, Homo sapiens
ctgcaaaagtaattgcaggttt

SEQ ID NO: 10038775 - DNA, 22 bp, Homo sapiens
ctgcaaaagtaattggggcttt

SEQ ID NO: 10038776 - DNA, 22 bp, Homo sapiens
tttgtcttggccaaggttctga

SEQ ID NO: 10038777 - DNA, 22 bp, Homo sapiens
ttggatccatctcaggcatagg

SEQ ID NO: 10038778 - DNA, 22 bp, Homo sapiens
ttgcttttgtctcgggtttgga

SEQ ID NO: 10038779 - DNA, 22 bp, Homo sapiens
ttgcttttccctgtctctgatt

SEQ ID NO: 10038780 - DNA, 22 bp, Homo sapiens
ttgttaaaactccattggtttg

SEQ ID NO: 10038781 - DNA, 22 bp, Homo sapiens
tttcagtgttatgactttcatt

SEQ ID NO: 10038782 - DNA, 22 bp, Homo sapiens
tttaaattatagttaatgtctg

SEQ ID NO: 10038783 - DNA, 22 bp, Homo sapiens
tttaaattctgtctgccgctta

SEQ ID NO: 10038784 - DNA, 22 bp, Homo sapiens
tttaaatttagaagaaacactg

SEQ ID NO: 10038785 - DNA, 22 bp, Homo sapiens
tttaaatttgtgtttagagggt

SEQ ID NO: 10038786 - DNA, 22 bp, Homo sapiens
ttccttcctgtcttccttactg

SEQ ID NO: 10038787 - DNA, 22 bp, Homo sapiens
ttcccacagagattacattgaa

SEQ ID NO: 10038788 - DNA, 22 bp, Homo sapiens
ttcattctgcagttctcagctc

SEQ ID NO: 10038789 - DNA, 22 bp, Homo sapiens
ttgagctcccgcttcttctttg

SEQ ID NO: 10038790 - DNA, 22 bp, Homo sapiens
ttgaggagaagactttgcttcc

SEQ ID NO: 10038791 - DNA, 22 bp, Homo sapiens
gagaaaatgtcagacttggtcg

SEQ ID NO: 10038792 - DNA, 22 bp, Homo sapiens
gactggaaagcctgtcctcaga

SEQ ID NO: 10038793 - DNA, 21 bp, Homo sapiens
gaaaggtcttaacttacagag

SEQ ID NO: 10038794 - DNA, 17 bp, Homo sapiens
gaaaggtcctagaaatc

SEQ ID NO: 10038795 - DNA, 22 bp, Homo sapiens
gaacctgtttatgttacctgcg

SEQ ID NO: 10038796 - DNA, 22 bp, Homo sapiens
gaacctgtaagtatagatgtgg

SEQ ID NO: 10038797 - DNA, 22 bp, Homo sapiens
cttctttcaagaatggattagg

SEQ ID NO: 10038798 - DNA, 22 bp, Homo sapiens
cttctttcccaggcatgtttta

SEQ ID NO: 10038799 - DNA, 22 bp, Homo sapiens
cttctttccttcctccagtggc

SEQ ID NO: 10038800 - DNA, 22 bp, Homo sapiens
cttctttcttttgatcacaggt

SEQ ID NO: 10038801 - DNA, 22 bp, Homo sapiens
ctttagtgttcaacccagataa

SEQ ID NO: 10038802 - DNA, 22 bp, Homo sapiens
gatgagaatgtttatcaaatgc

SEQ ID NO: 10038803 - DNA, 22 bp, Homo sapiens
gatctttgcaaactttgtcact

SEQ ID NO: 10038804 - DNA, 22 bp, Homo sapiens
gatccacagcccgcttgggccc

SEQ ID NO: 10038805 - DNA, 22 bp, Homo sapiens
gatccacaggaaccaaaacgca

SEQ ID NO: 10038806 - DNA, 22 bp, Homo sapiens
gatccacagctgcggtaggaga

SEQ ID NO: 10038807 - DNA, 22 bp, Homo sapiens
gatccacagggccctggcccag

SEQ ID NO: 10038808 - DNA, 21 bp, Homo sapiens
gatccactgacctggggatcc

SEQ ID NO: 10038809 - DNA, 22 bp, Homo sapiens
gatccacagtttgatgatcata

SEQ ID NO: 10038810 - DNA, 22 bp, Homo sapiens
gagttaaaagccctctcagcag

SEQ ID NO: 10038811 - DNA, 22 bp, Homo sapiens
gagatccacttaatttttttgc

SEQ ID NO: 10038812 - DNA, 22 bp, Homo sapiens
gagtcattgcacactagctcag

SEQ ID NO: 10038813 - DNA, 22 bp, Homo sapiens
gcacaattccatgggacagccc

SEQ ID NO: 10038814 - DNA, 22 bp, Homo sapiens
gcaggcttatggggagacagag

SEQ ID NO: 10038815 - DNA, 22 bp, Homo sapiens
gcaggcttgagagatcagatgg

SEQ ID NO: 10038816 - DNA, 22 bp, Homo sapiens
gcaggcttgcccggcctccttc

SEQ ID NO: 10038817 - DNA, 22 bp, Homo sapiens
gccacacttattctcatgcaca

SEQ ID NO: 10038818 - DNA, 22 bp, Homo sapiens
gctcttatagtcccagcatgtt

SEQ ID NO: 10038819 - DNA, 22 bp, Homo sapiens
gtctgaaaatatgattttgcct

SEQ ID NO: 10038820 - DNA, 22 bp, Homo sapiens
gtaaagaaggcaacctggttat

SEQ ID NO: 10038821 - DNA, 22 bp, Homo sapiens
gtaaagaagtttttgaatgcat

SEQ ID NO: 10038822 - DNA, 22 bp, Homo sapiens
gtatagaaacccagaaagatag

SEQ ID NO: 10038823 - DNA, 22 bp, Homo sapiens
gtggctctgtaaaatgcctgca

SEQ ID NO: 10038824 - DNA, 22 bp, Homo sapiens
taaaaatcttatgaatggcaag

SEQ ID NO: 10038825 - DNA, 22 bp, Homo sapiens
gtttaagagggtttcattccca

SEQ ID NO: 10038826 - DNA, 22 bp, Homo sapiens
gttctattactccctgcttctt

SEQ ID NO: 10038827 - DNA, 21 bp, Homo sapiens
gttattttaagtgagctttgc

SEQ ID NO: 10038828 - DNA, 22 bp, Homo sapiens
gttattttcattggctcagact

SEQ ID NO: 10038829 - DNA, 22 bp, Homo sapiens
gttctattcattgctccacgag

SEQ ID NO: 10038830 - DNA, 21 bp, Homo sapiens
gttctattttgcaaacttctg

SEQ ID NO: 10038831 - DNA, 22 bp, Homo sapiens
gggccatgagaggttcatcaac

SEQ ID NO: 10038832 - DNA, 22 bp, Homo sapiens
ggctcatgtttcagaaagtgga

SEQ ID NO: 10038833 - DNA, 22 bp, Homo sapiens
gggaaatctcgtcctctattta

SEQ ID NO: 10038834 - DNA, 22 bp, Homo sapiens
ggcaggctgggagtcatcagag

SEQ ID NO: 10038835 - DNA, 19 bp, Homo sapiens
ggcaggctggatagagagg

SEQ ID NO: 10038836 - DNA, 22 bp, Homo sapiens
ggcaggctgcttgggtcatgtc

SEQ ID NO: 10038837 - DNA, 22 bp, Homo sapiens
ggcaggctcagcagccaaggag

SEQ ID NO: 10038838 - DNA, 22 bp, Homo sapiens
ggaagaaatctggttaagagat

SEQ ID NO: 10038839 - DNA, 22 bp, Homo sapiens
ggagaatggccatcttttcaga

SEQ ID NO: 10038840 - DNA, 22 bp, Homo sapiens
ggagaatgattctttgctcact

SEQ ID NO: 10038841 - DNA, 22 bp, Homo sapiens
tggctgtgggatgagagcctca

SEQ ID NO: 10038842 - DNA, 21 bp, Homo sapiens
tggcttttatggagctctggg

SEQ ID NO: 10038843 - DNA, 22 bp, Homo sapiens
tgggaaatattctaaaagtctt

SEQ ID NO: 10038844 - DNA, 22 bp, Homo sapiens
tgggactcactcttttggccag

SEQ ID NO: 10038845 - DNA, 22 bp, Homo sapiens
tgggagcagcagggagatgcgg

SEQ ID NO: 10038846 - DNA, 22 bp, Homo sapiens
tgctgaaattagaacattgagg

SEQ ID NO: 10038847 - DNA, 19 bp, Homo sapiens
tgctatttgaagaagtgta

SEQ ID NO: 10038848 - DNA, 19 bp, Homo sapiens
tggaaaatggattgaatca

SEQ ID NO: 10038849 - DNA, 18 bp, Homo sapiens
tggaaattgaaacagaaa

SEQ ID NO: 10038850 - DNA, 22 bp, Homo sapiens
tggagcagcattcatccagcag

SEQ ID NO: 10038851 - DNA, 22 bp, Homo sapiens
tggagcagaaatttgaagccat

SEQ ID NO: 10038852 - DNA, 22 bp, Homo sapiens
tggagaatatttccaaatctaa

SEQ ID NO: 10038853 - DNA, 22 bp, Homo sapiens
tggtgatcagtcaactgtcttc

SEQ ID NO: 10038854 - DNA, 20 bp, Homo sapiens
tgtaaataggcattgtagtt

SEQ ID NO: 10038855 - DNA, 23 bp, Homo sapiens
tgtaacaatttcatatacatgca

SEQ ID NO: 10038856 - DNA, 22 bp, Homo sapiens
tgtcaaaaccttggaggcaagg

SEQ ID NO: 10038857 - DNA, 22 bp, Homo sapiens
tgtcaaaaagctgggacaagca

SEQ ID NO: 10038858 - DNA, 22 bp, Homo sapiens
tgtcaaaaataagagagattgt

SEQ ID NO: 10038859 - DNA, 23 bp, Homo sapiens
tgggatagaatttcatggctgct

SEQ ID NO: 10038860 - DNA, 22 bp, Homo sapiens
ttagtgcaaacctcagagacac

SEQ ID NO: 10038861 - DNA, 22 bp, Homo sapiens
ttatttcattgatttctaagac

SEQ ID NO: 10038862 - DNA, 22 bp, Homo sapiens
ttaaagaatagtgcccctattg

SEQ ID NO: 10038863 - DNA, 22 bp, Homo sapiens
ttacagaatgttcttccaacag

SEQ ID NO: 10038864 - DNA, 22 bp, Homo sapiens
tgtcttttataactgacatata

SEQ ID NO: 10038865 - DNA, 22 bp, Homo sapiens
tgttgagtatatacctacaagt

SEQ ID NO: 10038866 - DNA, 22 bp, Homo sapiens
tgttctttggcttcacagctct

SEQ ID NO: 10038867 - DNA, 22 bp, Homo sapiens
tgttaaatgctcagctcgggga

SEQ ID NO: 10038868 - DNA, 22 bp, Homo sapiens
tgttaaatgttttgctagtgtc

SEQ ID NO: 10038869 - DNA, 22 bp, Homo sapiens
tgttaaatgttcctttactgga

SEQ ID NO: 10038870 - DNA, 22 bp, Homo sapiens
tgtttttccatgtgcagaacaa

SEQ ID NO: 10038871 - DNA, 17 bp, Homo sapiens
tgttttttccctgttct

SEQ ID NO: 10038872 - DNA, 22 bp, Homo sapiens
tgtggctcggccagctgctgaa

SEQ ID NO: 10038873 - DNA, 21 bp, Homo sapiens
tgcactttgggggacaggctg

SEQ ID NO: 10038874 - DNA, 22 bp, Homo sapiens
tgcactttgcaggcatggaaac

SEQ ID NO: 10038875 - DNA, 22 bp, Homo sapiens
tgcacgtgtgagcattcacatg

SEQ ID NO: 10038876 - DNA, 22 bp, Homo sapiens
tgcacgtgggctctctgctctt

SEQ ID NO: 10038877 - DNA, 22 bp, Homo sapiens
tgcagaaggaggaggaaatcca

SEQ ID NO: 10038878 - DNA, 22 bp, Homo sapiens
tgagtggacacctgcttcttta

SEQ ID NO: 10038879 - DNA, 22 bp, Homo sapiens
tgataccctttggctgcgagca

SEQ ID NO: 10038880 - DNA, 22 bp, Homo sapiens
tgcaagaaaggtggggccaggc

SEQ ID NO: 10038881 - DNA, 22 bp, Homo sapiens
tgcaagaaacatattccacaag

SEQ ID NO: 10038882 - DNA, 22 bp, Homo sapiens
tgcaagaaggcaataaactctt

SEQ ID NO: 10038883 - DNA, 17 bp, Homo sapiens
tgcaagaagattaggaa

SEQ ID NO: 10038884 - DNA, 22 bp, Homo sapiens
tgcaagaaatgtgaagctacaa

SEQ ID NO: 10038885 - DNA, 22 bp, Homo sapiens
tgcaagaatgacccatctaccc

SEQ ID NO: 10038886 - DNA, 22 bp, Homo sapiens
tgcaagaatgacccatctaccc

SEQ ID NO: 10038887 - DNA, 22 bp, Homo sapiens
tgcaagaattgtataccctcat

SEQ ID NO: 10038888 - DNA, 22 bp, Homo sapiens
tgcaagaagtcctctctgggtg

SEQ ID NO: 10038889 - DNA, 21 bp, Homo sapiens
tgcaagaatcaggaagctgcc

SEQ ID NO: 10038890 - DNA, 22 bp, Homo sapiens
tgcacaaacacagagaatagat

SEQ ID NO: 10038891 - DNA, 22 bp, Homo sapiens
tgcaaaaattgctggaatcttt

SEQ ID NO: 10038892 - DNA, 22 bp, Homo sapiens
tgcaaaacttctcagagccttt

SEQ ID NO: 10038893 - DNA, 22 bp, Homo sapiens
tgcaaaaactgcaattgctttt

SEQ ID NO: 10038894 - DNA, 22 bp, Homo sapiens
tgcaaaaaggcagactggtgat

SEQ ID NO: 10038895 - DNA, 22 bp, Homo sapiens
tgcaaaaagagcgaggagccct

SEQ ID NO: 10038896 - DNA, 22 bp, Homo sapiens
tgcataaaatatgagaaatgta

SEQ ID NO: 10038897 - DNA, 22 bp, Homo sapiens
tgcaggctgggaagagggacaa

SEQ ID NO: 10038898 - DNA, 22 bp, Homo sapiens
tgcaggctggcagtgctgaaat

SEQ ID NO: 10038899 - DNA, 22 bp, Homo sapiens
tgcaggctggggaggcagactt

SEQ ID NO: 10038900 - DNA, 22 bp, Homo sapiens
tgcaggctccatgaggacaggc

SEQ ID NO: 10038901 - DNA, 22 bp, Homo sapiens
tgcaggctctgtgtgtgcctgg

SEQ ID NO: 10038902 - DNA, 22 bp, Homo sapiens
tgcaggctcttggtgacgtggg

SEQ ID NO: 10038903 - DNA, 21 bp, Homo sapiens
tgcaggctgtgcgctcctgcc

SEQ ID NO: 10038904 - DNA, 17 bp, Homo sapiens
tgcaggctgttatagcc

SEQ ID NO: 10038905 - DNA, 21 bp, Homo sapiens
tgcaggctgtttaagaggcaa

SEQ ID NO: 10038906 - DNA, 22 bp, Homo sapiens
tgcaggtgtggttcctcagcca

SEQ ID NO: 10038907 - DNA, 22 bp, Homo sapiens
tgccatttgccccagcactgtc

SEQ ID NO: 10038908 - DNA, 22 bp, Homo sapiens
tgaaataacttttgggtgagtt

SEQ ID NO: 10038909 - DNA, 22 bp, Homo sapiens
tgaaaatgcacgctggaaagca

SEQ ID NO: 10038910 - DNA, 22 bp, Homo sapiens
tgactggattgtcattacgacg

SEQ ID NO: 10038911 - DNA, 22 bp, Homo sapiens
tgactacaacctccacctcccg

SEQ ID NO: 10038912 - DNA, 22 bp, Homo sapiens
tgacctgtgtttgctgttgctc

SEQ ID NO: 10038913 - DNA, 18 bp, Homo sapiens
tgacatttccagagtgta

SEQ ID NO: 10038914 - DNA, 22 bp, Homo sapiens
tgacatttatcaaagaaatggt

SEQ ID NO: 10038915 - DNA, 22 bp, Homo sapiens
tgaggaaattgaggctcacaga

SEQ ID NO: 10038916 - DNA, 22 bp, Homo sapiens
tgagctccggcatatggaatta

SEQ ID NO: 10038917 - DNA, 22 bp, Homo sapiens
tgagcagggactttggagtctg

SEQ ID NO: 10038918 - DNA, 22 bp, Homo sapiens
tgagcagggactttgagtgtag

SEQ ID NO: 10038919 - DNA, 22 bp, Homo sapiens
tgagcaggactgaccggcctta

SEQ ID NO: 10038920 - DNA, 22 bp, Homo sapiens
tgagcaggactcactgcagcct

SEQ ID NO: 10038921 - DNA, 22 bp, Homo sapiens
tgagcaggagataaacaggtag

SEQ ID NO: 10038922 - DNA, 21 bp, Homo sapiens
tgagcaggagtcatgggaatg

SEQ ID NO: 10038923 - DNA, 22 bp, Homo sapiens
tgagcaggcaaacaatggttat

SEQ ID NO: 10038924 - DNA, 22 bp, Homo sapiens
tgagcaggattcgcctcttgca

SEQ ID NO: 10038925 - DNA, 22 bp, Homo sapiens
tgagcaggcgcagcaggaggtc

SEQ ID NO: 10038926 - DNA, 22 bp, Homo sapiens
tgagcaggctcccacttcagtg

SEQ ID NO: 10038927 - DNA, 22 bp, Homo sapiens
tgagaaatgggtctgctgaaga

SEQ ID NO: 10038928 - DNA, 18 bp, Homo sapiens
tgagaatgtaagaaatgg

SEQ ID NO: 10038929 - DNA, 22 bp, Homo sapiens
tgagaatgtgcaatatccttcc

SEQ ID NO: 10038930 - DNA, 22 bp, Homo sapiens
tctaaattactttgggcagtat

SEQ ID NO: 10038931 - DNA, 19 bp, Homo sapiens
tctcaatgttcagaaagct

SEQ ID NO: 10038932 - DNA, 22 bp, Homo sapiens
tctaaagatttggattcatttg

SEQ ID NO: 10038933 - DNA, 22 bp, Homo sapiens
tctgaaatggggctgaagcact

SEQ ID NO: 10038934 - DNA, 22 bp, Homo sapiens
tctgaaattgttagtaaaaatg

SEQ ID NO: 10038935 - DNA, 22 bp, Homo sapiens
tctctttgtctgctcttagttg

SEQ ID NO: 10038936 - DNA, 22 bp, Homo sapiens
tctcgctctgtcgcccaggctg

SEQ ID NO: 10038937 - DNA, 22 bp, Homo sapiens
tctgggaagtcctctgtcatgc

SEQ ID NO: 10038938 - DNA, 22 bp, Homo sapiens
tctgcaaacttaagttgaaata

SEQ ID NO: 10038939 - DNA, 22 bp, Homo sapiens
tctgttgactcctagcagccat

SEQ ID NO: 10038940 - DNA, 22 bp, Homo sapiens
tctgttgaccaagtcttcttcc

SEQ ID NO: 10038941 - DNA, 22 bp, Homo sapiens
tctgttttgcataatgttcttt

SEQ ID NO: 10038942 - DNA, 23 bp, Homo sapiens
tctgttttgcaacatgtgacaag

SEQ ID NO: 10038943 - DNA, 22 bp, Homo sapiens
tctgttttcatttgtcttgaga

SEQ ID NO: 10038944 - DNA, 22 bp, Homo sapiens
tctgtttttgaggctatcttct

SEQ ID NO: 10038945 - DNA, 22 bp, Homo sapiens
tctgttttgtgtctctctggtg

SEQ ID NO: 10038946 - DNA, 22 bp, Homo sapiens
tctgttttgtgtctctctggtg

SEQ ID NO: 10038947 - DNA, 19 bp, Homo sapiens
tctttcatttctagctctg

SEQ ID NO: 10038948 - DNA, 21 bp, Homo sapiens
aagaggaagcattatggcata

SEQ ID NO: 10038949 - DNA, 22 bp, Homo sapiens
aagacaatattgctgtgaacgt

SEQ ID NO: 10038950 - DNA, 22 bp, Homo sapiens
aagacaatgtttctgatagata

SEQ ID NO: 10038951 - DNA, 22 bp, Homo sapiens
aagacaatttgatactagttgc

SEQ ID NO: 10038952 - DNA, 22 bp, Homo sapiens
aagacaattttgagtatgcaca

SEQ ID NO: 10038953 - DNA, 22 bp, Homo sapiens
acaactgtcttcttcatgctcc

SEQ ID NO: 10038954 - DNA, 22 bp, Homo sapiens
aactctatttaccctactaaac

SEQ ID NO: 10038955 - DNA, 21 bp, Homo sapiens
aaggaaaagcttggtctctga

SEQ ID NO: 10038956 - DNA, 22 bp, Homo sapiens
aaattgctaaattgtaagaggg

SEQ ID NO: 10038957 - DNA, 23 bp, Homo sapiens
aaggcattggcttctctcatttc

SEQ ID NO: 10038958 - DNA, 22 bp, Homo sapiens
aacactgtaacagcatcatttt

SEQ ID NO: 10038959 - DNA, 22 bp, Homo sapiens
aagtcaaagctttcagaggaaa

SEQ ID NO: 10038960 - DNA, 19 bp, Homo sapiens
aaaaagaggctataatatt

SEQ ID NO: 10038961 - DNA, 22 bp, Homo sapiens
aaacaaagccagggaagttatg

SEQ ID NO: 10038962 - DNA, 22 bp, Homo sapiens
aaacaaatagtgcatgggaatt

SEQ ID NO: 10038963 - DNA, 22 bp, Homo sapiens
aaacaaatttcaagctgtgaca

SEQ ID NO: 10038964 - DNA, 22 bp, Homo sapiens
aaaataggtacggattagaatg

SEQ ID NO: 10038965 - DNA, 22 bp, Homo sapiens
aaatacagattccagggtctta

SEQ ID NO: 10038966 - DNA, 22 bp, Homo sapiens
aaatgctacatacacatcaggg

SEQ ID NO: 10038967 - DNA, 22 bp, Homo sapiens
aaatgctaacaaggaatgctgc

SEQ ID NO: 10038968 - DNA, 22 bp, Homo sapiens
aaatgctagggagaaactctcc

SEQ ID NO: 10038969 - DNA, 22 bp, Homo sapiens
aaagcaatcagattcagatgtc

SEQ ID NO: 10038970 - DNA, 22 bp, Homo sapiens
aaagcaatgcccgttcattatc

SEQ ID NO: 10038971 - DNA, 22 bp, Homo sapiens
aaatatccataagcacatctat

SEQ ID NO: 10038972 - DNA, 22 bp, Homo sapiens
aagcagagttagcttgtcacct

SEQ ID NO: 10038973 - DNA, 22 bp, Homo sapiens
aaatggctttgagggtaggaca

SEQ ID NO: 10038974 - DNA, 22 bp, Homo sapiens
aaatggctacaagatgtgctct

SEQ ID NO: 10038975 - DNA, 22 bp, Homo sapiens
aaatggctgactaaattaaatt

SEQ ID NO: 10038976 - DNA, 22 bp, Homo sapiens
aacaatgtgttcagcactgtgg

SEQ ID NO: 10038977 - DNA, 22 bp, Homo sapiens
aacaatgtgattgaagctagaa

SEQ ID NO: 10038978 - DNA, 22 bp, Homo sapiens
aacaatgttcttttagcttgaa

SEQ ID NO: 10038979 - DNA, 22 bp, Homo sapiens
agatatatttcctgcccaaggc

SEQ ID NO: 10038980 - DNA, 22 bp, Homo sapiens
aattcagtaatcattaatgatg

SEQ ID NO: 10038981 - DNA, 22 bp, Homo sapiens
agagaaagtcctgatctctcta

SEQ ID NO: 10038982 - DNA, 22 bp, Homo sapiens
agccttagaggaaaacattagt

SEQ ID NO: 10038983 - DNA, 22 bp, Homo sapiens
acaggaaatgaaatggtatcta

SEQ ID NO: 10038984 - DNA, 22 bp, Homo sapiens
acaggaaagagctaggcatagg

SEQ ID NO: 10038985 - DNA, 22 bp, Homo sapiens
acatgtgtgtatacgtatttat

SEQ ID NO: 10038986 - DNA, 22 bp, Homo sapiens
aagtgggaatagaaatgaaggt

SEQ ID NO: 10038987 - DNA, 20 bp, Homo sapiens
agaaaatgttttcagctgga

SEQ ID NO: 10038988 - DNA, 22 bp, Homo sapiens
agaaaatgtgaacttgtgaatt

SEQ ID NO: 10038989 - DNA, 22 bp, Homo sapiens
aatatgcagcatgatgaagtaa

SEQ ID NO: 10038990 - DNA, 22 bp, Homo sapiens
aatatgcaaataggtgtaatga

SEQ ID NO: 10038991 - DNA, 22 bp, Homo sapiens
aatatgcaaagcgtgttatctg

SEQ ID NO: 10038992 - DNA, 22 bp, Homo sapiens
aatatgcattaactgtgtacat

SEQ ID NO: 10038993 - DNA, 22 bp, Homo sapiens
aatatgcatgtatacatgtgta

SEQ ID NO: 10038994 - DNA, 22 bp, Homo sapiens
agcagcagatccaaaaaatgtg

SEQ ID NO: 10038995 - DNA, 22 bp, Homo sapiens
cactgtgtctggagtgagctgg

SEQ ID NO: 10038996 - DNA, 22 bp, Homo sapiens
agcagtaagcaactgagcttgc

SEQ ID NO: 10038997 - DNA, 23 bp, Homo sapiens
agcaggctgcttctccacagctg

SEQ ID NO: 10038998 - DNA, 22 bp, Homo sapiens
cagatgaagatcatagaatagt

SEQ ID NO: 10038999 - DNA, 22 bp, Homo sapiens
agagaatgcagggcttcggaca

SEQ ID NO: 10039000 - DNA, 22 bp, Homo sapiens
agaatatgatcggaatacagat

SEQ ID NO: 10039001 - DNA, 22 bp, Homo sapiens
agagtattgtgaccatttgtca

SEQ ID NO: 10039002 - DNA, 22 bp, Homo sapiens
agcaagaatatttctgccactg

SEQ ID NO: 10039003 - DNA, 21 bp, Homo sapiens
agcaagaatcaggaaggctct

SEQ ID NO: 10039004 - DNA, 20 bp, Homo sapiens
agcaagaaggttgtgggagc

SEQ ID NO: 10039005 - DNA, 22 bp, Homo sapiens
agcaagaaaatctctgtccaat

SEQ ID NO: 10039006 - DNA, 22 bp, Homo sapiens
agcaagaaatcttcagtgttct

SEQ ID NO: 10039007 - DNA, 22 bp, Homo sapiens
agcaagaagctttgctgtgata

SEQ ID NO: 10039008 - DNA, 22 bp, Homo sapiens
agcaagaagggcaaggaagttt

SEQ ID NO: 10039009 - DNA, 22 bp, Homo sapiens
agcaagaagggcaaggaagttt

SEQ ID NO: 10039010 - DNA, 20 bp, Homo sapiens
agcaagaacgttctgaggga

SEQ ID NO: 10039011 - DNA, 22 bp, Homo sapiens
caaagcaagggctgaagactcc

SEQ ID NO: 10039012 - DNA, 22 bp, Homo sapiens
attggtcacctccctcagctct

SEQ ID NO: 10039013 - DNA, 22 bp, Homo sapiens
attggccatttgcatgtattat

SEQ ID NO: 10039014 - DNA, 22 bp, Homo sapiens
agatcacagtggcaactccctt

SEQ ID NO: 10039015 - DNA, 22 bp, Homo sapiens
acatctttgctcttatagagct

SEQ ID NO: 10039016 - DNA, 22 bp, Homo sapiens
acatctttttggaaacggctga

SEQ ID NO: 10039017 - DNA, 22 bp, Homo sapiens
acatcttttactctggttcggg

SEQ ID NO: 10039018 - DNA, 22 bp, Homo sapiens
acatctttgtttcttagtgtat

SEQ ID NO: 10039019 - DNA, 22 bp, Homo sapiens
acatcttttttctctaattgtg

SEQ ID NO: 10039020 - DNA, 22 bp, Homo sapiens
acatacatggattcatggattc

SEQ ID NO: 10039021 - DNA, 22 bp, Homo sapiens
agcttatcttgttagtttcatt

SEQ ID NO: 10039022 - DNA, 22 bp, Homo sapiens
atcagtctgttggaatatcgct

SEQ ID NO: 10039023 - DNA, 22 bp, Homo sapiens
agaaaaagtcaaggaattggac

SEQ ID NO: 10039024 - DNA, 22 bp, Homo sapiens
agaaatcccaaggcatcaacca

SEQ ID NO: 10039025 - DNA, 22 bp, Homo sapiens
acttctatgcacagagcttgga

SEQ ID NO: 10039026 - DNA, 22 bp, Homo sapiens
actgttttctgtaaagggccag

SEQ ID NO: 10039027 - DNA, 22 bp, Homo sapiens
agtactgtcagcagggtgttga

SEQ ID NO: 10039028 - DNA, 22 bp, Homo sapiens
accttcctctaagacatttagc

SEQ ID NO: 10039029 - DNA, 22 bp, Homo sapiens
cctgagtagctggaattaaagg

SEQ ID NO: 10039030 - DNA, 22 bp, Homo sapiens
agtaaacagtttcttagaagaa

SEQ ID NO: 10039031 - DNA, 22 bp, Homo sapiens
agtaacaaagtgggagaatgat

SEQ ID NO: 10039032 - DNA, 22 bp, Homo sapiens
agtgcttttatatcattaatcc

SEQ ID NO: 10039033 - DNA, 22 bp, Homo sapiens
agtgaaatagcatttatgaagc

SEQ ID NO: 10039034 - DNA, 22 bp, Homo sapiens
agttaacacaagtaagattcca

SEQ ID NO: 10039035 - DNA, 22 bp, Homo sapiens
ataaaagatcccttctgagctc

SEQ ID NO: 10039036 - DNA, 22 bp, Homo sapiens
cttaaattttcatctacaagaa

SEQ ID NO: 10039037 - DNA, 22 bp, Homo sapiens
atctgtgtccttataagagaca

SEQ ID NO: 10039038 - DNA, 22 bp, Homo sapiens
catcatttcacttagatgaagt

SEQ ID NO: 10039039 - DNA, 22 bp, Homo sapiens
aggcaggccctctggaaaggta

SEQ ID NO: 10039040 - DNA, 22 bp, Homo sapiens
aggcaggcccctgagaatagac

SEQ ID NO: 10039041 - DNA, 22 bp, Homo sapiens
agctgcctagtagattgattgg

SEQ ID NO: 10039042 - DNA, 22 bp, Homo sapiens
agctgcctggagtcatttcctg

SEQ ID NO: 10039043 - DNA, 22 bp, Homo sapiens
agctgcctccctgtgcttgtcc

SEQ ID NO: 10039044 - DNA, 21 bp, Homo sapiens
agctgcctccacttctgaggc

SEQ ID NO: 10039045 - DNA, 21 bp, Homo sapiens
agctgcctgctctggacctgg

SEQ ID NO: 10039046 - DNA, 22 bp, Homo sapiens
agctgcctctgctggtttagaa

SEQ ID NO: 10039047 - DNA, 22 bp, Homo sapiens
caggaaatgctatcatagctga

SEQ ID NO: 10039048 - DNA, 17 bp, Homo sapiens
caggaaaatatgagtga

SEQ ID NO: 10039049 - DNA, 23 bp, Homo sapiens
cccatgctgggcgcagtgaatgg

SEQ ID NO: 10039050 - DNA, 21 bp, Homo sapiens
cctgaaattctcactagctta

SEQ ID NO: 10039051 - DNA, 22 bp, Homo sapiens
cctgaaatgactccagctgagt

SEQ ID NO: 10039052 - DNA, 22 bp, Homo sapiens
cagataacacaaagaaatgggc

SEQ ID NO: 10039053 - DNA, 20 bp, Homo sapiens
gcttccacctgaagcgcacc

SEQ ID NO: 10039054 - DNA, 22 bp, Homo sapiens
cagaaatgtttgttaatattgt

SEQ ID NO: 10039055 - DNA, 22 bp, Homo sapiens
gctacaaactgtcatggtgctt

SEQ ID NO: 10039056 - DNA, 22 bp, Homo sapiens
caaatccagatcccagtcgtag

SEQ ID NO: 10039057 - DNA, 22 bp, Homo sapiens
caaatgaatttccctgcaaatg

SEQ ID NO: 10039058 - DNA, 22 bp, Homo sapiens
gaggctttataactatttgttc

SEQ ID NO: 10039059 - DNA, 22 bp, Homo sapiens
gagttaaatattttctgaagtt

SEQ ID NO: 10039060 - DNA, 22 bp, Homo sapiens
gagttaaagtacctttgtatgt

SEQ ID NO: 10039061 - DNA, 17 bp, Homo sapiens
atgtaagaagaaagcag

SEQ ID NO: 10039062 - DNA, 22 bp, Homo sapiens
atgtaaagtatctgaaatgctg

SEQ ID NO: 10039063 - DNA, 22 bp, Homo sapiens
atggttattactgctgttccag

SEQ ID NO: 10039064 - DNA, 22 bp, Homo sapiens
gaaaatgcctctggcattaaac

SEQ ID NO: 10039065 - DNA, 22 bp, Homo sapiens
gaaatcttccaatggtcacatc

SEQ ID NO: 10039066 - DNA, 22 bp, Homo sapiens
atgaattgaaagaagaatatct

SEQ ID NO: 10039067 - DNA, 22 bp, Homo sapiens
gaaaagaactgcatgggattaa

SEQ ID NO: 10039068 - DNA, 22 bp, Homo sapiens
gaaaataggctgcatctccttc

SEQ ID NO: 10039069 - DNA, 22 bp, Homo sapiens
gacataaaccttgagatattaa

SEQ ID NO: 10039070 - DNA, 21 bp, Homo sapiens
tgaaacaatcagacagagtct

SEQ ID NO: 10039071 - DNA, 22 bp, Homo sapiens
tgagcaggggagagcgaatgtg

SEQ ID NO: 10039072 - DNA, 22 bp, Homo sapiens
tgagcagggagctgggctgagc

SEQ ID NO: 10039073 - DNA, 18 bp, Homo sapiens
tgagcaggggctgacctt

SEQ ID NO: 10039074 - DNA, 22 bp, Homo sapiens
tgagcaggtcaagactccagct

SEQ ID NO: 10039075 - DNA, 22 bp, Homo sapiens
tgagcaggtcaggaagtacatt

SEQ ID NO: 10039076 - DNA, 22 bp, Homo sapiens
tgagcaggtgagtctagggcag

SEQ ID NO: 10039077 - DNA, 21 bp, Homo sapiens
tgagcaggtgcagggaagtgg

SEQ ID NO: 10039078 - DNA, 21 bp, Homo sapiens
tgagcaggtgctgcttttatg

SEQ ID NO: 10039079 - DNA, 22 bp, Homo sapiens
tgagtttagtgtgagacttatc

SEQ ID NO: 10039080 - DNA, 22 bp, Homo sapiens
tgcaaatattgggacagtctag

SEQ ID NO: 10039081 - DNA, 22 bp, Homo sapiens
tgcagctgattaaagggcagac

SEQ ID NO: 10039082 - DNA, 21 bp, Homo sapiens
tgggatagaaatatggctgct

SEQ ID NO: 10039083 - DNA, 22 bp, Homo sapiens
tggagaatggaatgttgtgcag

SEQ ID NO: 10039084 - DNA, 23 bp, Homo sapiens
tggagaatgtgtttacttcgtgt

SEQ ID NO: 10039085 - DNA, 22 bp, Homo sapiens
tggagaatgatattccatcatt

SEQ ID NO: 10039086 - DNA, 22 bp, Homo sapiens
tggagaatctggaaactgttga

SEQ ID NO: 10039087 - DNA, 22 bp, Homo sapiens
tggagaattaggccaaatctcc

SEQ ID NO: 10039088 - DNA, 22 bp, Homo sapiens
tggagaattttgtcaccagaca

SEQ ID NO: 10039089 - DNA, 23 bp, Homo sapiens
tggagaattcttccttccactgt

SEQ ID NO: 10039090 - DNA, 23 bp, Homo sapiens
tggagaatttagagtctctagga

SEQ ID NO: 10039091 - DNA, 20 bp, Homo sapiens
catgctgcctccattgatgc

SEQ ID NO: 10039092 - DNA, 22 bp, Homo sapiens
catctacctccaccctatatat

SEQ ID NO: 10039093 - DNA, 22 bp, Homo sapiens
catctaccagaattgctataaa

SEQ ID NO: 10039094 - DNA, 22 bp, Homo sapiens
tcagtttcctggttttaatatt

SEQ ID NO: 10039095 - DNA, 22 bp, Homo sapiens
cagtgaaatcacaactttagtt

SEQ ID NO: 10039096 - DNA, 22 bp, Homo sapiens
cagtctttgatgcatcctagcc

SEQ ID NO: 10039097 - DNA, 22 bp, Homo sapiens
tattccaccagagatgtgaatt

SEQ ID NO: 10039098 - DNA, 22 bp, Homo sapiens
cagtggcagatcaccaactgga

SEQ ID NO: 10039099 - DNA, 22 bp, Homo sapiens
tagaaagacatgggccagcagc

SEQ ID NO: 10039100 - DNA, 22 bp, Homo sapiens
tagaaagactgtccagatttca

SEQ ID NO: 10039101 - DNA, 22 bp, Homo sapiens
tagcatctgtttctctttgtga

SEQ ID NO: 10039102 - DNA, 22 bp, Homo sapiens
tacagcatgatcacaatggaaa

SEQ ID NO: 10039103 - DNA, 22 bp, Homo sapiens
tacagcattaacaggctgttta

SEQ ID NO: 10039104 - DNA, 22 bp, Homo sapiens
tacagcattgcattttcctttg

SEQ ID NO: 10039105 - DNA, 22 bp, Homo sapiens
gaaacaatacttgtcctcacta

SEQ ID NO: 10039106 - DNA, 22 bp, Homo sapiens
gaaacaatcatcatgtgatttg

SEQ ID NO: 10039107 - DNA, 22 bp, Homo sapiens
gaaacaatttttgttgtctaag

SEQ ID NO: 10039108 - DNA, 22 bp, Homo sapiens
cttaaattggatgagttaagtt

SEQ ID NO: 10039109 - DNA, 22 bp, Homo sapiens
cttaaattcttaatgccctcat

SEQ ID NO: 10039110 - DNA, 20 bp, Homo sapiens
cttccacacaagaagcacag

SEQ ID NO: 10039111 - DNA, 22 bp, Homo sapiens
cttctattcactggtcacagtt

SEQ ID NO: 10039112 - DNA, 22 bp, Homo sapiens
gagagaaaaatgagcttcattg

SEQ ID NO: 10039113 - DNA, 22 bp, Homo sapiens
gagagaaagcccctgcatccct

SEQ ID NO: 10039114 - DNA, 22 bp, Homo sapiens
gagacattttaaagagccatgc

SEQ ID NO: 10039115 - DNA, 22 bp, Homo sapiens
gagaaagatgtaggctgggagg

SEQ ID NO: 10039116 - DNA, 22 bp, Homo sapiens
gagaaagacgtaggctgggagg

SEQ ID NO: 10039117 - DNA, 22 bp, Homo sapiens
gactctattcctggggccatag

SEQ ID NO: 10039118 - DNA, 22 bp, Homo sapiens
ttcagtttctaaatgctcctct

SEQ ID NO: 10039119 - DNA, 22 bp, Homo sapiens
cggctgtgtcttcacaggagcc

SEQ ID NO: 10039120 - DNA, 22 bp, Homo sapiens
ttccactggctttcagtgatct

SEQ ID NO: 10039121 - DNA, 22 bp, Homo sapiens
ttgatttttccagcttctagag

SEQ ID NO: 10039122 - DNA, 23 bp, Homo sapiens
ttgaatagggtggcaacaaactg

SEQ ID NO: 10039123 - DNA, 22 bp, Homo sapiens
tgttttctcttgaaaagcagtc

SEQ ID NO: 10039124 - DNA, 22 bp, Homo sapiens
cctgtaggatattgtagaatac

SEQ ID NO: 10039125 - DNA, 20 bp, Homo sapiens
tgttgattggtgtcatctca

SEQ ID NO: 10039126 - DNA, 22 bp, Homo sapiens
tgtttctgtatgatcaatattg

SEQ ID NO: 10039127 - DNA, 22 bp, Homo sapiens
tgtttcttacgtttttagaggc

SEQ ID NO: 10039128 - DNA, 22 bp, Homo sapiens
ttacagaagagaaagaattcag

SEQ ID NO: 10039129 - DNA, 17 bp, Homo sapiens
taaatacacaagggtat

SEQ ID NO: 10039130 - DNA, 22 bp, Homo sapiens
gtttctcacttccagtagccaa

SEQ ID NO: 10039131 - DNA, 22 bp, Homo sapiens
taggacagagttccctgatggc

SEQ ID NO: 10039132 - DNA, 22 bp, Homo sapiens
tagttaaaccaccattctggta

SEQ ID NO: 10039133 - DNA, 22 bp, Homo sapiens
tataccatgtgtgcacactccc

SEQ ID NO: 10039134 - DNA, 22 bp, Homo sapiens
tattgcacatgcgctagaacca

SEQ ID NO: 10039135 - DNA, 22 bp, Homo sapiens
tatttcacataccacagagtgt

SEQ ID NO: 10039136 - DNA, 22 bp, Homo sapiens
tatgctaattgttagtcacatg

SEQ ID NO: 10039137 - DNA, 22 bp, Homo sapiens
tcctcagtctctcaaatgaggc

SEQ ID NO: 10039138 - DNA, 22 bp, Homo sapiens
tcctcagttttctagtatggca

SEQ ID NO: 10039139 - DNA, 22 bp, Homo sapiens
tcccagaatctccagtgctaca

SEQ ID NO: 10039140 - DNA, 22 bp, Homo sapiens
tccacagattaaaaacatactt

SEQ ID NO: 10039141 - DNA, 22 bp, Homo sapiens
tccacagactattaagtgatct

SEQ ID NO: 10039142 - DNA, 22 bp, Homo sapiens
tcatgtttttgccatatgactc

SEQ ID NO: 10039143 - DNA, 22 bp, Homo sapiens
tccacagggatgttgagttctt

SEQ ID NO: 10039144 - DNA, 22 bp, Homo sapiens
tccacagggatgttgagttctt

SEQ ID NO: 10039145 - DNA, 18 bp, Homo sapiens
tccaccagtcaatctgtc

SEQ ID NO: 10039146 - DNA, 22 bp, Homo sapiens
tcaccgaggctggagtgcagtg

SEQ ID NO: 10039147 - DNA, 20 bp, Homo sapiens
tcacatcctctcccaacatg

SEQ ID NO: 10039148 - DNA, 22 bp, Homo sapiens
tcagctttcctgcagctaaggg

SEQ ID NO: 10039149 - DNA, 22 bp, Homo sapiens
ggagagctggtatatgaagaca

SEQ ID NO: 10039150 - DNA, 22 bp, Homo sapiens
gcatctttctgtccattcagca

SEQ ID NO: 10039151 - DNA, 22 bp, Homo sapiens
gcatctttagcctctccgtggc

SEQ ID NO: 10039152 - DNA, 22 bp, Homo sapiens
gcatctaaataaacgtgggagt

SEQ ID NO: 10039153 - DNA, 22 bp, Homo sapiens
gcagtctttgaatgtgaaatag

SEQ ID NO: 10039154 - DNA, 22 bp, Homo sapiens
gcagtgaaaaagtgcaccctgt

SEQ ID NO: 10039155 - DNA, 22 bp, Homo sapiens
gtgcaaaaatctatcaccagca

SEQ ID NO: 10039156 - DNA, 22 bp, Homo sapiens
gtaaattatttcaagatcatct

SEQ ID NO: 10039157 - DNA, 23 bp, Homo sapiens
ggatggacgtgatgccttagcca

SEQ ID NO: 10039158 - DNA, 22 bp, Homo sapiens
ggatgggaacttggtagggcat

SEQ ID NO: 10039159 - DNA, 19 bp, Homo sapiens
tttctaagctaaatgcttc

SEQ ID NO: 10039160 - DNA, 22 bp, Homo sapiens
ttctccatttaacttccttatg

SEQ ID NO: 10039161 - DNA, 22 bp, Homo sapiens
ttctcacaggctggaatgatga

SEQ ID NO: 10039162 - DNA, 22 bp, Homo sapiens
ttgaaacttagaaattgagctg

SEQ ID NO: 10039163 - DNA, 22 bp, Homo sapiens
ttcagacaataagagtcatctc

SEQ ID NO: 10039164 - DNA, 22 bp, Homo sapiens
ttataattctggcataggctgt

SEQ ID NO: 10039165 - DNA, 20 bp, Homo sapiens
ttatttgtttactttggtcc

SEQ ID NO: 10039166 - DNA, 22 bp, Homo sapiens
ttcaaaagtaatcagtattaga

SEQ ID NO: 10039167 - DNA, 22 bp, Homo sapiens
ttcaaaagactcagatgtagcg

SEQ ID NO: 10039168 - DNA, 22 bp, Homo sapiens
tttctattctggatctgtggca

SEQ ID NO: 10039169 - DNA, 22 bp, Homo sapiens
tttctaggtcttccatactgcc

SEQ ID NO: 10039170 - DNA, 20 bp, Homo sapiens
tttgagaccagtctgcccaa

SEQ ID NO: 10039171 - DNA, 22 bp, Homo sapiens
tttgtcatatagactattgtga

SEQ ID NO: 10039172 - DNA, 22 bp, Homo sapiens
tttggcgtctctcaggagctca

SEQ ID NO: 10039173 - DNA, 22 bp, Homo sapiens
acatttgagatgccttttaggt

SEQ ID NO: 10039174 - DNA, 22 bp, Homo sapiens
aggagattgtactgtcatcact

SEQ ID NO: 10039175 - DNA, 22 bp, Homo sapiens
acctgaattttggatgagctgt

SEQ ID NO: 10039176 - DNA, 22 bp, Homo sapiens
acctgaattgatttgacctgta

SEQ ID NO: 10039177 - DNA, 22 bp, Homo sapiens
agtaaacagaaagcaagatgat

SEQ ID NO: 10039178 - DNA, 22 bp, Homo sapiens
agtaaaatcttaagcacagtgg

SEQ ID NO: 10039179 - DNA, 22 bp, Homo sapiens
ataatgcatttagaataattca

SEQ ID NO: 10039180 - DNA, 22 bp, Homo sapiens
ataatgcagcttttcaatggcc

SEQ ID NO: 10039181 - DNA, 22 bp, Homo sapiens
ataaacaagactggccaacttt

SEQ ID NO: 10039182 - DNA, 22 bp, Homo sapiens
agaaagggtcactgaaagagga

SEQ ID NO: 10039183 - DNA, 22 bp, Homo sapiens
atcgcaagtttaaaaatctttg

SEQ ID NO: 10039184 - DNA, 22 bp, Homo sapiens
atcatcttgaaagtctatgttt

SEQ ID NO: 10039185 - DNA, 22 bp, Homo sapiens
atcatcttatctgactcatttt

SEQ ID NO: 10039186 - DNA, 22 bp, Homo sapiens
cacagttatgggaaacgtagtt

SEQ ID NO: 10039187 - DNA, 22 bp, Homo sapiens
cacagtttggtatagaagtgat

SEQ ID NO: 10039188 - DNA, 17 bp, Homo sapiens
agcaggctgcagaggcc

SEQ ID NO: 10039189 - DNA, 22 bp, Homo sapiens
cacagttagaggtagagtccag

SEQ ID NO: 10039190 - DNA, 22 bp, Homo sapiens
caaatagattgttcaatcctga

SEQ ID NO: 10039191 - DNA, 22 bp, Homo sapiens
cagagaaaaaatcctgctctca

SEQ ID NO: 10039192 - DNA, 22 bp, Homo sapiens
cagagaaactcagatagctgat

SEQ ID NO: 10039193 - DNA, 22 bp, Homo sapiens
cagagaaagggtgaattccttc

SEQ ID NO: 10039194 - DNA, 22 bp, Homo sapiens
cagagaaagaagcccattcatt

SEQ ID NO: 10039195 - DNA, 19 bp, Homo sapiens
cagaaatagcgaagtgtaa

SEQ ID NO: 10039196 - DNA, 22 bp, Homo sapiens
cagaaatatcagttgaaagtgc

SEQ ID NO: 10039197 - DNA, 22 bp, Homo sapiens
cagaaatattccaagtactgca

SEQ ID NO: 10039198 - DNA, 22 bp, Homo sapiens
cagaaatatttattgagtgaca

SEQ ID NO: 10039199 - DNA, 22 bp, Homo sapiens
cagcagtttcctatggttcagc

SEQ ID NO: 10039200 - DNA, 22 bp, Homo sapiens
atgaaagatgatttaaagtact

SEQ ID NO: 10039201 - DNA, 22 bp, Homo sapiens
atgaaactctaacttaacaagt

SEQ ID NO: 10039202 - DNA, 21 bp, Homo sapiens
attccacttttccttcaggga

SEQ ID NO: 10039203 - DNA, 22 bp, Homo sapiens
caaaaggcaggggaaagagtgc

SEQ ID NO: 10039204 - DNA, 22 bp, Homo sapiens
atttctcatgtacaaaaacact

SEQ ID NO: 10039205 - DNA, 22 bp, Homo sapiens
atttctcatgtacaaaaacact

SEQ ID NO: 10039206 - DNA, 22 bp, Homo sapiens
atttctcattttgcttcaaagg

SEQ ID NO: 10039207 - DNA, 22 bp, Homo sapiens
atttcacaaagaacagatgcag

SEQ ID NO: 10039208 - DNA, 22 bp, Homo sapiens
aagcacagctggaacagcagga

SEQ ID NO: 10039209 - DNA, 22 bp, Homo sapiens
aagcagagtccccttcccatgg

SEQ ID NO: 10039210 - DNA, 22 bp, Homo sapiens
aaccaccattctctcctcttcc

SEQ ID NO: 10039211 - DNA, 22 bp, Homo sapiens
aagtccaccagtcagactagga

SEQ ID NO: 10039212 - DNA, 22 bp, Homo sapiens
aacaaagtcgttgcctagaaga

SEQ ID NO: 10039213 - DNA, 20 bp, Homo sapiens
aaaaacagtaatgctgaaga

SEQ ID NO: 10039214 - DNA, 22 bp, Homo sapiens
aaaatgacattccagtgatatt

SEQ ID NO: 10039215 - DNA, 22 bp, Homo sapiens
aaaatccacaacgctcatttca

SEQ ID NO: 10039216 - DNA, 22 bp, Homo sapiens
aaaagagagctgaggagctcca

SEQ ID NO: 10039217 - DNA, 22 bp, Homo sapiens
aaagaatttgtacaccctacta

SEQ ID NO: 10039218 - DNA, 22 bp, Homo sapiens
aaacctgtctgattatggagac

SEQ ID NO: 10039219 - DNA, 22 bp, Homo sapiens
aaaggtcttgtcttgacagagt

SEQ ID NO: 10039220 - DNA, 22 bp, Homo sapiens
aaaggtctacatcactgaaaga

SEQ ID NO: 10039221 - DNA, 22 bp, Homo sapiens
aaagggctgatgtgacatagct

SEQ ID NO: 10039222 - DNA, 22 bp, Homo sapiens
aaacaatgttgtctccaagagg

SEQ ID NO: 10039223 - DNA, 23 bp, Homo sapiens
aaataggagtatctggatcatga

SEQ ID NO: 10039224 - DNA, 22 bp, Homo sapiens
aaaggaaaataagtagttccat

SEQ ID NO: 10039225 - DNA, 22 bp, Homo sapiens
aaagtgggaacaatggagagtg

SEQ ID NO: 10039226 - DNA, 22 bp, Homo sapiens
aaagtatctgaccgattataaa

SEQ ID NO: 10039227 - DNA, 22 bp, Homo sapiens
aaagtagagttgtggaattact

SEQ ID NO: 10039228 - DNA, 22 bp, Homo sapiens
agaaaaatcttggcgcttgtct

SEQ ID NO: 10039229 - DNA, 22 bp, Homo sapiens
aatccatttactctttacaaga

SEQ ID NO: 10039230 - DNA, 22 bp, Homo sapiens
aagtttcattgttcatgtaaca

SEQ ID NO: 10039231 - DNA, 22 bp, Homo sapiens
aataagattgacacaagtacct

SEQ ID NO: 10039232 - DNA, 22 bp, Homo sapiens
aaggaaatacaacatgtattca

SEQ ID NO: 10039233 - DNA, 22 bp, Homo sapiens
acaggcaggtaatttacatatt

SEQ ID NO: 10039234 - DNA, 22 bp, Homo sapiens
accatgtcatttattggccaaa

SEQ ID NO: 10039235 - DNA, 22 bp, Homo sapiens
acagcaaaggacgaacactctg

SEQ ID NO: 10039236 - DNA, 22 bp, Homo sapiens
acacatatctaagatagatgac

SEQ ID NO: 10039237 - DNA, 22 bp, Homo sapiens
agcaggaaagaaaaatctgtgt

SEQ ID NO: 10039238 - DNA, 22 bp, Homo sapiens
acaagttaggttttaatccaaa

SEQ ID NO: 10039239 - DNA, 22 bp, Homo sapiens
aattatggtatgttcaacaact

SEQ ID NO: 10039240 - DNA, 22 bp, Homo sapiens
ctttggcttgcactattacact

SEQ ID NO: 10039241 - DNA, 19 bp, Homo sapiens
ctttgcttgtttctgtgtc

SEQ ID NO: 10039242 - DNA, 22 bp, Homo sapiens
ctttctttcgaagacgtgatta

SEQ ID NO: 10039243 - DNA, 22 bp, Homo sapiens
gaatttgtcccttgatataaaa

SEQ ID NO: 10039244 - DNA, 22 bp, Homo sapiens
gaatttcctctaaacccctgag

SEQ ID NO: 10039245 - DNA, 22 bp, Homo sapiens
atgctaaattcagacagggtta

SEQ ID NO: 10039246 - DNA, 22 bp, Homo sapiens
atggctcttgaattgatactct

SEQ ID NO: 10039247 - DNA, 22 bp, Homo sapiens
atggcaaaaattaacagatcaa

SEQ ID NO: 10039248 - DNA, 22 bp, Homo sapiens
atgtggctgccacctgcctgaa

SEQ ID NO: 10039249 - DNA, 22 bp, Homo sapiens
gccatgactctccataccaaag

SEQ ID NO: 10039250 - DNA, 21 bp, Homo sapiens
caaaagagactgattcttgga

SEQ ID NO: 10039251 - DNA, 22 bp, Homo sapiens
caaagaaggaactataatccca

SEQ ID NO: 10039252 - DNA, 22 bp, Homo sapiens
caaagaagagatttacagagct

SEQ ID NO: 10039253 - DNA, 22 bp, Homo sapiens
caaagacacgggaaacaacgtt

SEQ ID NO: 10039254 - DNA, 22 bp, Homo sapiens
atttggctgtagtaactggatc

SEQ ID NO: 10039255 - DNA, 22 bp, Homo sapiens
atttgtcaataagatgaacata

SEQ ID NO: 10039256 - DNA, 20 bp, Homo sapiens
attccacttatatgaggtcc

SEQ ID NO: 10039257 - DNA, 22 bp, Homo sapiens
attctttccagacactgattgc

SEQ ID NO: 10039258 - DNA, 22 bp, Homo sapiens
attctttcatataaaggctcag

SEQ ID NO: 10039259 - DNA, 22 bp, Homo sapiens
gcagtaaataattttgtgtata

SEQ ID NO: 10039260 - DNA, 22 bp, Homo sapiens
gcaggttagatttaatccattc

SEQ ID NO: 10039261 - DNA, 22 bp, Homo sapiens
attatccagcaccaatgtcaga

SEQ ID NO: 10039262 - DNA, 22 bp, Homo sapiens
attataggcttgagccaccgtg

SEQ ID NO: 10039263 - DNA, 22 bp, Homo sapiens
attaaattggatctgcatagtt

SEQ ID NO: 10039264 - DNA, 22 bp, Homo sapiens
attaaattggacgctgggggaa

SEQ ID NO: 10039265 - DNA, 22 bp, Homo sapiens
attaaattagcaaactgtgaaa

SEQ ID NO: 10039266 - DNA, 22 bp, Homo sapiens
attaaattttcactaggctccc

SEQ ID NO: 10039267 - DNA, 22 bp, Homo sapiens
gattcactcatattttacgttt

SEQ ID NO: 10039268 - DNA, 22 bp, Homo sapiens
cactgcaacctccacctcctgg

SEQ ID NO: 10039269 - DNA, 21 bp, Homo sapiens
cactccacttagaacagggtt

SEQ ID NO: 10039270 - DNA, 22 bp, Homo sapiens
caagaatataaatactttcaaa

SEQ ID NO: 10039271 - DNA, 22 bp, Homo sapiens
caagaagtcatttagcctctca

SEQ ID NO: 10039272 - DNA, 22 bp, Homo sapiens
cagaaaatagagtttctctgag

SEQ ID NO: 10039273 - DNA, 22 bp, Homo sapiens
agggaaatggagagtgtagttt

SEQ ID NO: 10039274 - DNA, 20 bp, Homo sapiens
cagtgcccgtggaaaagatg

SEQ ID NO: 10039275 - DNA, 22 bp, Homo sapiens
cagtggcgtgatctctgctcac

SEQ ID NO: 10039276 - DNA, 22 bp, Homo sapiens
aggttattctctatctcatccc

SEQ ID NO: 10039277 - DNA, 22 bp, Homo sapiens
agtgcagctccctcacctgctt

SEQ ID NO: 10039278 - DNA, 22 bp, Homo sapiens
agtgcagagacctggtcaggca

SEQ ID NO: 10039279 - DNA, 22 bp, Homo sapiens
ctgttagtgatcaaagggagag

SEQ ID NO: 10039280 - DNA, 22 bp, Homo sapiens
ctgttagtcttttgcaggagag

SEQ ID NO: 10039281 - DNA, 22 bp, Homo sapiens
agtttcagttctgtcatttata

SEQ ID NO: 10039282 - DNA, 22 bp, Homo sapiens
agtttcaattcttttcacaaag

SEQ ID NO: 10039283 - DNA, 22 bp, Homo sapiens
atacagaagaactatagccact

SEQ ID NO: 10039284 - DNA, 22 bp, Homo sapiens
atacagaactctcagttgtata

SEQ ID NO: 10039285 - DNA, 22 bp, Homo sapiens
cagttaaagtgcttatcacaga

SEQ ID NO: 10039286 - DNA, 22 bp, Homo sapiens
cagttaaatgatgtgccctaga

SEQ ID NO: 10039287 - DNA, 22 bp, Homo sapiens
cagttaaattctccagttacca

SEQ ID NO: 10039288 - DNA, 22 bp, Homo sapiens
cagttaaacgggccatgtgagt

SEQ ID NO: 10039289 - DNA, 22 bp, Homo sapiens
cagttaaagctgcatgtgtcag

SEQ ID NO: 10039290 - DNA, 22 bp, Homo sapiens
cagttaaaatgtgctataagaa

SEQ ID NO: 10039291 - DNA, 22 bp, Homo sapiens
cagttaaacagattgagtgtta

SEQ ID NO: 10039292 - DNA, 22 bp, Homo sapiens
cagttaaaaggtatgctaccaa

SEQ ID NO: 10039293 - DNA, 22 bp, Homo sapiens
cagttaaaagaagtctatctta

SEQ ID NO: 10039294 - DNA, 22 bp, Homo sapiens
tactcaaactcactaagacaga

SEQ ID NO: 10039295 - DNA, 22 bp, Homo sapiens
tagctcaaaggttaagtgtgga

SEQ ID NO: 10039296 - DNA, 22 bp, Homo sapiens
tccacagtctatttttagtcta

SEQ ID NO: 10039297 - DNA, 22 bp, Homo sapiens
tccacagtggttgaactagtaa

SEQ ID NO: 10039298 - DNA, 22 bp, Homo sapiens
tccacagtggttgaactagttt

SEQ ID NO: 10039299 - DNA, 22 bp, Homo sapiens
catctttgtttcatctgtccag

SEQ ID NO: 10039300 - DNA, 22 bp, Homo sapiens
catctttgttttggatataatc

SEQ ID NO: 10039301 - DNA, 22 bp, Homo sapiens
catctttgttctgtaaactttt

SEQ ID NO: 10039302 - DNA, 22 bp, Homo sapiens
catctttgtaacttccacataa

SEQ ID NO: 10039303 - DNA, 22 bp, Homo sapiens
catctttggttttctatatgcc

SEQ ID NO: 10039304 - DNA, 22 bp, Homo sapiens
catctttgggctgcatggaagg

SEQ ID NO: 10039305 - DNA, 19 bp, Homo sapiens
catctttggtcacctagtc

SEQ ID NO: 10039306 - DNA, 20 bp, Homo sapiens
catctttggcaggactcctt

SEQ ID NO: 10039307 - DNA, 22 bp, Homo sapiens
catctttggagaaacttccgtt

SEQ ID NO: 10039308 - DNA, 22 bp, Homo sapiens
catctttgcccatccacttcca

SEQ ID NO: 10039309 - DNA, 22 bp, Homo sapiens
ccacatttttgatactctcact

SEQ ID NO: 10039310 - DNA, 22 bp, Homo sapiens
tctctgtgttgcaggaaaatct

SEQ ID NO: 10039311 - DNA, 22 bp, Homo sapiens
tctctgatctttaattcagata

SEQ ID NO: 10039312 - DNA, 22 bp, Homo sapiens
cctatgtctcatgggataagac

SEQ ID NO: 10039313 - DNA, 22 bp, Homo sapiens
tgacatttttataagagtcaaa

SEQ ID NO: 10039314 - DNA, 22 bp, Homo sapiens
tttctcaaaagacagaagtgaa

SEQ ID NO: 10039315 - DNA, 22 bp, Homo sapiens
ctctggttgcagctgaagttcc

SEQ ID NO: 10039316 - DNA, 18 bp, Homo sapiens
tttgcaaaggaagtatgg

SEQ ID NO: 10039317 - DNA, 22 bp, Homo sapiens
tttgcaaagtgcttgcagagta

SEQ ID NO: 10039318 - DNA, 22 bp, Homo sapiens
tttgcaaacacttaagaagaga

SEQ ID NO: 10039319 - DNA, 22 bp, Homo sapiens
tttgaaacccgtcactttgagt

SEQ ID NO: 10039320 - DNA, 22 bp, Homo sapiens
tttgaaacctagttatatgact

SEQ ID NO: 10039321 - DNA, 22 bp, Homo sapiens
tttgaaactctgaacatgtttc

SEQ ID NO: 10039322 - DNA, 22 bp, Homo sapiens
ttaaattattgagggattgtca

SEQ ID NO: 10039323 - DNA, 22 bp, Homo sapiens
ttaagatttgtagagaaaaagc

SEQ ID NO: 10039324 - DNA, 22 bp, Homo sapiens
ttagttttcccatctttatggt

SEQ ID NO: 10039325 - DNA, 22 bp, Homo sapiens
ttagcaaatatcttgaaacagg

SEQ ID NO: 10039326 - DNA, 22 bp, Homo sapiens
ttctttctctactagcagagct

SEQ ID NO: 10039327 - DNA, 22 bp, Homo sapiens
ctgtggatttaggcagagctga

SEQ ID NO: 10039328 - DNA, 20 bp, Homo sapiens
ctgtggtgagcaggagagta

SEQ ID NO: 10039329 - DNA, 22 bp, Homo sapiens
ctggtagtttgcaaaatggtgt

SEQ ID NO: 10039330 - DNA, 22 bp, Homo sapiens
gaaagaatgagcatcatgactt

SEQ ID NO: 10039331 - DNA, 22 bp, Homo sapiens
ctttggatggctgtgtgtttat

SEQ ID NO: 10039332 - DNA, 22 bp, Homo sapiens
gaaattcaggacaaagactctt

SEQ ID NO: 10039333 - DNA, 22 bp, Homo sapiens
ctttcgatcaagggtcccttca

SEQ ID NO: 10039334 - DNA, 19 bp, Homo sapiens
gactccaactttaagcatg

SEQ ID NO: 10039335 - DNA, 21 bp, Homo sapiens
gaagacaaatgggaatagctg

SEQ ID NO: 10039336 - DNA, 22 bp, Homo sapiens
gaatgctacttgactcagctca

SEQ ID NO: 10039337 - DNA, 22 bp, Homo sapiens
gaatgctattatttctgtgtgt

SEQ ID NO: 10039338 - DNA, 22 bp, Homo sapiens
gacagcatgagagatgccagtg

SEQ ID NO: 10039339 - DNA, 22 bp, Homo sapiens
gacagcatctgtgtggcaggag

SEQ ID NO: 10039340 - DNA, 22 bp, Homo sapiens
gacagcatggtgtctgttcagg

SEQ ID NO: 10039341 - DNA, 22 bp, Homo sapiens
gacagcattccatctgcaggtt

SEQ ID NO: 10039342 - DNA, 22 bp, Homo sapiens
gacagccatgcacttctgctgt

SEQ ID NO: 10039343 - DNA, 22 bp, Homo sapiens
gacatcaattcagcattttaag

SEQ ID NO: 10039344 - DNA, 19 bp, Homo sapiens
gagcaggccacacatgtgt

SEQ ID NO: 10039345 - DNA, 22 bp, Homo sapiens
gagtaaatcgtcattgcagcat

SEQ ID NO: 10039346 - DNA, 22 bp, Homo sapiens
gcttttgtggtgatggagaggc

SEQ ID NO: 10039347 - DNA, 22 bp, Homo sapiens
ggagaagaggagctggaagcct

SEQ ID NO: 10039348 - DNA, 22 bp, Homo sapiens
gcagctgggacactgaggccag

SEQ ID NO: 10039349 - DNA, 17 bp, Homo sapiens
gcagttaaattaagatg

SEQ ID NO: 10039350 - DNA, 22 bp, Homo sapiens
gcagtttactgtcaataactct

SEQ ID NO: 10039351 - DNA, 21 bp, Homo sapiens
gcagtttatgtaatatgcact

SEQ ID NO: 10039352 - DNA, 22 bp, Homo sapiens
gccacctgcgggccgtggtgga

SEQ ID NO: 10039353 - DNA, 22 bp, Homo sapiens
ggtggataggtacatggacttt

SEQ ID NO: 10039354 - DNA, 22 bp, Homo sapiens
gtattttatggcatgcagtggc

SEQ ID NO: 10039355 - DNA, 22 bp, Homo sapiens
ggctgtggggaccaacaggact

SEQ ID NO: 10039356 - DNA, 22 bp, Homo sapiens
ggcaggctgggtgtcatggagt

SEQ ID NO: 10039357 - DNA, 22 bp, Homo sapiens
ggcaggctttcagcatcaagtc

SEQ ID NO: 10039358 - DNA, 22 bp, Homo sapiens
ggcaggctttgagaaagagcat

SEQ ID NO: 10039359 - DNA, 20 bp, Homo sapiens
ggcaggctttatatggaggg

SEQ ID NO: 10039360 - DNA, 22 bp, Homo sapiens
tacatgctccttatgagaatct

SEQ ID NO: 10039361 - DNA, 19 bp, Homo sapiens
gttctttcatagtaagagc

SEQ ID NO: 10039362 - DNA, 22 bp, Homo sapiens
gtttcaatttgacccaaatctt

SEQ ID NO: 10039363 - DNA, 22 bp, Homo sapiens
gttaaattcgatgatggataaa

SEQ ID NO: 10039364 - DNA, 22 bp, Homo sapiens
taagagctaggattttaaatca

SEQ ID NO: 10039365 - DNA, 22 bp, Homo sapiens
taaagcaagacacacccatagc

SEQ ID NO: 10039366 - DNA, 22 bp, Homo sapiens
taaagacatggtgtaggtgaac

SEQ ID NO: 10039367 - DNA, 23 bp, Homo sapiens
taaagacagccttcaggattctg

SEQ ID NO: 10039368 - DNA, 22 bp, Homo sapiens
taaagacatgcaaagtctaatt

SEQ ID NO: 10039369 - DNA, 20 bp, Homo sapiens
taaagacataagctactatc

SEQ ID NO: 10039370 - DNA, 22 bp, Homo sapiens
tagtttcatctccaccctgccc

SEQ ID NO: 10039371 - DNA, 22 bp, Homo sapiens
tagagaaacagaaccaacaggg

SEQ ID NO: 10039372 - DNA, 22 bp, Homo sapiens
tagagaaacagaaccaacaggg

SEQ ID NO: 10039373 - DNA, 22 bp, Homo sapiens
tagaagaacatgtcaaactata

SEQ ID NO: 10039374 - DNA, 22 bp, Homo sapiens
tagcaaaagctcaacaggaagg

SEQ ID NO: 10039375 - DNA, 22 bp, Homo sapiens
tagcaaaatgtggatgtagttg

SEQ ID NO: 10039376 - DNA, 22 bp, Homo sapiens
tcaaataggtatgagtagaaat

SEQ ID NO: 10039377 - DNA, 22 bp, Homo sapiens
tatctttgtatcaatctccatt

SEQ ID NO: 10039378 - DNA, 21 bp, Homo sapiens
tcagtaaacctaaagattgta

SEQ ID NO: 10039379 - DNA, 22 bp, Homo sapiens
tcagtaaatctctaattggcat

SEQ ID NO: 10039380 - DNA, 22 bp, Homo sapiens
tcataaatagttgtgcctgaat

SEQ ID NO: 10039381 - DNA, 22 bp, Homo sapiens
tcatagaagcactcagctccct

SEQ ID NO: 10039382 - DNA, 22 bp, Homo sapiens
tcatagaaatatcacgtctttt

SEQ ID NO: 10039383 - DNA, 22 bp, Homo sapiens
tcatctttgtatccctaacaca

SEQ ID NO: 10039384 - DNA, 22 bp, Homo sapiens
tcatctttcctcaaaagatcca

SEQ ID NO: 10039385 - DNA, 22 bp, Homo sapiens
tcatctttaccccttgcttcaa

SEQ ID NO: 10039386 - DNA, 22 bp, Homo sapiens
tcattgttgcgttaatgtcttc

SEQ ID NO: 10039387 - DNA, 22 bp, Homo sapiens
tcattgttgacataccaagagc

SEQ ID NO: 10039388 - DNA, 22 bp, Homo sapiens
tcattgtcttgatatgattgtc

SEQ ID NO: 10039389 - DNA, 22 bp, Homo sapiens
tcattgtcagctcttgacttct

SEQ ID NO: 10039390 - DNA, 22 bp, Homo sapiens
tccaaatattatgattatagga

SEQ ID NO: 10039391 - DNA, 22 bp, Homo sapiens
tcactgcaacctccacctcctg

SEQ ID NO: 10039392 - DNA, 22 bp, Homo sapiens
tcactgcaacctccacctcccg

SEQ ID NO: 10039393 - DNA, 22 bp, Homo sapiens
tcaacagttgcactggagaggt

SEQ ID NO: 10039394 - DNA, 22 bp, Homo sapiens
tcagccacttccctctggtcag

SEQ ID NO: 10039395 - DNA, 22 bp, Homo sapiens
tcctcacactatagatgaggat

SEQ ID NO: 10039396 - DNA, 22 bp, Homo sapiens
tcctcacagagtggcaggcaat

SEQ ID NO: 10039397 - DNA, 22 bp, Homo sapiens
tcctcacatggtgagccacaca

SEQ ID NO: 10039398 - DNA, 22 bp, Homo sapiens
tcctcacagggcaggaaggagg

SEQ ID NO: 10039399 - DNA, 22 bp, Homo sapiens
tttcaaaggtggaagagtgaat

SEQ ID NO: 10039400 - DNA, 22 bp, Homo sapiens
tttcaaaggttttgtcatgtct

SEQ ID NO: 10039401 - DNA, 20 bp, Homo sapiens
tttcacaatgaacatgtctc

SEQ ID NO: 10039402 - DNA, 18 bp, Homo sapiens
tttcacagattcatgact

SEQ ID NO: 10039403 - DNA, 22 bp, Homo sapiens
tttcacagcgtctttctcttgc

SEQ ID NO: 10039404 - DNA, 22 bp, Homo sapiens
ttggaaatgtagaaaagcagat

SEQ ID NO: 10039405 - DNA, 22 bp, Homo sapiens
ttggaaatggctgtagttatga

SEQ ID NO: 10039406 - DNA, 22 bp, Homo sapiens
ttggaaatgatttctattatta

SEQ ID NO: 10039407 - DNA, 22 bp, Homo sapiens
ttggaaatacgagtagtatcat

SEQ ID NO: 10039408 - DNA, 22 bp, Homo sapiens
ttggaaatgcaaatatattgaa

SEQ ID NO: 10039409 - DNA, 22 bp, Homo sapiens
ttgctttcccaaggcagaacat

SEQ ID NO: 10039410 - DNA, 22 bp, Homo sapiens
ttggaaacgtcaccttttcctt

SEQ ID NO: 10039411 - DNA, 22 bp, Homo sapiens
ttggccatctaagcccagccac

SEQ ID NO: 10039412 - DNA, 22 bp, Homo sapiens
ttatagaaggagcattcactta

SEQ ID NO: 10039413 - DNA, 22 bp, Homo sapiens
ttcatttgtggtgaatgaagtg

SEQ ID NO: 10039414 - DNA, 22 bp, Homo sapiens
ttcagttttgcttttaatcatg

SEQ ID NO: 10039415 - DNA, 22 bp, Homo sapiens
ttcagttttattgtactgctat

SEQ ID NO: 10039416 - DNA, 22 bp, Homo sapiens
ttcacagagcttgttcatggcc

SEQ ID NO: 10039417 - DNA, 22 bp, Homo sapiens
ttgaaattgggtgtggctgtca

SEQ ID NO: 10039418 - DNA, 22 bp, Homo sapiens
ttcttttaatgttctgaagttt

SEQ ID NO: 10039419 - DNA, 21 bp, Homo sapiens
tttctttctggctctcacagt

SEQ ID NO: 10039420 - DNA, 18 bp, Homo sapiens
tttctttctgcctggggc

SEQ ID NO: 10039421 - DNA, 22 bp, Homo sapiens
tttgagttgcttatttaatagg

SEQ ID NO: 10039422 - DNA, 22 bp, Homo sapiens
tttgcttttgtgctctagtggt

SEQ ID NO: 10039423 - DNA, 22 bp, Homo sapiens
tttggtgagctgcgagtgagga

SEQ ID NO: 10039424 - DNA, 22 bp, Homo sapiens
ttttctggtcacatgttattaa

SEQ ID NO: 10039425 - DNA, 21 bp, Homo sapiens
ttttctggagtatgtctcctc

SEQ ID NO: 10039426 - DNA, 22 bp, Homo sapiens
acacagtttttcagacagagat

SEQ ID NO: 10039427 - DNA, 19 bp, Homo sapiens
agcaggccacagggccagc

SEQ ID NO: 10039428 - DNA, 22 bp, Homo sapiens
agcaggctttccacagaaggag

SEQ ID NO: 10039429 - DNA, 22 bp, Homo sapiens
acacatatgtggcaactgtaga

SEQ ID NO: 10039430 - DNA, 22 bp, Homo sapiens
acactgttctttgcactgagaa

SEQ ID NO: 10039431 - DNA, 22 bp, Homo sapiens
acactgtgtctagcattttaca

SEQ ID NO: 10039432 - DNA, 22 bp, Homo sapiens
acagaatattgtaagtgccact

SEQ ID NO: 10039433 - DNA, 22 bp, Homo sapiens
acagaatagttggccctgctat

SEQ ID NO: 10039434 - DNA, 20 bp, Homo sapiens
agagattttagtagccacag

SEQ ID NO: 10039435 - DNA, 22 bp, Homo sapiens
agacattatggctttcactggg

SEQ ID NO: 10039436 - DNA, 22 bp, Homo sapiens
acaaatagagattcaaataaag

SEQ ID NO: 10039437 - DNA, 22 bp, Homo sapiens
aatagaatgtaatctaatacat

SEQ ID NO: 10039438 - DNA, 22 bp, Homo sapiens
aatagcatagagttaaaatgca

SEQ ID NO: 10039439 - DNA, 22 bp, Homo sapiens
agaaggaaggataactgcatta

SEQ ID NO: 10039440 - DNA, 22 bp, Homo sapiens
agaaaggaggaagaatgacctc

SEQ ID NO: 10039441 - DNA, 22 bp, Homo sapiens
aatagctgggacctgaattagc

SEQ ID NO: 10039442 - DNA, 22 bp, Homo sapiens
aaagacagagctgtaggggaaa

SEQ ID NO: 10039443 - DNA, 22 bp, Homo sapiens
aaagacagatggcaaggatgat

SEQ ID NO: 10039444 - DNA, 22 bp, Homo sapiens
aaagacagtggattcaaaatcc

SEQ ID NO: 10039445 - DNA, 22 bp, Homo sapiens
aaagacagtggattcaaaatcc

SEQ ID NO: 10039446 - DNA, 22 bp, Homo sapiens
aaagacacacagccagcaagtg

SEQ ID NO: 10039447 - DNA, 22 bp, Homo sapiens
aaaatgctatttcatggaggag

SEQ ID NO: 10039448 - DNA, 22 bp, Homo sapiens
aaaatgctcatcagcgatggct

SEQ ID NO: 10039449 - DNA, 22 bp, Homo sapiens
aaaatgctgggaaagttggaat

SEQ ID NO: 10039450 - DNA, 22 bp, Homo sapiens
aaaatggcttaataggcaataa

SEQ ID NO: 10039451 - DNA, 22 bp, Homo sapiens
aaattgctatatgtgaatgtga

SEQ ID NO: 10039452 - DNA, 22 bp, Homo sapiens
aaattgctgtgaggtggtagta

SEQ ID NO: 10039453 - DNA, 22 bp, Homo sapiens
aacttctaatctgtacagtttt

SEQ ID NO: 10039454 - DNA, 22 bp, Homo sapiens
aaatatgagatgttctctttcg

SEQ ID NO: 10039455 - DNA, 22 bp, Homo sapiens
aaatacagattctgactcagag

SEQ ID NO: 10039456 - DNA, 22 bp, Homo sapiens
aaatgagtagcgatgcacatta

SEQ ID NO: 10039457 - DNA, 22 bp, Homo sapiens
aaatgcaaggcacattcctttt

SEQ ID NO: 10039458 - DNA, 22 bp, Homo sapiens
aatccacacatctggcatgtga

SEQ ID NO: 10039459 - DNA, 22 bp, Homo sapiens
aatccagatgagcaatcatact

SEQ ID NO: 10039460 - DNA, 22 bp, Homo sapiens
aatatccaggtagatgtcttct

SEQ ID NO: 10039461 - DNA, 22 bp, Homo sapiens
aatatccattgggagcaaatgg

SEQ ID NO: 10039462 - DNA, 22 bp, Homo sapiens
aatatccacactgtgtccctgc

SEQ ID NO: 10039463 - DNA, 22 bp, Homo sapiens
aatatccacttcaatacaggca

SEQ ID NO: 10039464 - DNA, 22 bp, Homo sapiens
aatgcagattcttattctgtag

SEQ ID NO: 10039465 - DNA, 22 bp, Homo sapiens
aatgctgtccaataggaacata

SEQ ID NO: 10039466 - DNA, 22 bp, Homo sapiens
aacagtaagagatgttttatct

SEQ ID NO: 10039467 - DNA, 22 bp, Homo sapiens
aaatggagttctaagtatagta

SEQ ID NO: 10039468 - DNA, 22 bp, Homo sapiens
aaatggaggcacgcagtggtta

SEQ ID NO: 10039469 - DNA, 19 bp, Homo sapiens
aaatggagctaatcttgtc

SEQ ID NO: 10039470 - DNA, 22 bp, Homo sapiens
aaatggaggcaaaattggtttc

SEQ ID NO: 10039471 - DNA, 22 bp, Homo sapiens
aaggagtctgggccattcagag

SEQ ID NO: 10039472 - DNA, 22 bp, Homo sapiens
acaaaacagtgttcctgcccct

SEQ ID NO: 10039473 - DNA, 22 bp, Homo sapiens
aagaacaggttctagaaccatt

SEQ ID NO: 10039474 - DNA, 22 bp, Homo sapiens
acaaatatttactgaatccact

SEQ ID NO: 10039475 - DNA, 22 bp, Homo sapiens
acaaatgaatcatacataatgt

SEQ ID NO: 10039476 - DNA, 18 bp, Homo sapiens
aagcagggtccattgtgc

SEQ ID NO: 10039477 - DNA, 22 bp, Homo sapiens
acacatataccactgtaaatga

SEQ ID NO: 10039478 - DNA, 22 bp, Homo sapiens
acatctttatactagtccttga

SEQ ID NO: 10039479 - DNA, 22 bp, Homo sapiens
acctcccagaaagttttgcagg

SEQ ID NO: 10039480 - DNA, 22 bp, Homo sapiens
accactgtctacacattgactc

SEQ ID NO: 10039481 - DNA, 22 bp, Homo sapiens
atcctgaaaattgaatggaagg

SEQ ID NO: 10039482 - DNA, 22 bp, Homo sapiens
agaaatgcctacgagataggga

SEQ ID NO: 10039483 - DNA, 17 bp, Homo sapiens
agaaagaggatccacag

SEQ ID NO: 10039484 - DNA, 22 bp, Homo sapiens
agaaagaggatgcagatctcat

SEQ ID NO: 10039485 - DNA, 22 bp, Homo sapiens
ataaggaaatgaaactctaata

SEQ ID NO: 10039486 - DNA, 22 bp, Homo sapiens
agtccttagaacactgtatctg

SEQ ID NO: 10039487 - DNA, 22 bp, Homo sapiens
agtaacatgagtttttctaatg

SEQ ID NO: 10039488 - DNA, 22 bp, Homo sapiens
agttcaaagctgcagtaatgga

SEQ ID NO: 10039489 - DNA, 23 bp, Homo sapiens
agttcaaaatcaaccaggacact

SEQ ID NO: 10039490 - DNA, 22 bp, Homo sapiens
agttcaaagtcaaggaaactgt

SEQ ID NO: 10039491 - DNA, 22 bp, Homo sapiens
agtgctttagcatccaactgtc

SEQ ID NO: 10039492 - DNA, 22 bp, Homo sapiens
attttgttatagaactctgtga

SEQ ID NO: 10039493 - DNA, 22 bp, Homo sapiens
attttctgtaactatttctata

SEQ ID NO: 10039494 - DNA, 22 bp, Homo sapiens
attgtatcttgtcattatgcat

SEQ ID NO: 10039495 - DNA, 22 bp, Homo sapiens
atgacttctgcaaggtcatttg

SEQ ID NO: 10039496 - DNA, 22 bp, Homo sapiens
atgacttcacctctgtgaagca

SEQ ID NO: 10039497 - DNA, 22 bp, Homo sapiens
agagaacagacagatgcaatga

SEQ ID NO: 10039498 - DNA, 22 bp, Homo sapiens
atgcttctgtaatgtgggaatg

SEQ ID NO: 10039499 - DNA, 22 bp, Homo sapiens
caagtctgtctgctcctgtgtg

SEQ ID NO: 10039500 - DNA, 22 bp, Homo sapiens
agcagagacatgaaatatgctt

SEQ ID NO: 10039501 - DNA, 22 bp, Homo sapiens
cacaggaaatgattctgcagca

SEQ ID NO: 10039502 - DNA, 22 bp, Homo sapiens
cacactgttgaggacgagatgt

SEQ ID NO: 10039503 - DNA, 22 bp, Homo sapiens
cacatttaaaggttgaagctga

SEQ ID NO: 10039504 - DNA, 22 bp, Homo sapiens
cacgttaacagctaacagatga

SEQ ID NO: 10039505 - DNA, 22 bp, Homo sapiens
cacatttaagtgcttgttcaga

SEQ ID NO: 10039506 - DNA, 22 bp, Homo sapiens
cacatgtagtaagcaggcaatg

SEQ ID NO: 10039507 - DNA, 22 bp, Homo sapiens
agcaggcctcatgcaccagcta

SEQ ID NO: 10039508 - DNA, 22 bp, Homo sapiens
cactttctgtgttgtgcaaaaa

SEQ ID NO: 10039509 - DNA, 22 bp, Homo sapiens
atgatctcattctttcaaaggg

SEQ ID NO: 10039510 - DNA, 18 bp, Homo sapiens
atgtgagagaatcttctt

SEQ ID NO: 10039511 - DNA, 22 bp, Homo sapiens
atttctgtggcttcattctcct

SEQ ID NO: 10039512 - DNA, 22 bp, Homo sapiens
atttctgtaacttatgaaagtt

SEQ ID NO: 10039513 - DNA, 22 bp, Homo sapiens
caaatgcatagtttataagaag

SEQ ID NO: 10039514 - DNA, 22 bp, Homo sapiens
caaatgcatgagaaataagagg

SEQ ID NO: 10039515 - DNA, 22 bp, Homo sapiens
caaatggatacaggcaaacatt

SEQ ID NO: 10039516 - DNA, 22 bp, Homo sapiens
caaatagactctagaatttatt

SEQ ID NO: 10039517 - DNA, 22 bp, Homo sapiens
attttacttcatttgaaatgcc

SEQ ID NO: 10039518 - DNA, 22 bp, Homo sapiens
attactttcagatgtgctgtaa

SEQ ID NO: 10039519 - DNA, 22 bp, Homo sapiens
attcagttgtctactactgcct

SEQ ID NO: 10039520 - DNA, 22 bp, Homo sapiens
attctttcaaggaatagttatt

SEQ ID NO: 10039521 - DNA, 22 bp, Homo sapiens
gctttctggttctcaaagcact

SEQ ID NO: 10039522 - DNA, 22 bp, Homo sapiens
cacaggaataagtcaaacttca

SEQ ID NO: 10039523 - DNA, 22 bp, Homo sapiens
cactttggatgccactggtcta

SEQ ID NO: 10039524 - DNA, 22 bp, Homo sapiens
cagaaataaacttctcacatcg

SEQ ID NO: 10039525 - DNA, 22 bp, Homo sapiens
cacatttacatataaaactttc

SEQ ID NO: 10039526 - DNA, 22 bp, Homo sapiens
cacatttagaggttagcatggt

SEQ ID NO: 10039527 - DNA, 22 bp, Homo sapiens
cacagttttgcccagggcttct

SEQ ID NO: 10039528 - DNA, 22 bp, Homo sapiens
gtcatcttctctcagcccaggc

SEQ ID NO: 10039529 - DNA, 22 bp, Homo sapiens
gtcatcttcgcagagtgatttt

SEQ ID NO: 10039530 - DNA, 22 bp, Homo sapiens
gtcatcttgctgttttagatct

SEQ ID NO: 10039531 - DNA, 22 bp, Homo sapiens
cagcaggctgtggaaatcctgg

SEQ ID NO: 10039532 - DNA, 22 bp, Homo sapiens
cagctattattttctctaaatt

SEQ ID NO: 10039533 - DNA, 22 bp, Homo sapiens
agggaaataatctattctgagg

SEQ ID NO: 10039534 - DNA, 22 bp, Homo sapiens
aggctagaggcttctggcttca

SEQ ID NO: 10039535 - DNA, 23 bp, Homo sapiens
agcttcctagtgacctggagtct

SEQ ID NO: 10039536 - DNA, 22 bp, Homo sapiens
agctttgaagtatttggtctcc

SEQ ID NO: 10039537 - DNA, 22 bp, Homo sapiens
cagtaaatagtggagatgtggg

SEQ ID NO: 10039538 - DNA, 22 bp, Homo sapiens
cagtaaatacatatcagagaag

SEQ ID NO: 10039539 - DNA, 22 bp, Homo sapiens
cagtaaattttatttgtgggtg

SEQ ID NO: 10039540 - DNA, 22 bp, Homo sapiens
cagtaaatataggaacgtggaa

SEQ ID NO: 10039541 - DNA, 22 bp, Homo sapiens
ccacagttattcatttgtgaca

SEQ ID NO: 10039542 - DNA, 22 bp, Homo sapiens
catcttctgggacttctcagtt

SEQ ID NO: 10039543 - DNA, 22 bp, Homo sapiens
catcttattttcttctagtgct

SEQ ID NO: 10039544 - DNA, 22 bp, Homo sapiens
catctcttcattagcattattg

SEQ ID NO: 10039545 - DNA, 22 bp, Homo sapiens
catacagaaaatatattttgat

SEQ ID NO: 10039546 - DNA, 18 bp, Homo sapiens
agttagaaatgaaggcca

SEQ ID NO: 10039547 - DNA, 22 bp, Homo sapiens
agtcttctcatttcacatgctt

SEQ ID NO: 10039548 - DNA, 22 bp, Homo sapiens
atagcaaagcctggcacaatga

SEQ ID NO: 10039549 - DNA, 22 bp, Homo sapiens
ctggagaagtactgagacattt

SEQ ID NO: 10039550 - DNA, 22 bp, Homo sapiens
ctggagaagcattcaaataatt

SEQ ID NO: 10039551 - DNA, 22 bp, Homo sapiens
atattgagataagaactgacat

SEQ ID NO: 10039552 - DNA, 22 bp, Homo sapiens
atattgagatgaggatattaac

SEQ ID NO: 10039553 - DNA, 22 bp, Homo sapiens
ctgtgtgtcatttgtcaatcct

SEQ ID NO: 10039554 - DNA, 22 bp, Homo sapiens
cagctattttgcctatcatggt

SEQ ID NO: 10039555 - DNA, 22 bp, Homo sapiens
tattttacagactactttagat

SEQ ID NO: 10039556 - DNA, 22 bp, Homo sapiens
cagtattttcaggatttggaag

SEQ ID NO: 10039557 - DNA, 22 bp, Homo sapiens
tattttactttaaagcgagaga

SEQ ID NO: 10039558 - DNA, 22 bp, Homo sapiens
tattttactatttggcaaagtc

SEQ ID NO: 10039559 - DNA, 22 bp, Homo sapiens
tattttacatgatccagagttg

SEQ ID NO: 10039560 - DNA, 22 bp, Homo sapiens
catgactctccctctgtttatt

SEQ ID NO: 10039561 - DNA, 22 bp, Homo sapiens
ccattgtaaattctgtggaagt

SEQ ID NO: 10039562 - DNA, 22 bp, Homo sapiens
tgatttctcatattgttcaaaa

SEQ ID NO: 10039563 - DNA, 22 bp, Homo sapiens
tgagaatgaatcttttgctttc

SEQ ID NO: 10039564 - DNA, 22 bp, Homo sapiens
tgagaatgccataagagctatt

SEQ ID NO: 10039565 - DNA, 22 bp, Homo sapiens
tgagaatgagggggtagaaggt

SEQ ID NO: 10039566 - DNA, 22 bp, Homo sapiens
cccaggtagtgagaaatggagg

SEQ ID NO: 10039567 - DNA, 20 bp, Homo sapiens
tggaatgggtccttgaaaaa

SEQ ID NO: 10039568 - DNA, 22 bp, Homo sapiens
tgctgttagtaaggaacatgac

SEQ ID NO: 10039569 - DNA, 22 bp, Homo sapiens
cccgactagctgggattacagg

SEQ ID NO: 10039570 - DNA, 22 bp, Homo sapiens
cctgagatggggattattccaa

SEQ ID NO: 10039571 - DNA, 22 bp, Homo sapiens
ctcaaaagacttaaacataaga

SEQ ID NO: 10039572 - DNA, 22 bp, Homo sapiens
ctaaagaagctagcaatctata

SEQ ID NO: 10039573 - DNA, 22 bp, Homo sapiens
ctaaagaattttgcttgaccag

SEQ ID NO: 10039574 - DNA, 22 bp, Homo sapiens
ttaggctgggctacaacaactg

SEQ ID NO: 10039575 - DNA, 22 bp, Homo sapiens
ttcaatagaaatgacattcttt

SEQ ID NO: 10039576 - DNA, 18 bp, Homo sapiens
ttcttttcatgtgatctc

SEQ ID NO: 10039577 - DNA, 22 bp, Homo sapiens
ttcttttcctgtggctcatcca

SEQ ID NO: 10039578 - DNA, 19 bp, Homo sapiens
ctccacagggattgtgatt

SEQ ID NO: 10039579 - DNA, 22 bp, Homo sapiens
ctccacagagatgctgattgta

SEQ ID NO: 10039580 - DNA, 22 bp, Homo sapiens
tttgcaaataaataagtgctcg

SEQ ID NO: 10039581 - DNA, 22 bp, Homo sapiens
ctctgctttttagggagcctag

SEQ ID NO: 10039582 - DNA, 22 bp, Homo sapiens
ttttaatactgctattgtagga

SEQ ID NO: 10039583 - DNA, 22 bp, Homo sapiens
ttttcagtaatgtctacataat

SEQ ID NO: 10039584 - DNA, 22 bp, Homo sapiens
ctgaatattagtcatgtctgat

SEQ ID NO: 10039585 - DNA, 22 bp, Homo sapiens
gaatatcccgctatgcaaagta

SEQ ID NO: 10039586 - DNA, 22 bp, Homo sapiens
gaagagaagcatcaataggtaa

SEQ ID NO: 10039587 - DNA, 22 bp, Homo sapiens
gaagagaaaggcaaggagtttt

SEQ ID NO: 10039588 - DNA, 22 bp, Homo sapiens
gaagagaaggtgtaggccatcc

SEQ ID NO: 10039589 - DNA, 22 bp, Homo sapiens
ctttcatccgcagatgagcctc

SEQ ID NO: 10039590 - DNA, 22 bp, Homo sapiens
gaacatttggcatgagaatttg

SEQ ID NO: 10039591 - DNA, 22 bp, Homo sapiens
gagaatgggaatgaaagtagca

SEQ ID NO: 10039592 - DNA, 22 bp, Homo sapiens
gagcagagtctatttccacact

SEQ ID NO: 10039593 - DNA, 22 bp, Homo sapiens
ctgtggctctcagaggctgctg

SEQ ID NO: 10039594 - DNA, 22 bp, Homo sapiens
ctggctttgttctgattgcttc

SEQ ID NO: 10039595 - DNA, 22 bp, Homo sapiens
gtgagactcgcctttgtgtagc

SEQ ID NO: 10039596 - DNA, 22 bp, Homo sapiens
gtgcaggtgttttggctgccag

SEQ ID NO: 10039597 - DNA, 22 bp, Homo sapiens
gtctgctcatgctaccgcgggc

SEQ ID NO: 10039598 - DNA, 22 bp, Homo sapiens
gtgaaatatttaacgtccaggt

SEQ ID NO: 10039599 - DNA, 22 bp, Homo sapiens
ggcaagaaggcttcaggtagct

SEQ ID NO: 10039600 - DNA, 21 bp, Homo sapiens
ggcaagaaacacaatcaagta

SEQ ID NO: 10039601 - DNA, 22 bp, Homo sapiens
ggcaagaaccacaattactttt

SEQ ID NO: 10039602 - DNA, 22 bp, Homo sapiens
ggcaagaacctcaattaccttt

SEQ ID NO: 10039603 - DNA, 21 bp, Homo sapiens
ggcaagaaacacaatcaagta

SEQ ID NO: 10039604 - DNA, 22 bp, Homo sapiens
ggccttggttccaaagcaggca

SEQ ID NO: 10039605 - DNA, 22 bp, Homo sapiens
gcaaagcagaaccctctctatc

SEQ ID NO: 10039606 - DNA, 22 bp, Homo sapiens
gcaaagaaatgtcagtgagagg

SEQ ID NO: 10039607 - DNA, 22 bp, Homo sapiens
gcagctttgaagacttatttgc

SEQ ID NO: 10039608 - DNA, 22 bp, Homo sapiens
gcagctttctaagctttattgc

SEQ ID NO: 10039609 - DNA, 22 bp, Homo sapiens
ggagagaattccatggacatgt

SEQ ID NO: 10039610 - DNA, 22 bp, Homo sapiens
gctttctaggcagagatgactg

SEQ ID NO: 10039611 - DNA, 22 bp, Homo sapiens
gctttcaattatgtcagcctgt

SEQ ID NO: 10039612 - DNA, 22 bp, Homo sapiens
taaggcagtgagaagaaacagg

SEQ ID NO: 10039613 - DNA, 20 bp, Homo sapiens
tacagaaacaggacttttgg

SEQ ID NO: 10039614 - DNA, 22 bp, Homo sapiens
tacagaaagggatgattgatct

SEQ ID NO: 10039615 - DNA, 22 bp, Homo sapiens
tacattctcttcccattgtctc

SEQ ID NO: 10039616 - DNA, 22 bp, Homo sapiens
gtttcccaaattgttcacaggg

SEQ ID NO: 10039617 - DNA, 22 bp, Homo sapiens
taaattctgatcaagttccttc

SEQ ID NO: 10039618 - DNA, 22 bp, Homo sapiens
taaattgttttctagaagttgt

SEQ ID NO: 10039619 - DNA, 20 bp, Homo sapiens
taaattagccttgaagatta

SEQ ID NO: 10039620 - DNA, 20 bp, Homo sapiens
tatgagtattactttcagga

SEQ ID NO: 10039621 - DNA, 22 bp, Homo sapiens
tatgagcagacagtggttttac

SEQ ID NO: 10039622 - DNA, 22 bp, Homo sapiens
tataaattattaggctgctaaa

SEQ ID NO: 10039623 - DNA, 22 bp, Homo sapiens
tatacacatatcttctaggcct

SEQ ID NO: 10039624 - DNA, 22 bp, Homo sapiens
tatatatgagcatgtgaggaca

SEQ ID NO: 10039625 - DNA, 22 bp, Homo sapiens
tatatatgggggaagctggatg

SEQ ID NO: 10039626 - DNA, 22 bp, Homo sapiens
tatatccataggctgtgcctag

SEQ ID NO: 10039627 - DNA, 22 bp, Homo sapiens
tatatccagaaaatcagttcat

SEQ ID NO: 10039628 - DNA, 22 bp, Homo sapiens
tatccacactcaaggggagggg

SEQ ID NO: 10039629 - DNA, 22 bp, Homo sapiens
tatccacactgggatgttttga

SEQ ID NO: 10039630 - DNA, 22 bp, Homo sapiens
tagcagaggtaagtgtggcaat

SEQ ID NO: 10039631 - DNA, 22 bp, Homo sapiens
tagcagaggctactgctccttg

SEQ ID NO: 10039632 - DNA, 22 bp, Homo sapiens
tagaaagaacttcatgtaaaac

SEQ ID NO: 10039633 - DNA, 19 bp, Homo sapiens
tccagcagtgcttgaaatc

SEQ ID NO: 10039634 - DNA, 22 bp, Homo sapiens
tcactctgggccctactgggct

SEQ ID NO: 10039635 - DNA, 22 bp, Homo sapiens
tcacttcttcccttgcacatat

SEQ ID NO: 10039636 - DNA, 22 bp, Homo sapiens
tcactttcctcatcacgactag

SEQ ID NO: 10039637 - DNA, 22 bp, Homo sapiens
tcactttaatgatttgtagaat

SEQ ID NO: 10039638 - DNA, 22 bp, Homo sapiens
tcactctgagaggtcactggaa

SEQ ID NO: 10039639 - DNA, 22 bp, Homo sapiens
tcactctgaatggtactgagga

SEQ ID NO: 10039640 - DNA, 22 bp, Homo sapiens
tatttctgattgctcatgaggc

SEQ ID NO: 10039641 - DNA, 22 bp, Homo sapiens
tatttctgtttatttgtacatc

SEQ ID NO: 10039642 - DNA, 22 bp, Homo sapiens
tcaagtttaattgagatgttta

SEQ ID NO: 10039643 - DNA, 22 bp, Homo sapiens
tcagtcttcaaatctgagtcgt

SEQ ID NO: 10039644 - DNA, 23 bp, Homo sapiens
tcagtcttccctgtcagtaatag

SEQ ID NO: 10039645 - DNA, 23 bp, Homo sapiens
tcagtcttggcttctgattttcc

SEQ ID NO: 10039646 - DNA, 22 bp, Homo sapiens
tcatatacctgcatgtgcatgt

SEQ ID NO: 10039647 - DNA, 22 bp, Homo sapiens
tttggcaaagatcaacatgtta

SEQ ID NO: 10039648 - DNA, 22 bp, Homo sapiens
tttctttccatacatattgcta

SEQ ID NO: 10039649 - DNA, 22 bp, Homo sapiens
tttctttctcgtaaacttagtt

SEQ ID NO: 10039650 - DNA, 22 bp, Homo sapiens
tttctttccatgagcctatgta

SEQ ID NO: 10039651 - DNA, 22 bp, Homo sapiens
tttctttcaattctcctaatgc

SEQ ID NO: 10039652 - DNA, 22 bp, Homo sapiens
tttctttccagagtgattggca

SEQ ID NO: 10039653 - DNA, 22 bp, Homo sapiens
tttgcaaataccatgaaacttg

SEQ ID NO: 10039654 - DNA, 22 bp, Homo sapiens
tttgcaaaatgaggtgaagagt

SEQ ID NO: 10039655 - DNA, 22 bp, Homo sapiens
tttgcaagatgaaaaagttcta

SEQ ID NO: 10039656 - DNA, 22 bp, Homo sapiens
tttgcaaatgctctgcagagct

SEQ ID NO: 10039657 - DNA, 22 bp, Homo sapiens
ttttggccacatccttttgagt

SEQ ID NO: 10039658 - DNA, 17 bp, Homo sapiens
tttcagattcactttct

SEQ ID NO: 10039659 - DNA, 22 bp, Homo sapiens
tttcaaagagaggcagaaggaa

SEQ ID NO: 10039660 - DNA, 22 bp, Homo sapiens
tttcaaagcaactgaaaaggaa

SEQ ID NO: 10039661 - DNA, 22 bp, Homo sapiens
tttctagaaacattatctctat

SEQ ID NO: 10039662 - DNA, 22 bp, Homo sapiens
tttctattggcgtcactgttgt

SEQ ID NO: 10039663 - DNA, 22 bp, Homo sapiens
tttctgtggtgggtagttcaga

SEQ ID NO: 10039664 - DNA, 22 bp, Homo sapiens
ttgcaagaggtgattttattga

SEQ ID NO: 10039665 - DNA, 22 bp, Homo sapiens
ttctacttctgacactgtttgt

SEQ ID NO: 10039666 - DNA, 22 bp, Homo sapiens
ttctaattgtgtttgcatatct

SEQ ID NO: 10039667 - DNA, 22 bp, Homo sapiens
ttccacattccttacattcata

SEQ ID NO: 10039668 - DNA, 22 bp, Homo sapiens
ttccacaggactaaatgtcatc

SEQ ID NO: 10039669 - DNA, 22 bp, Homo sapiens
ttcctacagccctgaatctcta

SEQ ID NO: 10039670 - DNA, 22 bp, Homo sapiens
ttgatctctgttgctgtctttg

SEQ ID NO: 10039671 - DNA, 20 bp, Homo sapiens
ttgcaaagtgaatagcaatt

SEQ ID NO: 10039672 - DNA, 18 bp, Homo sapiens
ttgaggagttcactgtct

SEQ ID NO: 10039673 - DNA, 19 bp, Homo sapiens
ttctttccacatcttctct

SEQ ID NO: 10039674 - DNA, 22 bp, Homo sapiens
ttctttcccagtagatgtgaaa

SEQ ID NO: 10039675 - DNA, 22 bp, Homo sapiens
ttctttccttgcctcagtgaag

SEQ ID NO: 10039676 - DNA, 22 bp, Homo sapiens
ttctttcctcccagcctttgga

SEQ ID NO: 10039677 - DNA, 22 bp, Homo sapiens
ttctggttctcaggaatgctaa

SEQ ID NO: 10039678 - DNA, 22 bp, Homo sapiens
ttctagtttccattttaagaca

SEQ ID NO: 10039679 - DNA, 22 bp, Homo sapiens
tgtggagatgtgagcaagggga

SEQ ID NO: 10039680 - DNA, 22 bp, Homo sapiens
tgtgtgaggactcagtgaaaca

SEQ ID NO: 10039681 - DNA, 22 bp, Homo sapiens
ttaacattgtccttagcagatt

SEQ ID NO: 10039682 - DNA, 22 bp, Homo sapiens
tgttttgtctaatagggcaggt

SEQ ID NO: 10039683 - DNA, 22 bp, Homo sapiens
tgttttgtgcatttacaacatg

SEQ ID NO: 10039684 - DNA, 22 bp, Homo sapiens
tgttttctgtgtagagatcaca

SEQ ID NO: 10039685 - DNA, 23 bp, Homo sapiens
tgtttttcattcacatgggctgt

SEQ ID NO: 10039686 - DNA, 22 bp, Homo sapiens
ttaaattaggactctagttctg

SEQ ID NO: 10039687 - DNA, 22 bp, Homo sapiens
ctgtgtgctgttagggagctgc

SEQ ID NO: 10039688 - DNA, 22 bp, Homo sapiens
ctgtgtgcaggtgctgggtacc

SEQ ID NO: 10039689 - DNA, 22 bp, Homo sapiens
ctgtgtgcagggcacaatggaa

SEQ ID NO: 10039690 - DNA, 22 bp, Homo sapiens
atccaccctgtggtggctttct

SEQ ID NO: 10039691 - DNA, 18 bp, Homo sapiens
ctgtgggaagagtttggg

SEQ ID NO: 10039692 - DNA, 18 bp, Homo sapiens
ctgtgggaaggctttcta

SEQ ID NO: 10039693 - DNA, 22 bp, Homo sapiens
atctgcagaggacaggcgagga

SEQ ID NO: 10039694 - DNA, 22 bp, Homo sapiens
atctgcaggaatgtgtgcagag

SEQ ID NO: 10039695 - DNA, 22 bp, Homo sapiens
atctgcacttaagcgaggcctg

SEQ ID NO: 10039696 - DNA, 22 bp, Homo sapiens
cttcttaatgcataaactgtgt

SEQ ID NO: 10039697 - DNA, 22 bp, Homo sapiens
cttcttaatgacagattaaaat

SEQ ID NO: 10039698 - DNA, 22 bp, Homo sapiens
atatttaactggtcccaatata

SEQ ID NO: 10039699 - DNA, 19 bp, Homo sapiens
atacagatgtatccatgat

SEQ ID NO: 10039700 - DNA, 22 bp, Homo sapiens
ctggaagtttccttcctggtca

SEQ ID NO: 10039701 - DNA, 18 bp, Homo sapiens
ctggaagttagtctttgg

SEQ ID NO: 10039702 - DNA, 22 bp, Homo sapiens
ctgctgcagatgacagacccaa

SEQ ID NO: 10039703 - DNA, 22 bp, Homo sapiens
ctgctgcaggatgggcactctg

SEQ ID NO: 10039704 - DNA, 18 bp, Homo sapiens
ctgctgcaggcactcagg

SEQ ID NO: 10039705 - DNA, 22 bp, Homo sapiens
atacattcatcacttttggtcc

SEQ ID NO: 10039706 - DNA, 22 bp, Homo sapiens
atacattcagcagtgctcatga

SEQ ID NO: 10039707 - DNA, 22 bp, Homo sapiens
atacattcctactgactagcta

SEQ ID NO: 10039708 - DNA, 21 bp, Homo sapiens
atacattctattaagcattta

SEQ ID NO: 10039709 - DNA, 22 bp, Homo sapiens
atacctgtgtatccacaagcgt

SEQ ID NO: 10039710 - DNA, 22 bp, Homo sapiens
ctggcccagttctgcgttttgc

SEQ ID NO: 10039711 - DNA, 22 bp, Homo sapiens
ctggcccatggtgagctctggg

SEQ ID NO: 10039712 - DNA, 22 bp, Homo sapiens
ctggcccattgccttctctctc

SEQ ID NO: 10039713 - DNA, 22 bp, Homo sapiens
ctggcccatggtgagctctggg

SEQ ID NO: 10039714 - DNA, 20 bp, Homo sapiens
ctggcccatctaccgctctg

SEQ ID NO: 10039715 - DNA, 22 bp, Homo sapiens
ctggctcccagctttcagggag

SEQ ID NO: 10039716 - DNA, 22 bp, Homo sapiens
ctggctcccgaagccctcagtg

SEQ ID NO: 10039717 - DNA, 19 bp, Homo sapiens
atagcagctatacccagat

SEQ ID NO: 10039718 - DNA, 22 bp, Homo sapiens
atagcaaggtatgactggagcc

SEQ ID NO: 10039719 - DNA, 22 bp, Homo sapiens
atacaaatttatagatgcattt

SEQ ID NO: 10039720 - DNA, 21 bp, Homo sapiens
ataagcatgctgattacattt

SEQ ID NO: 10039721 - DNA, 22 bp, Homo sapiens
ataaccatgattaatctaagaa

SEQ ID NO: 10039722 - DNA, 22 bp, Homo sapiens
ctgcctctcaggtccctgagat

SEQ ID NO: 10039723 - DNA, 22 bp, Homo sapiens
ctgcctctccccagagtggccc

SEQ ID NO: 10039724 - DNA, 22 bp, Homo sapiens
ctgcctctcagcctgaccgcca

SEQ ID NO: 10039725 - DNA, 22 bp, Homo sapiens
ctgcctctgcgtcccacagagt

SEQ ID NO: 10039726 - DNA, 22 bp, Homo sapiens
ctccaggctggggtgcaggttg

SEQ ID NO: 10039727 - DNA, 22 bp, Homo sapiens
ctcatgagactgatgtattaaa

SEQ ID NO: 10039728 - DNA, 22 bp, Homo sapiens
ctcattgcaacctccgcctccc

SEQ ID NO: 10039729 - DNA, 22 bp, Homo sapiens
ctcctgggtcattgccagcaaa

SEQ ID NO: 10039730 - DNA, 22 bp, Homo sapiens
ctcctgggggacagcggcaggg

SEQ ID NO: 10039731 - DNA, 22 bp, Homo sapiens
ctccagggaaaggggcgtccgc

SEQ ID NO: 10039732 - DNA, 21 bp, Homo sapiens
ctctgcagccctgcttccagg

SEQ ID NO: 10039733 - DNA, 22 bp, Homo sapiens
ctctgcaggcacccagggtggg

SEQ ID NO: 10039734 - DNA, 17 bp, Homo sapiens
ctctgcagtgcatggct

SEQ ID NO: 10039735 - DNA, 22 bp, Homo sapiens
ctctgcaggggaggcatgcact

SEQ ID NO: 10039736 - DNA, 22 bp, Homo sapiens
ctctgcaggccttgagtgtggt

SEQ ID NO: 10039737 - DNA, 22 bp, Homo sapiens
ctctttggtgcaccttgcagtc

SEQ ID NO: 10039738 - DNA, 22 bp, Homo sapiens
cctggatagctactggccaggc

SEQ ID NO: 10039739 - DNA, 19 bp, Homo sapiens
aggtccctgtcacctctca

SEQ ID NO: 10039740 - DNA, 22 bp, Homo sapiens
aggtccctcagaggcctcaccg

SEQ ID NO: 10039741 - DNA, 22 bp, Homo sapiens
aggtcccagtctgtgatgactc

SEQ ID NO: 10039742 - DNA, 22 bp, Homo sapiens
aggtagggttaatggagatata

SEQ ID NO: 10039743 - DNA, 22 bp, Homo sapiens
aggtagggaagaaggcatgaaa

SEQ ID NO: 10039744 - DNA, 22 bp, Homo sapiens
cctgtgccaaaatctaggcagt

SEQ ID NO: 10039745 - DNA, 19 bp, Homo sapiens
cgcaggagccgaggtgacc

SEQ ID NO: 10039746 - DNA, 22 bp, Homo sapiens
cctgttgtggaaaaagcctgat

SEQ ID NO: 10039747 - DNA, 22 bp, Homo sapiens
cgggcgcactccgggcagctgt

SEQ ID NO: 10039748 - DNA, 22 bp, Homo sapiens
agtatgcatatttcaaagtaag

SEQ ID NO: 10039749 - DNA, 22 bp, Homo sapiens
agtatgtagtgcaatcagtcag

SEQ ID NO: 10039750 - DNA, 23 bp, Homo sapiens
aggatgtaggatgtatggcagag

SEQ ID NO: 10039751 - DNA, 19 bp, Homo sapiens
catgagctgctcacttccc

SEQ ID NO: 10039752 - DNA, 22 bp, Homo sapiens
aggagccaggaaacctgctctg

SEQ ID NO: 10039753 - DNA, 20 bp, Homo sapiens
cagtccaggctagaaaacaa

SEQ ID NO: 10039754 - DNA, 22 bp, Homo sapiens
cagtccagccccctgctaaaag

SEQ ID NO: 10039755 - DNA, 22 bp, Homo sapiens
cataacatgtacatataaatgc

SEQ ID NO: 10039756 - DNA, 22 bp, Homo sapiens
cataagaatatttagtggcagc

SEQ ID NO: 10039757 - DNA, 22 bp, Homo sapiens
cataagaaataatgatgatgac

SEQ ID NO: 10039758 - DNA, 22 bp, Homo sapiens
aggagctgtgaatgggaggggt

SEQ ID NO: 10039759 - DNA, 22 bp, Homo sapiens
aggcaactgtttgataatgttg

SEQ ID NO: 10039760 - DNA, 22 bp, Homo sapiens
aggcaactcatcatgaaagact

SEQ ID NO: 10039761 - DNA, 22 bp, Homo sapiens
cattggccttttatcctagagg

SEQ ID NO: 10039762 - DNA, 22 bp, Homo sapiens
aggcactgttcccagttatcct

SEQ ID NO: 10039763 - DNA, 22 bp, Homo sapiens
aggacagagccctagtttcata

SEQ ID NO: 10039764 - DNA, 22 bp, Homo sapiens
aggacagagcctgtgcagaccg

SEQ ID NO: 10039765 - DNA, 22 bp, Homo sapiens
aggacagacctaggactggagc

SEQ ID NO: 10039766 - DNA, 22 bp, Homo sapiens
agctttgaaaatccaaattaca

SEQ ID NO: 10039767 - DNA, 22 bp, Homo sapiens
agctttgcactgagacagctca

SEQ ID NO: 10039768 - DNA, 22 bp, Homo sapiens
agctttgcaacctgaggccagt

SEQ ID NO: 10039769 - DNA, 22 bp, Homo sapiens
agctttgcacaacagagaggtg

SEQ ID NO: 10039770 - DNA, 22 bp, Homo sapiens
agctttgatagtacaggggctt

SEQ ID NO: 10039771 - DNA, 23 bp, Homo sapiens
agctttgaggactttaaaagata

SEQ ID NO: 10039772 - DNA, 22 bp, Homo sapiens
agctttgcttctgggagccaag

SEQ ID NO: 10039773 - DNA, 22 bp, Homo sapiens
aggaaaggattggcttctctgt

SEQ ID NO: 10039774 - DNA, 21 bp, Homo sapiens
aggaaaggccagcacgtaggg

SEQ ID NO: 10039775 - DNA, 21 bp, Homo sapiens
aggaaaggaagtccccagggt

SEQ ID NO: 10039776 - DNA, 22 bp, Homo sapiens
caggcccattctaggcttgcta

SEQ ID NO: 10039777 - DNA, 22 bp, Homo sapiens
caggcccatgagggcagccaca

SEQ ID NO: 10039778 - DNA, 22 bp, Homo sapiens
caggcccatctgctcccaggct

SEQ ID NO: 10039779 - DNA, 22 bp, Homo sapiens
caggcccaggtgtcgatgttcc

SEQ ID NO: 10039780 - DNA, 22 bp, Homo sapiens
caggcccaggggtctggcccac

SEQ ID NO: 10039781 - DNA, 22 bp, Homo sapiens
caggcccagggttattgggaaa

SEQ ID NO: 10039782 - DNA, 22 bp, Homo sapiens
caggcccagtgatcagggctct

SEQ ID NO: 10039783 - DNA, 22 bp, Homo sapiens
caggcagctcaaccttgggagc

SEQ ID NO: 10039784 - DNA, 22 bp, Homo sapiens
caggcagcgtcctgcttcctgt

SEQ ID NO: 10039785 - DNA, 22 bp, Homo sapiens
caggcagcgctcgtggcctggc

SEQ ID NO: 10039786 - DNA, 22 bp, Homo sapiens
agctgtcagtgctgtgcctgta

SEQ ID NO: 10039787 - DNA, 22 bp, Homo sapiens
caggaccccatattcactgaac

SEQ ID NO: 10039788 - DNA, 22 bp, Homo sapiens
caggcacacagggaatttggct

SEQ ID NO: 10039789 - DNA, 22 bp, Homo sapiens
caggcacacccactggtgcaga

SEQ ID NO: 10039790 - DNA, 22 bp, Homo sapiens
caggatgggatgtagtgggccc

SEQ ID NO: 10039791 - DNA, 22 bp, Homo sapiens
caggatgggtgtcggccagcac

SEQ ID NO: 10039792 - DNA, 22 bp, Homo sapiens
caggagtgaaatgaggcccagg

SEQ ID NO: 10039793 - DNA, 22 bp, Homo sapiens
caggatggccccggggctgtgc

SEQ ID NO: 10039794 - DNA, 22 bp, Homo sapiens
caggatggagggagggctgtta

SEQ ID NO: 10039795 - DNA, 22 bp, Homo sapiens
caggagccacattccaccttga

SEQ ID NO: 10039796 - DNA, 22 bp, Homo sapiens
aggcctggtgtgccggatgcag

SEQ ID NO: 10039797 - DNA, 22 bp, Homo sapiens
aggcctgggcaagaaggggcgt

SEQ ID NO: 10039798 - DNA, 22 bp, Homo sapiens
ccaggcactgctcgaggtgcta

SEQ ID NO: 10039799 - DNA, 22 bp, Homo sapiens
aggccctggacactcaagccgg

SEQ ID NO: 10039800 - DNA, 22 bp, Homo sapiens
aggccctgctgaggcctccctc

SEQ ID NO: 10039801 - DNA, 21 bp, Homo sapiens
aggccctggaggtcagagaaa

SEQ ID NO: 10039802 - DNA, 22 bp, Homo sapiens
aggcaggtcccctggaaggcac

SEQ ID NO: 10039803 - DNA, 22 bp, Homo sapiens
aggcaggtgagtcaaaacagac

SEQ ID NO: 10039804 - DNA, 17 bp, Homo sapiens
aggcaggtaagagttat

SEQ ID NO: 10039805 - DNA, 19 bp, Homo sapiens
aggcaggtgcagaggtccc

SEQ ID NO: 10039806 - DNA, 22 bp, Homo sapiens
ccagaggtggtgggtgctacag

SEQ ID NO: 10039807 - DNA, 22 bp, Homo sapiens
aggccctgacctgggagatcta

SEQ ID NO: 10039808 - DNA, 17 bp, Homo sapiens
ccagccctcgcgctttt

SEQ ID NO: 10039809 - DNA, 22 bp, Homo sapiens
ccagccctcggtagtcccatag

SEQ ID NO: 10039810 - DNA, 22 bp, Homo sapiens
ccaggttcaaatagctgtgtga

SEQ ID NO: 10039811 - DNA, 20 bp, Homo sapiens
ccaggcctgggcctgctcta

SEQ ID NO: 10039812 - DNA, 22 bp, Homo sapiens
aggctcagattcacatttggtt

SEQ ID NO: 10039813 - DNA, 22 bp, Homo sapiens
cccacgtcgaacttgctccaga

SEQ ID NO: 10039814 - DNA, 22 bp, Homo sapiens
cccacacatttttcacttaccg

SEQ ID NO: 10039815 - DNA, 22 bp, Homo sapiens
cccacacacatttatgatagga

SEQ ID NO: 10039816 - DNA, 22 bp, Homo sapiens
ccagtgtattatttgagaaatt

SEQ ID NO: 10039817 - DNA, 22 bp, Homo sapiens
aggctgcagcttgtctcgtggg

SEQ ID NO: 10039818 - DNA, 22 bp, Homo sapiens
cccaggaaatagccaggaggtg

SEQ ID NO: 10039819 - DNA, 22 bp, Homo sapiens
aggcttggctctcctatgagaa

SEQ ID NO: 10039820 - DNA, 22 bp, Homo sapiens
aggctttcctgtcactcatgct

SEQ ID NO: 10039821 - DNA, 22 bp, Homo sapiens
cccaggcctggtctgggccagt

SEQ ID NO: 10039822 - DNA, 22 bp, Homo sapiens
agggaccaggggtagctgagat

SEQ ID NO: 10039823 - DNA, 23 bp, Homo sapiens
agggcccaagcctggacagcagg

SEQ ID NO: 10039824 - DNA, 20 bp, Homo sapiens
agggcccaggaagagagtta

SEQ ID NO: 10039825 - DNA, 21 bp, Homo sapiens
cccctgggagccctgtcagta

SEQ ID NO: 10039826 - DNA, 22 bp, Homo sapiens
cccctgggtccaggcttctctg

SEQ ID NO: 10039827 - DNA, 22 bp, Homo sapiens
agggcagctgtgagccactgtg

SEQ ID NO: 10039828 - DNA, 22 bp, Homo sapiens
agggcagctgtgagccactgtg

SEQ ID NO: 10039829 - DNA, 22 bp, Homo sapiens
agggcccatgtgggagcacttg

SEQ ID NO: 10039830 - DNA, 22 bp, Homo sapiens
ccctggccagggcacagggagg

SEQ ID NO: 10039831 - DNA, 19 bp, Homo sapiens
ccctggcaggcaagcctgg

SEQ ID NO: 10039832 - DNA, 22 bp, Homo sapiens
agggggtgcccagatgaaggat

SEQ ID NO: 10039833 - DNA, 22 bp, Homo sapiens
agggggtgcatttgtgaatgaa

SEQ ID NO: 10039834 - DNA, 22 bp, Homo sapiens
cctctgtgtcctggtcattgaa

SEQ ID NO: 10039835 - DNA, 22 bp, Homo sapiens
cctcctggtccagcatctcttt

SEQ ID NO: 10039836 - DNA, 22 bp, Homo sapiens
aggggaatgggtagactgttga

SEQ ID NO: 10039837 - DNA, 22 bp, Homo sapiens
gtgcccaggtgtccctgagaag

SEQ ID NO: 10039838 - DNA, 22 bp, Homo sapiens
gtgcccagtcctgccttgacag

SEQ ID NO: 10039839 - DNA, 22 bp, Homo sapiens
cagcctggacagcgaccagagt

SEQ ID NO: 10039840 - DNA, 16 bp, Homo sapiens
cagcctgcagtggtca

SEQ ID NO: 10039841 - DNA, 22 bp, Homo sapiens
cagcctctttccacatcaggca

SEQ ID NO: 10039842 - DNA, 22 bp, Homo sapiens
gtgcccagtgcaggcccgcagg

SEQ ID NO: 10039843 - DNA, 22 bp, Homo sapiens
gtgcccagttgaggccaggact

SEQ ID NO: 10039844 - DNA, 22 bp, Homo sapiens
cagcaggaaggtttcccctgca

SEQ ID NO: 10039845 - DNA, 20 bp, Homo sapiens
cagcaggaaaagtgcctcag

SEQ ID NO: 10039846 - DNA, 22 bp, Homo sapiens
gtctgtctcctgggtgcgcacc

SEQ ID NO: 10039847 - DNA, 22 bp, Homo sapiens
gtctgtctgttgttgagaagca

SEQ ID NO: 10039848 - DNA, 22 bp, Homo sapiens
gtctgtctctctccagagtgca

SEQ ID NO: 10039849 - DNA, 22 bp, Homo sapiens
cagccctcaggtcctcagcagc

SEQ ID NO: 10039850 - DNA, 22 bp, Homo sapiens
gtccctggggaatcagctggag

SEQ ID NO: 10039851 - DNA, 19 bp, Homo sapiens
gtccctgggcagaggcacc

SEQ ID NO: 10039852 - DNA, 22 bp, Homo sapiens
gtccctgggtctaaggcagtaa

SEQ ID NO: 10039853 - DNA, 22 bp, Homo sapiens
cagagtctggactgcaggctcc

SEQ ID NO: 10039854 - DNA, 22 bp, Homo sapiens
ggggagagtcctttccagttcc

SEQ ID NO: 10039855 - DNA, 22 bp, Homo sapiens
ggggagagtattttattcaagt

SEQ ID NO: 10039856 - DNA, 22 bp, Homo sapiens
ggggagcagaagcagcaacaac

SEQ ID NO: 10039857 - DNA, 22 bp, Homo sapiens
ggtgacctcacctggtcccacc

SEQ ID NO: 10039858 - DNA, 22 bp, Homo sapiens
ggtgacagttccggaggtacag

SEQ ID NO: 10039859 - DNA, 22 bp, Homo sapiens
ggtgacgaatccatagcatcga

SEQ ID NO: 10039860 - DNA, 21 bp, Homo sapiens
cagcaaggaagtcgagtaggt

SEQ ID NO: 10039861 - DNA, 22 bp, Homo sapiens
cagcaaggactgggcatgtgaa

SEQ ID NO: 10039862 - DNA, 22 bp, Homo sapiens
cagcaccatttgcagcctcttt

SEQ ID NO: 10039863 - DNA, 22 bp, Homo sapiens
gggccaccccactgcccacgct

SEQ ID NO: 10039864 - DNA, 22 bp, Homo sapiens
cagagcctcatcatccactcca

SEQ ID NO: 10039865 - DNA, 22 bp, Homo sapiens
cagaggacttcccactcatctg

SEQ ID NO: 10039866 - DNA, 22 bp, Homo sapiens
cagaccctgggccacagaggag

SEQ ID NO: 10039867 - DNA, 22 bp, Homo sapiens
ggcttcaccaggtgcatgcatg

SEQ ID NO: 10039868 - DNA, 22 bp, Homo sapiens
gggcaggtatttatcttctatt

SEQ ID NO: 10039869 - DNA, 22 bp, Homo sapiens
gggcagcattctgtgggcaggt

SEQ ID NO: 10039870 - DNA, 22 bp, Homo sapiens
gggcagcatcaggaggggcttt

SEQ ID NO: 10039871 - DNA, 22 bp, Homo sapiens
ggaggtggaggttgcagtgagc

SEQ ID NO: 10039872 - DNA, 22 bp, Homo sapiens
ggccactgctctccagcctggg

SEQ ID NO: 10039873 - DNA, 22 bp, Homo sapiens
ggccccaggtagaagatataga

SEQ ID NO: 10039874 - DNA, 23 bp, Homo sapiens
cagaaagtttgagaagatacatc

SEQ ID NO: 10039875 - DNA, 22 bp, Homo sapiens
ggctgtcttgggagctcccccg

SEQ ID NO: 10039876 - DNA, 22 bp, Homo sapiens
ggctgcctagacttggaatttc

SEQ ID NO: 10039877 - DNA, 22 bp, Homo sapiens
ggctccagggtacccctggatg

SEQ ID NO: 10039878 - DNA, 22 bp, Homo sapiens
ggagcaggcagggccgtgtctg

SEQ ID NO: 10039879 - DNA, 19 bp, Homo sapiens
ggagcctggagcacgtgcc

SEQ ID NO: 10039880 - DNA, 22 bp, Homo sapiens
ggagcctgacagtgcccagcat

SEQ ID NO: 10039881 - DNA, 18 bp, Homo sapiens
gctttgcagaaatacaga

SEQ ID NO: 10039882 - DNA, 22 bp, Homo sapiens
caatgtgtgtgtttttctcaac

SEQ ID NO: 10039883 - DNA, 22 bp, Homo sapiens
caaggtgatacttacattagtg

SEQ ID NO: 10039884 - DNA, 22 bp, Homo sapiens
gctggaggaggaagtgtgaggg

SEQ ID NO: 10039885 - DNA, 22 bp, Homo sapiens
gctggaggatcacttgagccca

SEQ ID NO: 10039886 - DNA, 22 bp, Homo sapiens
gctggaggatggactggaagaa

SEQ ID NO: 10039887 - DNA, 22 bp, Homo sapiens
caagcaggaggagaagtttctg

SEQ ID NO: 10039888 - DNA, 22 bp, Homo sapiens
caaggccctgcaacctgacttg

SEQ ID NO: 10039889 - DNA, 22 bp, Homo sapiens
caaggcttatcagccaggagcc

SEQ ID NO: 10039890 - DNA, 22 bp, Homo sapiens
attccttgggaattattgaatg

SEQ ID NO: 10039891 - DNA, 22 bp, Homo sapiens
attccttggcattctggacttg

SEQ ID NO: 10039892 - DNA, 22 bp, Homo sapiens
attccttgtatatctacatgca

SEQ ID NO: 10039893 - DNA, 22 bp, Homo sapiens
attccttgggctgccttattat

SEQ ID NO: 10039894 - DNA, 22 bp, Homo sapiens
gcagctgctggagggaggcagg

SEQ ID NO: 10039895 - DNA, 22 bp, Homo sapiens
attccttggaacagatgcgaag

SEQ ID NO: 10039896 - DNA, 22 bp, Homo sapiens
attccttgctctcatcaacctt

SEQ ID NO: 10039897 - DNA, 22 bp, Homo sapiens
attccttgcacatcagatagtt

SEQ ID NO: 10039898 - DNA, 22 bp, Homo sapiens
gcaggcctgcccagcaggatgg

SEQ ID NO: 10039899 - DNA, 22 bp, Homo sapiens
gcatatgatcacgtgtgtcggt

SEQ ID NO: 10039900 - DNA, 22 bp, Homo sapiens
attgtcagctcgaaatgcatca

SEQ ID NO: 10039901 - DNA, 22 bp, Homo sapiens
gcatacagtccttgtattcttc

SEQ ID NO: 10039902 - DNA, 18 bp, Homo sapiens
gcatacagaggggaagta

SEQ ID NO: 10039903 - DNA, 22 bp, Homo sapiens
gcatacagagaggatgtggcat

SEQ ID NO: 10039904 - DNA, 22 bp, Homo sapiens
gcagtgtggccccagtatcacg

SEQ ID NO: 10039905 - DNA, 22 bp, Homo sapiens
gcagtgtgtctggagtacatgg

SEQ ID NO: 10039906 - DNA, 22 bp, Homo sapiens
attgtctgtactttaaaaatgt

SEQ ID NO: 10039907 - DNA, 22 bp, Homo sapiens
gcagcagagtttgggagatggt

SEQ ID NO: 10039908 - DNA, 22 bp, Homo sapiens
gcagcagatgctttcatggaca

SEQ ID NO: 10039909 - DNA, 22 bp, Homo sapiens
gcagcagagtagacagagccct

SEQ ID NO: 10039910 - DNA, 21 bp, Homo sapiens
gcagcagaggcttgacagaca

SEQ ID NO: 10039911 - DNA, 22 bp, Homo sapiens
gcagcagaggccctactctttg

SEQ ID NO: 10039912 - DNA, 22 bp, Homo sapiens
gcagcagagctttgtcctggct

SEQ ID NO: 10039913 - DNA, 17 bp, Homo sapiens
gcagcagagagaccctc

SEQ ID NO: 10039914 - DNA, 20 bp, Homo sapiens
gcagcagacagacaggggac

SEQ ID NO: 10039915 - DNA, 22 bp, Homo sapiens
gcagcagagaacacaatgatgg

SEQ ID NO: 10039916 - DNA, 22 bp, Homo sapiens
gcagcagagaccccaggaagga

SEQ ID NO: 10039917 - DNA, 22 bp, Homo sapiens
attcacttattctcaaagtcct

SEQ ID NO: 10039918 - DNA, 22 bp, Homo sapiens
attacaatcgagagaaacaaat

SEQ ID NO: 10039919 - DNA, 22 bp, Homo sapiens
attagtggtatctatcatagaa

SEQ ID NO: 10039920 - DNA, 22 bp, Homo sapiens
attagttgatctatatccaaag

SEQ ID NO: 10039921 - DNA, 22 bp, Homo sapiens
gctgacccctacaggttgtgtt

SEQ ID NO: 10039922 - DNA, 22 bp, Homo sapiens
gccccaggttgcctgtcccagg

SEQ ID NO: 10039923 - DNA, 22 bp, Homo sapiens
gcctcaaaagtgttgtagaggg

SEQ ID NO: 10039924 - DNA, 22 bp, Homo sapiens
gcctcaaatgtggagcactatt

SEQ ID NO: 10039925 - DNA, 22 bp, Homo sapiens
gcctcttgtttccttacatgga

SEQ ID NO: 10039926 - DNA, 22 bp, Homo sapiens
gcctggattacaaacagccaac

SEQ ID NO: 10039927 - DNA, 22 bp, Homo sapiens
gagggcgcttcagagagatgaa

SEQ ID NO: 10039928 - DNA, 22 bp, Homo sapiens
atgtcctggggtcttctcttca

SEQ ID NO: 10039929 - DNA, 22 bp, Homo sapiens
atgttggagtcgtaaggcatgg

SEQ ID NO: 10039930 - DNA, 22 bp, Homo sapiens
gaggcagcattcgcatagacag

SEQ ID NO: 10039931 - DNA, 22 bp, Homo sapiens
gaggcagcattcgcatagacag

SEQ ID NO: 10039932 - DNA, 22 bp, Homo sapiens
atgggctgtgggaccctggacc

SEQ ID NO: 10039933 - DNA, 22 bp, Homo sapiens
atggccagagaggccagcctgg

SEQ ID NO: 10039934 - DNA, 22 bp, Homo sapiens
atgatcagggcagaagcagaag

SEQ ID NO: 10039935 - DNA, 22 bp, Homo sapiens
atgatgaggtcccaagatctca

SEQ ID NO: 10039936 - DNA, 22 bp, Homo sapiens
atgacaggaataactatgatgg

SEQ ID NO: 10039937 - DNA, 22 bp, Homo sapiens
ctttcctagaaatatatactta

SEQ ID NO: 10039938 - DNA, 22 bp, Homo sapiens
atgctatgtttggtgttggaga

SEQ ID NO: 10039939 - DNA, 22 bp, Homo sapiens
gactggagataaaaccatgagt

SEQ ID NO: 10039940 - DNA, 22 bp, Homo sapiens
gaagtcttcattctctctgaga

SEQ ID NO: 10039941 - DNA, 22 bp, Homo sapiens
gaagtcttgaaacacaaactag

SEQ ID NO: 10039942 - DNA, 22 bp, Homo sapiens
gaaggctggctttctgagagca

SEQ ID NO: 10039943 - DNA, 22 bp, Homo sapiens
gaaggctggaaggcaagtagga

SEQ ID NO: 10039944 - DNA, 22 bp, Homo sapiens
atgcacaaggtagattattatt

SEQ ID NO: 10039945 - DNA, 22 bp, Homo sapiens
cactgggtcaggatagagccca

SEQ ID NO: 10039946 - DNA, 22 bp, Homo sapiens
cagaaagacctgggctcaagag

SEQ ID NO: 10039947 - DNA, 22 bp, Homo sapiens
cactgcacaatgtagcaaagaa

SEQ ID NO: 10039948 - DNA, 22 bp, Homo sapiens
cacctgcagggggagtcaagag

SEQ ID NO: 10039949 - DNA, 22 bp, Homo sapiens
agcaggtggcctcctgtctgtc

SEQ ID NO: 10039950 - DNA, 22 bp, Homo sapiens
caatttctggaactaattctga

SEQ ID NO: 10039951 - DNA, 19 bp, Homo sapiens
agcaggccacagggccagc

SEQ ID NO: 10039952 - DNA, 22 bp, Homo sapiens
agcagaccaggagtgcacaggt

SEQ ID NO: 10039953 - DNA, 21 bp, Homo sapiens
agcagacagatgcacgcacac

SEQ ID NO: 10039954 - DNA, 21 bp, Homo sapiens
caattactatgaaccagttga

SEQ ID NO: 10039955 - DNA, 22 bp, Homo sapiens
caattacttttgcaccaatata

SEQ ID NO: 10039956 - DNA, 22 bp, Homo sapiens
caagtccaggtcaatttaaagc

SEQ ID NO: 10039957 - DNA, 22 bp, Homo sapiens
caagtccaagatcaagaagcca

SEQ ID NO: 10039958 - DNA, 22 bp, Homo sapiens
caagtccaggtgggcaaataaa

SEQ ID NO: 10039959 - DNA, 22 bp, Homo sapiens
caagtccatcagataagcaaga

SEQ ID NO: 10039960 - DNA, 22 bp, Homo sapiens
caagggagttgctgcatgcagg

SEQ ID NO: 10039961 - DNA, 22 bp, Homo sapiens
cagagccaggtctaggagtctc

SEQ ID NO: 10039962 - DNA, 22 bp, Homo sapiens
agccagggacgctgcaggctac

SEQ ID NO: 10039963 - DNA, 22 bp, Homo sapiens
agccctctgagctagtcaccat

SEQ ID NO: 10039964 - DNA, 22 bp, Homo sapiens
agccctctgctgttctagtctc

SEQ ID NO: 10039965 - DNA, 22 bp, Homo sapiens
agcctgcttgagagtcctggct

SEQ ID NO: 10039966 - DNA, 22 bp, Homo sapiens
agctctggctaagctgataaat

SEQ ID NO: 10039967 - DNA, 22 bp, Homo sapiens
agctctggagccggaggatttc

SEQ ID NO: 10039968 - DNA, 22 bp, Homo sapiens
cagcctttgtgaacatcaggtg

SEQ ID NO: 10039969 - DNA, 22 bp, Homo sapiens
cagccttttaggactatttgtg

SEQ ID NO: 10039970 - DNA, 22 bp, Homo sapiens
cagccttttccatgtattgttg

SEQ ID NO: 10039971 - DNA, 22 bp, Homo sapiens
cagcctttcttgactgtgtgtt

SEQ ID NO: 10039972 - DNA, 22 bp, Homo sapiens
cagcctttgaacttcagaggtt

SEQ ID NO: 10039973 - DNA, 22 bp, Homo sapiens
cagcctttgggtcagaagattc

SEQ ID NO: 10039974 - DNA, 22 bp, Homo sapiens
cagccttttcttaaaatgcaag

SEQ ID NO: 10039975 - DNA, 22 bp, Homo sapiens
cagcctctgagccttggcagat

SEQ ID NO: 10039976 - DNA, 18 bp, Homo sapiens
cagcctctgattggttgc

SEQ ID NO: 10039977 - DNA, 22 bp, Homo sapiens
cagcctcttgcactttgaaggc

SEQ ID NO: 10039978 - DNA, 22 bp, Homo sapiens
cagcctttccaattgctgctgc

SEQ ID NO: 10039979 - DNA, 22 bp, Homo sapiens
cagcctttctgtttcctaaggt

SEQ ID NO: 10039980 - DNA, 22 bp, Homo sapiens
cagcctttatggaaaggcctgg

SEQ ID NO: 10039981 - DNA, 22 bp, Homo sapiens
cagcctttaagcttggataggt

SEQ ID NO: 10039982 - DNA, 22 bp, Homo sapiens
cagcctttatctcctgggctca

SEQ ID NO: 10039983 - DNA, 22 bp, Homo sapiens
cagcctttagcattaattccaa

SEQ ID NO: 10039984 - DNA, 22 bp, Homo sapiens
cagcctctctgtatctcaggat

SEQ ID NO: 10039985 - DNA, 22 bp, Homo sapiens
cagcagaaaatacctgtaactc

SEQ ID NO: 10039986 - DNA, 22 bp, Homo sapiens
cagcagaaaatgtgggtgattt

SEQ ID NO: 10039987 - DNA, 22 bp, Homo sapiens
agagaacagacagatgcaatga

SEQ ID NO: 10039988 - DNA, 20 bp, Homo sapiens
agacagtggggagctcctag

SEQ ID NO: 10039989 - DNA, 22 bp, Homo sapiens
atgaccagccgagataaacaga

SEQ ID NO: 10039990 - DNA, 22 bp, Homo sapiens
atcttacactgttgggtttctc

SEQ ID NO: 10039991 - DNA, 22 bp, Homo sapiens
atgtacatactgcattttcaaa

SEQ ID NO: 10039992 - DNA, 21 bp, Homo sapiens
atgtagggtttgccttctcta

SEQ ID NO: 10039993 - DNA, 17 bp, Homo sapiens
atgtatattaactctga

SEQ ID NO: 10039994 - DNA, 20 bp, Homo sapiens
agagatggggtatcaccgta

SEQ ID NO: 10039995 - DNA, 22 bp, Homo sapiens
agagctagaaggaagcatttct

SEQ ID NO: 10039996 - DNA, 22 bp, Homo sapiens
atgttccttccagagagcagaa

SEQ ID NO: 10039997 - DNA, 22 bp, Homo sapiens
attgtataagtctatttacaat

SEQ ID NO: 10039998 - DNA, 22 bp, Homo sapiens
agaggccggccgagcccatggg

SEQ ID NO: 10039999 - DNA, 22 bp, Homo sapiens
agaggaagccattgcttactga

SEQ ID NO: 10040000 - DNA, 22 bp, Homo sapiens
attctctagtctcttccataaa

SEQ ID NO: 10040001 - DNA, 22 bp, Homo sapiens
atttctttctggccacggtttt

SEQ ID NO: 10040002 - DNA, 22 bp, Homo sapiens
agcaaggtggagaaggatgggt

SEQ ID NO: 10040003 - DNA, 22 bp, Homo sapiens
agtgctttccctgaaaccttcc

SEQ ID NO: 10040004 - DNA, 22 bp, Homo sapiens
agtgaggctaataggcaatggt

SEQ ID NO: 10040005 - DNA, 22 bp, Homo sapiens
actggggagttgaagcactttc

SEQ ID NO: 10040006 - DNA, 22 bp, Homo sapiens
aggtgcagtgaaggaaaaggaa

SEQ ID NO: 10040007 - DNA, 22 bp, Homo sapiens
aggtgcagtgtttaaaagtagc

SEQ ID NO: 10040008 - DNA, 22 bp, Homo sapiens
aggtgccaagatgtcacagaca

SEQ ID NO: 10040009 - DNA, 22 bp, Homo sapiens
aggtgccagatgcacagctgaa

SEQ ID NO: 10040010 - DNA, 21 bp, Homo sapiens
aggtgccaaggagaagcaggc

SEQ ID NO: 10040011 - DNA, 22 bp, Homo sapiens
agggtgcagtcacaggaaatgt

SEQ ID NO: 10040012 - DNA, 19 bp, Homo sapiens
agggtccaggccctgtgga

SEQ ID NO: 10040013 - DNA, 22 bp, Homo sapiens
agggtcccgaaggagacagcaa

SEQ ID NO: 10040014 - DNA, 22 bp, Homo sapiens
agggtccattctttgccttttc

SEQ ID NO: 10040015 - DNA, 22 bp, Homo sapiens
agggtcccgtccctctgcaccc

SEQ ID NO: 10040016 - DNA, 22 bp, Homo sapiens
agggtgcaaaagcaaggacagt

SEQ ID NO: 10040017 - DNA, 20 bp, Homo sapiens
aggttcctttgtggagaatt

SEQ ID NO: 10040018 - DNA, 22 bp, Homo sapiens
aggttctcacacgtctacaccc

SEQ ID NO: 10040019 - DNA, 22 bp, Homo sapiens
aggttccttatggggatggcta

SEQ ID NO: 10040020 - DNA, 20 bp, Homo sapiens
aggtgtccacgtggcagggt

SEQ ID NO: 10040021 - DNA, 22 bp, Homo sapiens
aggttcccagagatagagctgt

SEQ ID NO: 10040022 - DNA, 22 bp, Homo sapiens
aggttcccaggatctgtctggg

SEQ ID NO: 10040023 - DNA, 19 bp, Homo sapiens
atacactaatataaaccac

SEQ ID NO: 10040024 - DNA, 22 bp, Homo sapiens
atacacgtgtgtgtacatgcac

SEQ ID NO: 10040025 - DNA, 20 bp, Homo sapiens
atacaatcatgaggaaaaag

SEQ ID NO: 10040026 - DNA, 22 bp, Homo sapiens
atacaatcaaccacttgcgagc

SEQ ID NO: 10040027 - DNA, 22 bp, Homo sapiens
agttctttgtgagtaatacaga

SEQ ID NO: 10040028 - DNA, 22 bp, Homo sapiens
atagctttcttaaatatataaa

SEQ ID NO: 10040029 - DNA, 22 bp, Homo sapiens
atatagaaggtgctatttacat

SEQ ID NO: 10040030 - DNA, 22 bp, Homo sapiens
atcaattcttaggaaaatagct

SEQ ID NO: 10040031 - DNA, 22 bp, Homo sapiens
atcaagctggcatatgtagttc

SEQ ID NO: 10040032 - DNA, 22 bp, Homo sapiens
agaaatatgctgattagatgaa

SEQ ID NO: 10040033 - DNA, 22 bp, Homo sapiens
agaaatcagaaccctgaagttc

SEQ ID NO: 10040034 - DNA, 22 bp, Homo sapiens
agaagcaggcctcacagatctg

SEQ ID NO: 10040035 - DNA, 22 bp, Homo sapiens
acatttctcaggtaagtcattt

SEQ ID NO: 10040036 - DNA, 20 bp, Homo sapiens
aggctcactcaccttgtgga

SEQ ID NO: 10040037 - DNA, 22 bp, Homo sapiens
acctcaggatgtggacacagaa

SEQ ID NO: 10040038 - DNA, 22 bp, Homo sapiens
acctcacaagtctctgtcagct

SEQ ID NO: 10040039 - DNA, 22 bp, Homo sapiens
aggggagcccctggtcctggtg

SEQ ID NO: 10040040 - DNA, 22 bp, Homo sapiens
agggaggtctggctgccctgag

SEQ ID NO: 10040041 - DNA, 22 bp, Homo sapiens
agggaggcaggaaagttgtctg

SEQ ID NO: 10040042 - DNA, 20 bp, Homo sapiens
aggcagtgtagagatgagta

SEQ ID NO: 10040043 - DNA, 18 bp, Homo sapiens
aggcaggtgctggaagtc

SEQ ID NO: 10040044 - DNA, 22 bp, Homo sapiens
aggcaggtgttgggagacacca

SEQ ID NO: 10040045 - DNA, 22 bp, Homo sapiens
aggcaggtgggtcacttgagtc

SEQ ID NO: 10040046 - DNA, 23 bp, Homo sapiens
aggcactcgacagaaatattgga

SEQ ID NO: 10040047 - DNA, 22 bp, Homo sapiens
acagtggcttttgtgtctgcag

SEQ ID NO: 10040048 - DNA, 22 bp, Homo sapiens
acagtggcatctacttaatctg

SEQ ID NO: 10040049 - DNA, 22 bp, Homo sapiens
acagtggcagtcgtgttctcta

SEQ ID NO: 10040050 - DNA, 22 bp, Homo sapiens
aggaaaggtagcgtgccagcag

SEQ ID NO: 10040051 - DNA, 19 bp, Homo sapiens
aggaaaggtggccttagca

SEQ ID NO: 10040052 - DNA, 22 bp, Homo sapiens
aggactggcagtgtgaggggtc

SEQ ID NO: 10040053 - DNA, 22 bp, Homo sapiens
aggactggccctgaggggaggc

SEQ ID NO: 10040054 - DNA, 22 bp, Homo sapiens
aggactggcggtcggtggggat

SEQ ID NO: 10040055 - DNA, 22 bp, Homo sapiens
aggactgggtgcagagggcatc

SEQ ID NO: 10040056 - DNA, 22 bp, Homo sapiens
acagggccttatatccagaagg

SEQ ID NO: 10040057 - DNA, 22 bp, Homo sapiens
acagggccctgtgggccccact

SEQ ID NO: 10040058 - DNA, 22 bp, Homo sapiens
acagggcctcagccagggcaga

SEQ ID NO: 10040059 - DNA, 22 bp, Homo sapiens
acagcagtgtctggtactgagt

SEQ ID NO: 10040060 - DNA, 22 bp, Homo sapiens
acaggaagaaagtgcagtagat

SEQ ID NO: 10040061 - DNA, 20 bp, Homo sapiens
acacatatagcagcataaac

SEQ ID NO: 10040062 - DNA, 22 bp, Homo sapiens
acacatataccactgtaaatga

SEQ ID NO: 10040063 - DNA, 21 bp, Homo sapiens
acacttcagtttttaaaggga

SEQ ID NO: 10040064 - DNA, 22 bp, Homo sapiens
acacttcatgcattcttcactc

SEQ ID NO: 10040065 - DNA, 20 bp, Homo sapiens
acagaaagctgccttgtccc

SEQ ID NO: 10040066 - DNA, 22 bp, Homo sapiens
acagagcaattcttgggtgttt

SEQ ID NO: 10040067 - DNA, 22 bp, Homo sapiens
acagagcacagtcgggatggga

SEQ ID NO: 10040068 - DNA, 22 bp, Homo sapiens
acagctgctctacaggttattt

SEQ ID NO: 10040069 - DNA, 22 bp, Homo sapiens
acaaatgaatcatacataatgt

SEQ ID NO: 10040070 - DNA, 22 bp, Homo sapiens
acaaatgaacatataagcttga

SEQ ID NO: 10040071 - DNA, 22 bp, Homo sapiens
acaaaagaataagatgagtcat

SEQ ID NO: 10040072 - DNA, 22 bp, Homo sapiens
aatgtacaagggttccagtttt

SEQ ID NO: 10040073 - DNA, 22 bp, Homo sapiens
aagaactagtcttacagcctca

SEQ ID NO: 10040074 - DNA, 22 bp, Homo sapiens
acacagcaaggtctgactttgg

SEQ ID NO: 10040075 - DNA, 17 bp, Homo sapiens
acacagacaggcagaca

SEQ ID NO: 10040076 - DNA, 22 bp, Homo sapiens
aaggagtgcatgactcagagta

SEQ ID NO: 10040077 - DNA, 22 bp, Homo sapiens
aaggagtctgggccattcagag

SEQ ID NO: 10040078 - DNA, 22 bp, Homo sapiens
aaggcactgaaaaattgtgtgt

SEQ ID NO: 10040079 - DNA, 22 bp, Homo sapiens
aagggaggggatgtaagcctgg

SEQ ID NO: 10040080 - DNA, 22 bp, Homo sapiens
aaggcccagcctggagcttgtt

SEQ ID NO: 10040081 - DNA, 22 bp, Homo sapiens
aagtgcttaggtcaaaggacat

SEQ ID NO: 10040082 - DNA, 22 bp, Homo sapiens
aagtctttttgaatctataact

SEQ ID NO: 10040083 - DNA, 22 bp, Homo sapiens
aagtcttttgctaagagtaatg

SEQ ID NO: 10040084 - DNA, 22 bp, Homo sapiens
aagtctttcataagtctcttat

SEQ ID NO: 10040085 - DNA, 22 bp, Homo sapiens
aagtctgggcctccttcccaga

SEQ ID NO: 10040086 - DNA, 22 bp, Homo sapiens
aagtctggtgctgtcctcaccc

SEQ ID NO: 10040087 - DNA, 22 bp, Homo sapiens
aagggcagggagtttgtgtcta

SEQ ID NO: 10040088 - DNA, 22 bp, Homo sapiens
aacttggtaccaccttctgaag

SEQ ID NO: 10040089 - DNA, 22 bp, Homo sapiens
aacttggtaaattgtgtcagat

SEQ ID NO: 10040090 - DNA, 22 bp, Homo sapiens
aatgcagaccagtatgaaaaac

SEQ ID NO: 10040091 - DNA, 22 bp, Homo sapiens
aatgcacatgttgtaataaata

SEQ ID NO: 10040092 - DNA, 22 bp, Homo sapiens
aatgcacacatttggtactgaa

SEQ ID NO: 10040093 - DNA, 22 bp, Homo sapiens
aatgcacatatatttccttatt

SEQ ID NO: 10040094 - DNA, 22 bp, Homo sapiens
aatacatatggaattccatgtt

SEQ ID NO: 10040095 - DNA, 22 bp, Homo sapiens
aagttacagttggaactgtgaa

SEQ ID NO: 10040096 - DNA, 22 bp, Homo sapiens
aagttacaagactaaatggaag

SEQ ID NO: 10040097 - DNA, 22 bp, Homo sapiens
aaatgcacaataaagtaaaggc

SEQ ID NO: 10040098 - DNA, 22 bp, Homo sapiens
aaatacaaaaattagccaggca

SEQ ID NO: 10040099 - DNA, 22 bp, Homo sapiens
aaatacagattcttgtgtctat

SEQ ID NO: 10040100 - DNA, 19 bp, Homo sapiens
aaatacagcagctgtttcc

SEQ ID NO: 10040101 - DNA, 22 bp, Homo sapiens
aaatacaggagtttggacttct

SEQ ID NO: 10040102 - DNA, 22 bp, Homo sapiens
aaagttgtaatggaagaaatgc

SEQ ID NO: 10040103 - DNA, 19 bp, Homo sapiens
aaatatcagagagatgata

SEQ ID NO: 10040104 - DNA, 22 bp, Homo sapiens
aaattgtcagaattcagaaagt

SEQ ID NO: 10040105 - DNA, 22 bp, Homo sapiens
aaattgtccttttaagaaacag

SEQ ID NO: 10040106 - DNA, 22 bp, Homo sapiens
aaagcagcagaatctctcaggg

SEQ ID NO: 10040107 - DNA, 22 bp, Homo sapiens
aaaatacacatactaggggaaa

SEQ ID NO: 10040108 - DNA, 22 bp, Homo sapiens
aaaagtgttcaggaagaataat

SEQ ID NO: 10040109 - DNA, 22 bp, Homo sapiens
aaaagttacctctgtaatataa

SEQ ID NO: 10040110 - DNA, 22 bp, Homo sapiens
aaaagtttaagactcattctag

SEQ ID NO: 10040111 - DNA, 22 bp, Homo sapiens
aaaacactgcaaagctgattgg

SEQ ID NO: 10040112 - DNA, 22 bp, Homo sapiens
aaaacacaagaagcagggtaca

SEQ ID NO: 10040113 - DNA, 23 bp, Homo sapiens
aaaacagcttcctccagtggctc

SEQ ID NO: 10040114 - DNA, 22 bp, Homo sapiens
aaaacagtttaggcatcacagt

SEQ ID NO: 10040115 - DNA, 22 bp, Homo sapiens
aaaacacaagaagcagggtaca

SEQ ID NO: 10040116 - DNA, 22 bp, Homo sapiens
aaaacataaactgacagcccat

SEQ ID NO: 10040117 - DNA, 23 bp, Homo sapiens
aaatgtgagggaaaatctttctg

SEQ ID NO: 10040118 - DNA, 22 bp, Homo sapiens
aaatggtgtttctaatgctaga

SEQ ID NO: 10040119 - DNA, 22 bp, Homo sapiens
aaatacagagttatggacctca

SEQ ID NO: 10040120 - DNA, 22 bp, Homo sapiens
aaaggacatgtcaatatcaggc

SEQ ID NO: 10040121 - DNA, 22 bp, Homo sapiens
aaaattgtcgaacagtagtaac

SEQ ID NO: 10040122 - DNA, 22 bp, Homo sapiens
aaagttttctgccttcattaga

SEQ ID NO: 10040123 - DNA, 19 bp, Homo sapiens
aaagttttattctcatttg

SEQ ID NO: 10040124 - DNA, 22 bp, Homo sapiens
aatagcttttgtatgatgaaat

SEQ ID NO: 10040125 - DNA, 22 bp, Homo sapiens
agaagaaactgtcggggatatt

SEQ ID NO: 10040126 - DNA, 22 bp, Homo sapiens
agaagaaagattgaaggttcct

SEQ ID NO: 10040127 - DNA, 22 bp, Homo sapiens
aagtttttcacattgctgttgt

SEQ ID NO: 10040128 - DNA, 22 bp, Homo sapiens
aataaaatgaactggtagagtt

SEQ ID NO: 10040129 - DNA, 21 bp, Homo sapiens
aataaaacagttggtgtcaat

SEQ ID NO: 10040130 - DNA, 22 bp, Homo sapiens
aagtgtgttctctgataaactc

SEQ ID NO: 10040131 - DNA, 20 bp, Homo sapiens
aagggcagagggaacagact

SEQ ID NO: 10040132 - DNA, 22 bp, Homo sapiens
aagggcagagggaatcccacat

SEQ ID NO: 10040133 - DNA, 22 bp, Homo sapiens
aagggaggtaaagctatttaaa

SEQ ID NO: 10040134 - DNA, 22 bp, Homo sapiens
acccagggctcaagcgtaggca

SEQ ID NO: 10040135 - DNA, 21 bp, Homo sapiens
acccaggggaagcagaaactg

SEQ ID NO: 10040136 - DNA, 22 bp, Homo sapiens
aagtagttagtccgcctgctct

SEQ ID NO: 10040137 - DNA, 22 bp, Homo sapiens
aagtatatactaaatgttaatc

SEQ ID NO: 10040138 - DNA, 22 bp, Homo sapiens
aaggcacatattttagagtcac

SEQ ID NO: 10040139 - DNA, 17 bp, Homo sapiens
aaggcacagggcactgg

SEQ ID NO: 10040140 - DNA, 18 bp, Homo sapiens
aaggcacaggagaacatt

SEQ ID NO: 10040141 - DNA, 22 bp, Homo sapiens
aaggcacagccacttgatcatc

SEQ ID NO: 10040142 - DNA, 22 bp, Homo sapiens
aaggcacacagttagatagagc

SEQ ID NO: 10040143 - DNA, 22 bp, Homo sapiens
aaggcacagaggcagggcactt

SEQ ID NO: 10040144 - DNA, 22 bp, Homo sapiens
aaggcacatgacctaggcctgg

SEQ ID NO: 10040145 - DNA, 22 bp, Homo sapiens
acatcctcggggaaaggcactg

SEQ ID NO: 10040146 - DNA, 22 bp, Homo sapiens
aaggatgattggtaatgacact

SEQ ID NO: 10040147 - DNA, 20 bp, Homo sapiens
aagcttcacttcatttgatc

SEQ ID NO: 10040148 - DNA, 22 bp, Homo sapiens
agagttaaatgaaatggtatgt

SEQ ID NO: 10040149 - DNA, 18 bp, Homo sapiens
aatttctttgacaactta

SEQ ID NO: 10040150 - DNA, 22 bp, Homo sapiens
agcaaatacttgaataaaaaga

SEQ ID NO: 10040151 - DNA, 22 bp, Homo sapiens
agcaaaagatagattaacaaga

SEQ ID NO: 10040152 - DNA, 22 bp, Homo sapiens
agcaaatacatttttagcataa

SEQ ID NO: 10040153 - DNA, 22 bp, Homo sapiens
aatgtataaccataggaaattt

SEQ ID NO: 10040154 - DNA, 22 bp, Homo sapiens
agagatgaaaagggtactgagg

SEQ ID NO: 10040155 - DNA, 22 bp, Homo sapiens
agagatgaaaagtggagactgg

SEQ ID NO: 10040156 - DNA, 22 bp, Homo sapiens
aatgtgtactttttcatgctca

SEQ ID NO: 10040157 - DNA, 22 bp, Homo sapiens
agagctgcgtctattcacaatc

SEQ ID NO: 10040158 - DNA, 22 bp, Homo sapiens
agagctgcccacacagcagatt

SEQ ID NO: 10040159 - DNA, 22 bp, Homo sapiens
agagctgcaatttcatgtggtg

SEQ ID NO: 10040160 - DNA, 22 bp, Homo sapiens
agagctgcacctatgcagacct

SEQ ID NO: 10040161 - DNA, 22 bp, Homo sapiens
agagctgctcagatgtcactgc

SEQ ID NO: 10040162 - DNA, 22 bp, Homo sapiens
acagaagtgagtggcaagaact

SEQ ID NO: 10040163 - DNA, 17 bp, Homo sapiens
acagcagggaagtgttg

SEQ ID NO: 10040164 - DNA, 22 bp, Homo sapiens
acagcagtggattagaggatgg

SEQ ID NO: 10040165 - DNA, 22 bp, Homo sapiens
acagcagaccactactagtagg

SEQ ID NO: 10040166 - DNA, 22 bp, Homo sapiens
acagcagagtggagatgagcac

SEQ ID NO: 10040167 - DNA, 20 bp, Homo sapiens
acagcagataccacaactat

SEQ ID NO: 10040168 - DNA, 22 bp, Homo sapiens
acagcagagtgtgagatagcca

SEQ ID NO: 10040169 - DNA, 22 bp, Homo sapiens
acagcagagttgagtagttgca

SEQ ID NO: 10040170 - DNA, 20 bp, Homo sapiens
acagcagccttgctagaaac

SEQ ID NO: 10040171 - DNA, 22 bp, Homo sapiens
acagcagcaatagcagtgacat

SEQ ID NO: 10040172 - DNA, 22 bp, Homo sapiens
acagcagatttccctgggctcc

SEQ ID NO: 10040173 - DNA, 22 bp, Homo sapiens
acagcagatctgtggagcttat

SEQ ID NO: 10040174 - DNA, 22 bp, Homo sapiens
acagcagatctggctacaggtt

SEQ ID NO: 10040175 - DNA, 22 bp, Homo sapiens
acagcagatgacaactatttat

SEQ ID NO: 10040176 - DNA, 22 bp, Homo sapiens
acagcagattacattctgctat

SEQ ID NO: 10040177 - DNA, 22 bp, Homo sapiens
agccaaggtcgccccagggcaa

SEQ ID NO: 10040178 - DNA, 22 bp, Homo sapiens
agccaaggtatcatgagaggca

SEQ ID NO: 10040179 - DNA, 22 bp, Homo sapiens
agccaagggtcagctgcacaga

SEQ ID NO: 10040180 - DNA, 22 bp, Homo sapiens
acaccaggtcccgtctgtacct

SEQ ID NO: 10040181 - DNA, 22 bp, Homo sapiens
acacccagattatgcacacaaa

SEQ ID NO: 10040182 - DNA, 22 bp, Homo sapiens
acacttcaaatggttggaaaat

SEQ ID NO: 10040183 - DNA, 21 bp, Homo sapiens
tcagtgcaattctatggggaa

SEQ ID NO: 10040184 - DNA, 22 bp, Homo sapiens
tcagtgtctagggacagtaatc

SEQ ID NO: 10040185 - DNA, 22 bp, Homo sapiens
tcaggttctggtgagggccctt

SEQ ID NO: 10040186 - DNA, 22 bp, Homo sapiens
tcagcagaaaggcactagatga

SEQ ID NO: 10040187 - DNA, 22 bp, Homo sapiens
tcagcagaacaaggaagcttaa

SEQ ID NO: 10040188 - DNA, 21 bp, Homo sapiens
tcagcagaaggaccactaggg

SEQ ID NO: 10040189 - DNA, 21 bp, Homo sapiens
tcagcagcttttgcagtccct

SEQ ID NO: 10040190 - DNA, 21 bp, Homo sapiens
tcagcagaaagcaaggtcagt

SEQ ID NO: 10040191 - DNA, 22 bp, Homo sapiens
tcagcctttgaagggctgcagg

SEQ ID NO: 10040192 - DNA, 22 bp, Homo sapiens
tcagccttgtggccctgctcca

SEQ ID NO: 10040193 - DNA, 22 bp, Homo sapiens
tcagcctttatctttctcccat

SEQ ID NO: 10040194 - DNA, 18 bp, Homo sapiens
tcagcctgttgtctgcct

SEQ ID NO: 10040195 - DNA, 20 bp, Homo sapiens
tcagccttctcatcctgggg

SEQ ID NO: 10040196 - DNA, 22 bp, Homo sapiens
tcagccttctgaggacctggga

SEQ ID NO: 10040197 - DNA, 20 bp, Homo sapiens
tcagccttgaatgcttgaaa

SEQ ID NO: 10040198 - DNA, 22 bp, Homo sapiens
tcagccttgcttctggactggt

SEQ ID NO: 10040199 - DNA, 22 bp, Homo sapiens
tcaggaagggctcagtctgtgc

SEQ ID NO: 10040200 - DNA, 22 bp, Homo sapiens
tcaggaaggcacttggtgtgtt

SEQ ID NO: 10040201 - DNA, 22 bp, Homo sapiens
tcaggaagctgctctgggtggt

SEQ ID NO: 10040202 - DNA, 22 bp, Homo sapiens
tcaggaagccggttaaatagat

SEQ ID NO: 10040203 - DNA, 22 bp, Homo sapiens
tcaggaagcatcctgaggtgtc

SEQ ID NO: 10040204 - DNA, 22 bp, Homo sapiens
tcaggcctgcaaatgaatggta

SEQ ID NO: 10040205 - DNA, 22 bp, Homo sapiens
tcaggcctgcaggcttcctgga

SEQ ID NO: 10040206 - DNA, 22 bp, Homo sapiens
tcaggccttcagacctggcccg

SEQ ID NO: 10040207 - DNA, 22 bp, Homo sapiens
tcaggcctggagaaaggaatga

SEQ ID NO: 10040208 - DNA, 22 bp, Homo sapiens
tatttctgtatgcataaaagga

SEQ ID NO: 10040209 - DNA, 22 bp, Homo sapiens
tcacaaagtgaagtgtgtcatg

SEQ ID NO: 10040210 - DNA, 22 bp, Homo sapiens
tcacaaatagctatattaagga

SEQ ID NO: 10040211 - DNA, 22 bp, Homo sapiens
tcacaattcagaaaccaagtag

SEQ ID NO: 10040212 - DNA, 22 bp, Homo sapiens
tcaccaaggcattttcacagca

SEQ ID NO: 10040213 - DNA, 22 bp, Homo sapiens
tcagagccctgctcctccccaa

SEQ ID NO: 10040214 - DNA, 22 bp, Homo sapiens
tccagcagtccatgtgagacac

SEQ ID NO: 10040215 - DNA, 22 bp, Homo sapiens
tccagcttttaccaaatgagca

SEQ ID NO: 10040216 - DNA, 23 bp, Homo sapiens
tccagcagccaagaagggtagaa

SEQ ID NO: 10040217 - DNA, 23 bp, Homo sapiens
tccagcagagccttccaggaggg

SEQ ID NO: 10040218 - DNA, 22 bp, Homo sapiens
tccagcagaccatcaaggctca

SEQ ID NO: 10040219 - DNA, 22 bp, Homo sapiens
tccagagatctctcttccctgt

SEQ ID NO: 10040220 - DNA, 22 bp, Homo sapiens
tcccagggtgcgcctgccctcg

SEQ ID NO: 10040221 - DNA, 22 bp, Homo sapiens
tcccagggttacagccagggca

SEQ ID NO: 10040222 - DNA, 22 bp, Homo sapiens
tcccagggtcctcttctggaat

SEQ ID NO: 10040223 - DNA, 20 bp, Homo sapiens
tccccagggcatcaggagca

SEQ ID NO: 10040224 - DNA, 22 bp, Homo sapiens
tccccagggctgcagagggtgt

SEQ ID NO: 10040225 - DNA, 22 bp, Homo sapiens
tccccaggagttttactttgca

SEQ ID NO: 10040226 - DNA, 22 bp, Homo sapiens
tccccaggagcaatgattcagt

SEQ ID NO: 10040227 - DNA, 22 bp, Homo sapiens
tccccaggggcctgggcacagt

SEQ ID NO: 10040228 - DNA, 22 bp, Homo sapiens
tccccaggggcatctctctgct

SEQ ID NO: 10040229 - DNA, 22 bp, Homo sapiens
tccccaggaatcaggtggttgc

SEQ ID NO: 10040230 - DNA, 22 bp, Homo sapiens
tccccaggactaagttgcaatc

SEQ ID NO: 10040231 - DNA, 22 bp, Homo sapiens
tccccaggaaggcccttcctgg

SEQ ID NO: 10040232 - DNA, 22 bp, Homo sapiens
tccccaggaaattctgattctt

SEQ ID NO: 10040233 - DNA, 19 bp, Homo sapiens
tagaatgcccacttaaaaa

SEQ ID NO: 10040234 - DNA, 22 bp, Homo sapiens
tagacagatgttttctggctgt

SEQ ID NO: 10040235 - DNA, 22 bp, Homo sapiens
tactttggggacaatatggaat

SEQ ID NO: 10040236 - DNA, 22 bp, Homo sapiens
tagaaaagccccagctggaggg

SEQ ID NO: 10040237 - DNA, 22 bp, Homo sapiens
tagaaacattcagttgcagtcc

SEQ ID NO: 10040238 - DNA, 22 bp, Homo sapiens
tagaaacagaatatgagtgaga

SEQ ID NO: 10040239 - DNA, 22 bp, Homo sapiens
tagaaacatataggatggcagg

SEQ ID NO: 10040240 - DNA, 22 bp, Homo sapiens
tagcagaagaaattcagagttg

SEQ ID NO: 10040241 - DNA, 22 bp, Homo sapiens
tagcagaaccagtcagtgagcc

SEQ ID NO: 10040242 - DNA, 22 bp, Homo sapiens
tagcagaagtcaccccgccact

SEQ ID NO: 10040243 - DNA, 22 bp, Homo sapiens
tagctttagtgaaaaatatcag

SEQ ID NO: 10040244 - DNA, 22 bp, Homo sapiens
tagctttggattctttggggaa

SEQ ID NO: 10040245 - DNA, 22 bp, Homo sapiens
tagctttgggaatgctctcctg

SEQ ID NO: 10040246 - DNA, 22 bp, Homo sapiens
tagctttgctggcaagcatgtc

SEQ ID NO: 10040247 - DNA, 22 bp, Homo sapiens
tagctttgcctgttaatcacaa

SEQ ID NO: 10040248 - DNA, 22 bp, Homo sapiens
tagctttgcccgtgctggattt

SEQ ID NO: 10040249 - DNA, 22 bp, Homo sapiens
tagctttgcctgaagtaatcag

SEQ ID NO: 10040250 - DNA, 22 bp, Homo sapiens
tagctttgaacttctgggctca

SEQ ID NO: 10040251 - DNA, 22 bp, Homo sapiens
tagctttgaagttatttaacag

SEQ ID NO: 10040252 - DNA, 22 bp, Homo sapiens
tagctttgacagttgcaggcag

SEQ ID NO: 10040253 - DNA, 22 bp, Homo sapiens
tagctttgccatctgtcacata

SEQ ID NO: 10040254 - DNA, 22 bp, Homo sapiens
tagctttgccacacatgtagat

SEQ ID NO: 10040255 - DNA, 22 bp, Homo sapiens
tagctttgaccaacgactggtc

SEQ ID NO: 10040256 - DNA, 22 bp, Homo sapiens
tagctttgcaaaggaagtttta

SEQ ID NO: 10040257 - DNA, 22 bp, Homo sapiens
tagctttgtttatcaaggggca

SEQ ID NO: 10040258 - DNA, 22 bp, Homo sapiens
tagctttgttagaatgtcttca

SEQ ID NO: 10040259 - DNA, 22 bp, Homo sapiens
tagctttgtgtcctgatttagc

SEQ ID NO: 10040260 - DNA, 16 bp, Homo sapiens
tagctttgtgttgtgg

SEQ ID NO: 10040261 - DNA, 22 bp, Homo sapiens
tagctttgtgtatgatgtctgt

SEQ ID NO: 10040262 - DNA, 22 bp, Homo sapiens
tagctttgtgaagtttacagac

SEQ ID NO: 10040263 - DNA, 22 bp, Homo sapiens
tagctttgtcctccaccctcag

SEQ ID NO: 10040264 - DNA, 22 bp, Homo sapiens
tagctttgtattatcagcattg

SEQ ID NO: 10040265 - DNA, 22 bp, Homo sapiens
tagggaggctacttcttgtagg

SEQ ID NO: 10040266 - DNA, 22 bp, Homo sapiens
tagggaggagggttttcaaatc

SEQ ID NO: 10040267 - DNA, 22 bp, Homo sapiens
taggcactgagtacatattggt

SEQ ID NO: 10040268 - DNA, 22 bp, Homo sapiens
tatccatagtttatagatcaag

SEQ ID NO: 10040269 - DNA, 22 bp, Homo sapiens
tatatatatgcacacacaccta

SEQ ID NO: 10040270 - DNA, 22 bp, Homo sapiens
taggtctctcttcttgatggga

SEQ ID NO: 10040271 - DNA, 22 bp, Homo sapiens
tatgtacagtccttaacttaaa

SEQ ID NO: 10040272 - DNA, 22 bp, Homo sapiens
tatgtgcacattagagagatgg

SEQ ID NO: 10040273 - DNA, 22 bp, Homo sapiens
taaattaaagattggagaagga

SEQ ID NO: 10040274 - DNA, 20 bp, Homo sapiens
taaattagccttgaagatta

SEQ ID NO: 10040275 - DNA, 22 bp, Homo sapiens
taaattagagccaggtaagttt

SEQ ID NO: 10040276 - DNA, 22 bp, Homo sapiens
taaattgcataagtacaaatga

SEQ ID NO: 10040277 - DNA, 22 bp, Homo sapiens
taaattctacaacttcaaagat

SEQ ID NO: 10040278 - DNA, 22 bp, Homo sapiens
taaccatattttccattaagtt

SEQ ID NO: 10040279 - DNA, 22 bp, Homo sapiens
taaccatattcacactatgccc

SEQ ID NO: 10040280 - DNA, 22 bp, Homo sapiens
gttacaaaggaagcttcactgc

SEQ ID NO: 10040281 - DNA, 22 bp, Homo sapiens
gttacaaaggactgggggccac

SEQ ID NO: 10040282 - DNA, 22 bp, Homo sapiens
tacattctcttcccattgtctc

SEQ ID NO: 10040283 - DNA, 22 bp, Homo sapiens
tacattctggaaaggcacagac

SEQ ID NO: 10040284 - DNA, 22 bp, Homo sapiens
tacattctgaaataaatggttt

SEQ ID NO: 10040285 - DNA, 16 bp, Homo sapiens
tacattctgatcactg

SEQ ID NO: 10040286 - DNA, 22 bp, Homo sapiens
tacattctactttttcactccc

SEQ ID NO: 10040287 - DNA, 22 bp, Homo sapiens
tacattctatatctgttacatc

SEQ ID NO: 10040288 - DNA, 22 bp, Homo sapiens
tacattctggtggagaaagtaa

SEQ ID NO: 10040289 - DNA, 22 bp, Homo sapiens
tacattctggtggagaaagtaa

SEQ ID NO: 10040290 - DNA, 23 bp, Homo sapiens
tacattctgtatttttatagagt

SEQ ID NO: 10040291 - DNA, 22 bp, Homo sapiens
tacatctatctagatgctcaga

SEQ ID NO: 10040292 - DNA, 22 bp, Homo sapiens
tacactgaaagagaggattgaa

SEQ ID NO: 10040293 - DNA, 22 bp, Homo sapiens
tacactgaagtgtcttggtata

SEQ ID NO: 10040294 - DNA, 22 bp, Homo sapiens
tacaacagacaggaataagatt
